United States Patent 11,464,842 (COMPOSITIONS AND METHOD FOR OPTIMIZED PEPTIDE VACCINES USING RESIDUE OPTIMIZATION) - sequence listing, part 10

SEQ ID NO: 160034 - protein, 9 aa, Artificial Sequence
  Description of Artificial Sequence: Synthetic peptide
  Seed: VELAGQSLL (PRAME_HUMAN)
VHLAGQSLI

SEQ ID NO: 160035 - protein, 11 aa, Artificial Sequence
  Description of Artificial Sequence: Synthetic peptide
  Seed: KLPTLAKFSPY (PRAME_HUMAN)
KMPTLAKFSPF

SEQ ID NO: 160036 - protein, 9 aa, Artificial Sequence
  Description of Artificial Sequence: Synthetic peptide
  Seed: VLSLSGVML (PRAME_HUMAN)
VLSLSGVMV

SEQ ID NO: 160037 - protein, 10 aa, Artificial Sequence
  Description of Artificial Sequence: Synthetic peptide
  Seed: ALQSLLQHLI (PRAME_HUMAN)
AQQSLLQHLV

SEQ ID NO: 160038 - protein, 9 aa, Artificial Sequence
  Description of Artificial Sequence: Synthetic peptide
  Seed: ISPEKEEQY (PRAME_HUMAN)
ISPEKEEQV

SEQ ID NO: 160039 - protein, 9 aa, Artificial Sequence
  Description of Artificial Sequence: Synthetic peptide
  Seed: TSPRRLVEL (PRAME_HUMAN)
TVPRRLVEV

SEQ ID NO: 160040 - protein, 10 aa, Artificial Sequence
  Description of Artificial Sequence: Synthetic peptide
  Seed: SPYLGQMINL (PRAME_HUMAN)
SGYLGQMINL

SEQ ID NO: 160041 - protein, 10 aa, Artificial Sequence
  Description of Artificial Sequence: Synthetic peptide
  Seed: AALELLPREL (PRAME_HUMAN)
AILELLPREV

SEQ ID NO: 160042 - protein, 10 aa, Artificial Sequence
  Description of Artificial Sequence: Synthetic peptide
  Seed: QAWPFTCLPL (PRAME_HUMAN)
QAWPFTCLPY

SEQ ID NO: 160043 - protein, 9 aa, Artificial Sequence
  Description of Artificial Sequence: Synthetic peptide
  Seed: SALQSLLQH (PRAME_HUMAN)
SQLQSLLQM

SEQ ID NO: 160044 - protein, 10 aa, Artificial Sequence
  Description of Artificial Sequence: Synthetic peptide
  Seed: MERRRLWGSI (PRAME_HUMAN)
MIRRRLWGSV

SEQ ID NO: 160045 - protein, 10 aa, Artificial Sequence
  Description of Artificial Sequence: Synthetic peptide
  Seed: RRRLWGSIQS (PRAME_HUMAN)
RHRLWGSIQR

SEQ ID NO: 160046 - protein, 11 aa, Artificial Sequence
  Description of Artificial Sequence: Synthetic peptide
  Seed: AAFDGRHSQTL (PRAME_HUMAN)
AVFDGRHSQTM

SEQ ID NO: 160047 - protein, 9 aa, Artificial Sequence
  Description of Artificial Sequence: Synthetic peptide
  Seed: SLLQHLIGL (PRAME_HUMAN)
SMLQHLIGI

SEQ ID NO: 160048 - protein, 9 aa, Artificial Sequence
  Description of Artificial Sequence: Synthetic peptide
  Seed: FPEPEAAQP (PRAME_HUMAN)
FAEPEAAQY

SEQ ID NO: 160049 - protein, 9 aa, Artificial Sequence
  Description of Artificial Sequence: Synthetic peptide
  Seed: LLLSHIHAS (PRAME_HUMAN)
LALSHIHAI

SEQ ID NO: 160050 - protein, 10 aa, Artificial Sequence
  Description of Artificial Sequence: Synthetic peptide
  Seed: SGNRASLYSF (PRAME_HUMAN)
SMNRASLYSM

SEQ ID NO: 160051 - protein, 9 aa, Artificial Sequence
  Description of Artificial Sequence: Synthetic peptide
  Seed: DSLFFLRGR (PRAME_HUMAN)
DILFFLRGK

SEQ ID NO: 160052 - protein, 9 aa, Artificial Sequence
  Description of Artificial Sequence: Synthetic peptide
  Seed: LQDLVFDEC (PRAME_HUMAN)
LMDLVFDEV

SEQ ID NO: 160053 - protein, 9 aa, Artificial Sequence
  Description of Artificial Sequence: Synthetic peptide
  Seed: ALAIAALEL (PRAME_HUMAN)
AMAIAALEV

SEQ ID NO: 160054 - protein, 10 aa, Artificial Sequence
  Description of Artificial Sequence: Synthetic peptide
  Seed: KAVLDGLDVL (PRAME_HUMAN)
KQVLDGLDVM

SEQ ID NO: 160055 - protein, 9 aa, Artificial Sequence
  Description of Artificial Sequence: Synthetic peptide
  Seed: MNPLETLSI (PRAME_HUMAN)
MSPLETLSL

SEQ ID NO: 160056 - protein, 10 aa, Artificial Sequence
  Description of Artificial Sequence: Synthetic peptide
  Seed: AAFDGRHSQT (PRAME_HUMAN)
AAFDGRHSQM

SEQ ID NO: 160057 - protein, 10 aa, Artificial Sequence
  Description of Artificial Sequence: Synthetic peptide
  Seed: LYVDSLFFLR (PRAME_HUMAN)
LLVDSLFFLR

SEQ ID NO: 160058 - protein, 9 aa, Artificial Sequence
  Description of Artificial Sequence: Synthetic peptide
  Seed: SRYISMSVW (PRAME_HUMAN)
SNYISMSVY

SEQ ID NO: 160059 - protein, 8 aa, Artificial Sequence
  Description of Artificial Sequence: Synthetic peptide
  Seed: FTSQFLSL (PRAME_HUMAN)
FSSQFLSY

SEQ ID NO: 160060 - protein, 9 aa, Artificial Sequence
  Description of Artificial Sequence: Synthetic peptide
  Seed: ELFSYLIEK (PRAME_HUMAN)
EGFSYLIEK

SEQ ID NO: 160061 - protein, 9 aa, Artificial Sequence
  Description of Artificial Sequence: Synthetic peptide
  Seed: RLRELLCEL (PRAME_HUMAN)
RLRELLCEY

SEQ ID NO: 160062 - protein, 8 aa, Artificial Sequence
  Description of Artificial Sequence: Synthetic peptide
  Seed: HGTLHLER (PRAME_HUMAN)
HTTLHLEL

SEQ ID NO: 160063 - protein, 9 aa, Artificial Sequence
  Description of Artificial Sequence: Synthetic peptide
  Seed: LTDVSPEPL (PRAME_HUMAN)
LIDVSPEPV

SEQ ID NO: 160064 - protein, 10 aa, Artificial Sequence
  Description of Artificial Sequence: Synthetic peptide
  Seed: AAFDGRHSQT (PRAME_HUMAN)
ASFDGRHSQL

SEQ ID NO: 160065 - protein, 9 aa, Artificial Sequence
  Description of Artificial Sequence: Synthetic peptide
  Seed: FYDPEPILC (PRAME_HUMAN)
FIDPEPILY

SEQ ID NO: 160066 - protein, 10 aa, Artificial Sequence
  Description of Artificial Sequence: Synthetic peptide
  Seed: DVSPEPLQAL (PRAME_HUMAN)
DVSPEPLQAK

SEQ ID NO: 160067 - protein, 9 aa, Artificial Sequence
  Description of Artificial Sequence: Synthetic peptide
  Seed: LSVLSLSGV (PRAME_HUMAN)
LVVLSLSGV

SEQ ID NO: 160068 - protein, 10 aa, Artificial Sequence
  Description of Artificial Sequence: Synthetic peptide
  Seed: ALYVDSLFFL (PRAME_HUMAN)
AYYVDSLFFI

SEQ ID NO: 160069 - protein, 9 aa, Artificial Sequence
  Description of Artificial Sequence: Synthetic peptide
  Seed: LLLSHIHAS (PRAME_HUMAN)
LILSHIHAL

SEQ ID NO: 160070 - protein, 11 aa, Artificial Sequence
  Description of Artificial Sequence: Synthetic peptide
  Seed: LPTLAKFSPYL (PRAME_HUMAN)
LQTLAKFSPYL

SEQ ID NO: 160071 - protein, 8 aa, Artificial Sequence
  Description of Artificial Sequence: Synthetic peptide
  Seed: FSYLIEKV (PRAME_HUMAN)
FPYLIEKI

SEQ ID NO: 160072 - protein, 9 aa, Artificial Sequence
  Description of Artificial Sequence: Synthetic peptide
  Seed: SYEDIHGTL (PRAME_HUMAN)
SAEDIHGTL

SEQ ID NO: 160073 - protein, 10 aa, Artificial Sequence
  Description of Artificial Sequence: Synthetic peptide
  Seed: DVSPEPLQAL (PRAME_HUMAN)
DVSPEPLQAW

SEQ ID NO: 160074 - protein, 9 aa, Artificial Sequence
  Description of Artificial Sequence: Synthetic peptide
  Seed: TFYDPEPIL (PRAME_HUMAN)
TIYDPEPIM

SEQ ID NO: 160075 - protein, 9 aa, Artificial Sequence
  Description of Artificial Sequence: Synthetic peptide
  Seed: IPVEVLVDL (PRAME_HUMAN)
IPVEVLVDW

SEQ ID NO: 160076 - protein, 10 aa, Artificial Sequence
  Description of Artificial Sequence: Synthetic peptide
  Seed: ERLAYLHARL (PRAME_HUMAN)
EFLAYLHARI

SEQ ID NO: 160077 - protein, 10 aa, Artificial Sequence
  Description of Artificial Sequence: Synthetic peptide
  Seed: FAMPMQDIKM (PRAME_HUMAN)
FLMPMQDIKI

SEQ ID NO: 160078 - protein, 9 aa, Artificial Sequence
  Description of Artificial Sequence: Synthetic peptide
  Seed: ITDDQLLAL (PRAME_HUMAN)
IFDDQLLAC

SEQ ID NO: 160079 - protein, 10 aa, Artificial Sequence
  Description of Artificial Sequence: Synthetic peptide
  Seed: IGLSNLTHVL (PRAME_HUMAN)
INLSNLTHVV

SEQ ID NO: 160080 - protein, 9 aa, Artificial Sequence
  Description of Artificial Sequence: Synthetic peptide
  Seed: FSYLIEKVK (PRAME_HUMAN)
FTYLIEKVK

SEQ ID NO: 160081 - protein, 9 aa, Artificial Sequence
  Description of Artificial Sequence: Synthetic peptide
  Seed: LQDLVFDEC (PRAME_HUMAN)
LEDLVFDEI

SEQ ID NO: 160082 - protein, 10 aa, Artificial Sequence
  Description of Artificial Sequence: Synthetic peptide
  Seed: AFDGRHSQTL (PRAME_HUMAN)
ASDGRHSQTM

SEQ ID NO: 160083 - protein, 9 aa, Artificial Sequence
  Description of Artificial Sequence: Synthetic peptide
  Seed: LYPVPLESY (PRAME_HUMAN)
LMPVPLESF

SEQ ID NO: 160084 - protein, 8 aa, Artificial Sequence
  Description of Artificial Sequence: Synthetic peptide
  Seed: YVDSLFFL (PRAME_HUMAN)
YQDSLFFI

SEQ ID NO: 160085 - protein, 9 aa, Artificial Sequence
  Description of Artificial Sequence: Synthetic peptide
  Seed: SQLTTLSFY (PRAME_HUMAN)
SALTTLSFM

SEQ ID NO: 160086 - protein, 9 aa, Artificial Sequence
  Description of Artificial Sequence: Synthetic peptide
  Seed: RLAYLHARL (PRAME_HUMAN)
RNAYLHARY

SEQ ID NO: 160087 - protein, 9 aa, Artificial Sequence
  Description of Artificial Sequence: Synthetic peptide
  Seed: ISPEKEEQY (PRAME_HUMAN)
IVPEKEEQL

SEQ ID NO: 160088 - protein, 9 aa, Artificial Sequence
  Description of Artificial Sequence: Synthetic peptide
  Seed: DEALAIAAL (PRAME_HUMAN)
DRALAIAAA

SEQ ID NO: 160089 - protein, 10 aa, Artificial Sequence
  Description of Artificial Sequence: Synthetic peptide
  Seed: ASATLQDLVF (PRAME_HUMAN)
ATATLQDLVW

SEQ ID NO: 160090 - protein, 9 aa, Artificial Sequence
  Description of Artificial Sequence: Synthetic peptide
  Seed: FLSLQCLQA (PRAME_HUMAN)
FASLQCLQV

SEQ ID NO: 160091 - protein, 11 aa, Artificial Sequence
  Description of Artificial Sequence: Synthetic peptide
  Seed: IGLSNLTHVLY (PRAME_HUMAN)
ITLSNLTHVLF

SEQ ID NO: 160092 - protein, 10 aa, Artificial Sequence
  Description of Artificial Sequence: Synthetic peptide
  Seed: FIPVEVLVDL (PRAME_HUMAN)
FKPVEVLVDW

SEQ ID NO: 160093 - protein, 8 aa, Artificial Sequence
  Description of Artificial Sequence: Synthetic peptide
  Seed: FYGNSISI (PRAME_HUMAN)
FFGNSISM

SEQ ID NO: 160094 - protein, 9 aa, Artificial Sequence
  Description of Artificial Sequence: Synthetic peptide
  Seed: MERRRLWGS (PRAME_HUMAN)
MERRRLWGL

SEQ ID NO: 160095 - protein, 10 aa, Artificial Sequence
  Description of Artificial Sequence: Synthetic peptide
  Seed: RASATLQDLV (PRAME_HUMAN)
RISATLQDLW

SEQ ID NO: 160096 - protein, 9 aa, Artificial Sequence
  Description of Artificial Sequence: Synthetic peptide
  Seed: RGRLDQLLR (PRAME_HUMAN)
RTRLDQLLK

SEQ ID NO: 160097 - protein, 8 aa, Artificial Sequence
  Description of Artificial Sequence: Synthetic peptide
  Seed: SQFLSLQC (PRAME_HUMAN)
SQFLSLQL

SEQ ID NO: 160098 - protein, 9 aa, Artificial Sequence
  Description of Artificial Sequence: Synthetic peptide
  Seed: VSPEPLQAL (PRAME_HUMAN)
VQPEPLQAI

SEQ ID NO: 160099 - protein, 9 aa, Artificial Sequence
  Description of Artificial Sequence: Synthetic peptide
  Seed: QLLALLPSL (PRAME_HUMAN)
QMLALLPSK

SEQ ID NO: 160100 - protein, 10 aa, Artificial Sequence
  Description of Artificial Sequence: Synthetic peptide
  Seed: SLLKDEALAI (PRAME_HUMAN)
SGLKDEALAV

SEQ ID NO: 160101 - protein, 9 aa, Artificial Sequence
  Description of Artificial Sequence: Synthetic peptide
  Seed: SISALQSLL (PRAME_HUMAN)
SISALQSLF

SEQ ID NO: 160102 - protein, 9 aa, Artificial Sequence
  Description of Artificial Sequence: Synthetic peptide
  Seed: SYEDIHGTL (PRAME_HUMAN)
SQEDIHGTL

SEQ ID NO: 160103 - protein, 9 aa, Artificial Sequence
  Description of Artificial Sequence: Synthetic peptide
  Seed: LSHIHASSY (PRAME_HUMAN)
LAHIHASSM

SEQ ID NO: 160104 - protein, 8 aa, Artificial Sequence
  Description of Artificial Sequence: Synthetic peptide
  Seed: LFPPLFMA (PRAME_HUMAN)
LYPPLFMV

SEQ ID NO: 160105 - protein, 9 aa, Artificial Sequence
  Description of Artificial Sequence: Synthetic peptide
  Seed: DSLFFLRGR (PRAME_HUMAN)
DYLFFLRGK

SEQ ID NO: 160106 - protein, 9 aa, Artificial Sequence
  Description of Artificial Sequence: Synthetic peptide
  Seed: ITDDQLLAL (PRAME_HUMAN)
ITDDQLLAF

SEQ ID NO: 160107 - protein, 9 aa, Artificial Sequence
  Description of Artificial Sequence: Synthetic peptide
  Seed: LFPPLFMAA (PRAME_HUMAN)
LWPPLFMAF

SEQ ID NO: 160108 - protein, 9 aa, Artificial Sequence
  Description of Artificial Sequence: Synthetic peptide
  Seed: RRLWGSIQS (PRAME_HUMAN)
RRLWGSIQR

SEQ ID NO: 160109 - protein, 10 aa, Artificial Sequence
  Description of Artificial Sequence: Synthetic peptide
  Seed: VMNPLETLSI (PRAME_HUMAN)
VINPLETLSY

SEQ ID NO: 160110 - protein, 10 aa, Artificial Sequence
  Description of Artificial Sequence: Synthetic peptide
  Seed: SQLTTLSFYG (PRAME_HUMAN)
SLLTTLSFYY

SEQ ID NO: 160111 - protein, 10 aa, Artificial Sequence
  Description of Artificial Sequence: Synthetic peptide
  Seed: TSQFLSLQCL (PRAME_HUMAN)
TIQFLSLQCF

SEQ ID NO: 160112 - protein, 9 aa, Artificial Sequence
  Description of Artificial Sequence: Synthetic peptide
  Seed: LQALYVDSL (PRAME_HUMAN)
LHALYVDSF

SEQ ID NO: 160113 - protein, 9 aa, Artificial Sequence
  Description of Artificial Sequence: Synthetic peptide
  Seed: LTDVSPEPL (PRAME_HUMAN)
LVDVSPEPV

SEQ ID NO: 160114 - protein, 9 aa, Artificial Sequence
  Description of Artificial Sequence: Synthetic peptide
  Seed: LLSHIHASS (PRAME_HUMAN)
LLSHIHASV

SEQ ID NO: 160115 - protein, 10 aa, Artificial Sequence
  Description of Artificial Sequence: Synthetic peptide
  Seed: FIPVEVLVDL (PRAME_HUMAN)
FLPVEVLVDW

SEQ ID NO: 160116 - protein, 11 aa, Artificial Sequence
  Description of Artificial Sequence: Synthetic peptide
  Seed: ESYEDIHGTLH (PRAME_HUMAN)
EVYEDIHGTLK

SEQ ID NO: 160117 - protein, 10 aa, Artificial Sequence
  Description of Artificial Sequence: Synthetic peptide
  Seed: QYIAQFTSQF (PRAME_HUMAN)
QYIAQFTSQI

SEQ ID NO: 160118 - protein, 9 aa, Artificial Sequence
  Description of Artificial Sequence: Synthetic peptide
  Seed: YPVPLESYE (PRAME_HUMAN)
YPVPLESYI

SEQ ID NO: 160119 - protein, 10 aa, Artificial Sequence
  Description of Artificial Sequence: Synthetic peptide
  Seed: GITDDQLLAL (PRAME_HUMAN)
GVTDDQLLAV

SEQ ID NO: 160120 - protein, 9 aa, Artificial Sequence
  Description of Artificial Sequence: Synthetic peptide
  Seed: AAQPMTKKR (PRAME_HUMAN)
AIQPMTKKR

SEQ ID NO: 160121 - protein, 10 aa, Artificial Sequence
  Description of Artificial Sequence: Synthetic peptide
  Seed: RLSEGDVMHL (PRAME_HUMAN)
RVSEGDVMHL

SEQ ID NO: 160122 - protein, 9 aa, Artificial Sequence
  Description of Artificial Sequence: Synthetic peptide
  Seed: KLKIFAMPM (PRAME_HUMAN)
KTKIFAMPV

SEQ ID NO: 160123 - protein, 9 aa, Artificial Sequence
  Description of Artificial Sequence: Synthetic peptide
  Seed: NSHQDFWTV (PRAME_HUMAN)
NSHQDFWTF

SEQ ID NO: 160124 - protein, 9 aa, Artificial Sequence
  Description of Artificial Sequence: Synthetic peptide
  Seed: AQFTSQFLS (PRAME_HUMAN)
AQFTSQFLV

SEQ ID NO: 160125 - protein, 9 aa, Artificial Sequence
  Description of Artificial Sequence: Synthetic peptide
  Seed: SHIHASSYI (PRAME_HUMAN)
SQIHASSYF

SEQ ID NO: 160126 - protein, 9 aa, Artificial Sequence
  Description of Artificial Sequence: Synthetic peptide
  Seed: ALQSLLQHL (PRAME_HUMAN)
ARQSLLQHI

SEQ ID NO: 160127 - protein, 9 aa, Artificial Sequence
  Description of Artificial Sequence: Synthetic peptide
  Seed: RWKLQVLDL (PRAME_HUMAN)
RSKLQVLDL

SEQ ID NO: 160128 - protein, 9 aa, Artificial Sequence
  Description of Artificial Sequence: Synthetic peptide
  Seed: SFYGNSISI (PRAME_HUMAN)
SLYGNSISA

SEQ ID NO: 160129 - protein, 9 aa, Artificial Sequence
  Description of Artificial Sequence: Synthetic peptide
  Seed: YIAQFTSQF (PRAME_HUMAN)
YRAQFTSQL

SEQ ID NO: 160130 - protein, 10 aa, Artificial Sequence
  Description of Artificial Sequence: Synthetic peptide
  Seed: RRLWGSIQSR (PRAME_HUMAN)
RCLWGSIQSK

SEQ ID NO: 160131 - protein, 8 aa, Artificial Sequence
  Description of Artificial Sequence: Synthetic peptide
  Seed: LAYLHARL (PRAME_HUMAN)
LQYLHARI

SEQ ID NO: 160132 - protein, 9 aa, Artificial Sequence
  Description of Artificial Sequence: Synthetic peptide
  Seed: KVDGLSTEA (PRAME_HUMAN)
KTDGLSTEV

SEQ ID NO: 160133 - protein, 9 aa, Artificial Sequence
  Description of Artificial Sequence: Synthetic peptide
  Seed: QSRYISMSV (PRAME_HUMAN)
QSRYISMSM

SEQ ID NO: 160134 - protein, 9 aa, Artificial Sequence
  Description of Artificial Sequence: Synthetic peptide
  Seed: YIAQFTSQF (PRAME_HUMAN)
YMAQFTSQA

SEQ ID NO: 160135 - protein, 10 aa, Artificial Sequence
  Description of Artificial Sequence: Synthetic peptide
  Seed: RELFPPLFMA (PRAME_HUMAN)
RALFPPLFMM

SEQ ID NO: 160136 - protein, 9 aa, Artificial Sequence
  Description of Artificial Sequence: Synthetic peptide
  Seed: SISALQSLL (PRAME_HUMAN)
SQSALQSLV

SEQ ID NO: 160137 - protein, 10 aa, Artificial Sequence
  Description of Artificial Sequence: Synthetic peptide
  Seed: TTLSFYGNSI (PRAME_HUMAN)
TELSFYGNSV

SEQ ID NO: 160138 - protein, 9 aa, Artificial Sequence
  Description of Artificial Sequence: Synthetic peptide
  Seed: WKLPTLAKF (PRAME_HUMAN)
WQLPTLAKY

SEQ ID NO: 160139 - protein, 10 aa, Artificial Sequence
  Description of Artificial Sequence: Synthetic peptide
  Seed: LQALYVDSLF (PRAME_HUMAN)
LHALYVDSLW

SEQ ID NO: 160140 - protein, 9 aa, Artificial Sequence
  Description of Artificial Sequence: Synthetic peptide
  Seed: ISPEKEEQY (PRAME_HUMAN)
IMPEKEEQY

SEQ ID NO: 160141 - protein, 10 aa, Artificial Sequence
  Description of Artificial Sequence: Synthetic peptide
  Seed: LKAMVQAWPF (PRAME_HUMAN)
LMAMVQAWPF

SEQ ID NO: 160142 - protein, 9 aa, Artificial Sequence
  Description of Artificial Sequence: Synthetic peptide
  Seed: NSISISALQ (PRAME_HUMAN)
NTISISALK

SEQ ID NO: 160143 - protein, 10 aa, Artificial Sequence
  Description of Artificial Sequence: Synthetic peptide
  Seed: RELFPPLFMA (PRAME_HUMAN)
RSLFPPLFMI

SEQ ID NO: 160144 - protein, 11 aa, Artificial Sequence
  Description of Artificial Sequence: Synthetic peptide
  Seed: YLGQMINLRRL (PRAME_HUMAN)
YMGQMINLRRV

SEQ ID NO: 160145 - protein, 8 aa, Artificial Sequence
  Description of Artificial Sequence: Synthetic peptide
  Seed: YSFPEPEA (PRAME_HUMAN)
YSFPEPEL

SEQ ID NO: 160146 - protein, 10 aa, Artificial Sequence
  Description of Artificial Sequence: Synthetic peptide
  Seed: IKMILKMVQL (PRAME_HUMAN)
IQMILKMVQV

SEQ ID NO: 160147 - protein, 11 aa, Artificial Sequence
  Description of Artificial Sequence: Synthetic peptide
  Seed: KAVLDGLDVLL (PRAME_HUMAN)
KQVLDGLDVLW

SEQ ID NO: 160148 - protein, 9 aa, Artificial Sequence
  Description of Artificial Sequence: Synthetic peptide
  Seed: ALLPSLSHC (PRAME_HUMAN)
ATLPSLSHV

SEQ ID NO: 160149 - protein, 9 aa, Artificial Sequence
  Description of Artificial Sequence: Synthetic peptide
  Seed: GQHLHLETF (PRAME_HUMAN)
GIHLHLETY

SEQ ID NO: 160150 - protein, 11 aa, Artificial Sequence
  Description of Artificial Sequence: Synthetic peptide
  Seed: IQSRYISMSVW (PRAME_HUMAN)
IMSRYISMSVY

SEQ ID NO: 160151 - protein, 9 aa, Artificial Sequence
  Description of Artificial Sequence: Synthetic peptide
  Seed: KLKIFAMPM (PRAME_HUMAN)
KFKIFAMPI

SEQ ID NO: 160152 - protein, 9 aa, Artificial Sequence
  Description of Artificial Sequence: Synthetic peptide
  Seed: SVWTSPRRL (PRAME_HUMAN)
SQWTSPRRI

SEQ ID NO: 160153 - protein, 10 aa, Artificial Sequence
  Description of Artificial Sequence: Synthetic peptide
  Seed: VELAGQSLLK (PRAME_HUMAN)
VILAGQSLLK

SEQ ID NO: 160154 - protein, 8 aa, Artificial Sequence
  Description of Artificial Sequence: Synthetic peptide
  Seed: YVDSLFFL (PRAME_HUMAN)
YLDSLFFA

SEQ ID NO: 160155 - protein, 9 aa, Artificial Sequence
  Description of Artificial Sequence: Synthetic peptide
  Seed: GACDELFSY (PRAME_HUMAN)
GACDELFSL

SEQ ID NO: 160156 - protein, 8 aa, Artificial Sequence
  Description of Artificial Sequence: Synthetic peptide
  Seed: TDDQLLAL (PRAME_HUMAN)
TLDQLLAL

SEQ ID NO: 160157 - protein, 8 aa, Artificial Sequence
  Description of Artificial Sequence: Synthetic peptide
  Seed: VMNPLETL (PRAME_HUMAN)
VANPLETM

SEQ ID NO: 160158 - protein, 10 aa, Artificial Sequence
  Description of Artificial Sequence: Synthetic peptide
  Seed: RYISMSVWTS (PRAME_HUMAN)
RMISMSVWTW

SEQ ID NO: 160159 - protein, 10 aa, Artificial Sequence
  Description of Artificial Sequence: Synthetic peptide
  Seed: DQLLALLPSL (PRAME_HUMAN)
DLLLALLPSI

SEQ ID NO: 160160 - protein, 10 aa, Artificial Sequence
  Description of Artificial Sequence: Synthetic peptide
  Seed: LERLAYLHAR (PRAME_HUMAN)
LGRLAYLHAK

SEQ ID NO: 160161 - protein, 9 aa, Artificial Sequence
  Description of Artificial Sequence: Synthetic peptide
  Seed: HVMNPLETL (PRAME_HUMAN)
HMMNPLETA

SEQ ID NO: 160162 - protein, 9 aa, Artificial Sequence
  Description of Artificial Sequence: Synthetic peptide
  Seed: RWKLQVLDL (PRAME_HUMAN)
RVKLQVLDA

SEQ ID NO: 160163 - protein, 9 aa, Artificial Sequence
  Description of Artificial Sequence: Synthetic peptide
  Seed: DVLLAQEVR (PRAME_HUMAN)
DTLLAQEVK

SEQ ID NO: 160164 - protein, 10 aa, Artificial Sequence
  Description of Artificial Sequence: Synthetic peptide
  Seed: RGRLDQLLRH (PRAME_HUMAN)
RDRLDQLLRI

SEQ ID NO: 160165 - protein, 10 aa, Artificial Sequence
  Description of Artificial Sequence: Synthetic peptide
  Seed: QALYVDSLFF (PRAME_HUMAN)
QSLYVDSLFM

SEQ ID NO: 160166 - protein, 9 aa, Artificial Sequence
  Description of Artificial Sequence: Synthetic peptide
  Seed: SQSPSVSQL (PRAME_HUMAN)
STSPSVSQF

SEQ ID NO: 160167 - protein, 9 aa, Artificial Sequence
  Description of Artificial Sequence: Synthetic peptide
  Seed: TDDQLLALL (PRAME_HUMAN)
TNDQLLALL

SEQ ID NO: 160168 - protein, 10 aa, Artificial Sequence
  Description of Artificial Sequence: Synthetic peptide
  Seed: FYDPEPILCP (PRAME_HUMAN)
FWDPEPILCL

SEQ ID NO: 160169 - protein, 11 aa, Artificial Sequence
  Description of Artificial Sequence: Synthetic peptide
  Seed: RASATLQDLVF (PRAME_HUMAN)
RLSATLQDLVF

SEQ ID NO: 160170 - protein, 10 aa, Artificial Sequence
  Description of Artificial Sequence: Synthetic peptide
  Seed: SPYLGQMINL (PRAME_HUMAN)
SQYLGQMINL

SEQ ID NO: 160171 - protein, 9 aa, Artificial Sequence
  Description of Artificial Sequence: Synthetic peptide
  Seed: GLSNLTHVL (PRAME_HUMAN)
GASNLTHVM

SEQ ID NO: 160172 - protein, 9 aa, Artificial Sequence
  Description of Artificial Sequence: Synthetic peptide
  Seed: VSPEPLQAL (PRAME_HUMAN)
VMPEPLQAR

SEQ ID NO: 160173 - protein, 11 aa, Artificial Sequence
  Description of Artificial Sequence: Synthetic peptide
  Seed: FLSLQCLQALY (PRAME_HUMAN)
FASLQCLQALL

SEQ ID NO: 160174 - protein, 10 aa, Artificial Sequence
  Description of Artificial Sequence: Synthetic peptide
  Seed: QLLRHVMNPL (PRAME_HUMAN)
QFLRHVMNPA

SEQ ID NO: 160175 - protein, 9 aa, Artificial Sequence
  Description of Artificial Sequence: Synthetic peptide
  Seed: LYVDSLFFL (PRAME_HUMAN)
LVVDSLFFI

SEQ ID NO: 160176 - protein, 8 aa, Artificial Sequence
  Description of Artificial Sequence: Synthetic peptide
  Seed: MINLRRLL (PRAME_HUMAN)
MLNLRRLM

SEQ ID NO: 160177 - protein, 9 aa, Artificial Sequence
  Description of Artificial Sequence: Synthetic peptide
  Seed: VLDGLDVLL (PRAME_HUMAN)
VSDGLDVLW

SEQ ID NO: 160178 - protein, 9 aa, Artificial Sequence
  Description of Artificial Sequence: Synthetic peptide
  Seed: VLDGLDVLL (PRAME_HUMAN)
VMDGLDVLI

SEQ ID NO: 160179 - protein, 10 aa, Artificial Sequence
  Description of Artificial Sequence: Synthetic peptide
  Seed: LLLSHIHASS (PRAME_HUMAN)
LILSHIHASA

SEQ ID NO: 160180 - protein, 9 aa, Artificial Sequence
  Description of Artificial Sequence: Synthetic peptide
  Seed: ACDELFSYL (PRAME_HUMAN)
AADELFSYW

SEQ ID NO: 160181 - protein, 11 aa, Artificial Sequence
  Description of Artificial Sequence: Synthetic peptide
  Seed: AEQPFIPVEVL (PRAME_HUMAN)
AEQPFIPVEVC

SEQ ID NO: 160182 - protein, 9 aa, Artificial Sequence
  Description of Artificial Sequence: Synthetic peptide
  Seed: SQSPSVSQL (PRAME_HUMAN)
SRSPSVSQL

SEQ ID NO: 160183 - protein, 9 aa, Artificial Sequence
  Description of Artificial Sequence: Synthetic peptide
  Seed: SFYGNSISI (PRAME_HUMAN)
SRYGNSISF

SEQ ID NO: 160184 - protein, 9 aa, Artificial Sequence
  Description of Artificial Sequence: Synthetic peptide
  Seed: YSFPEPEAA (PRAME_HUMAN)
YIFPEPEAM

SEQ ID NO: 160185 - protein, 9 aa, Artificial Sequence
  Description of Artificial Sequence: Synthetic peptide
  Seed: VQAWPFTCL (PRAME_HUMAN)
VAAWPFTCM

SEQ ID NO: 160186 - protein, 8 aa, Artificial Sequence
  Description of Artificial Sequence: Synthetic peptide
  Seed: FYDPEPIL (PRAME_HUMAN)
FGDPEPIF

SEQ ID NO: 160187 - protein, 10 aa, Artificial Sequence
  Description of Artificial Sequence: Synthetic peptide
  Seed: YEDIHGTLHL (PRAME_HUMAN)
YSDIHGTLHL

SEQ ID NO: 160188 - protein, 9 aa, Artificial Sequence
  Description of Artificial Sequence: Synthetic peptide
  Seed: HVMNPLETL (PRAME_HUMAN)
HVMNPLETK

SEQ ID NO: 160189 - protein, 11 aa, Artificial Sequence
  Description of Artificial Sequence: Synthetic peptide
  Seed: LPTLAKFSPYL (PRAME_HUMAN)
LKTLAKFSPYL

SEQ ID NO: 160190 - protein, 9 aa, Artificial Sequence
  Description of Artificial Sequence: Synthetic peptide
  Seed: LLKDEALAI (PRAME_HUMAN)
LAKDEALAF

SEQ ID NO: 160191 - protein, 9 aa, Artificial Sequence
  Description of Artificial Sequence: Synthetic peptide
  Seed: NLTHVLYPV (PRAME_HUMAN)
NATHVLYPV

SEQ ID NO: 160192 - protein, 10 aa, Artificial Sequence
  Description of Artificial Sequence: Synthetic peptide
  Seed: FLKEGACDEL (PRAME_HUMAN)
FQKEGACDEY

SEQ ID NO: 160193 - protein, 9 aa, Artificial Sequence
  Description of Artificial Sequence: Synthetic peptide
  Seed: RELFPPLFM (PRAME_HUMAN)
RKLFPPLFY

SEQ ID NO: 160194 - protein, 9 aa, Artificial Sequence
  Description of Artificial Sequence: Synthetic peptide
  Seed: LMKGQHLHL (PRAME_HUMAN)
LYKGQHLHY

SEQ ID NO: 160195 - protein, 9 aa, Artificial Sequence
  Description of Artificial Sequence: Synthetic peptide
  Seed: FYDPEPILC (PRAME_HUMAN)
FYDPEPILM

SEQ ID NO: 160196 - protein, 10 aa, Artificial Sequence
  Description of Artificial Sequence: Synthetic peptide
  Seed: GACDELFSYL (PRAME_HUMAN)
GICDELFSYM

SEQ ID NO: 160197 - protein, 9 aa, Artificial Sequence
  Description of Artificial Sequence: Synthetic peptide
  Seed: MHLSQSPSV (PRAME_HUMAN)
MKLSQSPSI

SEQ ID NO: 160198 - protein, 9 aa, Artificial Sequence
  Description of Artificial Sequence: Synthetic peptide
  Seed: SFPEPEAAQ (PRAME_HUMAN)
SWPEPEAAF

SEQ ID NO: 160199 - protein, 10 aa, Artificial Sequence
  Description of Artificial Sequence: Synthetic peptide
  Seed: YSFPEPEAAQ (PRAME_HUMAN)
YSFPEPEAAF

SEQ ID NO: 160200 - protein, 10 aa, Artificial Sequence
  Description of Artificial Sequence: Synthetic peptide
  Seed: YIAQFTSQFL (PRAME_HUMAN)
YLAQFTSQFF

SEQ ID NO: 160201 - protein, 9 aa, Artificial Sequence
  Description of Artificial Sequence: Synthetic peptide
  Seed: QTLKAMVQA (PRAME_HUMAN)
QQLKAMVQV

SEQ ID NO: 160202 - protein, 9 aa, Artificial Sequence
  Description of Artificial Sequence: Synthetic peptide
  Seed: LSVLSLSGV (PRAME_HUMAN)
LMVLSLSGV

SEQ ID NO: 160203 - protein, 10 aa, Artificial Sequence
  Description of Artificial Sequence: Synthetic peptide
  Seed: RHVMNPLETL (PRAME_HUMAN)
RMVMNPLETY

SEQ ID NO: 160204 - protein, 10 aa, Artificial Sequence
  Description of Artificial Sequence: Synthetic peptide
  Seed: RRRLWGSIQS (PRAME_HUMAN)
RVRLWGSIQR

SEQ ID NO: 160205 - protein, 9 aa, Artificial Sequence
  Description of Artificial Sequence: Synthetic peptide
  Seed: GACDELFSY (PRAME_HUMAN)
GTCDELFSR

SEQ ID NO: 160206 - protein, 8 aa, Artificial Sequence
  Description of Artificial Sequence: Synthetic peptide
  Seed: FSYLIEKV (PRAME_HUMAN)
FEYLIEKI

SEQ ID NO: 160207 - protein, 10 aa, Artificial Sequence
  Description of Artificial Sequence: Synthetic peptide
  Seed: IQSRYISMSV (PRAME_HUMAN)
ICSRYISMSK

SEQ ID NO: 160208 - protein, 10 aa, Artificial Sequence
  Description of Artificial Sequence: Synthetic peptide
  Seed: SMSVWTSPRR (PRAME_HUMAN)
SISVWTSPRK

SEQ ID NO: 160209 - protein, 10 aa, Artificial Sequence
  Description of Artificial Sequence: Synthetic peptide
  Seed: ISISALQSLL (PRAME_HUMAN)
ILISALQSLA

SEQ ID NO: 160210 - protein, 8 aa, Artificial Sequence
  Description of Artificial Sequence: Synthetic peptide
  Seed: LHLERLAY (PRAME_HUMAN)
LQLERLAM

SEQ ID NO: 160211 - protein, 10 aa, Artificial Sequence
  Description of Artificial Sequence: Synthetic peptide
  Seed: HASSYISPEK (PRAME_HUMAN)
HASSYISPER

SEQ ID NO: 160212 - protein, 9 aa, Artificial Sequence
  Description of Artificial Sequence: Synthetic peptide
  Seed: RLWGSIQSR (PRAME_HUMAN)
RQWGSIQSV

SEQ ID NO: 160213 - protein, 10 aa, Artificial Sequence
  Description of Artificial Sequence: Synthetic peptide
  Seed: YEDIHGTLHL (PRAME_HUMAN)
YADIHGTLHI

SEQ ID NO: 160214 - protein, 9 aa, Artificial Sequence
  Description of Artificial Sequence: Synthetic peptide
  Seed: ALLERASAT (PRAME_HUMAN)
AVLERASAI

SEQ ID NO: 160215 - protein, 9 aa, Artificial Sequence
  Description of Artificial Sequence: Synthetic peptide
  Seed: LYVDSLFFL (PRAME_HUMAN)
LIVDSLFFL

SEQ ID NO: 160216 - protein, 10 aa, Artificial Sequence
  Description of Artificial Sequence: Synthetic peptide
  Seed: RHVMNPLETL (PRAME_HUMAN)
RMVMNPLETA

SEQ ID NO: 160217 - protein, 9 aa, Artificial Sequence
  Description of Artificial Sequence: Synthetic peptide
  Seed: SATLQDLVF (PRAME_HUMAN)
SQTLQDLVY

SEQ ID NO: 160218 - protein, 9 aa, Artificial Sequence
  Description of Artificial Sequence: Synthetic peptide
  Seed: KLKIFAMPM (PRAME_HUMAN)
KWKIFAMPV

SEQ ID NO: 160219 - protein, 10 aa, Artificial Sequence
  Description of Artificial Sequence: Synthetic peptide
  Seed: TVWSGNRASL (PRAME_HUMAN)
TAWSGNRASF

SEQ ID NO: 160220 - protein, 9 aa, Artificial Sequence
  Description of Artificial Sequence: Synthetic peptide
  Seed: WLSANPCPH (PRAME_HUMAN)
WMSANPCPF

SEQ ID NO: 160221 - protein, 10 aa, Artificial Sequence
  Description of Artificial Sequence: Synthetic peptide
  Seed: RGRLDQLLRH (PRAME_HUMAN)
RVRLDQLLRM

SEQ ID NO: 160222 - protein, 9 aa, Artificial Sequence
  Description of Artificial Sequence: Synthetic peptide
  Seed: YVDSLFFLR (PRAME_HUMAN)
YTDSLFFLM

SEQ ID NO: 160223 - protein, 10 aa, Artificial Sequence
  Description of Artificial Sequence: Synthetic peptide
  Seed: LSQSPSVSQL (PRAME_HUMAN)
LWQSPSVSQY

SEQ ID NO: 160224 - protein, 9 aa, Artificial Sequence
  Description of Artificial Sequence: Synthetic peptide
  Seed: ESYEDIHGT (PRAME_HUMAN)
EVYEDIHGM

SEQ ID NO: 160225 - protein, 9 aa, Artificial Sequence
  Description of Artificial Sequence: Synthetic peptide
  Seed: HVMNPLETL (PRAME_HUMAN)
HTMNPLETW

SEQ ID NO: 160226 - protein, 10 aa, Artificial Sequence
  Description of Artificial Sequence: Synthetic peptide
  Seed: ISISALQSLL (PRAME_HUMAN)
IIISALQSLW

SEQ ID NO: 160227 - protein, 10 aa, Artificial Sequence
  Description of Artificial Sequence: Synthetic peptide
  Seed: FIPVEVLVDL (PRAME_HUMAN)
FRPVEVLVDM

SEQ ID NO: 160228 - protein, 10 aa, Artificial Sequence
  Description of Artificial Sequence: Synthetic peptide
  Seed: IGLSNLTHVL (PRAME_HUMAN)
IGLSNLTHVI

SEQ ID NO: 160229 - protein, 10 aa, Artificial Sequence
  Description of Artificial Sequence: Synthetic peptide
  Seed: MVQAWPFTCL (PRAME_HUMAN)
MKQAWPFTCY

SEQ ID NO: 160230 - protein, 9 aa, Artificial Sequence
  Description of Artificial Sequence: Synthetic peptide
  Seed: SQLSVLSLS (PRAME_HUMAN)
SQLSVLSLA

SEQ ID NO: 160231 - protein, 9 aa, Artificial Sequence
  Description of Artificial Sequence: Synthetic peptide
  Seed: LSEGDVMHL (PRAME_HUMAN)
LFEGDVMHI

SEQ ID NO: 160232 - protein, 11 aa, Artificial Sequence
  Description of Artificial Sequence: Synthetic peptide
  Seed: LTDVSPEPLQA (PRAME_HUMAN)
LLDVSPEPLQM

SEQ ID NO: 160233 - protein, 9 aa, Artificial Sequence
  Description of Artificial Sequence: Synthetic peptide
  Seed: VFDECGITD (PRAME_HUMAN)
VTDECGITM

SEQ ID NO: 160234 - protein, 9 aa, Artificial Sequence
  Description of Artificial Sequence: Synthetic peptide
  Seed: LQALYVDSL (PRAME_HUMAN)
LEALYVDSL

SEQ ID NO: 160235 - protein, 10 aa, Artificial Sequence
  Description of Artificial Sequence: Synthetic peptide
  Seed: RGRLDQLLRH (PRAME_HUMAN)
RKRLDQLLRR

SEQ ID NO: 160236 - protein, 9 aa, Artificial Sequence
  Description of Artificial Sequence: Synthetic peptide
  Seed: SYEDIHGTL (PRAME_HUMAN)
SWEDIHGTF

SEQ ID NO: 160237 - protein, 9 aa, Artificial Sequence
  Description of Artificial Sequence: Synthetic peptide
  Seed: QLLALLPSL (PRAME_HUMAN)
QTLALLPSF

SEQ ID NO: 160238 - protein, 9 aa, Artificial Sequence
  Description of Artificial Sequence: Synthetic peptide
  Seed: SQFLSLQCL (PRAME_HUMAN)
SEFLSLQCF

SEQ ID NO: 160239 - protein, 9 aa, Artificial Sequence
  Description of Artificial Sequence: Synthetic peptide
  Seed: FLRGRLDQL (PRAME_HUMAN)
FTRGRLDQL

SEQ ID NO: 160240 - protein, 9 aa, Artificial Sequence
  Description of Artificial Sequence: Synthetic peptide
  Seed: SFYGNSISI (PRAME_HUMAN)
SVYGNSISF

SEQ ID NO: 160241 - protein, 9 aa, Artificial Sequence
  Description of Artificial Sequence: Synthetic peptide
  Seed: SQSPSVSQL (PRAME_HUMAN)
SHSPSVSQY

SEQ ID NO: 160242 - protein, 9 aa, Artificial Sequence
  Description of Artificial Sequence: Synthetic peptide
  Seed: MNPLETLSI (PRAME_HUMAN)
MAPLETLSV

SEQ ID NO: 160243 - protein, 9 aa, Artificial Sequence
  Description of Artificial Sequence: Synthetic peptide
  Seed: NLTHVLYPV (PRAME_HUMAN)
NMTHVLYPL

SEQ ID NO: 160244 - protein, 9 aa, Artificial Sequence
  Description of Artificial Sequence: Synthetic peptide
  Seed: YPVPLESYE (PRAME_HUMAN)
YVVPLESYF

SEQ ID NO: 160245 - protein, 8 aa, Artificial Sequence
  Description of Artificial Sequence: Synthetic peptide
  Seed: SQLSVLSL (PRAME_HUMAN)
SHLSVLSA

SEQ ID NO: 160246 - protein, 10 aa, Artificial Sequence
  Description of Artificial Sequence: Synthetic peptide
  Seed: FIPVEVLVDL (PRAME_HUMAN)
FEPVEVLVDF

SEQ ID NO: 160247 - protein, 10 aa, Artificial Sequence
  Description of Artificial Sequence: Synthetic peptide
  Seed: MLTDVSPEPL (PRAME_HUMAN)
MITDVSPEPI

SEQ ID NO: 160248 - protein, 10 aa, Artificial Sequence
  Description of Artificial Sequence: Synthetic peptide
  Seed: RLAYLHARLR (PRAME_HUMAN)
RPAYLHARLR

SEQ ID NO: 160249 - protein, 10 aa, Artificial Sequence
  Description of Artificial Sequence: Synthetic peptide
  Seed: RRWKLQVLDL (PRAME_HUMAN)
RRWKLQVLDA

SEQ ID NO: 160250 - protein, 10 aa, Artificial Sequence
  Description of Artificial Sequence: Synthetic peptide
  Seed: RHVMNPLETL (PRAME_HUMAN)
REVMNPLETV

SEQ ID NO: 160251 - protein, 10 aa, Artificial Sequence
  Description of Artificial Sequence: Synthetic peptide
  Seed: IEDLEVTCTW (PRAME_HUMAN)
IADLEVTCTW

SEQ ID NO: 160252 - protein, 8 aa, Artificial Sequence
  Description of Artificial Sequence: Synthetic peptide
  Seed: SQLSVLSL (PRAME_HUMAN)
SELSVLSM

SEQ ID NO: 160253 - protein, 11 aa, Artificial Sequence
  Description of Artificial Sequence: Synthetic peptide
  Seed: FYDPEPILCPC (PRAME_HUMAN)
FFDPEPILCPL

SEQ ID NO: 160254 - protein, 10 aa, Artificial Sequence
  Description of Artificial Sequence: Synthetic peptide
  Seed: RGRLDQLLRH (PRAME_HUMAN)
RHRLDQLLRK

SEQ ID NO: 160255 - protein, 9 aa, Artificial Sequence
  Description of Artificial Sequence: Synthetic peptide
  Seed: RLSEGDVMH (PRAME_HUMAN)
RISEGDVMY

SEQ ID NO: 160256 - protein, 10 aa, Artificial Sequence
  Description of Artificial Sequence: Synthetic peptide
  Seed: RELFPPLFMA (PRAME_HUMAN)
RFLFPPLFMT

SEQ ID NO: 160257 - protein, 9 aa, Artificial Sequence
  Description of Artificial Sequence: Synthetic peptide
  Seed: RLDQLLRHV (PRAME_HUMAN)
RLDQLLRHI

SEQ ID NO: 160258 - protein, 9 aa, Artificial Sequence
  Description of Artificial Sequence: Synthetic peptide
  Seed: AFDGRHSQT (PRAME_HUMAN)
AFDGRHSQV

SEQ ID NO: 160259 - protein, 9 aa, Artificial Sequence
  Description of Artificial Sequence: Synthetic peptide
  Seed: FLRGRLDQL (PRAME_HUMAN)
FIRGRLDQI

SEQ ID NO: 160260 - protein, 9 aa, Artificial Sequence
  Description of Artificial Sequence: Synthetic peptide
  Seed: RLRELLCEL (PRAME_HUMAN)
RFRELLCEI

SEQ ID NO: 160261 - protein, 9 aa, Artificial Sequence
  Description of Artificial Sequence: Synthetic peptide
  Seed: ERLAYLHAR (PRAME_HUMAN)
EQLAYLHAR

SEQ ID NO: 160262 - protein, 9 aa, Artificial Sequence
  Description of Artificial Sequence: Synthetic peptide
  Seed: SLLQHLIGL (PRAME_HUMAN)
STLQHLIGK

SEQ ID NO: 160263 - protein, 9 aa, Artificial Sequence
  Description of Artificial Sequence: Synthetic peptide
  Seed: ASATLQDLV (PRAME_HUMAN)
AVATLQDLI

SEQ ID NO: 160264 - protein, 10 aa, Artificial Sequence
  Description of Artificial Sequence: Synthetic peptide
  Seed: RHVMNPLETL (PRAME_HUMAN)
RFVMNPLETI

SEQ ID NO: 160265 - protein, 9 aa, Artificial Sequence
  Description of Artificial Sequence: Synthetic peptide
  Seed: RASATLQDL (PRAME_HUMAN)
RTSATLQDY

SEQ ID NO: 160266 - protein, 9 aa, Artificial Sequence
  Description of Artificial Sequence: Synthetic peptide
  Seed: MINLRRLLL (PRAME_HUMAN)
MLNLRRLLI

SEQ ID NO: 160267 - protein, 10 aa, Artificial Sequence
  Description of Artificial Sequence: Synthetic peptide
  Seed: LLLSHIHASS (PRAME_HUMAN)
LILSHIHASV

SEQ ID NO: 160268 - protein, 9 aa, Artificial Sequence
  Description of Artificial Sequence: Synthetic peptide
  Seed: VSPEPLQAL (PRAME_HUMAN)
VVPEPLQAL

SEQ ID NO: 160269 - protein, 10 aa, Artificial Sequence
  Description of Artificial Sequence: Synthetic peptide
  Seed: AFDGRHSQTL (PRAME_HUMAN)
AYDGRHSQTL

SEQ ID NO: 160270 - protein, 10 aa, Artificial Sequence
  Description of Artificial Sequence: Synthetic peptide
  Seed: QSLLQHLIGL (PRAME_HUMAN)
QELLQHLIGI

SEQ ID NO: 160271 - protein, 10 aa, Artificial Sequence
  Description of Artificial Sequence: Synthetic peptide
  Seed: MLTDVSPEPL (PRAME_HUMAN)
MMTDVSPEPM

SEQ ID NO: 160272 - protein, 9 aa, Artificial Sequence
  Description of Artificial Sequence: Synthetic peptide
  Seed: LLLSHIHAS (PRAME_HUMAN)
LMLSHIHAS

SEQ ID NO: 160273 - protein, 9 aa, Artificial Sequence
  Description of Artificial Sequence: Synthetic peptide
  Seed: RLRELLCEL (PRAME_HUMAN)
RIRELLCEY

SEQ ID NO: 160274 - protein, 9 aa, Artificial Sequence
  Description of Artificial Sequence: Synthetic peptide
  Seed: RLDQLLRHV (PRAME_HUMAN)
RSDQLLRHL

SEQ ID NO: 160275 - protein, 10 aa, Artificial Sequence
  Description of Artificial Sequence: Synthetic peptide
  Seed: RTFYDPEPIL (PRAME_HUMAN)
RSFYDPEPIM

SEQ ID NO: 160276 - protein, 9 aa, Artificial Sequence
  Description of Artificial Sequence: Synthetic peptide
  Seed: AVLDGLDVL (PRAME_HUMAN)
ALLDGLDVL

SEQ ID NO: 160277 - protein, 10 aa, Artificial Sequence
  Description of Artificial Sequence: Synthetic peptide
  Seed: QSLLQHLIGL (PRAME_HUMAN)
QYLLQHLIGV

SEQ ID NO: 160278 - protein, 9 aa, Artificial Sequence
  Description of Artificial Sequence: Synthetic peptide
  Seed: SFYGNSISI (PRAME_HUMAN)
SFYGNSISY

SEQ ID NO: 160279 - protein, 9 aa, Artificial Sequence
  Description of Artificial Sequence: Synthetic peptide
  Seed: VQLDSIEDL (PRAME_HUMAN)
VVLDSIEDV

SEQ ID NO: 160280 - protein, 9 aa, Artificial Sequence
  Description of Artificial Sequence: Synthetic peptide
  Seed: EQPFIPVEV (PRAME_HUMAN)
EIPFIPVEA

SEQ ID NO: 160281 - protein, 10 aa, Artificial Sequence
  Description of Artificial Sequence: Synthetic peptide
  Seed: RELFPPLFMA (PRAME_HUMAN)
RYLFPPLFMV

SEQ ID NO: 160282 - protein, 9 aa, Artificial Sequence
  Description of Artificial Sequence: Synthetic peptide
  Seed: MINLRRLLL (PRAME_HUMAN)
MANLRRLLK

SEQ ID NO: 160283 - protein, 9 aa, Artificial Sequence
  Description of Artificial Sequence: Synthetic peptide
  Seed: LLRHVMNPL (PRAME_HUMAN)
LMRHVMNPF

SEQ ID NO: 160284 - protein, 10 aa, Artificial Sequence
  Description of Artificial Sequence: Synthetic peptide
  Seed: LYVDSLFFLR (PRAME_HUMAN)
LAVDSLFFLK

SEQ ID NO: 160285 - protein, 9 aa, Artificial Sequence
  Description of Artificial Sequence: Synthetic peptide
  Seed: NLTHVLYPV (PRAME_HUMAN)
NLTHVLYPT

SEQ ID NO: 160286 - protein, 9 aa, Artificial Sequence
  Description of Artificial Sequence: Synthetic peptide
  Seed: RTFYDPEPI (PRAME_HUMAN)
RGFYDPEPY

SEQ ID NO: 160287 - protein, 10 aa, Artificial Sequence
  Description of Artificial Sequence: Synthetic peptide
  Seed: TCLPLGVLMK (PRAME_HUMAN)
TVLPLGVLMK

SEQ ID NO: 160288 - protein, 9 aa, Artificial Sequence
  Description of Artificial Sequence: Synthetic peptide
  Seed: YVDSLFFLR (PRAME_HUMAN)
YMDSLFFLR

SEQ ID NO: 160289 - protein, 9 aa, Artificial Sequence
  Description of Artificial Sequence: Synthetic peptide
  Seed: LALLPSLSH (PRAME_HUMAN)
LMLLPSLSF

SEQ ID NO: 160290 - protein, 9 aa, Artificial Sequence
  Description of Artificial Sequence: Synthetic peptide
  Seed: RLDQLLRHV (PRAME_HUMAN)
RFDQLLRHM

SEQ ID NO: 160291 - protein, 9 aa, Artificial Sequence
  Description of Artificial Sequence: Synthetic peptide
  Seed: FYDPEPILC (PRAME_HUMAN)
FWDPEPILF

SEQ ID NO: 160292 - protein, 9 aa, Artificial Sequence
  Description of Artificial Sequence: Synthetic peptide
  Seed: LELLPRELF (PRAME_HUMAN)
LELLPRELV

SEQ ID NO: 160293 - protein, 10 aa, Artificial Sequence
  Description of Artificial Sequence: Synthetic peptide
  Seed: IGLSNLTHVL (PRAME_HUMAN)
IALSNLTHVI

SEQ ID NO: 160294 - protein, 10 aa, Artificial Sequence
  Description of Artificial Sequence: Synthetic peptide
  Seed: LSHIHASSYI (PRAME_HUMAN)
LAHIHASSYY

SEQ ID NO: 160295 - protein, 9 aa, Artificial Sequence
  Description of Artificial Sequence: Synthetic peptide
  Seed: SHCSQLTTL (PRAME_HUMAN)
SHCSQLTTY

SEQ ID NO: 160296 - protein, 9 aa, Artificial Sequence
  Description of Artificial Sequence: Synthetic peptide
  Seed: RLWGSIQSR (PRAME_HUMAN)
RSWGSIQSF

SEQ ID NO: 160297 - protein, 10 aa, Artificial Sequence
  Description of Artificial Sequence: Synthetic peptide
  Seed: TFYDPEPILC (PRAME_HUMAN)
TYYDPEPILY

SEQ ID NO: 160298 - protein, 9 aa, Artificial Sequence
  Description of Artificial Sequence: Synthetic peptide
  Seed: VFDECGITD (PRAME_HUMAN)
VADECGITF

SEQ ID NO: 160299 - protein, 10 aa, Artificial Sequence
  Description of Artificial Sequence: Synthetic peptide
  Seed: VTCTWKLPTL (PRAME_HUMAN)
VLCTWKLPTL

SEQ ID NO: 160300 - protein, 10 aa, Artificial Sequence
  Description of Artificial Sequence: Synthetic peptide
  Seed: ARLRELLCEL (PRAME_HUMAN)
AQLRELLCEA

SEQ ID NO: 160301 - protein, 9 aa, Artificial Sequence
  Description of Artificial Sequence: Synthetic peptide
  Seed: ITDDQLLAL (PRAME_HUMAN)
ISDDQLLAY

SEQ ID NO: 160302 - protein, 11 aa, Artificial Sequence
  Description of Artificial Sequence: Synthetic peptide
  Seed: MLTDVSPEPLQ (PRAME_HUMAN)
MMTDVSPEPLL

SEQ ID NO: 160303 - protein, 10 aa, Artificial Sequence
  Description of Artificial Sequence: Synthetic peptide
  Seed: AQFTSQFLSL (PRAME_HUMAN)
AQFTSQFLSM

SEQ ID NO: 160304 - protein, 9 aa, Artificial Sequence
  Description of Artificial Sequence: Synthetic peptide
  Seed: FTCLPLGVL (PRAME_HUMAN)
FVCLPLGVF

SEQ ID NO: 160305 - protein, 9 aa, Artificial Sequence
  Description of Artificial Sequence: Synthetic peptide
  Seed: VQLDSIEDL (PRAME_HUMAN)
VILDSIEDV

SEQ ID NO: 160306 - protein, 9 aa, Artificial Sequence
  Description of Artificial Sequence: Synthetic peptide
  Seed: SQSPSVSQL (PRAME_HUMAN)
SLSPSVSQW

SEQ ID NO: 160307 - protein, 10 aa, Artificial Sequence
  Description of Artificial Sequence: Synthetic peptide
  Seed: TLQDLVFDEC (PRAME_HUMAN)
TMQDLVFDEL

SEQ ID NO: 160308 - protein, 9 aa, Artificial Sequence
  Description of Artificial Sequence: Synthetic peptide
  Seed: VFDECGITD (PRAME_HUMAN)
VFDECGITV

SEQ ID NO: 160309 - protein, 9 aa, Artificial Sequence
  Description of Artificial Sequence: Synthetic peptide
  Seed: SLQCLQALY (PRAME_HUMAN)
SIQCLQALK

SEQ ID NO: 160310 - protein, 9 aa, Artificial Sequence
  Description of Artificial Sequence: Synthetic peptide
  Seed: SLSHCSQLT (PRAME_HUMAN)
SVSHCSQLL

SEQ ID NO: 160311 - protein, 10 aa, Artificial Sequence
  Description of Artificial Sequence: Synthetic peptide
  Seed: FIPVEVLVDL (PRAME_HUMAN)
FAPVEVLVDM

SEQ ID NO: 160312 - protein, 9 aa, Artificial Sequence
  Description of Artificial Sequence: Synthetic peptide
  Seed: KMILKMVQL (PRAME_HUMAN)
KTILKMVQM

SEQ ID NO: 160313 - protein, 9 aa, Artificial Sequence
  Description of Artificial Sequence: Synthetic peptide
  Seed: VQLDSIEDL (PRAME_HUMAN)
VQLDSIEDF

SEQ ID NO: 160314 - protein, 11 aa, Artificial Sequence
  Description of Artificial Sequence: Synthetic peptide
  Seed: GTLHLERLAYL (PRAME_HUMAN)
GFLHLERLAYL

SEQ ID NO: 160315 - protein, 10 aa, Artificial Sequence
  Description of Artificial Sequence: Synthetic peptide
  Seed: TTLSFYGNSI (PRAME_HUMAN)
TSLSFYGNSV

SEQ ID NO: 160316 - protein, 9 aa, Artificial Sequence
  Description of Artificial Sequence: Synthetic peptide
  Seed: FAMPMQDIK (PRAME_HUMAN)
FVMPMQDIK

SEQ ID NO: 160317 - protein, 10 aa, Artificial Sequence
  Description of Artificial Sequence: Synthetic peptide
  Seed: KIFAMPMQDI (PRAME_HUMAN)
KMFAMPMQDM

SEQ ID NO: 160318 - protein, 10 aa, Artificial Sequence
  Description of Artificial Sequence: Synthetic peptide
  Seed: LPTLAKFSPY (PRAME_HUMAN)
LRTLAKFSPF

SEQ ID NO: 160319 - protein, 10 aa, Artificial Sequence
  Description of Artificial Sequence: Synthetic peptide
  Seed: LSQSPSVSQL (PRAME_HUMAN)
LGQSPSVSQM

SEQ ID NO: 160320 - protein, 9 aa, Artificial Sequence
  Description of Artificial Sequence: Synthetic peptide
  Seed: LQSLLQHLI (PRAME_HUMAN)
LLSLLQHLA

SEQ ID NO: 160321 - protein, 9 aa, Artificial Sequence
  Description of Artificial Sequence: Synthetic peptide
  Seed: SRYISMSVW (PRAME_HUMAN)
SAYISMSVY

SEQ ID NO: 160322 - protein, 11 aa, Artificial Sequence
  Description of Artificial Sequence: Synthetic peptide
  Seed: SLQCLQALYVD (PRAME_HUMAN)
SMQCLQALYVL

SEQ ID NO: 160323 - protein, 9 aa, Artificial Sequence
  Description of Artificial Sequence: Synthetic peptide
  Seed: GQHLHLETF (PRAME_HUMAN)
GQHLHLETL

SEQ ID NO: 160324 - protein, 9 aa, Artificial Sequence
  Description of Artificial Sequence: Synthetic peptide
  Seed: SALQSLLQH (PRAME_HUMAN)
SALQSLLQL

SEQ ID NO: 160325 - protein, 10 aa, Artificial Sequence
  Description of Artificial Sequence: Synthetic peptide
  Seed: LKAMVQAWPF (PRAME_HUMAN)
LHAMVQAWPF

SEQ ID NO: 160326 - protein, 10 aa, Artificial Sequence
  Description of Artificial Sequence: Synthetic peptide
  Seed: KKLKIFAMPM (PRAME_HUMAN)
KNLKIFAMPK

SEQ ID NO: 160327 - protein, 10 aa, Artificial Sequence
  Description of Artificial Sequence: Synthetic peptide
  Seed: AFDGRHSQTL (PRAME_HUMAN)
ATDGRHSQTI

SEQ ID NO: 160328 - protein, 9 aa, Artificial Sequence
  Description of Artificial Sequence: Synthetic peptide
  Seed: ELFSYLIEK (PRAME_HUMAN)
EWFSYLIER

SEQ ID NO: 160329 - protein, 10 aa, Artificial Sequence
  Description of Artificial Sequence: Synthetic peptide
  Seed: KDEALAIAAL (PRAME_HUMAN)
KREALAIAAL

SEQ ID NO: 160330 - protein, 9 aa, Artificial Sequence
  Description of Artificial Sequence: Synthetic peptide
  Seed: AWPFTCLPL (PRAME_HUMAN)
ASPFTCLPL

SEQ ID NO: 160331 - protein, 9 aa, Artificial Sequence
  Description of Artificial Sequence: Synthetic peptide
  Seed: LLKDEALAI (PRAME_HUMAN)
LMKDEALAI

SEQ ID NO: 160332 - protein, 10 aa, Artificial Sequence
  Description of Artificial Sequence: Synthetic peptide
  Seed: TSQFLSLQCL (PRAME_HUMAN)
TYQFLSLQCY

SEQ ID NO: 160333 - protein, 9 aa, Artificial Sequence
  Description of Artificial Sequence: Synthetic peptide
  Seed: RASATLQDL (PRAME_HUMAN)
RASATLQDF

SEQ ID NO: 160334 - protein, 9 aa, Artificial Sequence
  Description of Artificial Sequence: Synthetic peptide
  Seed: SPEPLQALL (PRAME_HUMAN)
SVEPLQALM

SEQ ID NO: 160335 - protein, 9 aa, Artificial Sequence
  Description of Artificial Sequence: Synthetic peptide
  Seed: VQAWPFTCL (PRAME_HUMAN)
VIAWPFTCY

SEQ ID NO: 160336 - protein, 9 aa, Artificial Sequence
  Description of Artificial Sequence: Synthetic peptide
  Seed: QDIKMILKM (PRAME_HUMAN)
QQIKMILKW

SEQ ID NO: 160337 - protein, 10 aa, Artificial Sequence
  Description of Artificial Sequence: Synthetic peptide
  Seed: VTCTWKLPTL (PRAME_HUMAN)
VVCTWKLPTV

SEQ ID NO: 160338 - protein, 10 aa, Artificial Sequence
  Description of Artificial Sequence: Synthetic peptide
  Seed: SISISALQSL (PRAME_HUMAN)
SVSISALQSV

SEQ ID NO: 160339 - protein, 10 aa, Artificial Sequence
  Description of Artificial Sequence: Synthetic peptide
  Seed: CSQLTTLSFY (PRAME_HUMAN)
CIQLTTLSFF

SEQ ID NO: 160340 - protein, 9 aa, Artificial Sequence
  Description of Artificial Sequence: Synthetic peptide
  Seed: IAQFTSQFL (PRAME_HUMAN)
ISQFTSQFY

SEQ ID NO: 160341 - protein, 9 aa, Artificial Sequence
  Description of Artificial Sequence: Synthetic peptide
  Seed: GACDELFSY (PRAME_HUMAN)
GYCDELFSY

SEQ ID NO: 160342 - protein, 9 aa, Artificial Sequence
  Description of Artificial Sequence: Synthetic peptide
  Seed: QFTSQFLSL (PRAME_HUMAN)
QATSQFLSF

SEQ ID NO: 160343 - protein, 9 aa, Artificial Sequence
  Description of Artificial Sequence: Synthetic peptide
  Seed: FLRGRLDQL (PRAME_HUMAN)
FMRGRLDQY

SEQ ID NO: 160344 - protein, 10 aa, Artificial Sequence
  Description of Artificial Sequence: Synthetic peptide
  Seed: VSPEPLQALL (PRAME_HUMAN)
VAPEPLQALL

SEQ ID NO: 160345 - protein, 9 aa, Artificial Sequence
  Description of Artificial Sequence: Synthetic peptide
  Seed: RLWGSIQSR (PRAME_HUMAN)
RNWGSIQSR

SEQ ID NO: 160346 - protein, 10 aa, Artificial Sequence
  Description of Artificial Sequence: Synthetic peptide
  Seed: HCSQLTTLSF (PRAME_HUMAN)
HQSQLTTLSW

SEQ ID NO: 160347 - protein, 10 aa, Artificial Sequence
  Description of Artificial Sequence: Synthetic peptide
  Seed: HASSYISPEK (PRAME_HUMAN)
HDSSYISPER

SEQ ID NO: 160348 - protein, 11 aa, Artificial Sequence
  Description of Artificial Sequence: Synthetic peptide
  Seed: RLWGSIQSRYI (PRAME_HUMAN)
RQWGSIQSRYV

SEQ ID NO: 160349 - protein, 10 aa, Artificial Sequence
  Description of Artificial Sequence: Synthetic peptide
  Seed: MLTDVSPEPL (PRAME_HUMAN)
MTTDVSPEPI

SEQ ID NO: 160350 - protein, 10 aa, Artificial Sequence
  Description of Artificial Sequence: Synthetic peptide
  Seed: AAFDGRHSQT (PRAME_HUMAN)
ATFDGRHSQF

SEQ ID NO: 160351 - protein, 9 aa, Artificial Sequence
  Description of Artificial Sequence: Synthetic peptide
  Seed: KAMVQAWPF (PRAME_HUMAN)
KFMVQAWPL

SEQ ID NO: 160352 - protein, 10 aa, Artificial Sequence
  Description of Artificial Sequence: Synthetic peptide
  Seed: PTLAKFSPYL (PRAME_HUMAN)
PALAKFSPYL

SEQ ID NO: 160353 - protein, 9 aa, Artificial Sequence
  Description of Artificial Sequence: Synthetic peptide
  Seed: ESYEDIHGT (PRAME_HUMAN)
EMYEDIHGV

SEQ ID NO: 160354 - protein, 9 aa, Artificial Sequence
  Description of Artificial Sequence: Synthetic peptide
  Seed: WSGNRASLY (PRAME_HUMAN)
WAGNRASLW

SEQ ID NO: 160355 - protein, 9 aa, Artificial Sequence
  Description of Artificial Sequence: Synthetic peptide
  Seed: WSGNRASLY (PRAME_HUMAN)
WAGNRASLY

SEQ ID NO: 160356 - protein, 9 aa, Artificial Sequence
  Description of Artificial Sequence: Synthetic peptide
  Seed: AVLDGLDVL (PRAME_HUMAN)
AQLDGLDVW

SEQ ID NO: 160357 - protein, 8 aa, Artificial Sequence
  Description of Artificial Sequence: Synthetic peptide
  Seed: FYDPEPIL (PRAME_HUMAN)
FVDPEPIF

SEQ ID NO: 160358 - protein, 9 aa, Artificial Sequence
  Description of Artificial Sequence: Synthetic peptide
  Seed: RLWGSIQSR (PRAME_HUMAN)
RAWGSIQSK

SEQ ID NO: 160359 - protein, 10 aa, Artificial Sequence
  Description of Artificial Sequence: Synthetic peptide
  Seed: SPYLGQMINL (PRAME_HUMAN)
SPYLGQMINW

SEQ ID NO: 160360 - protein, 10 aa, Artificial Sequence
  Description of Artificial Sequence: Synthetic peptide
  Seed: KKLKIFAMPM (PRAME_HUMAN)
KRLKIFAMPY

SEQ ID NO: 160361 - protein, 9 aa, Artificial Sequence
  Description of Artificial Sequence: Synthetic peptide
  Seed: LQHLIGLSN (PRAME_HUMAN)
LQHLIGLSW

SEQ ID NO: 160362 - protein, 9 aa, Artificial Sequence
  Description of Artificial Sequence: Synthetic peptide
  Seed: SHCSQLTTL (PRAME_HUMAN)
SHCSQLTTA

SEQ ID NO: 160363 - protein, 9 aa, Artificial Sequence
  Description of Artificial Sequence: Synthetic peptide
  Seed: TLAKFSPYL (PRAME_HUMAN)
TIAKFSPYY

SEQ ID NO: 160364 - protein, 10 aa, Artificial Sequence
  Description of Artificial Sequence: Synthetic peptide
  Seed: LLSHIHASSY (PRAME_HUMAN)
LPSHIHASSY

SEQ ID NO: 160365 - protein, 10 aa, Artificial Sequence
  Description of Artificial Sequence: Synthetic peptide
  Seed: RLSEGDVMHL (PRAME_HUMAN)
RWSEGDVMHY

SEQ ID NO: 160366 - protein, 9 aa, Artificial Sequence
  Description of Artificial Sequence: Synthetic peptide
  Seed: ISISALQSL (PRAME_HUMAN)
IEISALQSF

SEQ ID NO: 160367 - protein, 10 aa, Artificial Sequence
  Description of Artificial Sequence: Synthetic peptide
  Seed: GQMINLRRLL (PRAME_HUMAN)
GMMINLRRLV

SEQ ID NO: 160368 - protein, 9 aa, Artificial Sequence
  Description of Artificial Sequence: Synthetic peptide
  Seed: SLLQHLIGL (PRAME_HUMAN)
SALQHLIGR

SEQ ID NO: 160369 - protein, 9 aa, Artificial Sequence
  Description of Artificial Sequence: Synthetic peptide
  Seed: YSFPEPEAA (PRAME_HUMAN)
YCFPEPEAM

SEQ ID NO: 160370 - protein, 9 aa, Artificial Sequence
  Description of Artificial Sequence: Synthetic peptide
  Seed: SATLQDLVF (PRAME_HUMAN)
SSTLQDLVF

SEQ ID NO: 160371 - protein, 8 aa, Artificial Sequence
  Description of Artificial Sequence: Synthetic peptide
  Seed: RRWKLQVL (PRAME_HUMAN)
RRWKLQVI

SEQ ID NO: 160372 - protein, 8 aa, Artificial Sequence
  Description of Artificial Sequence: Synthetic peptide
  Seed: VKRKKNVL (PRAME_HUMAN)
VLRKKNVL

SEQ ID NO: 160373 - protein, 9 aa, Artificial Sequence
  Description of Artificial Sequence: Synthetic peptide
  Seed: IAQFTSQFL (PRAME_HUMAN)
IMQFTSQFI

SEQ ID NO: 160374 - protein, 8 aa, Artificial Sequence
  Description of Artificial Sequence: Synthetic peptide
  Seed: YEDIHGTL (PRAME_HUMAN)
YFDIHGTL

SEQ ID NO: 160375 - protein, 10 aa, Artificial Sequence
  Description of Artificial Sequence: Synthetic peptide
  Seed: QLLALLPSLS (PRAME_HUMAN)
QLLALLPSLI

SEQ ID NO: 160376 - protein, 10 aa, Artificial Sequence
  Description of Artificial Sequence: Synthetic peptide
  Seed: KIFAMPMQDI (PRAME_HUMAN)
KTFAMPMQDF

SEQ ID NO: 160377 - protein, 10 aa, Artificial Sequence
  Description of Artificial Sequence: Synthetic peptide
  Seed: SVLSLSGVML (PRAME_HUMAN)
SILSLSGVMV

SEQ ID NO: 160378 - protein, 10 aa, Artificial Sequence
  Description of Artificial Sequence: Synthetic peptide
  Seed: VELAGQSLLK (PRAME_HUMAN)
VLLAGQSLLK

SEQ ID NO: 160379 - protein, 9 aa, Artificial Sequence
  Description of Artificial Sequence: Synthetic peptide
  Seed: SHIHASSYI (PRAME_HUMAN)
SLIHASSYM

SEQ ID NO: 160380 - protein, 10 aa, Artificial Sequence
  Description of Artificial Sequence: Synthetic peptide
  Seed: LLSHIHASSY (PRAME_HUMAN)
LYSHIHASSF

SEQ ID NO: 160381 - protein, 9 aa, Artificial Sequence
  Description of Artificial Sequence: Synthetic peptide
  Seed: LQALYVDSL (PRAME_HUMAN)
LLALYVDSA

SEQ ID NO: 160382 - protein, 11 aa, Artificial Sequence
  Description of Artificial Sequence: Synthetic peptide
  Seed: RLWGSIQSRYI (PRAME_HUMAN)
RIWGSIQSRYV

SEQ ID NO: 160383 - protein, 9 aa, Artificial Sequence
  Description of Artificial Sequence: Synthetic peptide
  Seed: GQHLHLETF (PRAME_HUMAN)
GAHLHLETL

SEQ ID NO: 160384 - protein, 10 aa, Artificial Sequence
  Description of Artificial Sequence: Synthetic peptide
  Seed: SISISALQSL (PRAME_HUMAN)
SISISALQSF

SEQ ID NO: 160385 - protein, 10 aa, Artificial Sequence
  Description of Artificial Sequence: Synthetic peptide
  Seed: RHVMNPLETL (PRAME_HUMAN)
RLVMNPLETY

SEQ ID NO: 160386 - protein, 9 aa, Artificial Sequence
  Description of Artificial Sequence: Synthetic peptide
  Seed: QMINLRRLL (PRAME_HUMAN)
QQINLRRLV

SEQ ID NO: 160387 - protein, 9 aa, Artificial Sequence
  Description of Artificial Sequence: Synthetic peptide
  Seed: LSANPCPHC (PRAME_HUMAN)
LSANPCPHW

SEQ ID NO: 160388 - protein, 9 aa, Artificial Sequence
  Description of Artificial Sequence: Synthetic peptide
  Seed: ALQSLLQHL (PRAME_HUMAN)
AMQSLLQHV

SEQ ID NO: 160389 - protein, 8 aa, Artificial Sequence
  Description of Artificial Sequence: Synthetic peptide
  Seed: VSPEPLQA (PRAME_HUMAN)
VAPEPLQV

SEQ ID NO: 160390 - protein, 11 aa, Artificial Sequence
  Description of Artificial Sequence: Synthetic peptide
  Seed: HVMNPLETLSI (PRAME_HUMAN)
HAMNPLETLSL

SEQ ID NO: 160391 - protein, 10 aa, Artificial Sequence
  Description of Artificial Sequence: Synthetic peptide
  Seed: AAFDGRHSQT (PRAME_HUMAN)
AGFDGRHSQM

SEQ ID NO: 160392 - protein, 10 aa, Artificial Sequence
  Description of Artificial Sequence: Synthetic peptide
  Seed: VLMKGQHLHL (PRAME_HUMAN)
VVMKGQHLHV

SEQ ID NO: 160393 - protein, 9 aa, Artificial Sequence
  Description of Artificial Sequence: Synthetic peptide
  Seed: SQFLSLQCL (PRAME_HUMAN)
SHFLSLQCV

SEQ ID NO: 160394 - protein, 10 aa, Artificial Sequence
  Description of Artificial Sequence: Synthetic peptide
  Seed: RELFPPLFMA (PRAME_HUMAN)
RALFPPLFMA

SEQ ID NO: 160395 - protein, 10 aa, Artificial Sequence
  Description of Artificial Sequence: Synthetic peptide
  Seed: RGRLDQLLRH (PRAME_HUMAN)
RYRLDQLLRM

SEQ ID NO: 160396 - protein, 10 aa, Artificial Sequence
  Description of Artificial Sequence: Synthetic peptide
  Seed: MERRRLWGSI (PRAME_HUMAN)
MERRRLWGSL

SEQ ID NO: 160397 - protein, 9 aa, Artificial Sequence
  Description of Artificial Sequence: Synthetic peptide
  Seed: SQSPSVSQL (PRAME_HUMAN)
SMSPSVSQM

SEQ ID NO: 160398 - protein, 9 aa, Artificial Sequence
  Description of Artificial Sequence: Synthetic peptide
  Seed: KLKIFAMPM (PRAME_HUMAN)
KYKIFAMPL

SEQ ID NO: 160399 - protein, 9 aa, Artificial Sequence
  Description of Artificial Sequence: Synthetic peptide
  Seed: LLERASATL (PRAME_HUMAN)
LMERASATV

SEQ ID NO: 160400 - protein, 9 aa, Artificial Sequence
  Description of Artificial Sequence: Synthetic peptide
  Seed: RLCCKKLKI (PRAME_HUMAN)
RSCCKKLKY

SEQ ID NO: 160401 - protein, 10 aa, Artificial Sequence
  Description of Artificial Sequence: Synthetic peptide
  Seed: ALYVDSLFFL (PRAME_HUMAN)
ALYVDSLFFM

SEQ ID NO: 160402 - protein, 9 aa, Artificial Sequence
  Description of Artificial Sequence: Synthetic peptide
  Seed: LALLPSLSH (PRAME_HUMAN)
LQLLPSLSY

SEQ ID NO: 160403 - protein, 10 aa, Artificial Sequence
  Description of Artificial Sequence: Synthetic peptide
  Seed: RLSEGDVMHL (PRAME_HUMAN)
RISEGDVMHW

SEQ ID NO: 160404 - protein, 9 aa, Artificial Sequence
  Description of Artificial Sequence: Synthetic peptide
  Seed: YIAQFTSQF (PRAME_HUMAN)
YYAQFTSQT

SEQ ID NO: 160405 - protein, 9 aa, Artificial Sequence
  Description of Artificial Sequence: Synthetic peptide
  Seed: SVLSLSGVM (PRAME_HUMAN)
STLSLSGVM

SEQ ID NO: 160406 - protein, 9 aa, Artificial Sequence
  Description of Artificial Sequence: Synthetic peptide
  Seed: SLLQHLIGL (PRAME_HUMAN)
SVLQHLIGA

SEQ ID NO: 160407 - protein, 10 aa, Artificial Sequence
  Description of Artificial Sequence: Synthetic peptide
  Seed: KDEALAIAAL (PRAME_HUMAN)
KIEALAIAAL

SEQ ID NO: 160408 - protein, 10 aa, Artificial Sequence
  Description of Artificial Sequence: Synthetic peptide
  Seed: AALELLPREL (PRAME_HUMAN)
ATLELLPREV

SEQ ID NO: 160409 - protein, 9 aa, Artificial Sequence
  Description of Artificial Sequence: Synthetic peptide
  Seed: ALQSLLQHL (PRAME_HUMAN)
AVQSLLQHW

SEQ ID NO: 160410 - protein, 9 aa, Artificial Sequence
  Description of Artificial Sequence: Synthetic peptide
  Seed: KLKIFAMPM (PRAME_HUMAN)
KIKIFAMPL

SEQ ID NO: 160411 - protein, 10 aa, Artificial Sequence
  Description of Artificial Sequence: Synthetic peptide
  Seed: RLSEGDVMHL (PRAME_HUMAN)
RASEGDVMHF

SEQ ID NO: 160412 - protein, 9 aa, Artificial Sequence
  Description of Artificial Sequence: Synthetic peptide
  Seed: SFYGNSISI (PRAME_HUMAN)
SQYGNSISM

SEQ ID NO: 160413 - protein, 10 aa, Artificial Sequence
  Description of Artificial Sequence: Synthetic peptide
  Seed: YEDIHGTLHL (PRAME_HUMAN)
YVDIHGTLHF

SEQ ID NO: 160414 - protein, 10 aa, Artificial Sequence
  Description of Artificial Sequence: Synthetic peptide
  Seed: AIAALELLPR (PRAME_HUMAN)
AFAALELLPR

SEQ ID NO: 160415 - protein, 9 aa, Artificial Sequence
  Description of Artificial Sequence: Synthetic peptide
  Seed: RLRELLCEL (PRAME_HUMAN)
RPRELLCEI

SEQ ID NO: 160416 - protein, 9 aa, Artificial Sequence
  Description of Artificial Sequence: Synthetic peptide
  Seed: SQSPSVSQL (PRAME_HUMAN)
SISPSVSQV

SEQ ID NO: 160417 - protein, 10 aa, Artificial Sequence
  Description of Artificial Sequence: Synthetic peptide
  Seed: AVLDGLDVLL (PRAME_HUMAN)
AQLDGLDVLF

SEQ ID NO: 160418 - protein, 9 aa, Artificial Sequence
  Description of Artificial Sequence: Synthetic peptide
  Seed: LYVDSLFFL (PRAME_HUMAN)
LSVDSLFFA

SEQ ID NO: 160419 - protein, 10 aa, Artificial Sequence
  Description of Artificial Sequence: Synthetic peptide
  Seed: LKAMVQAWPF (PRAME_HUMAN)
LMAMVQAWPW

SEQ ID NO: 160420 - protein, 9 aa, Artificial Sequence
  Description of Artificial Sequence: Synthetic peptide
  Seed: VLDGLDVLL (PRAME_HUMAN)
VCDGLDVLL

SEQ ID NO: 160421 - protein, 10 aa, Artificial Sequence
  Description of Artificial Sequence: Synthetic peptide
  Seed: LPTLAKFSPY (PRAME_HUMAN)
LETLAKFSPF

SEQ ID NO: 160422 - protein, 10 aa, Artificial Sequence
  Description of Artificial Sequence: Synthetic peptide
  Seed: RWKLQVLDLR (PRAME_HUMAN)
RMKLQVLDLR

SEQ ID NO: 160423 - protein, 8 aa, Artificial Sequence
  Description of Artificial Sequence: Synthetic peptide
  Seed: ITDDQLLA (PRAME_HUMAN)
IVDDQLLM

SEQ ID NO: 160424 - protein, 10 aa, Artificial Sequence
  Description of Artificial Sequence: Synthetic peptide
  Seed: VLYPVPLESY (PRAME_HUMAN)
VKYPVPLESY

SEQ ID NO: 160425 - protein, 9 aa, Artificial Sequence
  Description of Artificial Sequence: Synthetic peptide
  Seed: RTFYDPEPI (PRAME_HUMAN)
RRFYDPEPY

SEQ ID NO: 160426 - protein, 10 aa, Artificial Sequence
  Description of Artificial Sequence: Synthetic peptide
  Seed: ISMSVWTSPR (PRAME_HUMAN)
IAMSVWTSPR

SEQ ID NO: 160427 - protein, 9 aa, Artificial Sequence
  Description of Artificial Sequence: Synthetic peptide
  Seed: KVKRKKNVL (PRAME_HUMAN)
KMKRKKNVK

SEQ ID NO: 160428 - protein, 9 aa, Artificial Sequence
  Description of Artificial Sequence: Synthetic peptide
  Seed: SVWTSPRRL (PRAME_HUMAN)
SLWTSPRRW

SEQ ID NO: 160429 - protein, 11 aa, Artificial Sequence
  Description of Artificial Sequence: Synthetic peptide
  Seed: ALYVDSLFFLR (PRAME_HUMAN)
AMYVDSLFFLK

SEQ ID NO: 160430 - protein, 10 aa, Artificial Sequence
  Description of Artificial Sequence: Synthetic peptide
  Seed: LPRELFPPLF (PRAME_HUMAN)
LPRELFPPLA

SEQ ID NO: 160431 - protein, 11 aa, Artificial Sequence
  Description of Artificial Sequence: Synthetic peptide
  Seed: SIEDLEVTCTW (PRAME_HUMAN)
SSEDLEVTCTY

SEQ ID NO: 160432 - protein, 10 aa, Artificial Sequence
  Description of Artificial Sequence: Synthetic peptide
  Seed: LKAMVQAWPF (PRAME_HUMAN)
LKAMVQAWPW

SEQ ID NO: 160433 - protein, 10 aa, Artificial Sequence
  Description of Artificial Sequence: Synthetic peptide
  Seed: SPSVSQLSVL (PRAME_HUMAN)
SDSVSQLSVF

SEQ ID NO: 160434 - protein, 10 aa, Artificial Sequence
  Description of Artificial Sequence: Synthetic peptide
  Seed: LFPPLFMAAF (PRAME_HUMAN)
LWPPLFMAAW

SEQ ID NO: 160435 - protein, 10 aa, Artificial Sequence
  Description of Artificial Sequence: Synthetic peptide
  Seed: TTLSFYGNSI (PRAME_HUMAN)
TALSFYGNSV

SEQ ID NO: 160436 - protein, 9 aa, Artificial Sequence
  Description of Artificial Sequence: Synthetic peptide
  Seed: FLRGRLDQL (PRAME_HUMAN)
FLRGRLDQF

SEQ ID NO: 160437 - protein, 10 aa, Artificial Sequence
  Description of Artificial Sequence: Synthetic peptide
  Seed: IQSRYISMSV (PRAME_HUMAN)
IMSRYISMSY

SEQ ID NO: 160438 - protein, 9 aa, Artificial Sequence
  Description of Artificial Sequence: Synthetic peptide
  Seed: LQDLVFDEC (PRAME_HUMAN)
LVDLVFDEM

SEQ ID NO: 160439 - protein, 9 aa, Artificial Sequence
  Description of Artificial Sequence: Synthetic peptide
  Seed: YEDIHGTLH (PRAME_HUMAN)
YADIHGTLY

SEQ ID NO: 160440 - protein, 9 aa, Artificial Sequence
  Description of Artificial Sequence: Synthetic peptide
  Seed: VWSGNRASL (PRAME_HUMAN)
VASGNRASL

SEQ ID NO: 160441 - protein, 10 aa, Artificial Sequence
  Description of Artificial Sequence: Synthetic peptide
  Seed: AIAALELLPR (PRAME_HUMAN)
AVAALELLPR

SEQ ID NO: 160442 - protein, 9 aa, Artificial Sequence
  Description of Artificial Sequence: Synthetic peptide
  Seed: LSVLSLSGV (PRAME_HUMAN)
LSVLSLSGY

SEQ ID NO: 160443 - protein, 10 aa, Artificial Sequence
  Description of Artificial Sequence: Synthetic peptide
  Seed: RASATLQDLV (PRAME_HUMAN)
RASATLQDLF

SEQ ID NO: 160444 - protein, 10 aa, Artificial Sequence
  Description of Artificial Sequence: Synthetic peptide
  Seed: ALYVDSLFFL (PRAME_HUMAN)
AKYVDSLFFL

SEQ ID NO: 160445 - protein, 10 aa, Artificial Sequence
  Description of Artificial Sequence: Synthetic peptide
  Seed: VLYPVPLESY (PRAME_HUMAN)
VAYPVPLESK

SEQ ID NO: 160446 - protein, 9 aa, Artificial Sequence
  Description of Artificial Sequence: Synthetic peptide
  Seed: YIAQFTSQF (PRAME_HUMAN)
YQAQFTSQA

SEQ ID NO: 160447 - protein, 10 aa, Artificial Sequence
  Description of Artificial Sequence: Synthetic peptide
  Seed: SLSGVMLTDV (PRAME_HUMAN)
SISGVMLTDV

SEQ ID NO: 160448 - protein, 9 aa, Artificial Sequence
  Description of Artificial Sequence: Synthetic peptide
  Seed: CKKLKIFAM (PRAME_HUMAN)
CLKLKIFAM

SEQ ID NO: 160449 - protein, 10 aa, Artificial Sequence
  Description of Artificial Sequence: Synthetic peptide
  Seed: RLVELAGQSL (PRAME_HUMAN)
RRVELAGQSL

SEQ ID NO: 160450 - protein, 10 aa, Artificial Sequence
  Description of Artificial Sequence: Synthetic peptide
  Seed: PTLAKFSPYL (PRAME_HUMAN)
PRLAKFSPYL

SEQ ID NO: 160451 - protein, 9 aa, Artificial Sequence
  Description of Artificial Sequence: Synthetic peptide
  Seed: GQHLHLETF (PRAME_HUMAN)
GEHLHLETC

SEQ ID NO: 160452 - protein, 9 aa, Artificial Sequence
  Description of Artificial Sequence: Synthetic peptide
  Seed: RGRLDQLLR (PRAME_HUMAN)
RIRLDQLLA

SEQ ID NO: 160453 - protein, 10 aa, Artificial Sequence
  Description of Artificial Sequence: Synthetic peptide
  Seed: AFDGRHSQTL (PRAME_HUMAN)
AVDGRHSQTF

SEQ ID NO: 160454 - protein, 10 aa, Artificial Sequence
  Description of Artificial Sequence: Synthetic peptide
  Seed: SPYLGQMINL (PRAME_HUMAN)
SMYLGQMINI

SEQ ID NO: 160455 - protein, 9 aa, Artificial Sequence
  Description of Artificial Sequence: Synthetic peptide
  Seed: HVMNPLETL (PRAME_HUMAN)
HRMNPLETI

SEQ ID NO: 160456 - protein, 9 aa, Artificial Sequence
  Description of Artificial Sequence: Synthetic peptide
  Seed: RLDQLLRHV (PRAME_HUMAN)
RMDQLLRHF

SEQ ID NO: 160457 - protein, 9 aa, Artificial Sequence
  Description of Artificial Sequence: Synthetic peptide
  Seed: LWGSIQSRY (PRAME_HUMAN)
LTGSIQSRY

SEQ ID NO: 160458 - protein, 9 aa, Artificial Sequence
  Description of Artificial Sequence: Synthetic peptide
  Seed: LALLPSLSH (PRAME_HUMAN)
LQLLPSLSV

SEQ ID NO: 160459 - protein, 9 aa, Artificial Sequence
  Description of Artificial Sequence: Synthetic peptide
  Seed: LYPVPLESY (PRAME_HUMAN)
LYPVPLESL

SEQ ID NO: 160460 - protein, 10 aa, Artificial Sequence
  Description of Artificial Sequence: Synthetic peptide
  Seed: KDEALAIAAL (PRAME_HUMAN)
KKEALAIAAL

SEQ ID NO: 160461 - protein, 9 aa, Artificial Sequence
  Description of Artificial Sequence: Synthetic peptide
  Seed: ALQSLLQHL (PRAME_HUMAN)
AVQSLLQHA

SEQ ID NO: 160462 - protein, 10 aa, Artificial Sequence
  Description of Artificial Sequence: Synthetic peptide
  Seed: LETLSITNCR (PRAME_HUMAN)
LMTLSITNCR

SEQ ID NO: 160463 - protein, 9 aa, Artificial Sequence
  Description of Artificial Sequence: Synthetic peptide
  Seed: NSHQDFWTV (PRAME_HUMAN)
NLHQDFWTT

SEQ ID NO: 160464 - protein, 9 aa, Artificial Sequence
  Description of Artificial Sequence: Synthetic peptide
  Seed: LYPVPLESY (PRAME_HUMAN)
LVPVPLESL

SEQ ID NO: 160465 - protein, 9 aa, Artificial Sequence
  Description of Artificial Sequence: Synthetic peptide
  Seed: VLDGLDVLL (PRAME_HUMAN)
VYDGLDVLF

SEQ ID NO: 160466 - protein, 11 aa, Artificial Sequence
  Description of Artificial Sequence: Synthetic peptide
  Seed: MKGQHLHLETF (PRAME_HUMAN)
MQGQHLHLETF

SEQ ID NO: 160467 - protein, 9 aa, Artificial Sequence
  Description of Artificial Sequence: Synthetic peptide
  Seed: AVLDGLDVL (PRAME_HUMAN)
AALDGLDVL

SEQ ID NO: 160468 - protein, 10 aa, Artificial Sequence
  Description of Artificial Sequence: Synthetic peptide
  Seed: RRRLWGSIQS (PRAME_HUMAN)
RTRLWGSIQR

SEQ ID NO: 160469 - protein, 9 aa, Artificial Sequence
  Description of Artificial Sequence: Synthetic peptide
  Seed: KLKIFAMPM (PRAME_HUMAN)
KIKIFAMPR

SEQ ID NO: 160470 - protein, 10 aa, Artificial Sequence
  Description of Artificial Sequence: Synthetic peptide
  Seed: AMVQAWPFTC (PRAME_HUMAN)
ALVQAWPFTA

SEQ ID NO: 160471 - protein, 8 aa, Artificial Sequence
  Description of Artificial Sequence: Synthetic peptide
  Seed: FSYLIEKV (PRAME_HUMAN)
FQYLIEKM

SEQ ID NO: 160472 - protein, 9 aa, Artificial Sequence
  Description of Artificial Sequence: Synthetic peptide
  Seed: MNPLETLSI (PRAME_HUMAN)
MAPLETLSI

SEQ ID NO: 160473 - protein, 9 aa, Artificial Sequence
  Description of Artificial Sequence: Synthetic peptide
  Seed: MVQAWPFTC (PRAME_HUMAN)
MAQAWPFTI

SEQ ID NO: 160474 - protein, 9 aa, Artificial Sequence
  Description of Artificial Sequence: Synthetic peptide
  Seed: QPFIPVEVL (PRAME_HUMAN)
QIFIPVEVY

SEQ ID NO: 160475 - protein, 9 aa, Artificial Sequence
  Description of Artificial Sequence: Synthetic peptide
  Seed: NLTHVLYPV (PRAME_HUMAN)
NITHVLYPR

SEQ ID NO: 160476 - protein, 9 aa, Artificial Sequence
  Description of Artificial Sequence: Synthetic peptide
  Seed: FLSLQCLQA (PRAME_HUMAN)
FLSLQCLQI

SEQ ID NO: 160477 - protein, 9 aa, Artificial Sequence
  Description of Artificial Sequence: Synthetic peptide
  Seed: TLAKFSPYL (PRAME_HUMAN)
TVAKFSPYI

SEQ ID NO: 160478 - protein, 9 aa, Artificial Sequence
  Description of Artificial Sequence: Synthetic peptide
  Seed: AQFTSQFLS (PRAME_HUMAN)
AVFTSQFLI

SEQ ID NO: 160479 - protein, 9 aa, Artificial Sequence
  Description of Artificial Sequence: Synthetic peptide
  Seed: ALLERASAT (PRAME_HUMAN)
AVLERASAL

SEQ ID NO: 160480 - protein, 9 aa, Artificial Sequence
  Description of Artificial Sequence: Synthetic peptide
  Seed: LSHIHASSY (PRAME_HUMAN)
LYHIHASSV

SEQ ID NO: 160481 - protein, 9 aa, Artificial Sequence
  Description of Artificial Sequence: Synthetic peptide
  Seed: SMSVWTSPR (PRAME_HUMAN)
SMSVWTSPY

SEQ ID NO: 160482 - protein, 9 aa, Artificial Sequence
  Description of Artificial Sequence: Synthetic peptide
  Seed: VLMKGQHLH (PRAME_HUMAN)
VMMKGQHLY

SEQ ID NO: 160483 - protein, 11 aa, Artificial Sequence
  Description of Artificial Sequence: Synthetic peptide
  Seed: GTLHLERLAYL (PRAME_HUMAN)
GLLHLERLAYL

SEQ ID NO: 160484 - protein, 9 aa, Artificial Sequence
  Description of Artificial Sequence: Synthetic peptide
  Seed: FTCLPLGVL (PRAME_HUMAN)
FACLPLGVI

SEQ ID NO: 160485 - protein, 9 aa, Artificial Sequence
  Description of Artificial Sequence: Synthetic peptide
  Seed: KLKIFAMPM (PRAME_HUMAN)
KQKIFAMPH

SEQ ID NO: 160486 - protein, 9 aa, Artificial Sequence
  Description of Artificial Sequence: Synthetic peptide
  Seed: RRLWGSIQS (PRAME_HUMAN)
RRLWGSIQL

SEQ ID NO: 160487 - protein, 9 aa, Artificial Sequence
  Description of Artificial Sequence: Synthetic peptide
  Seed: HVMNPLETL (PRAME_HUMAN)
HIMNPLETF

SEQ ID NO: 160488 - protein, 9 aa, Artificial Sequence
  Description of Artificial Sequence: Synthetic peptide
  Seed: VFDECGITD (PRAME_HUMAN)
VYDECGITL

SEQ ID NO: 160489 - protein, 9 aa, Artificial Sequence
  Description of Artificial Sequence: Synthetic peptide
  Seed: YSFPEPEAA (PRAME_HUMAN)
YIFPEPEAH

SEQ ID NO: 160490 - protein, 9 aa, Artificial Sequence
  Description of Artificial Sequence: Synthetic peptide
  Seed: LSHIHASSY (PRAME_HUMAN)
LTHIHASSF

SEQ ID NO: 160491 - protein, 9 aa, Artificial Sequence
  Description of Artificial Sequence: Synthetic peptide
  Seed: SYEDIHGTL (PRAME_HUMAN)
SYEDIHGTY

SEQ ID NO: 160492 - protein, 11 aa, Artificial Sequence
  Description of Artificial Sequence: Synthetic peptide
  Seed: AAFDGRHSQTL (PRAME_HUMAN)
ARFDGRHSQTM

SEQ ID NO: 160493 - protein, 9 aa, Artificial Sequence
  Description of Artificial Sequence: Synthetic peptide
  Seed: SQSPSVSQL (PRAME_HUMAN)
SESPSVSQW

SEQ ID NO: 160494 - protein, 9 aa, Artificial Sequence
  Description of Artificial Sequence: Synthetic peptide
  Seed: SQSPSVSQL (PRAME_HUMAN)
SVSPSVSQV

SEQ ID NO: 160495 - protein, 9 aa, Artificial Sequence
  Description of Artificial Sequence: Synthetic peptide
  Seed: SYEDIHGTL (PRAME_HUMAN)
SFEDIHGTI

SEQ ID NO: 160496 - protein, 9 aa, Artificial Sequence
  Description of Artificial Sequence: Synthetic peptide
  Seed: FAMPMQDIK (PRAME_HUMAN)
FMMPMQDIR

SEQ ID NO: 160497 - protein, 9 aa, Artificial Sequence
  Description of Artificial Sequence: Synthetic peptide
  Seed: MPMQDIKMI (PRAME_HUMAN)
MVMQDIKMF

SEQ ID NO: 160498 - protein, 10 aa, Artificial Sequence
  Description of Artificial Sequence: Synthetic peptide
  Seed: FAMPMQDIKM (PRAME_HUMAN)
FMMPMQDIKI

SEQ ID NO: 160499 - protein, 10 aa, Artificial Sequence
  Description of Artificial Sequence: Synthetic peptide
  Seed: VLYPVPLESY (PRAME_HUMAN)
VRYPVPLESF

SEQ ID NO: 160500 - protein, 9 aa, Artificial Sequence
  Description of Artificial Sequence: Synthetic peptide
  Seed: GLSNLTHVL (PRAME_HUMAN)
GLSNLTHVA

SEQ ID NO: 160501 - protein, 10 aa, Artificial Sequence
  Description of Artificial Sequence: Synthetic peptide
  Seed: AAFDGRHSQT (PRAME_HUMAN)
AMFDGRHSQY

SEQ ID NO: 160502 - protein, 9 aa, Artificial Sequence
  Description of Artificial Sequence: Synthetic peptide
  Seed: GQHLHLETF (PRAME_HUMAN)
GFHLHLETL

SEQ ID NO: 160503 - protein, 9 aa, Artificial Sequence
  Description of Artificial Sequence: Synthetic peptide
  Seed: YSFPEPEAA (PRAME_HUMAN)
YMFPEPEAL

SEQ ID NO: 160504 - protein, 10 aa, Artificial Sequence
  Description of Artificial Sequence: Synthetic peptide
  Seed: FFLRGRLDQL (PRAME_HUMAN)
FGLRGRLDQA

SEQ ID NO: 160505 - protein, 9 aa, Artificial Sequence
  Description of Artificial Sequence: Synthetic peptide
  Seed: CKKLKIFAM (PRAME_HUMAN)
CMKLKIFAF

SEQ ID NO: 160506 - protein, 9 aa, Artificial Sequence
  Description of Artificial Sequence: Synthetic peptide
  Seed: LQALYVDSL (PRAME_HUMAN)
LIALYVDSV

SEQ ID NO: 160507 - protein, 11 aa, Artificial Sequence
  Description of Artificial Sequence: Synthetic peptide
  Seed: IAQFTSQFLSL (PRAME_HUMAN)
IIQFTSQFLSF

SEQ ID NO: 160508 - protein, 9 aa, Artificial Sequence
  Description of Artificial Sequence: Synthetic peptide
  Seed: LSLQCLQAL (PRAME_HUMAN)
LILQCLQAW

SEQ ID NO: 160509 - protein, 9 aa, Artificial Sequence
  Description of Artificial Sequence: Synthetic peptide
  Seed: IAALELLPR (PRAME_HUMAN)
IYALELLPR

SEQ ID NO: 160510 - protein, 9 aa, Artificial Sequence
  Description of Artificial Sequence: Synthetic peptide
  Seed: SLLQHLIGL (PRAME_HUMAN)
SILQHLIGK

SEQ ID NO: 160511 - protein, 9 aa, Artificial Sequence
  Description of Artificial Sequence: Synthetic peptide
  Seed: LLLSHIHAS (PRAME_HUMAN)
LLLSHIHAI

SEQ ID NO: 160512 - protein, 9 aa, Artificial Sequence
  Description of Artificial Sequence: Synthetic peptide
  Seed: SLLKDEALA (PRAME_HUMAN)
SVLKDEALV

SEQ ID NO: 160513 - protein, 10 aa, Artificial Sequence
  Description of Artificial Sequence: Synthetic peptide
  Seed: EALAIAALEL (PRAME_HUMAN)
EVLAIAALEV

SEQ ID NO: 160514 - protein, 9 aa, Artificial Sequence
  Description of Artificial Sequence: Synthetic peptide
  Seed: LLRHVMNPL (PRAME_HUMAN)
LERHVMNPM

SEQ ID NO: 160515 - protein, 9 aa, Artificial Sequence
  Description of Artificial Sequence: Synthetic peptide
  Seed: SISALQSLL (PRAME_HUMAN)
SQSALQSLI

SEQ ID NO: 160516 - protein, 9 aa, Artificial Sequence
  Description of Artificial Sequence: Synthetic peptide
  Seed: YPVPLESYE (PRAME_HUMAN)
YVVPLESYM

SEQ ID NO: 160517 - protein, 10 aa, Artificial Sequence
  Description of Artificial Sequence: Synthetic peptide
  Seed: AMVQAWPFTC (PRAME_HUMAN)
AEVQAWPFTV

SEQ ID NO: 160518 - protein, 10 aa, Artificial Sequence
  Description of Artificial Sequence: Synthetic peptide
  Seed: ITDDQLLALL (PRAME_HUMAN)
IADDQLLALM

SEQ ID NO: 160519 - protein, 9 aa, Artificial Sequence
  Description of Artificial Sequence: Synthetic peptide
  Seed: VSPEPLQAL (PRAME_HUMAN)
VTPEPLQAW

SEQ ID NO: 160520 - protein, 10 aa, Artificial Sequence
  Description of Artificial Sequence: Synthetic peptide
  Seed: ITDDQLLALL (PRAME_HUMAN)
IIDDQLLALM

SEQ ID NO: 160521 - protein, 9 aa, Artificial Sequence
  Description of Artificial Sequence: Synthetic peptide
  Seed: YSFPEPEAA (PRAME_HUMAN)
YYFPEPEAM

SEQ ID NO: 160522 - protein, 9 aa, Artificial Sequence
  Description of Artificial Sequence: Synthetic peptide
  Seed: SQFLSLQCL (PRAME_HUMAN)
SLFLSLQCV

SEQ ID NO: 160523 - protein, 9 aa, Artificial Sequence
  Description of Artificial Sequence: Synthetic peptide
  Seed: LGQMINLRR (PRAME_HUMAN)
LSQMINLRR

SEQ ID NO: 160524 - protein, 9 aa, Artificial Sequence
  Description of Artificial Sequence: Synthetic peptide
  Seed: ASSYISPEK (PRAME_HUMAN)
AASYISPEL

SEQ ID NO: 160525 - protein, 8 aa, Artificial Sequence
  Description of Artificial Sequence: Synthetic peptide
  Seed: AQFTSQFL (PRAME_HUMAN)
AQFTSQFI

SEQ ID NO: 160526 - protein, 9 aa, Artificial Sequence
  Description of Artificial Sequence: Synthetic peptide
  Seed: SPYLGQMIN (PRAME_HUMAN)
SPYLGQMIV

SEQ ID NO: 160527 - protein, 10 aa, Artificial Sequence
  Description of Artificial Sequence: Synthetic peptide
  Seed: FAMPMQDIKM (PRAME_HUMAN)
FLMPMQDIKV

SEQ ID NO: 160528 - protein, 10 aa, Artificial Sequence
  Description of Artificial Sequence: Synthetic peptide
  Seed: RRLWGSIQSR (PRAME_HUMAN)
RFLWGSIQSK

SEQ ID NO: 160529 - protein, 9 aa, Artificial Sequence
  Description of Artificial Sequence: Synthetic peptide
  Seed: RRWKLQVLD (PRAME_HUMAN)
RRWKLQVLL

SEQ ID NO: 160530 - protein, 10 aa, Artificial Sequence
  Description of Artificial Sequence: Synthetic peptide
  Seed: AQFTSQFLSL (PRAME_HUMAN)
AIFTSQFLSF

SEQ ID NO: 160531 - protein, 9 aa, Artificial Sequence
  Description of Artificial Sequence: Synthetic peptide
  Seed: ISISALQSL (PRAME_HUMAN)
IQISALQSV

SEQ ID NO: 160532 - protein, 9 aa, Artificial Sequence
  Description of Artificial Sequence: Synthetic peptide
  Seed: RTFYDPEPI (PRAME_HUMAN)
RIFYDPEPY

SEQ ID NO: 160533 - protein, 9 aa, Artificial Sequence
  Description of Artificial Sequence: Synthetic peptide
  Seed: ISISALQSL (PRAME_HUMAN)
IPISALQSM

SEQ ID NO: 160534 - protein, 9 aa, Artificial Sequence
  Description of Artificial Sequence: Synthetic peptide
  Seed: CKKLKIFAM (PRAME_HUMAN)
CQKLKIFAY

SEQ ID NO: 160535 - protein, 9 aa, Artificial Sequence
  Description of Artificial Sequence: Synthetic peptide
  Seed: YSFPEPEAA (PRAME_HUMAN)
YEFPEPEAF

SEQ ID NO: 160536 - protein, 9 aa, Artificial Sequence
  Description of Artificial Sequence: Synthetic peptide
  Seed: ISPEKEEQY (PRAME_HUMAN)
IVPEKEEQM

SEQ ID NO: 160537 - protein, 10 aa, Artificial Sequence
  Description of Artificial Sequence: Synthetic peptide
  Seed: RPRRWKLQVL (PRAME_HUMAN)
RRRRWKLQVF

SEQ ID NO: 160538 - protein, 9 aa, Artificial Sequence
  Description of Artificial Sequence: Synthetic peptide
  Seed: HVMNPLETL (PRAME_HUMAN)
HIMNPLETV

SEQ ID NO: 160539 - protein, 9 aa, Artificial Sequence
  Description of Artificial Sequence: Synthetic peptide
  Seed: GRLDQLLRH (PRAME_HUMAN)
GRLDQLLRY

SEQ ID NO: 160540 - protein, 10 aa, Artificial Sequence
  Description of Artificial Sequence: Synthetic peptide
  Seed: YGNSISISAL (PRAME_HUMAN)
YGNSISISAY

SEQ ID NO: 160541 - protein, 11 aa, Artificial Sequence
  Description of Artificial Sequence: Synthetic peptide
  Seed: MLTDVSPEPLQ (PRAME_HUMAN)
MMTDVSPEPLI

SEQ ID NO: 160542 - protein, 9 aa, Artificial Sequence
  Description of Artificial Sequence: Synthetic peptide
  Seed: LSLQCLQAL (PRAME_HUMAN)
LSLQCLQAW

SEQ ID NO: 160543 - protein, 10 aa, Artificial Sequence
  Description of Artificial Sequence: Synthetic peptide
  Seed: AVLDGLDVLL (PRAME_HUMAN)
ALLDGLDVLF

SEQ ID NO: 160544 - protein, 8 aa, Artificial Sequence
  Description of Artificial Sequence: Synthetic peptide
  Seed: FYDPEPIL (PRAME_HUMAN)
FSDPEPIM

SEQ ID NO: 160545 - protein, 9 aa, Artificial Sequence
  Description of Artificial Sequence: Synthetic peptide
  Seed: ALLERASAT (PRAME_HUMAN)
AMLERASAV

SEQ ID NO: 160546 - protein, 9 aa, Artificial Sequence
  Description of Artificial Sequence: Synthetic peptide
  Seed: LSEGDVMHL (PRAME_HUMAN)
LVEGDVMHL

SEQ ID NO: 160547 - protein, 10 aa, Artificial Sequence
  Description of Artificial Sequence: Synthetic peptide
  Seed: RLSEGDVMHL (PRAME_HUMAN)
RASEGDVMHL

SEQ ID NO: 160548 - protein, 9 aa, Artificial Sequence
  Description of Artificial Sequence: Synthetic peptide
  Seed: TDDQLLALL (PRAME_HUMAN)
TVDQLLALF

SEQ ID NO: 160549 - protein, 9 aa, Artificial Sequence
  Description of Artificial Sequence: Synthetic peptide
  Seed: ITDDQLLAL (PRAME_HUMAN)
IIDDQLLAV

SEQ ID NO: 160550 - protein, 9 aa, Artificial Sequence
  Description of Artificial Sequence: Synthetic peptide
  Seed: RRWKLQVLD (PRAME_HUMAN)
RRWKLQVLQ

SEQ ID NO: 160551 - protein, 10 aa, Artificial Sequence
  Description of Artificial Sequence: Synthetic peptide
  Seed: RHVMNPLETL (PRAME_HUMAN)
RVVMNPLETF

SEQ ID NO: 160552 - protein, 9 aa, Artificial Sequence
  Description of Artificial Sequence: Synthetic peptide
  Seed: LLERASATL (PRAME_HUMAN)
LLERASATY

SEQ ID NO: 160553 - protein, 9 aa, Artificial Sequence
  Description of Artificial Sequence: Synthetic peptide
  Seed: AVLDGLDVL (PRAME_HUMAN)
ALLDGLDVI

SEQ ID NO: 160554 - protein, 10 aa, Artificial Sequence
  Description of Artificial Sequence: Synthetic peptide
  Seed: TSQFLSLQCL (PRAME_HUMAN)
TFQFLSLQCF

SEQ ID NO: 160555 - protein, 10 aa, Artificial Sequence
  Description of Artificial Sequence: Synthetic peptide
  Seed: RELFPPLFMA (PRAME_HUMAN)
RNLFPPLFMI

SEQ ID NO: 160556 - protein, 9 aa, Artificial Sequence
  Description of Artificial Sequence: Synthetic peptide
  Seed: KFSPYLGQM (PRAME_HUMAN)
KFSPYLGQL

SEQ ID NO: 160557 - protein, 9 aa, Artificial Sequence
  Description of Artificial Sequence: Synthetic peptide
  Seed: LAIAALELL (PRAME_HUMAN)
LMIAALELV

SEQ ID NO: 160558 - protein, 10 aa, Artificial Sequence
  Description of Artificial Sequence: Synthetic peptide
  Seed: SVLSLSGVML (PRAME_HUMAN)
STLSLSGVMV

SEQ ID NO: 160559 - protein, 10 aa, Artificial Sequence
  Description of Artificial Sequence: Synthetic peptide
  Seed: RLAYLHARLR (PRAME_HUMAN)
RLAYLHARLI

SEQ ID NO: 160560 - protein, 10 aa, Artificial Sequence
  Description of Artificial Sequence: Synthetic peptide
  Seed: GACDELFSYL (PRAME_HUMAN)
GMCDELFSYA

SEQ ID NO: 160561 - protein, 9 aa, Artificial Sequence
  Description of Artificial Sequence: Synthetic peptide
  Seed: VLMKGQHLH (PRAME_HUMAN)
VVMKGQHLF

SEQ ID NO: 160562 - protein, 9 aa, Artificial Sequence
  Description of Artificial Sequence: Synthetic peptide
  Seed: QSRYISMSV (PRAME_HUMAN)
QMRYISMSV

SEQ ID NO: 160563 - protein, 10 aa, Artificial Sequence
  Description of Artificial Sequence: Synthetic peptide
  Seed: SALQSLLQHL (PRAME_HUMAN)
SILQSLLQHA

SEQ ID NO: 160564 - protein, 10 aa, Artificial Sequence
  Description of Artificial Sequence: Synthetic peptide
  Seed: KKLKIFAMPM (PRAME_HUMAN)
KVLKIFAMPY

SEQ ID NO: 160565 - protein, 10 aa, Artificial Sequence
  Description of Artificial Sequence: Synthetic peptide
  Seed: HLERLAYLHA (PRAME_HUMAN)
HTERLAYLHK

SEQ ID NO: 160566 - protein, 9 aa, Artificial Sequence
  Description of Artificial Sequence: Synthetic peptide
  Seed: LFMAAFDGR (PRAME_HUMAN)
LVMAAFDGR

SEQ ID NO: 160567 - protein, 11 aa, Artificial Sequence
  Description of Artificial Sequence: Synthetic peptide
  Seed: RRWKLQVLDLR (PRAME_HUMAN)
RRWKLQVLDLT

SEQ ID NO: 160568 - protein, 10 aa, Artificial Sequence
  Description of Artificial Sequence: Synthetic peptide
  Seed: PTLAKFSPYL (PRAME_HUMAN)
PRLAKFSPYV

SEQ ID NO: 160569 - protein, 10 aa, Artificial Sequence
  Description of Artificial Sequence: Synthetic peptide
  Seed: LSHIHASSYI (PRAME_HUMAN)
LVHIHASSYW

SEQ ID NO: 160570 - protein, 10 aa, Artificial Sequence
  Description of Artificial Sequence: Synthetic peptide
  Seed: KDEALAIAAL (PRAME_HUMAN)
KMEALAIAAL

SEQ ID NO: 160571 - protein, 9 aa, Artificial Sequence
  Description of Artificial Sequence: Synthetic peptide
  Seed: FYDPEPILC (PRAME_HUMAN)
FFDPEPILI

SEQ ID NO: 160572 - protein, 9 aa, Artificial Sequence
  Description of Artificial Sequence: Synthetic peptide
  Seed: HLHLETFKA (PRAME_HUMAN)
HLHLETFKI

SEQ ID NO: 160573 - protein, 9 aa, Artificial Sequence
  Description of Artificial Sequence: Synthetic peptide
  Seed: LLALLPSLS (PRAME_HUMAN)
LMALLPSLI

SEQ ID NO: 160574 - protein, 9 aa, Artificial Sequence
  Description of Artificial Sequence: Synthetic peptide
  Seed: LALLPSLSH (PRAME_HUMAN)
LTLLPSLSY

SEQ ID NO: 160575 - protein, 9 aa, Artificial Sequence
  Description of Artificial Sequence: Synthetic peptide
  Seed: ISISALQSL (PRAME_HUMAN)
IHISALQSY

SEQ ID NO: 160576 - protein, 9 aa, Artificial Sequence
  Description of Artificial Sequence: Synthetic peptide
  Seed: LDVLLAQEV (PRAME_HUMAN)
LEVLLAQEI

SEQ ID NO: 160577 - protein, 10 aa, Artificial Sequence
  Description of Artificial Sequence: Synthetic peptide
  Seed: ISMSVWTSPR (PRAME_HUMAN)
IVMSVWTSPR

SEQ ID NO: 160578 - protein, 9 aa, Artificial Sequence
  Description of Artificial Sequence: Synthetic peptide
  Seed: LTDVSPEPL (PRAME_HUMAN)
LSDVSPEPM

SEQ ID NO: 160579 - protein, 10 aa, Artificial Sequence
  Description of Artificial Sequence: Synthetic peptide
  Seed: LLPRELFPPL (PRAME_HUMAN)
LIPRELFPPV

SEQ ID NO: 160580 - protein, 9 aa, Artificial Sequence
  Description of Artificial Sequence: Synthetic peptide
  Seed: RHSQTLKAM (PRAME_HUMAN)
RKSQTLKAF

SEQ ID NO: 160581 - protein, 11 aa, Artificial Sequence
  Description of Artificial Sequence: Synthetic peptide
  Seed: MKGQHLHLETF (PRAME_HUMAN)
MGGQHLHLETF

SEQ ID NO: 160582 - protein, 10 aa, Artificial Sequence
  Description of Artificial Sequence: Synthetic peptide
  Seed: LQALYVDSLF (PRAME_HUMAN)
LQALYVDSLW

SEQ ID NO: 160583 - protein, 10 aa, Artificial Sequence
  Description of Artificial Sequence: Synthetic peptide
  Seed: ESYEDIHGTL (PRAME_HUMAN)
EAYEDIHGTW

SEQ ID NO: 160584 - protein, 9 aa, Artificial Sequence
  Description of Artificial Sequence: Synthetic peptide
  Seed: RLRELLCEL (PRAME_HUMAN)
RSRELLCEI

SEQ ID NO: 160585 - protein, 9 aa, Artificial Sequence
  Description of Artificial Sequence: Synthetic peptide
  Seed: DVLLAQEVR (PRAME_HUMAN)
DTLLAQEVR

SEQ ID NO: 160586 - protein, 9 aa, Artificial Sequence
  Description of Artificial Sequence: Synthetic peptide
  Seed: SQSPSVSQL (PRAME_HUMAN)
SVSPSVSQY

SEQ ID NO: 160587 - protein, 9 aa, Artificial Sequence
  Description of Artificial Sequence: Synthetic peptide
  Seed: YLHARLREL (PRAME_HUMAN)
YFHARLREM

SEQ ID NO: 160588 - protein, 9 aa, Artificial Sequence
  Description of Artificial Sequence: Synthetic peptide
  Seed: KAMVQAWPF (PRAME_HUMAN)
KQMVQAWPI

SEQ ID NO: 160589 - protein, 10 aa, Artificial Sequence
  Description of Artificial Sequence: Synthetic peptide
  Seed: HCSQLTTLSF (PRAME_HUMAN)
HISQLTTLSW

SEQ ID NO: 160590 - protein, 10 aa, Artificial Sequence
  Description of Artificial Sequence: Synthetic peptide
  Seed: FIPVEVLVDL (PRAME_HUMAN)
FCPVEVLVDM

SEQ ID NO: 160591 - protein, 11 aa, Artificial Sequence
  Description of Artificial Sequence: Synthetic peptide
  Seed: AAFDGRHSQTL (PRAME_HUMAN)
AAFDGRHSQTH

SEQ ID NO: 160592 - protein, 10 aa, Artificial Sequence
  Description of Artificial Sequence: Synthetic peptide
  Seed: GLSNLTHVLY (PRAME_HUMAN)
GTSNLTHVLW

SEQ ID NO: 160593 - protein, 9 aa, Artificial Sequence
  Description of Artificial Sequence: Synthetic peptide
  Seed: YIAQFTSQF (PRAME_HUMAN)
YQAQFTSQI

SEQ ID NO: 160594 - protein, 8 aa, Artificial Sequence
  Description of Artificial Sequence: Synthetic peptide
  Seed: VSPEPLQA (PRAME_HUMAN)
VAPEPLQI

SEQ ID NO: 160595 - protein, 10 aa, Artificial Sequence
  Description of Artificial Sequence: Synthetic peptide
  Seed: LLLSHIHASS (PRAME_HUMAN)
LLLSHIHASL

SEQ ID NO: 160596 - protein, 9 aa, Artificial Sequence
  Description of Artificial Sequence: Synthetic peptide
  Seed: LLLSHIHAS (PRAME_HUMAN)
LNLSHIHAV

SEQ ID NO: 160597 - protein, 9 aa, Artificial Sequence
  Description of Artificial Sequence: Synthetic peptide
  Seed: RELFPPLFM (PRAME_HUMAN)
RMLFPPLFF

SEQ ID NO: 160598 - protein, 9 aa, Artificial Sequence
  Description of Artificial Sequence: Synthetic peptide
  Seed: KLKIFAMPM (PRAME_HUMAN)
KFKIFAMPA

SEQ ID NO: 160599 - protein, 10 aa, Artificial Sequence
  Description of Artificial Sequence: Synthetic peptide
  Seed: QLLALLPSLS (PRAME_HUMAN)
QMLALLPSLI

SEQ ID NO: 160600 - protein, 9 aa, Artificial Sequence
  Description of Artificial Sequence: Synthetic peptide
  Seed: RWKLQVLDL (PRAME_HUMAN)
RVKLQVLDI

SEQ ID NO: 160601 - protein, 9 aa, Artificial Sequence
  Description of Artificial Sequence: Synthetic peptide
  Seed: SIEDLEVTC (PRAME_HUMAN)
SAEDLEVTI

SEQ ID NO: 160602 - protein, 9 aa, Artificial Sequence
  Description of Artificial Sequence: Synthetic peptide
  Seed: ACDELFSYL (PRAME_HUMAN)
AQDELFSYV

SEQ ID NO: 160603 - protein, 10 aa, Artificial Sequence
  Description of Artificial Sequence: Synthetic peptide
  Seed: RELFPPLFMA (PRAME_HUMAN)
RCLFPPLFML

SEQ ID NO: 160604 - protein, 10 aa, Artificial Sequence
  Description of Artificial Sequence: Synthetic peptide
  Seed: LYVDSLFFLR (PRAME_HUMAN)
LHVDSLFFLR

SEQ ID NO: 160605 - protein, 11 aa, Artificial Sequence
  Description of Artificial Sequence: Synthetic peptide
  Seed: HLIGLSNLTHV (PRAME_HUMAN)
HMIGLSNLTHV

SEQ ID NO: 160606 - protein, 9 aa, Artificial Sequence
  Description of Artificial Sequence: Synthetic peptide
  Seed: LDQLLRHVM (PRAME_HUMAN)
LEQLLRHVM

SEQ ID NO: 160607 - protein, 10 aa, Artificial Sequence
  Description of Artificial Sequence: Synthetic peptide
  Seed: SLLKDEALAI (PRAME_HUMAN)
SELKDEALAV

SEQ ID NO: 160608 - protein, 9 aa, Artificial Sequence
  Description of Artificial Sequence: Synthetic peptide
  Seed: LLKDEALAI (PRAME_HUMAN)
LMKDEALAF

SEQ ID NO: 160609 - protein, 10 aa, Artificial Sequence
  Description of Artificial Sequence: Synthetic peptide
  Seed: AVLDGLDVLL (PRAME_HUMAN)
AILDGLDVLA

SEQ ID NO: 160610 - protein, 10 aa, Artificial Sequence
  Description of Artificial Sequence: Synthetic peptide
  Seed: EDLEVTCTWK (PRAME_HUMAN)
ESLEVTCTWR

SEQ ID NO: 160611 - protein, 9 aa, Artificial Sequence
  Description of Artificial Sequence: Synthetic peptide
  Seed: VQAWPFTCL (PRAME_HUMAN)
VIAWPFTCL

SEQ ID NO: 160612 - protein, 11 aa, Artificial Sequence
  Description of Artificial Sequence: Synthetic peptide
  Seed: RRLVELAGQSL (PRAME_HUMAN)
RRLVELAGQSI

SEQ ID NO: 160613 - protein, 9 aa, Artificial Sequence
  Description of Artificial Sequence: Synthetic peptide
  Seed: SALQSLLQH (PRAME_HUMAN)
SQLQSLLQL

SEQ ID NO: 160614 - protein, 9 aa, Artificial Sequence
  Description of Artificial Sequence: Synthetic peptide
  Seed: SQLSVLSLS (PRAME_HUMAN)
STLSVLSLA

SEQ ID NO: 160615 - protein, 9 aa, Artificial Sequence
  Description of Artificial Sequence: Synthetic peptide
  Seed: YGNSISISA (PRAME_HUMAN)
YTNSISISV

SEQ ID NO: 160616 - protein, 9 aa, Artificial Sequence
  Description of Artificial Sequence: Synthetic peptide
  Seed: KLKIFAMPM (PRAME_HUMAN)
KSKIFAMPE

SEQ ID NO: 160617 - protein, 10 aa, Artificial Sequence
  Description of Artificial Sequence: Synthetic peptide
  Seed: ARLRELLCEL (PRAME_HUMAN)
ASLRELLCEI

SEQ ID NO: 160618 - protein, 10 aa, Artificial Sequence
  Description of Artificial Sequence: Synthetic peptide
  Seed: FYDPEPILCP (PRAME_HUMAN)
FFDPEPILCI

SEQ ID NO: 160619 - protein, 9 aa, Artificial Sequence
  Description of Artificial Sequence: Synthetic peptide
  Seed: LSLQCLQAL (PRAME_HUMAN)
LTLQCLQAF

SEQ ID NO: 160620 - protein, 10 aa, Artificial Sequence
  Description of Artificial Sequence: Synthetic peptide
  Seed: TSQFLSLQCL (PRAME_HUMAN)
TCQFLSLQCF

SEQ ID NO: 160621 - protein, 8 aa, Artificial Sequence
  Description of Artificial Sequence: Synthetic peptide
  Seed: SPRRLVEL (PRAME_HUMAN)
SPRRLVEV

SEQ ID NO: 160622 - protein, 9 aa, Artificial Sequence
  Description of Artificial Sequence: Synthetic peptide
  Seed: LAIAALELL (PRAME_HUMAN)
LQIAALELI

SEQ ID NO: 160623 - protein, 9 aa, Artificial Sequence
  Description of Artificial Sequence: Synthetic peptide
  Seed: TSPRRLVEL (PRAME_HUMAN)
TPPRRLVEM

SEQ ID NO: 160624 - protein, 10 aa, Artificial Sequence
  Description of Artificial Sequence: Synthetic peptide
  Seed: RGRLDQLLRH (PRAME_HUMAN)
RFRLDQLLRK

SEQ ID NO: 160625 - protein, 9 aa, Artificial Sequence
  Description of Artificial Sequence: Synthetic peptide
  Seed: TLAKFSPYL (PRAME_HUMAN)
TQAKFSPYI

SEQ ID NO: 160626 - protein, 10 aa, Artificial Sequence
  Description of Artificial Sequence: Synthetic peptide
  Seed: VLMKGQHLHL (PRAME_HUMAN)
VMMKGQHLHV

SEQ ID NO: 160627 - protein, 9 aa, Artificial Sequence
  Description of Artificial Sequence: Synthetic peptide
  Seed: ISISALQSL (PRAME_HUMAN)
INISALQSF

SEQ ID NO: 160628 - protein, 9 aa, Artificial Sequence
  Description of Artificial Sequence: Synthetic peptide
  Seed: KLKIFAMPM (PRAME_HUMAN)
KTKIFAMPH

SEQ ID NO: 160629 - protein, 9 aa, Artificial Sequence
  Description of Artificial Sequence: Synthetic peptide
  Seed: WKLPTLAKF (PRAME_HUMAN)
WILPTLAKF

SEQ ID NO: 160630 - protein, 10 aa, Artificial Sequence
  Description of Artificial Sequence: Synthetic peptide
  Seed: IQSRYISMSV (PRAME_HUMAN)
IFSRYISMSK

SEQ ID NO: 160631 - protein, 9 aa, Artificial Sequence
  Description of Artificial Sequence: Synthetic peptide
  Seed: SIQSRYISM (PRAME_HUMAN)
SWQSRYISF

SEQ ID NO: 160632 - protein, 9 aa, Artificial Sequence
  Description of Artificial Sequence: Synthetic peptide
  Seed: HVMNPLETL (PRAME_HUMAN)
HAMNPLETW

SEQ ID NO: 160633 - protein, 9 aa, Artificial Sequence
  Description of Artificial Sequence: Synthetic peptide
  Seed: SFYGNSISI (PRAME_HUMAN)
SLYGNSISL

SEQ ID NO: 160634 - protein, 8 aa, Artificial Sequence
  Description of Artificial Sequence: Synthetic peptide
  Seed: FSYLIEKV (PRAME_HUMAN)
FEYLIEKL

SEQ ID NO: 160635 - protein, 9 aa, Artificial Sequence
  Description of Artificial Sequence: Synthetic peptide
  Seed: LYPVPLESY (PRAME_HUMAN)
LFPVPLESY

SEQ ID NO: 160636 - protein, 9 aa, Artificial Sequence
  Description of Artificial Sequence: Synthetic peptide
  Seed: LLSHIHASS (PRAME_HUMAN)
LLSHIHASA

SEQ ID NO: 160637 - protein, 9 aa, Artificial Sequence
  Description of Artificial Sequence: Synthetic peptide
  Seed: KAMVQAWPF (PRAME_HUMAN)
KKMVQAWPY

SEQ ID NO: 160638 - protein, 9 aa, Artificial Sequence
  Description of Artificial Sequence: Synthetic peptide
  Seed: MHLSQSPSV (PRAME_HUMAN)
MMLSQSPSI

SEQ ID NO: 160639 - protein, 9 aa, Artificial Sequence
  Description of Artificial Sequence: Synthetic peptide
  Seed: KAMVQAWPF (PRAME_HUMAN)
KSMVQAWPM

SEQ ID NO: 160640 - protein, 9 aa, Artificial Sequence
  Description of Artificial Sequence: Synthetic peptide
  Seed: KMILKMVQL (PRAME_HUMAN)
KYILKMVQY

SEQ ID NO: 160641 - protein, 9 aa, Artificial Sequence
  Description of Artificial Sequence: Synthetic peptide
  Seed: RLWGSIQSR (PRAME_HUMAN)
RAWGSIQSR

SEQ ID NO: 160642 - protein, 10 aa, Artificial Sequence
  Description of Artificial Sequence: Synthetic peptide
  Seed: DRTFYDPEPI (PRAME_HUMAN)
DCTFYDPEPV

SEQ ID NO: 160643 - protein, 9 aa, Artificial Sequence
  Description of Artificial Sequence: Synthetic peptide
  Seed: VFDECGITD (PRAME_HUMAN)
VFDECGITA

SEQ ID NO: 160644 - protein, 9 aa, Artificial Sequence
  Description of Artificial Sequence: Synthetic peptide
  Seed: NSHQDFWTV (PRAME_HUMAN)
NVHQDFWTI

SEQ ID NO: 160645 - protein, 10 aa, Artificial Sequence
  Description of Artificial Sequence: Synthetic peptide
  Seed: HCSQLTTLSF (PRAME_HUMAN)
HHSQLTTLSW

SEQ ID NO: 160646 - protein, 9 aa, Artificial Sequence
  Description of Artificial Sequence: Synthetic peptide
  Seed: GQHLHLETF (PRAME_HUMAN)
GHHLHLETV

SEQ ID NO: 160647 - protein, 10 aa, Artificial Sequence
  Description of Artificial Sequence: Synthetic peptide
  Seed: SEGDVMHLSQ (PRAME_HUMAN)
SEGDVMHLSL

SEQ ID NO: 160648 - protein, 9 aa, Artificial Sequence
  Description of Artificial Sequence: Synthetic peptide
  Seed: ESYEDIHGT (PRAME_HUMAN)
ESYEDIHGA

SEQ ID NO: 160649 - protein, 10 aa, Artificial Sequence
  Description of Artificial Sequence: Synthetic peptide
  Seed: ESYEDIHGTL (PRAME_HUMAN)
ESYEDIHGTV

SEQ ID NO: 160650 - protein, 10 aa, Artificial Sequence
  Description of Artificial Sequence: Synthetic peptide
  Seed: SPYLGQMINL (PRAME_HUMAN)
SQYLGQMINF

SEQ ID NO: 160651 - protein, 9 aa, Artificial Sequence
  Description of Artificial Sequence: Synthetic peptide
  Seed: YISMSVWTS (PRAME_HUMAN)
YISMSVWTI

SEQ ID NO: 160652 - protein, 10 aa, Artificial Sequence
  Description of Artificial Sequence: Synthetic peptide
  Seed: VDSLFFLRGR (PRAME_HUMAN)
VMSLFFLRGR

SEQ ID NO: 160653 - protein, 9 aa, Artificial Sequence
  Description of Artificial Sequence: Synthetic peptide
  Seed: ELFPPLFMA (PRAME_HUMAN)
ELFPPLFMI

SEQ ID NO: 160654 - protein, 10 aa, Artificial Sequence
  Description of Artificial Sequence: Synthetic peptide
  Seed: FFLRGRLDQL (PRAME_HUMAN)
FVLRGRLDQA

SEQ ID NO: 160655 - protein, 10 aa, Artificial Sequence
  Description of Artificial Sequence: Synthetic peptide
  Seed: RELFPPLFMA (PRAME_HUMAN)
RYLFPPLFMI

SEQ ID NO: 160656 - protein, 9 aa, Artificial Sequence
  Description of Artificial Sequence: Synthetic peptide
  Seed: GNRASLYSF (PRAME_HUMAN)
GMRASLYSF

SEQ ID NO: 160657 - protein, 9 aa, Artificial Sequence
  Description of Artificial Sequence: Synthetic peptide
  Seed: LSVLSLSGV (PRAME_HUMAN)
LLVLSLSGV

SEQ ID NO: 160658 - protein, 10 aa, Artificial Sequence
  Description of Artificial Sequence: Synthetic peptide
  Seed: KKLKIFAMPM (PRAME_HUMAN)
KKLKIFAMPY

SEQ ID NO: 160659 - protein, 10 aa, Artificial Sequence
  Description of Artificial Sequence: Synthetic peptide
  Seed: RLAYLHARLR (PRAME_HUMAN)
RRAYLHARLK

SEQ ID NO: 160660 - protein, 10 aa, Artificial Sequence
  Description of Artificial Sequence: Synthetic peptide
  Seed: GLSNLTHVLY (PRAME_HUMAN)
GLSNLTHVLM

SEQ ID NO: 160661 - protein, 8 aa, Artificial Sequence
  Description of Artificial Sequence: Synthetic peptide
  Seed: DQLLRHVM (PRAME_HUMAN)
DLLLRHVM

SEQ ID NO: 160662 - protein, 10 aa, Artificial Sequence
  Description of Artificial Sequence: Synthetic peptide
  Seed: MVQAWPFTCL (PRAME_HUMAN)
MMQAWPFTCF

SEQ ID NO: 160663 - protein, 9 aa, Artificial Sequence
  Description of Artificial Sequence: Synthetic peptide
  Seed: YLIEKVKRK (PRAME_HUMAN)
YMIEKVKRM

SEQ ID NO: 160664 - protein, 9 aa, Artificial Sequence
  Description of Artificial Sequence: Synthetic peptide
  Seed: LSLQCLQAL (PRAME_HUMAN)
LILQCLQAF

SEQ ID NO: 160665 - protein, 9 aa, Artificial Sequence
  Description of Artificial Sequence: Synthetic peptide
  Seed: SHIHASSYI (PRAME_HUMAN)
SAIHASSYF

SEQ ID NO: 160666 - protein, 9 aa, Artificial Sequence
  Description of Artificial Sequence: Synthetic peptide
  Seed: VSPEPLQAL (PRAME_HUMAN)
VWPEPLQAM

SEQ ID NO: 160667 - protein, 10 aa, Artificial Sequence
  Description of Artificial Sequence: Synthetic peptide
  Seed: ISMSVWTSPR (PRAME_HUMAN)
IMMSVWTSPK

SEQ ID NO: 160668 - protein, 10 aa, Artificial Sequence
  Description of Artificial Sequence: Synthetic peptide
  Seed: GITDDQLLAL (PRAME_HUMAN)
GQTDDQLLAV

SEQ ID NO: 160669 - protein, 9 aa, Artificial Sequence
  Description of Artificial Sequence: Synthetic peptide
  Seed: KAMVQAWPF (PRAME_HUMAN)
KTMVQAWPY

SEQ ID NO: 160670 - protein, 10 aa, Artificial Sequence
  Description of Artificial Sequence: Synthetic peptide
  Seed: RLSEGDVMHL (PRAME_HUMAN)
RASEGDVMHW

SEQ ID NO: 160671 - protein, 10 aa, Artificial Sequence
  Description of Artificial Sequence: Synthetic peptide
  Seed: CCKKLKIFAM (PRAME_HUMAN)
CLKKLKIFAM

SEQ ID NO: 160672 - protein, 10 aa, Artificial Sequence
  Description of Artificial Sequence: Synthetic peptide
  Seed: KDEALAIAAL (PRAME_HUMAN)
KKEALAIAAA

SEQ ID NO: 160673 - protein, 10 aa, Artificial Sequence
  Description of Artificial Sequence: Synthetic peptide
  Seed: VMNPLETLSI (PRAME_HUMAN)
VINPLETLSF

SEQ ID NO: 160674 - protein, 9 aa, Artificial Sequence
  Description of Artificial Sequence: Synthetic peptide
  Seed: ITDDQLLAL (PRAME_HUMAN)
ITDDQLLAW

SEQ ID NO: 160675 - protein, 8 aa, Homo sapiens
  Native (PRAME_HUMAN)
LHLERLAY

SEQ ID NO: 160676 - protein, 8 aa, Homo sapiens
  Native (PRAME_HUMAN)
LDQLLRHV

SEQ ID NO: 160677 - protein, 10 aa, Homo sapiens
  Native (PRAME_HUMAN)
QHLHLETFKA

SEQ ID NO: 160678 - protein, 8 aa, Homo sapiens
  Native (PRAME_HUMAN)
HLSQSPSV

SEQ ID NO: 160679 - protein, 8 aa, Homo sapiens
  Native (PRAME_HUMAN)
LAIAALEL

SEQ ID NO: 160680 - protein, 9 aa, Homo sapiens
  Native (PRAME_HUMAN)
TCLPLGVLM

SEQ ID NO: 160681 - protein, 9 aa, Homo sapiens
  Native (PRAME_HUMAN)
AWPFTCLPL

SEQ ID NO: 160682 - protein, 9 aa, Homo sapiens
  Native (PRAME_HUMAN)
VWTSPRRLV

SEQ ID NO: 160683 - protein, 10 aa, Homo sapiens
  Native (PRAME_HUMAN)
QALYVDSLFF

SEQ ID NO: 160684 - protein, 10 aa, Homo sapiens
  Native (PRAME_HUMAN)
RLWGSIQSRY

SEQ ID NO: 160685 - protein, 10 aa, Homo sapiens
  Native (PRAME_HUMAN)
ISISALQSLL

SEQ ID NO: 160686 - protein, 10 aa, Homo sapiens
  Native (PRAME_HUMAN)
MVQAWPFTCL

SEQ ID NO: 160687 - protein, 11 aa, Homo sapiens
  Native (PRAME_HUMAN)
KEEQYIAQFTS

SEQ ID NO: 160688 - protein, 8 aa, Homo sapiens
  Native (PRAME_HUMAN)
RELFPPLF

SEQ ID NO: 160689 - protein, 8 aa, Homo sapiens
  Native (PRAME_HUMAN)
QPFIPVEV

SEQ ID NO: 160690 - protein, 9 aa, Homo sapiens
  Native (PRAME_HUMAN)
LQALYVDSL

SEQ ID NO: 160691 - protein, 10 aa, Homo sapiens
  Native (PRAME_HUMAN)
FAMPMQDIKM

SEQ ID NO: 160692 - protein, 9 aa, Homo sapiens
  Native (PRAME_HUMAN)
RRWKLQVLD

SEQ ID NO: 160693 - protein, 9 aa, Homo sapiens
  Native (PRAME_HUMAN)
FWTVWSGNR

SEQ ID NO: 160694 - protein, 11 aa, Homo sapiens
  Native (PRAME_HUMAN)
LAIAALELLPR

SEQ ID NO: 160695 - protein, 9 aa, Homo sapiens
  Native (PRAME_HUMAN)
LKMVQLDSI

SEQ ID NO: 160696 - protein, 11 aa, Homo sapiens
  Native (PRAME_HUMAN)
LQSLLQHLIGL

SEQ ID NO: 160697 - protein, 10 aa, Homo sapiens
  Native (PRAME_HUMAN)
SPEKEEQYIA

SEQ ID NO: 160698 - protein, 8 aa, Homo sapiens
  Native (PRAME_HUMAN)
ALYVDSLF

SEQ ID NO: 160699 - protein, 11 aa, Homo sapiens
  Native (PRAME_HUMAN)
SMSVWTSPRRL

SEQ ID NO: 160700 - protein, 9 aa, Homo sapiens
  Native (PRAME_HUMAN)
NVLRLCCKK

SEQ ID NO: 160701 - protein, 10 aa, Homo sapiens
  Native (PRAME_HUMAN)
RLSEGDVMHL

SEQ ID NO: 160702 - protein, 10 aa, Homo sapiens
  Native (PRAME_HUMAN)
LETLSITNCR

SEQ ID NO: 160703 - protein, 11 aa, Homo sapiens
  Native (PRAME_HUMAN)
LERLAYLHARL

SEQ ID NO: 160704 - protein, 10 aa, Homo sapiens
  Native (PRAME_HUMAN)
KNVLRLCCKK

SEQ ID NO: 160705 - protein, 10 aa, Homo sapiens
  Native (PRAME_HUMAN)
RTFYDPEPIL

SEQ ID NO: 160706 - protein, 10 aa, Homo sapiens
  Native (PRAME_HUMAN)
KEEQYIAQFT

SEQ ID NO: 160707 - protein, 9 aa, Homo sapiens
  Native (PRAME_HUMAN)
RRRLWGSIQ

SEQ ID NO: 160708 - protein, 9 aa, Homo sapiens
  Native (PRAME_HUMAN)
QALLERASA

SEQ ID NO: 160709 - protein, 9 aa, Homo sapiens
  Native (PRAME_HUMAN)
AEQPFIPVE

SEQ ID NO: 160710 - protein, 9 aa, Homo sapiens
  Native (PRAME_HUMAN)
SALQSLLQH

SEQ ID NO: 160711 - protein, 11 aa, Homo sapiens
  Native (PRAME_HUMAN)
AALELLPRELF

SEQ ID NO: 160712 - protein, 9 aa, Homo sapiens
  Native (PRAME_HUMAN)
RELLCELGR

SEQ ID NO: 160713 - protein, 9 aa, Homo sapiens
  Native (PRAME_HUMAN)
RLAYLHARL

SEQ ID NO: 160714 - protein, 10 aa, Homo sapiens
  Native (PRAME_HUMAN)
HCSQLTTLSF

SEQ ID NO: 160715 - protein, 8 aa, Homo sapiens
  Native (PRAME_HUMAN)
KKLKIFAM

SEQ ID NO: 160716 - protein, 8 aa, Homo sapiens
  Native (PRAME_HUMAN)
LLALLPSL

SEQ ID NO: 160717 - protein, 10 aa, Homo sapiens
  Native (PRAME_HUMAN)
NSHQDFWTVW

SEQ ID NO: 160718 - protein, 10 aa, Homo sapiens
  Native (PRAME_HUMAN)
IEDLEVTCTW

SEQ ID NO: 160719 - protein, 8 aa, Homo sapiens
  Native (PRAME_HUMAN)
FSPYLGQM

SEQ ID NO: 160720 - protein, 8 aa, Homo sapiens
  Native (PRAME_HUMAN)
QEVRPRRW

SEQ ID NO: 160721 - protein, 11 aa, Homo sapiens
  Native (PRAME_HUMAN)
HVMNPLETLSI

SEQ ID NO: 160722 - protein, 10 aa, Homo sapiens
  Native (PRAME_HUMAN)
FFLRGRLDQL

SEQ ID NO: 160723 - protein, 9 aa, Homo sapiens
  Native (PRAME_HUMAN)
RWKLQVLDL

SEQ ID NO: 160724 - protein, 10 aa, Homo sapiens
  Native (PRAME_HUMAN)
RLCCKKLKIF

SEQ ID NO: 160725 - protein, 10 aa, Homo sapiens
  Native (PRAME_HUMAN)
AALELLPREL

SEQ ID NO: 160726 - protein, 9 aa, Homo sapiens
  Native (PRAME_HUMAN)
LQCLQALYV

SEQ ID NO: 160727 - protein, 8 aa, Homo sapiens
  Native (PRAME_HUMAN)
SVSQLSVL

SEQ ID NO: 160728 - protein, 10 aa, Homo sapiens
  Native (PRAME_HUMAN)
LLKDEALAIA

SEQ ID NO: 160729 - protein, 9 aa, Homo sapiens
  Native (PRAME_HUMAN)
QPFIPVEVL

SEQ ID NO: 160730 - protein, 10 aa, Homo sapiens
  Native (PRAME_HUMAN)
EGACDELFSY

SEQ ID NO: 160731 - protein, 9 aa, Homo sapiens
  Native (PRAME_HUMAN)
TFYDPEPIL

SEQ ID NO: 160732 - protein, 9 aa, Homo sapiens
  Native (PRAME_HUMAN)
SHQDFWTVW

SEQ ID NO: 160733 - protein, 9 aa, Homo sapiens
  Native (PRAME_HUMAN)
LGRPSMVWL

SEQ ID NO: 160734 - protein, 9 aa, Homo sapiens
  Native (PRAME_HUMAN)
DLEVTCTWK

SEQ ID NO: 160735 - protein, 9 aa, Homo sapiens
  Native (PRAME_HUMAN)
FYDPEPILC

SEQ ID NO: 160736 - protein, 9 aa, Homo sapiens
  Native (PRAME_HUMAN)
VWSGNRASL

SEQ ID NO: 160737 - protein, 9 aa, Homo sapiens
  Native (PRAME_HUMAN)
GQHLHLETF

SEQ ID NO: 160738 - protein, 9 aa, Homo sapiens
  Native (PRAME_HUMAN)
VLYPVPLES

SEQ ID NO: 160739 - protein, 9 aa, Homo sapiens
  Native (PRAME_HUMAN)
RHSQTLKAM

SEQ ID NO: 160740 - protein, 10 aa, Homo sapiens
  Native (PRAME_HUMAN)
QLSVLSLSGV

SEQ ID NO: 160741 - protein, 8 aa, Homo sapiens
  Native (PRAME_HUMAN)
DDQLLALL

SEQ ID NO: 160742 - protein, 10 aa, Homo sapiens
  Native (PRAME_HUMAN)
EDLEVTCTWK

SEQ ID NO: 160743 - protein, 9 aa, Homo sapiens
  Native (PRAME_HUMAN)
LQDLVFDEC

SEQ ID NO: 160744 - protein, 8 aa, Homo sapiens
  Native (PRAME_HUMAN)
SEGDVMHL

SEQ ID NO: 160745 - protein, 9 aa, Homo sapiens
  Native (PRAME_HUMAN)
VSQLSVLSL

SEQ ID NO: 160746 - protein, 8 aa, Homo sapiens
  Native (PRAME_HUMAN)
WPFTCLPL

SEQ ID NO: 160747 - protein, 9 aa, Homo sapiens
  Native (PRAME_HUMAN)
GITDDQLLA

SEQ ID NO: 160748 - protein, 9 aa, Homo sapiens
  Native (PRAME_HUMAN)
LAYLHARLR

SEQ ID NO: 160749 - protein, 9 aa, Homo sapiens
  Native (PRAME_HUMAN)
YLIEKVKRK

SEQ ID NO: 160750 - protein, 10 aa, Homo sapiens
  Native (PRAME_HUMAN)
AQPMTKKRKV

SEQ ID NO: 160751 - protein, 10 aa, Homo sapiens
  Native (PRAME_HUMAN)
AAQPMTKKRK

SEQ ID NO: 160752 - protein, 9 aa, Homo sapiens
  Native (PRAME_HUMAN)
PTLAKFSPY

SEQ ID NO: 160753 - protein, 8 aa, Homo sapiens
  Native (PRAME_HUMAN)
QAWPFTCL

SEQ ID NO: 160754 - protein, 10 aa, Homo sapiens
  Native (PRAME_HUMAN)
LLCELGRPSM

SEQ ID NO: 160755 - protein, 10 aa, Homo sapiens
  Native (PRAME_HUMAN)
RLDQLLRHVM

SEQ ID NO: 160756 - protein, 10 aa, Homo sapiens
  Native (PRAME_HUMAN)
AYLHARLREL

SEQ ID NO: 160757 - protein, 11 aa, Homo sapiens
  Native (PRAME_HUMAN)
NPCPHCGDRTF

SEQ ID NO: 160758 - protein, 9 aa, Homo sapiens
  Native (PRAME_HUMAN)
LRRLLLSHI

SEQ ID NO: 160759 - protein, 9 aa, Homo sapiens
  Native (PRAME_HUMAN)
VEVLVDLFL

SEQ ID NO: 160760 - protein, 8 aa, Homo sapiens
  Native (PRAME_HUMAN)
SSYISPEK

SEQ ID NO: 160761 - protein, 8 aa, Homo sapiens
  Native (PRAME_HUMAN)
LELLPREL

SEQ ID NO: 160762 - protein, 9 aa, Homo sapiens
  Native (PRAME_HUMAN)
CPHCGDRTF

SEQ ID NO: 160763 - protein, 11 aa, Homo sapiens
  Native (PRAME_HUMAN)
RRLWGSIQSRY

SEQ ID NO: 160764 - protein, 8 aa, Homo sapiens
  Native (PRAME_HUMAN)
ASATLQDL

SEQ ID NO: 160765 - protein, 8 aa, Homo sapiens
  Native (PRAME_HUMAN)
LHLETFKA

SEQ ID NO: 160766 - protein, 9 aa, Homo sapiens
  Native (PRAME_HUMAN)
ELAGQSLLK

SEQ ID NO: 160767 - protein, 8 aa, Homo sapiens
  Native (PRAME_HUMAN)
LTHVLYPV

SEQ ID NO: 160768 - protein, 8 aa, Homo sapiens
  Native (PRAME_HUMAN)
LDGLDVLL

SEQ ID NO: 160769 - protein, 11 aa, Homo sapiens
  Native (PRAME_HUMAN)
KEGACDELFSY

SEQ ID NO: 160770 - protein, 10 aa, Homo sapiens
  Native (PRAME_HUMAN)
LKAMVQAWPF

SEQ ID NO: 160771 - protein, 8 aa, Homo sapiens
  Native (PRAME_HUMAN)
IAQFTSQF

SEQ ID NO: 160772 - protein, 10 aa, Homo sapiens
  Native (PRAME_HUMAN)
LFPPLFMAAF

SEQ ID NO: 160773 - protein, 9 aa, Homo sapiens
  Native (PRAME_HUMAN)
GRHSQTLKA

SEQ ID NO: 160774 - protein, 10 aa, Homo sapiens
  Native (PRAME_HUMAN)
KFSPYLGQMI

SEQ ID NO: 160775 - protein, 9 aa, Homo sapiens
  Native (PRAME_HUMAN)
LELLPRELF

SEQ ID NO: 160776 - protein, 9 aa, Homo sapiens
  Native (PRAME_HUMAN)
RTFYDPEPI

SEQ ID NO: 160777 - protein, 8 aa, Homo sapiens
  Native (PRAME_HUMAN)
LQCLQALY

SEQ ID NO: 160778 - protein, 8 aa, Homo sapiens
  Native (PRAME_HUMAN)
QALYVDSL

SEQ ID NO: 160779 - protein, 9 aa, Homo sapiens
  Native (PRAME_HUMAN)
ASATLQDLV

SEQ ID NO: 160780 - protein, 11 aa, Homo sapiens
  Native (PRAME_HUMAN)
LVELAGQSLLK

SEQ ID NO: 160781 - protein, 9 aa, Homo sapiens
  Native (PRAME_HUMAN)
SMVWLSANP

SEQ ID NO: 160782 - protein, 9 aa, Homo sapiens
  Native (PRAME_HUMAN)
AMVQAWPFT

SEQ ID NO: 160783 - protein, 10 aa, Homo sapiens
  Native (PRAME_HUMAN)
RHVMNPLETL

SEQ ID NO: 160784 - protein, 9 aa, Homo sapiens
  Native (PRAME_HUMAN)
EPILCPCFM

SEQ ID NO: 160785 - protein, 11 aa, Homo sapiens
  Native (PRAME_HUMAN)
MKGQHLHLETF

SEQ ID NO: 160786 - protein, 9 aa, Homo sapiens
  Native (PRAME_HUMAN)
QALYVDSLF

SEQ ID NO: 160787 - protein, 10 aa, Homo sapiens
  Native (PRAME_HUMAN)
DIHGTLHLER

SEQ ID NO: 160788 - protein, 11 aa, Homo sapiens
  Native (PRAME_HUMAN)
GITDDQLLALL

SEQ ID NO: 160789 - protein, 11 aa, Homo sapiens
  Native (PRAME_HUMAN)
LERASATLQDL

SEQ ID NO: 160790 - protein, 8 aa, Homo sapiens
  Native (PRAME_HUMAN)
LSNLTHVL

SEQ ID NO: 160791 - protein, 10 aa, Homo sapiens
  Native (PRAME_HUMAN)
ILKMVQLDSI

SEQ ID NO: 160792 - protein, 10 aa, Homo sapiens
  Native (PRAME_HUMAN)
LYVDSLFFLR

SEQ ID NO: 160793 - protein, 10 aa, Homo sapiens
  Native (PRAME_HUMAN)
VTCTWKLPTL

SEQ ID NO: 160794 - protein, 8 aa, Homo sapiens
  Native (PRAME_HUMAN)
QHLHLETF

SEQ ID NO: 160795 - protein, 9 aa, Homo sapiens
  Native (PRAME_HUMAN)
AFDGRHSQT

SEQ ID NO: 160796 - protein, 10 aa, Homo sapiens
  Native (PRAME_HUMAN)
LSTEAEQPFI

SEQ ID NO: 160797 - protein, 9 aa, Homo sapiens
  Native (PRAME_HUMAN)
RHVMNPLET

SEQ ID NO: 160798 - protein, 9 aa, Homo sapiens
  Native (PRAME_HUMAN)
DGRHSQTLK

SEQ ID NO: 160799 - protein, 10 aa, Homo sapiens
  Native (PRAME_HUMAN)
GRPSMVWLSA

SEQ ID NO: 160800 - protein, 9 aa, Homo sapiens
  Native (PRAME_HUMAN)
DRTFYDPEP

SEQ ID NO: 160801 - protein, 8 aa, Homo sapiens
  Native (PRAME_HUMAN)
LRHVMNPL

SEQ ID NO: 160802 - protein, 8 aa, Homo sapiens
  Native (PRAME_HUMAN)
IEDLEVTC

SEQ ID NO: 160803 - protein, 9 aa, Homo sapiens
  Native (PRAME_HUMAN)
RRLLLSHIH

SEQ ID NO: 160804 - protein, 11 aa, Homo sapiens
  Native (PRAME_HUMAN)
DECGITDDQLL

SEQ ID NO: 160805 - protein, 10 aa, Homo sapiens
  Native (PRAME_HUMAN)
RASATLQDLV

SEQ ID NO: 160806 - protein, 9 aa, Homo sapiens
  Native (PRAME_HUMAN)
SQLSVLSLS

SEQ ID NO: 160807 - protein, 8 aa, Homo sapiens
  Native (PRAME_HUMAN)
CELGRPSM

SEQ ID NO: 160808 - protein, 9 aa, Homo sapiens
  Native (PRAME_HUMAN)
LSGVMLTDV

SEQ ID NO: 160809 - protein, 9 aa, Homo sapiens
  Native (PRAME_HUMAN)
HGTLHLERL

SEQ ID NO: 160810 - protein, 11 aa, Homo sapiens
  Native (PRAME_HUMAN)
LKDEALAIAAL

SEQ ID NO: 160811 - protein, 10 aa, Homo sapiens
  Native (PRAME_HUMAN)
SLLKDEALAI

SEQ ID NO: 160812 - protein, 8 aa, Homo sapiens
  Native (PRAME_HUMAN)
WSGNRASL

SEQ ID NO: 160813 - protein, 11 aa, Homo sapiens
  Native (PRAME_HUMAN)
KLPTLAKFSPY

SEQ ID NO: 160814 - protein, 10 aa, Homo sapiens
  Native (PRAME_HUMAN)
KRKKNVLRLC

SEQ ID NO: 160815 - protein, 10 aa, Homo sapiens
  Native (PRAME_HUMAN)
ETLSITNCRL

SEQ ID NO: 160816 - protein, 9 aa, Homo sapiens
  Native (PRAME_HUMAN)
TLAKFSPYL

SEQ ID NO: 160817 - protein, 10 aa, Homo sapiens
  Native (PRAME_HUMAN)
KVKRKKNVLR

SEQ ID NO: 160818 - protein, 9 aa, Homo sapiens
  Native (PRAME_HUMAN)
LHLETFKAV

SEQ ID NO: 160819 - protein, 9 aa, Homo sapiens
  Native (PRAME_HUMAN)
AMPMQDIKM

SEQ ID NO: 160820 - protein, 8 aa, Homo sapiens
  Native (PRAME_HUMAN)
AYLHARLR

SEQ ID NO: 160821 - protein, 8 aa, Homo sapiens
  Native (PRAME_HUMAN)
MKGQHLHL

SEQ ID NO: 160822 - protein, 9 aa, Homo sapiens
  Native (PRAME_HUMAN)
RPSMVWLSA

SEQ ID NO: 160823 - protein, 10 aa, Homo sapiens
  Native (PRAME_HUMAN)
GLSNLTHVLY

SEQ ID NO: 160824 - protein, 10 aa, Homo sapiens
  Native (PRAME_HUMAN)
SGNRASLYSF

SEQ ID NO: 160825 - protein, 11 aa, Homo sapiens
  Native (PRAME_HUMAN)
RTFYDPEPILC

SEQ ID NO: 160826 - protein, 11 aa, Homo sapiens
  Native (PRAME_HUMAN)
SEGDVMHLSQS

SEQ ID NO: 160827 - protein, 9 aa, Homo sapiens
  Native (PRAME_HUMAN)
LDQLLRHVM

SEQ ID NO: 160828 - protein, 9 aa, Homo sapiens
  Native (PRAME_HUMAN)
QDIKMILKM

SEQ ID NO: 160829 - protein, 11 aa, Homo sapiens
  Native (PRAME_HUMAN)
ALLERASATLQ

SEQ ID NO: 160830 - protein, 9 aa, Homo sapiens
  Native (PRAME_HUMAN)
MNPLETLSI

SEQ ID NO: 160831 - protein, 10 aa, Homo sapiens
  Native (PRAME_HUMAN)
SPYLGQMINL

SEQ ID NO: 160832 - protein, 9 aa, Homo sapiens
  Native (PRAME_HUMAN)
TWKLPTLAK

SEQ ID NO: 160833 - protein, 11 aa, Homo sapiens
  Native (PRAME_HUMAN)
LIGLSNLTHVL

SEQ ID NO: 160834 - protein, 11 aa, Homo sapiens
  Native (PRAME_HUMAN)
ALYVDSLFFLR

SEQ ID NO: 160835 - protein, 10 aa, Homo sapiens
  Native (PRAME_HUMAN)
ELFPPLFMAA

SEQ ID NO: 160836 - protein, 9 aa, Homo sapiens
  Native (PRAME_HUMAN)
SPEPLQALL

SEQ ID NO: 160837 - protein, 8 aa, Homo sapiens
  Native (PRAME_HUMAN)
RLAYLHAR

SEQ ID NO: 160838 - protein, 9 aa, Homo sapiens
  Native (PRAME_HUMAN)
SFPEPEAAQ

SEQ ID NO: 160839 - protein, 10 aa, Homo sapiens
  Native (PRAME_HUMAN)
GTLHLERLAY

SEQ ID NO: 160840 - protein, 10 aa, Homo sapiens
  Native (PRAME_HUMAN)
FIPVEVLVDL

SEQ ID NO: 160841 - protein, 10 aa, Homo sapiens
  Native (PRAME_HUMAN)
VLRLCCKKLK

SEQ ID NO: 160842 - protein, 9 aa, Homo sapiens
  Native (PRAME_HUMAN)
VQLDSIEDL

SEQ ID NO: 160843 - protein, 10 aa, Homo sapiens
  Native (PRAME_HUMAN)
FTCLPLGVLM

SEQ ID NO: 160844 - protein, 10 aa, Homo sapiens
  Native (PRAME_HUMAN)
MTKKRKVDGL

SEQ ID NO: 160845 - protein, 10 aa, Homo sapiens
  Native (PRAME_HUMAN)
TFYDPEPILC

SEQ ID NO: 160846 - protein, 8 aa, Homo sapiens
  Native (PRAME_HUMAN)
VRPRRWKL

SEQ ID NO: 160847 - protein, 10 aa, Homo sapiens
  Native (PRAME_HUMAN)
ALAIAALELL

SEQ ID NO: 160848 - protein, 9 aa, Homo sapiens
  Native (PRAME_HUMAN)
CLPLGVLMK

SEQ ID NO: 160849 - protein, 9 aa, Homo sapiens
  Native (PRAME_HUMAN)
LQSLLQHLI

SEQ ID NO: 160850 - protein, 9 aa, Homo sapiens
  Native (PRAME_HUMAN)
TLKAMVQAW

SEQ ID NO: 160851 - protein, 9 aa, Homo sapiens
  Native (PRAME_HUMAN)
LDGLDVLLA

SEQ ID NO: 160852 - protein, 11 aa, Homo sapiens
  Native (PRAME_HUMAN)
AMVQAWPFTCL

SEQ ID NO: 160853 - protein, 11 aa, Homo sapiens
  Native (PRAME_HUMAN)
QYIAQFTSQFL

SEQ ID NO: 160854 - protein, 9 aa, Homo sapiens
  Native (PRAME_HUMAN)
LLAQEVRPR

SEQ ID NO: 160855 - protein, 11 aa, Homo sapiens
  Native (PRAME_HUMAN)
HLSQSPSVSQL

SEQ ID NO: 160856 - protein, 11 aa, Homo sapiens
  Native (PRAME_HUMAN)
SHCSQLTTLSF

SEQ ID NO: 160857 - protein, 8 aa, Homo sapiens
  Native (PRAME_HUMAN)
LRELLCEL

SEQ ID NO: 160858 - protein, 11 aa, Homo sapiens
  Native (PRAME_HUMAN)
FLSLQCLQALY

SEQ ID NO: 160859 - protein, 10 aa, Homo sapiens
  Native (PRAME_HUMAN)
GQMINLRRLL

SEQ ID NO: 160860 - protein, 9 aa, Homo sapiens
  Native (PRAME_HUMAN)
EDLEVTCTW

SEQ ID NO: 160861 - protein, 8 aa, Homo sapiens
  Native (PRAME_HUMAN)
QSLLQHLI

SEQ ID NO: 160862 - protein, 10 aa, Homo sapiens
  Native (PRAME_HUMAN)
KDEALAIAAL

SEQ ID NO: 160863 - protein, 10 aa, Homo sapiens
  Native (PRAME_HUMAN)
ESYEDIHGTL

SEQ ID NO: 160864 - protein, 10 aa, Homo sapiens
  Native (PRAME_HUMAN)
QAWPFTCLPL

SEQ ID NO: 160865 - protein, 8 aa, Homo sapiens
  Native (PRAME_HUMAN)
SHQDFWTV

SEQ ID NO: 160866 - protein, 11 aa, Homo sapiens
  Native (PRAME_HUMAN)
RLSEGDVMHLS

SEQ ID NO: 160867 - protein, 9 aa, Homo sapiens
  Native (PRAME_HUMAN)
QPMTKKRKV

SEQ ID NO: 160868 - protein, 9 aa, Homo sapiens
  Native (PRAME_HUMAN)
MQDIKMILK

SEQ ID NO: 160869 - protein, 11 aa, Homo sapiens
  Native (PRAME_HUMAN)
GRHSQTLKAMV

SEQ ID NO: 160870 - protein, 10 aa, Homo sapiens
  Native (PRAME_HUMAN)
MSVWTSPRRL

SEQ ID NO: 160871 - protein, 9 aa, Homo sapiens
  Native (PRAME_HUMAN)
TCTWKLPTL

SEQ ID NO: 160872 - protein, 8 aa, Homo sapiens
  Native (PRAME_HUMAN)
FTSQFLSL

SEQ ID NO: 160873 - protein, 8 aa, Homo sapiens
  Native (PRAME_HUMAN)
RYISMSVW

SEQ ID NO: 160874 - protein, 9 aa, Homo sapiens
  Native (PRAME_HUMAN)
SLLKDEALA

SEQ ID NO: 160875 - protein, 9 aa, Homo sapiens
  Native (PRAME_HUMAN)
CSQLTTLSF

SEQ ID NO: 160876 - protein, 10 aa, Homo sapiens
  Native (PRAME_HUMAN)
LSLQCLQALY

SEQ ID NO: 160877 - protein, 9 aa, Homo sapiens
  Native (PRAME_HUMAN)
LSLQCLQAL

SEQ ID NO: 160878 - protein, 8 aa, Homo sapiens
  Native (PRAME_HUMAN)
LSFYGNSI

SEQ ID NO: 160879 - protein, 9 aa, Homo sapiens
  Native (PRAME_HUMAN)
WPFTCLPLG

SEQ ID NO: 160880 - protein, 9 aa, Homo sapiens
  Native (PRAME_HUMAN)
KEGACDELF

SEQ ID NO: 160881 - protein, 8 aa, Homo sapiens
  Native (PRAME_HUMAN)
FAMPMQDI

SEQ ID NO: 160882 - protein, 9 aa, Homo sapiens
  Native (PRAME_HUMAN)
TEAEQPFIP

SEQ ID NO: 160883 - protein, 8 aa, Homo sapiens
  Native (PRAME_HUMAN)
RELLCELG

SEQ ID NO: 160884 - protein, 10 aa, Homo sapiens
  Native (PRAME_HUMAN)
SHIHASSYIS

SEQ ID NO: 160885 - protein, 10 aa, Homo sapiens
  Native (PRAME_HUMAN)
RLVELAGQSL

SEQ ID NO: 160886 - protein, 8 aa, Homo sapiens
  Native (PRAME_HUMAN)
RRLLLSHI

SEQ ID NO: 160887 - protein, 9 aa, Homo sapiens
  Native (PRAME_HUMAN)
RLLLSHIHA

SEQ ID NO: 160888 - protein, 11 aa, Homo sapiens
  Native (PRAME_HUMAN)
GTLHLERLAYL

SEQ ID NO: 160889 - protein, 11 aa, Homo sapiens
  Native (PRAME_HUMAN)
SLQCLQALYVD

SEQ ID NO: 160890 - protein, 9 aa, Homo sapiens
  Native (PRAME_HUMAN)
ALQSLLQHL

SEQ ID NO: 160891 - protein, 9 aa, Homo sapiens
  Native (PRAME_HUMAN)
HLETFKAVL

SEQ ID NO: 160892 - protein, 8 aa, Homo sapiens
  Native (PRAME_HUMAN)
SHIHASSY

SEQ ID NO: 160893 - protein, 10 aa, Homo sapiens
  Native (PRAME_HUMAN)
LPSLSHCSQL

SEQ ID NO: 160894 - protein, 9 aa, Homo sapiens
  Native (PRAME_HUMAN)
YDPEPILCP

SEQ ID NO: 160895 - protein, 10 aa, Homo sapiens
  Native (PRAME_HUMAN)
LQALYVDSLF

SEQ ID NO: 160896 - protein, 10 aa, Homo sapiens
  Native (PRAME_HUMAN)
YLIEKVKRKK

SEQ ID NO: 160897 - protein, 8 aa, Homo sapiens
  Native (PRAME_HUMAN)
VDGLSTEA

SEQ ID NO: 160898 - protein, 8 aa, Homo sapiens
  Native (PRAME_HUMAN)
DVLLAQEV

SEQ ID NO: 160899 - protein, 9 aa, Homo sapiens
  Native (PRAME_HUMAN)
DVSPEPLQA

SEQ ID NO: 160900 - protein, 10 aa, Homo sapiens
  Native (PRAME_HUMAN)
RPSMVWLSAN

SEQ ID NO: 160901 - protein, 10 aa, Homo sapiens
  Native (PRAME_HUMAN)
LRKNSHQDFW

SEQ ID NO: 160902 - protein, 11 aa, Homo sapiens
  Native (PRAME_HUMAN)
LSVLSLSGVML

SEQ ID NO: 160903 - protein, 11 aa, Homo sapiens
  Native (PRAME_HUMAN)
SFPEPEAAQPM

SEQ ID NO: 160904 - protein, 8 aa, Homo sapiens
  Native (PRAME_HUMAN)
SQFLSLQC

SEQ ID NO: 160905 - protein, 9 aa, Homo sapiens
  Native (PRAME_HUMAN)
SYLIEKVKR

SEQ ID NO: 160906 - protein, 10 aa, Homo sapiens
  Native (PRAME_HUMAN)
GACDELFSYL

SEQ ID NO: 160907 - protein, 9 aa, Homo sapiens
  Native (PRAME_HUMAN)
LSANPCPHC

SEQ ID NO: 160908 - protein, 9 aa, Homo sapiens
  Native (PRAME_HUMAN)
SHCSQLTTL

SEQ ID NO: 160909 - protein, 9 aa, Homo sapiens
  Native (PRAME_HUMAN)
DVLLAQEVR

SEQ ID NO: 160910 - protein, 11 aa, Homo sapiens
  Native (PRAME_HUMAN)
ESYEDIHGTLH

SEQ ID NO: 160911 - protein, 9 aa, Homo sapiens
  Native (PRAME_HUMAN)
ERRRLWGSI

SEQ ID NO: 160912 - protein, 10 aa, Homo sapiens
  Native (PRAME_HUMAN)
LSQSPSVSQL

SEQ ID NO: 160913 - protein, 11 aa, Homo sapiens
  Native (PRAME_HUMAN)
RRWKLQVLDLR

SEQ ID NO: 160914 - protein, 8 aa, Homo sapiens
  Native (PRAME_HUMAN)
FTCLPLGV

SEQ ID NO: 160915 - protein, 9 aa, Homo sapiens
  Native (PRAME_HUMAN)
AQEVRPRRW

SEQ ID NO: 160916 - protein, 10 aa, Homo sapiens
  Native (PRAME_HUMAN)
QSPSVSQLSV

SEQ ID NO: 160917 - protein, 9 aa, Homo sapiens
  Native (PRAME_HUMAN)
LLRHVMNPL

SEQ ID NO: 160918 - protein, 10 aa, Homo sapiens
  Native (PRAME_HUMAN)
QSRYISMSVW

SEQ ID NO: 160919 - protein, 9 aa, Homo sapiens
  Native (PRAME_HUMAN)
LMKGQHLHL

SEQ ID NO: 160920 - protein, 9 aa, Homo sapiens
  Native (PRAME_HUMAN)
LLERASATL

SEQ ID NO: 160921 - protein, 11 aa, Homo sapiens
  Native (PRAME_HUMAN)
RLAYLHARLRE

SEQ ID NO: 160922 - protein, 10 aa, Homo sapiens
  Native (PRAME_HUMAN)
PYLGQMINLR

SEQ ID NO: 160923 - protein, 10 aa, Homo sapiens
  Native (PRAME_HUMAN)
AMVQAWPFTC

SEQ ID NO: 160924 - protein, 9 aa, Homo sapiens
  Native (PRAME_HUMAN)
MVQAWPFTC

SEQ ID NO: 160925 - protein, 8 aa, Homo sapiens
  Native (PRAME_HUMAN)
SPRRLVEL

SEQ ID NO: 160926 - protein, 9 aa, Homo sapiens
  Native (PRAME_HUMAN)
ESYEDIHGT

SEQ ID NO: 160927 - protein, 11 aa, Homo sapiens
  Native (PRAME_HUMAN)
LAYLHARLREL

SEQ ID NO: 160928 - protein, 10 aa, Homo sapiens
  Native (PRAME_HUMAN)
QFLSLQCLQA

SEQ ID NO: 160929 - protein, 9 aa, Homo sapiens
  Native (PRAME_HUMAN)
VQAWPFTCL

SEQ ID NO: 160930 - protein, 9 aa, Homo sapiens
  Native (PRAME_HUMAN)
LRLCCKKLK

SEQ ID NO: 160931 - protein, 10 aa, Homo sapiens
  Native (PRAME_HUMAN)
HLHLETFKAV

SEQ ID NO: 160932 - protein, 9 aa, Homo sapiens
  Native (PRAME_HUMAN)
YPVPLESYE

SEQ ID NO: 160933 - protein, 9 aa, Homo sapiens
  Native (PRAME_HUMAN)
ELFPPLFMA

SEQ ID NO: 160934 - protein, 10 aa, Homo sapiens
  Native (PRAME_HUMAN)
RRLVELAGQS

SEQ ID NO: 160935 - protein, 9 aa, Homo sapiens
  Native (PRAME_HUMAN)
QSRYISMSV

SEQ ID NO: 160936 - protein, 8 aa, Homo sapiens
  Native (PRAME_HUMAN)
LHARLREL

SEQ ID NO: 160937 - protein, 9 aa, Homo sapiens
  Native (PRAME_HUMAN)
STEAEQPFI

SEQ ID NO: 160938 - protein, 10 aa, Homo sapiens
  Native (PRAME_HUMAN)
SLYSFPEPEA

SEQ ID NO: 160939 - protein, 10 aa, Homo sapiens
  Native (PRAME_HUMAN)
DRTFYDPEPI

SEQ ID NO: 160940 - protein, 10 aa, Homo sapiens
  Native (PRAME_HUMAN)
LLPRELFPPL

SEQ ID NO: 160941 - protein, 10 aa, Homo sapiens
  Native (PRAME_HUMAN)
EAAQPMTKKR

SEQ ID NO: 160942 - protein, 11 aa, Homo sapiens
  Native (PRAME_HUMAN)
RWKLQVLDLRK

SEQ ID NO: 160943 - protein, 9 aa, Homo sapiens
  Native (PRAME_HUMAN)
AVLDGLDVL

SEQ ID NO: 160944 - protein, 9 aa, Homo sapiens
  Native (PRAME_HUMAN)
KLQVLDLRK

SEQ ID NO: 160945 - protein, 9 aa, Homo sapiens
  Native (PRAME_HUMAN)
RLSEGDVMH

SEQ ID NO: 160946 - protein, 10 aa, Homo sapiens
  Native (PRAME_HUMAN)
MNPLETLSIT

SEQ ID NO: 160947 - protein, 9 aa, Homo sapiens
  Native (PRAME_HUMAN)
LALLPSLSH

SEQ ID NO: 160948 - protein, 11 aa, Homo sapiens
  Native (PRAME_HUMAN)
WSGNRASLYSF

SEQ ID NO: 160949 - protein, 11 aa, Homo sapiens
  Native (PRAME_HUMAN)
TVWSGNRASLY

SEQ ID NO: 160950 - protein, 9 aa, Homo sapiens
  Native (PRAME_HUMAN)
LDVLLAQEV

SEQ ID NO: 160951 - protein, 8 aa, Homo sapiens
  Native (PRAME_HUMAN)
DELFSYLI

SEQ ID NO: 160952 - protein, 11 aa, Homo sapiens
  Native (PRAME_HUMAN)
SANPCPHCGDR

SEQ ID NO: 160953 - protein, 11 aa, Homo sapiens
  Native (PRAME_HUMAN)
VQLDSIEDLEV

SEQ ID NO: 160954 - protein, 8 aa, Homo sapiens
  Native (PRAME_HUMAN)
ATLQDLVF

SEQ ID NO: 160955 - protein, 9 aa, Homo sapiens
  Native (PRAME_HUMAN)
ALLPSLSHC

SEQ ID NO: 160956 - protein, 10 aa, Homo sapiens
  Native (PRAME_HUMAN)
ISMSVWTSPR

SEQ ID NO: 160957 - protein, 10 aa, Homo sapiens
  Native (PRAME_HUMAN)
RWKLQVLDLR

SEQ ID NO: 160958 - protein, 8 aa, Homo sapiens
  Native (PRAME_HUMAN)
FPPLFMAA

SEQ ID NO: 160959 - protein, 11 aa, Homo sapiens
  Native (PRAME_HUMAN)
FYGNSISISAL

SEQ ID NO: 160960 - protein, 10 aa, Homo sapiens
  Native (PRAME_HUMAN)
MINLRRLLLS

SEQ ID NO: 160961 - protein, 11 aa, Homo sapiens
  Native (PRAME_HUMAN)
RLWGSIQSRYI

SEQ ID NO: 160962 - protein, 11 aa, Homo sapiens
  Native (PRAME_HUMAN)
HARLRELLCEL

SEQ ID NO: 160963 - protein, 10 aa, Homo sapiens
  Native (PRAME_HUMAN)
LRRLLLSHIH

SEQ ID NO: 160964 - protein, 11 aa, Homo sapiens
  Native (PRAME_HUMAN)
DFWTVWSGNRA

SEQ ID NO: 160965 - protein, 10 aa, Homo sapiens
  Native (PRAME_HUMAN)
ELFSYLIEKV

SEQ ID NO: 160966 - protein, 9 aa, Homo sapiens
  Native (PRAME_HUMAN)
MSVWTSPRR

SEQ ID NO: 160967 - protein, 11 aa, Homo sapiens
  Native (PRAME_HUMAN)
CELGRPSMVWL

SEQ ID NO: 160968 - protein, 8 aa, Homo sapiens
  Native (PRAME_HUMAN)
HSQTLKAM

SEQ ID NO: 160969 - protein, 8 aa, Homo sapiens
  Native (PRAME_HUMAN)
CLPLGVLM

SEQ ID NO: 160970 - protein, 11 aa, Homo sapiens
  Native (PRAME_HUMAN)
FPEPEAAQPMT

SEQ ID NO: 160971 - protein, 11 aa, Homo sapiens
  Native (PRAME_HUMAN)
IEKVKRKKNVL

SEQ ID NO: 160972 - protein, 8 aa, Homo sapiens
  Native (PRAME_HUMAN)
YVDSLFFL

SEQ ID NO: 160973 - protein, 10 aa, Homo sapiens
  Native (PRAME_HUMAN)
PMQDIKMILK

SEQ ID NO: 160974 - protein, 9 aa, Homo sapiens
  Native (PRAME_HUMAN)
PYLGQMINL

SEQ ID NO: 160975 - protein, 11 aa, Homo sapiens
  Native (PRAME_HUMAN)
SLSGVMLTDVS

SEQ ID NO: 160976 - protein, 8 aa, Homo sapiens
  Native (PRAME_HUMAN)
LLLSHIHA

SEQ ID NO: 160977 - protein, 9 aa, Homo sapiens
  Native (PRAME_HUMAN)
DSLFFLRGR

SEQ ID NO: 160978 - protein, 9 aa, Homo sapiens
  Native (PRAME_HUMAN)
SEGDVMHLS

SEQ ID NO: 160979 - protein, 9 aa, Homo sapiens
  Native (PRAME_HUMAN)
AQFTSQFLS

SEQ ID NO: 160980 - protein, 10 aa, Homo sapiens
  Native (PRAME_HUMAN)
CPHCGDRTFY

SEQ ID NO: 160981 - protein, 9 aa, Homo sapiens
  Native (PRAME_HUMAN)
TFKAVLDGL

SEQ ID NO: 160982 - protein, 10 aa, Homo sapiens
  Native (PRAME_HUMAN)
WPFTCLPLGV

SEQ ID NO: 160983 - protein, 10 aa, Homo sapiens
  Native (PRAME_HUMAN)
TTLSFYGNSI

SEQ ID NO: 160984 - protein, 9 aa, Homo sapiens
  Native (PRAME_HUMAN)
VDLFLKEGA

SEQ ID NO: 160985 - protein, 9 aa, Homo sapiens
  Native (PRAME_HUMAN)
YSFPEPEAA

SEQ ID NO: 160986 - protein, 9 aa, Homo sapiens
  Native (PRAME_HUMAN)
MERRRLWGS

SEQ ID NO: 160987 - protein, 11 aa, Homo sapiens
  Native (PRAME_HUMAN)
TDVSPEPLQAL

SEQ ID NO: 160988 - protein, 10 aa, Homo sapiens
  Native (PRAME_HUMAN)
GQHLHLETFK

SEQ ID NO: 160989 - protein, 10 aa, Homo sapiens
  Native (PRAME_HUMAN)
AVLDGLDVLL

SEQ ID NO: 160990 - protein, 11 aa, Homo sapiens
  Native (PRAME_HUMAN)
SYISPEKEEQY

SEQ ID NO: 160991 - protein, 8 aa, Homo sapiens
  Native (PRAME_HUMAN)
FYGNSISI

SEQ ID NO: 160992 - protein, 10 aa, Homo sapiens
  Native (PRAME_HUMAN)
FYDPEPILCP

SEQ ID NO: 160993 - protein, 11 aa, Homo sapiens
  Native (PRAME_HUMAN)
IEDLEVTCTWK

SEQ ID NO: 160994 - protein, 11 aa, Homo sapiens
  Native (PRAME_HUMAN)
SNLTHVLYPVP

SEQ ID NO: 160995 - protein, 9 aa, Homo sapiens
  Native (PRAME_HUMAN)
PEKEEQYIA

SEQ ID NO: 160996 - protein, 9 aa, Homo sapiens
  Native (PRAME_HUMAN)
ACDELFSYL

SEQ ID NO: 160997 - protein, 9 aa, Homo sapiens
  Native (PRAME_HUMAN)
IHGTLHLER

SEQ ID NO: 160998 - protein, 10 aa, Homo sapiens
  Native (PRAME_HUMAN)
ALQSLLQHLI

SEQ ID NO: 160999 - protein, 9 aa, Homo sapiens
  Native (PRAME_HUMAN)
EPLQALLER

SEQ ID NO: 161000 - protein, 9 aa, Homo sapiens
  Native (PRAME_HUMAN)
YISMSVWTS

SEQ ID NO: 161001 - protein, 9 aa, Homo sapiens
  Native (PRAME_HUMAN)
WSGNRASLY

SEQ ID NO: 161002 - protein, 9 aa, Homo sapiens
  Native (PRAME_HUMAN)
RRLWGSIQS

SEQ ID NO: 161003 - protein, 8 aa, Homo sapiens
  Native (PRAME_HUMAN)
KMVQLDSI

SEQ ID NO: 161004 - protein, 11 aa, Homo sapiens
  Native (PRAME_HUMAN)
AYLHARLRELL

SEQ ID NO: 161005 - protein, 9 aa, Homo sapiens
  Native (PRAME_HUMAN)
TDDQLLALL

SEQ ID NO: 161006 - protein, 8 aa, Homo sapiens
  Native (PRAME_HUMAN)
WTSPRRLV

SEQ ID NO: 161007 - protein, 8 aa, Homo sapiens
  Native (PRAME_HUMAN)
SPYLGQMI

SEQ ID NO: 161008 - protein, 10 aa, Homo sapiens
  Native (PRAME_HUMAN)
NLTHVLYPVP

SEQ ID NO: 161009 - protein, 10 aa, Homo sapiens
  Native (PRAME_HUMAN)
RLAYLHARLR

SEQ ID NO: 161010 - protein, 8 aa, Homo sapiens
  Native (PRAME_HUMAN)
DQLLRHVM

SEQ ID NO: 161011 - protein, 8 aa, Homo sapiens
  Native (PRAME_HUMAN)
TFYDPEPI

SEQ ID NO: 161012 - protein, 11 aa, Homo sapiens
  Native (PRAME_HUMAN)
ISALQSLLQHL

SEQ ID NO: 161013 - protein, 10 aa, Homo sapiens
  Native (PRAME_HUMAN)
ISPEKEEQYI

SEQ ID NO: 161014 - protein, 10 aa, Homo sapiens
  Native (PRAME_HUMAN)
VWSGNRASLY

SEQ ID NO: 161015 - protein, 9 aa, Homo sapiens
  Native (PRAME_HUMAN)
ALAIAALEL

SEQ ID NO: 161016 - protein, 8 aa, Homo sapiens
  Native (PRAME_HUMAN)
FSYLIEKV

SEQ ID NO: 161017 - protein, 11 aa, Homo sapiens
  Native (PRAME_HUMAN)
FLRGRLDQLLR

SEQ ID NO: 161018 - protein, 11 aa, Homo sapiens
  Native (PRAME_HUMAN)
LLSHIHASSYI

SEQ ID NO: 161019 - protein, 9 aa, Homo sapiens
  Native (PRAME_HUMAN)
NRASLYSFP

SEQ ID NO: 161020 - protein, 10 aa, Homo sapiens
  Native (PRAME_HUMAN)
VDSLFFLRGR

SEQ ID NO: 161021 - protein, 10 aa, Homo sapiens
  Native (PRAME_HUMAN)
YLGQMINLRR

SEQ ID NO: 161022 - protein, 11 aa, Homo sapiens
  Native (PRAME_HUMAN)
LFLKEGACDEL

SEQ ID NO: 161023 - protein, 10 aa, Homo sapiens
  Native (PRAME_HUMAN)
MVQLDSIEDL

SEQ ID NO: 161024 - protein, 10 aa, Homo sapiens
  Native (PRAME_HUMAN)
VLLAQEVRPR

SEQ ID NO: 161025 - protein, 10 aa, Homo sapiens
  Native (PRAME_HUMAN)
VMNPLETLSI

SEQ ID NO: 161026 - protein, 9 aa, Homo sapiens
  Native (PRAME_HUMAN)
GVLMKGQHL

SEQ ID NO: 161027 - protein, 9 aa, Homo sapiens
  Native (PRAME_HUMAN)
HSQTLKAMV

SEQ ID NO: 161028 - protein, 11 aa, Homo sapiens
  Native (PRAME_HUMAN)
RELFPPLFMAA

SEQ ID NO: 161029 - protein, 9 aa, Homo sapiens
  Native (PRAME_HUMAN)
ELGRPSMVW

SEQ ID NO: 161030 - protein, 9 aa, Homo sapiens
  Native (PRAME_HUMAN)
IHASSYISP

SEQ ID NO: 161031 - protein, 9 aa, Homo sapiens
  Native (PRAME_HUMAN)
IFAMPMQDI

SEQ ID NO: 161032 - protein, 9 aa, Homo sapiens
  Native (PRAME_HUMAN)
IEDLEVTCT

SEQ ID NO: 161033 - protein, 10 aa, Homo sapiens
  Native (PRAME_HUMAN)
HLERLAYLHA

SEQ ID NO: 161034 - protein, 10 aa, Homo sapiens
  Native (PRAME_HUMAN)
EEQYIAQFTS

SEQ ID NO: 161035 - protein, 9 aa, Homo sapiens
  Native (PRAME_HUMAN)
LHLERLAYL

SEQ ID NO: 161036 - protein, 10 aa, Homo sapiens
  Native (PRAME_HUMAN)
PTLAKFSPYL

SEQ ID NO: 161037 - protein, 9 aa, Homo sapiens
  Native (PRAME_HUMAN)
VPLESYEDI

SEQ ID NO: 161038 - protein, 8 aa, Homo sapiens
  Native (PRAME_HUMAN)
ACDELFSY

SEQ ID NO: 161039 - protein, 10 aa, Homo sapiens
  Native (PRAME_HUMAN)
LFSYLIEKVK

SEQ ID NO: 161040 - protein, 9 aa, Homo sapiens
  Native (PRAME_HUMAN)
GACDELFSY

SEQ ID NO: 161041 - protein, 9 aa, Homo sapiens
  Native (PRAME_HUMAN)
ISPEKEEQY

SEQ ID NO: 161042 - protein, 8 aa, Homo sapiens
  Native (PRAME_HUMAN)
EEQYIAQF

SEQ ID NO: 161043 - protein, 11 aa, Homo sapiens
  Native (PRAME_HUMAN)
EAAQPMTKKRK

SEQ ID NO: 161044 - protein, 11 aa, Homo sapiens
  Native (PRAME_HUMAN)
RLVELAGQSLL

SEQ ID NO: 161045 - protein, 9 aa, Homo sapiens
  Native (PRAME_HUMAN)
LAQEVRPRR

SEQ ID NO: 161046 - protein, 8 aa, Homo sapiens
  Native (PRAME_HUMAN)
LSITNCRL

SEQ ID NO: 161047 - protein, 9 aa, Homo sapiens
  Native (PRAME_HUMAN)
QHLIGLSNL

SEQ ID NO: 161048 - protein, 8 aa, Homo sapiens
  Native (PRAME_HUMAN)
VLMKGQHL

SEQ ID NO: 161049 - protein, 9 aa, Homo sapiens
  Native (PRAME_HUMAN)
EAEQPFIPV

SEQ ID NO: 161050 - protein, 11 aa, Homo sapiens
  Native (PRAME_HUMAN)
YISPEKEEQYI

SEQ ID NO: 161051 - protein, 9 aa, Homo sapiens
  Native (PRAME_HUMAN)
KNVLRLCCK

SEQ ID NO: 161052 - protein, 9 aa, Homo sapiens
  Native (PRAME_HUMAN)
TKKRKVDGL

SEQ ID NO: 161053 - protein, 8 aa, Homo sapiens
  Native (PRAME_HUMAN)
VEVLVDLF

SEQ ID NO: 161054 - protein, 10 aa, Homo sapiens
  Native (PRAME_HUMAN)
LPTLAKFSPY

SEQ ID NO: 161055 - protein, 10 aa, Homo sapiens
  Native (PRAME_HUMAN)
ITDDQLLALL

SEQ ID NO: 161056 - protein, 9 aa, Homo sapiens
  Native (PRAME_HUMAN)
GRLDQLLRH

SEQ ID NO: 161057 - protein, 8 aa, Homo sapiens
  Native (PRAME_HUMAN)
LRLCCKKL

SEQ ID NO: 161058 - protein, 11 aa, Homo sapiens
  Native (PRAME_HUMAN)
DEALAIAALEL

SEQ ID NO: 161059 - protein, 9 aa, Homo sapiens
  Native (PRAME_HUMAN)
RLCCKKLKI

SEQ ID NO: 161060 - protein, 10 aa, Homo sapiens
  Native (PRAME_HUMAN)
AMPMQDIKMI

SEQ ID NO: 161061 - protein, 10 aa, Homo sapiens
  Native (PRAME_HUMAN)
QSLLQHLIGL

SEQ ID NO: 161062 - protein, 10 aa, Homo sapiens
  Native (PRAME_HUMAN)
VMHLSQSPSV

SEQ ID NO: 161063 - protein, 10 aa, Homo sapiens
  Native (PRAME_HUMAN)
DFWTVWSGNR

SEQ ID NO: 161064 - protein, 11 aa, Homo sapiens
  Native (PRAME_HUMAN)
LLPSLSHCSQL

SEQ ID NO: 161065 - protein, 9 aa, Homo sapiens
  Native (PRAME_HUMAN)
FPEPEAAQP

SEQ ID NO: 161066 - protein, 10 aa, Homo sapiens
  Native (PRAME_HUMAN)
IHGTLHLERL

SEQ ID NO: 161067 - protein, 9 aa, Homo sapiens
  Native (PRAME_HUMAN)
LTDVSPEPL

SEQ ID NO: 161068 - protein, 8 aa, Homo sapiens
  Native (PRAME_HUMAN)
LQSLLQHL

SEQ ID NO: 161069 - protein, 10 aa, Homo sapiens
  Native (PRAME_HUMAN)
TSQFLSLQCL

SEQ ID NO: 161070 - protein, 11 aa, Homo sapiens
  Native (PRAME_HUMAN)
FTSQFLSLQCL

SEQ ID NO: 161071 - protein, 11 aa, Homo sapiens
  Native (PRAME_HUMAN)
TLKAMVQAWPF

SEQ ID NO: 161072 - protein, 8 aa, Homo sapiens
  Native (PRAME_HUMAN)
LFFLRGRL

SEQ ID NO: 161073 - protein, 10 aa, Homo sapiens
  Native (PRAME_HUMAN)
PLFMAAFDGR

SEQ ID NO: 161074 - protein, 11 aa, Homo sapiens
  Native (PRAME_HUMAN)
KAVLDGLDVLL

SEQ ID NO: 161075 - protein, 9 aa, Homo sapiens
  Native (PRAME_HUMAN)
LRKNSHQDF

SEQ ID NO: 161076 - protein, 10 aa, Homo sapiens
  Native (PRAME_HUMAN)
SQTLKAMVQA

SEQ ID NO: 161077 - protein, 8 aa, Homo sapiens
  Native (PRAME_HUMAN)
HARLRELL

SEQ ID NO: 161078 - protein, 10 aa, Homo sapiens
  Native (PRAME_HUMAN)
SPSVSQLSVL

SEQ ID NO: 161079 - protein, 10 aa, Homo sapiens
  Native (PRAME_HUMAN)
YIAQFTSQFL

SEQ ID NO: 161080 - protein, 8 aa, Homo sapiens
  Native (PRAME_HUMAN)
LERASATL

SEQ ID NO: 161081 - protein, 9 aa, Homo sapiens
  Native (PRAME_HUMAN)
LQHLIGLSN

SEQ ID NO: 161082 - protein, 9 aa, Homo sapiens
  Native (PRAME_HUMAN)
YGNSISISA

SEQ ID NO: 161083 - protein, 9 aa, Homo sapiens
  Native (PRAME_HUMAN)
SQFLSLQCL

SEQ ID NO: 161084 - protein, 9 aa, Homo sapiens
  Native (PRAME_HUMAN)
EDIHGTLHL

SEQ ID NO: 161085 - protein, 8 aa, Homo sapiens
  Native (PRAME_HUMAN)
RHSQTLKA

SEQ ID NO: 161086 - protein, 9 aa, Homo sapiens
  Native (PRAME_HUMAN)
SLLQHLIGL

SEQ ID NO: 161087 - protein, 8 aa, Homo sapiens
  Native (PRAME_HUMAN)
EALAIAAL

SEQ ID NO: 161088 - protein, 10 aa, Homo sapiens
  Native (PRAME_HUMAN)
TLQDLVFDEC

SEQ ID NO: 161089 - protein, 10 aa, Homo sapiens
  Native (PRAME_HUMAN)
TVWSGNRASL

SEQ ID NO: 161090 - protein, 9 aa, Homo sapiens
  Native (PRAME_HUMAN)
SATLQDLVF

SEQ ID NO: 161091 - protein, 9 aa, Homo sapiens
  Native (PRAME_HUMAN)
QFTSQFLSL

SEQ ID NO: 161092 - protein, 8 aa, Homo sapiens
  Native (PRAME_HUMAN)
LGRPSMVW

SEQ ID NO: 161093 - protein, 9 aa, Homo sapiens
  Native (PRAME_HUMAN)
EVLVDLFLK

SEQ ID NO: 161094 - protein, 9 aa, Homo sapiens
  Native (PRAME_HUMAN)
FSYLIEKVK

SEQ ID NO: 161095 - protein, 8 aa, Homo sapiens
  Native (PRAME_HUMAN)
IQSRYISM

SEQ ID NO: 161096 - protein, 11 aa, Homo sapiens
  Native (PRAME_HUMAN)
IQSRYISMSVW

SEQ ID NO: 161097 - protein, 8 aa, Homo sapiens
  Native (PRAME_HUMAN)
KEGACDEL

SEQ ID NO: 161098 - protein, 11 aa, Homo sapiens
  Native (PRAME_HUMAN)
PRELFPPLFMA

SEQ ID NO: 161099 - protein, 9 aa, Homo sapiens
  Native (PRAME_HUMAN)
QSLLKDEAL

SEQ ID NO: 161100 - protein, 8 aa, Homo sapiens
  Native (PRAME_HUMAN)
SQLTTLSF

SEQ ID NO: 161101 - protein, 10 aa, Homo sapiens
  Native (PRAME_HUMAN)
GRHSQTLKAM

SEQ ID NO: 161102 - protein, 11 aa, Homo sapiens
  Native (PRAME_HUMAN)
ELFPPLFMAAF

SEQ ID NO: 161103 - protein, 9 aa, Homo sapiens
  Native (PRAME_HUMAN)
RELFPPLFM

SEQ ID NO: 161104 - protein, 9 aa, Homo sapiens
  Native (PRAME_HUMAN)
SHIHASSYI

SEQ ID NO: 161105 - protein, 10 aa, Homo sapiens
  Native (PRAME_HUMAN)
LLLSHIHASS

SEQ ID NO: 161106 - protein, 11 aa, Homo sapiens
  Native (PRAME_HUMAN)
ELFSYLIEKVK

SEQ ID NO: 161107 - protein, 8 aa, Homo sapiens
  Native (PRAME_HUMAN)
RRWKLQVL

SEQ ID NO: 161108 - protein, 8 aa, Homo sapiens
  Native (PRAME_HUMAN)
KLQVLDLR

SEQ ID NO: 161109 - protein, 8 aa, Homo sapiens
  Native (PRAME_HUMAN)
YEDIHGTL

SEQ ID NO: 161110 - protein, 8 aa, Homo sapiens
  Native (PRAME_HUMAN)
LKIFAMPM

SEQ ID NO: 161111 - protein, 10 aa, Homo sapiens
  Native (PRAME_HUMAN)
LESYEDIHGT

SEQ ID NO: 161112 - protein, 11 aa, Homo sapiens
  Native (PRAME_HUMAN)
AFDGRHSQTLK

SEQ ID NO: 161113 - protein, 11 aa, Homo sapiens
  Native (PRAME_HUMAN)
AMPMQDIKMIL

SEQ ID NO: 161114 - protein, 9 aa, Homo sapiens
  Native (PRAME_HUMAN)
GNSISISAL

SEQ ID NO: 161115 - protein, 11 aa, Homo sapiens
  Native (PRAME_HUMAN)
QALLERASATL

SEQ ID NO: 161116 - protein, 8 aa, Homo sapiens
  Native (PRAME_HUMAN)
SISALQSL

SEQ ID NO: 161117 - protein, 9 aa, Homo sapiens
  Native (PRAME_HUMAN)
LETLSITNC

SEQ ID NO: 161118 - protein, 10 aa, Homo sapiens
  Native (PRAME_HUMAN)
YGNSISISAL

SEQ ID NO: 161119 - protein, 10 aa, Homo sapiens
  Native (PRAME_HUMAN)
IQSRYISMSV

SEQ ID NO: 161120 - protein, 10 aa, Homo sapiens
  Native (PRAME_HUMAN)
KKLKIFAMPM

SEQ ID NO: 161121 - protein, 10 aa, Homo sapiens
  Native (PRAME_HUMAN)
TLAKFSPYLG

SEQ ID NO: 161122 - protein, 11 aa, Homo sapiens
  Native (PRAME_HUMAN)
HLIGLSNLTHV

SEQ ID NO: 161123 - protein, 8 aa, Homo sapiens
  Native (PRAME_HUMAN)
FIPVEVLV

SEQ ID NO: 161124 - protein, 11 aa, Homo sapiens
  Native (PRAME_HUMAN)
MLTDVSPEPLQ

SEQ ID NO: 161125 - protein, 8 aa, Homo sapiens
  Native (PRAME_HUMAN)
SQTLKAMV

SEQ ID NO: 161126 - protein, 10 aa, Homo sapiens
  Native (PRAME_HUMAN)
DECGITDDQL

SEQ ID NO: 161127 - protein, 11 aa, Homo sapiens
  Native (PRAME_HUMAN)
QSPSVSQLSVL

SEQ ID NO: 161128 - protein, 9 aa, Homo sapiens
  Native (PRAME_HUMAN)
VLRLCCKKL

SEQ ID NO: 161129 - protein, 10 aa, Homo sapiens
  Native (PRAME_HUMAN)
KAVLDGLDVL

SEQ ID NO: 161130 - protein, 10 aa, Homo sapiens
  Native (PRAME_HUMAN)
SEGDVMHLSQ

SEQ ID NO: 161131 - protein, 9 aa, Homo sapiens
  Native (PRAME_HUMAN)
LFPPLFMAA

SEQ ID NO: 161132 - protein, 10 aa, Homo sapiens
  Native (PRAME_HUMAN)
LAQEVRPRRW

SEQ ID NO: 161133 - protein, 11 aa, Homo sapiens
  Native (PRAME_HUMAN)
LGRPSMVWLSA

SEQ ID NO: 161134 - protein, 9 aa, Homo sapiens
  Native (PRAME_HUMAN)
QTLKAMVQA

SEQ ID NO: 161135 - protein, 10 aa, Homo sapiens
  Native (PRAME_HUMAN)
SALQSLLQHL

SEQ ID NO: 161136 - protein, 8 aa, Homo sapiens
  Native (PRAME_HUMAN)
EAAQPMTK

SEQ ID NO: 161137 - protein, 8 aa, Homo sapiens
  Native (PRAME_HUMAN)
ITDDQLLA

SEQ ID NO: 161138 - protein, 10 aa, Homo sapiens
  Native (PRAME_HUMAN)
SYEDIHGTLH

SEQ ID NO: 161139 - protein, 11 aa, Homo sapiens
  Native (PRAME_HUMAN)
LYVDSLFFLRG

SEQ ID NO: 161140 - protein, 9 aa, Homo sapiens
  Native (PRAME_HUMAN)
ALLERASAT

SEQ ID NO: 161141 - protein, 10 aa, Homo sapiens
  Native (PRAME_HUMAN)
FWTVWSGNRA

SEQ ID NO: 161142 - protein, 11 aa, Homo sapiens
  Native (PRAME_HUMAN)
GRLDQLLRHVM

SEQ ID NO: 161143 - protein, 11 aa, Homo sapiens
  Native (PRAME_HUMAN)
LPTLAKFSPYL

SEQ ID NO: 161144 - protein, 8 aa, Homo sapiens
  Native (PRAME_HUMAN)
HLERLAYL

SEQ ID NO: 161145 - protein, 9 aa, Homo sapiens
  Native (PRAME_HUMAN)
GNRASLYSF

SEQ ID NO: 161146 - protein, 11 aa, Homo sapiens
  Native (PRAME_HUMAN)
CDELFSYLIEK

SEQ ID NO: 161147 - protein, 10 aa, Homo sapiens
  Native (PRAME_HUMAN)
WTSPRRLVEL

SEQ ID NO: 161148 - protein, 8 aa, Homo sapiens
  Native (PRAME_HUMAN)
NSISISAL

SEQ ID NO: 161149 - protein, 11 aa, Homo sapiens
  Native (PRAME_HUMAN)
RASATLQDLVF

SEQ ID NO: 161150 - protein, 10 aa, Homo sapiens
  Native (PRAME_HUMAN)
LLAQEVRPRR

SEQ ID NO: 161151 - protein, 10 aa, Homo sapiens
  Native (PRAME_HUMAN)
LSHCSQLTTL

SEQ ID NO: 161152 - protein, 9 aa, Homo sapiens
  Native (PRAME_HUMAN)
LLKDEALAI

SEQ ID NO: 161153 - protein, 8 aa, Homo sapiens
  Native (PRAME_HUMAN)
RRRLWGSI

SEQ ID NO: 161154 - protein, 9 aa, Homo sapiens
  Native (PRAME_HUMAN)
SPRRLVELA

SEQ ID NO: 161155 - protein, 10 aa, Homo sapiens
  Native (PRAME_HUMAN)
ALLERASATL

SEQ ID NO: 161156 - protein, 11 aa, Homo sapiens
  Native (PRAME_HUMAN)
SLLKDEALAIA

SEQ ID NO: 161157 - protein, 10 aa, Homo sapiens
  Native (PRAME_HUMAN)
FSYLIEKVKR

SEQ ID NO: 161158 - protein, 11 aa, Homo sapiens
  Native (PRAME_HUMAN)
MSVWTSPRRLV

SEQ ID NO: 161159 - protein, 9 aa, Homo sapiens
  Native (PRAME_HUMAN)
KVDGLSTEA

SEQ ID NO: 161160 - protein, 9 aa, Homo sapiens
  Native (PRAME_HUMAN)
SISALQSLL

SEQ ID NO: 161161 - protein, 8 aa, Homo sapiens
  Native (PRAME_HUMAN)
YPVPLESY

SEQ ID NO: 161162 - protein, 8 aa, Homo sapiens
  Native (PRAME_HUMAN)
VKRKKNVL

SEQ ID NO: 161163 - protein, 10 aa, Homo sapiens
  Native (PRAME_HUMAN)
LSFYGNSISI

SEQ ID NO: 161164 - protein, 11 aa, Homo sapiens
  Native (PRAME_HUMAN)
DVMHLSQSPSV

SEQ ID NO: 161165 - protein, 9 aa, Homo sapiens
  Native (PRAME_HUMAN)
ERLAYLHAR

SEQ ID NO: 161166 - protein, 11 aa, Homo sapiens
  Native (PRAME_HUMAN)
LESYEDIHGTL

SEQ ID NO: 161167 - protein, 10 aa, Homo sapiens
  Native (PRAME_HUMAN)
LRGRLDQLLR

SEQ ID NO: 161168 - protein, 10 aa, Homo sapiens
  Native (PRAME_HUMAN)
TWKLPTLAKF

SEQ ID NO: 161169 - protein, 10 aa, Homo sapiens
  Native (PRAME_HUMAN)
RKVDGLSTEA

SEQ ID NO: 161170 - protein, 11 aa, Homo sapiens
  Native (PRAME_HUMAN)
MPMQDIKMILK

SEQ ID NO: 161171 - protein, 9 aa, Homo sapiens
  Native (PRAME_HUMAN)
FDGRHSQTL

SEQ ID NO: 161172 - protein, 8 aa, Homo sapiens
  Native (PRAME_HUMAN)
NPLETLSI

SEQ ID NO: 161173 - protein, 8 aa, Homo sapiens
  Native (PRAME_HUMAN)
SVWTSPRR

SEQ ID NO: 161174 - protein, 8 aa, Homo sapiens
  Native (PRAME_HUMAN)
VSPEPLQA

SEQ ID NO: 161175 - protein, 11 aa, Homo sapiens
  Native (PRAME_HUMAN)
LSLQCLQALYV

SEQ ID NO: 161176 - protein, 9 aa, Homo sapiens
  Native (PRAME_HUMAN)
LSTEAEQPF

SEQ ID NO: 161177 - protein, 11 aa, Homo sapiens
  Native (PRAME_HUMAN)
FYDPEPILCPC

SEQ ID NO: 161178 - protein, 8 aa, Homo sapiens
  Native (PRAME_HUMAN)
GRLDQLLR

SEQ ID NO: 161179 - protein, 8 aa, Homo sapiens
  Native (PRAME_HUMAN)
NRASLYSF

SEQ ID NO: 161180 - protein, 9 aa, Homo sapiens
  Native (PRAME_HUMAN)
IGLSNLTHV

SEQ ID NO: 161181 - protein, 9 aa, Homo sapiens
  Native (PRAME_HUMAN)
LVELAGQSL

SEQ ID NO: 161182 - protein, 8 aa, Homo sapiens
  Native (PRAME_HUMAN)
LETFKAVL

SEQ ID NO: 161183 - protein, 8 aa, Homo sapiens
  Native (PRAME_HUMAN)
PRELFPPL

SEQ ID NO: 161184 - protein, 8 aa, Homo sapiens
  Native (PRAME_HUMAN)
MSVWTSPR

SEQ ID NO: 161185 - protein, 8 aa, Homo sapiens
  Native (PRAME_HUMAN)
GLSNLTHV

SEQ ID NO: 161186 - protein, 10 aa, Homo sapiens
  Native (PRAME_HUMAN)
QLLALLPSLS

SEQ ID NO: 161187 - protein, 11 aa, Homo sapiens
  Native (PRAME_HUMAN)
AEQPFIPVEVL

SEQ ID NO: 161188 - protein, 10 aa, Homo sapiens
  Native (PRAME_HUMAN)
RPRRWKLQVL

SEQ ID NO: 161189 - protein, 11 aa, Homo sapiens
  Native (PRAME_HUMAN)
SLYSFPEPEAA

SEQ ID NO: 161190 - protein, 10 aa, Homo sapiens
  Native (PRAME_HUMAN)
HLIGLSNLTH

SEQ ID NO: 161191 - protein, 10 aa, Homo sapiens
  Native (PRAME_HUMAN)
RRLWGSIQSR

SEQ ID NO: 161192 - protein, 11 aa, Homo sapiens
  Native (PRAME_HUMAN)
HGTLHLERLAY

SEQ ID NO: 161193 - protein, 9 aa, Homo sapiens
  Native (PRAME_HUMAN)
PFIPVEVLV

SEQ ID NO: 161194 - protein, 8 aa, Homo sapiens
  Native (PRAME_HUMAN)
LYVDSLFF

SEQ ID NO: 161195 - protein, 8 aa, Homo sapiens
  Native (PRAME_HUMAN)
QSPSVSQL

SEQ ID NO: 161196 - protein, 9 aa, Homo sapiens
  Native (PRAME_HUMAN)
SPYLGQMIN

SEQ ID NO: 161197 - protein, 11 aa, Homo sapiens
  Native (PRAME_HUMAN)
PEKEEQYIAQF

SEQ ID NO: 161198 - protein, 10 aa, Homo sapiens
  Native (PRAME_HUMAN)
TEAEQPFIPV

SEQ ID NO: 161199 - protein, 11 aa, Homo sapiens
  Native (PRAME_HUMAN)
DVSPEPLQALL

SEQ ID NO: 161200 - protein, 11 aa, Homo sapiens
  Native (PRAME_HUMAN)
LLQHLIGLSNL

SEQ ID NO: 161201 - protein, 10 aa, Homo sapiens
  Native (PRAME_HUMAN)
SMSVWTSPRR

SEQ ID NO: 161202 - protein, 10 aa, Homo sapiens
  Native (PRAME_HUMAN)
RHSQTLKAMV

SEQ ID NO: 161203 - protein, 11 aa, Homo sapiens
  Native (PRAME_HUMAN)
RLRELLCELGR

SEQ ID NO: 161204 - protein, 11 aa, Homo sapiens
  Native (PRAME_HUMAN)
YISMSVWTSPR

SEQ ID NO: 161205 - protein, 8 aa, Homo sapiens
  Native (PRAME_HUMAN)
PFIPVEVL

SEQ ID NO: 161206 - protein, 11 aa, Homo sapiens
  Native (PRAME_HUMAN)
VQAWPFTCLPL

SEQ ID NO: 161207 - protein, 10 aa, Homo sapiens
  Native (PRAME_HUMAN)
LRELLCELGR

SEQ ID NO: 161208 - protein, 11 aa, Homo sapiens
  Native (PRAME_HUMAN)
NLTHVLYPVPL

SEQ ID NO: 161209 - protein, 10 aa, Homo sapiens
  Native (PRAME_HUMAN)
LTHVLYPVPL

SEQ ID NO: 161210 - protein, 10 aa, Homo sapiens
  Native (PRAME_HUMAN)
TLHLERLAYL

SEQ ID NO: 161211 - protein, 8 aa, Homo sapiens
  Native (PRAME_HUMAN)
QMINLRRL

SEQ ID NO: 161212 - protein, 10 aa, Homo sapiens
  Native (PRAME_HUMAN)
RGRLDQLLRH

SEQ ID NO: 161213 - protein, 9 aa, Homo sapiens
  Native (PRAME_HUMAN)
LGQMINLRR

SEQ ID NO: 161214 - protein, 10 aa, Homo sapiens
  Native (PRAME_HUMAN)
RRRLWGSIQS

SEQ ID NO: 161215 - protein, 10 aa, Homo sapiens
  Native (PRAME_HUMAN)
MHLSQSPSVS

SEQ ID NO: 161216 - protein, 11 aa, Homo sapiens
  Native (PRAME_HUMAN)
ELLPRELFPPL

SEQ ID NO: 161217 - protein, 9 aa, Homo sapiens
  Native (PRAME_HUMAN)
HLHLETFKA

SEQ ID NO: 161218 - protein, 8 aa, Homo sapiens
  Native (PRAME_HUMAN)
QLDSIEDL

SEQ ID NO: 161219 - protein, 10 aa, Homo sapiens
  Native (PRAME_HUMAN)
RRWKLQVLDL

SEQ ID NO: 161220 - protein, 8 aa, Homo sapiens
  Native (PRAME_HUMAN)
VLDGLDVL

SEQ ID NO: 161221 - protein, 9 aa, Homo sapiens
  Native (PRAME_HUMAN)
GQSLLKDEA

SEQ ID NO: 161222 - protein, 10 aa, Homo sapiens
  Native (PRAME_HUMAN)
FLKEGACDEL

SEQ ID NO: 161223 - protein, 9 aa, Homo sapiens
  Native (PRAME_HUMAN)
YVDSLFFLR

SEQ ID NO: 161224 - protein, 11 aa, Homo sapiens
  Native (PRAME_HUMAN)
KNSHQDFWTVW

SEQ ID NO: 161225 - protein, 9 aa, Homo sapiens
  Native (PRAME_HUMAN)
KMILKMVQL

SEQ ID NO: 161226 - protein, 8 aa, Homo sapiens
  Native (PRAME_HUMAN)
LAYLHARL

SEQ ID NO: 161227 - protein, 8 aa, Homo sapiens
  Native (PRAME_HUMAN)
YLIEKVKR

SEQ ID NO: 161228 - protein, 11 aa, Homo sapiens
  Native (PRAME_HUMAN)
NSISISALQSL

SEQ ID NO: 161229 - protein, 11 aa, Homo sapiens
  Native (PRAME_HUMAN)
HVLYPVPLESY

SEQ ID NO: 161230 - protein, 11 aa, Homo sapiens
  Native (PRAME_HUMAN)
TLHLERLAYLH

SEQ ID NO: 161231 - protein, 11 aa, Homo sapiens
  Native (PRAME_HUMAN)
WPFTCLPLGVL

SEQ ID NO: 161232 - protein, 11 aa, Homo sapiens
  Native (PRAME_HUMAN)
ISMSVWTSPRR

SEQ ID NO: 161233 - protein, 10 aa, Homo sapiens
  Native (PRAME_HUMAN)
SVLSLSGVML

SEQ ID NO: 161234 - protein, 9 aa, Homo sapiens
  Native (PRAME_HUMAN)
RPRRWKLQV

SEQ ID NO: 161235 - protein, 11 aa, Homo sapiens
  Native (PRAME_HUMAN)
CGITDDQLLAL

SEQ ID NO: 161236 - protein, 10 aa, Homo sapiens
  Native (PRAME_HUMAN)
SVSQLSVLSL

SEQ ID NO: 161237 - protein, 9 aa, Homo sapiens
  Native (PRAME_HUMAN)
NSISISALQ

SEQ ID NO: 161238 - protein, 9 aa, Homo sapiens
  Native (PRAME_HUMAN)
LHARLRELL

SEQ ID NO: 161239 - protein, 9 aa, Homo sapiens
  Native (PRAME_HUMAN)
LCELGRPSM

SEQ ID NO: 161240 - protein, 11 aa, Homo sapiens
  Native (PRAME_HUMAN)
VLLAQEVRPRR

SEQ ID NO: 161241 - protein, 11 aa, Homo sapiens
  Native (PRAME_HUMAN)
SYEDIHGTLHL

SEQ ID NO: 161242 - protein, 8 aa, Homo sapiens
  Native (PRAME_HUMAN)
AAQPMTKK

SEQ ID NO: 161243 - protein, 8 aa, Homo sapiens
  Native (PRAME_HUMAN)
CTWKLPTL

SEQ ID NO: 161244 - protein, 11 aa, Homo sapiens
  Native (PRAME_HUMAN)
EKVKRKKNVLR

SEQ ID NO: 161245 - protein, 10 aa, Homo sapiens
  Native (PRAME_HUMAN)
YLHARLRELL

SEQ ID NO: 161246 - protein, 10 aa, Homo sapiens
  Native (PRAME_HUMAN)
QLDSIEDLEV

SEQ ID NO: 161247 - protein, 10 aa, Homo sapiens
  Native (PRAME_HUMAN)
VRPRRWKLQV

SEQ ID NO: 161248 - protein, 10 aa, Homo sapiens
  Native (PRAME_HUMAN)
RYISMSVWTS

SEQ ID NO: 161249 - protein, 9 aa, Homo sapiens
  Native (PRAME_HUMAN)
ASSYISPEK

SEQ ID NO: 161250 - protein, 10 aa, Homo sapiens
  Native (PRAME_HUMAN)
VLDGLDVLLA

SEQ ID NO: 161251 - protein, 10 aa, Homo sapiens
  Native (PRAME_HUMAN)
QEVRPRRWKL

SEQ ID NO: 161252 - protein, 9 aa, Homo sapiens
  Native (PRAME_HUMAN)
DELFSYLIE

SEQ ID NO: 161253 - protein, 9 aa, Homo sapiens
  Native (PRAME_HUMAN)
SFYGNSISI

SEQ ID NO: 161254 - protein, 9 aa, Homo sapiens
  Native (PRAME_HUMAN)
KVKRKKNVL

SEQ ID NO: 161255 - protein, 10 aa, Homo sapiens
  Native (PRAME_HUMAN)
SLLQHLIGLS

SEQ ID NO: 161256 - protein, 11 aa, Homo sapiens
  Native (PRAME_HUMAN)
TLSFYGNSISI

SEQ ID NO: 161257 - protein, 11 aa, Homo sapiens
  Native (PRAME_HUMAN)
EPEAAQPMTKK

SEQ ID NO: 161258 - protein, 8 aa, Homo sapiens
  Native (PRAME_HUMAN)
HGTLHLER

SEQ ID NO: 161259 - protein, 9 aa, Homo sapiens
  Native (PRAME_HUMAN)
LSEGDVMHL

SEQ ID NO: 161260 - protein, 10 aa, Homo sapiens
  Native (PRAME_HUMAN)
RRLLLSHIHA

SEQ ID NO: 161261 - protein, 9 aa, Homo sapiens
  Native (PRAME_HUMAN)
QMINLRRLL

SEQ ID NO: 161262 - protein, 11 aa, Homo sapiens
  Native (PRAME_HUMAN)
LRHVMNPLETL

SEQ ID NO: 161263 - protein, 9 aa, Homo sapiens
  Native (PRAME_HUMAN)
GQMINLRRL

SEQ ID NO: 161264 - protein, 10 aa, Homo sapiens
  Native (PRAME_HUMAN)
LRLCCKKLKI

SEQ ID NO: 161265 - protein, 8 aa, Homo sapiens
  Native (PRAME_HUMAN)
VWTSPRRL

SEQ ID NO: 161266 - protein, 11 aa, Homo sapiens
  Native (PRAME_HUMAN)
VRPRRWKLQVL

SEQ ID NO: 161267 - protein, 10 aa, Homo sapiens
  Native (PRAME_HUMAN)
SLQCLQALYV

SEQ ID NO: 161268 - protein, 9 aa, Homo sapiens
  Native (PRAME_HUMAN)
ALELLPREL

SEQ ID NO: 161269 - protein, 11 aa, Homo sapiens
  Native (PRAME_HUMAN)
LQALYVDSLFF

SEQ ID NO: 161270 - protein, 8 aa, Homo sapiens
  Native (PRAME_HUMAN)
TLAKFSPY

SEQ ID NO: 161271 - protein, 10 aa, Homo sapiens
  Native (PRAME_HUMAN)
AKFSPYLGQM

SEQ ID NO: 161272 - protein, 9 aa, Homo sapiens
  Native (PRAME_HUMAN)
MINLRRLLL

SEQ ID NO: 161273 - protein, 9 aa, Homo sapiens
  Native (PRAME_HUMAN)
SVWTSPRRL

SEQ ID NO: 161274 - protein, 11 aa, Homo sapiens
  Native (PRAME_HUMAN)
LLKDEALAIAA

SEQ ID NO: 161275 - protein, 9 aa, Homo sapiens
  Native (PRAME_HUMAN)
KFSPYLGQM

SEQ ID NO: 161276 - protein, 8 aa, Homo sapiens
  Native (PRAME_HUMAN)
TEAEQPFI

SEQ ID NO: 161277 - protein, 11 aa, Homo sapiens
  Native (PRAME_HUMAN)
LRGRLDQLLRH

SEQ ID NO: 161278 - protein, 9 aa, Homo sapiens
  Native (PRAME_HUMAN)
VLSLSGVML

SEQ ID NO: 161279 - protein, 8 aa, Homo sapiens
  Native (PRAME_HUMAN)
YSFPEPEA

SEQ ID NO: 161280 - protein, 9 aa, Homo sapiens
  Native (PRAME_HUMAN)
PEPEAAQPM

SEQ ID NO: 161281 - protein, 11 aa, Homo sapiens
  Native (PRAME_HUMAN)
HLERLAYLHAR

SEQ ID NO: 161282 - protein, 11 aa, Homo sapiens
  Native (PRAME_HUMAN)
LFSYLIEKVKR

SEQ ID NO: 161283 - protein, 9 aa, Homo sapiens
  Native (PRAME_HUMAN)
TLHLERLAY

SEQ ID NO: 161284 - protein, 8 aa, Homo sapiens
  Native (PRAME_HUMAN)
THVLYPVP

SEQ ID NO: 161285 - protein, 9 aa, Homo sapiens
  Native (PRAME_HUMAN)
CELGRPSMV

SEQ ID NO: 161286 - protein, 10 aa, Homo sapiens
  Native (PRAME_HUMAN)
ERLAYLHARL

SEQ ID NO: 161287 - protein, 11 aa, Homo sapiens
  Native (PRAME_HUMAN)
FSPYLGQMINL

SEQ ID NO: 161288 - protein, 9 aa, Homo sapiens
  Native (PRAME_HUMAN)
SRYISMSVW

SEQ ID NO: 161289 - protein, 9 aa, Homo sapiens
  Native (PRAME_HUMAN)
LPTLAKFSP

SEQ ID NO: 161290 - protein, 9 aa, Homo sapiens
  Native (PRAME_HUMAN)
RRLVELAGQ

SEQ ID NO: 161291 - protein, 9 aa, Homo sapiens
  Native (PRAME_HUMAN)
LWGSIQSRY

SEQ ID NO: 161292 - protein, 11 aa, Homo sapiens
  Native (PRAME_HUMAN)
QDFWTVWSGNR

SEQ ID NO: 161293 - protein, 10 aa, Homo sapiens
  Native (PRAME_HUMAN)
QMINLRRLLL

SEQ ID NO: 161294 - protein, 9 aa, Homo sapiens
  Native (PRAME_HUMAN)
HARLRELLC

SEQ ID NO: 161295 - protein, 10 aa, Homo sapiens
  Native (PRAME_HUMAN)
SLSHCSQLTT

SEQ ID NO: 161296 - protein, 11 aa, Homo sapiens
  Native (PRAME_HUMAN)
IGLSNLTHVLY

SEQ ID NO: 161297 - protein, 10 aa, Homo sapiens
  Native (PRAME_HUMAN)
MQDIKMILKM

SEQ ID NO: 161298 - protein, 10 aa, Homo sapiens
  Native (PRAME_HUMAN)
VEVLVDLFLK

SEQ ID NO: 161299 - protein, 10 aa, Homo sapiens
  Native (PRAME_HUMAN)
AAFDGRHSQT

SEQ ID NO: 161300 - protein, 10 aa, Homo sapiens
  Native (PRAME_HUMAN)
AIAALELLPR

SEQ ID NO: 161301 - protein, 10 aa, Homo sapiens
  Native (PRAME_HUMAN)
ERASATLQDL

SEQ ID NO: 161302 - protein, 11 aa, Homo sapiens
  Native (PRAME_HUMAN)
LCELGRPSMVW

SEQ ID NO: 161303 - protein, 9 aa, Homo sapiens
  Native (PRAME_HUMAN)
KDEALAIAA

SEQ ID NO: 161304 - protein, 8 aa, Homo sapiens
  Native (PRAME_HUMAN)
MQDIKMIL

SEQ ID NO: 161305 - protein, 8 aa, Homo sapiens
  Native (PRAME_HUMAN)
YLGQMINL

SEQ ID NO: 161306 - protein, 9 aa, Homo sapiens
  Native (PRAME_HUMAN)
EQPFIPVEV

SEQ ID NO: 161307 - protein, 8 aa, Homo sapiens
  Native (PRAME_HUMAN)
DSIEDLEV

SEQ ID NO: 161308 - protein, 11 aa, Homo sapiens
  Native (PRAME_HUMAN)
QFLSLQCLQAL

SEQ ID NO: 161309 - protein, 8 aa, Homo sapiens
  Native (PRAME_HUMAN)
AMVQAWPF

SEQ ID NO: 161310 - protein, 10 aa, Homo sapiens
  Native (PRAME_HUMAN)
GITDDQLLAL

SEQ ID NO: 161311 - protein, 9 aa, Homo sapiens
  Native (PRAME_HUMAN)
GLSNLTHVL

SEQ ID NO: 161312 - protein, 9 aa, Homo sapiens
  Native (PRAME_HUMAN)
LRGRLDQLL

SEQ ID NO: 161313 - protein, 9 aa, Homo sapiens
  Native (PRAME_HUMAN)
HLIGLSNLT

SEQ ID NO: 161314 - protein, 9 aa, Homo sapiens
  Native (PRAME_HUMAN)
TLSITNCRL

SEQ ID NO: 161315 - protein, 9 aa, Homo sapiens
  Native (PRAME_HUMAN)
IPVEVLVDL

SEQ ID NO: 161316 - protein, 9 aa, Homo sapiens
  Native (PRAME_HUMAN)
LERLAYLHA

SEQ ID NO: 161317 - protein, 11 aa, Homo sapiens
  Native (PRAME_HUMAN)
YVDSLFFLRGR

SEQ ID NO: 161318 - protein, 9 aa, Homo sapiens
  Native (PRAME_HUMAN)
LCCKKLKIF

SEQ ID NO: 161319 - protein, 9 aa, Homo sapiens
  Native (PRAME_HUMAN)
NPCPHCGDR

SEQ ID NO: 161320 - protein, 9 aa, Homo sapiens
  Native (PRAME_HUMAN)
EVRPRRWKL

SEQ ID NO: 161321 - protein, 9 aa, Homo sapiens
  Native (PRAME_HUMAN)
IAQFTSQFL

SEQ ID NO: 161322 - protein, 9 aa, Homo sapiens
  Native (PRAME_HUMAN)
SLFFLRGRL

SEQ ID NO: 161323 - protein, 9 aa, Homo sapiens
  Native (PRAME_HUMAN)
FTCLPLGVL

SEQ ID NO: 161324 - protein, 11 aa, Homo sapiens
  Native (PRAME_HUMAN)
RRLLLSHIHAS

SEQ ID NO: 161325 - protein, 10 aa, Homo sapiens
  Native (PRAME_HUMAN)
CCKKLKIFAM

SEQ ID NO: 161326 - protein, 9 aa, Homo sapiens
  Native (PRAME_HUMAN)
YIAQFTSQF

SEQ ID NO: 161327 - protein, 11 aa, Homo sapiens
  Native (PRAME_HUMAN)
LETFKAVLDGL

SEQ ID NO: 161328 - protein, 10 aa, Homo sapiens
  Native (PRAME_HUMAN)
AQFTSQFLSL

SEQ ID NO: 161329 - protein, 11 aa, Homo sapiens
  Native (PRAME_HUMAN)
FLKEGACDELF

SEQ ID NO: 161330 - protein, 9 aa, Homo sapiens
  Native (PRAME_HUMAN)
IAALELLPR

SEQ ID NO: 161331 - protein, 9 aa, Homo sapiens
  Native (PRAME_HUMAN)
MPMQDIKMI

SEQ ID NO: 161332 - protein, 8 aa, Homo sapiens
  Native (PRAME_HUMAN)
SRYISMSV

SEQ ID NO: 161333 - protein, 9 aa, Homo sapiens
  Native (PRAME_HUMAN)
RGRLDQLLR

SEQ ID NO: 161334 - protein, 11 aa, Homo sapiens
  Native (PRAME_HUMAN)
EALAIAALELL

SEQ ID NO: 161335 - protein, 11 aa, Homo sapiens
  Native (PRAME_HUMAN)
SLSHCSQLTTL

SEQ ID NO: 161336 - protein, 11 aa, Homo sapiens
  Native (PRAME_HUMAN)
ERLAYLHARLR

SEQ ID NO: 161337 - protein, 8 aa, Homo sapiens
  Native (PRAME_HUMAN)
MINLRRLL

SEQ ID NO: 161338 - protein, 11 aa, Homo sapiens
  Native (PRAME_HUMAN)
DVLLAQEVRPR

SEQ ID NO: 161339 - protein, 10 aa, Homo sapiens
  Native (PRAME_HUMAN)
GLSTEAEQPF

SEQ ID NO: 161340 - protein, 11 aa, Homo sapiens
  Native (PRAME_HUMAN)
LETLSITNCRL

SEQ ID NO: 161341 - protein, 11 aa, Homo sapiens
  Native (PRAME_HUMAN)
RRLVELAGQSL

SEQ ID NO: 161342 - protein, 10 aa, Homo sapiens
  Native (PRAME_HUMAN)
EPLQALLERA

SEQ ID NO: 161343 - protein, 10 aa, Homo sapiens
  Native (PRAME_HUMAN)
MLTDVSPEPL

SEQ ID NO: 161344 - protein, 11 aa, Homo sapiens
  Native (PRAME_HUMAN)
SIQSRYISMSV

SEQ ID NO: 161345 - protein, 10 aa, Homo sapiens
  Native (PRAME_HUMAN)
ALELLPRELF

SEQ ID NO: 161346 - protein, 9 aa, Homo sapiens
  Native (PRAME_HUMAN)
MHLSQSPSV

SEQ ID NO: 161347 - protein, 10 aa, Homo sapiens
  Native (PRAME_HUMAN)
TDVSPEPLQA

SEQ ID NO: 161348 - protein, 9 aa, Homo sapiens
  Native (PRAME_HUMAN)
VLMKGQHLH

SEQ ID NO: 161349 - protein, 9 aa, Homo sapiens
  Native (PRAME_HUMAN)
SPSVSQLSV

SEQ ID NO: 161350 - protein, 10 aa, Homo sapiens
  Native (PRAME_HUMAN)
ALYVDSLFFL

SEQ ID NO: 161351 - protein, 9 aa, Homo sapiens
  Native (PRAME_HUMAN)
FSPYLGQMI

SEQ ID NO: 161352 - protein, 10 aa, Homo sapiens
  Native (PRAME_HUMAN)
CLQALYVDSL

SEQ ID NO: 161353 - protein, 10 aa, Homo sapiens
  Native (PRAME_HUMAN)
VLSLSGVMLT

SEQ ID NO: 161354 - protein, 9 aa, Homo sapiens
  Native (PRAME_HUMAN)
LIEKVKRKK

SEQ ID NO: 161355 - protein, 10 aa, Homo sapiens
  Native (PRAME_HUMAN)
SYLIEKVKRK

SEQ ID NO: 161356 - protein, 9 aa, Homo sapiens
  Native (PRAME_HUMAN)
LLSHIHASS

SEQ ID NO: 161357 - protein, 10 aa, Homo sapiens
  Native (PRAME_HUMAN)
SQLTTLSFYG

SEQ ID NO: 161358 - protein, 10 aa, Homo sapiens
  Native (PRAME_HUMAN)
VLMKGQHLHL

SEQ ID NO: 161359 - protein, 11 aa, Homo sapiens
  Native (PRAME_HUMAN)
LSNLTHVLYPV

SEQ ID NO: 161360 - protein, 10 aa, Homo sapiens
  Native (PRAME_HUMAN)
FLSLQCLQAL

SEQ ID NO: 161361 - protein, 11 aa, Homo sapiens
  Native (PRAME_HUMAN)
FTCLPLGVLMK

SEQ ID NO: 161362 - protein, 8 aa, Homo sapiens
  Native (PRAME_HUMAN)
VMNPLETL

SEQ ID NO: 161363 - protein, 8 aa, Homo sapiens
  Native (PRAME_HUMAN)
DEALAIAA

SEQ ID NO: 161364 - protein, 10 aa, Homo sapiens
  Native (PRAME_HUMAN)
FLRGRLDQLL

SEQ ID NO: 161365 - protein, 8 aa, Homo sapiens
  Native (PRAME_HUMAN)
LRGRLDQL

SEQ ID NO: 161366 - protein, 11 aa, Homo sapiens
  Native (PRAME_HUMAN)
LLLSHIHASSY

SEQ ID NO: 161367 - protein, 9 aa, Homo sapiens
  Native (PRAME_HUMAN)
SVLSLSGVM

SEQ ID NO: 161368 - protein, 9 aa, Homo sapiens
  Native (PRAME_HUMAN)
LLLSHIHAS

SEQ ID NO: 161369 - protein, 10 aa, Homo sapiens
  Native (PRAME_HUMAN)
LIGLSNLTHV

SEQ ID NO: 161370 - protein, 10 aa, Homo sapiens
  Native (PRAME_HUMAN)
LSHIHASSYI

SEQ ID NO: 161371 - protein, 11 aa, Homo sapiens
  Native (PRAME_HUMAN)
LTDVSPEPLQA

SEQ ID NO: 161372 - protein, 8 aa, Homo sapiens
  Native (PRAME_HUMAN)
ISALQSLL

SEQ ID NO: 161373 - protein, 8 aa, Homo sapiens
  Native (PRAME_HUMAN)
LSLSGVML

SEQ ID NO: 161374 - protein, 10 aa, Homo sapiens
  Native (PRAME_HUMAN)
LERLAYLHAR

SEQ ID NO: 161375 - protein, 11 aa, Homo sapiens
  Native (PRAME_HUMAN)
YLGQMINLRRL

SEQ ID NO: 161376 - protein, 8 aa, Homo sapiens
  Native (PRAME_HUMAN)
LPRELFPP

SEQ ID NO: 161377 - protein, 9 aa, Homo sapiens
  Native (PRAME_HUMAN)
FAMPMQDIK

SEQ ID NO: 161378 - protein, 11 aa, Homo sapiens
  Native (PRAME_HUMAN)
YLHARLRELLC

SEQ ID NO: 161379 - protein, 8 aa, Homo sapiens
  Native (PRAME_HUMAN)
TDVSPEPL

SEQ ID NO: 161380 - protein, 9 aa, Homo sapiens
  Native (PRAME_HUMAN)
EEQYIAQFT

SEQ ID NO: 161381 - protein, 10 aa, Homo sapiens
  Native (PRAME_HUMAN)
DELFSYLIEK

SEQ ID NO: 161382 - protein, 11 aa, Homo sapiens
  Native (PRAME_HUMAN)
EDIHGTLHLER

SEQ ID NO: 161383 - protein, 10 aa, Homo sapiens
  Native (PRAME_HUMAN)
IGLSNLTHVL

SEQ ID NO: 161384 - protein, 9 aa, Homo sapiens
  Native (PRAME_HUMAN)
VFDECGITD

SEQ ID NO: 161385 - protein, 10 aa, Homo sapiens
  Native (PRAME_HUMAN)
IKMILKMVQL

SEQ ID NO: 161386 - protein, 10 aa, Homo sapiens
  Native (PRAME_HUMAN)
RLRELLCELG

SEQ ID NO: 161387 - protein, 10 aa, Homo sapiens
  Native (PRAME_HUMAN)
LPRELFPPLF

SEQ ID NO: 161388 - protein, 10 aa, Homo sapiens
  Native (PRAME_HUMAN)
SNLTHVLYPV

SEQ ID NO: 161389 - protein, 11 aa, Homo sapiens
  Native (PRAME_HUMAN)
SQTLKAMVQAW

SEQ ID NO: 161390 - protein, 11 aa, Homo sapiens
  Native (PRAME_HUMAN)
VMLTDVSPEPL

SEQ ID NO: 161391 - protein, 9 aa, Homo sapiens
  Native (PRAME_HUMAN)
KAVLDGLDV

SEQ ID NO: 161392 - protein, 9 aa, Homo sapiens
  Native (PRAME_HUMAN)
PRELFPPLF

SEQ ID NO: 161393 - protein, 9 aa, Homo sapiens
  Native (PRAME_HUMAN)
EAAQPMTKK

SEQ ID NO: 161394 - protein, 9 aa, Homo sapiens
  Native (PRAME_HUMAN)
SLSHCSQLT

SEQ ID NO: 161395 - protein, 8 aa, Homo sapiens
  Native (PRAME_HUMAN)
SQLSVLSL

SEQ ID NO: 161396 - protein, 9 aa, Homo sapiens
  Native (PRAME_HUMAN)
FMAAFDGRH

SEQ ID NO: 161397 - protein, 10 aa, Homo sapiens
  Native (PRAME_HUMAN)
DPEPILCPCF

SEQ ID NO: 161398 - protein, 10 aa, Homo sapiens
  Native (PRAME_HUMAN)
KIFAMPMQDI

SEQ ID NO: 161399 - protein, 10 aa, Homo sapiens
  Native (PRAME_HUMAN)
LLSHIHASSY

SEQ ID NO: 161400 - protein, 11 aa, Homo sapiens
  Native (PRAME_HUMAN)
KMVQLDSIEDL

SEQ ID NO: 161401 - protein, 11 aa, Homo sapiens
  Native (PRAME_HUMAN)
IPVEVLVDLFL

SEQ ID NO: 161402 - protein, 9 aa, Homo sapiens
  Native (PRAME_HUMAN)
WTVWSGNRA

SEQ ID NO: 161403 - protein, 11 aa, Homo sapiens
  Native (PRAME_HUMAN)
SQLSVLSLSGV

SEQ ID NO: 161404 - protein, 9 aa, Homo sapiens
  Native (PRAME_HUMAN)
LPLGVLMKG

SEQ ID NO: 161405 - protein, 10 aa, Homo sapiens
  Native (PRAME_HUMAN)
NLRRLLLSHI

SEQ ID NO: 161406 - protein, 11 aa, Homo sapiens
  Native (PRAME_HUMAN)
YPVPLESYEDI

SEQ ID NO: 161407 - protein, 10 aa, Homo sapiens
  Native (PRAME_HUMAN)
QPFIPVEVLV

SEQ ID NO: 161408 - protein, 11 aa, Homo sapiens
  Native (PRAME_HUMAN)
SQSPSVSQLSV

SEQ ID NO: 161409 - protein, 9 aa, Homo sapiens
  Native (PRAME_HUMAN)
NPLETLSIT

SEQ ID NO: 161410 - protein, 10 aa, Homo sapiens
  Native (PRAME_HUMAN)
GRLDQLLRHV

SEQ ID NO: 161411 - protein, 10 aa, Homo sapiens
  Native (PRAME_HUMAN)
LTDVSPEPLQ

SEQ ID NO: 161412 - protein, 9 aa, Homo sapiens
  Native (PRAME_HUMAN)
RLDQLLRHV

SEQ ID NO: 161413 - protein, 10 aa, Homo sapiens
  Native (PRAME_HUMAN)
LVELAGQSLL

SEQ ID NO: 161414 - protein, 10 aa, Homo sapiens
  Native (PRAME_HUMAN)
EALAIAALEL

SEQ ID NO: 161415 - protein, 10 aa, Homo sapiens
  Native (PRAME_HUMAN)
DVSPEPLQAL

SEQ ID NO: 161416 - protein, 11 aa, Homo sapiens
  Native (PRAME_HUMAN)
CTWKLPTLAKF

SEQ ID NO: 161417 - protein, 10 aa, Homo sapiens
  Native (PRAME_HUMAN)
MERRRLWGSI

SEQ ID NO: 161418 - protein, 9 aa, Homo sapiens
  Native (PRAME_HUMAN)
RASATLQDL

SEQ ID NO: 161419 - protein, 11 aa, Homo sapiens
  Native (PRAME_HUMAN)
NPLETLSITNC

SEQ ID NO: 161420 - protein, 10 aa, Homo sapiens
  Native (PRAME_HUMAN)
AFDGRHSQTL

SEQ ID NO: 161421 - protein, 11 aa, Homo sapiens
  Native (PRAME_HUMAN)
LLCELGRPSMV

SEQ ID NO: 161422 - protein, 9 aa, Homo sapiens
  Native (PRAME_HUMAN)
YLGQMINLR

SEQ ID NO: 161423 - protein, 8 aa, Homo sapiens
  Native (PRAME_HUMAN)
HQDFWTVW

SEQ ID NO: 161424 - protein, 9 aa, Homo sapiens
  Native (PRAME_HUMAN)
SIEDLEVTC

SEQ ID NO: 161425 - protein, 10 aa, Homo sapiens
  Native (PRAME_HUMAN)
SLSGVMLTDV

SEQ ID NO: 161426 - protein, 9 aa, Homo sapiens
  Native (PRAME_HUMAN)
SPEKEEQYI

SEQ ID NO: 161427 - protein, 10 aa, Homo sapiens
  Native (PRAME_HUMAN)
YISPEKEEQY

SEQ ID NO: 161428 - protein, 9 aa, Homo sapiens
  Native (PRAME_HUMAN)
CKKLKIFAM

SEQ ID NO: 161429 - protein, 10 aa, Homo sapiens
  Native (PRAME_HUMAN)
FMAAFDGRHS

SEQ ID NO: 161430 - protein, 9 aa, Homo sapiens
  Native (PRAME_HUMAN)
AAQPMTKKR

SEQ ID NO: 161431 - protein, 11 aa, Homo sapiens
  Native (PRAME_HUMAN)
LLPRELFPPLF

SEQ ID NO: 161432 - protein, 11 aa, Homo sapiens
  Native (PRAME_HUMAN)
FKAVLDGLDVL

SEQ ID NO: 161433 - protein, 10 aa, Homo sapiens
  Native (PRAME_HUMAN)
GSIQSRYISM

SEQ ID NO: 161434 - protein, 10 aa, Homo sapiens
  Native (PRAME_HUMAN)
ETFKAVLDGL

SEQ ID NO: 161435 - protein, 10 aa, Homo sapiens
  Native (PRAME_HUMAN)
LHLETFKAVL

SEQ ID NO: 161436 - protein, 8 aa, Homo sapiens
  Native (PRAME_HUMAN)
TDDQLLAL

SEQ ID NO: 161437 - protein, 10 aa, Homo sapiens
  Native (PRAME_HUMAN)
LQHLIGLSNL

SEQ ID NO: 161438 - protein, 10 aa, Homo sapiens
  Native (PRAME_HUMAN)
TCLPLGVLMK

SEQ ID NO: 161439 - protein, 11 aa, Homo sapiens
  Native (PRAME_HUMAN)
SIEDLEVTCTW

SEQ ID NO: 161440 - protein, 9 aa, Homo sapiens
  Native (PRAME_HUMAN)
WLSANPCPH

SEQ ID NO: 161441 - protein, 10 aa, Homo sapiens
  Native (PRAME_HUMAN)
YSFPEPEAAQ

SEQ ID NO: 161442 - protein, 9 aa, Homo sapiens
  Native (PRAME_HUMAN)
FPPLFMAAF

SEQ ID NO: 161443 - protein, 11 aa, Homo sapiens
  Native (PRAME_HUMAN)
LPRELFPPLFM

SEQ ID NO: 161444 - protein, 8 aa, Homo sapiens
  Native (PRAME_HUMAN)
HLIGLSNL

SEQ ID NO: 161445 - protein, 8 aa, Homo sapiens
  Native (PRAME_HUMAN)
SLFFLRGR

SEQ ID NO: 161446 - protein, 8 aa, Homo sapiens
  Native (PRAME_HUMAN)
VELAGQSL

SEQ ID NO: 161447 - protein, 8 aa, Homo sapiens
  Native (PRAME_HUMAN)
LFPPLFMA

SEQ ID NO: 161448 - protein, 11 aa, Homo sapiens
  Native (PRAME_HUMAN)
QALYVDSLFFL

SEQ ID NO: 161449 - protein, 11 aa, Homo sapiens
  Native (PRAME_HUMAN)
CRLSEGDVMHL

SEQ ID NO: 161450 - protein, 9 aa, Homo sapiens
  Native (PRAME_HUMAN)
FLSLQCLQA

SEQ ID NO: 161451 - protein, 8 aa, Homo sapiens
  Native (PRAME_HUMAN)
SPEPLQAL

SEQ ID NO: 161452 - protein, 11 aa, Homo sapiens
  Native (PRAME_HUMAN)
RRRLWGSIQSR

SEQ ID NO: 161453 - protein, 10 aa, Homo sapiens
  Native (PRAME_HUMAN)
VELAGQSLLK

SEQ ID NO: 161454 - protein, 11 aa, Homo sapiens
  Native (PRAME_HUMAN)
EQYIAQFTSQF

SEQ ID NO: 161455 - protein, 9 aa, Homo sapiens
  Native (PRAME_HUMAN)
TLSFYGNSI

SEQ ID NO: 161456 - protein, 10 aa, Homo sapiens
  Native (PRAME_HUMAN)
SISISALQSL

SEQ ID NO: 161457 - protein, 9 aa, Homo sapiens
  Native (PRAME_HUMAN)
ALYVDSLFF

SEQ ID NO: 161458 - protein, 8 aa, Homo sapiens
  Native (PRAME_HUMAN)
MILKMVQL

SEQ ID NO: 161459 - protein, 11 aa, Homo sapiens
  Native (PRAME_HUMAN)
LLAQEVRPRRW

SEQ ID NO: 161460 - protein, 11 aa, Homo sapiens
  Native (PRAME_HUMAN)
ALAIAALELLP

SEQ ID NO: 161461 - protein, 10 aa, Homo sapiens
  Native (PRAME_HUMAN)
ARLRELLCEL

SEQ ID NO: 161462 - protein, 8 aa, Homo sapiens
  Native (PRAME_HUMAN)
SPEKEEQY

SEQ ID NO: 161463 - protein, 8 aa, Homo sapiens
  Native (PRAME_HUMAN)
MPMQDIKM

SEQ ID NO: 161464 - protein, 10 aa, Homo sapiens
  Native (PRAME_HUMAN)
RELLCELGRP

SEQ ID NO: 161465 - protein, 11 aa, Homo sapiens
  Native (PRAME_HUMAN)
AVLDGLDVLLA

SEQ ID NO: 161466 - protein, 10 aa, Homo sapiens
  Native (PRAME_HUMAN)
ASATLQDLVF

SEQ ID NO: 161467 - protein, 10 aa, Homo sapiens
  Native (PRAME_HUMAN)
IFAMPMQDIK

SEQ ID NO: 161468 - protein, 9 aa, Homo sapiens
  Native (PRAME_HUMAN)
LDSIEDLEV

SEQ ID NO: 161469 - protein, 9 aa, Homo sapiens
  Native (PRAME_HUMAN)
YEDIHGTLH

SEQ ID NO: 161470 - protein, 9 aa, Homo sapiens
  Native (PRAME_HUMAN)
CRLSEGDVM

SEQ ID NO: 161471 - protein, 10 aa, Homo sapiens
  Native (PRAME_HUMAN)
HASSYISPEK

SEQ ID NO: 161472 - protein, 9 aa, Homo sapiens
  Native (PRAME_HUMAN)
LFMAAFDGR

SEQ ID NO: 161473 - protein, 8 aa, Homo sapiens
  Native (PRAME_HUMAN)
AQFTSQFL

SEQ ID NO: 161474 - protein, 10 aa, Homo sapiens
  Native (PRAME_HUMAN)
DQLLALLPSL

SEQ ID NO: 161475 - protein, 10 aa, Homo sapiens
  Native (PRAME_HUMAN)
VSPEPLQALL

SEQ ID NO: 161476 - protein, 9 aa, Homo sapiens
  Native (PRAME_HUMAN)
WKLPTLAKF

SEQ ID NO: 161477 - protein, 9 aa, Homo sapiens
  Native (PRAME_HUMAN)
THVLYPVPL

SEQ ID NO: 161478 - protein, 10 aa, Homo sapiens
  Native (PRAME_HUMAN)
CSQLTTLSFY

SEQ ID NO: 161479 - protein, 10 aa, Homo sapiens
  Native (PRAME_HUMAN)
QLLRHVMNPL

SEQ ID NO: 161480 - protein, 9 aa, Homo sapiens
  Native (PRAME_HUMAN)
PRRWKLQVL

SEQ ID NO: 161481 - protein, 9 aa, Homo sapiens
  Native (PRAME_HUMAN)
CTWKLPTLA

SEQ ID NO: 161482 - protein, 11 aa, Homo sapiens
  Native (PRAME_HUMAN)
RPRRWKLQVLD

SEQ ID NO: 161483 - protein, 10 aa, Homo sapiens
  Native (PRAME_HUMAN)
LSVLSLSGVM

SEQ ID NO: 161484 - protein, 10 aa, Homo sapiens
  Native (PRAME_HUMAN)
RELFPPLFMA

SEQ ID NO: 161485 - protein, 11 aa, Homo sapiens
  Native (PRAME_HUMAN)
PRRWKLQVLDL

SEQ ID NO: 161486 - protein, 10 aa, Homo sapiens
  Native (PRAME_HUMAN)
YEDIHGTLHL

SEQ ID NO: 161487 - protein, 11 aa, Homo sapiens
  Native (PRAME_HUMAN)
FAMPMQDIKMI

SEQ ID NO: 161488 - protein, 10 aa, Homo sapiens
  Native (PRAME_HUMAN)
SPRRLVELAG

SEQ ID NO: 161489 - protein, 11 aa, Homo sapiens
  Native (PRAME_HUMAN)
HCSQLTTLSFY

SEQ ID NO: 161490 - protein, 9 aa, Homo sapiens
  Native (PRAME_HUMAN)
KRKVDGLST

SEQ ID NO: 161491 - protein, 10 aa, Homo sapiens
  Native (PRAME_HUMAN)
YVDSLFFLRG

SEQ ID NO: 161492 - protein, 9 aa, Homo sapiens
  Native (PRAME_HUMAN)
LLALLPSLS

SEQ ID NO: 161493 - protein, 11 aa, Homo sapiens
  Native (PRAME_HUMAN)
IAQFTSQFLSL

SEQ ID NO: 161494 - protein, 8 aa, Homo sapiens
  Native (PRAME_HUMAN)
WTVWSGNR

SEQ ID NO: 161495 - protein, 9 aa, Homo sapiens
  Native (PRAME_HUMAN)
LSVLSLSGV

SEQ ID NO: 161496 - protein, 9 aa, Homo sapiens
  Native (PRAME_HUMAN)
AAFDGRHSQ

SEQ ID NO: 161497 - protein, 11 aa, Homo sapiens
  Native (PRAME_HUMAN)
LSLSGVMLTDV

SEQ ID NO: 161498 - protein, 10 aa, Homo sapiens
  Native (PRAME_HUMAN)
GLDVLLAQEV

SEQ ID NO: 161499 - protein, 10 aa, Homo sapiens
  Native (PRAME_HUMAN)
SMVWLSANPC

SEQ ID NO: 161500 - protein, 11 aa, Homo sapiens
  Native (PRAME_HUMAN)
WTVWSGNRASL

SEQ ID NO: 161501 - protein, 10 aa, Homo sapiens
  Native (PRAME_HUMAN)
GQSLLKDEAL

SEQ ID NO: 161502 - protein, 8 aa, Homo sapiens
  Native (PRAME_HUMAN)
LAKFSPYL

SEQ ID NO: 161503 - protein, 8 aa, Homo sapiens
  Native (PRAME_HUMAN)
INLRRLLL

SEQ ID NO: 161504 - protein, 8 aa, Homo sapiens
  Native (PRAME_HUMAN)
AEQPFIPV

SEQ ID NO: 161505 - protein, 10 aa, Homo sapiens
  Native (PRAME_HUMAN)
KGQHLHLETF

SEQ ID NO: 161506 - protein, 9 aa, Artificial Sequence
  Description of Artificial Sequence: Synthetic peptide
  Seed: AAFDGRHSQ (PRAME_HUMAN)
  misc_feature (2)..(2): Xaa can be Ala, Val, Ser, Ile, Thr, Gly, Gln, Met, Leu, Asn, Glu, Cys, Pro, Phe, Tyr, Asp, Trp, Arg, Lys, or His
  misc_feature (9)..(9): Xaa can be Met, Phe, Leu, Tyr, Trp, Val, His, Ile, Lys, Arg, Ala, Cys, Gln, Thr, Ser, Gly, Pro, Asn, or Glu
AXFDGRHSX

SEQ ID NO: 161507 - protein, 10 aa, Artificial Sequence
  Description of Artificial Sequence: Synthetic peptide
  Seed: AAFDGRHSQT (PRAME_HUMAN)
  misc_feature (2)..(2): Xaa can be Ala, Ser, Val, Thr, Met, Gln, Ile, Leu, Pro, Gly, Glu, Asn, Cys, Phe, Tyr, Asp, Trp, Lys, Arg, or His
  misc_feature (10)..(10): Xaa can be Phe, Tyr, Met, Leu, Trp, Lys, Val, His, Ile, Arg, Ala, Cys, Gln, Thr, Ser, Asn, Gly, Glu, or Pro
AXFDGRHSQX

SEQ ID NO: 161508 - protein, 11 aa, Artificial Sequence
  Description of Artificial Sequence: Synthetic peptide
  Seed: AAFDGRHSQTL (PRAME_HUMAN)
  misc_feature (2)..(2): Xaa can be Ala, Arg, Pro, Gln, Val, Ile, Ser, Thr, Met, Leu, Glu, Tyr, Phe, Gly, His, Asp, Cys, Asn, Trp, or Lys
  misc_feature (11)..(11): Xaa can be Leu, Phe, Val, Tyr, Met, Trp, Ile, His, Lys, Arg, Cys, Ala, Thr, Gln, Gly, Ser, Pro, Glu, or Asn
AXFDGRHSQTX

SEQ ID NO: 161509 - protein, 10 aa, Artificial Sequence
  Description of Artificial Sequence: Synthetic peptide
  Seed: AALELLPREL (PRAME_HUMAN)
  misc_feature (2)..(2): Xaa can be Leu, Gln, Met, Ile, Arg, Thr, Ala, Val, Ser, Glu, Gly, His, Cys, Asn, Tyr, Asp, Lys, Trp, Phe, or Pro
  misc_feature (10)..(10): Xaa can be Trp, Phe, Leu, Tyr, Met, Val, Ile, Ala, Cys, Lys, Thr, or His
AXLELLPREX

SEQ ID NO: 161510 - protein, 11 aa, Artificial Sequence
  Description of Artificial Sequence: Synthetic peptide
  Seed: AALELLPRELF (PRAME_HUMAN)
  misc_feature (2)..(2): Xaa can be Thr, Ser, Cys, Ala, Val, Asn, Gln, Glu, Phe, Asp, Met, Gly, Pro, Trp, Leu, or Ile
  misc_feature (11)..(11): Xaa can be Trp, Phe, Leu, Tyr, Met, or Ile
AXLELLPRELX

SEQ ID NO: 161511 - protein, 8 aa, Artificial Sequence
  Description of Artificial Sequence: Synthetic peptide
  Seed: AAQPMTKK (PRAME_HUMAN)
  misc_feature (2)..(2): Xaa can be Val, Ile, Thr, Ala, or Ser
  misc_feature (8)..(8): Xaa can be Lys, or Arg
AXQPMTKX

SEQ ID NO: 161512 - protein, 9 aa, Artificial Sequence
  Description of Artificial Sequence: Synthetic peptide
  Seed: AAQPMTKKR (PRAME_HUMAN)
  misc_feature (2)..(2): Xaa can be Leu, Thr, Met, Val, Ile, Gln, Phe, Asp, Trp, Tyr, Ser, Gly, Pro, Ala, Asn, or Glu
  misc_feature (9)..(9): Xaa can be Arg, Lys, Tyr, Leu, Met, Val, Phe, His, or Ile
AXQPMTKKX

SEQ ID NO: 161513 - protein, 10 aa, Artificial Sequence
  Description of Artificial Sequence: Synthetic peptide
  Seed: AAQPMTKKRK (PRAME_HUMAN)
  misc_feature (2)..(2): Xaa can be Met, Thr, Ala, Tyr, Leu, Gln, Phe, Val, Ile, Trp, Ser, Gly, or Asn
  misc_feature (10)..(10): Xaa can be Arg, Lys, or Tyr
AXQPMTKKRX

SEQ ID NO: 161514 - protein, 8 aa, Artificial Sequence
  Description of Artificial Sequence: Synthetic peptide
  Seed: ACDELFSY (PRAME_HUMAN)
  misc_feature (2)..(2): Xaa can be Thr, Ser, Asn, Gln, Ala, Met, Leu, Ile, Val, Gly, Cys, Asp, Phe, Glu, Trp, or Tyr
  misc_feature (8)..(8): Xaa can be Tyr, Lys, Arg, Phe, His, Met, or Trp
AXDELFSX

SEQ ID NO: 161515 - protein, 9 aa, Artificial Sequence
  Description of Artificial Sequence: Synthetic peptide
  Seed: ACDELFSYL (PRAME_HUMAN)
  misc_feature (2)..(2): Xaa can be Leu, Thr, Met, Ala, Ile, Val, Phe, Tyr, Ser, Gly, Gln, Arg, Trp, Cys, Asn, Asp, Glu, His, Pro, or Lys
  misc_feature (9)..(9): Xaa can be Ile, Phe, Tyr, Met, Lys, Val, Trp, Leu, Arg, Cys, His, Ala, Thr, Gln, Ser, Glu, Gly, or As n
AXDELFSYX

SEQ ID NO: 161516 - protein, 8 aa, Artificial Sequence
  Description of Artificial Sequence: Synthetic peptide
  Seed: AEQPFIPV (PRAME_HUMAN)
  misc_feature (2)..(2): Xaa can be Glu, Asp, Gln, Ala, or Ser
  misc_feature (8)..(8): Xaa can be Ile, Leu, Val, Met, Phe, Ala, Pro, Tyr, Thr, Cys, Gly, or Ser
AXQPFIPX

SEQ ID NO: 161517 - protein, 9 aa, Artificial Sequence
  Description of Artificial Sequence: Synthetic peptide
  Seed: AEQPFIPVE (PRAME_HUMAN)
  misc_feature (2)..(2): Xaa can be Glu, Asp, Gln, Ala, Ser, Asn, Lys, Gly, or Pro
  misc_feature (9)..(9): Xaa can be Leu, Trp, Phe, Met, Val, Ile, Ala, Thr, Ser, Tyr, Cys, Gly, Pro, His, Arg, Lys, Asp, Glu, Gln, or Asn
AXQPFIPVX

SEQ ID NO: 161518 - protein, 10 aa, Artificial Sequence
  Description of Artificial Sequence: Synthetic peptide
  Seed: AEQPFIPVEV (PRAME_HUMAN)
  misc_feature (2)..(2): Xaa can be Glu, Asp, Gln, Arg, Ser, His, Ala, Lys, Met, Ile, Leu, Tyr, Pro, Thr, Val, Gly, Phe, Asn, Trp, or Cys
  misc_feature (10)..(10): Xaa can be Leu, Phe, Met, Ile, Val, Trp, Cys, Tyr, Ala, Thr, Pro, Ser, Lys, Asn, Gln, Gly, Arg, Glu, Asp, or His
AXQPFIPVEX

SEQ ID NO: 161519 - protein, 11 aa, Artificial Sequence
  Description of Artificial Sequence: Synthetic peptide
  Seed: AEQPFIPVEVL (PRAME_HUMAN)
  misc_feature (2)..(2): Xaa can be Glu, Gln, Asp, Met, Leu, Ile, Lys, or Val
  misc_feature (11)..(11): Xaa can be Trp, Phe, Leu, Ile, Val, Met, Tyr, Cys, Ala, Thr, Ser, Arg, Glu, Asp, Gly, Asn, His, Lys, Pro, or Gln
AXQPFIPVEVX

SEQ ID NO: 161520 - protein, 9 aa, Artificial Sequence
  Description of Artificial Sequence: Synthetic peptide
  Seed: AFDGRHSQT (PRAME_HUMAN)
  misc_feature (2)..(2): Xaa can be Phe, Tyr, Trp, Ala, Gln, Arg, His, Leu, Met, Ile, Gly, Val, Ser, Thr, Cys, Pro, Asp, Glu, Lys, or Asn
  misc_feature (9)..(9): Xaa can be Met, Ile, Val, Leu, Phe, Cys, Tyr, Ala, Trp, Thr, Ser, or Pro
AXDGRHSQX

SEQ ID NO: 161521 - protein, 10 aa, Artificial Sequence
  Description of Artificial Sequence: Synthetic peptide
  Seed: AFDGRHSQTL (PRAME_HUMAN)
  misc_feature (2)..(2): Xaa can be Arg, Ala, Ile, Val, Ser, Thr, Tyr, Leu, Met, Phe, Gly, Trp, Gln, His, Cys, Asn, Pro, Glu, Lys, or Asp
  misc_feature (10)..(10): Xaa can be Leu, Met, Phe, Ile, Val, Tyr, Trp, Cys, Lys, Arg, His, or Ala
AXDGRHSQTX

SEQ ID NO: 161522 - protein, 11 aa, Artificial Sequence
  Description of Artificial Sequence: Synthetic peptide
  Seed: AFDGRHSQTLK (PRAME_HUMAN)
  misc_feature (2)..(2): Xaa can be Thr, Ser, Val, Phe, Ile, Met, Gln, Tyr, Leu, Ala, or Trp
  misc_feature (11)..(11): Xaa can be Arg, Lys, Ala, or Val
AXDGRHSQTLX

SEQ ID NO: 161523 - protein, 10 aa, Artificial Sequence
  Description of Artificial Sequence: Synthetic peptide
  Seed: AIAALELLPR (PRAME_HUMAN)
  misc_feature (2)..(2): Xaa can be Ala, Thr, Ile, Val, Leu, Met, Ser, Gln, Lys, His, Pro, Gly, Tyr, Phe, Asn, Trp, Arg, Cys, Asp, or Glu
  misc_feature (10)..(10): Xaa can be Arg, Lys, Tyr, Leu, His, or Met
AXAALELLPX

SEQ ID NO: 161524 - protein, 10 aa, Artificial Sequence
  Description of Artificial Sequence: Synthetic peptide
  Seed: AKFSPYLGQM (PRAME_HUMAN)
  misc_feature (2)..(2): Xaa can be Arg, Gln, Glu, Lys, Met, His, Tyr, Phe, Ala, Ser, Thr, Leu, Gly, Val, Ile, Trp, Asn, or As p
  misc_feature (10)..(10): Xaa can be Tyr, Phe, Met, Leu, Trp, His, Ile, Lys, Val, Thr, Arg, Ala, Cys, or Gln
AXFSPYLGQX

SEQ ID NO: 161525 - protein, 9 aa, Artificial Sequence
  Description of Artificial Sequence: Synthetic peptide
  Seed: ALAIAALEL (PRAME_HUMAN)
  misc_feature (2)..(2): Xaa can be Ala, Gln, Ser, Thr, Leu, Ile, Val, Met, Gly, Asn, Glu, Tyr, Asp, Arg, Pro, Phe, Cys, His, Lys, or Trp
  misc_feature (9)..(9): Xaa can be Tyr, Phe, Leu, Val, Met, Ile, Lys, Arg, Trp, His, Ala, Cys, Thr, Gln, or Ser
AXAIAALEX

SEQ ID NO: 161526 - protein, 10 aa, Artificial Sequence
  Description of Artificial Sequence: Synthetic peptide
  Seed: ALAIAALELL (PRAME_HUMAN)
  misc_feature (2)..(2): Xaa can be Met, Leu, Gln, Val, Ile, Glu, Thr, Ser, Ala, Phe, Tyr, Asp, Arg, Asn, Pro, His, Trp, Cys, Lys, or Gly
  misc_feature (10)..(10): Xaa can be Ile, Leu, Val, Ala, Trp, Met, Phe, Cys, Pro, Thr, Ser, Gly, or Tyr
AXAIAALELX

SEQ ID NO: 161527 - protein, 11 aa, Artificial Sequence
  Description of Artificial Sequence: Synthetic peptide
  Seed: ALAIAALELLP (PRAME_HUMAN)
  misc_feature (2)..(2): Xaa can be Leu, or Met
  misc_feature (11)..(11): Xaa can be Met, Val, Lys, Leu, Gln, Thr, Pro, Glu, Cys, Asp, Arg, Tyr, Gly, Ser, Trp, His, Asn, Phe, Ile, or Ala
AXAIAALELLX

SEQ ID NO: 161528 - protein, 9 aa, Artificial Sequence
  Description of Artificial Sequence: Synthetic peptide
  Seed: ALELLPREL (PRAME_HUMAN)
  misc_feature (2)..(2): Xaa can be Ala, Tyr, Thr, Val, Ser, Arg, Gln, Ile, Phe, Gly, Trp, Leu, Met, Asp, His, Glu, Asn, Cys, Lys, or Pro
  misc_feature (9)..(9): Xaa can be Leu, Met, Ile, Phe, Val, Tyr, Trp, Lys, Arg, Cys, Ala, or His
AXELLPREX

SEQ ID NO: 161529 - protein, 10 aa, Artificial Sequence
  Description of Artificial Sequence: Synthetic peptide
  Seed: ALELLPRELF (PRAME_HUMAN)
  misc_feature (2)..(2): Xaa can be Leu, Lys, Met, Phe, Trp, His, Gln, Tyr, Thr, Asn, Cys, Asp, Ser, Pro, Gly, Val, Ile, Glu, Arg, or Ala
  misc_feature (10)..(10): Xaa can be Trp, Phe, Leu, Met, Val, Tyr, or Ile
AXELLPRELX

SEQ ID NO: 161530 - protein, 9 aa, Artificial Sequence
  Description of Artificial Sequence: Synthetic peptide
  Seed: ALLERASAT (PRAME_HUMAN)
  misc_feature (2)..(2): Xaa can be Met, Leu, Thr, Ile, Val, Gln, Ser, or Ala
  misc_feature (9)..(9): Xaa can be Val, Ile, Leu, Ala, Met, Phe, Thr, Cys, or Ser
AXLERASAX

SEQ ID NO: 161531 - protein, 10 aa, Artificial Sequence
  Description of Artificial Sequence: Synthetic peptide
  Seed: ALLERASATL (PRAME_HUMAN)
  misc_feature (2)..(2): Xaa can be Gln, Met, Leu, Thr, Val, Ile, Ser, Ala, Glu, Phe, Tyr, Trp, Lys, Gly, Pro, Asn, His, Asp, Arg, or Cys
  misc_feature (10)..(10): Xaa can be Tyr, Phe, Val, Leu, Arg, Met, Trp, Lys, Ile, Ala, Cys, Thr, or His
AXLERASATX

SEQ ID NO: 161532 - protein, 11 aa, Artificial Sequence
  Description of Artificial Sequence: Synthetic peptide
  Seed: ALLERASATLQ (PRAME_HUMAN)
  misc_feature (2)..(2): Xaa can be Leu, Met, or Ile
  misc_feature (11)..(11): Xaa can be Val, Ile, Gly, Leu, Pro, Glu, Asn, Arg, Met, Asp, Phe, Gln, His, Tyr, Lys, Cys, Ala, Thr, Trp, or Ser
AXLERASATLX

SEQ ID NO: 161533 - protein, 9 aa, Artificial Sequence
  Description of Artificial Sequence: Synthetic peptide
  Seed: ALLPSLSHC (PRAME_HUMAN)
  misc_feature (2)..(2): Xaa can be Met, Leu, Gln, Val, Ile, Thr, Ser, Ala, Phe, Asn, Glu, Cys, Gly, Tyr, or Asp
  misc_feature (9)..(9): Xaa can be Val, Leu, Ile, Met, Ala, Thr, Cys, Phe, Ser, or Gly
AXLPSLSHX

SEQ ID NO: 161534 - protein, 9 aa, Artificial Sequence
  Description of Artificial Sequence: Synthetic peptide
  Seed: ALQSLLQHL (PRAME_HUMAN)
  misc_feature (2)..(2): Xaa can be Met, Gln, Ile, Leu, Val, Ala, Thr, Ser, Gly, Tyr, Arg, Phe, Asn, Glu, Asp, Lys, His, Trp, Cys, or Pro
  misc_feature (9)..(9): Xaa can be Leu, Met, Tyr, Phe, Ile, Trp, Val, Arg, Lys, Ala, His, Thr, or Cys
AXQSLLQHX

SEQ ID NO: 161535 - protein, 10 aa, Artificial Sequence
  Description of Artificial Sequence: Synthetic peptide
  Seed: ALQSLLQHLI (PRAME_HUMAN)
  misc_feature (2)..(2): Xaa can be Leu, Met, Gln, Ile, Val, Glu, Thr, Phe, Tyr, Trp, Ala, Ser, His, Pro, Asn, Arg, Lys, Gly, Asp, or Cys
  misc_feature (10)..(10): Xaa can be Val, Leu, Ile, Trp, Phe, Ala, Met, Cys, Thr, Gly, Pro, Ser, Tyr, Asn, Lys, Arg, His, Asp, Gln, or Glu
AXQSLLQHLX

SEQ ID NO: 161536 - protein, 8 aa, Artificial Sequence
  Description of Artificial Sequence: Synthetic peptide
  Seed: ALYVDSLF (PRAME_HUMAN)
  misc_feature (2)..(2): Xaa can be Gln, Met, Lys, Ser, Leu, His, Ala, Val, Arg, or Ile
  misc_feature (8)..(8): Xaa can be Tyr, Phe, Met, or Leu
AXYVDSLX

SEQ ID NO: 161537 - protein, 9 aa, Artificial Sequence
  Description of Artificial Sequence: Synthetic peptide
  Seed: ALYVDSLFF (PRAME_HUMAN)
  misc_feature (2)..(2): Xaa can be Gln, Thr, Ala, Met, Ser, Lys, Leu, His, Ile, Glu, Val, Gly, Arg, Asn, Cys, Phe, Trp, Pro, Tyr, or Asp
  misc_feature (9)..(9): Xaa can be Phe, Tyr, Met, Leu, Trp, Ile, His, Val, Lys, Arg, Ala, Cys, Gly, or Thr
AXYVDSLFX

SEQ ID NO: 161538 - protein, 10 aa, Artificial Sequence
  Description of Artificial Sequence: Synthetic peptide
  Seed: ALYVDSLFFL (PRAME_HUMAN)
  misc_feature (2)..(2): Xaa can be Tyr, Met, Leu, Gln, Ile, Val, Thr, Ala, Ser, Trp, Phe, Cys, Gly, Asn, Glu, Arg, Lys, Pro, His, or Asp
  misc_feature (10)..(10): Xaa can be Val, Trp, Ile, Met, Leu, Phe, Arg, Lys, Tyr, Ala, Thr, Cys, Ser, Pro, Gly, His, Gln, Asp, Asn, or Glu
AXYVDSLFFX

SEQ ID NO: 161539 - protein, 11 aa, Artificial Sequence
  Description of Artificial Sequence: Synthetic peptide
  Seed: ALYVDSLFFLR (PRAME_HUMAN)
  misc_feature (2)..(2): Xaa can be Val, Ile, Met, Leu, Gln, Thr, Ser, Trp, Lys, Arg, Gly, Cys, Asn, His, Phe, Ala, Asp, Tyr, Pro, or Glu
  misc_feature (11)..(11): Xaa can be Lys, Val, Arg, Tyr, His, Leu, Ile, Pro, Gln, Ala, Met, Trp, Glu, Thr, Asn, Ser, Cys, Asp, Phe, or Gly
AXYVDSLFFLX

SEQ ID NO: 161540 - protein, 9 aa, Artificial Sequence
  Description of Artificial Sequence: Synthetic peptide
  Seed: AMPMQDIKM (PRAME_HUMAN)
  misc_feature (2)..(2): Xaa can be Ala, Leu, Ser, Ile, Tyr, Thr, Val, Gln, Gly, Met, Phe, Arg, Trp, Glu, Asn, His, Pro, Cys, Lys, or Asp
  misc_feature (9)..(9): Xaa can be Leu, Met, Tyr, Phe, Ile, Val, Trp, Lys, Arg, Ala, or His
AXPMQDIKX

SEQ ID NO: 161541 - protein, 10 aa, Artificial Sequence
  Description of Artificial Sequence: Synthetic peptide
  Seed: AMPMQDIKMI (PRAME_HUMAN)
  misc_feature (2)..(2): Xaa can be Met, Leu, Gln, Ile, or Val
  misc_feature (10)..(10): Xaa can be Val, Leu, Ile, or Ala
AXPMQDIKMX

SEQ ID NO: 161542 - protein, 11 aa, Artificial Sequence
  Description of Artificial Sequence: Synthetic peptide
  Seed: AMPMQDIKMIL (PRAME_HUMAN)
  misc_feature (2)..(2): Xaa can be Arg, Phe, Tyr, Met, His, Pro, Ser, or Trp
  misc_feature (11)..(11): Xaa can be Leu, or Met
AXPMQDIKMIX

SEQ ID NO: 161543 - protein, 8 aa, Artificial Sequence
  Description of Artificial Sequence: Synthetic peptide
  Seed: AMVQAWPF (PRAME_HUMAN)
  misc_feature (2)..(2): Xaa can be Gln, Met, Lys, His, Leu, Ile, Val, Ser, or Ala
  misc_feature (8)..(8): Xaa can be Tyr, Phe, Met, Ile, or Leu
AXVQAWPX

SEQ ID NO: 161544 - protein, 9 aa, Artificial Sequence
  Description of Artificial Sequence: Synthetic peptide
  Seed: AMVQAWPFT (PRAME_HUMAN)
  misc_feature (2)..(2): Xaa can be Met, Gln, Leu, Thr, Val, Ile, Ala, or Ser
  misc_feature (9)..(9): Xaa can be Leu, Ile, Val, Ala, Met, Thr, Cys, Ser, or Phe
AXVQAWPFX

SEQ ID NO: 161545 - protein, 10 aa, Artificial Sequence
  Description of Artificial Sequence: Synthetic peptide
  Seed: AMVQAWPFTC (PRAME_HUMAN)
  misc_feature (2)..(2): Xaa can be Met, Leu, Gln, Phe, Tyr, Val, Thr, Ile, Lys, Cys, Pro, Trp, Ser, His, Asp, Arg, Glu, Gly, Ala, or Asn
  misc_feature (10)..(10): Xaa can be Leu, Ile, Val, Ala, Met, Thr, Cys, Ser, or Phe
AXVQAWPFTX

SEQ ID NO: 161546 - protein, 11 aa, Artificial Sequence
  Description of Artificial Sequence: Synthetic peptide
  Seed: AMVQAWPFTCL (PRAME_HUMAN)
  misc_feature (2)..(2): Xaa can be Met, Leu, Ile, Phe, or Tyr
  misc_feature (11)..(11): Xaa can be Val, Ile, Ala, or Leu
AXVQAWPFTCX

SEQ ID NO: 161547 - protein, 9 aa, Artificial Sequence
  Description of Artificial Sequence: Synthetic peptide
  Seed: AQEVRPRRW (PRAME_HUMAN)
  misc_feature (2)..(2): Xaa can be Glu, Gln, Ser, Thr, Asp, Ala, Gly, Tyr, Cys, Val, Met, Asn, Trp, Phe, Ile, Pro, or Leu
  misc_feature (9)..(9): Xaa can be Trp, Phe, Tyr, Val, Met, Ile, Leu, His, Cys, or Arg
AXEVRPRRX

SEQ ID NO: 161548 - protein, 8 aa, Artificial Sequence
  Description of Artificial Sequence: Synthetic peptide
  Seed: AQFTSQFL (PRAME_HUMAN)
  misc_feature (2)..(2): Xaa can be Gln, Met, Ala, Ser, Glu, Arg, Lys, Leu, Gly, His, Val, Asn, Thr, or Ile
  misc_feature (8)..(8): Xaa can be Tyr, Phe, Ile, Leu, Val, Met, or Trp
AXFTSQFX

SEQ ID NO: 161549 - protein, 9 aa, Artificial Sequence
  Description of Artificial Sequence: Synthetic peptide
  Seed: AQFTSQFLS (PRAME_HUMAN)
  misc_feature (2)..(2): Xaa can be Gln, Met, Leu, Glu, Ile, Thr, Val, Ala, Ser, Asn, Asp, Gly, Lys, Phe, or His
  misc_feature (9)..(9): Xaa can be Val, Ile, Leu, Ala, Met, Phe, Thr, Cys, Ser, Pro, Trp, or Tyr
AXFTSQFLX

SEQ ID NO: 161550 - protein, 10 aa, Artificial Sequence
  Description of Artificial Sequence: Synthetic peptide
  Seed: AQFTSQFLSL (PRAME_HUMAN)
  misc_feature (2)..(2): Xaa can be Arg, Glu, Gln, Met, Leu, His, Val, Ile, Ala, Lys, Thr, Ser, Asp, Gly, Tyr, Phe, Asn, Trp, Pro, or Cys
  misc_feature (10)..(10): Xaa can be Tyr, Phe, Met, Leu, Val, Ile, Trp, Ala, Thr, Cys, His, Ser, Lys, Gly, Arg, Gln, Pro, Glu, or Asn
AXFTSQFLSX

SEQ ID NO: 161551 - protein, 10 aa, Artificial Sequence
  Description of Artificial Sequence: Synthetic peptide
  Seed: AQPMTKKRKV (PRAME_HUMAN)
  misc_feature (2)..(2): Xaa can be , or Gln
  misc_feature (10)..(10): Xaa can be , or Val
AXPMTKKRKX

SEQ ID NO: 161552 - protein, 10 aa, Artificial Sequence
  Description of Artificial Sequence: Synthetic peptide
  Seed: ARLRELLCEL (PRAME_HUMAN)
  misc_feature (2)..(2): Xaa can be Arg, Met, Leu, Phe, Ala, Tyr, Asn, Thr, Ser, Val, Trp, Gly, His, Ile, Pro, Lys, Glu, Cys, Asp, or Gln
  misc_feature (10)..(10): Xaa can be Ile, Thr, Val, Met, Ala, Leu, Cys, Ser, Trp, Lys, Tyr, Arg, Phe, or His
AXLRELLCEX

SEQ ID NO: 161553 - protein, 8 aa, Artificial Sequence
  Description of Artificial Sequence: Synthetic peptide
  Seed: ASATLQDL (PRAME_HUMAN)
  misc_feature (2)..(2): Xaa can be Ala, Ser, or Thr
  misc_feature (8)..(8): Xaa can be Leu, Tyr, Phe, Met, or Ile
AXATLQDX

SEQ ID NO: 161554 - protein, 9 aa, Artificial Sequence
  Description of Artificial Sequence: Synthetic peptide
  Seed: ASATLQDLV (PRAME_HUMAN)
  misc_feature (2)..(2): Xaa can be Gln, Met, Leu, Thr, Ile, Ala, Val, Ser, Glu, Gly, Asn, Cys, Pro, Asp, Phe, Trp, or Tyr
  misc_feature (9)..(9): Xaa can be Trp, Phe, Leu, Val, Ile, Met, Ala, Tyr, Thr, or Cys
AXATLQDLX

SEQ ID NO: 161555 - protein, 10 aa, Artificial Sequence
  Description of Artificial Sequence: Synthetic peptide
  Seed: ASATLQDLVF (PRAME_HUMAN)
  misc_feature (2)..(2): Xaa can be Ala, Ser, Gln, Thr, Met, Val, Gly, Leu, Ile, Lys, His, Glu, Phe, Arg, Cys, Asn, Tyr, Trp, Pro, or Asp
  misc_feature (10)..(10): Xaa can be Trp, Tyr, Phe, Lys, Met, Leu, Arg, Ile, or His
AXATLQDLVX

SEQ ID NO: 161556 - protein, 9 aa, Artificial Sequence
  Description of Artificial Sequence: Synthetic peptide
  Seed: ASSYISPEK (PRAME_HUMAN)
  misc_feature (2)..(2): Xaa can be Met, Thr, Ala, Ser, Val, Leu, Ile, Gly, Cys, Asn, Asp, Gln, Pro, Phe, Tyr, Trp, or His
  misc_feature (9)..(9): Xaa can be Arg, Lys, Tyr, Leu, Met, Phe, Ile, Val, His, or Ala
AXSYISPEX

SEQ ID NO: 161557 - protein, 8 aa, Artificial Sequence
  Description of Artificial Sequence: Synthetic peptide
  Seed: ATLQDLVF (PRAME_HUMAN)
  misc_feature (2)..(2): Xaa can be Thr, Ser, Ala, or Val
  misc_feature (8)..(8): Xaa can be Trp, or Phe
AXLQDLVX

SEQ ID NO: 161558 - protein, 9 aa, Artificial Sequence
  Description of Artificial Sequence: Synthetic peptide
  Seed: AVLDGLDVL (PRAME_HUMAN)
  misc_feature (2)..(2): Xaa can be Met, Leu, Ala, Gln, Ile, Val, Thr, Ser, Arg, Gly, Glu, Asp, Phe, Asn, His, Tyr, Cys, Lys, Pro, or Trp
  misc_feature (9)..(9): Xaa can be Phe, Met, Leu, Tyr, Val, Lys, Arg, Ile, Trp, Ala, His, Thr, Cys, Gly, Ser, Pro, or Gln
AXLDGLDVX

SEQ ID NO: 161559 - protein, 10 aa, Artificial Sequence
  Description of Artificial Sequence: Synthetic peptide
  Seed: AVLDGLDVLL (PRAME_HUMAN)
  misc_feature (2)..(2): Xaa can be Leu, Met, Gln, Val, Ile, Ala, Thr, Ser, Arg, Gly, Glu, Phe, Asn, His, Cys, Pro, Lys, Tyr, Asp, or Trp
  misc_feature (10)..(10): Xaa can be Arg, Ile, Leu, Lys, Trp, Phe, Val, Tyr, Met, His, Ala, Cys, Thr, Gln, Ser, Gly, Glu, Pro, Asp, or Asn
AXLDGLDVLX

SEQ ID NO: 161560 - protein, 11 aa, Artificial Sequence
  Description of Artificial Sequence: Synthetic peptide
  Seed: AVLDGLDVLLA (PRAME_HUMAN)
  misc_feature (2)..(2): Xaa can be Leu, Met, Val, Ile, Gln, Ala, Thr, or Ser
  misc_feature (11)..(11): Xaa can be Val, Leu, Met, Ile, Ala, Thr, Cys, Phe, Lys, Ser, Tyr, or Gly
AXLDGLDVLLX

SEQ ID NO: 161561 - protein, 9 aa, Artificial Sequence
  Description of Artificial Sequence: Synthetic peptide
  Seed: AWPFTCLPL (PRAME_HUMAN)
  misc_feature (2)..(2): Xaa can be Ala, Tyr, Phe, Arg, Ser, Gln, Thr, Met, Trp, Ile, Val, Leu, Gly, Cys, His, Pro, Asn, Asp, Lys, or Glu
  misc_feature (9)..(9): Xaa can be Leu, Met, Phe, Ile, Tyr, Val, Trp, Ala, His, Cys, or Thr
AXPFTCLPX

SEQ ID NO: 161562 - protein, 8 aa, Artificial Sequence
  Description of Artificial Sequence: Synthetic peptide
  Seed: AYLHARLR (PRAME_HUMAN)
  misc_feature (2)..(2): Xaa can be Gln, Tyr, Ser, Ile, Leu, Val, Phe, Met, Thr, or Trp
  misc_feature (8)..(8): Xaa can be , or Arg
AXLHARLX

SEQ ID NO: 161563 - protein, 10 aa, Artificial Sequence
  Description of Artificial Sequence: Synthetic peptide
  Seed: AYLHARLREL (PRAME_HUMAN)
  misc_feature (2)..(2): Xaa can be Phe, Tyr, Trp, Met, Pro, Leu, Asn, Ala, Lys, Thr, Glu, Asp, Cys, Gly, Val, His, Ile, Gln, Arg, or Ser
  misc_feature (10)..(10): Xaa can be Val, Ile, Leu, Ala, Met, Phe, Trp, or Tyr
AXLHARLREX

SEQ ID NO: 161564 - protein, 11 aa, Artificial Sequence
  Description of Artificial Sequence: Synthetic peptide
  Seed: AYLHARLRELL (PRAME_HUMAN)
  misc_feature (2)..(2): Xaa can be Tyr, Phe, Trp, or Met
  misc_feature (11)..(11): Xaa can be Phe, Trp, Leu, Met, Ile, or Val
AXLHARLRELX

SEQ ID NO: 161565 - protein, 10 aa, Artificial Sequence
  Description of Artificial Sequence: Synthetic peptide
  Seed: CCKKLKIFAM (PRAME_HUMAN)
  misc_feature (2)..(2): Xaa can be Met, Pro, Ile, Ala, Leu, Gln, Val, Phe, Thr, His, Cys, Asn, Tyr, Arg, Trp, Ser, Lys, Gly, Glu, or Asp
  misc_feature (10)..(10): Xaa can be Leu, Met, Ile, Val, Ala, or Phe
CXKKLKIFAX

SEQ ID NO: 161566 - protein, 11 aa, Artificial Sequence
  Description of Artificial Sequence: Synthetic peptide
  Seed: CDELFSYLIEK (PRAME_HUMAN)
  misc_feature (2)..(2): Xaa can be Lys, Gln, Thr, Ser, His, Ala, Pro, Val, Phe, Asp, Arg, Cys, Glu, Met, Trp, Ile, Gly, Tyr, Leu, or Asn
  misc_feature (11)..(11): Xaa can be , or Lys
CXELFSYLIEX

SEQ ID NO: 161567 - protein, 8 aa, Artificial Sequence
  Description of Artificial Sequence: Synthetic peptide
  Seed: CELGRPSM (PRAME_HUMAN)
  misc_feature (2)..(2): Xaa can be Glu, or Asp
  misc_feature (8)..(8): Xaa can be Leu, Val, Phe, Ile, Met, Ala, or Tyr
CXLGRPSX

SEQ ID NO: 161568 - protein, 9 aa, Artificial Sequence
  Description of Artificial Sequence: Synthetic peptide
  Seed: CELGRPSMV (PRAME_HUMAN)
  misc_feature (2)..(2): Xaa can be Glu, Gln, Asp, Ser, Ala, Met, Ile, Val, or Leu
  misc_feature (9)..(9): Xaa can be Val, Ile, Leu, Met, Trp, Tyr, Ala, Phe, Cys, Pro, Ser, Thr, or Gly
CXLGRPSMX

SEQ ID NO: 161569 - protein, 10 aa, Artificial Sequence
  Description of Artificial Sequence: Synthetic peptide
  Seed: CELGRPSMVW (PRAME_HUMAN)
  misc_feature (2)..(2): Xaa can be Glu, Thr, Ser, Ala, Trp, Asn, Pro, Ile, Met, Leu, Gln, Val, Cys, Phe, Gly, or Asp
  misc_feature (10)..(10): Xaa can be Trp, Phe, Tyr, Met, Ile, or Leu
CXLGRPSMVX

SEQ ID NO: 161570 - protein, 11 aa, Artificial Sequence
  Description of Artificial Sequence: Synthetic peptide
  Seed: CELGRPSMVWL (PRAME_HUMAN)
  misc_feature (2)..(2): Xaa can be , or Glu
  misc_feature (11)..(11): Xaa can be Ala, Cys, Val, Leu, Ile, or Met
CXLGRPSMVWX

SEQ ID NO: 161571 - protein, 11 aa, Artificial Sequence
  Description of Artificial Sequence: Synthetic peptide
  Seed: CGITDDQLLAL (PRAME_HUMAN)
  misc_feature (2)..(2): Xaa can be Ser, Thr, Ala, Val, Ile, Leu, Met, Pro, or Gly
  misc_feature (11)..(11): Xaa can be Leu, Met, Phe, Ile, or Val
CXITDDQLLAX

SEQ ID NO: 161572 - protein, 9 aa, Artificial Sequence
  Description of Artificial Sequence: Synthetic peptide
  Seed: CKKLKIFAM (PRAME_HUMAN)
  misc_feature (2)..(2): Xaa can be Met, Pro, Leu, Ala, Ile, Gln, Ser, Val, Lys, Gly, Glu, His, Phe, Thr, Tyr, Asn, Arg, Trp, Cys, or Asp
  misc_feature (9)..(9): Xaa can be Val, Leu, Met, Ile, Phe, Ala, Cys, Tyr, Thr, Gly, Ser, Glu, Trp, or Pro
CXKLKIFAX

SEQ ID NO: 161573 - protein, 8 aa, Artificial Sequence
  Description of Artificial Sequence: Synthetic peptide
  Seed: CLPLGVLM (PRAME_HUMAN)
  misc_feature (2)..(2): Xaa can be Gly, Ala, Ser, Ile, Thr, Val, Leu, Met, Tyr, Asn, Cys, Phe, Gln, or Pro
  misc_feature (8)..(8): Xaa can be Leu, Met, Ile, Phe, or Val
CXPLGVLX

SEQ ID NO: 161574 - protein, 9 aa, Artificial Sequence
  Description of Artificial Sequence: Synthetic peptide
  Seed: CLPLGVLMK (PRAME_HUMAN)
  misc_feature (2)..(2): Xaa can be Thr, Met, Ala, Val, Leu, Ser, Ile, Asn, Gly, or Gln
  misc_feature (9)..(9): Xaa can be Lys, Arg, Tyr, Leu, or His
CXPLGVLMX

SEQ ID NO: 161575 - protein, 10 aa, Artificial Sequence
  Description of Artificial Sequence: Synthetic peptide
  Seed: CLQALYVDSL (PRAME_HUMAN)
  misc_feature (2)..(2): Xaa can be Leu, Met, Phe, Tyr, Asn, Gln, Ile, Ser, Ala, Arg, Val, His, Trp, Lys, Thr, Gly, Glu, Cys, Asp, or Pro
  misc_feature (10)..(10): Xaa can be Val, Leu, Ile, Ala, or Met
CXQALYVDSX

SEQ ID NO: 161576 - protein, 9 aa, Artificial Sequence
  Description of Artificial Sequence: Synthetic peptide
  Seed: CPHCGDRTF (PRAME_HUMAN)
  misc_feature (2)..(2): Xaa can be Pro, Ala, Met, Val, His, Gln, Leu, Ile, Arg, Thr, Ser, Phe, Gly, Tyr, Asn, Trp, Cys, Lys, Glu, or Asp
  misc_feature (9)..(9): Xaa can be Tyr, Phe, Met, Trp, Leu, Ile, Ala, Pro, Thr, Cys, Val, Ser, or His
CXHCGDRTX

SEQ ID NO: 161577 - protein, 10 aa, Artificial Sequence
  Description of Artificial Sequence: Synthetic peptide
  Seed: CPHCGDRTFY (PRAME_HUMAN)
  misc_feature (2)..(2): Xaa can be Pro, Thr, Ser, Ala, Val, Gln, Leu, Met, Ile, Tyr, Phe, Gly, Glu, or His
  misc_feature (10)..(10): Xaa can be Tyr, Phe, Trp, or Met
CXHCGDRTFX

SEQ ID NO: 161578 - protein, 9 aa, Artificial Sequence
  Description of Artificial Sequence: Synthetic peptide
  Seed: CRLSEGDVM (PRAME_HUMAN)
  misc_feature (2)..(2): Xaa can be Gln, His, Arg, Met, Phe, Ala, Lys, Tyr, Leu, Ser, Val, Glu, Ile, Thr, or Pro
  misc_feature (9)..(9): Xaa can be Tyr, Phe, Met, Leu, Ile, Trp, Val, Cys, or His
CXLSEGDVX

SEQ ID NO: 161579 - protein, 11 aa, Artificial Sequence
  Description of Artificial Sequence: Synthetic peptide
  Seed: CRLSEGDVMHL (PRAME_HUMAN)
  misc_feature (2)..(2): Xaa can be Arg, His, Tyr, Phe, Gln, Met, Trp, Leu, Ile, Ala, Lys, Gly, Val, Ser, Thr, Cys, Glu, Asn, or Asp
  misc_feature (11)..(11): Xaa can be Val, Leu, Ile, Lys, Met, Phe, Ala, Tyr, Trp, Cys, Arg, or His
CXLSEGDVMHX

SEQ ID NO: 161580 - protein, 9 aa, Artificial Sequence
  Description of Artificial Sequence: Synthetic peptide
  Seed: CSQLTTLSF (PRAME_HUMAN)
  misc_feature (2)..(2): Xaa can be Ala, Gln, Thr, Ser, Val, Pro, Met, Lys, Ile, Arg, His, Phe, Gly, Asn, Tyr, Glu, Trp, Leu, Asp, or Cys
  misc_feature (9)..(9): Xaa can be Tyr, Trp, Phe, Leu, Met, Ile, Val, His, Lys, Ala, Arg, or Gly
CXQLTTLSX

SEQ ID NO: 161581 - protein, 10 aa, Artificial Sequence
  Description of Artificial Sequence: Synthetic peptide
  Seed: CSQLTTLSFY (PRAME_HUMAN)
  misc_feature (2)..(2): Xaa can be Gln, Met, Ser, Thr, Val, Ala, Ile, Arg, Lys, Pro, His, Glu, Cys, Asp, Trp, Leu, Phe, Gly, Asn, or Tyr
  misc_feature (10)..(10): Xaa can be Met, Tyr, Phe, Lys, Trp, Leu, Arg, Ile, Asp, Glu, Val, Asn, Thr, His, Ser, Cys, Ala, Pro, Gly, or Gln
CXQLTTLSFX

SEQ ID NO: 161582 - protein, 8 aa, Artificial Sequence
  Description of Artificial Sequence: Synthetic peptide
  Seed: CTWKLPTL (PRAME_HUMAN)
  misc_feature (2)..(2): Xaa can be Gln, Ala, Thr, Ser, Val, Met, Gly, Ile, Glu, Pro, Asn, Leu, His, Lys, Phe, Tyr, Asp, Arg, or Cys
  misc_feature (8)..(8): Xaa can be Val, Ile, Leu, Trp, Met, Tyr, Phe, Thr, His, Cys, or Ala
CXWKLPTX

SEQ ID NO: 161583 - protein, 9 aa, Artificial Sequence
  Description of Artificial Sequence: Synthetic peptide
  Seed: CTWKLPTLA (PRAME_HUMAN)
  misc_feature (2)..(2): Xaa can be Thr, Val, Ser, or Ala
  misc_feature (9)..(9): Xaa can be Val, Ile, Ala, or Leu
CXWKLPTLX

SEQ ID NO: 161584 - protein, 10 aa, Artificial Sequence
  Description of Artificial Sequence: Synthetic peptide
  Seed: CTWKLPTLAK (PRAME_HUMAN)
  misc_feature (2)..(2): Xaa can be Thr, Ser, Met, Leu, His, Cys, Ala, Lys, Phe, Trp, Gln, Arg, Gly, Asn, Val, Ile, Tyr, Asp, Glu, or Pro
  misc_feature (10)..(10): Xaa can be Arg, Lys, Tyr, Ala, or Val
CXWKLPTLAX

SEQ ID NO: 161585 - protein, 11 aa, Artificial Sequence
  Description of Artificial Sequence: Synthetic peptide
  Seed: CTWKLPTLAKF (PRAME_HUMAN)
  misc_feature (2)..(2): Xaa can be Ser, Thr, Ala, Gly, Asn, Met, Asp, Gln, Pro, Cys, Val, Leu, or Ile
  misc_feature (11)..(11): Xaa can be Trp, Phe, or Tyr
CXWKLPTLAKX

SEQ ID NO: 161586 - protein, 8 aa, Artificial Sequence
  Description of Artificial Sequence: Synthetic peptide
  Seed: DDQLLALL (PRAME_HUMAN)
  misc_feature (2)..(2): Xaa can be Glu, Asp, or Gln
  misc_feature (8)..(8): Xaa can be Leu, Met, Phe, Ile, or Val
DXQLLALX

SEQ ID NO: 161587 - protein, 8 aa, Artificial Sequence
  Description of Artificial Sequence: Synthetic peptide
  Seed: DEALAIAA (PRAME_HUMAN)
  misc_feature (2)..(2): Xaa can be Glu, Asp, or Gln
  misc_feature (8)..(8): Xaa can be Phe, Tyr, Leu, Ile, Met, Ala, Val, His, Trp, Thr, Cys, Ser, Pro, Gln, Arg, or Lys
DXALAIAX

SEQ ID NO: 161588 - protein, 9 aa, Artificial Sequence
  Description of Artificial Sequence: Synthetic peptide
  Seed: DEALAIAAL (PRAME_HUMAN)
  misc_feature (2)..(2): Xaa can be Glu, Gln, His, Arg, Ala, Asp, Met, Lys, Leu, Asn, Thr, Pro, Gly, Ile, Ser, Val, Tyr, Phe, Cys, or Trp
  misc_feature (9)..(9): Xaa can be Tyr, Phe, Leu, Val, Ile, Met, Ala, Trp, Thr, Cys, Pro, Gly, Ser, His, Arg, Asn, Lys, Gln, or Glu
DXALAIAAX

SEQ ID NO: 161589 - protein, 11 aa, Artificial Sequence
  Description of Artificial Sequence: Synthetic peptide
  Seed: DEALAIAALEL (PRAME_HUMAN)
  misc_feature (2)..(2): Xaa can be , or Glu
  misc_feature (11)..(11): Xaa can be Val, Ala, Leu, Met, Cys, or Ile
DXALAIAALEX

SEQ ID NO: 161590 - protein, 10 aa, Artificial Sequence
  Description of Artificial Sequence: Synthetic peptide
  Seed: DECGITDDQL (PRAME_HUMAN)
  misc_feature (2)..(2): Xaa can be , or Glu
  misc_feature (10)..(10): Xaa can be Val, Leu, Ala, Ile, Phe, or Met
DXCGITDDQX

SEQ ID NO: 161591 - protein, 11 aa, Artificial Sequence
  Description of Artificial Sequence: Synthetic peptide
  Seed: DECGITDDQLL (PRAME_HUMAN)
  misc_feature (2)..(2): Xaa can be Glu, or Gln
  misc_feature (11)..(11): Xaa can be Phe, Trp, Tyr, Met, Leu, Ile, Ala, or Val
DXCGITDDQLX

SEQ ID NO: 161592 - protein, 8 aa, Artificial Sequence
  Description of Artificial Sequence: Synthetic peptide
  Seed: DELFSYLI (PRAME_HUMAN)
  misc_feature (2)..(2): Xaa can be Glu, Gln, or Asp
  misc_feature (8)..(8): Xaa can be Phe, Tyr, Met, Trp, Ile, Ala, Ser, Val, Leu, Thr, or His
DXLFSYLX

SEQ ID NO: 161593 - protein, 9 aa, Artificial Sequence
  Description of Artificial Sequence: Synthetic peptide
  Seed: DELFSYLIE (PRAME_HUMAN)
  misc_feature (2)..(2): Xaa can be Glu, Gln, or Asp
  misc_feature (9)..(9): Xaa can be Tyr, Phe, His, Met, Val, Gln, Asn, Thr, Ala, Trp, Ile, Leu, Ser, or Glu
DXLFSYLIX

SEQ ID NO: 161594 - protein, 10 aa, Artificial Sequence
  Description of Artificial Sequence: Synthetic peptide
  Seed: DELFSYLIEK (PRAME_HUMAN)
  misc_feature (2)..(2): Xaa can be Val, Thr, Ser, Gly, Trp, Asp, Tyr, Met, Phe, Ile, Asn, Ala, Cys, Leu, Gln, His, Lys, Glu, Pro, or Arg
  misc_feature (10)..(10): Xaa can be Arg, Lys, or Tyr
DXLFSYLIEX

SEQ ID NO: 161595 - protein, 10 aa, Artificial Sequence
  Description of Artificial Sequence: Synthetic peptide
  Seed: DFWTVWSGNR (PRAME_HUMAN)
  misc_feature (2)..(2): Xaa can be Thr, Ser, Gln, Val, Gly, Trp, Leu, Tyr, Ile, Met, Ala, Phe, Asn, Pro, His, or Cys
  misc_feature (10)..(10): Xaa can be Arg, Lys, or Tyr
DXWTVWSGNX

SEQ ID NO: 161596 - protein, 11 aa, Artificial Sequence
  Description of Artificial Sequence: Synthetic peptide
  Seed: DFWTVWSGNRA (PRAME_HUMAN)
  misc_feature (2)..(2): Xaa can be Phe, Tyr, Gly, Met, Ala, Asn, Thr, Ser, Gln, Ile, Val, Trp, or Leu
  misc_feature (11)..(11): Xaa can be Arg, Asn, Gln, Leu, Cys, Met, Tyr, Pro, Trp, Gly, Ile, Phe, Lys, Thr, Ser, Ala, Glu, Asp, Val, or His
DXWTVWSGNRX

SEQ ID NO: 161597 - protein, 9 aa, Artificial Sequence
  Description of Artificial Sequence: Synthetic peptide
  Seed: DGRHSQTLK (PRAME_HUMAN)
  misc_feature (2)..(2): Xaa can be Val, Thr, Ile, Ala, Met, Ser, Leu, Gly, Glu, Cys, Trp, Tyr, Asn, Asp, Gln, Phe, Pro, Lys, Arg, or His
  misc_feature (9)..(9): Xaa can be Arg, Lys, Tyr, His, Leu, Met, Phe, Gln, or Val
DXRHSQTLX

SEQ ID NO: 161598 - protein, 10 aa, Artificial Sequence
  Description of Artificial Sequence: Synthetic peptide
  Seed: DIHGTLHLER (PRAME_HUMAN)
  misc_feature (2)..(2): Xaa can be Thr, Val, Ile, Ala, Cys, Met, Trp, Asn, Glu, Gln, Tyr, Phe, Ser, Gly, Leu, Lys, or His
  misc_feature (10)..(10): Xaa can be Arg, Lys, Tyr, His, Leu, Phe, or Met
DXHGTLHLEX

SEQ ID NO: 161599 - protein, 9 aa, Artificial Sequence
  Description of Artificial Sequence: Synthetic peptide
  Seed: DLEVTCTWK (PRAME_HUMAN)
  misc_feature (2)..(2): Xaa can be Met, Thr, Ile, Ser, Val, Ala, Leu, Gln, Gly, or Phe
  misc_feature (9)..(9): Xaa can be Arg, or Lys
DXEVTCTWX

SEQ ID NO: 161600 - protein, 10 aa, Artificial Sequence
  Description of Artificial Sequence: Synthetic peptide
  Seed: DPEPILCPCF (PRAME_HUMAN)
  misc_feature (2)..(2): Xaa can be Pro, or Ala
  misc_feature (10)..(10): Xaa can be Tyr, or Phe
DXEPILCPCX

SEQ ID NO: 161601 - protein, 10 aa, Artificial Sequence
  Description of Artificial Sequence: Synthetic peptide
  Seed: DQLLALLPSL (PRAME_HUMAN)
  misc_feature (2)..(2): Xaa can be Tyr, Phe, Trp, Met, Ser, Thr, Leu, Ala, Ile, Arg, Lys, Val, Cys, Gly, Gln, Asn, His, Glu, Asp, or Pro
  misc_feature (10)..(10): Xaa can be Val, Leu, Ile, Ala, Met, or Thr
DXLLALLPSX

SEQ ID NO: 161602 - protein, 8 aa, Artificial Sequence
  Description of Artificial Sequence: Synthetic peptide
  Seed: DQLLRHVM (PRAME_HUMAN)
  misc_feature (2)..(2): Xaa can be Glu, His, Gln, Arg, Met, Leu, Ala, Ser, Val, Thr, Ile, Gly, Asn, Asp, Cys, Phe, Pro, Lys, Tyr, or Trp
  misc_feature (8)..(8): Xaa can be Met, Leu, Ile, Val, Phe, Tyr, Cys, Ala, Thr, Ser, Trp, His, Pro, Gln, Arg, or Lys
DXLLRHVX

SEQ ID NO: 161603 - protein, 9 aa, Artificial Sequence
  Description of Artificial Sequence: Synthetic peptide
  Seed: DRTFYDPEP (PRAME_HUMAN)
  misc_feature (2)..(2): Xaa can be , or Arg
  misc_feature (9)..(9): Xaa can be Ile, Met, Leu, Thr, Pro, Cys, Ala, or Val
DXTFYDPEX

SEQ ID NO: 161604 - protein, 10 aa, Artificial Sequence
  Description of Artificial Sequence: Synthetic peptide
  Seed: DRTFYDPEPI (PRAME_HUMAN)
  misc_feature (2)..(2): Xaa can be Met, Thr, Arg, Ser, Cys, His, Asp, Leu, Gln, Phe, Tyr, Gly, Lys, Val, Glu, Pro, Asn, Trp, Ala, or Ile
  misc_feature (10)..(10): Xaa can be Val, Ala, Leu, Ile, or Met
DXTFYDPEPX

SEQ ID NO: 161605 - protein, 8 aa, Artificial Sequence
  Description of Artificial Sequence: Synthetic peptide
  Seed: DSIEDLEV (PRAME_HUMAN)
  misc_feature (2)..(2): Xaa can be Ala, Pro, Ser, or Gly
  misc_feature (8)..(8): Xaa can be Ile, Val, Leu, or Met
DXIEDLEX

SEQ ID NO: 161606 - protein, 9 aa, Artificial Sequence
  Description of Artificial Sequence: Synthetic peptide
  Seed: DSLFFLRGR (PRAME_HUMAN)
  misc_feature (2)..(2): Xaa can be Thr, Val, Ala, Ser, Ile, His, Trp, Asn, Pro, Met, Leu, Gln, Tyr, Glu, Phe, Cys, Asp, Gly, Lys, or Arg
  misc_feature (9)..(9): Xaa can be Arg, Lys, Tyr, Leu, His, Phe, Met, or Val
DXLFFLRGX

SEQ ID NO: 161607 - protein, 8 aa, Artificial Sequence
  Description of Artificial Sequence: Synthetic peptide
  Seed: DVLLAQEV (PRAME_HUMAN)
  misc_feature (2)..(2): Xaa can be Ala, Gln, Pro, Thr, Ile, Met, Glu, Asn, Val, Ser, Leu, Gly, Cys, Asp, His, or Phe
  misc_feature (8)..(8): Xaa can be Ile, Val, Leu, Phe, Met, Cys, or Ala
DXLLAQEX

SEQ ID NO: 161608 - protein, 9 aa, Artificial Sequence
  Description of Artificial Sequence: Synthetic peptide
  Seed: DVLLAQEVR (PRAME_HUMAN)
  misc_feature (2)..(2): Xaa can be Val, Thr, Gln, Ile, Met, Leu, Gly, Trp, Asn, Ser, Ala, Tyr, Phe, or Cys
  misc_feature (9)..(9): Xaa can be Arg, Lys, or Tyr
DXLLAQEVX

SEQ ID NO: 161609 - protein, 11 aa, Artificial Sequence
  Description of Artificial Sequence: Synthetic peptide
  Seed: DVLLAQEVRPR (PRAME_HUMAN)
  misc_feature (2)..(2): Xaa can be Val, Phe, Thr, Met, Tyr, Ser, Gln, Ala, Leu, Gly, Ile, Trp, Asn, or Cys
  misc_feature (11)..(11): Xaa can be Arg, or Lys
DXLLAQEVRPX

SEQ ID NO: 161610 - protein, 11 aa, Artificial Sequence
  Description of Artificial Sequence: Synthetic peptide
  Seed: DVMHLSQSPSV (PRAME_HUMAN)
  misc_feature (2)..(2): Xaa can be Thr, or Val
  misc_feature (11)..(11): Xaa can be , or Val
DXMHLSQSPSX

SEQ ID NO: 161611 - protein, 9 aa, Artificial Sequence
  Description of Artificial Sequence: Synthetic peptide
  Seed: DVSPEPLQA (PRAME_HUMAN)
  misc_feature (2)..(2): Xaa can be Pro, Thr, Val, Ile, Ala, Ser, Met, or Leu
  misc_feature (9)..(9): Xaa can be Val, Leu, Ile, Ala, Met, Ser, Thr, Pro, Phe, Cys, or Tyr
DXSPEPLQX

SEQ ID NO: 161612 - protein, 10 aa, Artificial Sequence
  Description of Artificial Sequence: Synthetic peptide
  Seed: DVSPEPLQAL (PRAME_HUMAN)
  misc_feature (2)..(2): Xaa can be Val, Ala, Thr, Ile, Ser, Leu, Met, Gly, Pro, Gln, Asn, Glu, Phe, Tyr, Asp, Trp, Cys, or Ly s
  misc_feature (10)..(10): Xaa can be Arg, Lys, Leu, Tyr, Trp, Phe, Ile, Val, Met, Ala, His, Gln, or Cys
DXSPEPLQAX

SEQ ID NO: 161613 - protein, 11 aa, Artificial Sequence
  Description of Artificial Sequence: Synthetic peptide
  Seed: DVSPEPLQALL (PRAME_HUMAN)
  misc_feature (2)..(2): Xaa can be Val, Thr, Ile, Ala, Ser, Leu, Met, Gln, Asn, Gly, Tyr, Phe, Glu, Asp, Pro, Cys, or Trp
  misc_feature (11)..(11): Xaa can be Lys, Arg, Trp, Tyr, Phe, Gln, His, Met, Val, or Leu
DXSPEPLQALX

SEQ ID NO: 161614 - protein, 8 aa, Artificial Sequence
  Description of Artificial Sequence: Synthetic peptide
  Seed: EAAQPMTK (PRAME_HUMAN)
  misc_feature (2)..(2): Xaa can be Ala, Ser, Thr, Val, Gln, Ile, Leu, Asn, Met, Cys, Gly, or Phe
  misc_feature (8)..(8): Xaa can be Lys, Arg, Tyr, Leu, Phe, Met, His, or Ile
EXAQPMTX

SEQ ID NO: 161615 - protein, 9 aa, Artificial Sequence
  Description of Artificial Sequence: Synthetic peptide
  Seed: EAAQPMTKK (PRAME_HUMAN)
  misc_feature (2)..(2): Xaa can be Val, Thr, Ile, Ala, Ser, Leu, Met, Gly, Gln, Asn, Glu, Cys, Asp, Phe, Pro, Tyr, His, Trp, Lys, or Arg
  misc_feature (9)..(9): Xaa can be Arg, Lys, Tyr, Phe, His, Leu, Met, Gln, Val, Ile, Ala, Trp, Thr, Asn, Glu, Cys, Gly, Ser, or Pro
EXAQPMTKX

SEQ ID NO: 161616 - protein, 10 aa, Artificial Sequence
  Description of Artificial Sequence: Synthetic peptide
  Seed: EAAQPMTKKR (PRAME_HUMAN)
  misc_feature (2)..(2): Xaa can be Val, Thr, Ile, Leu, Met, Ala, Ser, Asp, Tyr, Cys, Glu, Trp, Gln, Gly, Phe, Asn, Pro, or Hi s
  misc_feature (10)..(10): Xaa can be Arg, Lys, Met, Leu, Tyr, Phe, His, Val, Ile, Gln, Ala, or Trp
EXAQPMTKKX

SEQ ID NO: 161617 - protein, 11 aa, Artificial Sequence
  Description of Artificial Sequence: Synthetic peptide
  Seed: EAAQPMTKKRK (PRAME_HUMAN)
  misc_feature (2)..(2): Xaa can be Val, Met, Ala, Ser, Leu, Thr, or Ile
  misc_feature (11)..(11): Xaa can be Lys, Arg, or Met
EXAQPMTKKRX

SEQ ID NO: 161618 - protein, 9 aa, Artificial Sequence
  Description of Artificial Sequence: Synthetic peptide
  Seed: EAEQPFIPV (PRAME_HUMAN)
  misc_feature (2)..(2): Xaa can be Thr, Ala, Ser, Ile, Val, Pro, Leu, Met, Gln, Phe, or Cys
  misc_feature (9)..(9): Xaa can be Leu, Val, Ile, Met, Ala, Phe, or Thr
EXEQPFIPX

SEQ ID NO: 161619 - protein, 8 aa, Artificial Sequence
  Description of Artificial Sequence: Synthetic peptide
  Seed: EALAIAAL (PRAME_HUMAN)
  misc_feature (2)..(2): Xaa can be Gln, Met, Leu, Glu, Gly, Ala, Ser, Pro, Asn, Ile, Phe, Thr, or Tyr
  misc_feature (8)..(8): Xaa can be Ile, Leu, Val, Met, or Phe
EXLAIAAX

SEQ ID NO: 161620 - protein, 10 aa, Artificial Sequence
  Description of Artificial Sequence: Synthetic peptide
  Seed: EALAIAALEL (PRAME_HUMAN)
  misc_feature (2)..(2): Xaa can be Thr, Tyr, Phe, Val, Ala, Met, Ser, Leu, Ile, Trp, His, Lys, Arg, Gln, Gly, or Asn
  misc_feature (10)..(10): Xaa can be Val, Leu, Ile, Ala, Met, or Thr
EXLAIAALEX

SEQ ID NO: 161621 - protein, 11 aa, Artificial Sequence
  Description of Artificial Sequence: Synthetic peptide
  Seed: EALAIAALELL (PRAME_HUMAN)
  misc_feature (2)..(2): Xaa can be Tyr, Met, Phe, Ser, Trp, Leu, Ala, Gly, Thr, Ile, Val, Lys, His, Arg, or Gln
  misc_feature (11)..(11): Xaa can be Leu, Val, Ile, Ala, or Met
EXLAIAALELX

SEQ ID NO: 161622 - protein, 9 aa, Artificial Sequence
  Description of Artificial Sequence: Synthetic peptide
  Seed: EDIHGTLHL (PRAME_HUMAN)
  misc_feature (2)..(2): Xaa can be Glu, Asp, or Gln
  misc_feature (9)..(9): Xaa can be Pro, Leu, Cys, Ala, Met, Ile, Phe, Val, Thr, Trp, Gly, Ser, or Tyr
EXIHGTLHX

SEQ ID NO: 161623 - protein, 11 aa, Artificial Sequence
  Description of Artificial Sequence: Synthetic peptide
  Seed: EDIHGTLHLER (PRAME_HUMAN)
  misc_feature (2)..(2): Xaa can be Val, Thr, Ile, Ser, Met, Gly, Phe, Tyr, Trp, Ala, Leu, Cys, Glu, His, Asn, Pro, Gln, or As p
  misc_feature (11)..(11): Xaa can be Arg, Lys, Tyr, or His
EXIHGTLHLEX

SEQ ID NO: 161624 - protein, 9 aa, Artificial Sequence
  Description of Artificial Sequence: Synthetic peptide
  Seed: EDLEVTCTW (PRAME_HUMAN)
  misc_feature (2)..(2): Xaa can be Glu, Thr, Val, Ile, Gln, Pro, Ser, Ala, Leu, Met, Asp, Gly, Asn, Lys, Cys, Phe, His, Arg, Tyr, or Trp
  misc_feature (9)..(9): Xaa can be Trp, Tyr, Phe, Leu, Met, Ile, Val, His, Cys, Gln, Lys, Ala, Arg, or Thr
EXLEVTCTX

SEQ ID NO: 161625 - protein, 10 aa, Artificial Sequence
  Description of Artificial Sequence: Synthetic peptide
  Seed: EDLEVTCTWK (PRAME_HUMAN)
  misc_feature (2)..(2): Xaa can be Thr, Ile, Val, Ala, Ser, Tyr, Met, Cys, Gln, Asn, Trp, Asp, Phe, Leu, Gly, Glu, or Pro
  misc_feature (10)..(10): Xaa can be Arg, Lys, Tyr, or His
EXLEVTCTWX

SEQ ID NO: 161626 - protein, 8 aa, Artificial Sequence
  Description of Artificial Sequence: Synthetic peptide
  Seed: EEQYIAQF (PRAME_HUMAN)
  misc_feature (2)..(2): Xaa can be Glu, Asp, Gln, Phe, Tyr, Met, Ile, or Trp
  misc_feature (8)..(8): Xaa can be Tyr, Leu, Trp, Phe, Met, Val, Ile, Cys, Thr, His, Ala, or Pro
EXQYIAQX

SEQ ID NO: 161627 - protein, 9 aa, Artificial Sequence
  Description of Artificial Sequence: Synthetic peptide
  Seed: EEQYIAQFT (PRAME_HUMAN)
  misc_feature (2)..(2): Xaa can be Glu, Gln, or Asp
  misc_feature (9)..(9): Xaa can be Val, Ile, Leu, Met, Ala, Cys, Thr, Gly, Ser, Trp, Phe, or Pro
EXQYIAQFX

SEQ ID NO: 161628 - protein, 10 aa, Artificial Sequence
  Description of Artificial Sequence: Synthetic peptide
  Seed: EEQYIAQFTS (PRAME_HUMAN)
  misc_feature (2)..(2): Xaa can be , or Glu
  misc_feature (10)..(10): Xaa can be Ala, Phe, Pro, Ser, Cys, Ile, Val, Thr, Met, or Leu
EXQYIAQFTX

SEQ ID NO: 161629 - protein, 10 aa, Artificial Sequence
  Description of Artificial Sequence: Synthetic peptide
  Seed: EGACDELFSY (PRAME_HUMAN)
  misc_feature (2)..(2): Xaa can be Thr, Gln, Leu, Gly, Ala, Met, Ser, Ile, Val, Cys, or Asn
  misc_feature (10)..(10): Xaa can be Tyr, Lys, or Arg
EXACDELFSX

SEQ ID NO: 161630 - protein, 11 aa, Artificial Sequence
  Description of Artificial Sequence: Synthetic peptide
  Seed: EKVKRKKNVLR (PRAME_HUMAN)
  misc_feature (2)..(2): Xaa can be Lys, Arg, or Met
  misc_feature (11)..(11): Xaa can be , or Arg
EXVKRKKNVLX

SEQ ID NO: 161631 - protein, 9 aa, Artificial Sequence
  Description of Artificial Sequence: Synthetic peptide
  Seed: ELAGQSLLK (PRAME_HUMAN)
  misc_feature (2)..(2): Xaa can be Val, Ala, Ile, Thr, Ser, Leu, Met, Gly, Gln, Asn, Tyr, Cys, Glu, Phe, Asp, Trp, His, Pro, Lys, or Arg
  misc_feature (9)..(9): Xaa can be Arg, Lys, Tyr, His, Phe, Met, Leu, Gln, Ile, Ala, Val, Trp, or Asn
EXAGQSLLX

SEQ ID NO: 161632 - protein, 9 aa, Artificial Sequence
  Description of Artificial Sequence: Synthetic peptide
  Seed: ELFPPLFMA (PRAME_HUMAN)
  misc_feature (2)..(2): Xaa can be Thr, Val, Met, Ile, Leu, Ala, Ser, Gln, Cys, Asn, Gly, Phe, Pro, Asp, or Tyr
  misc_feature (9)..(9): Xaa can be Val, Ile, Ala, Leu, Met, Thr, Cys, Ser, Phe, Gly, or Pro
EXFPPLFMX

SEQ ID NO: 161633 - protein, 10 aa, Artificial Sequence
  Description of Artificial Sequence: Synthetic peptide
  Seed: ELFPPLFMAA (PRAME_HUMAN)
  misc_feature (2)..(2): Xaa can be Thr, Val, Ile, Ser, Ala, Met, Leu, Asn, Gln, Phe, Cys, Gly, Pro, Tyr, or Asp
  misc_feature (10)..(10): Xaa can be Val, Ile, Leu, Ala, Met, Thr, Ser, Cys, Gln, Glu, Arg, Tyr, Asp, Lys, Pro, Gly, His, Phe, Asn, or Trp
EXFPPLFMAX

SEQ ID NO: 161634 - protein, 11 aa, Artificial Sequence
  Description of Artificial Sequence: Synthetic peptide
  Seed: ELFPPLFMAAF (PRAME_HUMAN)
  misc_feature (2)..(2): Xaa can be Gln, Glu, Met, Ile, Ala, Ser, Val, Leu, Thr, Gly, Pro, or Arg
  misc_feature (11)..(11): Xaa can be Tyr, Phe, or Trp
EXFPPLFMAAX

SEQ ID NO: 161635 - protein, 9 aa, Artificial Sequence
  Description of Artificial Sequence: Synthetic peptide
  Seed: ELFSYLIEK (PRAME_HUMAN)
  misc_feature (2)..(2): Xaa can be Thr, Val, Ile, Met, Ala, Leu, Ser, Gly, Gln, Cys, Asn, Tyr, Phe, Glu, Asp, His, Lys, Arg, Pro, or Trp
  misc_feature (9)..(9): Xaa can be Arg, Lys, Tyr, His, Leu, Met, Val, Ile, Phe, Gln, Ala, Glu, Asn, Ser, or Thr
EXFSYLIEX

SEQ ID NO: 161636 - protein, 10 aa, Artificial Sequence
  Description of Artificial Sequence: Synthetic peptide
  Seed: ELFSYLIEKV (PRAME_HUMAN)
  misc_feature (2)..(2): Xaa can be Thr, Val, Met, Ser, Ile, Ala, Leu, Gln, Asn, Cys, Gly, or Phe
  misc_feature (10)..(10): Xaa can be Val, Ala, Ile, Leu, Met, Thr, Ser, or Cys
EXFSYLIEKX

SEQ ID NO: 161637 - protein, 11 aa, Artificial Sequence
  Description of Artificial Sequence: Synthetic peptide
  Seed: ELFSYLIEKVK (PRAME_HUMAN)
  misc_feature (2)..(2): Xaa can be Leu, Ala, Thr, Ile, Gly, Ser, Met, Val, Asn, Gln, or Phe
  misc_feature (11)..(11): Xaa can be Arg, or Lys
EXFSYLIEKVX

SEQ ID NO: 161638 - protein, 9 aa, Artificial Sequence
  Description of Artificial Sequence: Synthetic peptide
  Seed: ELGRPSMVW (PRAME_HUMAN)
  misc_feature (2)..(2): Xaa can be Val, Gln, Thr, Ser, Ala, Met, Ile, Leu, Cys, Asp, Asn, Gly, Pro, or Phe
  misc_feature (9)..(9): Xaa can be Trp, Phe, Leu, Tyr, Met, Ile, or Val
EXGRPSMVX

SEQ ID NO: 161639 - protein, 11 aa, Artificial Sequence
  Description of Artificial Sequence: Synthetic peptide
  Seed: ELLPRELFPPL (PRAME_HUMAN)
  misc_feature (2)..(2): Xaa can be Arg, Phe, Tyr, Met, Leu, Trp, Ser, Lys, Cys, Gln, Ala, Val, Thr, Ile, His, Pro, Gly, Asp, Asn, or Glu
  misc_feature (11)..(11): Xaa can be Leu, Val, Met, Ile, Phe, or Ala
EXLPRELFPPX

SEQ ID NO: 161640 - protein, 11 aa, Artificial Sequence
  Description of Artificial Sequence: Synthetic peptide
  Seed: EPEAAQPMTKK (PRAME_HUMAN)
  misc_feature (2)..(2): Xaa can be Met, Cys, Lys, Glu, Leu, Phe, Gln, Arg, Gly, Trp, Thr, Asp, Pro, Val, Tyr, Ser, Ile, Ala, Asn, or His
  misc_feature (11)..(11): Xaa can be Lys, or Arg
EXEAAQPMTKX

SEQ ID NO: 161641 - protein, 9 aa, Artificial Sequence
  Description of Artificial Sequence: Synthetic peptide
  Seed: EPILCPCFM (PRAME_HUMAN)
  misc_feature (2)..(2): Xaa can be Pro, Ala, Val, Ser, or Met
  misc_feature (9)..(9): Xaa can be Trp, Tyr, Met, Phe, Val, Leu, or Ile
EXILCPCFX

SEQ ID NO: 161642 - protein, 9 aa, Artificial Sequence
  Description of Artificial Sequence: Synthetic peptide
  Seed: EPLQALLER (PRAME_HUMAN)
  misc_feature (2)..(2): Xaa can be Val, Thr, Ala, Ile, Ser, Leu, Met, Gln, Tyr, Gly, Asn, His, Asp, Phe, Pro, Glu, Lys, Trp, Cys, or Arg
  misc_feature (9)..(9): Xaa can be Arg, Lys, His, Tyr, Met, Phe, Leu, Ile, Val, Gln, or Ala
EXLQALLEX

SEQ ID NO: 161643 - protein, 10 aa, Artificial Sequence
  Description of Artificial Sequence: Synthetic peptide
  Seed: EPLQALLERA (PRAME_HUMAN)
  misc_feature (2)..(2): Xaa can be , or Pro
  misc_feature (10)..(10): Xaa can be Ala, or Val
EXLQALLERX

SEQ ID NO: 161644 - protein, 9 aa, Artificial Sequence
  Description of Artificial Sequence: Synthetic peptide
  Seed: EQPFIPVEV (PRAME_HUMAN)
  misc_feature (2)..(2): Xaa can be Glu, Arg, His, Gln, Thr, Val, Ala, Met, Asp, Ile, Leu, Ser, Tyr, Gly, Pro, Lys, Phe, Asn, Trp, or Cys
  misc_feature (9)..(9): Xaa can be Leu, Met, Val, Ile, Phe, Ala, Thr, Cys, Pro, Trp, Tyr, Ser, or Gly
EXPFIPVEX

SEQ ID NO: 161645 - protein, 11 aa, Artificial Sequence
  Description of Artificial Sequence: Synthetic peptide
  Seed: EQYIAQFTSQF (PRAME_HUMAN)
  misc_feature (2)..(2): Xaa can be Arg, Met, Tyr, Lys, Val, Ser, Ile, Leu, Ala, Thr, His, Phe, Trp, Gln, Asn, Gly, or Cys
  misc_feature (11)..(11): Xaa can be Phe, Trp, Leu, Ile, Tyr, or Met
EXYIAQFTSQX

SEQ ID NO: 161646 - protein, 10 aa, Artificial Sequence
  Description of Artificial Sequence: Synthetic peptide
  Seed: ERASATLQDL (PRAME_HUMAN)
  misc_feature (2)..(2): Xaa can be Arg, His, or Tyr
  misc_feature (10)..(10): Xaa can be Phe, Tyr, Leu, Ile, Met, Trp, Val, Lys, or Ala
EXASATLQDX

SEQ ID NO: 161647 - protein, 9 aa, Artificial Sequence
  Description of Artificial Sequence: Synthetic peptide
  Seed: ERLAYLHAR (PRAME_HUMAN)
  misc_feature (2)..(2): Xaa can be Arg, Thr, Val, Phe, Tyr, Asp, Ala, Ser, Leu, Gly, Pro, Trp, Met, His, Ile, Cys, Gln, Asn, Lys, or Glu
  misc_feature (9)..(9): Xaa can be Arg, Lys, His, Leu, Phe, Trp, Tyr, Val, Ile, or Met
EXLAYLHAX

SEQ ID NO: 161648 - protein, 10 aa, Artificial Sequence
  Description of Artificial Sequence: Synthetic peptide
  Seed: ERLAYLHARL (PRAME_HUMAN)
  misc_feature (2)..(2): Xaa can be Arg, Thr, Val, Phe, Tyr, Met, His, Leu, Ile, Ser, Ala, Glu, Cys, Gly, Gln, Asn, Trp, Asp, Pro, or Lys
  misc_feature (10)..(10): Xaa can be Val, Leu, Ile, Ala, Met, Trp, Phe, Tyr, Thr, or Lys
EXLAYLHARX

SEQ ID NO: 161649 - protein, 11 aa, Artificial Sequence
  Description of Artificial Sequence: Synthetic peptide
  Seed: ERLAYLHARLR (PRAME_HUMAN)
  misc_feature (2)..(2): Xaa can be Ile, Thr, Ser, Val, Ala, Asn, Met, Asp, Cys, Gln, Leu, Tyr, His, Arg, Lys, Phe, Gly, Pro, Glu, or Trp
  misc_feature (11)..(11): Xaa can be Arg, or Lys
EXLAYLHARLX

SEQ ID NO: 161650 - protein, 9 aa, Artificial Sequence
  Description of Artificial Sequence: Synthetic peptide
  Seed: ERRRLWGSI (PRAME_HUMAN)
  misc_feature (2)..(2): Xaa can be Arg, His, or Gln
  misc_feature (9)..(9): Xaa can be Leu, Met, Ile, Val, or Phe
EXRRLWGSX

SEQ ID NO: 161651 - protein, 9 aa, Artificial Sequence
  Description of Artificial Sequence: Synthetic peptide
  Seed: ESYEDIHGT (PRAME_HUMAN)
  misc_feature (2)..(2): Xaa can be Thr, Val, Ala, Ile, Ser, Leu, Met, Cys, Gly, Gln, Asn, Pro, Phe, Asp, Tyr, or Glu
  misc_feature (9)..(9): Xaa can be Val, Leu, Ile, Ala, Met, Thr, Cys, Phe, Arg, Ser, Gly, Lys, or Pro
EXYEDIHGX

SEQ ID NO: 161652 - protein, 10 aa, Artificial Sequence
  Description of Artificial Sequence: Synthetic peptide
  Seed: ESYEDIHGTL (PRAME_HUMAN)
  misc_feature (2)..(2): Xaa can be Thr, Val, Ala, Ser, Ile, Met, Leu, Pro, Gln, Arg, Tyr, Gly, Asn, Cys, Glu, Asp, Phe, His, Lys, or Trp
  misc_feature (10)..(10): Xaa can be Arg, Lys, Trp, Tyr, Phe, Met, Leu, Val, Ile, His, Ala, Gln, Thr, Cys, Asn, Glu, or Ser
EXYEDIHGTX

SEQ ID NO: 161653 - protein, 11 aa, Artificial Sequence
  Description of Artificial Sequence: Synthetic peptide
  Seed: ESYEDIHGTLH (PRAME_HUMAN)
  misc_feature (2)..(2): Xaa can be Val, Thr, Ile, Ala, Met, Leu, Ser, Gln, Gly, Glu, Phe, Asp, Cys, Asn, Tyr, Lys, Pro, Trp, or His
  misc_feature (11)..(11): Xaa can be Lys, Arg, Tyr, Phe, His, Gln, Asn, Met, Leu, Glu, or Trp
EXYEDIHGTLX

SEQ ID NO: 161654 - protein, 10 aa, Artificial Sequence
  Description of Artificial Sequence: Synthetic peptide
  Seed: ETFKAVLDGL (PRAME_HUMAN)
  misc_feature (2)..(2): Xaa can be Thr, Val, Ala, Ser, Ile, Met, Leu, Gln, Gly, Asn, Phe, Cys, Glu, Asp, Trp, Tyr, or Pro
  misc_feature (10)..(10): Xaa can be Lys, Arg, Val, Trp, Ile, Leu, Ala, Phe, Tyr, Met, His, Thr, Gln, Ser, or Cys
EXFKAVLDGX

SEQ ID NO: 161655 - protein, 9 aa, Artificial Sequence
  Description of Artificial Sequence: Synthetic peptide
  Seed: ETLSITNCR (PRAME_HUMAN)
  misc_feature (2)..(2): Xaa can be Thr, Val, Ile, Ala, Leu, Ser, Met, Gly, Pro, Asn, Trp, Cys, Asp, Gln, Phe, Tyr, Glu, His, Lys, or Arg
  misc_feature (9)..(9): Xaa can be Arg, Lys, Met, Tyr, His, Leu, Phe, Ile, Val, Gln, or Ala
EXLSITNCX

SEQ ID NO: 161656 - protein, 10 aa, Artificial Sequence
  Description of Artificial Sequence: Synthetic peptide
  Seed: ETLSITNCRL (PRAME_HUMAN)
  misc_feature (2)..(2): Xaa can be Thr, Val, Ala, Ile, Ser, Met, Leu, Tyr, Gln, Trp, Asn, Glu, Cys, Phe, Pro, Gly, His, Asp, Lys, or Arg
  misc_feature (10)..(10): Xaa can be Arg, Lys, Trp, Met, Tyr, Ile, Val, Phe, Leu, His, Pro, Ala, Ser, Asn, Cys, Gly, Asp, Thr, Glu, or Gln
EXLSITNCRX

SEQ ID NO: 161657 - protein, 9 aa, Artificial Sequence
  Description of Artificial Sequence: Synthetic peptide
  Seed: EVLVDLFLK (PRAME_HUMAN)
  misc_feature (2)..(2): Xaa can be Thr, Val, Ile, Ser, Ala, Met, Leu, Pro, Phe, Cys, His, Trp, Gly, Glu, Asn, Gln, Asp, Tyr, Arg, or Lys
  misc_feature (9)..(9): Xaa can be Arg, Lys, Tyr, or His
EXLVDLFLX

SEQ ID NO: 161658 - protein, 9 aa, Artificial Sequence
  Description of Artificial Sequence: Synthetic peptide
  Seed: EVRPRRWKL (PRAME_HUMAN)
  misc_feature (2)..(2): Xaa can be Met, Ala, Ile, Leu, Pro, Thr, Val, Gln, Ser, Gly, Phe, Asn, Glu, Arg, Asp, His, Cys, Lys, Trp, or Tyr
  misc_feature (9)..(9): Xaa can be Leu, Met, Ile, Val, Phe, Arg, Lys, Ala, Tyr, Cys, or Thr
EXRPRRWKX

SEQ ID NO: 161659 - protein, 8 aa, Artificial Sequence
  Description of Artificial Sequence: Synthetic peptide
  Seed: FAMPMQDI (PRAME_HUMAN)
  misc_feature (2)..(2): Xaa can be Ala, Ser, Gly, Thr, Gln, Ile, Val, Pro, Met, Glu, or Asp
  misc_feature (8)..(8): Xaa can be Leu, Phe, Tyr, Ile, Met, Val, Lys, or His
FXMPMQDX

SEQ ID NO: 161660 - protein, 9 aa, Artificial Sequence
  Description of Artificial Sequence: Synthetic peptide
  Seed: FAMPMQDIK (PRAME_HUMAN)
  misc_feature (2)..(2): Xaa can be Ala, Val, Thr, Ser, Met, Leu, Gly, Ile, Gln, Asn, Phe, Tyr, Cys, Pro, Glu, Asp, or Trp
  misc_feature (9)..(9): Xaa can be Tyr, Arg, Lys, Leu, Phe, Met, His, Ile, Val, Trp, Cys, or Ala
FXMPMQDIX

SEQ ID NO: 161661 - protein, 10 aa, Artificial Sequence
  Description of Artificial Sequence: Synthetic peptide
  Seed: FAMPMQDIKM (PRAME_HUMAN)
  misc_feature (2)..(2): Xaa can be Pro, Leu, Met, Ala, Gln, Ile, Ser, Thr, Val, Gly, Cys, Asn, Phe, Glu, Tyr, Asp, Lys, or Tr p
  misc_feature (10)..(10): Xaa can be Trp, Tyr, Phe, Val, Leu, Met, Ala, Ile, Thr, Ser, Lys, Cys, His, Gln, or Gly
FXMPMQDIKX

SEQ ID NO: 161662 - protein, 11 aa, Artificial Sequence
  Description of Artificial Sequence: Synthetic peptide
  Seed: FAMPMQDIKMI (PRAME_HUMAN)
  misc_feature (2)..(2): Xaa can be Thr, Ala, Ser, Gly, Val, Asn, Gln, Ile, Leu, Met, Cys, Phe, Glu, Asp, Pro, Trp, or Lys
  misc_feature (11)..(11): Xaa can be Trp, Phe, Met, Leu, Tyr, Val, Ile, or Cys
FXMPMQDIKMX

SEQ ID NO: 161663 - protein, 9 aa, Artificial Sequence
  Description of Artificial Sequence: Synthetic peptide
  Seed: FDGRHSQTL (PRAME_HUMAN)
  misc_feature (2)..(2): Xaa can be Glu, Asp, His, Arg, Ala, Ser, Gln, Tyr, Leu, Pro, Ile, Asn, Phe, Met, Gly, Thr, Val, Trp, Lys, or Cys
  misc_feature (9)..(9): Xaa can be Leu, Met, Ile, Val, Phe, Ala, Tyr, Cys, Trp, Pro, Thr, Glu, Gly, Asp, or Ser
FXGRHSQTX

SEQ ID NO: 161664 - protein, 10 aa, Artificial Sequence
  Description of Artificial Sequence: Synthetic peptide
  Seed: FFLRGRLDQL (PRAME_HUMAN)
  misc_feature (2)..(2): Xaa can be Met, Leu, Phe, Tyr, Pro, Trp, Ile, Lys, Asp, Arg, Gly, Ser, Ala, Gln, Asn, His, Thr, Glu, Val, or Cys
  misc_feature (10)..(10): Xaa can be Thr, Val, Ala, Leu, Met, Ile, Phe, Tyr, Ser, or Cys
FXLRGRLDQX

SEQ ID NO: 161665 - protein, 8 aa, Artificial Sequence
  Description of Artificial Sequence: Synthetic peptide
  Seed: FIPVEVLV (PRAME_HUMAN)
  misc_feature (2)..(2): Xaa can be Leu, Met, or Ile
  misc_feature (8)..(8): Xaa can be Val, Ile, Met, Leu, or Ala
FXPVEVLX

SEQ ID NO: 161666 - protein, 10 aa, Artificial Sequence
  Description of Artificial Sequence: Synthetic peptide
  Seed: FIPVEVLVDL (PRAME_HUMAN)
  misc_feature (2)..(2): Xaa can be Leu, Met, Gln, Ile, Val, Ser, Ala, Thr, Trp, Tyr, Arg, Pro, His, Cys, Lys, Glu, Phe, Asp, Gly, or Asn
  misc_feature (10)..(10): Xaa can be Trp, Met, His, Tyr, Ile, Leu, Phe, Val, Ala, Thr, Ser, or Cys
FXPVEVLVDX

SEQ ID NO: 161667 - protein, 11 aa, Artificial Sequence
  Description of Artificial Sequence: Synthetic peptide
  Seed: FKAVLDGLDVL (PRAME_HUMAN)
  misc_feature (2)..(2): Xaa can be Arg, Asn, Ala, Gln, Phe, Cys, Leu, Trp, His, Lys, Tyr, Ile, Gly, Met, Val, Glu, Asp, Pro, Thr, or Ser
  misc_feature (11)..(11): Xaa can be Ile, Leu, Val, Ala, or Met
FXAVLDGLDVX

SEQ ID NO: 161668 - protein, 10 aa, Artificial Sequence
  Description of Artificial Sequence: Synthetic peptide
  Seed: FLKEGACDEL (PRAME_HUMAN)
  misc_feature (2)..(2): Xaa can be Met, Leu, Val, Gln, Ala, Ile, Ser, Thr, Gly, Arg, Glu, Phe, Asn, Cys, Pro, Tyr, His, Lys, Asp, or Trp
  misc_feature (10)..(10): Xaa can be Tyr, Phe, Leu, Met, Lys, Arg, Ile, Trp, His, Val, Ala, Cys, Ser, or Thr
FXKEGACDEX

SEQ ID NO: 161669 - protein, 11 aa, Artificial Sequence
  Description of Artificial Sequence: Synthetic peptide
  Seed: FLKEGACDELF (PRAME_HUMAN)
  misc_feature (2)..(2): Xaa can be Leu, Met, Gln, Ala, Ile, Val, Thr, Ser, Glu, Gly, Pro, Asn, Asp, Lys, or Arg
  misc_feature (11)..(11): Xaa can be Tyr, Lys, Arg, Phe, Met, Leu, Trp, His, Val, Ile, Cys, Ala, Thr, Ser, Glu, Asp, Gln, Pro, Asn, or Gly
FXKEGACDELX

SEQ ID NO: 161670 - protein, 9 aa, Artificial Sequence
  Description of Artificial Sequence: Synthetic peptide
  Seed: FLRGRLDQL (PRAME_HUMAN)
  misc_feature (2)..(2): Xaa can be Leu, Met, Pro, Ala, Ile, Val, Arg, Ser, Thr, Gln, Tyr, Phe, Gly, Glu, Cys, His, Trp, Asp, Asn, or Lys
  misc_feature (9)..(9): Xaa can be Phe, Met, Tyr, Leu, Val, Ile, Trp, Arg, His, Ala, Lys, Cys, Thr, Pro, Gly, Ser, or Gln
FXRGRLDQX

SEQ ID NO: 161671 - protein, 10 aa, Artificial Sequence
  Description of Artificial Sequence: Synthetic peptide
  Seed: FLRGRLDQLL (PRAME_HUMAN)
  misc_feature (2)..(2): Xaa can be Met, Leu, Gln, Ile, Pro, Val, Arg, Ala, Lys, Glu, Thr, Cys, Asn, Gly, Ser, Tyr, Asp, Phe, Trp, or His
  misc_feature (10)..(10): Xaa can be Leu, Met, Ile, Val, Ala, Phe, Arg, Gln, Tyr, Ser, Lys, Asn, Cys, Gly, Pro, Glu, Trp, Thr, Asp, or His
FXRGRLDQLX

SEQ ID NO: 161672 - protein, 11 aa, Artificial Sequence
  Description of Artificial Sequence: Synthetic peptide
  Seed: FLRGRLDQLLR (PRAME_HUMAN)
  misc_feature (2)..(2): Xaa can be Thr, Ser, Ile, Val, Leu, Met, Trp, Tyr, Ala, Phe, or Gln
  misc_feature (11)..(11): Xaa can be Arg, or Lys
FXRGRLDQLLX

SEQ ID NO: 161673 - protein, 9 aa, Artificial Sequence
  Description of Artificial Sequence: Synthetic peptide
  Seed: FLSLQCLQA (PRAME_HUMAN)
  misc_feature (2)..(2): Xaa can be Met, Leu, Gln, Val, Ile, Thr, Ser, or Ala
  misc_feature (9)..(9): Xaa can be Ile, Leu, Ala, Val, Met, Thr, Cys, Phe, Ser, or Gly
FXSLQCLQX

SEQ ID NO: 161674 - protein, 10 aa, Artificial Sequence
  Description of Artificial Sequence: Synthetic peptide
  Seed: FLSLQCLQAL (PRAME_HUMAN)
  misc_feature (2)..(2): Xaa can be Leu, Met, Gln, Thr, Ile, Val, Tyr, Ser, Lys, Asp, Cys, His, Pro, Glu, Phe, Ala, Trp, Asn, Gly, or Arg
  misc_feature (10)..(10): Xaa can be Ala, Ile, Leu, Val, Met, Thr, Cys, Ser, Phe, Pro, or Gly
FXSLQCLQAX

SEQ ID NO: 161675 - protein, 11 aa, Artificial Sequence
  Description of Artificial Sequence: Synthetic peptide
  Seed: FLSLQCLQALY (PRAME_HUMAN)
  misc_feature (2)..(2): Xaa can be Leu, Met, Gln, Ser, Trp, Gly, Glu, Ile, Cys, Phe, Pro, Arg, Thr, Val, Tyr, Ala, Lys, Asn, Asp, or His
  misc_feature (11)..(11): Xaa can be Ile, Val, Tyr, Met, Leu, Ala, Phe, Cys, Pro, Gly, Trp, Ser, Thr, Asn, Asp, Glu, His, Gln, Arg, or Lys
FXSLQCLQALX

SEQ ID NO: 161676 - protein, 9 aa, Artificial Sequence
  Description of Artificial Sequence: Synthetic peptide
  Seed: FMAAFDGRH (PRAME_HUMAN)
  misc_feature (2)..(2): Xaa can be Gln, Met, Lys, His, Ala, Arg, Val, Ile, Leu, Ser, Glu, Tyr, Gly, Asn, Phe, or Thr
  misc_feature (9)..(9): Xaa can be Tyr, Phe, Met, Leu, His, Ile, Trp, or Val
FXAAFDGRX

SEQ ID NO: 161677 - protein, 10 aa, Artificial Sequence
  Description of Artificial Sequence: Synthetic peptide
  Seed: FMAAFDGRHS (PRAME_HUMAN)
  misc_feature (2)..(2): Xaa can be Met, Leu, Gln, Ile, Val, Thr, Ala, or Ser
  misc_feature (10)..(10): Xaa can be Val, Leu, Ile, Ala, Met, Phe, Cys, Thr, Ser, or Pro
FXAAFDGRHX

SEQ ID NO: 161678 - protein, 9 aa, Artificial Sequence
  Description of Artificial Sequence: Synthetic peptide
  Seed: FPEPEAAQP (PRAME_HUMAN)
  misc_feature (2)..(2): Xaa can be Pro, Ala, Tyr, Ser, Ile, Phe, Val, Met, Thr, Gly, Cys, Leu, Asp, Gln, Trp, or Glu
  misc_feature (9)..(9): Xaa can be Tyr, Phe, Met, Leu, Ile, Ala, Val, Trp, Pro, Gly, Thr, Ser, Gln, Lys, Cys, Arg, or His
FXEPEAAQX

SEQ ID NO: 161679 - protein, 10 aa, Artificial Sequence
  Description of Artificial Sequence: Synthetic peptide
  Seed: FPEPEAAQPM (PRAME_HUMAN)
  misc_feature (2)..(2): Xaa can be Pro, Ala, Ser, Val, Met, Leu, Ile, Thr, Phe, Tyr, Gly, Cys, Trp, Gln, Asn, Glu, Arg, His, Asp, or Lys
  misc_feature (10)..(10): Xaa can be Tyr, Leu, Phe, Met, Ile, Val, Trp, Ala, Cys, Pro, Gly, Arg, Ser, Lys, His, Gln, or Thr
FXEPEAAQPX

SEQ ID NO: 161680 - protein, 11 aa, Artificial Sequence
  Description of Artificial Sequence: Synthetic peptide
  Seed: FPEPEAAQPMT (PRAME_HUMAN)
  misc_feature (2)..(2): Xaa can be , or Pro
  misc_feature (11)..(11): Xaa can be Gly, Val, Ile, Trp, Tyr, Arg, Leu, Cys, Pro, Ser, Ala, Thr, Phe, or Met
FXEPEAAQPMX

SEQ ID NO: 161681 - protein, 8 aa, Artificial Sequence
  Description of Artificial Sequence: Synthetic peptide
  Seed: FPPLFMAA (PRAME_HUMAN)
  misc_feature (2)..(2): Xaa can be Pro, Ala, Gly, or Ser
  misc_feature (8)..(8): Xaa can be Ile, Val, Leu, Ala, Cys, Ser, Thr, Met, Pro, or Phe
FXPLFMAX

SEQ ID NO: 161682 - protein, 9 aa, Artificial Sequence
  Description of Artificial Sequence: Synthetic peptide
  Seed: FPPLFMAAF (PRAME_HUMAN)
  misc_feature (2)..(2): Xaa can be Pro, Tyr, Ala, Arg, Ser, Phe, Val, Trp, Gln, Met, Gly, Thr, Leu, Ile, Asn, Cys, His, Lys, Glu, or Asp
  misc_feature (9)..(9): Xaa can be Leu, Tyr, Phe, Met, Ile, Val, His, Trp, Ala, Cys, Arg, Lys, Thr, Ser, Pro, Gln, or Gly
FXPLFMAAX

SEQ ID NO: 161683 - protein, 8 aa, Artificial Sequence
  Description of Artificial Sequence: Synthetic peptide
  Seed: FSPYLGQM (PRAME_HUMAN)
  misc_feature (2)..(2): Xaa can be Ala, Ser, Thr, Gly, Val, Gln, Cys, Asn, Pro, Met, Ile, Leu, or Phe
  misc_feature (8)..(8): Xaa can be Leu, Tyr, Met, Phe, Ile, Val, or Trp
FXPYLGQX

SEQ ID NO: 161684 - protein, 9 aa, Artificial Sequence
  Description of Artificial Sequence: Synthetic peptide
  Seed: FSPYLGQMI (PRAME_HUMAN)
  misc_feature (2)..(2): Xaa can be Ala, Pro, Met, Leu, Ile, Thr, Val, Gln, Ser, Gly, Phe, Asn, Cys, Arg, Glu, Tyr, His, Trp, Lys, or Asp
  misc_feature (9)..(9): Xaa can be Leu, Met, Tyr, Phe, Val, Ile, Trp, Ala, His, Thr, Cys, Lys, or Arg
FXPYLGQMX

SEQ ID NO: 161685 - protein, 11 aa, Artificial Sequence
  Description of Artificial Sequence: Synthetic peptide
  Seed: FSPYLGQMINL (PRAME_HUMAN)
  misc_feature (2)..(2): Xaa can be Ala, Tyr, Ser, Lys, Arg, Phe, Met, Cys, Pro, Glu, Gln, Asp, Ile, His, Gly, Thr, Trp, Leu, Val, or Asn
  misc_feature (11)..(11): Xaa can be Ile, Phe, Trp, Leu, Met, or Tyr
FXPYLGQMINX

SEQ ID NO: 161686 - protein, 8 aa, Artificial Sequence
  Description of Artificial Sequence: Synthetic peptide
  Seed: FSYLIEKV (PRAME_HUMAN)
  misc_feature (2)..(2): Xaa can be Gln, Ala, Pro, Ser, Glu, Thr, Asn, Ile, Gly, Val, Met, Asp, Phe, Leu, Lys, His, Cys, or Ar g
  misc_feature (8)..(8): Xaa can be Ile, Leu, Val, Phe, Met, Tyr, Ala, Cys, Trp, Thr, or His
FXYLIEKX

SEQ ID NO: 161687 - protein, 9 aa, Artificial Sequence
  Description of Artificial Sequence: Synthetic peptide
  Seed: FSYLIEKVK (PRAME_HUMAN)
  misc_feature (2)..(2): Xaa can be Thr, Ser, Ala, Val, Met, Gly, Asp, Gln, Leu, Asn, Ile, or Pro
  misc_feature (9)..(9): Xaa can be Arg, Lys, Tyr, or His
FXYLIEKVX

SEQ ID NO: 161688 - protein, 10 aa, Artificial Sequence
  Description of Artificial Sequence: Synthetic peptide
  Seed: FSYLIEKVKR (PRAME_HUMAN)
  misc_feature (2)..(2): Xaa can be Met, Gln, Phe, Thr, Ile, Gly, Val, Tyr, Ser, Leu, Ala, Trp, His, Cys, Asp, Glu, Asn, Arg, or Pro
  misc_feature (10)..(10): Xaa can be Arg, or Lys
FXYLIEKVKX

SEQ ID NO: 161689 - protein, 8 aa, Artificial Sequence
  Description of Artificial Sequence: Synthetic peptide
  Seed: FTCLPLGV (PRAME_HUMAN)
  misc_feature (2)..(2): Xaa can be Ala, Ser, Thr, Gly, Ile, Val, or Asn
  misc_feature (8)..(8): Xaa can be Leu, Met, Ile, Tyr, Phe, Val, or Lys
FXCLPLGX

SEQ ID NO: 161690 - protein, 9 aa, Artificial Sequence
  Description of Artificial Sequence: Synthetic peptide
  Seed: FTCLPLGVL (PRAME_HUMAN)
  misc_feature (2)..(2): Xaa can be Ala, Leu, Val, Gln, Ser, Thr, Met, Ile, Asn, Gly, Asp, Cys, Pro, Glu, Arg, Phe, Tyr, Trp, His, or Lys
  misc_feature (9)..(9): Xaa can be Tyr, Phe, Leu, Met, Trp, Val, Lys, Ile, Arg, His, Ala, Thr, Gln, Ser, or Cys
FXCLPLGVX

SEQ ID NO: 161691 - protein, 10 aa, Artificial Sequence
  Description of Artificial Sequence: Synthetic peptide
  Seed: FTCLPLGVLM (PRAME_HUMAN)
  misc_feature (2)..(2): Xaa can be Ser, Ala, Met, Val, Leu, Gln, Ile, Thr, Gly, Asn, Pro, Cys, Phe, Glu, Asp, Trp, Tyr, Lys, Arg, or His
  misc_feature (10)..(10): Xaa can be Trp, Phe, Leu, Lys, Tyr, Met, Ile, Val, Ala, Arg, Thr, Cys, or His
FXCLPLGVLX

SEQ ID NO: 161692 - protein, 11 aa, Artificial Sequence
  Description of Artificial Sequence: Synthetic peptide
  Seed: FTCLPLGVLMK (PRAME_HUMAN)
  misc_feature (2)..(2): Xaa can be Val, Leu, Thr, Ile, Met, Ala, or Ser
  misc_feature (11)..(11): Xaa can be Lys, or Arg
FXCLPLGVLMX

SEQ ID NO: 161693 - protein, 8 aa, Artificial Sequence
  Description of Artificial Sequence: Synthetic peptide
  Seed: FTSQFLSL (PRAME_HUMAN)
  misc_feature (2)..(2): Xaa can be Ala, Ser, Gly, Thr, Val, Ile, Gln, Cys, Arg, Leu, Met, Asp, Phe, His, Asn, Glu, Tyr, or Pr o
  misc_feature (8)..(8): Xaa can be Leu, Met, Phe, Tyr, Ile, Lys, Val, Trp, His, or Arg
FXSQFLSX

SEQ ID NO: 161694 - protein, 11 aa, Artificial Sequence
  Description of Artificial Sequence: Synthetic peptide
  Seed: FTSQFLSLQCL (PRAME_HUMAN)
  misc_feature (2)..(2): Xaa can be Val, Gln, Thr, Met, Ser, Leu, Ala, Ile, Cys, Gly, Asn, Pro, His, Lys, Tyr, Trp, Phe, Glu, Arg, or Asp
  misc_feature (11)..(11): Xaa can be Val, Trp, Ile, Leu, Phe, Ala, Tyr, or Met
FXSQFLSLQCX

SEQ ID NO: 161695 - protein, 9 aa, Artificial Sequence
  Description of Artificial Sequence: Synthetic peptide
  Seed: FWTVWSGNR (PRAME_HUMAN)
  misc_feature (2)..(2): Xaa can be Met, Phe, Tyr, His, Gly, Ser, Trp, Ile, Val, Ala, Asp, Cys, Gln, Thr, Pro, Leu, or Asn
  misc_feature (9)..(9): Xaa can be Arg, or Lys
FXTVWSGNX

SEQ ID NO: 161696 - protein, 10 aa, Artificial Sequence
  Description of Artificial Sequence: Synthetic peptide
  Seed: FWTVWSGNRA (PRAME_HUMAN)
  misc_feature (2)..(2): Xaa can be Asp, Ile, Val, Cys, Pro, Lys, Glu, Arg, Ser, Gln, Thr, Ala, Met, Tyr, His, Trp, Asn, Gly, Phe, or Leu
  misc_feature (10)..(10): Xaa can be Leu, Val, Ile, or Ala
FXTVWSGNRX

SEQ ID NO: 161697 - protein, 8 aa, Artificial Sequence
  Description of Artificial Sequence: Synthetic peptide
  Seed: FYDPEPIL (PRAME_HUMAN)
  misc_feature (2)..(2): Xaa can be Ala, Tyr, Val, Ser, Ile, Thr, Gly, Met, Phe, Leu, Gln, Trp, Asn, Cys, Pro, Arg, His, Asp, Glu, or Lys
  misc_feature (8)..(8): Xaa can be Met, Ile, Phe, Leu, Val, Tyr, Trp, Ala, Lys, Cys, Arg, Thr, Gln, or Ser
FXDPEPIX

SEQ ID NO: 161698 - protein, 9 aa, Artificial Sequence
  Description of Artificial Sequence: Synthetic peptide
  Seed: FYDPEPILC (PRAME_HUMAN)
  misc_feature (2)..(2): Xaa can be Phe, Val, Tyr, Met, Ile, Ala, Thr, Trp, Gly, Leu, Ser, Gln, Asn, Cys, Pro, Arg, His, Asp, Glu, or Lys
  misc_feature (9)..(9): Xaa can be Leu, Arg, Val, Ala, Lys, Tyr, Ile, Met, Phe, Cys, Trp, Thr, Ser, His, Pro, Gly, Gln, Glu, Asn, or Asp
FXDPEPILX

SEQ ID NO: 161699 - protein, 10 aa, Artificial Sequence
  Description of Artificial Sequence: Synthetic peptide
  Seed: FYDPEPILCP (PRAME_HUMAN)
  misc_feature (2)..(2): Xaa can be Tyr, Phe, Trp, Met, Ala, Leu, Gly, Ser, Ile, Val, Gln, Thr, His, Pro, Glu, Lys, Arg, Cys, Asn, or Asp
  misc_feature (10)..(10): Xaa can be Leu, Ile, Phe, Met, Val, Cys, Tyr, Trp, Ala, Thr, Gly, Ser, Pro, Glu, Asn, His, Gln, Arg, or Lys
FXDPEPILCX

SEQ ID NO: 161700 - protein, 11 aa, Artificial Sequence
  Description of Artificial Sequence: Synthetic peptide
  Seed: FYDPEPILCPC (PRAME_HUMAN)
  misc_feature (2)..(2): Xaa can be Tyr, Phe, Trp, Arg, Met, Ala, Gly, His, Ser, Leu, Ile, Gln, Pro, Val, Thr, Cys, Asn, Lys, or Glu
  misc_feature (11)..(11): Xaa can be Met, Leu, Phe, Ile, Val, Cys, Ala, Trp, Tyr, Thr, or Lys
FXDPEPILCPX

SEQ ID NO: 161701 - protein, 8 aa, Artificial Sequence
  Description of Artificial Sequence: Synthetic peptide
  Seed: FYGNSISI (PRAME_HUMAN)
  misc_feature (2)..(2): Xaa can be Tyr, Phe, Trp, Arg, Ala, His, Gly, Ser, Gln, Ile, Met, Asn, Val, Thr, Glu, Asp, Leu, Lys, Cys, or Pro
  misc_feature (8)..(8): Xaa can be Leu, Met, Phe, Ile, Tyr, Val, Trp, or His
FXGNSISX

SEQ ID NO: 161702 - protein, 11 aa, Artificial Sequence
  Description of Artificial Sequence: Synthetic peptide
  Seed: FYGNSISISAL (PRAME_HUMAN)
  misc_feature (2)..(2): Xaa can be Tyr, Arg, Trp, Phe, His, Ala, Gly, Gln, Ser, or Met
  misc_feature (11)..(11): Xaa can be Leu, Phe, Met, Tyr, Trp, Ile, Lys, His, or Val
FXGNSISISAX

SEQ ID NO: 161703 - protein, 9 aa, Artificial Sequence
  Description of Artificial Sequence: Synthetic peptide
  Seed: GACDELFSY (PRAME_HUMAN)
  misc_feature (2)..(2): Xaa can be Arg, Met, Ala, Leu, Ile, Gln, Val, Thr, Ser, Tyr, Pro, Trp, Phe, Asn, Gly, Glu, Asp, Lys, Cys, or His
  misc_feature (9)..(9): Xaa can be Phe, Tyr, Trp, Met, Leu, Lys, Arg, Ile, His, Val, Ala, or Cys
GXCDELFSX

SEQ ID NO: 161704 - protein, 10 aa, Artificial Sequence
  Description of Artificial Sequence: Synthetic peptide
  Seed: GACDELFSYL (PRAME_HUMAN)
  misc_feature (2)..(2): Xaa can be Leu, Val, Met, Ala, Ile, Gln, Ser, Thr, Asn, Glu, Gly, Arg, Phe, Tyr, His, Cys, Lys, Trp, Asp, or Pro
  misc_feature (10)..(10): Xaa can be Trp, Phe, Leu, Tyr, Val, Met, Lys, Ile, Arg, Ala, Thr, Cys, His, Gly, or Ser
GXCDELFSYX

SEQ ID NO: 161705 - protein, 9 aa, Artificial Sequence
  Description of Artificial Sequence: Synthetic peptide
  Seed: GITDDQLLA (PRAME_HUMAN)
  misc_feature (2)..(2): Xaa can be Leu, Met, Gln, Ile, Val, Thr, Ser, or Ala
  misc_feature (9)..(9): Xaa can be Val, Leu, Ile, Ala, or Met
GXTDDQLLX

SEQ ID NO: 161706 - protein, 10 aa, Artificial Sequence
  Description of Artificial Sequence: Synthetic peptide
  Seed: GITDDQLLAL (PRAME_HUMAN)
  misc_feature (2)..(2): Xaa can be Gln, Leu, Met, Thr, Ile, Val, Ala, Ser, Glu, Gly, Asn, Asp, Arg, Lys, Phe, or His
  misc_feature (10)..(10): Xaa can be Trp, Lys, Leu, Met, Arg, Phe, Tyr, Ile, Val, Ala, Thr, or Cys
GXTDDQLLAX

SEQ ID NO: 161707 - protein, 11 aa, Artificial Sequence
  Description of Artificial Sequence: Synthetic peptide
  Seed: GITDDQLLALL (PRAME_HUMAN)
  misc_feature (2)..(2): Xaa can be Met, Val, Gln, Leu, Ile, Glu, or Ala
  misc_feature (11)..(11): Xaa can be Trp, Phe, Met, Val, Ile, Leu, Ala, or Tyr
GXTDDQLLALX

SEQ ID NO: 161708 - protein, 10 aa, Artificial Sequence
  Description of Artificial Sequence: Synthetic peptide
  Seed: GLDVLLAQEV (PRAME_HUMAN)
  misc_feature (2)..(2): Xaa can be Met, Leu, Ile, Val, or Gln
  misc_feature (10)..(10): Xaa can be Val, Leu, Met, Ile, Phe, or Ala
GXDVLLAQEX

SEQ ID NO: 161709 - protein, 8 aa, Artificial Sequence
  Description of Artificial Sequence: Synthetic peptide
  Seed: GLSNLTHV (PRAME_HUMAN)
  misc_feature (2)..(2): Xaa can be Leu, or Met
  misc_feature (8)..(8): Xaa can be Val, or Leu
GXSNLTHX

SEQ ID NO: 161710 - protein, 9 aa, Artificial Sequence
  Description of Artificial Sequence: Synthetic peptide
  Seed: GLSNLTHVL (PRAME_HUMAN)
  misc_feature (2)..(2): Xaa can be Gln, Met, Ala, Val, Thr, Leu, Ile, Gly, Ser, Arg, Asn, Tyr, Phe, Glu, His, Lys, Cys, Asp, Trp, or Pro
  misc_feature (9)..(9): Xaa can be Tyr, Phe, Leu, Met, Ile, Val, Arg, Trp, Lys, His, Ala, Thr, or Cys
GXSNLTHVX

SEQ ID NO: 161711 - protein, 10 aa, Artificial Sequence
  Description of Artificial Sequence: Synthetic peptide
  Seed: GLSNLTHVLY (PRAME_HUMAN)
  misc_feature (2)..(2): Xaa can be Met, Leu, Gln, Ile, Val, Thr, Ser, Phe, Trp, Ala, Tyr, Gly, Lys, Cys, Asn, Asp, Glu, His, Arg, or Pro
  misc_feature (10)..(10): Xaa can be Phe, Lys, Tyr, Trp, Arg, Met, Leu, Val, Ile, Ala, Cys, Gln, Gly, His, Thr, Ser, Asn, Asp, Glu, or Pro
GXSNLTHVLX

SEQ ID NO: 161712 - protein, 10 aa, Artificial Sequence
  Description of Artificial Sequence: Synthetic peptide
  Seed: GLSTEAEQPF (PRAME_HUMAN)
  misc_feature (2)..(2): Xaa can be Gln, Met, Leu, Ile, Val, Thr, Ser, or Ala
  misc_feature (10)..(10): Xaa can be Tyr, Phe, Trp, Leu, Met, or Ile
GXSTEAEQPX

SEQ ID NO: 161713 - protein, 9 aa, Artificial Sequence
  Description of Artificial Sequence: Synthetic peptide
  Seed: GNRASLYSF (PRAME_HUMAN)
  misc_feature (2)..(2): Xaa can be Gln, Met, Leu, Lys, Val, Glu, Ile, Ser, His, Ala, Arg, Asn, Thr, Tyr, Phe, Gly, Pro, Asp, Trp, or Cys
  misc_feature (9)..(9): Xaa can be Tyr, Phe, Met, Leu, Trp, Ile, His, Ala, or Val
GXRASLYSX

SEQ ID NO: 161714 - protein, 9 aa, Artificial Sequence
  Description of Artificial Sequence: Synthetic peptide
  Seed: GNSISISAL (PRAME_HUMAN)
  misc_feature (2)..(2): Xaa can be Arg, Ala, Gln, Gly, Phe, His, Asn, Glu, Tyr, Ser, Ile, Val, Thr, Met, Leu, or Asp
  misc_feature (9)..(9): Xaa can be Leu, Met, Val, Phe, or Ile
GXSISISAX

SEQ ID NO: 161715 - protein, 9 aa, Artificial Sequence
  Description of Artificial Sequence: Synthetic peptide
  Seed: GQHLHLETF (PRAME_HUMAN)
  misc_feature (2)..(2): Xaa can be Glu, Arg, Gln, Ala, Asp, His, Ser, Gly, Thr, Tyr, Leu, Met, Lys, Val, Ile, Phe, Asn, Trp, Pro, or Cys
  misc_feature (9)..(9): Xaa can be Leu, Tyr, Phe, Met, Val, Ile, Trp, His, Lys, Ala, Arg, Cys, Thr, Pro, Ser, Gly, Glu, Asn, Gln, or Asp
GXHLHLETX

SEQ ID NO: 161716 - protein, 10 aa, Artificial Sequence
  Description of Artificial Sequence: Synthetic peptide
  Seed: GQHLHLETFK (PRAME_HUMAN)
  misc_feature (2)..(2): Xaa can be Thr, Ser, Leu, Ala, Trp, Val, Gln, Gly, Ile, Met, Tyr, Phe, Asn, or Cys
  misc_feature (10)..(10): Xaa can be Arg, Lys, or Ala
GXHLHLETFX

SEQ ID NO: 161717 - protein, 9 aa, Artificial Sequence
  Description of Artificial Sequence: Synthetic peptide
  Seed: GQMINLRRL (PRAME_HUMAN)
  misc_feature (2)..(2): Xaa can be Arg, Glu, Gln, Met, Leu, His, Asp, Val, Ala, Ile, Ser, Lys, Thr, Tyr, Asn, or Gly
  misc_feature (9)..(9): Xaa can be Tyr, Phe, Val, Leu, Ile, Met, Ala, Trp, Cys, His, Thr, Lys, Ser, Arg, Gln, or Pro
GXMINLRRX

SEQ ID NO: 161718 - protein, 10 aa, Artificial Sequence
  Description of Artificial Sequence: Synthetic peptide
  Seed: GQMINLRRLL (PRAME_HUMAN)
  misc_feature (2)..(2): Xaa can be Arg, Gln, Phe, Val, Tyr, Met, Leu, Ile, Thr, Ser, Cys, Ala, Trp, Glu, Gly, His, Lys, Pro, Asp, or Asn
  misc_feature (10)..(10): Xaa can be Leu, Val, Ile, Ala, Phe, Trp, Tyr, Cys, Thr, or Met
GXMINLRRLX

SEQ ID NO: 161719 - protein, 9 aa, Artificial Sequence
  Description of Artificial Sequence: Synthetic peptide
  Seed: GQSLLKDEA (PRAME_HUMAN)
  misc_feature (2)..(2): Xaa can be Glu, His, Gln, Asp, Met, Val, Leu, Ile, Thr, Ala, Ser, or Arg
  misc_feature (9)..(9): Xaa can be Val, Ile, Leu, Ala, Met, Cys, Pro, Thr, Phe, Trp, Glu, Gln, Ser, Gly, Tyr, or Asp
GXSLLKDEX

SEQ ID NO: 161720 - protein, 10 aa, Artificial Sequence
  Description of Artificial Sequence: Synthetic peptide
  Seed: GQSLLKDEAL (PRAME_HUMAN)
  misc_feature (2)..(2): Xaa can be Glu, Gln, Met, Asp, Leu, Ile, or Val
  misc_feature (10)..(10): Xaa can be Phe, Trp, Leu, Met, Ile, Val, Tyr, Ser, Pro, Cys, Ala, or Thr
GXSLLKDEAX

SEQ ID NO: 161721 - protein, 9 aa, Artificial Sequence
  Description of Artificial Sequence: Synthetic peptide
  Seed: GRHSQTLKA (PRAME_HUMAN)
  misc_feature (2)..(2): Xaa can be Arg, His, Gln, Lys, Asn, Glu, Tyr, Met, Ser, Ala, Phe, Gly, Thr, Leu, Trp, Asp, Val, Ile, or Pro
  misc_feature (9)..(9): Xaa can be Leu, Met, Phe, Tyr, Ile, Val, Lys, Ala, Arg, Cys, Trp, Pro, Gly, Thr, Glu, Asn, Gln, His, or Ser
GXHSQTLKX

SEQ ID NO: 161722 - protein, 10 aa, Artificial Sequence
  Description of Artificial Sequence: Synthetic peptide
  Seed: GRHSQTLKAM (PRAME_HUMAN)
  misc_feature (2)..(2): Xaa can be Arg, Gln, Tyr, His, Lys, Phe, Glu, or Ala
  misc_feature (10)..(10): Xaa can be Leu, Phe, Tyr, Met, Lys, Thr, Gln, Cys, Trp, Arg, Ala, Ile, Val, or His
GXHSQTLKAX

SEQ ID NO: 161723 - protein, 11 aa, Artificial Sequence
  Description of Artificial Sequence: Synthetic peptide
  Seed: GRHSQTLKAMV (PRAME_HUMAN)
  misc_feature (2)..(2): Xaa can be , or Arg
  misc_feature (11)..(11): Xaa can be Trp, Gln, Leu, His, Ala, Arg, Met, Ile, Phe, Lys, Tyr, Cys, or Val
GXHSQTLKAMX

SEQ ID NO: 161724 - protein, 8 aa, Artificial Sequence
  Description of Artificial Sequence: Synthetic peptide
  Seed: GRLDQLLR (PRAME_HUMAN)
  misc_feature (2)..(2): Xaa can be , or Arg
  misc_feature (8)..(8): Xaa can be Leu, Phe, Tyr, Lys, or Arg
GXLDQLLX

SEQ ID NO: 161725 - protein, 9 aa, Artificial Sequence
  Description of Artificial Sequence: Synthetic peptide
  Seed: GRLDQLLRH (PRAME_HUMAN)
  misc_feature (2)..(2): Xaa can be Arg, Gln, His, Lys, Tyr, Asn, Ala, Met, Phe, Glu, Ser, Gly, Trp, Thr, Leu, or Ile
  misc_feature (9)..(9): Xaa can be Leu, Phe, Tyr, Met, Lys, Ile, Val, Arg, Trp, His, Thr, Gln, Ala, Asn, Ser, Pro, Glu, Gly, or Cys
GXLDQLLRX

SEQ ID NO: 161726 - protein, 10 aa, Artificial Sequence
  Description of Artificial Sequence: Synthetic peptide
  Seed: GRLDQLLRHV (PRAME_HUMAN)
  misc_feature (2)..(2): Xaa can be Arg, Met, Gln, Leu, Tyr, His, Phe, Lys, Val, Ile, Glu, Ala, Asn, Asp, Trp, Cys, Pro, Gly, Thr, or Ser
  misc_feature (10)..(10): Xaa can be Val, Leu, Ile, Met, Phe, Tyr, Thr, Cys, Ala, Lys, Gln, Arg, Ser, Glu, Gly, Asn, His, Pro, or Trp
GXLDQLLRHX

SEQ ID NO: 161727 - protein, 11 aa, Artificial Sequence
  Description of Artificial Sequence: Synthetic peptide
  Seed: GRLDQLLRHVM (PRAME_HUMAN)
  misc_feature (2)..(2): Xaa can be Arg, His, or Gln
  misc_feature (11)..(11): Xaa can be Phe, Tyr, Leu, His, Met, Lys, Ala, Cys, Trp, Ile, Val, Arg, Asn, Glu, or Gln
GXLDQLLRHVX

SEQ ID NO: 161728 - protein, 10 aa, Artificial Sequence
  Description of Artificial Sequence: Synthetic peptide
  Seed: GRPSMVWLSA (PRAME_HUMAN)
  misc_feature (2)..(2): Xaa can be Arg, Met, Phe, Asn, Leu, Ser, Thr, Glu, Cys, Pro, Gly, Val, Gln, Tyr, Ala, Ile, Lys, Trp, Asp, or His
  misc_feature (10)..(10): Xaa can be Leu, Met, Ala, Phe, Val, Ile, Thr, His, Tyr, Trp, Lys, Arg, or Cys
GXPSMVWLSX

SEQ ID NO: 161729 - protein, 10 aa, Artificial Sequence
  Description of Artificial Sequence: Synthetic peptide
  Seed: GSIQSRYISM (PRAME_HUMAN)
  misc_feature (2)..(2): Xaa can be Ala, Thr, Ser, Gln, Val, Met, Gly, Ile, Cys, Leu, Pro, Asn, or Glu
  misc_feature (10)..(10): Xaa can be Trp, Tyr, Phe, Val, Ile, Leu, Met, or His
GXIQSRYISX

SEQ ID NO: 161730 - protein, 10 aa, Artificial Sequence
  Description of Artificial Sequence: Synthetic peptide
  Seed: GTLHLERLAY (PRAME_HUMAN)
  misc_feature (2)..(2): Xaa can be Gln, Leu, Met, Thr, Ser, Ala, Val, Ile, Asn, Phe, Asp, Gly, Pro, Arg, Trp, Tyr, Glu, His, Cys, or Lys
  misc_feature (10)..(10): Xaa can be Tyr, Phe, Lys, Trp, Met, Leu, or Arg
GXLHLERLAX

SEQ ID NO: 161731 - protein, 11 aa, Artificial Sequence
  Description of Artificial Sequence: Synthetic peptide
  Seed: GTLHLERLAYL (PRAME_HUMAN)
  misc_feature (2)..(2): Xaa can be Met, Leu, Tyr, Phe, Trp, Gln, Ala, Ser, Ile, Val, Arg, Lys, Thr, His, Cys, Gly, or Asn
  misc_feature (11)..(11): Xaa can be Val, Leu, Ile, Ala, Met, Thr, or Cys
GXLHLERLAYX

SEQ ID NO: 161732 - protein, 9 aa, Artificial Sequence
  Description of Artificial Sequence: Synthetic peptide
  Seed: GVLMKGQHL (PRAME_HUMAN)
  misc_feature (2)..(2): Xaa can be Leu, Met, Ile, Ala, Gln, Val, Thr, or Ser
  misc_feature (9)..(9): Xaa can be Leu, Val, Ile, Met, or Ala
GXLMKGQHX

SEQ ID NO: 161733 - protein, 8 aa, Artificial Sequence
  Description of Artificial Sequence: Synthetic peptide
  Seed: HARLRELL (PRAME_HUMAN)
  misc_feature (2)..(2): Xaa can be Pro, Met, Ala, Leu, Ser, Thr, Gly, Val, His, Gln, Ile, Asn, Arg, Glu, Phe, Cys, Asp, Lys, Trp, or Tyr
  misc_feature (8)..(8): Xaa can be Leu, Met, Ile, Val, Phe, Tyr, Cys, or Ala
HXRLRELX

SEQ ID NO: 161734 - protein, 9 aa, Artificial Sequence
  Description of Artificial Sequence: Synthetic peptide
  Seed: HARLRELLC (PRAME_HUMAN)
  misc_feature (2)..(2): Xaa can be Pro, Leu, Ala, Ile, Met, Val, Ser, Gln, Gly, Thr, Asn, Phe, Cys, His, Asp, Tyr, Glu, Lys, Arg, or Trp
  misc_feature (9)..(9): Xaa can be Met, Leu, Ile, Val, Phe, Ala, Cys, Thr, Trp, Ser, Gly, Pro, or Tyr
HXRLRELLX

SEQ ID NO: 161735 - protein, 11 aa, Artificial Sequence
  Description of Artificial Sequence: Synthetic peptide
  Seed: HARLRELLCEL (PRAME_HUMAN)
  misc_feature (2)..(2): Xaa can be Met, Leu, Phe, Ala, Trp, Pro, Tyr, Ser, Gln, Val, Cys, Asn, Thr, Glu, His, Ile, Asp, Gly, Arg, or Lys
  misc_feature (11)..(11): Xaa can be Val, Leu, Ile, Ala, Met, or Phe
HXRLRELLCEX

SEQ ID NO: 161736 - protein, 10 aa, Artificial Sequence
  Description of Artificial Sequence: Synthetic peptide
  Seed: HASSYISPEK (PRAME_HUMAN)
  misc_feature (2)..(2): Xaa can be Thr, Ala, Ser, Val, Met, Leu, Ile, Gly, Phe, Tyr, Asn, Gln, Lys, Glu, Pro, Arg, Cys, Trp, Asp, or His
  misc_feature (10)..(10): Xaa can be Arg, Lys, Tyr, Phe, Met, Leu, Trp, Ile, His, or Val
HXSSYISPEX

SEQ ID NO: 161737 - protein, 10 aa, Artificial Sequence
  Description of Artificial Sequence: Synthetic peptide
  Seed: HCSQLTTLSF (PRAME_HUMAN)
  misc_feature (2)..(2): Xaa can be Ala, Thr, Ser, Val, Gln, Ile, Met, Gly, Leu, Pro, Trp, His, Tyr, Lys, Arg, Phe, Asp, Asn, Cys, or Glu
  misc_feature (10)..(10): Xaa can be Tyr, Met, Leu, Phe, Trp, His, Lys, Ile, Val, Ala, or Arg
HXSQLTTLSX

SEQ ID NO: 161738 - protein, 11 aa, Artificial Sequence
  Description of Artificial Sequence: Synthetic peptide
  Seed: HCSQLTTLSFY (PRAME_HUMAN)
  misc_feature (2)..(2): Xaa can be Gln, Thr, Ser, Leu, Ile, Ala, Gly, Val, Met, Asp, Arg, Phe, Glu, Pro, His, Cys, Asn, Lys, Tyr, or Trp
  misc_feature (11)..(11): Xaa can be Tyr, Met, Phe, Lys, His, Gly, Ile, Thr, Pro, Cys, Asn, Trp, Gln, Asp, Glu, Val, Ala, Leu, Arg, or Ser
HXSQLTTLSFX

SEQ ID NO: 161739 - protein, 8 aa, Artificial Sequence
  Description of Artificial Sequence: Synthetic peptide
  Seed: HGTLHLER (PRAME_HUMAN)
  misc_feature (2)..(2): Xaa can be Ala, Ser, Thr, Gly, Val, Ile, Leu, Met, Asn, Phe, Gln, Cys, or Asp
  misc_feature (8)..(8): Xaa can be Tyr, Leu, Lys, Phe, Met, Arg, Val, Ile, or Trp
HXTLHLEX

SEQ ID NO: 161740 - protein, 9 aa, Artificial Sequence
  Description of Artificial Sequence: Synthetic peptide
  Seed: HGTLHLERL (PRAME_HUMAN)
  misc_feature (2)..(2): Xaa can be Arg, Ser, Ala, Gln, Gly, Thr, Val, Asn, Tyr, Ile, His, Glu, Lys, Asp, Cys, Met, Phe, Leu, Trp, or Pro
  misc_feature (9)..(9): Xaa can be Leu, Met, Phe, Tyr, Ile, Val, Lys, Trp, Arg, Cys, His, or Ala
HXTLHLERX

SEQ ID NO: 161741 - protein, 11 aa, Artificial Sequence
  Description of Artificial Sequence: Synthetic peptide
  Seed: HGTLHLERLAY (PRAME_HUMAN)
  misc_feature (2)..(2): Xaa can be Met, Gln, Thr, Ala, Glu, Ile, Ser, Phe, Lys, Leu, Val, Tyr, Arg, Pro, Cys, Trp, Asp, His, Asn, or Gly
  misc_feature (11)..(11): Xaa can be Tyr, Phe, or Met
HXTLHLERLAX

SEQ ID NO: 161742 - protein, 8 aa, Artificial Sequence
  Description of Artificial Sequence: Synthetic peptide
  Seed: HLERLAYL (PRAME_HUMAN)
  misc_feature (2)..(2): Xaa can be Leu, Met, or Ile
  misc_feature (8)..(8): Xaa can be Val, Ala, Leu, or Ile
HXERLAYX

SEQ ID NO: 161743 - protein, 10 aa, Artificial Sequence
  Description of Artificial Sequence: Synthetic peptide
  Seed: HLERLAYLHA (PRAME_HUMAN)
  misc_feature (2)..(2): Xaa can be Thr, Ser, Val, Met, Ala, Ile, Tyr, Gln, Phe, Gly, Leu, His, Asn, or Trp
  misc_feature (10)..(10): Xaa can be Lys, Ala, Val, Leu, Ile, Met, Gly, Ser, Tyr, Thr, Arg, or Phe
HXERLAYLHX

SEQ ID NO: 161744 - protein, 11 aa, Artificial Sequence
  Description of Artificial Sequence: Synthetic peptide
  Seed: HLERLAYLHAR (PRAME_HUMAN)
  misc_feature (2)..(2): Xaa can be Met, Val, Leu, Asp, Pro, Lys, Ile, Glu, Gly, Asn, Trp, Arg, Ala, Thr, Cys, Ser, Gln, His, Tyr, or Phe
  misc_feature (11)..(11): Xaa can be Ile, Phe, Lys, Tyr, Met, Val, Arg, or Leu
HXERLAYLHAX

SEQ ID NO: 161745 - protein, 9 aa, Artificial Sequence
  Description of Artificial Sequence: Synthetic peptide
  Seed: HLETFKAVL (PRAME_HUMAN)
  misc_feature (2)..(2): Xaa can be Arg, Ala, Ser, Thr, Phe, Ile, Leu, Gln, Tyr, Val, Gly, Met, Trp, Glu, His, Pro, Asn, Cys, Asp, or Lys
  misc_feature (9)..(9): Xaa can be Tyr, Met, Leu, Phe, Ile, Val, Trp, Lys, Cys, Arg, or Ala
HXETFKAVX

SEQ ID NO: 161746 - protein, 9 aa, Artificial Sequence
  Description of Artificial Sequence: Synthetic peptide
  Seed: HLHLETFKA (PRAME_HUMAN)
  misc_feature (2)..(2): Xaa can be Leu, Met, Val, Ile, Gln, Thr, Ala, or Ser
  misc_feature (9)..(9): Xaa can be Val, Ile, Leu, Ala, or Met
HXHLETFKX

SEQ ID NO: 161747 - protein, 10 aa, Artificial Sequence
  Description of Artificial Sequence: Synthetic peptide
  Seed: HLHLETFKAV (PRAME_HUMAN)
  misc_feature (2)..(2): Xaa can be Met, Leu, Gln, Val, or Ile
  misc_feature (10)..(10): Xaa can be Val, Leu, Ile, or Ala
HXHLETFKAX

SEQ ID NO: 161748 - protein, 8 aa, Artificial Sequence
  Description of Artificial Sequence: Synthetic peptide
  Seed: HLIGLSNL (PRAME_HUMAN)
  misc_feature (2)..(2): Xaa can be Leu, or Met
  misc_feature (8)..(8): Xaa can be Ile, Ala, Val, or Leu
HXIGLSNX

SEQ ID NO: 161749 - protein, 9 aa, Artificial Sequence
  Description of Artificial Sequence: Synthetic peptide
  Seed: HLIGLSNLT (PRAME_HUMAN)
  misc_feature (2)..(2): Xaa can be Met, Leu, Gln, Val, Ile, Thr, Ala, or Ser
  misc_feature (9)..(9): Xaa can be Val, Ile, Leu, Ala, Met, Thr, or Phe
HXIGLSNLX

SEQ ID NO: 161750 - protein, 10 aa, Artificial Sequence
  Description of Artificial Sequence: Synthetic peptide
  Seed: HLIGLSNLTH (PRAME_HUMAN)
  misc_feature (2)..(2): Xaa can be Ala, Val, Ser, Gly, Thr, Gln, Ile, Leu, Met, Glu, Cys, Asn, Tyr, Pro, or Phe
  misc_feature (10)..(10): Xaa can be Tyr, Phe, Met, Leu, His, Trp, Lys, Val, Ala, Arg, or Ile
HXIGLSNLTX

SEQ ID NO: 161751 - protein, 11 aa, Artificial Sequence
  Description of Artificial Sequence: Synthetic peptide
  Seed: HLIGLSNLTHV (PRAME_HUMAN)
  misc_feature (2)..(2): Xaa can be Leu, Met, Gln, Val, Ile, Tyr, Phe, or Thr
  misc_feature (11)..(11): Xaa can be Val, Leu, Ile, Met, or Ala
HXIGLSNLTHX

SEQ ID NO: 161752 - protein, 8 aa, Artificial Sequence
  Description of Artificial Sequence: Synthetic peptide
  Seed: HLSQSPSV (PRAME_HUMAN)
  misc_feature (2)..(2): Xaa can be Gln, Glu, Ile, Met, Ser, Val, Ala, Leu, or Gly
  misc_feature (8)..(8): Xaa can be Ile, Val, Leu, or Met
HXSQSPSX

SEQ ID NO: 161753 - protein, 11 aa, Artificial Sequence
  Description of Artificial Sequence: Synthetic peptide
  Seed: HLSQSPSVSQL (PRAME_HUMAN)
  misc_feature (2)..(2): Xaa can be Ala, Gln, Met, Leu, Val, Ser, Ile, Thr, Gly, Glu, Arg, Asn, Cys, Pro, Tyr, Phe, Asp, His, Trp, or Lys
  misc_feature (11)..(11): Xaa can be Phe, Leu, Tyr, Met, Lys, Arg, Trp, Ile, Val, His, Ala, or Cys
HXSQSPSVSQX

SEQ ID NO: 161754 - protein, 8 aa, Artificial Sequence
  Description of Artificial Sequence: Synthetic peptide
  Seed: HQDFWTVW (PRAME_HUMAN)
  misc_feature (2)..(2): Xaa can be Glu, or Gln
  misc_feature (8)..(8): Xaa can be Trp, Tyr, or Phe
HXDFWTVX

SEQ ID NO: 161755 - protein, 8 aa, Artificial Sequence
  Description of Artificial Sequence: Synthetic peptide
  Seed: HSQTLKAM (PRAME_HUMAN)
  misc_feature (2)..(2): Xaa can be Ala, Ser, Thr, Val, Gln, Gly, or Ile
  misc_feature (8)..(8): Xaa can be Tyr, Phe, Leu, Met, Ile, Val, or His
HXQTLKAX

SEQ ID NO: 161756 - protein, 9 aa, Artificial Sequence
  Description of Artificial Sequence: Synthetic peptide
  Seed: HSQTLKAMV (PRAME_HUMAN)
  misc_feature (2)..(2): Xaa can be Ala, Ser, Thr, Val, Gln, Ile, Met, Glu, Phe, Leu, or Gly
  misc_feature (9)..(9): Xaa can be Leu, Tyr, Ile, Phe, Met, Val, or Trp
HXQTLKAMX

SEQ ID NO: 161757 - protein, 11 aa, Artificial Sequence
  Description of Artificial Sequence: Synthetic peptide
  Seed: HVLYPVPLESY (PRAME_HUMAN)
  misc_feature (2)..(2): Xaa can be Ala, Gln, Met, Tyr, Leu, Val, Glu, Ser, Arg, Pro, His, Cys, Thr, Ile, Lys, Phe, or Trp
  misc_feature (11)..(11): Xaa can be Tyr, Phe, Met, Trp, or Leu
HXLYPVPLESX

SEQ ID NO: 161758 - protein, 9 aa, Artificial Sequence
  Description of Artificial Sequence: Synthetic peptide
  Seed: HVMNPLETL (PRAME_HUMAN)
  misc_feature (2)..(2): Xaa can be Glu, Pro, Arg, Ala, His, Gln, Thr, Leu, Asp, Val, Met, Ser, Ile, Tyr, Phe, Lys, Gly, Cys, Trp, or Asn
  misc_feature (9)..(9): Xaa can be Lys, Phe, Val, Tyr, Ile, Met, Trp, Leu, Arg, His, Ala, Cys, Thr, Ser, Gln, Pro, Gly, Asn, Glu, or Asp
HXMNPLETX

SEQ ID NO: 161759 - protein, 11 aa, Artificial Sequence
  Description of Artificial Sequence: Synthetic peptide
  Seed: HVMNPLETLSI (PRAME_HUMAN)
  misc_feature (2)..(2): Xaa can be Gln, Met, Ala, Leu, Ser, Ile, Val, Thr, Glu, Gly, Pro, Asn, Phe, His, Arg, Cys, or Lys
  misc_feature (11)..(11): Xaa can be Leu, Trp, Phe, Val, Ile, Met, Tyr, Ala, or Cys
HXMNPLETLSX

SEQ ID NO: 161760 - protein, 9 aa, Artificial Sequence
  Description of Artificial Sequence: Synthetic peptide
  Seed: IAALELLPR (PRAME_HUMAN)
  misc_feature (2)..(2): Xaa can be Ala, Ser, Thr, Val, Gly, Ile, Cys, Leu, Met, Phe, Tyr, Pro, Asp, Gln, Glu, Trp, Asn, or Hi s
  misc_feature (9)..(9): Xaa can be Arg, Lys, Leu, Tyr, Met, Phe, Val, His, Ile, Trp, or Ala
IXALELLPX

SEQ ID NO: 161761 - protein, 8 aa, Artificial Sequence
  Description of Artificial Sequence: Synthetic peptide
  Seed: IAQFTSQF (PRAME_HUMAN)
  misc_feature (2)..(2): Xaa can be Ala, Ser, or Thr
  misc_feature (8)..(8): Xaa can be Tyr, Phe, Met, Leu, Val, or Ile
IXQFTSQX

SEQ ID NO: 161762 - protein, 9 aa, Artificial Sequence
  Description of Artificial Sequence: Synthetic peptide
  Seed: IAQFTSQFL (PRAME_HUMAN)
  misc_feature (2)..(2): Xaa can be Ala, Gly, Leu, Met, Ile, Val, Thr, Ser, Gln, Pro, Arg, Phe, Tyr, Asn, Glu, Cys, His, Trp, or Asp
  misc_feature (9)..(9): Xaa can be Trp, Leu, Phe, Met, Tyr, Ile, Val, Ala, Lys, Cys, or His
IXQFTSQFX

SEQ ID NO: 161763 - protein, 11 aa, Artificial Sequence
  Description of Artificial Sequence: Synthetic peptide
  Seed: IAQFTSQFLSL (PRAME_HUMAN)
  misc_feature (2)..(2): Xaa can be Tyr, Met, Arg, Ser, Trp, His, Ala, Phe, Ile, Gln, Leu, Lys, Val, Cys, Gly, Asn, Thr, or Gl u
  misc_feature (11)..(11): Xaa can be Tyr, Phe, Met, Leu, Ile, or Trp
IXQFTSQFLSX

SEQ ID NO: 161764 - protein, 8 aa, Artificial Sequence
  Description of Artificial Sequence: Synthetic peptide
  Seed: IEDLEVTC (PRAME_HUMAN)
  misc_feature (2)..(2): Xaa can be Glu, or Asp
  misc_feature (8)..(8): Xaa can be Val, Leu, Phe, Cys, Thr, Ala, Met, Pro, or Ile
IXDLEVTX

SEQ ID NO: 161765 - protein, 9 aa, Artificial Sequence
  Description of Artificial Sequence: Synthetic peptide
  Seed: IEDLEVTCT (PRAME_HUMAN)
  misc_feature (2)..(2): Xaa can be Glu, Asp, Gln, Ala, or Ser
  misc_feature (9)..(9): Xaa can be Leu, Met, Ala, Phe, Ile, Val, Ser, Cys, Tyr, Gly, Pro, or Thr
IXDLEVTCX

SEQ ID NO: 161766 - protein, 10 aa, Artificial Sequence
  Description of Artificial Sequence: Synthetic peptide
  Seed: IEDLEVTCTW (PRAME_HUMAN)
  misc_feature (2)..(2): Xaa can be Glu, Ser, Thr, Ala, Gln, Phe, Asp, Val, Cys, Trp, Tyr, Met, Gly, Asn, Leu, Pro, Ile, His, Lys, or Arg
  misc_feature (10)..(10): Xaa can be Trp, Phe, Tyr, Leu, Met, Ile, Val, or Lys
IXDLEVTCTX

SEQ ID NO: 161767 - protein, 11 aa, Artificial Sequence
  Description of Artificial Sequence: Synthetic peptide
  Seed: IEDLEVTCTWK (PRAME_HUMAN)
  misc_feature (2)..(2): Xaa can be Thr, Met, Ser, Val, Ala, Gly, Ile, Leu, Gln, Asn, Cys, Glu, or Phe
  misc_feature (11)..(11): Xaa can be Lys, Tyr, Arg, His, Trp, or Phe
IXDLEVTCTWX

SEQ ID NO: 161768 - protein, 11 aa, Artificial Sequence
  Description of Artificial Sequence: Synthetic peptide
  Seed: IEKVKRKKNVL (PRAME_HUMAN)
  misc_feature (2)..(2): Xaa can be , or Glu
  misc_feature (11)..(11): Xaa can be , or Leu
IXKVKRKKNVX

SEQ ID NO: 161769 - protein, 9 aa, Artificial Sequence
  Description of Artificial Sequence: Synthetic peptide
  Seed: IFAMPMQDI (PRAME_HUMAN)
  misc_feature (2)..(2): Xaa can be Tyr, Phe, Trp, or Met
  misc_feature (9)..(9): Xaa can be Met, Phe, Trp, Leu, Ile, Tyr, Val, Ala, or His
IXAMPMQDX

SEQ ID NO: 161770 - protein, 10 aa, Artificial Sequence
  Description of Artificial Sequence: Synthetic peptide
  Seed: IFAMPMQDIK (PRAME_HUMAN)
  misc_feature (2)..(2): Xaa can be Met, Phe, Tyr, Ile, Gly, Ser, Thr, Trp, Leu, Val, or Gln
  misc_feature (10)..(10): Xaa can be Arg, or Lys
IXAMPMQDIX

SEQ ID NO: 161771 - protein, 9 aa, Artificial Sequence
  Description of Artificial Sequence: Synthetic peptide
  Seed: IGLSNLTHV (PRAME_HUMAN)
  misc_feature (2)..(2): Xaa can be Ala, Ser, Gln, Met, Leu, Thr, Ile, Val, Arg, Pro, Gly, Cys, Asn, Phe, Tyr, Glu, Asp, Trp, His, or Lys
  misc_feature (9)..(9): Xaa can be Leu, Met, Val, Ile, Phe, Tyr, Ala, Thr, Cys, Trp, Lys, or His
IXLSNLTHX

SEQ ID NO: 161772 - protein, 10 aa, Artificial Sequence
  Description of Artificial Sequence: Synthetic peptide
  Seed: IGLSNLTHVL (PRAME_HUMAN)
  misc_feature (2)..(2): Xaa can be Leu, Met, Phe, Ile, Tyr, Gln, Asp, Thr, Glu, Val, Gly, Ser, Arg, Ala, Pro, Asn, Lys, His, Trp, or Cys
  misc_feature (10)..(10): Xaa can be Val, Ile, Met, Ala, Leu, Thr, Phe, Asn, Tyr, His, Trp, Lys, Arg, Pro, Gly, Asp, Gln, Ser, Glu, or Cys
IXLSNLTHVX

SEQ ID NO: 161773 - protein, 11 aa, Artificial Sequence
  Description of Artificial Sequence: Synthetic peptide
  Seed: IGLSNLTHVLY (PRAME_HUMAN)
  misc_feature (2)..(2): Xaa can be Ser, Thr, Val, Ala, Met, Lys, Gln, His, Asn, Arg, Pro, Phe, Trp, Tyr, Cys, Asp, Leu, Ile, Glu, or Gly
  misc_feature (11)..(11): Xaa can be Trp, Tyr, Phe, Met, Leu, or Ile
IXLSNLTHVLX

SEQ ID NO: 161774 - protein, 9 aa, Artificial Sequence
  Description of Artificial Sequence: Synthetic peptide
  Seed: IHASSYISP (PRAME_HUMAN)
  misc_feature (2)..(2): Xaa can be His, Arg, Gln, Pro, Glu, or Lys
  misc_feature (9)..(9): Xaa can be Ala, Val, Leu, Ile, Cys, Met, Pro, Thr, Gly, Ser, or Phe
IXASSYISX

SEQ ID NO: 161775 - protein, 9 aa, Artificial Sequence
  Description of Artificial Sequence: Synthetic peptide
  Seed: IHGTLHLER (PRAME_HUMAN)
  misc_feature (2)..(2): Xaa can be Tyr, Ser, Leu, Gln, Thr, Phe, Val, Met, Asp, Trp, Glu, Ala, Asn, Ile, His, Pro, or Gly
  misc_feature (9)..(9): Xaa can be Arg, or Lys
IXGTLHLEX

SEQ ID NO: 161776 - protein, 10 aa, Artificial Sequence
  Description of Artificial Sequence: Synthetic peptide
  Seed: IHGTLHLERL (PRAME_HUMAN)
  misc_feature (2)..(2): Xaa can be , or His
  misc_feature (10)..(10): Xaa can be Phe, Leu, Val, Ile, or Met
IXGTLHLERX

SEQ ID NO: 161777 - protein, 10 aa, Artificial Sequence
  Description of Artificial Sequence: Synthetic peptide
  Seed: IKMILKMVQL (PRAME_HUMAN)
  misc_feature (2)..(2): Xaa can be Met, Leu, Phe, Tyr, Ser, Gln, Glu, Lys, Arg, Cys, Asn, Ala, Val, Ile, Pro, Asp, His, Trp, Gly, or Thr
  misc_feature (10)..(10): Xaa can be Leu, Ala, Val, Ile, Thr, or Met
IXMILKMVQX

SEQ ID NO: 161778 - protein, 10 aa, Artificial Sequence
  Description of Artificial Sequence: Synthetic peptide
  Seed: ILKMVQLDSI (PRAME_HUMAN)
  misc_feature (2)..(2): Xaa can be Leu, Met, Gln, Ile, Val, or Thr
  misc_feature (10)..(10): Xaa can be Val, Ile, Leu, Met, Ala, or Thr
IXKMVQLDSX

SEQ ID NO: 161779 - protein, 8 aa, Artificial Sequence
  Description of Artificial Sequence: Synthetic peptide
  Seed: INLRRLLL (PRAME_HUMAN)
  misc_feature (2)..(2): Xaa can be Pro, Leu, Met, Ala, Ile, Gln, Gly, Val, Glu, Ser, Asp, Asn, or Thr
  misc_feature (8)..(8): Xaa can be Leu, Met, Ile, Val, or Phe
IXLRRLLX

SEQ ID NO: 161780 - protein, 9 aa, Artificial Sequence
  Description of Artificial Sequence: Synthetic peptide
  Seed: IPVEVLVDL (PRAME_HUMAN)
  misc_feature (2)..(2): Xaa can be Pro, Ala, Gln, Gly, Thr, Ile, Val, Ser, His, Glu, Arg, Phe, Tyr, Cys, Asn, Met, Leu, Asp, Trp, or Lys
  misc_feature (9)..(9): Xaa can be Tyr, Leu, Phe, Lys, Met, Arg, Ile, Val, Trp, Ala, His, Cys, Ser, Gly, Thr, or Pro
IXVEVLVDX

SEQ ID NO: 161781 - protein, 10 aa, Artificial Sequence
  Description of Artificial Sequence: Synthetic peptide
  Seed: IPVEVLVDLF (PRAME_HUMAN)
  misc_feature (2)..(2): Xaa can be Pro, Val, Ala, Met, Ser, Gln, Leu, Thr, Glu, or Ile
  misc_feature (10)..(10): Xaa can be Tyr, Phe, Trp, Ala, Ile, Leu, Val, Met, or Cys
IXVEVLVDLX

SEQ ID NO: 161782 - protein, 11 aa, Artificial Sequence
  Description of Artificial Sequence: Synthetic peptide
  Seed: IPVEVLVDLFL (PRAME_HUMAN)
  misc_feature (2)..(2): Xaa can be , or Pro
  misc_feature (11)..(11): Xaa can be , or Leu
IXVEVLVDLFX

SEQ ID NO: 161783 - protein, 8 aa, Artificial Sequence
  Description of Artificial Sequence: Synthetic peptide
  Seed: IQSRYISM (PRAME_HUMAN)
  misc_feature (2)..(2): Xaa can be Gln, Met, Ala, Ser, Glu, Gly, Lys, His, Asp, or Leu
  misc_feature (8)..(8): Xaa can be Val, Leu, Tyr, Ile, Phe, or Met
IXSRYISX

SEQ ID NO: 161784 - protein, 10 aa, Artificial Sequence
  Description of Artificial Sequence: Synthetic peptide
  Seed: IQSRYISMSV (PRAME_HUMAN)
  misc_feature (2)..(2): Xaa can be Arg, Lys, Met, Gln, Tyr, Ile, Thr, Glu, Leu, Cys, Ala, Ser, Asp, Val, Pro, Gly, His, Asn, Phe, or Trp
  misc_feature (10)..(10): Xaa can be Arg, Val, Lys, Ser, Phe, Thr, Gly, Met, Tyr, Ala, Leu, Ile, Pro, His, Trp, Cys, Glu, Asn, or Gln
IXSRYISMSX

SEQ ID NO: 161785 - protein, 11 aa, Artificial Sequence
  Description of Artificial Sequence: Synthetic peptide
  Seed: IQSRYISMSVW (PRAME_HUMAN)
  misc_feature (2)..(2): Xaa can be Ser, Gln, Thr, Met, Ala, His, Lys, Phe, Trp, Tyr, Glu, Asn, Arg, Gly, Ile, Val, Leu, Cys, Pro, or Asp
  misc_feature (11)..(11): Xaa can be Tyr, Phe, Trp, Met, Leu, or Ile
IXSRYISMSVX

SEQ ID NO: 161786 - protein, 8 aa, Artificial Sequence
  Description of Artificial Sequence: Synthetic peptide
  Seed: ISALQSLL (PRAME_HUMAN)
  misc_feature (2)..(2): Xaa can be Ala, Ser, Thr, or Gly
  misc_feature (8)..(8): Xaa can be Leu, Met, Phe, Tyr, Lys, Val, or Ile
IXALQSLX

SEQ ID NO: 161787 - protein, 11 aa, Artificial Sequence
  Description of Artificial Sequence: Synthetic peptide
  Seed: ISALQSLLQHL (PRAME_HUMAN)
  misc_feature (2)..(2): Xaa can be Ser, Thr, Leu, Ala, Met, Asn, Gln, Val, Ile, Cys, Gly, His, Glu, Asp, Pro, Trp, Phe, Lys, Arg, or Tyr
  misc_feature (11)..(11): Xaa can be Val, Ile, Leu, Trp, Met, Phe, Tyr, or Ala
IXALQSLLQHX

SEQ ID NO: 161788 - protein, 9 aa, Artificial Sequence
  Description of Artificial Sequence: Synthetic peptide
  Seed: ISISALQSL (PRAME_HUMAN)
  misc_feature (2)..(2): Xaa can be Pro, Gln, Ala, Met, Leu, Ile, Tyr, Val, Thr, Arg, Ser, Phe, Gly, Asn, Asp, His, Lys, Cys, Glu, or Trp
  misc_feature (9)..(9): Xaa can be Met, Phe, Leu, Trp, Ile, Tyr, Val, Lys, His, Arg, Ala, Cys, Thr, Ser, Gly, Asn, Gln, or Pr o
IXISALQSX

SEQ ID NO: 161789 - protein, 10 aa, Artificial Sequence
  Description of Artificial Sequence: Synthetic peptide
  Seed: ISISALQSLL (PRAME_HUMAN)
  misc_feature (2)..(2): Xaa can be Leu, Met, Gln, Thr, Ser, Ala, Val, Ile, Gly, Asn, Phe, Asp, Cys, Glu, Tyr, Trp, His, Pro, Lys, or Arg
  misc_feature (10)..(10): Xaa can be Leu, Ile, Trp, Val, Lys, Phe, Arg, Met, Tyr, Ala, Thr, His, Gly, Ser, Asp, Glu, Cys, Asn, Gln, or Pro
IXISALQSLX

SEQ ID NO: 161790 - protein, 10 aa, Artificial Sequence
  Description of Artificial Sequence: Synthetic peptide
  Seed: ISMSVWTSPR (PRAME_HUMAN)
  misc_feature (2)..(2): Xaa can be Val, Thr, Ile, Met, Leu, Ser, Phe, Trp, Gln, Ala, Tyr, Asp, Gly, Lys, Cys, Asn, Glu, Pro, Arg, or His
  misc_feature (10)..(10): Xaa can be Arg, Lys, Tyr, His, Met, Phe, Leu, Val, or Ala
IXMSVWTSPX

SEQ ID NO: 161791 - protein, 11 aa, Artificial Sequence
  Description of Artificial Sequence: Synthetic peptide
  Seed: ISMSVWTSPRR (PRAME_HUMAN)
  misc_feature (2)..(2): Xaa can be Tyr, Thr, Ser, Phe, Trp, Ile, Leu, Met, Val, Gln, Gly, Asn, Ala, Arg, His, Glu, Asp, Cys, or Lys
  misc_feature (11)..(11): Xaa can be Arg, Lys, Gly, Gln, Asn, Cys, Pro, Thr, Asp, Ser, Val, Leu, Ala, Met, His, Trp, Ile, Tyr, Glu, or Phe
IXMSVWTSPRX

SEQ ID NO: 161792 - protein, 9 aa, Artificial Sequence
  Description of Artificial Sequence: Synthetic peptide
  Seed: ISPEKEEQY (PRAME_HUMAN)
  misc_feature (2)..(2): Xaa can be Tyr, Ala, Arg, Ser, Met, Ile, Gln, Val, Phe, Leu, Thr, Pro, Trp, Gly, Asp, Cys, Asn, Glu, Lys, or His
  misc_feature (9)..(9): Xaa can be Leu, Tyr, Phe, Val, Ile, Met, Trp, Lys, Arg, Cys, His, Ala, or Thr
IXPEKEEQX

SEQ ID NO: 161793 - protein, 10 aa, Artificial Sequence
  Description of Artificial Sequence: Synthetic peptide
  Seed: ISPEKEEQYI (PRAME_HUMAN)
  misc_feature (2)..(2): Xaa can be Ile, Thr, Leu, Val, Ser, Met, Ala, Gly, Gln, Phe, Tyr, Cys, Glu, Asp, Asn, Trp, or Pro
  misc_feature (10)..(10): Xaa can be Trp, Leu, Lys, Phe, Met, Tyr, Arg, Ile, or Val
IXPEKEEQYX

SEQ ID NO: 161794 - protein, 8 aa, Artificial Sequence
  Description of Artificial Sequence: Synthetic peptide
  Seed: ITDDQLLA (PRAME_HUMAN)
  misc_feature (2)..(2): Xaa can be Ala, Ser, Ile, Thr, Val, Phe, Leu, Met, Gly, Trp, Gln, Pro, Cys, Asp, Tyr, Glu, Asn, His, Arg, or Lys
  misc_feature (8)..(8): Xaa can be Leu, Met, Ile, Phe, Val, Tyr, Ala, Cys, Trp, Thr, or Lys
IXDDQLLX

SEQ ID NO: 161795 - protein, 9 aa, Artificial Sequence
  Description of Artificial Sequence: Synthetic peptide
  Seed: ITDDQLLAL (PRAME_HUMAN)
  misc_feature (2)..(2): Xaa can be Ala, Tyr, Phe, Ile, Ser, Val, Trp, Leu, Thr, Met, Pro, Gly, Glu, Gln, Cys, Asn, Arg, Asp, His, or Lys
  misc_feature (9)..(9): Xaa can be Ile, Met, Lys, Leu, Val, Tyr, Phe, Arg, Trp, Cys, Ala, Thr, His, Ser, Pro, Gln, Gly, Glu, Asn, or Asp
IXDDQLLAX

SEQ ID NO: 161796 - protein, 10 aa, Artificial Sequence
  Description of Artificial Sequence: Synthetic peptide
  Seed: ITDDQLLALL (PRAME_HUMAN)
  misc_feature (2)..(2): Xaa can be Leu, Thr, Met, Tyr, Ala, Val, Ser, Ile, Trp, Phe, Gly, Gln, Asn, Cys, His, Glu, Arg, Pro, Asp, or Lys
  misc_feature (10)..(10): Xaa can be Lys, Tyr, Phe, Trp, Leu, Met, Val, Ile, Arg, His, Cys, Ala, Thr, Gln, Ser, Glu, Gly, or As n
IXDDQLLALX

SEQ ID NO: 161797 - protein, 9 aa, Artificial Sequence
  Description of Artificial Sequence: Synthetic peptide
  Seed: KAMVQAWPF (PRAME_HUMAN)
  misc_feature (2)..(2): Xaa can be Tyr, Ser, Gln, Thr, Pro, Ala, Arg, Met, Val, Trp, Leu, Ile, Phe, Lys, Asn, Glu, Asp, His, Gly, or Cys
  misc_feature (9)..(9): Xaa can be Tyr, Trp, Phe, Ile, Met, Leu, Val, His, Lys, Arg, Ala, Gly, Cys, Ser, Asn, Thr, Asp, or Pr o
KXMVQAWPX

SEQ ID NO: 161798 - protein, 9 aa, Artificial Sequence
  Description of Artificial Sequence: Synthetic peptide
  Seed: KAVLDGLDV (PRAME_HUMAN)
  misc_feature (2)..(2): Xaa can be Val, Gln, Ala, Ser, Ile, Thr, Leu, Gly, Met, Asp, Asn, or Glu
  misc_feature (9)..(9): Xaa can be Leu, Lys, Tyr, Arg, Val, Ile, Phe, Met, His, or Ala
KXVLDGLDX

SEQ ID NO: 161799 - protein, 10 aa, Artificial Sequence
  Description of Artificial Sequence: Synthetic peptide
  Seed: KAVLDGLDVL (PRAME_HUMAN)
  misc_feature (2)..(2): Xaa can be Leu, Met, Gln, Ser, Val, Thr, Ala, Ile, Cys, Asn, Glu, Gly, Phe, Arg, Lys, Asp, Pro, Trp, Tyr, or His
  misc_feature (10)..(10): Xaa can be Ile, Leu, Val, Trp, Phe, Met, Tyr, or Ala
KXVLDGLDVX

SEQ ID NO: 161800 - protein, 11 aa, Artificial Sequence
  Description of Artificial Sequence: Synthetic peptide
  Seed: KAVLDGLDVLL (PRAME_HUMAN)
  misc_feature (2)..(2): Xaa can be Thr, Ala, Val, Ser, Ile, Met, Gln, Gly, Leu, Cys, Glu, Asn, Pro, Arg, Trp, Asp, Lys, Phe, Tyr, or His
  misc_feature (11)..(11): Xaa can be Leu, Val, Ile, Trp, Phe, Met, Tyr, Lys, Arg, or Cys
KXVLDGLDVLX

SEQ ID NO: 161801 - protein, 9 aa, Artificial Sequence
  Description of Artificial Sequence: Synthetic peptide
  Seed: KDEALAIAA (PRAME_HUMAN)
  misc_feature (2)..(2): Xaa can be Glu, Asp, Gln, or Ala
  misc_feature (9)..(9): Xaa can be Leu, Cys, Met, Ala, Val, Ile, Phe, Tyr, Trp, Thr, Pro, Asp, Lys, Asn, Glu, Gln, Gly, Arg, or Ser
KXEALAIAX

SEQ ID NO: 161802 - protein, 10 aa, Artificial Sequence
  Description of Artificial Sequence: Synthetic peptide
  Seed: KDEALAIAAL (PRAME_HUMAN)
  misc_feature (2)..(2): Xaa can be Glu, Asp, Gln, Ala, Met, Pro, Lys, Phe, Ser, Tyr, Thr, Cys, Leu, Arg, Trp, Asn, Ile, His, Gly, or Val
  misc_feature (10)..(10): Xaa can be Thr, Val, Met, Ile, Pro, Leu, Ala, Phe, Cys, Asp, Ser, Glu, Tyr, Gln, Gly, or Trp
KXEALAIAAX

SEQ ID NO: 161803 - protein, 9 aa, Artificial Sequence
  Description of Artificial Sequence: Synthetic peptide
  Seed: KEEQYIAQF (PRAME_HUMAN)
  misc_feature (2)..(2): Xaa can be Glu, Gln, Arg, Asp, Ala, Ser, Val, Lys, Met, Leu, Tyr, Ile, Asn, Thr, His, Gly, Phe, Trp, Pro, or Cys
  misc_feature (9)..(9): Xaa can be Leu, Met, Tyr, Phe, Ile, Val, Trp, His, Ala, Cys, Pro, Lys, Arg, Ser, Gly, Thr, Glu, Gln, or Asp
KXEQYIAQX

SEQ ID NO: 161804 - protein, 10 aa, Artificial Sequence
  Description of Artificial Sequence: Synthetic peptide
  Seed: KEEQYIAQFT (PRAME_HUMAN)
  misc_feature (2)..(2): Xaa can be Glu, Asp, or Gln
  misc_feature (10)..(10): Xaa can be Leu, Ala, Trp, Met, Phe, Val, Ser, Ile, Gly, Thr, Cys, Pro, or Tyr
KXEQYIAQFX

SEQ ID NO: 161805 - protein, 11 aa, Artificial Sequence
  Description of Artificial Sequence: Synthetic peptide
  Seed: KEEQYIAQFTS (PRAME_HUMAN)
  misc_feature (2)..(2): Xaa can be , or Glu
  misc_feature (11)..(11): Xaa can be Leu, Cys, Phe, Val, Ser, Met, Ile, Gly, Ala, Pro, or Thr
KXEQYIAQFTX

SEQ ID NO: 161806 - protein, 8 aa, Artificial Sequence
  Description of Artificial Sequence: Synthetic peptide
  Seed: KEGACDEL (PRAME_HUMAN)
  misc_feature (2)..(2): Xaa can be Glu, or Asp
  misc_feature (8)..(8): Xaa can be Leu, Val, Met, Ala, Phe, or Ile
KXGACDEX

SEQ ID NO: 161807 - protein, 9 aa, Artificial Sequence
  Description of Artificial Sequence: Synthetic peptide
  Seed: KEGACDELF (PRAME_HUMAN)
  misc_feature (2)..(2): Xaa can be Glu, Ile, Met, Ala, Val, Leu, Gln, Thr, Asp, Ser, Lys, Arg, Asn, or Gly
  misc_feature (9)..(9): Xaa can be Trp, Phe, Leu, Tyr, Ile, Met, Val, Ala, Ser, Cys, Gly, Pro, or Thr
KXGACDELX

SEQ ID NO: 161808 - protein, 11 aa, Artificial Sequence
  Description of Artificial Sequence: Synthetic peptide
  Seed: KEGACDELFSY (PRAME_HUMAN)
  misc_feature (2)..(2): Xaa can be Glu, Thr, Met, Gln, Val, Ile, Ser, Leu, Asp, Ala, Gly, Asn, Cys, Arg, Tyr, Lys, Phe, or Tr p
  misc_feature (11)..(11): Xaa can be Tyr, Lys, Phe, Arg, Trp, His, Ile, Leu, or Met
KXGACDELFSX

SEQ ID NO: 161809 - protein, 9 aa, Artificial Sequence
  Description of Artificial Sequence: Synthetic peptide
  Seed: KFSPYLGQM (PRAME_HUMAN)
  misc_feature (2)..(2): Xaa can be Arg, Ala, Tyr, Ser, Gln, Thr, Met, Leu, Ile, Val, Trp, Phe, Gly, Cys, Lys, Asn, His, Glu, Asp, or Pro
  misc_feature (9)..(9): Xaa can be Met, Phe, Leu, Tyr, Ile, Val, Trp, His, Lys, Arg, Ala, Cys, Gln, or Thr
KXSPYLGQX

SEQ ID NO: 161810 - protein, 10 aa, Artificial Sequence
  Description of Artificial Sequence: Synthetic peptide
  Seed: KFSPYLGQMI (PRAME_HUMAN)
  misc_feature (2)..(2): Xaa can be Tyr, Trp, Phe, Met, Val, Ile, Gln, Leu, or His
  misc_feature (10)..(10): Xaa can be Phe, Trp, Tyr, Leu, Met, Val, Ile, or Cys
KXSPYLGQMX

SEQ ID NO: 161811 - protein, 10 aa, Artificial Sequence
  Description of Artificial Sequence: Synthetic peptide
  Seed: KGQHLHLETF (PRAME_HUMAN)
  misc_feature (2)..(2): Xaa can be Thr, Gln, Met, Ser, Ala, Gly, Leu, Pro, Cys, Asp, Ile, Val, Glu, Asn, Phe, His, Tyr, Arg, Trp, or Lys
  misc_feature (10)..(10): Xaa can be Phe, Met, Tyr, Leu, Trp, Ile, His, or Val
KXQHLHLETX

SEQ ID NO: 161812 - protein, 10 aa, Artificial Sequence
  Description of Artificial Sequence: Synthetic peptide
  Seed: KIFAMPMQDI (PRAME_HUMAN)
  misc_feature (2)..(2): Xaa can be Met, Leu, Val, Ile, Gln, Thr, Ser, Ala, Glu, or Phe
  misc_feature (10)..(10): Xaa can be Val, Trp, Ile, Phe, Leu, Met, Ala, Tyr, Cys, or Thr
KXFAMPMQDX

SEQ ID NO: 161813 - protein, 11 aa, Artificial Sequence
  Description of Artificial Sequence: Synthetic peptide
  Seed: KIFAMPMQDIK (PRAME_HUMAN)
  misc_feature (2)..(2): Xaa can be Leu, Met, Thr, Ile, Val, Ser, Tyr, Phe, Trp, Gln, Ala, Lys, His, Gly, Arg, Cys, or Asn
  misc_feature (11)..(11): Xaa can be Arg, Lys, Tyr, His, or Ala
KXFAMPMQDIX

SEQ ID NO: 161814 - protein, 8 aa, Artificial Sequence
  Description of Artificial Sequence: Synthetic peptide
  Seed: KKLKIFAM (PRAME_HUMAN)
  misc_feature (2)..(2): Xaa can be Gln, Lys, Met, Ala, Ser, or Leu
  misc_feature (8)..(8): Xaa can be Tyr, Phe, Met, or Leu
KXLKIFAX

SEQ ID NO: 161815 - protein, 10 aa, Artificial Sequence
  Description of Artificial Sequence: Synthetic peptide
  Seed: KKLKIFAMPM (PRAME_HUMAN)
  misc_feature (2)..(2): Xaa can be Ser, Thr, Val, Tyr, Met, Arg, Ala, Gln, Ile, Phe, Gly, Trp, Asn, Lys, His, Pro, Leu, Cys, Glu, or Asp
  misc_feature (10)..(10): Xaa can be Tyr, Ile, Lys, Val, Phe, Met, Ala, Leu, Ser, Arg, Gly, Thr, Pro, His, Trp, Gln, Cys, Asn, or Glu
KXLKIFAMPX

SEQ ID NO: 161816 - protein, 9 aa, Artificial Sequence
  Description of Artificial Sequence: Synthetic peptide
  Seed: KLKIFAMPM (PRAME_HUMAN)
  misc_feature (2)..(2): Xaa can be Ile, Thr, Val, Met, Ala, Ser, Leu, Gln, Gly, Tyr, Trp, Phe, Asn, Lys, His, Cys, Glu, Arg, Pro, or Asp
  misc_feature (9)..(9): Xaa can be Phe, Tyr, Lys, Met, Ile, Val, Leu, Ala, His, Arg, Ser, Cys, Thr, Gly, Trp, Pro, Glu, Gln, Asn, or Asp
KXKIFAMPX

SEQ ID NO: 161817 - protein, 11 aa, Artificial Sequence
  Description of Artificial Sequence: Synthetic peptide
  Seed: KLPTLAKFSPY (PRAME_HUMAN)
  misc_feature (2)..(2): Xaa can be Gln, Cys, Pro, Arg, Val, His, Trp, Met, Tyr, Lys, Ala, Glu, Thr, Gly, Ile, Ser, Asn, Asp, Phe, or Leu
  misc_feature (11)..(11): Xaa can be Phe, Met, Trp, Tyr, or Leu
KXPTLAKFSPX

SEQ ID NO: 161818 - protein, 8 aa, Artificial Sequence
  Description of Artificial Sequence: Synthetic peptide
  Seed: KLQVLDLR (PRAME_HUMAN)
  misc_feature (2)..(2): Xaa can be Leu, Val, Phe, Ile, Thr, Met, or Tyr
  misc_feature (8)..(8): Xaa can be , or Arg
KXQVLDLX

SEQ ID NO: 161819 - protein, 9 aa, Artificial Sequence
  Description of Artificial Sequence: Synthetic peptide
  Seed: KLQVLDLRK (PRAME_HUMAN)
  misc_feature (2)..(2): Xaa can be Met, Leu, Thr, Ile, Val, Trp, Gly, Ser, Tyr, Phe, Asn, Ala, or Gln
  misc_feature (9)..(9): Xaa can be Lys, Arg, Tyr, His, or Leu
KXQVLDLRX

SEQ ID NO: 161820 - protein, 9 aa, Artificial Sequence
  Description of Artificial Sequence: Synthetic peptide
  Seed: KMILKMVQL (PRAME_HUMAN)
  misc_feature (2)..(2): Xaa can be Arg, Met, Leu, Gln, Ser, Thr, Ala, Val, Ile, Tyr, Asn, Phe, Glu, Lys, Gly, Asp, Trp, Pro, Cys, or His
  misc_feature (9)..(9): Xaa can be Ile, Phe, Tyr, Met, Val, Leu, Trp, Lys, Arg, His, Ala, Cys, Thr, Ser, Asn, Gln, Gly, Glu, or Pro
KXILKMVQX

SEQ ID NO: 161821 - protein, 8 aa, Artificial Sequence
  Description of Artificial Sequence: Synthetic peptide
  Seed: KMVQLDSI (PRAME_HUMAN)
  misc_feature (2)..(2): Xaa can be Gln, Ala, Ser, Met, or Glu
  misc_feature (8)..(8): Xaa can be Val, Ile, Leu, or Met
KXVQLDSX

SEQ ID NO: 161822 - protein, 11 aa, Artificial Sequence
  Description of Artificial Sequence: Synthetic peptide
  Seed: KMVQLDSIEDL (PRAME_HUMAN)
  misc_feature (2)..(2): Xaa can be Leu, Met, Gln, Ile, Val, Ala, Thr, Glu, or Ser
  misc_feature (11)..(11): Xaa can be Trp, Phe, Leu, Val, Ile, Met, Tyr, or Ala
KXVQLDSIEDX

SEQ ID NO: 161823 - protein, 11 aa, Artificial Sequence
  Description of Artificial Sequence: Synthetic peptide
  Seed: KNSHQDFWTVW (PRAME_HUMAN)
  misc_feature (2)..(2): Xaa can be Thr, Ser, Ala, Cys, Ile, Met, Val, Gly, Tyr, Glu, Gln, Asp, Pro, Leu, Arg, Trp, His, Lys, Phe, or Asn
  misc_feature (11)..(11): Xaa can be Trp, Phe, Tyr, Ile, Met, or Leu
KXSHQDFWTVX

SEQ ID NO: 161824 - protein, 9 aa, Artificial Sequence
  Description of Artificial Sequence: Synthetic peptide
  Seed: KNVLRLCCK (PRAME_HUMAN)
  misc_feature (2)..(2): Xaa can be Thr, Val, Met, Tyr, Ser, Leu, Phe, Gly, Ile, Gln, Trp, Asn, Ala, Asp, or Cys
  misc_feature (9)..(9): Xaa can be Lys, Arg, Tyr, His, Val, or Leu
KXVLRLCCX

SEQ ID NO: 161825 - protein, 10 aa, Artificial Sequence
  Description of Artificial Sequence: Synthetic peptide
  Seed: KNVLRLCCKK (PRAME_HUMAN)
  misc_feature (2)..(2): Xaa can be Phe, Asn, Thr, His, Tyr, Leu, Ser, Lys, Val, Trp, Glu, Met, Ala, Pro, Gln, Asp, Ile, Gly, Arg, or Cys
  misc_feature (10)..(10): Xaa can be Lys, or Arg
KXVLRLCCKX

SEQ ID NO: 161826 - protein, 9 aa, Artificial Sequence
  Description of Artificial Sequence: Synthetic peptide
  Seed: KRKKNVLRL (PRAME_HUMAN)
  misc_feature (2)..(2): Xaa can be Arg, Gln, Asn, Ala, Glu, Ser, Lys, Gly, His, Asp, Tyr, Leu, Thr, Ile, Val, Met, Phe, Trp, Pro, or Cys
  misc_feature (9)..(9): Xaa can be Leu, Phe, Met, Tyr, Ile, Lys, Val, Arg, Trp, His, Pro, Ala, Gly, Glu, Thr, Gln, Asn, Cys, or Ser
KXKKNVLRX

SEQ ID NO: 161827 - protein, 10 aa, Artificial Sequence
  Description of Artificial Sequence: Synthetic peptide
  Seed: KRKKNVLRLC (PRAME_HUMAN)
  misc_feature (2)..(2): Xaa can be Arg, or Gln
  misc_feature (10)..(10): Xaa can be Leu, Phe, Val, Cys, Ile, Tyr, or Met
KXKKNVLRLX

SEQ ID NO: 161828 - protein, 9 aa, Artificial Sequence
  Description of Artificial Sequence: Synthetic peptide
  Seed: KRKVDGLST (PRAME_HUMAN)
  misc_feature (2)..(2): Xaa can be Arg, Gln, Gly, Ala, Lys, Ser, Leu, Asn, Met, Thr, Ile, His, Glu, Asp, Val, Cys, Phe, or Tr p
  misc_feature (9)..(9): Xaa can be Leu, Ile, Lys, Phe, Arg, Met, Tyr, Val, Trp, Gln, His, Pro, Thr, Ala, Cys, Ser, or Gly
KXKVDGLSX

SEQ ID NO: 161829 - protein, 9 aa, Artificial Sequence
  Description of Artificial Sequence: Synthetic peptide
  Seed: KVDGLSTEA (PRAME_HUMAN)
  misc_feature (2)..(2): Xaa can be Ala, Ile, Ser, Val, Phe, Gly, Met, Leu, Cys, Thr, Gln, Asn, Tyr, Pro, Trp, Glu, Lys, Asp, His, or Arg
  misc_feature (9)..(9): Xaa can be Met, Val, Ile, Leu, Phe, Tyr, Cys, Ala, Trp, Thr, Ser, Lys, Gln, Arg, or Pro
KXDGLSTEX

SEQ ID NO: 161830 - protein, 9 aa, Artificial Sequence
  Description of Artificial Sequence: Synthetic peptide
  Seed: KVKRKKNVL (PRAME_HUMAN)
  misc_feature (2)..(2): Xaa can be Thr, Val, Ser, Ala, Pro, Met, Ile, Arg, Leu, Gln, Tyr, Phe, Gly, Glu, Asn, Asp, Trp, Cys, His, or Lys
  misc_feature (9)..(9): Xaa can be Leu, Lys, Met, Ile, Val, Ala, Tyr, Phe, Arg, Cys, Ser, Thr, Pro, His, Gly, Trp, Asn, Glu, or Gln
KXKRKKNVX

SEQ ID NO: 161831 - protein, 10 aa, Artificial Sequence
  Description of Artificial Sequence: Synthetic peptide
  Seed: KVKRKKNVLR (PRAME_HUMAN)
  misc_feature (2)..(2): Xaa can be Thr, Ser, Val, Tyr, Met, Ile, Phe, Ala, Leu, Trp, Gln, Asn, Gly, His, or Cys
  misc_feature (10)..(10): Xaa can be Lys, Ala, Val, Arg, Ile, Met, Ser, Leu, Thr, Tyr, Gly, Pro, Gln, Cys, Phe, Asn, Glu, or Hi s
KXKRKKNVLX

SEQ ID NO: 161832 - protein, 8 aa, Artificial Sequence
  Description of Artificial Sequence: Synthetic peptide
  Seed: LAIAALEL (PRAME_HUMAN)
  misc_feature (2)..(2): Xaa can be Ala, Pro, Ser, Gly, Gln, Thr, Asp, Asn, Val, Glu, Ile, Met, Leu, or His
  misc_feature (8)..(8): Xaa can be Ile, Leu, Val, Lys, Phe, Met, Tyr, Arg, Ala, Cys, or His
LXIAALEX

SEQ ID NO: 161833 - protein, 9 aa, Artificial Sequence
  Description of Artificial Sequence: Synthetic peptide
  Seed: LAIAALELL (PRAME_HUMAN)
  misc_feature (2)..(2): Xaa can be Met, Gln, Leu, Ser, Pro, Ile, Ala, Val, Thr, Arg, Glu, Gly, Asn, Cys, Asp, Tyr, Lys, Phe, His, or Trp
  misc_feature (9)..(9): Xaa can be Leu, Phe, Trp, Tyr, Met, Val, Ile, Lys, Ala, Thr, Cys, His, Ser, Arg, Gly, or Pro
LXIAALELX

SEQ ID NO: 161834 - protein, 11 aa, Artificial Sequence
  Description of Artificial Sequence: Synthetic peptide
  Seed: LAIAALELLPR (PRAME_HUMAN)
  misc_feature (2)..(2): Xaa can be Val, Tyr, Thr, Trp, Met, Phe, Lys, Gly, Arg, Asn, Leu, Ala, Ser, Glu, Gln, His, or Ile
  misc_feature (11)..(11): Xaa can be Arg, or Lys
LXIAALELLPX

SEQ ID NO: 161835 - protein, 8 aa, Artificial Sequence
  Description of Artificial Sequence: Synthetic peptide
  Seed: LAKFSPYL (PRAME_HUMAN)
  misc_feature (2)..(2): Xaa can be Ala, Ser, Met, Phe, Trp, Leu, Ile, Tyr, Gln, Thr, Pro, Val, His, Asn, or Asp
  misc_feature (8)..(8): Xaa can be Val, Leu, Ile, Tyr, Phe, Met, or Ala
LXKFSPYX

SEQ ID NO: 161836 - protein, 9 aa, Artificial Sequence
  Description of Artificial Sequence: Synthetic peptide
  Seed: LALLPSLSH (PRAME_HUMAN)
  misc_feature (2)..(2): Xaa can be Gln, Met, Ala, Thr, Leu, Ser, Gly, Lys, Ile, Val, His, Glu, Asn, Pro, Arg, Cys, Phe, Tyr, Asp, or Trp
  misc_feature (9)..(9): Xaa can be Tyr, Phe, Met, Leu, Lys, Ile, Arg, Val, His, Trp, Ala, Gly, Cys, Ser, Thr, or Asn
LXLLPSLSX

SEQ ID NO: 161837 - protein, 9 aa, Artificial Sequence
  Description of Artificial Sequence: Synthetic peptide
  Seed: LAQEVRPRR (PRAME_HUMAN)
  misc_feature (2)..(2): Xaa can be Met, Leu, Ile, Val, Thr, Asp, Gly, Pro, Tyr, Gln, Trp, Phe, Asn, Ser, Ala, Glu, Cys, or Hi s
  misc_feature (9)..(9): Xaa can be Arg, Lys, Leu, Tyr, Met, Val, Phe, Ile, or His
LXQEVRPRX

SEQ ID NO: 161838 - protein, 10 aa, Artificial Sequence
  Description of Artificial Sequence: Synthetic peptide
  Seed: LAQEVRPRRW (PRAME_HUMAN)
  misc_feature (2)..(2): Xaa can be Thr, Ser, Met, Ile, Cys, Val, Ala, Leu, Gln, Gly, Asp, Pro, Phe, Asn, Trp, Lys, Tyr, or Gl u
  misc_feature (10)..(10): Xaa can be Trp, Phe, Tyr, Met, Ile, or Leu
LXQEVRPRRX

SEQ ID NO: 161839 - protein, 8 aa, Artificial Sequence
  Description of Artificial Sequence: Synthetic peptide
  Seed: LAYLHARL (PRAME_HUMAN)
  misc_feature (2)..(2): Xaa can be Gln, Ala, Ser, Glu, Thr, Asn, Pro, Gly, Asp, Met, Val, His, or Arg
  misc_feature (8)..(8): Xaa can be Leu, Val, Ile, Phe, Met, Tyr, Ala, or Cys
LXYLHARX

SEQ ID NO: 161840 - protein, 9 aa, Artificial Sequence
  Description of Artificial Sequence: Synthetic peptide
  Seed: LAYLHARLR (PRAME_HUMAN)
  misc_feature (2)..(2): Xaa can be Met, Leu, Ala, Thr, Ser, Val, Ile, Pro, Gly, Asp, Phe, Gln, Trp, Asn, Tyr, Cys, His, or Gl u
  misc_feature (9)..(9): Xaa can be Arg, Lys, Tyr, His, Leu, Val, or Met
LXYLHARLX

SEQ ID NO: 161841 - protein, 11 aa, Artificial Sequence
  Description of Artificial Sequence: Synthetic peptide
  Seed: LAYLHARLREL (PRAME_HUMAN)
  misc_feature (2)..(2): Xaa can be Ala, or Ser
  misc_feature (11)..(11): Xaa can be Tyr, Leu, Met, or Phe
LXYLHARLREX

SEQ ID NO: 161842 - protein, 9 aa, Artificial Sequence
  Description of Artificial Sequence: Synthetic peptide
  Seed: LCCKKLKIF (PRAME_HUMAN)
  misc_feature (2)..(2): Xaa can be Ser, Thr, Ala, Val, Gly, Asp, Cys, Met, Asn, Leu, Ile, Gln, Phe, Trp, Lys, Glu, Tyr, or Pr o
  misc_feature (9)..(9): Xaa can be Trp, Phe, Leu, Met, Tyr, Val, Ile, or Cys
LXCKKLKIX

SEQ ID NO: 161843 - protein, 9 aa, Artificial Sequence
  Description of Artificial Sequence: Synthetic peptide
  Seed: LCELGRPSM (PRAME_HUMAN)
  misc_feature (2)..(2): Xaa can be Ala, Ile, Cys, Val, Phe, Ser, Thr, Gly, Leu, Met, Tyr, Asn, Pro, Gln, Asp, or Trp
  misc_feature (9)..(9): Xaa can be Leu, Met, Phe, Ile, Val, Tyr, or Cys
LXELGRPSX

SEQ ID NO: 161844 - protein, 11 aa, Artificial Sequence
  Description of Artificial Sequence: Synthetic peptide
  Seed: LCELGRPSMVW (PRAME_HUMAN)
  misc_feature (2)..(2): Xaa can be Ala, Ser, Thr, Gln, Val, Trp, Phe, Leu, Ile, Met, Gly, Cys, Pro, or Asn
  misc_feature (11)..(11): Xaa can be Trp, or Phe
LXELGRPSMVX

SEQ ID NO: 161845 - protein, 8 aa, Artificial Sequence
  Description of Artificial Sequence: Synthetic peptide
  Seed: LDGLDVLL (PRAME_HUMAN)
  misc_feature (2)..(2): Xaa can be Glu, or Asp
  misc_feature (8)..(8): Xaa can be Leu, Phe, or Met
LXGLDVLX

SEQ ID NO: 161846 - protein, 9 aa, Artificial Sequence
  Description of Artificial Sequence: Synthetic peptide
  Seed: LDGLDVLLA (PRAME_HUMAN)
  misc_feature (2)..(2): Xaa can be Glu, or Asp
  misc_feature (9)..(9): Xaa can be Ala, Cys, Val, Ile, Ser, Phe, Met, Leu, Pro, or Thr
LXGLDVLLX

SEQ ID NO: 161847 - protein, 8 aa, Artificial Sequence
  Description of Artificial Sequence: Synthetic peptide
  Seed: LDQLLRHV (PRAME_HUMAN)
  misc_feature (2)..(2): Xaa can be Glu, or Asp
  misc_feature (8)..(8): Xaa can be Ile, Met, Leu, Tyr, Val, Phe, Thr, Cys, or Ala
LXQLLRHX

SEQ ID NO: 161848 - protein, 9 aa, Artificial Sequence
  Description of Artificial Sequence: Synthetic peptide
  Seed: LDQLLRHVM (PRAME_HUMAN)
  misc_feature (2)..(2): Xaa can be Glu, Asp, Gln, Ala, His, Arg, Ser, Tyr, Phe, Gly, Asn, Pro, Met, Val, Trp, Ile, Thr, Lys, or Leu
  misc_feature (9)..(9): Xaa can be Leu, Met, Phe, Ile, Val, Cys, Pro, Tyr, Trp, Ala, Ser, Gln, Thr, Arg, Gly, Lys, Asp, or Gl u
LXQLLRHVX

SEQ ID NO: 161849 - protein, 9 aa, Artificial Sequence
  Description of Artificial Sequence: Synthetic peptide
  Seed: LDSIEDLEV (PRAME_HUMAN)
  misc_feature (2)..(2): Xaa can be Glu, Asp, or Gln
  misc_feature (9)..(9): Xaa can be Met, Leu, Phe, Ile, Ala, Val, Tyr, Thr, Pro, Ser, Trp, Lys, Gly, or Cys
LXSIEDLEX

SEQ ID NO: 161850 - protein, 9 aa, Artificial Sequence
  Description of Artificial Sequence: Synthetic peptide
  Seed: LDVLLAQEV (PRAME_HUMAN)
  misc_feature (2)..(2): Xaa can be Glu, Asp, Gln, Ser, Ala, Met, Asn, Leu, Gly, Val, Pro, Ile, Thr, or His
  misc_feature (9)..(9): Xaa can be Val, Ile, Leu, Met, Cys, Ala, Phe, Trp, Pro, Tyr, Thr, Ser, or Gly
LXVLLAQEX

SEQ ID NO: 161851 - protein, 8 aa, Artificial Sequence
  Description of Artificial Sequence: Synthetic peptide
  Seed: LELLPREL (PRAME_HUMAN)
  misc_feature (2)..(2): Xaa can be Glu, Asp, Gln, His, Arg, Ala, Leu, Met, Asn, Pro, Gly, Val, Thr, Ser, Ile, Tyr, or Phe
  misc_feature (8)..(8): Xaa can be Leu, Val, Ile, Met, Phe, Ala, Trp, Cys, Tyr, Pro, Gly, Thr, Ser, or His
LXLLPREX

SEQ ID NO: 161852 - protein, 9 aa, Artificial Sequence
  Description of Artificial Sequence: Synthetic peptide
  Seed: LELLPRELF (PRAME_HUMAN)
  misc_feature (2)..(2): Xaa can be Glu, Asp, Gln, Leu, Met, Ala, Lys, Ser, Pro, Ile, His, Arg, Val, Phe, Gly, Asn, Thr, Cys, or Tyr
  misc_feature (9)..(9): Xaa can be Tyr, Phe, Met, Leu, Trp, Ile, Val, Ala, Pro, Lys, Cys, His, Ser, Arg, Gly, or Thr
LXLLPRELX

SEQ ID NO: 161853 - protein, 8 aa, Artificial Sequence
  Description of Artificial Sequence: Synthetic peptide
  Seed: LERASATL (PRAME_HUMAN)
  misc_feature (2)..(2): Xaa can be Glu, Asp, Gln, Ala, or Ser
  misc_feature (8)..(8): Xaa can be Ile, Val, Leu, Phe, Met, Tyr, or Ala
LXRASATX

SEQ ID NO: 161854 - protein, 11 aa, Artificial Sequence
  Description of Artificial Sequence: Synthetic peptide
  Seed: LERASATLQDL (PRAME_HUMAN)
  misc_feature (2)..(2): Xaa can be , or Glu
  misc_feature (11)..(11): Xaa can be Leu, Ala, Phe, Cys, Met, Val, or Ile
LXRASATLQDX

SEQ ID NO: 161855 - protein, 9 aa, Artificial Sequence
  Description of Artificial Sequence: Synthetic peptide
  Seed: LERLAYLHA (PRAME_HUMAN)
  misc_feature (2)..(2): Xaa can be Glu, or Asp
  misc_feature (9)..(9): Xaa can be Leu, Ile, Val, Met, Phe, Thr, Pro, Ala, or Cys
LXRLAYLHX

SEQ ID NO: 161856 - protein, 10 aa, Artificial Sequence
  Description of Artificial Sequence: Synthetic peptide
  Seed: LERLAYLHAR (PRAME_HUMAN)
  misc_feature (2)..(2): Xaa can be Arg, Ala, Phe, Glu, Thr, Met, Tyr, Cys, Ser, Gln, Leu, Asn, His, Lys, Ile, Pro, Val, Asp, Trp, or Gly
  misc_feature (10)..(10): Xaa can be Arg, Lys, Tyr, Met, Val, Ile, Leu, Phe, Ala, His, or Trp
LXRLAYLHAX

SEQ ID NO: 161857 - protein, 11 aa, Artificial Sequence
  Description of Artificial Sequence: Synthetic peptide
  Seed: LERLAYLHARL (PRAME_HUMAN)
  misc_feature (2)..(2): Xaa can be Met, Phe, Tyr, Thr, Lys, Ala, Val, Asp, Asn, Cys, Gly, Glu, His, Arg, Pro, Ser, Ile, Trp, Leu, or Gln
  misc_feature (11)..(11): Xaa can be Val, Leu, or Ile
LXRLAYLHARX

SEQ ID NO: 161858 - protein, 10 aa, Artificial Sequence
  Description of Artificial Sequence: Synthetic peptide
  Seed: LESYEDIHGT (PRAME_HUMAN)
  misc_feature (2)..(2): Xaa can be , or Glu
  misc_feature (10)..(10): Xaa can be Thr, Ile, Ala, Val, Leu, Met, Pro, Phe, or Cys
LXSYEDIHGX

SEQ ID NO: 161859 - protein, 11 aa, Artificial Sequence
  Description of Artificial Sequence: Synthetic peptide
  Seed: LESYEDIHGTL (PRAME_HUMAN)
  misc_feature (2)..(2): Xaa can be , or Glu
  misc_feature (11)..(11): Xaa can be Val, Phe, Met, Cys, Ile, Ala, or Leu
LXSYEDIHGTX

SEQ ID NO: 161860 - protein, 8 aa, Artificial Sequence
  Description of Artificial Sequence: Synthetic peptide
  Seed: LETFKAVL (PRAME_HUMAN)
  misc_feature (2)..(2): Xaa can be Glu, or Asp
  misc_feature (8)..(8): Xaa can be Leu, Phe, Ile, Val, Met, Tyr, or Ala
LXTFKAVX

SEQ ID NO: 161861 - protein, 11 aa, Artificial Sequence
  Description of Artificial Sequence: Synthetic peptide
  Seed: LETFKAVLDGL (PRAME_HUMAN)
  misc_feature (2)..(2): Xaa can be , or Glu
  misc_feature (11)..(11): Xaa can be , or Leu
LXTFKAVLDGX

SEQ ID NO: 161862 - protein, 9 aa, Artificial Sequence
  Description of Artificial Sequence: Synthetic peptide
  Seed: LETLSITNC (PRAME_HUMAN)
  misc_feature (2)..(2): Xaa can be Glu, Asp, or Gln
  misc_feature (9)..(9): Xaa can be Leu, Met, Val, Ile, Ala, Phe, Trp, Gly, Tyr, Pro, Thr, Ser, or Cys
LXTLSITNX

SEQ ID NO: 161863 - protein, 10 aa, Artificial Sequence
  Description of Artificial Sequence: Synthetic peptide
  Seed: LETLSITNCR (PRAME_HUMAN)
  misc_feature (2)..(2): Xaa can be Gly, Ser, Thr, Trp, Ala, Cys, Pro, Leu, Val, Asp, Lys, His, Tyr, Gln, Asn, Phe, Met, Ile, Glu, or Arg
  misc_feature (10)..(10): Xaa can be Arg, or Lys
LXTLSITNCX

SEQ ID NO: 161864 - protein, 11 aa, Artificial Sequence
  Description of Artificial Sequence: Synthetic peptide
  Seed: LETLSITNCRL (PRAME_HUMAN)
  misc_feature (2)..(2): Xaa can be , or Glu
  misc_feature (11)..(11): Xaa can be Met, or Leu
LXTLSITNCRX

SEQ ID NO: 161865 - protein, 9 aa, Artificial Sequence
  Description of Artificial Sequence: Synthetic peptide
  Seed: LEVTCTWKL (PRAME_HUMAN)
  misc_feature (2)..(2): Xaa can be Glu, Gln, His, Asp, Met, Leu, Ile, Ala, Val, Ser, Arg, or Thr
  misc_feature (9)..(9): Xaa can be Leu, Phe, Ile, Val, Trp, Met, Tyr, Ala, Cys, Pro, Gly, Ser, or Thr
LXVTCTWKX

SEQ ID NO: 161866 - protein, 8 aa, Artificial Sequence
  Description of Artificial Sequence: Synthetic peptide
  Seed: LFFLRGRL (PRAME_HUMAN)
  misc_feature (2)..(2): Xaa can be Tyr, or Phe
  misc_feature (8)..(8): Xaa can be Leu, Met, Phe, Tyr, or Ile
LXFLRGRX

SEQ ID NO: 161867 - protein, 11 aa, Artificial Sequence
  Description of Artificial Sequence: Synthetic peptide
  Seed: LFLKEGACDEL (PRAME_HUMAN)
  misc_feature (2)..(2): Xaa can be Phe, Met, Tyr, or Leu
  misc_feature (11)..(11): Xaa can be Val, or Leu
LXLKEGACDEX

SEQ ID NO: 161868 - protein, 9 aa, Artificial Sequence
  Description of Artificial Sequence: Synthetic peptide
  Seed: LFMAAFDGR (PRAME_HUMAN)
  misc_feature (2)..(2): Xaa can be Met, Leu, Ser, Ile, Val, Ala, Thr, Trp, Phe, Tyr, Gly, Pro, Gln, Asn, Glu, Asp, Cys, or Hi s
  misc_feature (9)..(9): Xaa can be Arg, Lys, Tyr, Leu, Ile, Met, Val, or Phe
LXMAAFDGX

SEQ ID NO: 161869 - protein, 8 aa, Artificial Sequence
  Description of Artificial Sequence: Synthetic peptide
  Seed: LFPPLFMA (PRAME_HUMAN)
  misc_feature (2)..(2): Xaa can be Met, Phe, Trp, Leu, Tyr, Ile, Ala, Asn, His, Ser, Thr, Gly, Gln, Pro, Val, or Asp
  misc_feature (8)..(8): Xaa can be Val, Leu, Ile, Ala, or Met
LXPPLFMX

SEQ ID NO: 161870 - protein, 9 aa, Artificial Sequence
  Description of Artificial Sequence: Synthetic peptide
  Seed: LFPPLFMAA (PRAME_HUMAN)
  misc_feature (2)..(2): Xaa can be Tyr, Phe, Trp, Met, Ala, Ile, Leu, Arg, Ser, Gln, Val, Gly, Thr, His, Cys, Asn, Pro, or Ly s
  misc_feature (9)..(9): Xaa can be Met, Leu, Phe, Tyr, Ile, Val, Trp, Cys, His, Ala, Lys, Arg, Thr, Gln, or Ser
LXPPLFMAX

SEQ ID NO: 161871 - protein, 10 aa, Artificial Sequence
  Description of Artificial Sequence: Synthetic peptide
  Seed: LFPPLFMAAF (PRAME_HUMAN)
  misc_feature (2)..(2): Xaa can be Tyr, Trp, Phe, Met, Arg, Pro, His, Ala, Gln, Val, Leu, Thr, Ile, Ser, Gly, Glu, Cys, Asn, Asp, or Lys
  misc_feature (10)..(10): Xaa can be Tyr, Phe, Met, Leu, Trp, Ile, or Val
LXPPLFMAAX

SEQ ID NO: 161872 - protein, 10 aa, Artificial Sequence
  Description of Artificial Sequence: Synthetic peptide
  Seed: LFSYLIEKVK (PRAME_HUMAN)
  misc_feature (2)..(2): Xaa can be Phe, Tyr, Thr, Gln, Met, Leu, Ala, Ser, Gly, Arg, Trp, Ile, or Val
  misc_feature (10)..(10): Xaa can be Arg, or Lys
LXSYLIEKVX

SEQ ID NO: 161873 - protein, 11 aa, Artificial Sequence
  Description of Artificial Sequence: Synthetic peptide
  Seed: LFSYLIEKVKR (PRAME_HUMAN)
  misc_feature (2)..(2): Xaa can be Phe, Arg, Gln, Met, Ser, Ile, Val, Tyr, Leu, or Thr
  misc_feature (11)..(11): Xaa can be , or Arg
LXSYLIEKVKX

SEQ ID NO: 161874 - protein, 9 aa, Artificial Sequence
  Description of Artificial Sequence: Synthetic peptide
  Seed: LGQMINLRR (PRAME_HUMAN)
  misc_feature (2)..(2): Xaa can be Met, Ile, Val, Leu, Thr, Ala, Tyr, Ser, Trp, Phe, Gln, His, Pro, Gly, Asp, Cys, or Asn
  misc_feature (9)..(9): Xaa can be Arg, Lys, Tyr, or Leu
LXQMINLRX

SEQ ID NO: 161875 - protein, 8 aa, Artificial Sequence
  Description of Artificial Sequence: Synthetic peptide
  Seed: LGRPSMVW (PRAME_HUMAN)
  misc_feature (2)..(2): Xaa can be Thr, Ser, Ala, Gln, Cys, Pro, Ile, Asn, Asp, Gly, Leu, Val, Glu, Phe, or Met
  misc_feature (8)..(8): Xaa can be Trp, Leu, Phe, Met, Tyr, or Ile
LXRPSMVX

SEQ ID NO: 161876 - protein, 9 aa, Artificial Sequence
  Description of Artificial Sequence: Synthetic peptide
  Seed: LGRPSMVWL (PRAME_HUMAN)
  misc_feature (2)..(2): Xaa can be Thr, Ser, Val, Met, Tyr, Ala, Ile, Gln, Leu, Gly, Phe, Trp, Asn, Cys, Pro, Asp, Lys, His, Arg, or Glu
  misc_feature (9)..(9): Xaa can be Trp, Lys, Ala, Phe, Val, Leu, Ile, Ser, Arg, Met, Gly, Tyr, Thr, Asn, Pro, His, Cys, Gln, or Glu
LXRPSMVWX

SEQ ID NO: 161877 - protein, 11 aa, Artificial Sequence
  Description of Artificial Sequence: Synthetic peptide
  Seed: LGRPSMVWLSA (PRAME_HUMAN)
  misc_feature (2)..(2): Xaa can be Pro, Asn, Glu, Phe, Ala, Asp, Gly, Ser, Trp, Gln, Leu, Val, Arg, Cys, Met, Lys, His, Tyr, Thr, or Ile
  misc_feature (11)..(11): Xaa can be Ala, or Val
LXRPSMVWLSX

SEQ ID NO: 161878 - protein, 8 aa, Artificial Sequence
  Description of Artificial Sequence: Synthetic peptide
  Seed: LHARLREL (PRAME_HUMAN)
  misc_feature (2)..(2): Xaa can be His, Arg, Tyr, Gln, Asn, Pro, Ser, Glu, Ala, or Asp
  misc_feature (8)..(8): Xaa can be Leu, Tyr, Phe, Met, Ile, Val, Cys, Thr, or Ala
LXARLREX

SEQ ID NO: 161879 - protein, 9 aa, Artificial Sequence
  Description of Artificial Sequence: Synthetic peptide
  Seed: LHARLRELL (PRAME_HUMAN)
  misc_feature (2)..(2): Xaa can be His, Arg, Gln, Pro, Ala, or Glu
  misc_feature (9)..(9): Xaa can be Leu, Tyr, Met, Ile, Phe, Val, Ala, Cys, Trp, Thr, or Pro
LXARLRELX

SEQ ID NO: 161880 - protein, 8 aa, Artificial Sequence
  Description of Artificial Sequence: Synthetic peptide
  Seed: LHLERLAY (PRAME_HUMAN)
  misc_feature (2)..(2): Xaa can be Gln, Tyr, Arg, Met, His, Lys, Leu, Ala, or Ser
  misc_feature (8)..(8): Xaa can be Phe, Tyr, Met, Leu, or Ile
LXLERLAX

SEQ ID NO: 161881 - protein, 9 aa, Artificial Sequence
  Description of Artificial Sequence: Synthetic peptide
  Seed: LHLERLAYL (PRAME_HUMAN)
  misc_feature (2)..(2): Xaa can be Arg, His, Tyr, Gln, Trp, Phe, Asn, Ala, Glu, Thr, Ser, Gly, Met, Asp, Lys, Val, Pro, Leu, Ile, or Cys
  misc_feature (9)..(9): Xaa can be Leu, Met, Phe, Ile, Tyr, Val, Trp, Cys, Ala, His, Thr, Pro, Arg, or Lys
LXLERLAYX

SEQ ID NO: 161882 - protein, 8 aa, Artificial Sequence
  Description of Artificial Sequence: Synthetic peptide
  Seed: LHLETFKA (PRAME_HUMAN)
  misc_feature (2)..(2): Xaa can be His, or Arg
  misc_feature (8)..(8): Xaa can be Ala, Thr, Met, Cys, Leu, Ile, or Val
LXLETFKX

SEQ ID NO: 161883 - protein, 9 aa, Artificial Sequence
  Description of Artificial Sequence: Synthetic peptide
  Seed: LHLETFKAV (PRAME_HUMAN)
  misc_feature (2)..(2): Xaa can be His, Arg, Gln, Glu, Lys, Pro, Ala, Met, Ser, Asn, Gly, Leu, Asp, Ile, Thr, Val, or Phe
  misc_feature (9)..(9): Xaa can be Val, Ile, Leu, Tyr, Phe, Met, Ala, Thr, Cys, Pro, Trp, His, Ser, or Gly
LXLETFKAX

SEQ ID NO: 161884 - protein, 10 aa, Artificial Sequence
  Description of Artificial Sequence: Synthetic peptide
  Seed: LHLETFKAVL (PRAME_HUMAN)
  misc_feature (2)..(2): Xaa can be His, or Arg
  misc_feature (10)..(10): Xaa can be Leu, Ala, Val, Phe, Thr, Trp, Cys, Met, or Ile
LXLETFKAVX

SEQ ID NO: 161885 - protein, 9 aa, Artificial Sequence
  Description of Artificial Sequence: Synthetic peptide
  Seed: LIEKVKRKK (PRAME_HUMAN)
  misc_feature (2)..(2): Xaa can be Leu, Ile, Met, Val, Gln, Thr, Ser, or Ala
  misc_feature (9)..(9): Xaa can be Lys, Arg, or Tyr
LXEKVKRKX

SEQ ID NO: 161886 - protein, 10 aa, Artificial Sequence
  Description of Artificial Sequence: Synthetic peptide
  Seed: LIGLSNLTHV (PRAME_HUMAN)
  misc_feature (2)..(2): Xaa can be Leu, Met, Gln, Val, Ile, Thr, or Ala
  misc_feature (10)..(10): Xaa can be Val, Leu, Ile, Met, Ala, or Thr
LXGLSNLTHX

SEQ ID NO: 161887 - protein, 11 aa, Artificial Sequence
  Description of Artificial Sequence: Synthetic peptide
  Seed: LIGLSNLTHVL (PRAME_HUMAN)
  misc_feature (2)..(2): Xaa can be Leu, Phe, Met, Thr, Ser, Arg, Pro, Ile, Gln, Cys, His, Asn, Glu, Val, Trp, Lys, Tyr, Ala, Asp, or Gly
  misc_feature (11)..(11): Xaa can be Met, Ile, Leu, Val, Ala, Asn, Cys, Arg, Asp, Thr, Tyr, Ser, Trp, Glu, Gly, Gln, His, Pro, Lys, or Phe
LXGLSNLTHVX

SEQ ID NO: 161888 - protein, 10 aa, Artificial Sequence
  Description of Artificial Sequence: Synthetic peptide
  Seed: LKAMVQAWPF (PRAME_HUMAN)
  misc_feature (2)..(2): Xaa can be Pro, Ser, Gln, Met, Ala, Thr, Leu, Lys, Gly, Asp, His, Ile, Cys, Val, Tyr, Phe, Arg, Asn, Glu, or Trp
  misc_feature (10)..(10): Xaa can be Tyr, Met, Phe, Trp, Leu, Ile, His, Val, Ser, Gly, Thr, Gln, Asn, or Ala
LXAMVQAWPX

SEQ ID NO: 161889 - protein, 11 aa, Artificial Sequence
  Description of Artificial Sequence: Synthetic peptide
  Seed: LKDEALAIAAL (PRAME_HUMAN)
  misc_feature (2)..(2): Xaa can be Glu, Arg, Ser, Phe, Gln, Lys, Cys, His, Thr, Asn, Ala, Leu, Met, Pro, Trp, Asp, Gly, Ile, Val, or Tyr
  misc_feature (11)..(11): Xaa can be Met, Leu, Ile, or Phe
LXDEALAIAAX

SEQ ID NO: 161890 - protein, 8 aa, Artificial Sequence
  Description of Artificial Sequence: Synthetic peptide
  Seed: LKIFAMPM (PRAME_HUMAN)
  misc_feature (2)..(2): Xaa can be Gln, Lys, Met, His, Glu, Ser, Ala, Arg, Thr, Leu, Asn, Gly, Ile, Val, or Tyr
  misc_feature (8)..(8): Xaa can be Phe, Tyr, Met, Leu, Trp, Ile, Val, Ala, or His
LXIFAMPX

SEQ ID NO: 161891 - protein, 9 aa, Artificial Sequence
  Description of Artificial Sequence: Synthetic peptide
  Seed: LKMVQLDSI (PRAME_HUMAN)
  misc_feature (2)..(2): Xaa can be Gln, Met, Lys, His, Arg, Leu, Ile, Glu, Ser, Thr, Val, Ala, Asn, Tyr, Phe, or Gly
  misc_feature (9)..(9): Xaa can be Tyr, Phe, Met, Leu, Ile, Trp, Val, His, or Ala
LXMVQLDSX

SEQ ID NO: 161892 - protein, 8 aa, Artificial Sequence
  Description of Artificial Sequence: Synthetic peptide
  Seed: LLALLPSL (PRAME_HUMAN)
  misc_feature (2)..(2): Xaa can be Gln, Gly, Ser, Leu, Met, Glu, Ala, Tyr, Asn, His, Thr, Phe, Ile, Pro, Val, Trp, Lys, or As p
  misc_feature (8)..(8): Xaa can be Val, Ile, Leu, Met, Ala, Cys, or Phe
LXALLPSX

SEQ ID NO: 161893 - protein, 9 aa, Artificial Sequence
  Description of Artificial Sequence: Synthetic peptide
  Seed: LLALLPSLS (PRAME_HUMAN)
  misc_feature (2)..(2): Xaa can be Met, Leu, Gln, Val, Ile, Thr, Ala, Phe, or Ser
  misc_feature (9)..(9): Xaa can be Val, Leu, Ile, Ala, Met, Cys, Gly, Phe, Thr, Ser, or Pro
LXALLPSLX

SEQ ID NO: 161894 - protein, 9 aa, Artificial Sequence
  Description of Artificial Sequence: Synthetic peptide
  Seed: LLAQEVRPR (PRAME_HUMAN)
  misc_feature (2)..(2): Xaa can be Met, Leu, Thr, Val, Gly, Ser, Gln, Asp, Tyr, Phe, Ala, Ile, Pro, Asn, Glu, Trp, or His
  misc_feature (9)..(9): Xaa can be Arg, Lys, Tyr, Leu, Val, or His
LXAQEVRPX

SEQ ID NO: 161895 - protein, 10 aa, Artificial Sequence
  Description of Artificial Sequence: Synthetic peptide
  Seed: LLAQEVRPRR (PRAME_HUMAN)
  misc_feature (2)..(2): Xaa can be Met, Leu, Phe, Ile, Thr, Val, Tyr, Ser, Trp, Gln, or Ala
  misc_feature (10)..(10): Xaa can be Arg, Lys, or Tyr
LXAQEVRPRX

SEQ ID NO: 161896 - protein, 11 aa, Artificial Sequence
  Description of Artificial Sequence: Synthetic peptide
  Seed: LLAQEVRPRRW (PRAME_HUMAN)
  misc_feature (2)..(2): Xaa can be Ser, Thr, Val, Met, Ala, Pro, Glu, Gln, Leu, Phe, Ile, Cys, Gly, Asp, or Asn
  misc_feature (11)..(11): Xaa can be Trp, Phe, Met, Leu, Tyr, or Ile
LXAQEVRPRRX

SEQ ID NO: 161897 - protein, 10 aa, Artificial Sequence
  Description of Artificial Sequence: Synthetic peptide
  Seed: LLCELGRPSM (PRAME_HUMAN)
  misc_feature (2)..(2): Xaa can be Arg, Met, Gln, Leu, Val, Thr, Ile, Ser, Gly, Ala, Asn, Phe, Glu, Pro, Trp, Tyr, Asp, Cys, Lys, or His
  misc_feature (10)..(10): Xaa can be Tyr, Leu, Phe, Ile, Met, Val, Trp, Ala, Lys, or Arg
LXCELGRPSX

SEQ ID NO: 161898 - protein, 11 aa, Artificial Sequence
  Description of Artificial Sequence: Synthetic peptide
  Seed: LLCELGRPSMV (PRAME_HUMAN)
  misc_feature (2)..(2): Xaa can be Leu, or Met
  misc_feature (11)..(11): Xaa can be Val, Met, Leu, or Ile
LXCELGRPSMX

SEQ ID NO: 161899 - protein, 9 aa, Artificial Sequence
  Description of Artificial Sequence: Synthetic peptide
  Seed: LLERASATL (PRAME_HUMAN)
  misc_feature (2)..(2): Xaa can be Arg, Met, Leu, Ile, Val, Gln, Tyr, Thr, Ser, Trp, Phe, Ala, Gly, Pro, His, Asn, Cys, Glu, or Lys
  misc_feature (9)..(9): Xaa can be Tyr, Leu, Met, Phe, Ile, Val, Trp, Ala, Arg, or Lys
LXERASATX

SEQ ID NO: 161900 - protein, 9 aa, Artificial Sequence
  Description of Artificial Sequence: Synthetic peptide
  Seed: LLKDEALAI (PRAME_HUMAN)
  misc_feature (2)..(2): Xaa can be Ala, Ser, Val, Gln, Arg, Thr, Ile, Leu, Gly, Met, Pro, Phe, Glu, Asn, Asp, Cys, Lys, His, Tyr, or Trp
  misc_feature (9)..(9): Xaa can be Tyr, Met, Leu, Ile, Phe, Val, His, Trp, Lys, Ala, Arg, Cys, Thr, Gln, Ser, Asn, Glu, Pro, or Gly
LXKDEALAX

SEQ ID NO: 161901 - protein, 10 aa, Artificial Sequence
  Description of Artificial Sequence: Synthetic peptide
  Seed: LLKDEALAIA (PRAME_HUMAN)
  misc_feature (2)..(2): Xaa can be Met, Leu, Val, Ile, Thr, Gln, or Ala
  misc_feature (10)..(10): Xaa can be Val, Ile, Leu, Ala, Met, Thr, or Ser
LXKDEALAIX

SEQ ID NO: 161902 - protein, 11 aa, Artificial Sequence
  Description of Artificial Sequence: Synthetic peptide
  Seed: LLKDEALAIAA (PRAME_HUMAN)
  misc_feature (2)..(2): Xaa can be Leu, or Met
  misc_feature (11)..(11): Xaa can be Leu, Met, Ile, Ala, or Val
LXKDEALAIAX

SEQ ID NO: 161903 - protein, 8 aa, Artificial Sequence
  Description of Artificial Sequence: Synthetic peptide
  Seed: LLLSHIHA (PRAME_HUMAN)
  misc_feature (2)..(2): Xaa can be Leu, or Met
  misc_feature (8)..(8): Xaa can be Val, Ile, Leu, or Ala
LXLSHIHX

SEQ ID NO: 161904 - protein, 9 aa, Artificial Sequence
  Description of Artificial Sequence: Synthetic peptide
  Seed: LLLSHIHAS (PRAME_HUMAN)
  misc_feature (2)..(2): Xaa can be Leu, Met, Ile, Gln, Val, Ser, Thr, Ala, Gly, Asn, Glu, Cys, Phe, Trp, Asp, Tyr, Lys, or Ar g
  misc_feature (9)..(9): Xaa can be Val, Ile, Leu, Met, Ala, Thr, Phe, Cys, Ser, Lys, Pro, Gly, Arg, Tyr, or Gln
LXLSHIHAX

SEQ ID NO: 161905 - protein, 10 aa, Artificial Sequence
  Description of Artificial Sequence: Synthetic peptide
  Seed: LLLSHIHASS (PRAME_HUMAN)
  misc_feature (2)..(2): Xaa can be Met, Leu, His, Ala, Arg, Trp, Ser, Asp, Cys, Pro, Gln, Glu, Thr, Lys, Phe, Gly, Val, Tyr, Ile, or Asn
  misc_feature (10)..(10): Xaa can be Met, Ala, Thr, Leu, Val, Ile, Ser, or Cys
LXLSHIHASX

SEQ ID NO: 161906 - protein, 11 aa, Artificial Sequence
  Description of Artificial Sequence: Synthetic peptide
  Seed: LLLSHIHASSY (PRAME_HUMAN)
  misc_feature (2)..(2): Xaa can be Ser, Gln, Thr, Met, Leu, His, Lys, Ala, Phe, Arg, Cys, Pro, Val, Ile, Glu, Asp, Tyr, Gly, Asn, or Trp
  misc_feature (11)..(11): Xaa can be Trp, Tyr, Phe, Met, Leu, or Ile
LXLSHIHASSX

SEQ ID NO: 161907 - protein, 10 aa, Artificial Sequence
  Description of Artificial Sequence: Synthetic peptide
  Seed: LLPRELFPPL (PRAME_HUMAN)
  misc_feature (2)..(2): Xaa can be Met, Arg, Leu, Thr, Ala, His, Glu, Trp, Gly, Asn, Ser, Tyr, Pro, Ile, Phe, Cys, Lys, Val, Asp, or Gln
  misc_feature (10)..(10): Xaa can be Ala, Ile, Met, Val, Leu, Phe, Tyr, Cys, or Thr
LXPRELFPPX

SEQ ID NO: 161908 - protein, 11 aa, Artificial Sequence
  Description of Artificial Sequence: Synthetic peptide
  Seed: LLPRELFPPLF (PRAME_HUMAN)
  misc_feature (2)..(2): Xaa can be Tyr, Met, Arg, Phe, Trp, His, Ser, Ala, Thr, Val, Leu, Pro, Lys, Gln, Asn, Ile, or Cys
  misc_feature (11)..(11): Xaa can be Leu, Phe, Met, Ile, Val, Trp, Ala, or Tyr
LXPRELFPPLX

SEQ ID NO: 161909 - protein, 11 aa, Artificial Sequence
  Description of Artificial Sequence: Synthetic peptide
  Seed: LLPSLSHCSQL (PRAME_HUMAN)
  misc_feature (2)..(2): Xaa can be Leu, Met, Ala, Ser, Val, Ile, or Gly
  misc_feature (11)..(11): Xaa can be Leu, Ile, Val, or Met
LXPSLSHCSQX

SEQ ID NO: 161910 - protein, 11 aa, Artificial Sequence
  Description of Artificial Sequence: Synthetic peptide
  Seed: LLQHLIGLSNL (PRAME_HUMAN)
  misc_feature (2)..(2): Xaa can be Leu, or Met
  misc_feature (11)..(11): Xaa can be Ile, Leu, or Val
LXQHLIGLSNX

SEQ ID NO: 161911 - protein, 9 aa, Artificial Sequence
  Description of Artificial Sequence: Synthetic peptide
  Seed: LLRHVMNPL (PRAME_HUMAN)
  misc_feature (2)..(2): Xaa can be Pro, Met, Leu, Gln, Ala, Ile, Val, Thr, Ser, Gly, Lys, Phe, His, Tyr, Glu, Asn, Arg, Asp, Trp, or Cys
  misc_feature (9)..(9): Xaa can be Tyr, Phe, Met, Leu, Arg, Lys, Ile, Val, His, Ala, Trp, Cys, Thr, Ser, Pro, Gly, Gln, or Gl u
LXRHVMNPX

SEQ ID NO: 161912 - protein, 9 aa, Artificial Sequence
  Description of Artificial Sequence: Synthetic peptide
  Seed: LLSHIHASS (PRAME_HUMAN)
  misc_feature (2)..(2): Xaa can be Leu, Met, Val, Ile, Gln, Thr, Ala, Ser, or Phe
  misc_feature (9)..(9): Xaa can be Val, Ile, Leu, Ala, Met, Phe, Gly, Pro, Cys, Thr, or Ser
LXSHIHASX

SEQ ID NO: 161913 - protein, 10 aa, Artificial Sequence
  Description of Artificial Sequence: Synthetic peptide
  Seed: LLSHIHASSY (PRAME_HUMAN)
  misc_feature (2)..(2): Xaa can be Gln, Met, Ser, Ala, Thr, Val, Ile, His, Cys, Asn, Glu, Phe, Tyr, Trp, Lys, Asp, Pro, Arg, Leu, or Gly
  misc_feature (10)..(10): Xaa can be Trp, Phe, Tyr, Met, Leu, Ile, Lys, His, or Val
LXSHIHASSX

SEQ ID NO: 161914 - protein, 11 aa, Artificial Sequence
  Description of Artificial Sequence: Synthetic peptide
  Seed: LLSHIHASSYI (PRAME_HUMAN)
  misc_feature (2)..(2): Xaa can be Met, Leu, Ile, Val, Gln, or Thr
  misc_feature (11)..(11): Xaa can be Val, Leu, Ile, Ala, or Met
LXSHIHASSYX

SEQ ID NO: 161915 - protein, 9 aa, Artificial Sequence
  Description of Artificial Sequence: Synthetic peptide
  Seed: LMKGQHLHL (PRAME_HUMAN)
  misc_feature (2)..(2): Xaa can be Thr, Ser, Pro, Gln, Tyr, Ala, Met, Val, Arg, Ile, Gly, Leu, Asn, Phe, Glu, Trp, Asp, His, Cys, or Lys
  misc_feature (9)..(9): Xaa can be Met, Phe, Tyr, Leu, Trp, Val, Ile, Lys, Arg, Ala, His, Cys, Ser, Pro, or Thr
LXKGQHLHX

SEQ ID NO: 161916 - protein, 9 aa, Artificial Sequence
  Description of Artificial Sequence: Synthetic peptide
  Seed: LPLGVLMKG (PRAME_HUMAN)
  misc_feature (2)..(2): Xaa can be Pro, or Ala
  misc_feature (9)..(9): Xaa can be Leu, Ala, Pro, Ile, Thr, Trp, Lys, Ser, Val, Tyr, Gly, Gln, Phe, Cys, Glu, Met, or Arg
LXLGVLMKX

SEQ ID NO: 161917 - protein, 8 aa, Artificial Sequence
  Description of Artificial Sequence: Synthetic peptide
  Seed: LPRELFPP (PRAME_HUMAN)
  misc_feature (2)..(2): Xaa can be , or Pro
  misc_feature (8)..(8): Xaa can be Ser, Leu, Val, Ala, Phe, Ile, Met, Thr, Pro, or Cys
LXRELFPX

SEQ ID NO: 161918 - protein, 9 aa, Artificial Sequence
  Description of Artificial Sequence: Synthetic peptide
  Seed: LPRELFPPL (PRAME_HUMAN)
  misc_feature (2)..(2): Xaa can be Pro, Ala, His, Arg, Val, Gln, Ser, Thr, Ile, Met, Gly, Asp, Glu, Leu, Asn, Tyr, Lys, Cys, Trp, or Phe
  misc_feature (9)..(9): Xaa can be Phe, Tyr, Leu, Met, Ile, Val, Ala, Trp, Cys, His, Thr, Pro, Gly, Ser, Arg, Lys, Glu, Asn, Asp, or Gln
LXRELFPPX

SEQ ID NO: 161919 - protein, 10 aa, Artificial Sequence
  Description of Artificial Sequence: Synthetic peptide
  Seed: LPRELFPPLF (PRAME_HUMAN)
  misc_feature (2)..(2): Xaa can be Pro, or Ala
  misc_feature (10)..(10): Xaa can be Leu, Tyr, Val, Trp, Asp, Cys, Met, Lys, Asn, Gln, Phe, Thr, Pro, His, Ala, Ser, Arg, Glu, Ile, or Gly
LXRELFPPLX

SEQ ID NO: 161920 - protein, 11 aa, Artificial Sequence
  Description of Artificial Sequence: Synthetic peptide
  Seed: LPRELFPPLFM (PRAME_HUMAN)
  misc_feature (2)..(2): Xaa can be , or Pro
  misc_feature (11)..(11): Xaa can be Leu, Thr, Tyr, Ile, Ala, Phe, Met, Val, Ser, or Cys
LXRELFPPLFX

SEQ ID NO: 161921 - protein, 10 aa, Artificial Sequence
  Description of Artificial Sequence: Synthetic peptide
  Seed: LPSLSHCSQL (PRAME_HUMAN)
  misc_feature (2)..(2): Xaa can be , or Pro
  misc_feature (10)..(10): Xaa can be Val, Ile, Phe, Tyr, Met, Leu, or Ala
LXSLSHCSQX

SEQ ID NO: 161922 - protein, 9 aa, Artificial Sequence
  Description of Artificial Sequence: Synthetic peptide
  Seed: LPTLAKFSP (PRAME_HUMAN)
  misc_feature (2)..(2): Xaa can be Pro, or Ala
  misc_feature (9)..(9): Xaa can be Leu, Ala, Tyr, Pro, Phe, Gly, Ser, Val, Thr, Cys, Ile, or Met
LXTLAKFSX

SEQ ID NO: 161923 - protein, 10 aa, Artificial Sequence
  Description of Artificial Sequence: Synthetic peptide
  Seed: LPTLAKFSPY (PRAME_HUMAN)
  misc_feature (2)..(2): Xaa can be Pro, Gln, Met, Ser, Thr, Arg, Gly, Ala, Asn, Lys, Trp, Phe, Val, Leu, Glu, Tyr, Ile, Cys, Asp, or His
  misc_feature (10)..(10): Xaa can be Leu, Met, Phe, Trp, Tyr, Ile, Val, His, Ala, Pro, Gly, Ser, Thr, or Cys
LXTLAKFSPX

SEQ ID NO: 161924 - protein, 11 aa, Artificial Sequence
  Description of Artificial Sequence: Synthetic peptide
  Seed: LPTLAKFSPYL (PRAME_HUMAN)
  misc_feature (2)..(2): Xaa can be Pro, Thr, Val, Cys, Gln, Ile, Met, Asp, Ala, Lys, Asn, His, Phe, Leu, Ser, Trp, Glu, Gly, Tyr, or Arg
  misc_feature (11)..(11): Xaa can be Ile, Leu, Val, Ala, or Met
LXTLAKFSPYX

SEQ ID NO: 161925 - protein, 9 aa, Artificial Sequence
  Description of Artificial Sequence: Synthetic peptide
  Seed: LQALYVDSL (PRAME_HUMAN)
  misc_feature (2)..(2): Xaa can be Met, His, Leu, Glu, Gln, Val, Arg, Ile, Ala, Lys, Ser, Thr, Pro, Asp, Gly, Asn, Tyr, Phe, Trp, or Cys
  misc_feature (9)..(9): Xaa can be Tyr, Leu, Phe, Val, Met, Ile, Ala, Trp, Thr, Cys, Ser, Pro, His, or Gly
LXALYVDSX

SEQ ID NO: 161926 - protein, 10 aa, Artificial Sequence
  Description of Artificial Sequence: Synthetic peptide
  Seed: LQALYVDSLF (PRAME_HUMAN)
  misc_feature (2)..(2): Xaa can be Gln, Thr, Ser, Ala, Met, Lys, Phe, Glu, Ile, Trp, Tyr, Asn, Cys, Arg, Val, Leu, Pro, Gly, His, or Asp
  misc_feature (10)..(10): Xaa can be Tyr, Met, Phe, Trp, Leu, Ile, or His
LXALYVDSLX

SEQ ID NO: 161927 - protein, 11 aa, Artificial Sequence
  Description of Artificial Sequence: Synthetic peptide
  Seed: LQALYVDSLFF (PRAME_HUMAN)
  misc_feature (2)..(2): Xaa can be Gln, Met, Lys, Ser, Glu, Ala, His, Ile, Thr, Leu, Arg, Val, Asn, Tyr, Cys, Pro, Asp, Trp, Phe, or Gly
  misc_feature (11)..(11): Xaa can be Tyr, Phe, Met, or Leu
LXALYVDSLFX

SEQ ID NO: 161928 - protein, 8 aa, Artificial Sequence
  Description of Artificial Sequence: Synthetic peptide
  Seed: LQCLQALY (PRAME_HUMAN)
  misc_feature (2)..(2): Xaa can be Gln, Met, or Ala
  misc_feature (8)..(8): Xaa can be Tyr, Phe, or Met
LXCLQALX

SEQ ID NO: 161929 - protein, 9 aa, Artificial Sequence
  Description of Artificial Sequence: Synthetic peptide
  Seed: LQCLQALYV (PRAME_HUMAN)
  misc_feature (2)..(2): Xaa can be Gln, Met, Leu, Thr, Ala, Ser, Glu, Asn, Ile, Val, Gly, or Cys
  misc_feature (9)..(9): Xaa can be Leu, Ile, Val, Met, Phe, Ala, Trp, or Tyr
LXCLQALYX

SEQ ID NO: 161930 - protein, 9 aa, Artificial Sequence
  Description of Artificial Sequence: Synthetic peptide
  Seed: LQDLVFDEC (PRAME_HUMAN)
  misc_feature (2)..(2): Xaa can be Glu, Ala, Ser, Ile, Val, Thr, Leu, Gly, Phe, Met, Gln, Tyr, Asn, Trp, Cys, Asp, His, Pro, Lys, or Arg
  misc_feature (9)..(9): Xaa can be Leu, Met, Ile, Phe, Val, Tyr, Ala, Cys, Trp, Thr, Ser, Lys, Gly, or Pro
LXDLVFDEX

SEQ ID NO: 161931 - protein, 9 aa, Artificial Sequence
  Description of Artificial Sequence: Synthetic peptide
  Seed: LQHLIGLSN (PRAME_HUMAN)
  misc_feature (2)..(2): Xaa can be Gln, Met, Lys, His, Ala, Arg, Ser, Glu, Asn, Thr, Leu, Val, Phe, Ile, Gly, Tyr, Cys, Pro, or Trp
  misc_feature (9)..(9): Xaa can be Phe, Tyr, Met, Leu, Ile, His, Trp, Val, Ala, Gly, Cys, Thr, Ser, or Asn
LXHLIGLSX

SEQ ID NO: 161932 - protein, 10 aa, Artificial Sequence
  Description of Artificial Sequence: Synthetic peptide
  Seed: LQHLIGLSNL (PRAME_HUMAN)
  misc_feature (2)..(2): Xaa can be Arg, Gln, Ile, Leu, Met, Gly, Val, Thr, Ala, Ser, Lys, His, Asn, Pro, Glu, Phe, Tyr, Cys, Asp, or Trp
  misc_feature (10)..(10): Xaa can be Tyr, Phe, Leu, Met, Val, Ile, Trp, Arg, His, or Lys
LXHLIGLSNX

SEQ ID NO: 161933 - protein, 8 aa, Artificial Sequence
  Description of Artificial Sequence: Synthetic peptide
  Seed: LQSLLQHL (PRAME_HUMAN)
  misc_feature (2)..(2): Xaa can be Glu, Gln, Asp, Ala, Pro, Ser, Gly, Met, Asn, His, or Arg
  misc_feature (8)..(8): Xaa can be Ile, Leu, Val, Met, Phe, Trp, or Tyr
LXSLLQHX

SEQ ID NO: 161934 - protein, 9 aa, Artificial Sequence
  Description of Artificial Sequence: Synthetic peptide
  Seed: LQSLLQHLI (PRAME_HUMAN)
  misc_feature (2)..(2): Xaa can be Glu, Leu, Met, Gln, His, Arg, Thr, Ala, Val, Ile, Asn, Asp, Ser, Gly, Pro, Lys, Phe, Tyr, Cys, or Trp
  misc_feature (9)..(9): Xaa can be Tyr, Leu, Phe, Met, Val, Ile, Trp, Ala, Cys, Thr, Pro, Ser, Lys, Arg, His, or Gly
LXSLLQHLX

SEQ ID NO: 161935 - protein, 11 aa, Artificial Sequence
  Description of Artificial Sequence: Synthetic peptide
  Seed: LQSLLQHLIGL (PRAME_HUMAN)
  misc_feature (2)..(2): Xaa can be Tyr, His, Trp, Val, Asn, Ser, Ala, Thr, Asp, Phe, Lys, Gly, Gln, Ile, Met, Cys, Pro, Glu, Arg, or Leu
  misc_feature (11)..(11): Xaa can be Val, Ala, Leu, or Ile
LXSLLQHLIGX

SEQ ID NO: 161936 - protein, 8 aa, Artificial Sequence
  Description of Artificial Sequence: Synthetic peptide
  Seed: LRELLCEL (PRAME_HUMAN)
  misc_feature (2)..(2): Xaa can be Ala, Arg, Tyr, Gln, His, or Phe
  misc_feature (8)..(8): Xaa can be , or Leu
LXELLCEX

SEQ ID NO: 161937 - protein, 10 aa, Artificial Sequence
  Description of Artificial Sequence: Synthetic peptide
  Seed: LRELLCELGR (PRAME_HUMAN)
  misc_feature (2)..(2): Xaa can be , or Arg
  misc_feature (10)..(10): Xaa can be Leu, Arg, Ile, Lys, Tyr, Phe, or Met
LXELLCELGX

SEQ ID NO: 161938 - protein, 8 aa, Artificial Sequence
  Description of Artificial Sequence: Synthetic peptide
  Seed: LRGRLDQL (PRAME_HUMAN)
  misc_feature (2)..(2): Xaa can be Arg, or Tyr
  misc_feature (8)..(8): Xaa can be , or Leu
LXGRLDQX

SEQ ID NO: 161939 - protein, 9 aa, Artificial Sequence
  Description of Artificial Sequence: Synthetic peptide
  Seed: LRGRLDQLL (PRAME_HUMAN)
  misc_feature (2)..(2): Xaa can be Arg, His, Gln, Tyr, Phe, Gly, Thr, Met, Ala, Ile, Ser, Leu, Asn, Trp, or Val
  misc_feature (9)..(9): Xaa can be Leu, Phe, Met, Ile, Tyr, Val, Lys, Trp, or Arg
LXGRLDQLX

SEQ ID NO: 161940 - protein, 10 aa, Artificial Sequence
  Description of Artificial Sequence: Synthetic peptide
  Seed: LRGRLDQLLR (PRAME_HUMAN)
  misc_feature (2)..(2): Xaa can be Arg, Gly, Met, Gln, Leu, Thr, Cys, Ala, Pro, Asn, Val, Ile, Phe, or Ser
  misc_feature (10)..(10): Xaa can be Leu, Phe, Ile, Lys, Trp, Val, Tyr, Met, or Arg
LXGRLDQLLX

SEQ ID NO: 161941 - protein, 11 aa, Artificial Sequence
  Description of Artificial Sequence: Synthetic peptide
  Seed: LRGRLDQLLRH (PRAME_HUMAN)
  misc_feature (2)..(2): Xaa can be , or Arg
  misc_feature (11)..(11): Xaa can be Tyr, Phe, Val, Trp, Leu, Met, Ile, Lys, His, or Arg
LXGRLDQLLRX

SEQ ID NO: 161942 - protein, 8 aa, Artificial Sequence
  Description of Artificial Sequence: Synthetic peptide
  Seed: LRHVMNPL (PRAME_HUMAN)
  misc_feature (2)..(2): Xaa can be Arg, Tyr, His, or Gln
  misc_feature (8)..(8): Xaa can be Leu, Tyr, Phe, Met, or Ile
LXHVMNPX

SEQ ID NO: 161943 - protein, 11 aa, Artificial Sequence
  Description of Artificial Sequence: Synthetic peptide
  Seed: LRHVMNPLETL (PRAME_HUMAN)
  misc_feature (2)..(2): Xaa can be Arg, or Tyr
  misc_feature (11)..(11): Xaa can be Phe, Arg, Ile, Trp, Val, Met, Lys, Leu, or Tyr
LXHVMNPLETX

SEQ ID NO: 161944 - protein, 9 aa, Artificial Sequence
  Description of Artificial Sequence: Synthetic peptide
  Seed: LRKNSHQDF (PRAME_HUMAN)
  misc_feature (2)..(2): Xaa can be Arg, Gln, Met, Tyr, Phe, Lys, Leu, Ala, His, Ser, Val, Ile, Glu, Asn, Gly, Thr, or Trp
  misc_feature (9)..(9): Xaa can be Phe, Tyr, Met, Leu, Ile, Trp, Val, Arg, His, or Lys
LXKNSHQDX

SEQ ID NO: 161945 - protein, 10 aa, Artificial Sequence
  Description of Artificial Sequence: Synthetic peptide
  Seed: LRKNSHQDFW (PRAME_HUMAN)
  misc_feature (2)..(2): Xaa can be , or Arg
  misc_feature (10)..(10): Xaa can be Phe, Trp, or Tyr
LXKNSHQDFX

SEQ ID NO: 161946 - protein, 8 aa, Artificial Sequence
  Description of Artificial Sequence: Synthetic peptide
  Seed: LRLCCKKL (PRAME_HUMAN)
  misc_feature (2)..(2): Xaa can be Arg, or His
  misc_feature (8)..(8): Xaa can be , or Leu
LXLCCKKX

SEQ ID NO: 161947 - protein, 9 aa, Artificial Sequence
  Description of Artificial Sequence: Synthetic peptide
  Seed: LRLCCKKLK (PRAME_HUMAN)
  misc_feature (2)..(2): Xaa can be Arg, Gln, Ala, Gly, Met, Val, Thr, Ser, Leu, Asn, Cys, Ile, Asp, Glu, Lys, Trp, or Phe
  misc_feature (9)..(9): Xaa can be Leu, Ile, Phe, Lys, His, Tyr, Arg, Met, or Val
LXLCCKKLX

SEQ ID NO: 161948 - protein, 10 aa, Artificial Sequence
  Description of Artificial Sequence: Synthetic peptide
  Seed: LRLCCKKLKI (PRAME_HUMAN)
  misc_feature (2)..(2): Xaa can be Arg, Gly, Gln, Asn, Ala, Ser, Thr, Leu, Asp, Cys, Met, Glu, Lys, Ile, or Val
  misc_feature (10)..(10): Xaa can be Leu, Ile, Met, Phe, Val, Lys, Trp, Tyr, or Arg
LXLCCKKLKX

SEQ ID NO: 161949 - protein, 9 aa, Artificial Sequence
  Description of Artificial Sequence: Synthetic peptide
  Seed: LRRLLLSHI (PRAME_HUMAN)
  misc_feature (2)..(2): Xaa can be Arg, His, Tyr, Gln, Gly, Asn, Thr, Cys, Ala, Ser, Asp, or Glu
  misc_feature (9)..(9): Xaa can be Leu, Ile, Phe, Met, Tyr, Arg, Val, Lys, or Trp
LXRLLLSHX

SEQ ID NO: 161950 - protein, 10 aa, Artificial Sequence
  Description of Artificial Sequence: Synthetic peptide
  Seed: LRRLLLSHIH (PRAME_HUMAN)
  misc_feature (2)..(2): Xaa can be Arg, Val, Thr, Asn, Glu, Lys, Pro, Phe, Tyr, Ala, Gln, Met, Ser, Ile, Trp, His, Asp, Leu, Gly, or Cys
  misc_feature (10)..(10): Xaa can be Phe, Tyr, Leu, Ile, Met, Val, Arg, Lys, His, or Trp
LXRLLLSHIX

SEQ ID NO: 161951 - protein, 9 aa, Artificial Sequence
  Description of Artificial Sequence: Synthetic peptide
  Seed: LSANPCPHC (PRAME_HUMAN)
  misc_feature (2)..(2): Xaa can be Ser, Ala, Thr, Val, Gly, Cys, Met, Ile, Asn, Phe, Asp, Pro, Leu, Gln, Glu, Lys, Tyr, or Tr p
  misc_feature (9)..(9): Xaa can be Trp, Phe, Leu, Met, Tyr, Ile, Val, or Cys
LXANPCPHX

SEQ ID NO: 161952 - protein, 9 aa, Artificial Sequence
  Description of Artificial Sequence: Synthetic peptide
  Seed: LSEGDVMHL (PRAME_HUMAN)
  misc_feature (2)..(2): Xaa can be Leu, Met, Ala, Thr, Ser, Ile, Phe, Tyr, Val, Gly, Gln, Asn, Pro, Trp, Cys, Glu, Asp, Arg, His, or Lys
  misc_feature (9)..(9): Xaa can be Met, Leu, Trp, Phe, Tyr, Lys, Ile, Val, Arg, His, Cys, Ala, Gln, or Thr
LXEGDVMHX

SEQ ID NO: 161953 - protein, 8 aa, Artificial Sequence
  Description of Artificial Sequence: Synthetic peptide
  Seed: LSFYGNSI (PRAME_HUMAN)
  misc_feature (2)..(2): Xaa can be Ser, Ala, Val, Ile, Met, Thr, Gln, Gly, Leu, Asn, Glu, Pro, Asp, Phe, His, or Cys
  misc_feature (8)..(8): Xaa can be Ile, Leu, Tyr, Phe, Val, Met, Trp, or His
LXFYGNSX

SEQ ID NO: 161954 - protein, 10 aa, Artificial Sequence
  Description of Artificial Sequence: Synthetic peptide
  Seed: LSFYGNSISI (PRAME_HUMAN)
  misc_feature (2)..(2): Xaa can be Thr, Met, Leu, Tyr, Ala, Ser, Ile, Gln, Gly, Val, Cys, Asp, Phe, Asn, Pro, Arg, Glu, Lys, Trp, or His
  misc_feature (10)..(10): Xaa can be Phe, Val, Leu, Met, Ile, Trp, Tyr, Ala, Thr, Lys, His, or Cys
LXFYGNSISX

SEQ ID NO: 161955 - protein, 9 aa, Artificial Sequence
  Description of Artificial Sequence: Synthetic peptide
  Seed: LSGVMLTDV (PRAME_HUMAN)
  misc_feature (2)..(2): Xaa can be Ser, Thr, or Ala
  misc_feature (9)..(9): Xaa can be Ile, Val, Met, or Leu
LXGVMLTDX

SEQ ID NO: 161956 - protein, 10 aa, Artificial Sequence
  Description of Artificial Sequence: Synthetic peptide
  Seed: LSHCSQLTTL (PRAME_HUMAN)
  misc_feature (2)..(2): Xaa can be Ala, Ser, Thr, Arg, Ile, Gly, Leu, Met, Val, Gln, Cys, Asn, Glu, Trp, Pro, Phe, Asp, Tyr, or Lys
  misc_feature (10)..(10): Xaa can be Trp, Leu, Tyr, Phe, Ile, Met, Val, Arg, Lys, or His
LXHCSQLTTX

SEQ ID NO: 161957 - protein, 9 aa, Artificial Sequence
  Description of Artificial Sequence: Synthetic peptide
  Seed: LSHIHASSY (PRAME_HUMAN)
  misc_feature (2)..(2): Xaa can be Gln, Ala, Tyr, Ser, Thr, Arg, Pro, Met, Val, Ile, Gly, Phe, Leu, Asn, Trp, Lys, His, Cys, Glu, or Asp
  misc_feature (9)..(9): Xaa can be Met, Tyr, Trp, Phe, Leu, Ile, Val, His, Lys, Ala, Arg, Cys, Ser, Thr, Gln, Pro, Gly, or As n
LXHIHASSX

SEQ ID NO: 161958 - protein, 10 aa, Artificial Sequence
  Description of Artificial Sequence: Synthetic peptide
  Seed: LSHIHASSYI (PRAME_HUMAN)
  misc_feature (2)..(2): Xaa can be Thr, Val, Ala, Ser, Ile, Met, Gln, Cys, Phe, Gly, Pro, Leu, or Asn
  misc_feature (10)..(10): Xaa can be Trp, Phe, Tyr, Val, Ile, Leu, Met, or Ala
LXHIHASSYX

SEQ ID NO: 161959 - protein, 8 aa, Artificial Sequence
  Description of Artificial Sequence: Synthetic peptide
  Seed: LSITNCRL (PRAME_HUMAN)
  misc_feature (2)..(2): Xaa can be Ala, or Ser
  misc_feature (8)..(8): Xaa can be Leu, Tyr, Met, or Phe
LXITNCRX

SEQ ID NO: 161960 - protein, 9 aa, Artificial Sequence
  Description of Artificial Sequence: Synthetic peptide
  Seed: LSLQCLQAL (PRAME_HUMAN)
  misc_feature (2)..(2): Xaa can be Gln, Met, Val, Ser, Leu, Ile, Arg, Thr, Lys, Ala, Gly, Tyr, Glu, Asp, Cys, Asn, Phe, His, Pro, or Trp
  misc_feature (9)..(9): Xaa can be Met, Phe, Tyr, Leu, Trp, Val, Ile, His, Ala, Thr, Cys, Lys, Ser, Gly, or Arg
LXLQCLQAX

SEQ ID NO: 161961 - protein, 10 aa, Artificial Sequence
  Description of Artificial Sequence: Synthetic peptide
  Seed: LSLQCLQALY (PRAME_HUMAN)
  misc_feature (2)..(2): Xaa can be Ser, Gln, Thr, Ala, Met, Val, His, Lys, Leu, Tyr, Pro, Asn, Gly, Phe, Arg, Cys, Glu, Asp, Trp, or Ile
  misc_feature (10)..(10): Xaa can be Trp, Phe, Tyr, Met, Leu, Ile, Lys, His, or Val
LXLQCLQALX

SEQ ID NO: 161962 - protein, 11 aa, Artificial Sequence
  Description of Artificial Sequence: Synthetic peptide
  Seed: LSLQCLQALYV (PRAME_HUMAN)
  misc_feature (2)..(2): Xaa can be Leu, Met, Phe, Tyr, Lys, Ile, Arg, Val, Ala, Thr, Ser, or Gln
  misc_feature (11)..(11): Xaa can be Val, Leu, Ile, or Ala
LXLQCLQALYX

SEQ ID NO: 161963 - protein, 8 aa, Artificial Sequence
  Description of Artificial Sequence: Synthetic peptide
  Seed: LSLSGVML (PRAME_HUMAN)
  misc_feature (2)..(2): Xaa can be Ser, Ala, or Thr
  misc_feature (8)..(8): Xaa can be Leu, Phe, Tyr, or Met
LXLSGVMX

SEQ ID NO: 161964 - protein, 11 aa, Artificial Sequence
  Description of Artificial Sequence: Synthetic peptide
  Seed: LSLSGVMLTDV (PRAME_HUMAN)
  misc_feature (2)..(2): Xaa can be Leu, Met, Phe, Tyr, Ile, Trp, Ser, Gln, Lys, Ala, Val, Thr, Gly, His, or Arg
  misc_feature (11)..(11): Xaa can be Val, Leu, Ile, Ala, or Met
LXLSGVMLTDX

SEQ ID NO: 161965 - protein, 8 aa, Artificial Sequence
  Description of Artificial Sequence: Synthetic peptide
  Seed: LSNLTHVL (PRAME_HUMAN)
  misc_feature (2)..(2): Xaa can be Ala, Ser, Val, Gln, Gly, Thr, Met, Asn, Ile, Arg, Tyr, Leu, Phe, Glu, His, Trp, Cys, Asp, or Pro
  misc_feature (8)..(8): Xaa can be Leu, Met, Tyr, Ile, Trp, Phe, Val, or His
LXNLTHVX

SEQ ID NO: 161966 - protein, 9 aa, Artificial Sequence
  Description of Artificial Sequence: Synthetic peptide
  Seed: LSNLTHVLY (PRAME_HUMAN)
  misc_feature (2)..(2): Xaa can be Pro, Ala, Ser, Thr, Gln, Val, Arg, Ile, Met, Leu, Lys, Tyr, Gly, Asn, Cys, Phe, Trp, Glu, Asp, or His
  misc_feature (9)..(9): Xaa can be Tyr, Phe, Trp, Leu, Met, Ile, Val, Lys, His, Arg, Cys, Ala, Gly, Ser, Thr, or Gln
LXNLTHVLX

SEQ ID NO: 161967 - protein, 11 aa, Artificial Sequence
  Description of Artificial Sequence: Synthetic peptide
  Seed: LSNLTHVLYPV (PRAME_HUMAN)
  misc_feature (2)..(2): Xaa can be Leu, Met, Asn, Pro, Gly, Asp, Cys, Ile, Glu, Gln, Phe, Tyr, Ser, Lys, Val, Trp, His, Ala, Thr, or Arg
  misc_feature (11)..(11): Xaa can be Leu, Ile, Ala, Val, Met, or Thr
LXNLTHVLYPX

SEQ ID NO: 161968 - protein, 10 aa, Artificial Sequence
  Description of Artificial Sequence: Synthetic peptide
  Seed: LSQSPSVSQL (PRAME_HUMAN)
  misc_feature (2)..(2): Xaa can be Ala, Ile, Val, Ser, Gly, Thr, Leu, Gln, Tyr, Met, Phe, Cys, Glu, Pro, Asn, Arg, Trp, Asp, Lys, or His
  misc_feature (10)..(10): Xaa can be Phe, Leu, Met, Tyr, Val, Trp, Ile, His, Lys, Arg, or Ala
LXQSPSVSQX

SEQ ID NO: 161969 - protein, 9 aa, Artificial Sequence
  Description of Artificial Sequence: Synthetic peptide
  Seed: LSTEAEQPF (PRAME_HUMAN)
  misc_feature (2)..(2): Xaa can be Pro, Gln, Ala, Thr, Met, Ile, Ser, Val, Leu, Gly, Glu, Phe, Asn, Lys, Asp, Cys, Tyr, Arg, Trp, or His
  misc_feature (9)..(9): Xaa can be Phe, Tyr, Trp, Met, Leu, Lys, Arg, Ile, Val, His, Ala, Gly, Thr, Ser, Gln, or Cys
LXTEAEQPX

SEQ ID NO: 161970 - protein, 10 aa, Artificial Sequence
  Description of Artificial Sequence: Synthetic peptide
  Seed: LSTEAEQPFI (PRAME_HUMAN)
  misc_feature (2)..(2): Xaa can be Ser, Thr, Ala, Ile, Gly, Val, Cys, Met, Asn, Glu, Asp, Phe, Trp, Pro, Leu, or Gln
  misc_feature (10)..(10): Xaa can be Trp, Phe, Leu, Met, Ile, or Tyr
LXTEAEQPFX

SEQ ID NO: 161971 - protein, 9 aa, Artificial Sequence
  Description of Artificial Sequence: Synthetic peptide
  Seed: LSVLSLSGV (PRAME_HUMAN)
  misc_feature (2)..(2): Xaa can be Met, Leu, Val, Ile, Gln, Ala, Ser, Thr, Gly, Asn, Phe, or Cys
  misc_feature (9)..(9): Xaa can be Val, Trp, Ala, Ile, Phe, Met, Leu, Tyr, Thr, Cys, Pro, Ser, or Gly
LXVLSLSGX

SEQ ID NO: 161972 - protein, 10 aa, Artificial Sequence
  Description of Artificial Sequence: Synthetic peptide
  Seed: LSVLSLSGVM (PRAME_HUMAN)
  misc_feature (2)..(2): Xaa can be Gln, Met, Lys, Thr, Ser, Leu, Ala, His, Pro, Gly, Val, Ile, Arg, Asp, Cys, Glu, Asn, Phe, Tyr, or Trp
  misc_feature (10)..(10): Xaa can be Tyr, Phe, Met, Trp, Leu, Ile, His, or Val
LXVLSLSGVX

SEQ ID NO: 161973 - protein, 11 aa, Artificial Sequence
  Description of Artificial Sequence: Synthetic peptide
  Seed: LSVLSLSGVML (PRAME_HUMAN)
  misc_feature (2)..(2): Xaa can be Thr, Ser, Val, Gly, Cys, Ala, Asn, Met, Gln, Ile, or Leu
  misc_feature (11)..(11): Xaa can be Trp, Phe, Met, Tyr, Leu, or Ile
LXVLSLSGVMX

SEQ ID NO: 161974 - protein, 9 aa, Artificial Sequence
  Description of Artificial Sequence: Synthetic peptide
  Seed: LTDVSPEPL (PRAME_HUMAN)
  misc_feature (2)..(2): Xaa can be Tyr, Phe, Ala, Thr, Pro, Ser, Ile, Val, Leu, Met, Gly, Trp, Glu, Cys, Asn, Gln, Arg, Asp, His, or Lys
  misc_feature (9)..(9): Xaa can be Val, Met, Ile, Leu, Phe, Tyr, Trp, Arg, Lys, Ala, Cys, Thr, His, Ser, Pro, Gln, or Gly
LXDVSPEPX

SEQ ID NO: 161975 - protein, 10 aa, Artificial Sequence
  Description of Artificial Sequence: Synthetic peptide
  Seed: LTDVSPEPLQ (PRAME_HUMAN)
  misc_feature (2)..(2): Xaa can be Thr, Met, Ser, Leu, Ile, Val, Ala, Gly, Phe, Asn, Tyr, Gln, Glu, Asp, Trp, or Cys
  misc_feature (10)..(10): Xaa can be Tyr, Lys, Arg, His, Phe, Met, Trp, Gln, or Leu
LXDVSPEPLX

SEQ ID NO: 161976 - protein, 11 aa, Artificial Sequence
  Description of Artificial Sequence: Synthetic peptide
  Seed: LTDVSPEPLQA (PRAME_HUMAN)
  misc_feature (2)..(2): Xaa can be Ala, Val, Thr, Leu, Ser, Ile, Gly, Met, Asn, Trp, Tyr, Cys, Gln, Pro, Phe, Glu, Asp, or Hi s
  misc_feature (11)..(11): Xaa can be Leu, Met, Phe, Ile, Val, Cys, Trp, Tyr, Ala, Arg, Lys, or Thr
LXDVSPEPLQX

SEQ ID NO: 161977 - protein, 8 aa, Artificial Sequence
  Description of Artificial Sequence: Synthetic peptide
  Seed: LTHVLYPV (PRAME_HUMAN)
  misc_feature (2)..(2): Xaa can be Met, Leu, Trp, Ser, Ile, Asn, Tyr, Ala, Phe, Val, Gln, His, Asp, Gly, Glu, Cys, Thr, Pro, or Lys
  misc_feature (8)..(8): Xaa can be Val, Ile, Leu, Ala, Thr, or Met
LXHVLYPX

SEQ ID NO: 161978 - protein, 10 aa, Artificial Sequence
  Description of Artificial Sequence: Synthetic peptide
  Seed: LTHVLYPVPL (PRAME_HUMAN)
  misc_feature (2)..(2): Xaa can be Ser, Ala, Thr, His, Phe, Asp, Asn, Arg, Pro, Lys, Val, Gln, Glu, Met, Trp, Cys, Tyr, Gly, Ile, or Leu
  misc_feature (10)..(10): Xaa can be Leu, Met, Trp, Phe, Tyr, or Ile
LXHVLYPVPX

SEQ ID NO: 161979 - protein, 9 aa, Artificial Sequence
  Description of Artificial Sequence: Synthetic peptide
  Seed: LVELAGQSL (PRAME_HUMAN)
  misc_feature (2)..(2): Xaa can be Ala, Pro, Ser, Thr, Phe, Tyr, Leu, Val, Gln, Ile, Met, Asn, Arg, Gly, Trp, His, Cys, Asp, Glu, or Lys
  misc_feature (9)..(9): Xaa can be Tyr, Phe, Leu, Met, Ile, Val, Lys, Trp, Arg, Cys, Ala, His, Ser, Pro, or Thr
LXELAGQSX

SEQ ID NO: 161980 - protein, 10 aa, Artificial Sequence
  Description of Artificial Sequence: Synthetic peptide
  Seed: LVELAGQSLL (PRAME_HUMAN)
  misc_feature (2)..(2): Xaa can be Glu, Arg, Trp, Ser, His, Tyr, Pro, Val, Cys, Leu, Gly, Gln, Asp, Lys, Asn, Ile, Thr, Phe, Met, or Ala
  misc_feature (10)..(10): Xaa can be Met, Leu, Phe, or Ile
LXELAGQSLX

SEQ ID NO: 161981 - protein, 11 aa, Artificial Sequence
  Description of Artificial Sequence: Synthetic peptide
  Seed: LVELAGQSLLK (PRAME_HUMAN)
  misc_feature (2)..(2): Xaa can be Thr, Val, Ser, Ile, Leu, Met, Ala, Asn, Cys, Phe, Gln, Asp, Gly, Glu, Trp, Tyr, Lys, Pro, His, or Arg
  misc_feature (11)..(11): Xaa can be Lys, Tyr, Arg, His, Phe, Trp, or Met
LXELAGQSLLX

SEQ ID NO: 161982 - protein, 9 aa, Artificial Sequence
  Description of Artificial Sequence: Synthetic peptide
  Seed: LWGSIQSRY (PRAME_HUMAN)
  misc_feature (2)..(2): Xaa can be Met, Trp, Phe, Tyr, Ser, Leu, Val, Thr, His, Ile, Pro, Cys, Gln, Gly, Asp, Ala, Glu, Lys, or Asn
  misc_feature (9)..(9): Xaa can be Tyr, or Phe
LXGSIQSRX

SEQ ID NO: 161983 - protein, 9 aa, Artificial Sequence
  Description of Artificial Sequence: Synthetic peptide
  Seed: LYPVPLESY (PRAME_HUMAN)
  misc_feature (2)..(2): Xaa can be Ala, Tyr, Gln, Thr, Arg, Ser, Gly, Val, Phe, Ile, Trp, Asn, Leu, Pro, Met, His, Asp, Glu, Lys, or Cys
  misc_feature (9)..(9): Xaa can be Val, Leu, Ile, Met, Tyr, Phe, Trp, His, Lys, Arg, Cys, Ala, Thr, Ser, or Gln
LXPVPLESX

SEQ ID NO: 161984 - protein, 8 aa, Artificial Sequence
  Description of Artificial Sequence: Synthetic peptide
  Seed: LYVDSLFF (PRAME_HUMAN)
  misc_feature (2)..(2): Xaa can be Tyr, Phe, or Trp
  misc_feature (8)..(8): Xaa can be Phe, Met, Leu, Ile, Tyr, or Trp
LXVDSLFX

SEQ ID NO: 161985 - protein, 9 aa, Artificial Sequence
  Description of Artificial Sequence: Synthetic peptide
  Seed: LYVDSLFFL (PRAME_HUMAN)
  misc_feature (2)..(2): Xaa can be Met, Leu, Gln, Val, Ile, Arg, Thr, Ala, Tyr, Phe, Ser, His, Trp, Cys, Gly, Asn, Glu, Lys, Asp, or Pro
  misc_feature (9)..(9): Xaa can be Leu, Val, Ile, Met, Phe, Ala, Tyr, Cys, Thr, Trp, Ser, Gly, Arg, Lys, Pro, Gln, Glu, or Hi s
LXVDSLFFX

SEQ ID NO: 161986 - protein, 10 aa, Artificial Sequence
  Description of Artificial Sequence: Synthetic peptide
  Seed: LYVDSLFFLR (PRAME_HUMAN)
  misc_feature (2)..(2): Xaa can be Met, Leu, Thr, Ile, Tyr, Val, Phe, Ser, Ala, Trp, Lys, Gly, Asp, Gln, Cys, Asn, Arg, Glu, His, or Pro
  misc_feature (10)..(10): Xaa can be Arg, Lys, Tyr, His, Met, Val, Ile, Leu, or Phe
LXVDSLFFLX

SEQ ID NO: 161987 - protein, 11 aa, Artificial Sequence
  Description of Artificial Sequence: Synthetic peptide
  Seed: LYVDSLFFLRG (PRAME_HUMAN)
  misc_feature (2)..(2): Xaa can be Met, Phe, Tyr, Val, Thr, Ile, Gln, Leu, Ser, Trp, Asn, Arg, His, Lys, Ala, or Gly
  misc_feature (11)..(11): Xaa can be Arg, Lys, Asn, Cys, His, Tyr, Trp, Ile, Ser, Val, Gln, Phe, Gly, Pro, Met, Leu, Asp, Ala, Glu, or Thr
LXVDSLFFLRX

SEQ ID NO: 161988 - protein, 9 aa, Artificial Sequence
  Description of Artificial Sequence: Synthetic peptide
  Seed: MERRRLWGS (PRAME_HUMAN)
  misc_feature (2)..(2): Xaa can be Glu, Asp, or Gln
  misc_feature (9)..(9): Xaa can be Ile, Met, Leu, Val, Cys, Phe, Ala, Pro, Ser, or Thr
MXRRRLWGX

SEQ ID NO: 161989 - protein, 10 aa, Artificial Sequence
  Description of Artificial Sequence: Synthetic peptide
  Seed: MERRRLWGSI (PRAME_HUMAN)
  misc_feature (2)..(2): Xaa can be Met, Leu, Pro, Val, Gln, Ile, Ala, Phe, Trp, Lys, Asn, Arg, Thr, Glu, Ser, Gly, Tyr, His, Cys, or Asp
  misc_feature (10)..(10): Xaa can be Met, Leu, Val, Phe, Ile, Ala, Cys, Thr, Ser, Trp, Gly, Tyr, Pro, or Glu
MXRRRLWGSX

SEQ ID NO: 161990 - protein, 9 aa, Artificial Sequence
  Description of Artificial Sequence: Synthetic peptide
  Seed: MHLSQSPSV (PRAME_HUMAN)
  misc_feature (2)..(2): Xaa can be Gln, His, Arg, Met, Lys, Glu, Ala, Pro, Leu, Ser, Val, Asn, Thr, Asp, Ile, Phe, Gly, Tyr, Cys, or Trp
  misc_feature (9)..(9): Xaa can be Phe, Tyr, Met, Leu, Ile, Val, Trp, Ala, His, Cys, Thr, Gly, Pro, Ser, Asn, or Gln
MXLSQSPSX

SEQ ID NO: 161991 - protein, 10 aa, Artificial Sequence
  Description of Artificial Sequence: Synthetic peptide
  Seed: MHLSQSPSVS (PRAME_HUMAN)
  misc_feature (2)..(2): Xaa can be His, Arg, Gln, or Pro
  misc_feature (10)..(10): Xaa can be Ala, Val, Leu, Ile, Cys, Phe, Met, Ser, Thr, Gly, or Pro
MXLSQSPSVX

SEQ ID NO: 161992 - protein, 8 aa, Artificial Sequence
  Description of Artificial Sequence: Synthetic peptide
  Seed: MILKMVQL (PRAME_HUMAN)
  misc_feature (2)..(2): Xaa can be Met, Pro, Leu, Arg, Lys, Ile, or Ala
  misc_feature (8)..(8): Xaa can be Leu, Met, or Ile
MXLKMVQX

SEQ ID NO: 161993 - protein, 8 aa, Artificial Sequence
  Description of Artificial Sequence: Synthetic peptide
  Seed: MINLRRLL (PRAME_HUMAN)
  misc_feature (2)..(2): Xaa can be Met, Ala, Ile, Pro, Ser, Phe, Leu, Val, Gly, Thr, Gln, Asn, Arg, Lys, Tyr, Asp, Trp, His, Glu, or Cys
  misc_feature (8)..(8): Xaa can be Leu, Met, Ile, Val, Phe, Tyr, Ala, Trp, Cys, Ser, Pro, or Thr
MXNLRRLX

SEQ ID NO: 161994 - protein, 9 aa, Artificial Sequence
  Description of Artificial Sequence: Synthetic peptide
  Seed: MINLRRLLL (PRAME_HUMAN)
  misc_feature (2)..(2): Xaa can be Ser, Thr, Pro, Met, Arg, Gln, Ala, Leu, Val, Tyr, Ile, Phe, Gly, Asn, Glu, Lys, Asp, Cys, Trp, or His
  misc_feature (9)..(9): Xaa can be Ile, Leu, Met, Lys, Phe, Tyr, Val, Ala, Arg, Trp, Cys, Ser, Thr, Gly, His, Pro, Glu, Gln, or Asn
MXNLRRLLX

SEQ ID NO: 161995 - protein, 10 aa, Artificial Sequence
  Description of Artificial Sequence: Synthetic peptide
  Seed: MINLRRLLLS (PRAME_HUMAN)
  misc_feature (2)..(2): Xaa can be Pro, Ile, Ala, Leu, Met, Gln, Phe, Val, Lys, Ser, Trp, Tyr, Arg, Gly, Thr, Asn, Asp, His, Glu, or Cys
  misc_feature (10)..(10): Xaa can be Leu, Met, Phe, Ile, Val, Ala, Pro, Cys, Ser, Gly, Glu, Asp, Thr, Gln, His, Trp, Lys, Arg, Tyr, or Asn
MXNLRRLLLX

SEQ ID NO: 161996 - protein, 8 aa, Artificial Sequence
  Description of Artificial Sequence: Synthetic peptide
  Seed: MKGQHLHL (PRAME_HUMAN)
  misc_feature (2)..(2): Xaa can be Ser, Ala, His, Gln, Arg, Glu, Asp, Phe, Tyr, Thr, Gly, Asn, Cys, Pro, Ile, Trp, Leu, Val, Met, or Lys
  misc_feature (8)..(8): Xaa can be Leu, Met, Ile, Phe, or Val
MXGQHLHX

SEQ ID NO: 161997 - protein, 11 aa, Artificial Sequence
  Description of Artificial Sequence: Synthetic peptide
  Seed: MKGQHLHLETF (PRAME_HUMAN)
  misc_feature (2)..(2): Xaa can be Cys, Ser, Val, Arg, Phe, Ile, Thr, Lys, Asp, Leu, Gln, His, Ala, Met, Glu, Pro, Tyr, Asn, Gly, or Trp
  misc_feature (11)..(11): Xaa can be Met, Tyr, or Phe
MXGQHLHLETX

SEQ ID NO: 161998 - protein, 10 aa, Artificial Sequence
  Description of Artificial Sequence: Synthetic peptide
  Seed: MLTDVSPEPL (PRAME_HUMAN)
  misc_feature (2)..(2): Xaa can be Met, Leu, Thr, Val, Ala, Ser, Ile, Gln, Glu, Tyr, Cys, Phe, Gly, Pro, Arg, His, Asn, Trp, Asp, or Lys
  misc_feature (10)..(10): Xaa can be Val, Lys, Leu, Phe, Met, Arg, Tyr, Ile, Trp, Ala, His, Thr, Ser, Cys, Gly, or Pro
MXTDVSPEPX

SEQ ID NO: 161999 - protein, 11 aa, Artificial Sequence
  Description of Artificial Sequence: Synthetic peptide
  Seed: MLTDVSPEPLQ (PRAME_HUMAN)
  misc_feature (2)..(2): Xaa can be Leu, Met, Ile, Gln, or Val
  misc_feature (11)..(11): Xaa can be Val, Leu, Asn, Gln, Gly, Ala, Pro, Ile, Cys, Tyr, Trp, Thr, Phe, Ser, Met, Lys, Asp, Glu, Arg, or His
MXTDVSPEPLX

SEQ ID NO: 162000 - protein, 9 aa, Artificial Sequence
  Description of Artificial Sequence: Synthetic peptide
  Seed: MNPLETLSI (PRAME_HUMAN)
  misc_feature (2)..(2): Xaa can be Ala, Ser, Gln, Arg, Thr, Gly, Val, Ile, Met, Leu, Phe, Tyr, Pro, Asn, Lys, His, Asp, Trp, Glu, or Cys
  misc_feature (9)..(9): Xaa can be Tyr, Ile, Leu, Phe, Val, Met, Cys, Trp, Ala, Lys, Arg, His, Thr, or Ser
MXPLETLSX

SEQ ID NO: 162001 - protein, 10 aa, Artificial Sequence
  Description of Artificial Sequence: Synthetic peptide
  Seed: MNPLETLSIT (PRAME_HUMAN)
  misc_feature (2)..(2): Xaa can be Asn, Ile, Trp, Ala, Arg, Phe, Pro, Asp, Glu, Val, Gly, Cys, Thr, His, Met, Gln, Tyr, Ser, Leu, or Lys
  misc_feature (10)..(10): Xaa can be Cys, Thr, Ala, Pro, Ile, Val, or Ser
MXPLETLSIX

SEQ ID NO: 162002 - protein, 8 aa, Artificial Sequence
  Description of Artificial Sequence: Synthetic peptide
  Seed: MPMQDIKM (PRAME_HUMAN)
  misc_feature (2)..(2): Xaa can be Pro, Ala, Val, or Met
  misc_feature (8)..(8): Xaa can be Tyr, Trp, Phe, Ile, Met, Leu, Val, or Ala
MXMQDIKX

SEQ ID NO: 162003 - protein, 9 aa, Artificial Sequence
  Description of Artificial Sequence: Synthetic peptide
  Seed: MPMQDIKMI (PRAME_HUMAN)
  misc_feature (2)..(2): Xaa can be Pro, Ala, Gln, Val, Ser, Gly, Met, Leu, Ile, Thr, Cys, Asp, Glu, or Phe
  misc_feature (9)..(9): Xaa can be Tyr, Phe, Trp, Met, Ile, Val, Leu, His, Ala, Cys, Arg, Pro, Thr, Ser, Gln, Gly, or Lys
MXMQDIKMX

SEQ ID NO: 162004 - protein, 10 aa, Artificial Sequence
  Description of Artificial Sequence: Synthetic peptide
  Seed: MPMQDIKMIL (PRAME_HUMAN)
  misc_feature (2)..(2): Xaa can be Pro, Leu, Met, Ala, Thr, Ile, Gln, Ser, Arg, Val, His, Asn, Cys, Tyr, Phe, Asp, Gly, Trp, Glu, or Lys
  misc_feature (10)..(10): Xaa can be Tyr, Trp, Ala, Met, Leu, Val, Ile, Phe, Thr, Cys, Gly, Ser, Pro, His, Glu, Asn, Lys, Gln, or Arg
MXMQDIKMIX

SEQ ID NO: 162005 - protein, 11 aa, Artificial Sequence
  Description of Artificial Sequence: Synthetic peptide
  Seed: MPMQDIKMILK (PRAME_HUMAN)
  misc_feature (2)..(2): Xaa can be , or Pro
  misc_feature (11)..(11): Xaa can be Pro, Trp, Gln, Gly, Asn, His, Arg, Ala, Ile, Lys, Cys, Leu, Phe, Asp, Ser, Tyr, Glu, Val, Met, or Thr
MXMQDIKMILX

SEQ ID NO: 162006 - protein, 8 aa, Artificial Sequence
  Description of Artificial Sequence: Synthetic peptide
  Seed: MQDIKMIL (PRAME_HUMAN)
  misc_feature (2)..(2): Xaa can be Glu, Ala, Gly, Thr, Phe, Arg, Ser, Tyr, Ile, His, Val, Asn, Trp, Asp, Leu, Gln, Met, Cys, Lys, or Pro
  misc_feature (8)..(8): Xaa can be Leu, Ile, Val, Met, Phe, Tyr, Cys, Ala, or Trp
MXDIKMIX

SEQ ID NO: 162007 - protein, 9 aa, Artificial Sequence
  Description of Artificial Sequence: Synthetic peptide
  Seed: MQDIKMILK (PRAME_HUMAN)
  misc_feature (2)..(2): Xaa can be Thr, Ser, Ala, Val, Ile, Arg, Gly, Met, Leu, Asn, Tyr, Cys, Gln, Phe, Trp, Pro, Glu, Asp, Lys, or His
  misc_feature (9)..(9): Xaa can be Leu, Tyr, Lys, Met, Phe, Ile, Arg, Val, His, Trp, Gln, Ala, Cys, Glu, Asn, or Thr
MXDIKMILX

SEQ ID NO: 162008 - protein, 10 aa, Artificial Sequence
  Description of Artificial Sequence: Synthetic peptide
  Seed: MQDIKMILKM (PRAME_HUMAN)
  misc_feature (2)..(2): Xaa can be Gln, Met, Val, Ser, Leu, Ile, Lys, Ala, Glu, Thr, Arg, or His
  misc_feature (10)..(10): Xaa can be Phe, Tyr, Val, Ile, Met, Ala, Leu, or Trp
MXDIKMILKX

SEQ ID NO: 162009 - protein, 8 aa, Artificial Sequence
  Description of Artificial Sequence: Synthetic peptide
  Seed: MSVWTSPR (PRAME_HUMAN)
  misc_feature (2)..(2): Xaa can be Thr, Val, Tyr, Trp, Ala, Ile, Phe, Met, Leu, Ser, Lys, Gln, Cys, Arg, Asn, Gly, or His
  misc_feature (8)..(8): Xaa can be Arg, Lys, or Tyr
MXVWTSPX

SEQ ID NO: 162010 - protein, 9 aa, Artificial Sequence
  Description of Artificial Sequence: Synthetic peptide
  Seed: MSVWTSPRR (PRAME_HUMAN)
  misc_feature (2)..(2): Xaa can be Val, Met, Thr, Leu, Ile, Ser, Ala, Asp, Asn, Pro, Gly, Trp, Cys, Phe, Tyr, Gln, or His
  misc_feature (9)..(9): Xaa can be Arg, Lys, Tyr, Met, Leu, His, Val, Phe, or Ile
MXVWTSPRX

SEQ ID NO: 162011 - protein, 10 aa, Artificial Sequence
  Description of Artificial Sequence: Synthetic peptide
  Seed: MSVWTSPRRL (PRAME_HUMAN)
  misc_feature (2)..(2): Xaa can be Ser, Thr, Ala, Val, Gln, Met, Ile, Gly, Leu, Pro, Tyr, Cys, Glu, Phe, Trp, Asp, His, Asn, Lys, or Arg
  misc_feature (10)..(10): Xaa can be Phe, Trp, Tyr, Met, Leu, or Ile
MXVWTSPRRX

SEQ ID NO: 162012 - protein, 11 aa, Artificial Sequence
  Description of Artificial Sequence: Synthetic peptide
  Seed: MSVWTSPRRLV (PRAME_HUMAN)
  misc_feature (2)..(2): Xaa can be Thr, Val, or Ser
  misc_feature (11)..(11): Xaa can be Val, Ile, Leu, or Ala
MXVWTSPRRLX

SEQ ID NO: 162013 - protein, 10 aa, Artificial Sequence
  Description of Artificial Sequence: Synthetic peptide
  Seed: MTKKRKVDGL (PRAME_HUMAN)
  misc_feature (2)..(2): Xaa can be Leu, Arg, Met, Pro, Ala, Ile, Val, Gly, Gln, Asn, Phe, Ser, Trp, Thr, Lys, or Glu
  misc_feature (10)..(10): Xaa can be Leu, Met, Phe, Ile, Val, Ala, Tyr, Lys, or Arg
MXKKRKVDGX

SEQ ID NO: 162014 - protein, 9 aa, Artificial Sequence
  Description of Artificial Sequence: Synthetic peptide
  Seed: MVQAWPFTC (PRAME_HUMAN)
  misc_feature (2)..(2): Xaa can be Met, Leu, Gln, Ile, Val, Thr, Ala, Phe, Ser, Tyr, Cys, Glu, Trp, Gly, Pro, Arg, or Asn
  misc_feature (9)..(9): Xaa can be Val, Leu, Ile, Ala, Met, Thr, Cys, Phe, Ser, Pro, Gly, Lys, Tyr, Asp, Trp, Glu, Arg, Gln, or Asn
MXQAWPFTX

SEQ ID NO: 162015 - protein, 10 aa, Artificial Sequence
  Description of Artificial Sequence: Synthetic peptide
  Seed: MVQAWPFTCL (PRAME_HUMAN)
  misc_feature (2)..(2): Xaa can be Leu, Met, Thr, Gln, Val, Ala, Gly, Tyr, Lys, Glu, Ile, His, Arg, Cys, Phe, Ser, Pro, Trp, Asn, or Asp
  misc_feature (10)..(10): Xaa can be Ala, Met, Trp, Ile, Val, Phe, Leu, Tyr, His, Thr, Ser, Pro, Cys, or Lys
MXQAWPFTCX

SEQ ID NO: 162016 - protein, 10 aa, Artificial Sequence
  Description of Artificial Sequence: Synthetic peptide
  Seed: MVQLDSIEDL (PRAME_HUMAN)
  misc_feature (2)..(2): Xaa can be Met, Leu, Ile, Pro, Asp, Phe, Thr, Gly, Ala, Ser, Tyr, Asn, Lys, Val, Glu, Gln, Cys, His, Trp, or Arg
  misc_feature (10)..(10): Xaa can be Val, Leu, Ile, Ala, or Met
MXQLDSIEDX

SEQ ID NO: 162017 - protein, 10 aa, Artificial Sequence
  Description of Artificial Sequence: Synthetic peptide
  Seed: NLRRLLLSHI (PRAME_HUMAN)
  misc_feature (2)..(2): Xaa can be Met, Leu, Ile, or Val
  misc_feature (10)..(10): Xaa can be Val, Leu, Ala, or Ile
NXRRLLLSHX

SEQ ID NO: 162018 - protein, 9 aa, Artificial Sequence
  Description of Artificial Sequence: Synthetic peptide
  Seed: NLTHVLYPV (PRAME_HUMAN)
  misc_feature (2)..(2): Xaa can be Thr, Leu, Met, Gln, Val, Ala, Ile, Ser, Gly, Asn, Phe, Pro, Tyr, Cys, Trp, or Asp
  misc_feature (9)..(9): Xaa can be Val, Arg, Ile, Lys, Leu, Ala, Thr, Met, Ser, Cys, Tyr, Phe, Pro, or Gly
NXTHVLYPX

SEQ ID NO: 162019 - protein, 10 aa, Artificial Sequence
  Description of Artificial Sequence: Synthetic peptide
  Seed: NLTHVLYPVP (PRAME_HUMAN)
  misc_feature (2)..(2): Xaa can be Met, Leu, Ile, Val, Gln, or Thr
  misc_feature (10)..(10): Xaa can be Val, Ile, Leu, His, Thr, Phe, Met, Ser, Asp, Gly, Ala, Trp, Lys, Gln, Asn, Cys, Arg, Pro, Glu, or Tyr
NXTHVLYPVX

SEQ ID NO: 162020 - protein, 11 aa, Artificial Sequence
  Description of Artificial Sequence: Synthetic peptide
  Seed: NLTHVLYPVPL (PRAME_HUMAN)
  misc_feature (2)..(2): Xaa can be Met, Leu, His, Arg, Val, Ile, Tyr, Glu, Gln, Ala, Pro, Asn, Cys, Lys, Ser, Phe, Asp, Thr, Trp, or Gly
  misc_feature (11)..(11): Xaa can be Leu, Val, Ile, Met, or Ala
NXTHVLYPVPX

SEQ ID NO: 162021 - protein, 9 aa, Artificial Sequence
  Description of Artificial Sequence: Synthetic peptide
  Seed: NPCPHCGDR (PRAME_HUMAN)
  misc_feature (2)..(2): Xaa can be Val, Thr, Ser, Ile, Ala, Pro, Gly, Leu, Met, or Gln
  misc_feature (9)..(9): Xaa can be Arg, Lys, or Tyr
NXCPHCGDX

SEQ ID NO: 162022 - protein, 11 aa, Artificial Sequence
  Description of Artificial Sequence: Synthetic peptide
  Seed: NPCPHCGDRTF (PRAME_HUMAN)
  misc_feature (2)..(2): Xaa can be Pro, Ala, Thr, Ser, Val, Ile, Met, Gly, Cys, Gln, Leu, Glu, Asn, Phe, Asp, Trp, Tyr, Lys, Arg, or His
  misc_feature (11)..(11): Xaa can be Trp, Tyr, Phe, Leu, Met, Ile, Val, Cys, Ala, Thr, Ser, Pro, or Gly
NXCPHCGDRTX

SEQ ID NO: 162023 - protein, 8 aa, Artificial Sequence
  Description of Artificial Sequence: Synthetic peptide
  Seed: NPLETLSI (PRAME_HUMAN)
  misc_feature (2)..(2): Xaa can be Pro, Gln, Glu, Ser, Ala, Asp, Gly, or Val
  misc_feature (8)..(8): Xaa can be Ile, Val, Leu, Met, Thr, Pro, Ala, or Phe
NXLETLSX

SEQ ID NO: 162024 - protein, 9 aa, Artificial Sequence
  Description of Artificial Sequence: Synthetic peptide
  Seed: NPLETLSIT (PRAME_HUMAN)
  misc_feature (2)..(2): Xaa can be Pro, or Ala
  misc_feature (9)..(9): Xaa can be Leu, Ala, Met, Gly, Thr, Phe, Cys, Ser, Val, Ile, Pro, or Tyr
NXLETLSIX

SEQ ID NO: 162025 - protein, 11 aa, Artificial Sequence
  Description of Artificial Sequence: Synthetic peptide
  Seed: NPLETLSITNC (PRAME_HUMAN)
  misc_feature (2)..(2): Xaa can be , or Pro
  misc_feature (11)..(11): Xaa can be Val, Phe, Met, Ala, Ile, Cys, or Leu
NXLETLSITNX

SEQ ID NO: 162026 - protein, 8 aa, Artificial Sequence
  Description of Artificial Sequence: Synthetic peptide
  Seed: NRASLYSF (PRAME_HUMAN)
  misc_feature (2)..(2): Xaa can be , or Arg
  misc_feature (8)..(8): Xaa can be Phe, Met, Leu, or Tyr
NXASLYSX

SEQ ID NO: 162027 - protein, 9 aa, Artificial Sequence
  Description of Artificial Sequence: Synthetic peptide
  Seed: NRASLYSFP (PRAME_HUMAN)
  misc_feature (2)..(2): Xaa can be , or Arg
  misc_feature (9)..(9): Xaa can be Pro, Leu, Met, Val, Ile, Thr, Ala, or Cys
NXASLYSFX

SEQ ID NO: 162028 - protein, 9 aa, Artificial Sequence
  Description of Artificial Sequence: Synthetic peptide
  Seed: NSHQDFWTV (PRAME_HUMAN)
  misc_feature (2)..(2): Xaa can be Ala, Met, Thr, Leu, Gln, Val, Ile, Pro, Ser, Gly, Asn, Phe, Glu, Cys, Tyr, Trp, or Asp
  misc_feature (9)..(9): Xaa can be Trp, Leu, Tyr, Phe, Met, Val, Ile, Ala, Thr, Lys, Cys, Ser, Arg, or His
NXHQDFWTX

SEQ ID NO: 162029 - protein, 10 aa, Artificial Sequence
  Description of Artificial Sequence: Synthetic peptide
  Seed: NSHQDFWTVW (PRAME_HUMAN)
  misc_feature (2)..(2): Xaa can be Ser, Thr, Val, Cys, Ile, Ala, Gly, Met, Leu, or Asn
  misc_feature (10)..(10): Xaa can be Trp, or Phe
NXHQDFWTVX

SEQ ID NO: 162030 - protein, 8 aa, Artificial Sequence
  Description of Artificial Sequence: Synthetic peptide
  Seed: NSISISAL (PRAME_HUMAN)
  misc_feature (2)..(2): Xaa can be Ser, Ala, Gln, Glu, Asn, Leu, Val, Pro, Gly, Met, Ile, Asp, or Thr
  misc_feature (8)..(8): Xaa can be Val, Ile, Leu, Met, Phe, or Tyr
NXISISAX

SEQ ID NO: 162031 - protein, 9 aa, Artificial Sequence
  Description of Artificial Sequence: Synthetic peptide
  Seed: NSISISALQ (PRAME_HUMAN)
  misc_feature (2)..(2): Xaa can be Thr, Val, Ser, Ala, Ile, Gly, Asn, Leu, Met, Phe, His, Glu, Gln, Asp, Cys, Pro, Tyr, Trp, or Lys
  misc_feature (9)..(9): Xaa can be Arg, Lys, Tyr, Gln, His, Met, Glu, Phe, Ala, Ile, Ser, Leu, or Val
NXISISALX

SEQ ID NO: 162032 - protein, 11 aa, Artificial Sequence
  Description of Artificial Sequence: Synthetic peptide
  Seed: NSISISALQSL (PRAME_HUMAN)
  misc_feature (2)..(2): Xaa can be Ala, Ser, Thr, Val, Gln, Gly, Ile, Met, Glu, Asn, Leu, Cys, Asp, Phe, Pro, Tyr, or Trp
  misc_feature (11)..(11): Xaa can be Trp, Lys, Arg, Tyr, Phe, Leu, Met, His, Ile, or Val
NXISISALQSX

SEQ ID NO: 162033 - protein, 9 aa, Artificial Sequence
  Description of Artificial Sequence: Synthetic peptide
  Seed: NVLRLCCKK (PRAME_HUMAN)
  misc_feature (2)..(2): Xaa can be Thr, Val, Ile, Ser, Tyr, Gln, Asp, Trp, Gly, Phe, Leu, Ala, Asn, Met, Cys, Glu, His, or Pr o
  misc_feature (9)..(9): Xaa can be Arg, Lys, Tyr, or His
NXLRLCCKX

SEQ ID NO: 162034 - protein, 9 aa, Artificial Sequence
  Description of Artificial Sequence: Synthetic peptide
  Seed: PEKEEQYIA (PRAME_HUMAN)
  misc_feature (2)..(2): Xaa can be , or Glu
  misc_feature (9)..(9): Xaa can be Val, Ala, Pro, Cys, Ile, Leu, or Met
PXKEEQYIX

SEQ ID NO: 162035 - protein, 11 aa, Artificial Sequence
  Description of Artificial Sequence: Synthetic peptide
  Seed: PEKEEQYIAQF (PRAME_HUMAN)
  misc_feature (2)..(2): Xaa can be , or Glu
  misc_feature (11)..(11): Xaa can be Phe, Tyr, or Trp
PXKEEQYIAQX

SEQ ID NO: 162036 - protein, 9 aa, Artificial Sequence
  Description of Artificial Sequence: Synthetic peptide
  Seed: PEPEAAQPM (PRAME_HUMAN)
  misc_feature (2)..(2): Xaa can be , or Glu
  misc_feature (9)..(9): Xaa can be Leu, Met, Phe, Ile, Pro, Val, or Ala
PXPEAAQPX

SEQ ID NO: 162037 - protein, 8 aa, Artificial Sequence
  Description of Artificial Sequence: Synthetic peptide
  Seed: PFIPVEVL (PRAME_HUMAN)
  misc_feature (2)..(2): Xaa can be Tyr, or Phe
  misc_feature (8)..(8): Xaa can be Leu, Met, Tyr, or Phe
PXIPVEVX

SEQ ID NO: 162038 - protein, 9 aa, Artificial Sequence
  Description of Artificial Sequence: Synthetic peptide
  Seed: PFIPVEVLV (PRAME_HUMAN)
  misc_feature (2)..(2): Xaa can be Tyr, Phe, Trp, Met, Thr, His, Ile, Leu, or Val
  misc_feature (9)..(9): Xaa can be Phe, Leu, Met, Trp, Ile, Val, Cys, or Tyr
PXIPVEVLX

SEQ ID NO: 162039 - protein, 10 aa, Artificial Sequence
  Description of Artificial Sequence: Synthetic peptide
  Seed: PLFMAAFDGR (PRAME_HUMAN)
  misc_feature (2)..(2): Xaa can be Arg, Met, Phe, Tyr, Trp, Cys, His, Lys, Gln, Asn, Thr, Ser, Ile, Val, Gly, Ala, or Leu
  misc_feature (10)..(10): Xaa can be Arg, or Lys
PXFMAAFDGX

SEQ ID NO: 162040 - protein, 10 aa, Artificial Sequence
  Description of Artificial Sequence: Synthetic peptide
  Seed: PMQDIKMILK (PRAME_HUMAN)
  misc_feature (2)..(2): Xaa can be Thr, Met, Val, Leu, Ala, or Ile
  misc_feature (10)..(10): Xaa can be Lys, or Arg
PXQDIKMILX

SEQ ID NO: 162041 - protein, 8 aa, Artificial Sequence
  Description of Artificial Sequence: Synthetic peptide
  Seed: PRELFPPL (PRAME_HUMAN)
  misc_feature (2)..(2): Xaa can be Met, Arg, Lys, Ala, or Tyr
  misc_feature (8)..(8): Xaa can be Leu, Ile, Met, or Phe
PXELFPPX

SEQ ID NO: 162042 - protein, 9 aa, Artificial Sequence
  Description of Artificial Sequence: Synthetic peptide
  Seed: PRELFPPLF (PRAME_HUMAN)
  misc_feature (2)..(2): Xaa can be , or Arg
  misc_feature (9)..(9): Xaa can be Leu, or Phe
PXELFPPLX

SEQ ID NO: 162043 - protein, 11 aa, Artificial Sequence
  Description of Artificial Sequence: Synthetic peptide
  Seed: PRELFPPLFMA (PRAME_HUMAN)
  misc_feature (2)..(2): Xaa can be Tyr, Phe, Lys, Arg, Met, Leu, Ala, Ser, Ile, Trp, Thr, His, Gly, Cys, Gln, Asn, Val, Asp, Glu, or Pro
  misc_feature (11)..(11): Xaa can be Val, Ile, Leu, Ala, Met, or Thr
PXELFPPLFMX

SEQ ID NO: 162044 - protein, 9 aa, Artificial Sequence
  Description of Artificial Sequence: Synthetic peptide
  Seed: PRRWKLQVL (PRAME_HUMAN)
  misc_feature (2)..(2): Xaa can be Met, Leu, Pro, Gln, Ile, Ala, Val, Phe, Gly, Asn, Ser, Glu, Asp, Arg, Thr, Lys, or His
  misc_feature (9)..(9): Xaa can be Leu, Met, Ile, Val, or Phe
PXRWKLQVX

SEQ ID NO: 162045 - protein, 11 aa, Artificial Sequence
  Description of Artificial Sequence: Synthetic peptide
  Seed: PRRWKLQVLDL (PRAME_HUMAN)
  misc_feature (2)..(2): Xaa can be Arg, Lys, Tyr, Gly, Met, His, Ser, Ala, Trp, Phe, Thr, or Gln
  misc_feature (11)..(11): Xaa can be Leu, Lys, Met, Phe, Arg, Ile, Tyr, Ala, His, or Val
PXRWKLQVLDX

SEQ ID NO: 162046 - protein, 9 aa, Artificial Sequence
  Description of Artificial Sequence: Synthetic peptide
  Seed: PTLAKFSPY (PRAME_HUMAN)
  misc_feature (2)..(2): Xaa can be Met, Thr, Ser, Gln, Ala, Leu, Ile, Val, Trp, Phe, Asn, Glu, Tyr, Pro, or Gly
  misc_feature (9)..(9): Xaa can be Tyr, Phe, Trp, or Met
PXLAKFSPX

SEQ ID NO: 162047 - protein, 10 aa, Artificial Sequence
  Description of Artificial Sequence: Synthetic peptide
  Seed: PTLAKFSPYL (PRAME_HUMAN)
  misc_feature (2)..(2): Xaa can be Phe, Tyr, Arg, Leu, Met, Thr, Lys, Ser, Ile, Trp, His, Gly, Ala, Val, Cys, Asn, Gln, Pro, Glu, or Asp
  misc_feature (10)..(10): Xaa can be Leu, Val, Ile, Ala, Met, Thr, Cys, Phe, or Ser
PXLAKFSPYX

SEQ ID NO: 162048 - protein, 9 aa, Artificial Sequence
  Description of Artificial Sequence: Synthetic peptide
  Seed: PYLGQMINL (PRAME_HUMAN)
  misc_feature (2)..(2): Xaa can be Tyr, Trp, Phe, Leu, or Met
  misc_feature (9)..(9): Xaa can be Phe, Leu, Ile, Met, Trp, Tyr, or Val
PXLGQMINX

SEQ ID NO: 162049 - protein, 10 aa, Artificial Sequence
  Description of Artificial Sequence: Synthetic peptide
  Seed: PYLGQMINLR (PRAME_HUMAN)
  misc_feature (2)..(2): Xaa can be Tyr, Phe, Met, Thr, or Val
  misc_feature (10)..(10): Xaa can be , or Arg
PXLGQMINLX

SEQ ID NO: 162050 - protein, 9 aa, Artificial Sequence
  Description of Artificial Sequence: Synthetic peptide
  Seed: QALLERASA (PRAME_HUMAN)
  misc_feature (2)..(2): Xaa can be Pro, Ala, or Val
  misc_feature (9)..(9): Xaa can be Ala, Leu, Ile, Met, Val, Gly, Tyr, Thr, Pro, Phe, Cys, or Ser
QXLLERASX

SEQ ID NO: 162051 - protein, 11 aa, Artificial Sequence
  Description of Artificial Sequence: Synthetic peptide
  Seed: QALLERASATL (PRAME_HUMAN)
  misc_feature (2)..(2): Xaa can be Tyr, Phe, Met, Leu, Ser, Arg, Trp, Ala, Ile, Lys, Gly, Val, Gln, His, Cys, Thr, or Asn
  misc_feature (11)..(11): Xaa can be Val, Leu, Ile, Met, or Ala
QXLLERASATX

SEQ ID NO: 162052 - protein, 8 aa, Artificial Sequence
  Description of Artificial Sequence: Synthetic peptide
  Seed: QALYVDSL (PRAME_HUMAN)
  misc_feature (2)..(2): Xaa can be Gln, Ala, Ser, or Met
  misc_feature (8)..(8): Xaa can be Val, Ile, Leu, or Met
QXLYVDSX

SEQ ID NO: 162053 - protein, 9 aa, Artificial Sequence
  Description of Artificial Sequence: Synthetic peptide
  Seed: QALYVDSLF (PRAME_HUMAN)
  misc_feature (2)..(2): Xaa can be Gln, Ser, Ala, Thr, Pro, Met, Val, Leu, Lys, Gly, His, Asn, Arg, Ile, Phe, Cys, Tyr, Glu, Asp, or Trp
  misc_feature (9)..(9): Xaa can be Tyr, Phe, Trp, Met, Leu, Ile, Val, or His
QXLYVDSLX

SEQ ID NO: 162054 - protein, 10 aa, Artificial Sequence
  Description of Artificial Sequence: Synthetic peptide
  Seed: QALYVDSLFF (PRAME_HUMAN)
  misc_feature (2)..(2): Xaa can be Gln, Ser, Thr, Ala, Met, Pro, Lys, His, Leu, Arg, Val, Trp, Ile, Tyr, Glu, Asp, Gly, Asn, Cys, or Phe
  misc_feature (10)..(10): Xaa can be Trp, Tyr, Phe, Met, Leu, Ile, His, or Val
QXLYVDSLFX

SEQ ID NO: 162055 - protein, 11 aa, Artificial Sequence
  Description of Artificial Sequence: Synthetic peptide
  Seed: QALYVDSLFFL (PRAME_HUMAN)
  misc_feature (2)..(2): Xaa can be Tyr, Met, Phe, Ala, Leu, Ser, Arg, Lys, Ile, His, Gln, Gly, Trp, Asn, Val, Thr, Cys, Glu, Asp, or Pro
  misc_feature (11)..(11): Xaa can be Trp, Leu, Phe, Met, Ile, Val, Ala, Thr, Ser, Cys, Gln, Gly, His, Lys, Asp, Glu, Pro, Asn, Arg, or Tyr
QXLYVDSLFFX

SEQ ID NO: 162056 - protein, 8 aa, Artificial Sequence
  Description of Artificial Sequence: Synthetic peptide
  Seed: QAWPFTCL (PRAME_HUMAN)
  misc_feature (2)..(2): Xaa can be Gln, Ala, Ser, Pro, Met, Glu, Gly, Leu, Asn, Arg, Thr, Val, or Ile
  misc_feature (8)..(8): Xaa can be Ile, Val, Leu, Met, Phe, Tyr, or Ala
QXWPFTCX

SEQ ID NO: 162057 - protein, 10 aa, Artificial Sequence
  Description of Artificial Sequence: Synthetic peptide
  Seed: QAWPFTCLPL (PRAME_HUMAN)
  misc_feature (2)..(2): Xaa can be Gln, Val, Met, Thr, Ala, Ile, Leu, Ser, Tyr, Trp, Gly, Arg, Phe, Glu, Pro, Lys, Cys, Asp, His, or Asn
  misc_feature (10)..(10): Xaa can be Ile, Phe, Leu, Trp, Met, Val, Tyr, Ala, Thr, His, or Cys
QXWPFTCLPX

SEQ ID NO: 162058 - protein, 11 aa, Artificial Sequence
  Description of Artificial Sequence: Synthetic peptide
  Seed: QDFWTVWSGNR (PRAME_HUMAN)
  misc_feature (2)..(2): Xaa can be Tyr, His, Trp, Gln, Met, Asn, Val, Glu, Asp, Ser, Ala, Phe, Thr, Ile, or Leu
  misc_feature (11)..(11): Xaa can be , or Arg
QXFWTVWSGNX

SEQ ID NO: 162059 - protein, 9 aa, Artificial Sequence
  Description of Artificial Sequence: Synthetic peptide
  Seed: QDIKMILKM (PRAME_HUMAN)
  misc_feature (2)..(2): Xaa can be Glu, Gln, Asp, Arg, Ala, His, Ser, Asn, Gly, Thr, Met, Ile, Pro, Val, Leu, Lys, Phe, Tyr, or Cys
  misc_feature (9)..(9): Xaa can be Tyr, Leu, Met, Phe, Trp, Ile, Val, Ala, Cys, Pro, Lys, Arg, His, Thr, Asn, Glu, Asp, Gln, Gly, or Ser
QXIKMILKX

SEQ ID NO: 162060 - protein, 8 aa, Artificial Sequence
  Description of Artificial Sequence: Synthetic peptide
  Seed: QEVRPRRW (PRAME_HUMAN)
  misc_feature (2)..(2): Xaa can be Glu, Asp, Gln, Ser, Thr, Leu, Gly, Ile, Asn, Ala, Pro, Met, Cys, Phe, or Val
  misc_feature (8)..(8): Xaa can be Trp, Phe, Tyr, Val, Ile, Leu, Met, or His
QXVRPRRX

SEQ ID NO: 162061 - protein, 10 aa, Artificial Sequence
  Description of Artificial Sequence: Synthetic peptide
  Seed: QEVRPRRWKL (PRAME_HUMAN)
  misc_feature (2)..(2): Xaa can be Glu, Asp, or Gln
  misc_feature (10)..(10): Xaa can be Tyr, Trp, Phe, Thr, His, Met, Val, Ala, Pro, Ile, Cys, or Leu
QXVRPRRWKX

SEQ ID NO: 162062 - protein, 10 aa, Artificial Sequence
  Description of Artificial Sequence: Synthetic peptide
  Seed: QFLSLQCLQA (PRAME_HUMAN)
  misc_feature (2)..(2): Xaa can be Phe, Leu, Met, Tyr, Ile, Cys, Glu, Pro, Thr, Gly, Val, Arg, Gln, Ala, Asn, Ser, Trp, His, Asp, or Lys
  misc_feature (10)..(10): Xaa can be Val, Ile, Leu, or Ala
QXLSLQCLQX

SEQ ID NO: 162063 - protein, 11 aa, Artificial Sequence
  Description of Artificial Sequence: Synthetic peptide
  Seed: QFLSLQCLQAL (PRAME_HUMAN)
  misc_feature (2)..(2): Xaa can be Phe, Met, Tyr, or Leu
  misc_feature (11)..(11): Xaa can be Val, Leu, or Ile
QXLSLQCLQAX

SEQ ID NO: 162064 - protein, 9 aa, Artificial Sequence
  Description of Artificial Sequence: Synthetic peptide
  Seed: QFTSQFLSL (PRAME_HUMAN)
  misc_feature (2)..(2): Xaa can be Arg, Ala, Ser, Tyr, Thr, Gln, Trp, Phe, Val, His, Gly, Glu, Met, Ile, Asn, Lys, Pro, Leu, Cys, or Asp
  misc_feature (9)..(9): Xaa can be Leu, Met, Phe, Tyr, Ile, Val, Lys, Trp, Arg, His, Cys, Ala, or Gln
QXTSQFLSX

SEQ ID NO: 162065 - protein, 8 aa, Artificial Sequence
  Description of Artificial Sequence: Synthetic peptide
  Seed: QHLHLETF (PRAME_HUMAN)
  misc_feature (2)..(2): Xaa can be His, Arg, or Gln
  misc_feature (8)..(8): Xaa can be Ile, Leu, Ala, Val, Tyr, Met, Phe, Thr, Pro, or Cys
QXLHLETX

SEQ ID NO: 162066 - protein, 10 aa, Artificial Sequence
  Description of Artificial Sequence: Synthetic peptide
  Seed: QHLHLETFKA (PRAME_HUMAN)
  misc_feature (2)..(2): Xaa can be , or His
  misc_feature (10)..(10): Xaa can be Ile, Ala, or Val
QXLHLETFKX

SEQ ID NO: 162067 - protein, 9 aa, Artificial Sequence
  Description of Artificial Sequence: Synthetic peptide
  Seed: QHLIGLSNL (PRAME_HUMAN)
  misc_feature (2)..(2): Xaa can be His, Arg, Gln, Glu, Lys, or Pro
  misc_feature (9)..(9): Xaa can be Tyr, Phe, Ala, Met, Leu, Val, Ile, Cys, Ser, Pro, Trp, or Thr
QXLIGLSNX

SEQ ID NO: 162068 - protein, 8 aa, Artificial Sequence
  Description of Artificial Sequence: Synthetic peptide
  Seed: QLDSIEDL (PRAME_HUMAN)
  misc_feature (2)..(2): Xaa can be Tyr, Phe, Ala, Thr, Ser, Ile, Val, Trp, Leu, Met, Gly, Gln, Cys, or Asn
  misc_feature (8)..(8): Xaa can be Leu, Met, Ile, Phe, or Val
QXDSIEDX

SEQ ID NO: 162069 - protein, 10 aa, Artificial Sequence
  Description of Artificial Sequence: Synthetic peptide
  Seed: QLDSIEDLEV (PRAME_HUMAN)
  misc_feature (2)..(2): Xaa can be Ala, Met, Leu, Ser, Val, Ile, Gly, Thr, Phe, Gln, Tyr, Cys, Trp, Pro, or Asn
  misc_feature (10)..(10): Xaa can be Phe, Leu, Met, Ile, Val, Lys, Tyr, Ala, Trp, or Cys
QXDSIEDLEX

SEQ ID NO: 162070 - protein, 9 aa, Artificial Sequence
  Description of Artificial Sequence: Synthetic peptide
  Seed: QLLALLPSL (PRAME_HUMAN)
  misc_feature (2)..(2): Xaa can be Gln, Arg, Met, Leu, Ile, Val, Ser, Thr, Ala, Asn, Gly, Glu, Phe, Tyr, Cys, Trp, Pro, Asp, Lys, or His
  misc_feature (9)..(9): Xaa can be Val, Leu, Tyr, Phe, Ile, Arg, Lys, Met, Trp, Ala, Thr, Cys, His, Ser, or Gln
QXLALLPSX

SEQ ID NO: 162071 - protein, 10 aa, Artificial Sequence
  Description of Artificial Sequence: Synthetic peptide
  Seed: QLLALLPSLS (PRAME_HUMAN)
  misc_feature (2)..(2): Xaa can be Leu, Met, Gln, Phe, Ile, Val, Tyr, Ser, Trp, Thr, Lys, Asn, Cys, Asp, Arg, Gly, Glu, Ala, His, or Pro
  misc_feature (10)..(10): Xaa can be Val, Leu, Ile, Ala, Met, Cys, Phe, Thr, Lys, Gly, Ser, Trp, Tyr, Arg, His, Asn, Glu, Gln, Asp, or Pro
QXLALLPSLX

SEQ ID NO: 162072 - protein, 10 aa, Artificial Sequence
  Description of Artificial Sequence: Synthetic peptide
  Seed: QLLRHVMNPL (PRAME_HUMAN)
  misc_feature (2)..(2): Xaa can be Met, Leu, Phe, Gln, Tyr, Pro, Trp, Lys, Glu, Asp, His, Ser, Ala, Gly, Cys, Asn, Thr, Ile, Arg, or Val
  misc_feature (10)..(10): Xaa can be Val, Ala, Leu, Ile, Met, Thr, or Phe
QXLRHVMNPX

SEQ ID NO: 162073 - protein, 10 aa, Artificial Sequence
  Description of Artificial Sequence: Synthetic peptide
  Seed: QLSVLSLSGV (PRAME_HUMAN)
  misc_feature (2)..(2): Xaa can be Met, Leu, Thr, Ile, Gln, Val, Tyr, Lys, Ser, His, Asp, Phe, Cys, Glu, Trp, Arg, Pro, Asn, Gly, or Ala
  misc_feature (10)..(10): Xaa can be Val, Ile, Leu, Ala, Met, or Thr
QXSVLSLSGX

SEQ ID NO: 162074 - protein, 8 aa, Artificial Sequence
  Description of Artificial Sequence: Synthetic peptide
  Seed: QMINLRRL (PRAME_HUMAN)
  misc_feature (2)..(2): Xaa can be Gln, Leu, Glu, Met, Ser, Ala, Asn, Gly, Val, or Ile
  misc_feature (8)..(8): Xaa can be Val, Ile, Leu, Met, or Phe
QXINLRRX

SEQ ID NO: 162075 - protein, 9 aa, Artificial Sequence
  Description of Artificial Sequence: Synthetic peptide
  Seed: QMINLRRLL (PRAME_HUMAN)
  misc_feature (2)..(2): Xaa can be Arg, Gln, Met, Thr, Leu, Ser, Val, Ala, Ile, Glu, Gly, Lys, Pro, His, Asn, Cys, Phe, Tyr, Asp, or Trp
  misc_feature (9)..(9): Xaa can be Trp, Phe, Tyr, Met, Leu, Ile, Val, Ala, Cys, Lys, His, Arg, or Gln
QXINLRRLX

SEQ ID NO: 162076 - protein, 10 aa, Artificial Sequence
  Description of Artificial Sequence: Synthetic peptide
  Seed: QMINLRRLLL (PRAME_HUMAN)
  misc_feature (2)..(2): Xaa can be Met, Leu, Pro, Val, Ile, Trp, Gln, Ala, Tyr, Phe, or Arg
  misc_feature (10)..(10): Xaa can be Leu, Val, Met, Ala, Ile, or Phe
QXINLRRLLX

SEQ ID NO: 162077 - protein, 8 aa, Artificial Sequence
  Description of Artificial Sequence: Synthetic peptide
  Seed: QPFIPVEV (PRAME_HUMAN)
  misc_feature (2)..(2): Xaa can be Pro, His, Gln, Arg, Ala, Ser, Glu, Gly, Asn, Thr, Met, Val, Ile, Asp, Leu, Lys, or Phe
  misc_feature (8)..(8): Xaa can be Val, Ile, Leu, Met, Ala, Cys, Phe, Thr, Gly, Pro, Ser, or Tyr
QXFIPVEX

SEQ ID NO: 162078 - protein, 9 aa, Artificial Sequence
  Description of Artificial Sequence: Synthetic peptide
  Seed: QPFIPVEVL (PRAME_HUMAN)
  misc_feature (2)..(2): Xaa can be Pro, His, Arg, Gln, Ala, Met, Glu, Asn, Val, Ser, Lys, Asp, Ile, Cys, Thr, Leu, Gly, Tyr, Phe, or Trp
  misc_feature (9)..(9): Xaa can be Leu, Tyr, Phe, Met, Ile, Val, Trp, Ala, Cys, Pro, Thr, His, Ser, Gly, Glu, Asn, Gln, Lys, or Arg
QXFIPVEVX

SEQ ID NO: 162079 - protein, 10 aa, Artificial Sequence
  Description of Artificial Sequence: Synthetic peptide
  Seed: QPFIPVEVLV (PRAME_HUMAN)
  misc_feature (2)..(2): Xaa can be , or Pro
  misc_feature (10)..(10): Xaa can be Met, Leu, Thr, Val, Tyr, Ile, Pro, Phe, Cys, Ala, or Ser
QXFIPVEVLX

SEQ ID NO: 162080 - protein, 9 aa, Artificial Sequence
  Description of Artificial Sequence: Synthetic peptide
  Seed: QPMTKKRKV (PRAME_HUMAN)
  misc_feature (2)..(2): Xaa can be Pro, Ala, Ile, Leu, Met, Gly, Val, Gln, Thr, Ser, Asn, Asp, Arg, Phe, Glu, or Cys
  misc_feature (9)..(9): Xaa can be Leu, Met, Ile, Val, Phe, Ala, Pro, Cys, Tyr, or Thr
QXMTKKRKX

SEQ ID NO: 162081 - protein, 9 aa, Artificial Sequence
  Description of Artificial Sequence: Synthetic peptide
  Seed: QSLLKDEAL (PRAME_HUMAN)
  misc_feature (2)..(2): Xaa can be Glu, Gln, Asp, Ala, Ser, Arg, Thr, Pro, Val, Met, His, Ile, Leu, Gly, Asn, Cys, Phe, Lys, Tyr, or Trp
  misc_feature (9)..(9): Xaa can be Tyr, Leu, Phe, Met, Trp, Ile, Val, Ala, Lys, Cys, Arg, Gly, Thr, Ser, Pro, or His
QXLLKDEAX

SEQ ID NO: 162082 - protein, 8 aa, Artificial Sequence
  Description of Artificial Sequence: Synthetic peptide
  Seed: QSLLQHLI (PRAME_HUMAN)
  misc_feature (2)..(2): Xaa can be Ser, Gln, Ala, Met, Gly, Asn, Thr, Glu, Leu, Ile, Cys, or Val
  misc_feature (8)..(8): Xaa can be Trp, Val, Leu, Ile, Phe, Tyr, or Met
QXLLQHLX

SEQ ID NO: 162083 - protein, 10 aa, Artificial Sequence
  Description of Artificial Sequence: Synthetic peptide
  Seed: QSLLQHLIGL (PRAME_HUMAN)
  misc_feature (2)..(2): Xaa can be Ala, Ser, Thr, Val, Tyr, Phe, Pro, Trp, Asn, Lys, His, Cys, Leu, Glu, Gln, Asp, Met, Ile, Gly, or Arg
  misc_feature (10)..(10): Xaa can be Met, Val, Leu, Ala, Ile, Trp, Tyr, Phe, or Thr
QXLLQHLIGX

SEQ ID NO: 162084 - protein, 8 aa, Artificial Sequence
  Description of Artificial Sequence: Synthetic peptide
  Seed: QSPSVSQL (PRAME_HUMAN)
  misc_feature (2)..(2): Xaa can be Ser, Ala, Val, Gln, Thr, Pro, Met, Leu, Asn, Phe, Ile, Glu, Gly, Arg, Tyr, Cys, or His
  misc_feature (8)..(8): Xaa can be Leu, Val, Ile, Met, Phe, or Tyr
QXPSVSQX

SEQ ID NO: 162085 - protein, 10 aa, Artificial Sequence
  Description of Artificial Sequence: Synthetic peptide
  Seed: QSPSVSQLSV (PRAME_HUMAN)
  misc_feature (2)..(2): Xaa can be Thr, Ala, Ser, Val, or Ile
  misc_feature (10)..(10): Xaa can be Val, Leu, Ile, Met, or Ala
QXPSVSQLSX

SEQ ID NO: 162086 - protein, 11 aa, Artificial Sequence
  Description of Artificial Sequence: Synthetic peptide
  Seed: QSPSVSQLSVL (PRAME_HUMAN)
  misc_feature (2)..(2): Xaa can be Arg, Pro, Ser, or Met
  misc_feature (11)..(11): Xaa can be Leu, or Met
QXPSVSQLSVX

SEQ ID NO: 162087 - protein, 9 aa, Artificial Sequence
  Description of Artificial Sequence: Synthetic peptide
  Seed: QSRYISMSV (PRAME_HUMAN)
  misc_feature (2)..(2): Xaa can be Ser, Thr, Val, Tyr, Met, Ala, Phe, Ile, Pro, Gln, Gly, Leu, Trp, Asn, Cys, Glu, Arg, Lys, His, or Asp
  misc_feature (9)..(9): Xaa can be Lys, Leu, Val, Met, Ala, Ile, Trp, Ser, Gly, Tyr, Arg, Thr, Phe, Pro, Asn, Cys, His, Gln, or Glu
QXRYISMSX

SEQ ID NO: 162088 - protein, 10 aa, Artificial Sequence
  Description of Artificial Sequence: Synthetic peptide
  Seed: QSRYISMSVW (PRAME_HUMAN)
  misc_feature (2)..(2): Xaa can be Ser, Thr, Ala, Met, Gln, Val, Leu, Ile, Cys, or Gly
  misc_feature (10)..(10): Xaa can be Trp, Phe, Tyr, Leu, Met, or Ile
QXRYISMSVX

SEQ ID NO: 162089 - protein, 9 aa, Artificial Sequence
  Description of Artificial Sequence: Synthetic peptide
  Seed: QTLKAMVQA (PRAME_HUMAN)
  misc_feature (2)..(2): Xaa can be Met, Leu, Thr, Ile, Gln, Val, Ala, or Ser
  misc_feature (9)..(9): Xaa can be Ile, Ala, Val, Leu, Met, or Thr
QXLKAMVQX

SEQ ID NO: 162090 - protein, 10 aa, Artificial Sequence
  Description of Artificial Sequence: Synthetic peptide
  Seed: QTLKAMVQAW (PRAME_HUMAN)
  misc_feature (2)..(2): Xaa can be Thr, Ser, Met, Val, Ala, Leu, Cys, Gly, Ile, Lys, Trp, Glu, Asn, Gln, Asp, Phe, or Pro
  misc_feature (10)..(10): Xaa can be Trp, Phe, Tyr, Leu, Ile, or Met
QXLKAMVQAX

SEQ ID NO: 162091 - protein, 10 aa, Artificial Sequence
  Description of Artificial Sequence: Synthetic peptide
  Seed: QYIAQFTSQF (PRAME_HUMAN)
  misc_feature (2)..(2): Xaa can be Gln, Tyr, Met, Trp, Phe, Arg, Lys, Ala, Thr, His, Ser, Leu, Val, Ile, Cys, Asp, Gly, Asn, Glu, or Pro
  misc_feature (10)..(10): Xaa can be Tyr, Phe, Met, Leu, Trp, Ile, Val, or His
QXIAQFTSQX

SEQ ID NO: 162092 - protein, 11 aa, Artificial Sequence
  Description of Artificial Sequence: Synthetic peptide
  Seed: QYIAQFTSQFL (PRAME_HUMAN)
  misc_feature (2)..(2): Xaa can be Tyr, Phe, Trp, Leu, or Met
  misc_feature (11)..(11): Xaa can be Leu, Val, Ile, Trp, Phe, His, Glu, Arg, Met, Asn, Tyr, Lys, Ser, Cys, Thr, Gln, Pro, Asp, Ala, or Gly
QXIAQFTSQFX

SEQ ID NO: 162093 - protein, 9 aa, Artificial Sequence
  Description of Artificial Sequence: Synthetic peptide
  Seed: RASATLQDL (PRAME_HUMAN)
  misc_feature (2)..(2): Xaa can be Arg, Gln, Pro, Val, Ala, Ser, Ile, Leu, Met, Glu, Thr, Gly, Asn, Phe, Lys, Cys, His, Tyr, Trp, or Asp
  misc_feature (9)..(9): Xaa can be Tyr, Phe, Leu, Trp, Met, Val, Ile, Ala, His, Lys, Cys, Arg, Gln, or Thr
RXSATLQDX

SEQ ID NO: 162094 - protein, 10 aa, Artificial Sequence
  Description of Artificial Sequence: Synthetic peptide
  Seed: RASATLQDLV (PRAME_HUMAN)
  misc_feature (2)..(2): Xaa can be Ser, Gln, Thr, Leu, Glu, Val, Ala, Ile, Met, Arg, Tyr, Cys, Asn, Asp, Lys, Phe, Trp, His, Pro, or Gly
  misc_feature (10)..(10): Xaa can be Met, Ile, Phe, Leu, Trp, Tyr, Val, Cys, Ala, or Gly
RXSATLQDLX

SEQ ID NO: 162095 - protein, 11 aa, Artificial Sequence
  Description of Artificial Sequence: Synthetic peptide
  Seed: RASATLQDLVF (PRAME_HUMAN)
  misc_feature (2)..(2): Xaa can be Ala, Thr, Gln, Ser, Met, Ile, Val, Leu, Glu, Lys, Arg, His, Asn, Gly, Tyr, Cys, Phe, Pro, Trp, or Asp
  misc_feature (11)..(11): Xaa can be Trp, Phe, Tyr, Met, Leu, Ile, Lys, Val, His, or Cys
RXSATLQDLVX

SEQ ID NO: 162096 - protein, 8 aa, Artificial Sequence
  Description of Artificial Sequence: Synthetic peptide
  Seed: RELFPPLF (PRAME_HUMAN)
  misc_feature (2)..(2): Xaa can be Glu, Asp, Gln, Lys, Arg, His, or Met
  misc_feature (8)..(8): Xaa can be Tyr, Phe, Met, Trp, Leu, Val, Ile, Ala, Gly, Ser, Thr, Cys, or Pro
RXLFPPLX

SEQ ID NO: 162097 - protein, 9 aa, Artificial Sequence
  Description of Artificial Sequence: Synthetic peptide
  Seed: RELFPPLFM (PRAME_HUMAN)
  misc_feature (2)..(2): Xaa can be Glu, Gln, Asp, Met, Arg, Lys, Ser, Thr, Val, Leu, Ile, Ala, Gly, Asn, His, Pro, Tyr, Phe, Trp, or Cys
  misc_feature (9)..(9): Xaa can be Tyr, Phe, Leu, Met, Ile, Val, Trp, Ala, Cys, His, Pro, Arg, Gly, Thr, Lys, or Ser
RXLFPPLFX

SEQ ID NO: 162098 - protein, 10 aa, Artificial Sequence
  Description of Artificial Sequence: Synthetic peptide
  Seed: RELFPPLFMA (PRAME_HUMAN)
  misc_feature (2)..(2): Xaa can be Glu, Leu, Met, Phe, Tyr, Gln, Ile, Val, Lys, Ser, Thr, Pro, Gly, Ala, Trp, Cys, Asn, Arg, Asp, or His
  misc_feature (10)..(10): Xaa can be Cys, Phe, Thr, Ala, Leu, Met, Val, Ser, Ile, Gly, Pro, Tyr, Trp, Lys, or His
RXLFPPLFMX

SEQ ID NO: 162099 - protein, 11 aa, Artificial Sequence
  Description of Artificial Sequence: Synthetic peptide
  Seed: RELFPPLFMAA (PRAME_HUMAN)
  misc_feature (2)..(2): Xaa can be Trp, Met, Leu, Phe, Val, Pro, Glu, Arg, His, Ile, Asn, Gln, Ala, Cys, Tyr, Lys, Asp, Gly, Thr, or Ser
  misc_feature (11)..(11): Xaa can be Lys, Gly, Met, Val, Arg, Asp, Phe, Asn, Cys, Glu, Ser, Thr, Trp, Ala, Gln, Ile, Leu, Pro, His, or Tyr
RXLFPPLFMAX

SEQ ID NO: 162100 - protein, 8 aa, Artificial Sequence
  Description of Artificial Sequence: Synthetic peptide
  Seed: RELLCELG (PRAME_HUMAN)
  misc_feature (2)..(2): Xaa can be Glu, or Asp
  misc_feature (8)..(8): Xaa can be Ala, Ile, Val, Leu, Thr, Met, Pro, Gly, Phe, Cys, or Ser
RXLLCELX

SEQ ID NO: 162101 - protein, 9 aa, Artificial Sequence
  Description of Artificial Sequence: Synthetic peptide
  Seed: RELLCELGR (PRAME_HUMAN)
  misc_feature (2)..(2): Xaa can be Arg, Glu, Gln, Thr, Met, Gly, Val, Ala, Asn, Asp, Leu, Lys, Ser, Ile, His, Phe, Cys, Tyr, Trp, or Pro
  misc_feature (9)..(9): Xaa can be Leu, Arg, Lys, Phe, Ile, Tyr, Met, His, Trp, Val, Cys, Pro, Thr, Ser, Glu, Gln, Asn, Gly, or Ala
RXLLCELGX

SEQ ID NO: 162102 - protein, 10 aa, Artificial Sequence
  Description of Artificial Sequence: Synthetic peptide
  Seed: RELLCELGRP (PRAME_HUMAN)
  misc_feature (2)..(2): Xaa can be , or Glu
  misc_feature (10)..(10): Xaa can be Phe, Met, Pro, Ala, Val, Cys, Thr, Leu, or Ile
RXLLCELGRX

SEQ ID NO: 162103 - protein, 9 aa, Artificial Sequence
  Description of Artificial Sequence: Synthetic peptide
  Seed: RGRLDQLLR (PRAME_HUMAN)
  misc_feature (2)..(2): Xaa can be Arg, Thr, Met, Phe, Tyr, Ala, Ser, Val, Ile, Leu, Gln, Gly, Asn, Trp, Lys, Cys, Glu, Asp, Pro, or His
  misc_feature (9)..(9): Xaa can be Lys, Leu, Arg, Ile, Met, Phe, Tyr, Val, Ala, His, Ser, Thr, Gly, Asn, Gln, Pro, Glu, Cys, Trp, or Asp
RXRLDQLLX

SEQ ID NO: 162104 - protein, 10 aa, Artificial Sequence
  Description of Artificial Sequence: Synthetic peptide
  Seed: RGRLDQLLRH (PRAME_HUMAN)
  misc_feature (2)..(2): Xaa can be Arg, His, Phe, Gly, Cys, Ala, Thr, Ser, Asp, Glu, Leu, Gln, Pro, Lys, Tyr, Asn, Ile, Met, Val, or Trp
  misc_feature (10)..(10): Xaa can be Ala, Val, Lys, Met, Ile, Leu, Ser, Tyr, Cys, Thr, Phe, Trp, Gln, Arg, His, Gly, Asn, Pro, Glu, or Asp
RXRLDQLLRX

SEQ ID NO: 162105 - protein, 8 aa, Artificial Sequence
  Description of Artificial Sequence: Synthetic peptide
  Seed: RHSQTLKA (PRAME_HUMAN)
  misc_feature (2)..(2): Xaa can be , or His
  misc_feature (8)..(8): Xaa can be Ile, Ala, Leu, or Val
RXSQTLKX

SEQ ID NO: 162106 - protein, 9 aa, Artificial Sequence
  Description of Artificial Sequence: Synthetic peptide
  Seed: RHSQTLKAM (PRAME_HUMAN)
  misc_feature (2)..(2): Xaa can be Arg, Gln, His, Met, Tyr, Glu, Lys, Phe, Asn, Trp, Asp, Ser, Ala, Val, Ile, Gly, Thr, Pro, Leu, or Cys
  misc_feature (9)..(9): Xaa can be Tyr, Phe, Leu, Met, Ile, Val, Trp, His, Ala, Thr, Cys, Pro, Ser, Gly, Lys, Arg, or Gln
RXSQTLKAX

SEQ ID NO: 162107 - protein, 10 aa, Artificial Sequence
  Description of Artificial Sequence: Synthetic peptide
  Seed: RHSQTLKAMV (PRAME_HUMAN)
  misc_feature (2)..(2): Xaa can be , or His
  misc_feature (10)..(10): Xaa can be Leu, Ala, Met, Trp, Phe, Val, or Ile
RXSQTLKAMX

SEQ ID NO: 162108 - protein, 9 aa, Artificial Sequence
  Description of Artificial Sequence: Synthetic peptide
  Seed: RHVMNPLET (PRAME_HUMAN)
  misc_feature (2)..(2): Xaa can be His, Gln, Pro, Arg, Glu, Asn, Lys, or Ala
  misc_feature (9)..(9): Xaa can be Leu, Ala, Val, Ile, Met, Phe, Cys, Gly, Ser, Thr, or Pro
RXVMNPLEX

SEQ ID NO: 162109 - protein, 10 aa, Artificial Sequence
  Description of Artificial Sequence: Synthetic peptide
  Seed: RHVMNPLETL (PRAME_HUMAN)
  misc_feature (2)..(2): Xaa can be Arg, Met, His, Leu, Gln, Ile, Asn, Glu, Tyr, Ala, Cys, Thr, Pro, Gly, Asp, Ser, Phe, Trp, Val, or Lys
  misc_feature (10)..(10): Xaa can be Tyr, Leu, Ala, Trp, Phe, Met, Ile, Val, Thr, Cys, His, Gly, Asn, Pro, Arg, Gln, Lys, or Se r
RXVMNPLETX

SEQ ID NO: 162110 - protein, 10 aa, Artificial Sequence
  Description of Artificial Sequence: Synthetic peptide
  Seed: RKVDGLSTEA (PRAME_HUMAN)
  misc_feature (2)..(2): Xaa can be His, Arg, Gln, Pro, Glu, or Lys
  misc_feature (10)..(10): Xaa can be Leu, Ala, Val, Ile, Met, Cys, Gly, Ser, Thr, Phe, or Pro
RXVDGLSTEX

SEQ ID NO: 162111 - protein, 8 aa, Artificial Sequence
  Description of Artificial Sequence: Synthetic peptide
  Seed: RLAYLHAR (PRAME_HUMAN)
  misc_feature (2)..(2): Xaa can be Phe, Thr, Tyr, Val, Trp, Ile, Met, Gln, Ser, Leu, Ala, Asn, Cys, Arg, Gly, Lys, or His
  misc_feature (8)..(8): Xaa can be Arg, or Lys
RXAYLHAX

SEQ ID NO: 162112 - protein, 9 aa, Artificial Sequence
  Description of Artificial Sequence: Synthetic peptide
  Seed: RLAYLHARL (PRAME_HUMAN)
  misc_feature (2)..(2): Xaa can be Leu, Gln, Met, Thr, Ile, Val, Ala, Tyr, Ser, Phe, Glu, Trp, Lys, Gly, Asn, Cys, His, Arg, Asp, or Pro
  misc_feature (9)..(9): Xaa can be Tyr, Phe, Met, Trp, Arg, Leu, Ile, Lys, Val, His, Ala, Cys, Thr, or Gly
RXAYLHARX

SEQ ID NO: 162113 - protein, 10 aa, Artificial Sequence
  Description of Artificial Sequence: Synthetic peptide
  Seed: RLAYLHARLR (PRAME_HUMAN)
  misc_feature (2)..(2): Xaa can be Leu, Met, Thr, Ser, Val, Tyr, Ile, Phe, Trp, Gly, Lys, His, Pro, Glu, Gln, Ala, Cys, Arg, Asn, or Asp
  misc_feature (10)..(10): Xaa can be Ser, Val, Arg, Leu, Ile, Tyr, Met, Lys, Ala, His, Gly, Thr, Pro, Phe, Gln, Cys, Asn, Glu, Asp, or Trp
RXAYLHARLX

SEQ ID NO: 162114 - protein, 11 aa, Artificial Sequence
  Description of Artificial Sequence: Synthetic peptide
  Seed: RLAYLHARLRE (PRAME_HUMAN)
  misc_feature (2)..(2): Xaa can be Phe, Met, Trp, Ser, Leu, Thr, Ala, Tyr, Val, Gln, Ile, Asn, His, Asp, Gly, Pro, Cys, Glu, Arg, or Lys
  misc_feature (11)..(11): Xaa can be Lys, Arg, Ser, Ala, Pro, Gln, Thr, Met, Asn, Tyr, Gly, Trp, Cys, Val, Phe, Ile, Glu, Asp, Leu, or His
RXAYLHARLRX

SEQ ID NO: 162115 - protein, 9 aa, Artificial Sequence
  Description of Artificial Sequence: Synthetic peptide
  Seed: RLCCKKLKI (PRAME_HUMAN)
  misc_feature (2)..(2): Xaa can be Arg, Gln, Leu, Met, Gly, Glu, Ser, Ala, Asn, Val, Thr, Ile, Lys, Asp, Phe, Tyr, Cys, Trp, His, or Pro
  misc_feature (9)..(9): Xaa can be Leu, Tyr, Phe, Ile, Met, Lys, Trp, Val, Arg, Ala, His, Cys, Glu, Ser, Gln, Asn, Thr, Gly, or Pro
RXCCKKLKX

SEQ ID NO: 162116 - protein, 10 aa, Artificial Sequence
  Description of Artificial Sequence: Synthetic peptide
  Seed: RLCCKKLKIF (PRAME_HUMAN)
  misc_feature (2)..(2): Xaa can be Met, Ile, Gln, Leu, Thr, Val, Ala, Ser, or Glu
  misc_feature (10)..(10): Xaa can be Tyr, Trp, or Phe
RXCCKKLKIX

SEQ ID NO: 162117 - protein, 9 aa, Artificial Sequence
  Description of Artificial Sequence: Synthetic peptide
  Seed: RLDQLLRHV (PRAME_HUMAN)
  misc_feature (2)..(2): Xaa can be Met, Tyr, Phe, Leu, Ala, Gln, Ser, Val, Ile, Thr, Trp, Asn, Gly, Arg, Glu, His, Asp, Cys, Pro, or Lys
  misc_feature (9)..(9): Xaa can be Leu, Met, Phe, Val, Ile, Tyr, Trp, Arg, Cys, Ala, Lys, or Thr
RXDQLLRHX

SEQ ID NO: 162118 - protein, 10 aa, Artificial Sequence
  Description of Artificial Sequence: Synthetic peptide
  Seed: RLDQLLRHVM (PRAME_HUMAN)
  misc_feature (2)..(2): Xaa can be Glu, Gln, Ala, Leu, Met, Val, Ser, Tyr, Thr, Ile, His, Arg, Phe, Trp, Lys, Gly, Asp, Cys, Asn, or Pro
  misc_feature (10)..(10): Xaa can be Leu, Ile, Met, Phe, Tyr, Val, Trp, Ala, Cys, Thr, Lys, Gly, Pro, or Ser
RXDQLLRHVX

SEQ ID NO: 162119 - protein, 9 aa, Artificial Sequence
  Description of Artificial Sequence: Synthetic peptide
  Seed: RLLLSHIHA (PRAME_HUMAN)
  misc_feature (2)..(2): Xaa can be Thr, Val, Ser, Met, Ile, Tyr, Ala, Phe, Gln, Leu, Trp, Gly, Asn, Cys, or His
  misc_feature (9)..(9): Xaa can be Lys, Ala, Ile, Val, Leu, Met, Arg, Ser, Thr, Gly, Tyr, His, Phe, Asn, Gln, Pro, or Cys
RXLLSHIHX

SEQ ID NO: 162120 - protein, 9 aa, Artificial Sequence
  Description of Artificial Sequence: Synthetic peptide
  Seed: RLRELLCEL (PRAME_HUMAN)
  misc_feature (2)..(2): Xaa can be Thr, Phe, Ser, Val, Tyr, Arg, Ala, Ile, Met, Pro, Leu, Trp, Gln, Gly, Glu, Cys, Asn, Lys, Asp, or His
  misc_feature (9)..(9): Xaa can be Ile, Arg, Lys, Met, Tyr, Val, Leu, Phe, Trp, Ala, His, Ser, Gly, Thr, Cys, Asn, Pro, Gln, Glu, or Asp
RXRELLCEX

SEQ ID NO: 162121 - protein, 10 aa, Artificial Sequence
  Description of Artificial Sequence: Synthetic peptide
  Seed: RLRELLCELG (PRAME_HUMAN)
  misc_feature (2)..(2): Xaa can be Leu, Met, Ile, Val, Thr, or Gln
  misc_feature (10)..(10): Xaa can be Val, Ala, Leu, Ile, Met, Ser, Cys, Thr, Phe, Pro, His, Arg, Glu, Gly, Lys, Gln, Asp, Tyr, Trp, or Asn
RXRELLCELX

SEQ ID NO: 162122 - protein, 11 aa, Artificial Sequence
  Description of Artificial Sequence: Synthetic peptide
  Seed: RLRELLCELGR (PRAME_HUMAN)
  misc_feature (2)..(2): Xaa can be Ile, Met, Leu, Tyr, Phe, Ser, Val, Trp, Ala, Thr, Gln, Gly, or Asn
  misc_feature (11)..(11): Xaa can be Arg, or Lys
RXRELLCELGX

SEQ ID NO: 162123 - protein, 9 aa, Artificial Sequence
  Description of Artificial Sequence: Synthetic peptide
  Seed: RLSEGDVMH (PRAME_HUMAN)
  misc_feature (2)..(2): Xaa can be Met, Gln, Leu, Ile, Val, Ser, Ala, Thr, Phe, Asn, Gly, Glu, Trp, Tyr, Lys, Pro, Asp, Cys, Arg, or His
  misc_feature (9)..(9): Xaa can be Tyr, Phe, Lys, Met, Arg, Leu, Trp, His, Ile, or Val
RXSEGDVMX

SEQ ID NO: 162124 - protein, 10 aa, Artificial Sequence
  Description of Artificial Sequence: Synthetic peptide
  Seed: RLSEGDVMHL (PRAME_HUMAN)
  misc_feature (2)..(2): Xaa can be Gln, Met, Leu, Arg, Ala, Val, Ile, Thr, Ser, Tyr, Gly, Glu, Asn, Cys, Lys, His, Phe, Trp, Asp, or Pro
  misc_feature (10)..(10): Xaa can be Tyr, Leu, Trp, Phe, Arg, Met, Lys, Ile, Val, His, Cys, Ala, Thr, Gln, Ser, or Gly
RXSEGDVMHX

SEQ ID NO: 162125 - protein, 11 aa, Artificial Sequence
  Description of Artificial Sequence: Synthetic peptide
  Seed: RLSEGDVMHLS (PRAME_HUMAN)
  misc_feature (2)..(2): Xaa can be Met, Leu, Ile, Val, Gln, or Thr
  misc_feature (11)..(11): Xaa can be Val, Leu, Ile, Asp, Cys, Met, Pro, Arg, His, Ser, Trp, Asn, Lys, Gly, Ala, Phe, Gln, Glu, Tyr, or Thr
RXSEGDVMHLX

SEQ ID NO: 162126 - protein, 10 aa, Artificial Sequence
  Description of Artificial Sequence: Synthetic peptide
  Seed: RLVELAGQSL (PRAME_HUMAN)
  misc_feature (2)..(2): Xaa can be Arg, Gln, Ala, Leu, Met, Val, Glu, Ile, Thr, Ser, Gly, Lys, Tyr, Asn, Asp, His, Phe, Trp, Cys, or Pro
  misc_feature (10)..(10): Xaa can be Tyr, Phe, Leu, Met, Trp, Lys, Val, Arg, Ile, His, Ala, Cys, Thr, Gln, Gly, Pro, Ser, Glu, or Asn
RXVELAGQSX

SEQ ID NO: 162127 - protein, 11 aa, Artificial Sequence
  Description of Artificial Sequence: Synthetic peptide
  Seed: RLVELAGQSLL (PRAME_HUMAN)
  misc_feature (2)..(2): Xaa can be Glu, Gln, Leu, Met, Val, Ile, Ala, Ser, Thr, Arg, Gly, Cys, Lys, Tyr, Asn, His, Phe, Pro, Trp, or Asp
  misc_feature (11)..(11): Xaa can be Leu, Ile, Met, Phe, Trp, Tyr, Val, Ala, Cys, Thr, Arg, His, Pro, Glu, Asn, Asp, Gln, Gly, Lys, or Ser
RXVELAGQSLX

SEQ ID NO: 162128 - protein, 9 aa, Artificial Sequence
  Description of Artificial Sequence: Synthetic peptide
  Seed: RLWGSIQSR (PRAME_HUMAN)
  misc_feature (2)..(2): Xaa can be Arg, Met, Leu, Ile, Gln, Val, Ala, Thr, Ser, Lys, Trp, Gly, Tyr, Phe, Asn, Glu, His, Cys, Asp, or Pro
  misc_feature (9)..(9): Xaa can be Tyr, Leu, Lys, Arg, Ile, Val, Phe, Met, His, Trp, Ala, Thr, Cys, Gln, Ser, Gly, Pro, Asn, Glu, or Asp
RXWGSIQSX

SEQ ID NO: 162129 - protein, 10 aa, Artificial Sequence
  Description of Artificial Sequence: Synthetic peptide
  Seed: RLWGSIQSRY (PRAME_HUMAN)
  misc_feature (2)..(2): Xaa can be Val, Phe, Met, Thr, Ala, Tyr, Gln, Leu, Ile, Trp, Ser, Glu, His, Lys, Asn, Asp, Cys, Gly, Arg, or Pro
  misc_feature (10)..(10): Xaa can be Phe, Tyr, Arg, Lys, Trp, Met, Leu, Ile, Val, Asp, Gln, Gly, Asn, Cys, Ser, Glu, Pro, Thr, His, or Ala
RXWGSIQSRX

SEQ ID NO: 162130 - protein, 11 aa, Artificial Sequence
  Description of Artificial Sequence: Synthetic peptide
  Seed: RLWGSIQSRYI (PRAME_HUMAN)
  misc_feature (2)..(2): Xaa can be Met, Gln, Leu, Ile, Val, Ser, Thr, Ala, Glu, Cys, Asn, Gly, Trp, Tyr, or Phe
  misc_feature (11)..(11): Xaa can be Trp, Phe, Leu, Val, Ile, Tyr, Met, Ala, Gly, Asp, Asn, Cys, Gln, Pro, Thr, Arg, Glu, His, Ser, or Lys
RXWGSIQSRYX

SEQ ID NO: 162131 - protein, 9 aa, Artificial Sequence
  Description of Artificial Sequence: Synthetic peptide
  Seed: RPRRWKLQV (PRAME_HUMAN)
  misc_feature (2)..(2): Xaa can be Pro, Ala, Met, Ser, Val, Leu, Thr, Ile, or Gln
  misc_feature (9)..(9): Xaa can be Leu, Met, Ile, Val, Phe, Ala, His, Glu, Cys, Trp, Gly, Thr, Tyr, Gln, Pro, or Ser
RXRRWKLQX

SEQ ID NO: 162132 - protein, 10 aa, Artificial Sequence
  Description of Artificial Sequence: Synthetic peptide
  Seed: RPRRWKLQVL (PRAME_HUMAN)
  misc_feature (2)..(2): Xaa can be Arg, Pro, Gln, Leu, Met, Lys, Ala, Asn, Glu, Trp, Ile, Gly, Thr, Ser, His, Phe, Cys, Val, Asp, or Tyr
  misc_feature (10)..(10): Xaa can be Met, Phe, Leu, Lys, Arg, Ile, Val, Tyr, Ser, Cys, Thr, Pro, Ala, Gly, Trp, Gln, His, Glu, or Asn
RXRRWKLQVX

SEQ ID NO: 162133 - protein, 11 aa, Artificial Sequence
  Description of Artificial Sequence: Synthetic peptide
  Seed: RPRRWKLQVLD (PRAME_HUMAN)
  misc_feature (2)..(2): Xaa can be , or Pro
  misc_feature (11)..(11): Xaa can be Asn, Arg, Ser, Ala, Thr, Tyr, Ile, Lys, His, Gly, Phe, Met, Asp, Cys, Val, Glu, Leu, Trp, Pro, or Gln
RXRRWKLQVLX

SEQ ID NO: 162134 - protein, 9 aa, Artificial Sequence
  Description of Artificial Sequence: Synthetic peptide
  Seed: RPSMVWLSA (PRAME_HUMAN)
  misc_feature (2)..(2): Xaa can be Pro, Ala, Met, Thr, Ser, Ile, Val, Leu, or Gly
  misc_feature (9)..(9): Xaa can be Leu, Met, Val, Ala, Ile, His, Gln, Cys, Gly, Ser, Trp, Phe, Tyr, Glu, Pro, or Thr
RXSMVWLSX

SEQ ID NO: 162135 - protein, 10 aa, Artificial Sequence
  Description of Artificial Sequence: Synthetic peptide
  Seed: RPSMVWLSAN (PRAME_HUMAN)
  misc_feature (2)..(2): Xaa can be Pro, Leu, Ala, Thr, Ser, Ile, Met, or Val
  misc_feature (10)..(10): Xaa can be Leu, Met, Gly, Lys, Val, Gln, Ser, Asp, Tyr, Cys, Thr, Pro, His, Ala, Asn, Glu, Trp, Phe, Ile, or Arg
RXSMVWLSAX

SEQ ID NO: 162136 - protein, 8 aa, Artificial Sequence
  Description of Artificial Sequence: Synthetic peptide
  Seed: RRLLLSHI (PRAME_HUMAN)
  misc_feature (2)..(2): Xaa can be Arg, Gln, or Met
  misc_feature (8)..(8): Xaa can be Leu, Phe, His, Arg, Met, Val, Lys, Gly, Tyr, Ala, Ile, or Trp
RXLLLSHX

SEQ ID NO: 162137 - protein, 9 aa, Artificial Sequence
  Description of Artificial Sequence: Synthetic peptide
  Seed: RRLLLSHIH (PRAME_HUMAN)
  misc_feature (2)..(2): Xaa can be Arg, Gln, Lys, His, Met, Asn, Ala, Tyr, Phe, Ser, Thr, Gly, Glu, Leu, or Ile
  misc_feature (9)..(9): Xaa can be Leu, Phe, Tyr, Met, Lys, Ile, Val, Arg, Trp, Ala, Gln, Glu, Gly, Asn, Thr, Cys, His, Pro, or Ser
RXLLLSHIX

SEQ ID NO: 162138 - protein, 10 aa, Artificial Sequence
  Description of Artificial Sequence: Synthetic peptide
  Seed: RRLLLSHIHA (PRAME_HUMAN)
  misc_feature (2)..(2): Xaa can be Arg, Gln, or Lys
  misc_feature (10)..(10): Xaa can be Ile, Val, Met, Phe, Leu, Tyr, Lys, Arg, Asp, Glu, Ser, His, Ala, Gln, Asn, Cys, Pro, Trp, Thr, or Gly
RXLLLSHIHX

SEQ ID NO: 162139 - protein, 11 aa, Artificial Sequence
  Description of Artificial Sequence: Synthetic peptide
  Seed: RRLLLSHIHAS (PRAME_HUMAN)
  misc_feature (2)..(2): Xaa can be Arg, Gln, or Lys
  misc_feature (11)..(11): Xaa can be Leu, Met, Phe, Ile, Lys, Val, Thr, Tyr, Gln, Ala, His, Ser, Trp, Arg, Glu, Pro, Gly, Asn, or Cys
RXLLLSHIHAX

SEQ ID NO: 162140 - protein, 9 aa, Artificial Sequence
  Description of Artificial Sequence: Synthetic peptide
  Seed: RRLVELAGQ (PRAME_HUMAN)
  misc_feature (2)..(2): Xaa can be Arg, Gln, Lys, Gly, Ala, Asn, Ser, His, Glu, Asp, Cys, Met, Thr, Ile, Leu, or Val
  misc_feature (9)..(9): Xaa can be Leu, Lys, Arg, Phe, Ile, Tyr, Met, Trp, His, Val, Glu, Pro, Gly, Asn, Gln, Cys, Ala, Thr, or Ser
RXLVELAGX

SEQ ID NO: 162141 - protein, 10 aa, Artificial Sequence
  Description of Artificial Sequence: Synthetic peptide
  Seed: RRLVELAGQS (PRAME_HUMAN)
  misc_feature (2)..(2): Xaa can be Arg, or Gln
  misc_feature (10)..(10): Xaa can be Lys, Arg, Phe, Leu, Tyr, Ala, Thr, Asn, Ser, Gly, Ile, His, Trp, Gln, Met, Cys, or Val
RXLVELAGQX

SEQ ID NO: 162142 - protein, 11 aa, Artificial Sequence
  Description of Artificial Sequence: Synthetic peptide
  Seed: RRLVELAGQSL (PRAME_HUMAN)
  misc_feature (2)..(2): Xaa can be Arg, Gln, His, Lys, Tyr, Ala, or Glu
  misc_feature (11)..(11): Xaa can be Leu, Phe, Tyr, Lys, Ile, Met, Cys, Arg, Ala, Val, Trp, Ser, Asn, Glu, Thr, Pro, Gln, His, or Gly
RXLVELAGQSX

SEQ ID NO: 162143 - protein, 9 aa, Artificial Sequence
  Description of Artificial Sequence: Synthetic peptide
  Seed: RRLWGSIQS (PRAME_HUMAN)
  misc_feature (2)..(2): Xaa can be Arg, Gln, Lys, His, Ala, Met, Glu, Gly, Asn, Ser, Tyr, Thr, Leu, Phe, Val, Trp, Pro, Ile, Asp, or Cys
  misc_feature (9)..(9): Xaa can be Leu, Tyr, Phe, Lys, Met, Arg, Ile, Val, Trp, His, Ala, Gln, Thr, Glu, Pro, Ser, Cys, Asn, or Gly
RXLWGSIQX

SEQ ID NO: 162144 - protein, 10 aa, Artificial Sequence
  Description of Artificial Sequence: Synthetic peptide
  Seed: RRLWGSIQSR (PRAME_HUMAN)
  misc_feature (2)..(2): Xaa can be Arg, Gln, Lys, His, Tyr, Met, Asn, Gly, Ala, Phe, Glu, Thr, Ser, Trp, Leu, Val, Pro, Cys, Ile, or Asp
  misc_feature (10)..(10): Xaa can be Lys, Tyr, Arg, Leu, Phe, His, Met, Val, Ile, Trp, Pro, Gln, Gly, Thr, Asn, Ala, Cys, Ser, or Glu
RXLWGSIQSX

SEQ ID NO: 162145 - protein, 11 aa, Artificial Sequence
  Description of Artificial Sequence: Synthetic peptide
  Seed: RRLWGSIQSRY (PRAME_HUMAN)
  misc_feature (2)..(2): Xaa can be Tyr, Pro, Trp, Cys, Glu, Arg, Met, Asn, Gln, Gly, Ser, Phe, Thr, Asp, Ala, Val, Lys, His, Ile, or Leu
  misc_feature (11)..(11): Xaa can be Lys, Glu, Ser, Ile, Met, Arg, Asp, Thr, Pro, Leu, Val, His, Gly, Gln, Ala, Tyr, Asn, Phe, Trp, or Cys
RXLWGSIQSRX

SEQ ID NO: 162146 - protein, 8 aa, Artificial Sequence
  Description of Artificial Sequence: Synthetic peptide
  Seed: RRRLWGSI (PRAME_HUMAN)
  misc_feature (2)..(2): Xaa can be , or Arg
  misc_feature (8)..(8): Xaa can be Lys, Arg, Trp, Val, Met, Phe, Leu, Tyr, or Ile
RXRLWGSX

SEQ ID NO: 162147 - protein, 9 aa, Artificial Sequence
  Description of Artificial Sequence: Synthetic peptide
  Seed: RRRLWGSIQ (PRAME_HUMAN)
  misc_feature (2)..(2): Xaa can be Arg, Gln, Asn, Gly, Ala, Ser, Thr, or Lys
  misc_feature (9)..(9): Xaa can be Leu, Lys, Phe, Ile, Tyr, Met, Arg, Val, His, Ser, Ala, Glu, Thr, Trp, Gln, Gly, or Cys
RXRLWGSIX

SEQ ID NO: 162148 - protein, 10 aa, Artificial Sequence
  Description of Artificial Sequence: Synthetic peptide
  Seed: RRRLWGSIQS (PRAME_HUMAN)
  misc_feature (2)..(2): Xaa can be Arg, Ser, Glu, Gln, Ile, Phe, Leu, Asp, Asn, Lys, Met, Val, Trp, Cys, Thr, Pro, Gly, His, Tyr, or Ala
  misc_feature (10)..(10): Xaa can be Trp, Tyr, Phe, Val, Leu, Arg, Ile, His, Lys, Met, Ala, Thr, Gly, Gln, Ser, Pro, Glu, Asn, or Cys
RXRLWGSIQX

SEQ ID NO: 162149 - protein, 11 aa, Artificial Sequence
  Description of Artificial Sequence: Synthetic peptide
  Seed: RRRLWGSIQSR (PRAME_HUMAN)
  misc_feature (2)..(2): Xaa can be Arg, Gln, Trp, Met, Lys, Ala, Thr, Pro, Cys, Asn, Leu, Asp, Glu, Tyr, Phe, Val, Gly, His, Ile, or Ser
  misc_feature (11)..(11): Xaa can be Lys, Arg, Phe, Leu, Tyr, Met, Trp, Cys, Asn, Val, Ala, Glu, Thr, Ser, His, Gly, Ile, Pro, or Gln
RXRLWGSIQSX

SEQ ID NO: 162150 - protein, 8 aa, Artificial Sequence
  Description of Artificial Sequence: Synthetic peptide
  Seed: RRWKLQVL (PRAME_HUMAN)
  misc_feature (2)..(2): Xaa can be Arg, His, Gln, Glu, Asp, Tyr, Ala, Lys, Asn, Phe, Pro, Thr, Ser, or Gly
  misc_feature (8)..(8): Xaa can be Leu, Phe, Met, Tyr, Ile, Val, Ala, Lys, Cys, His, Gln, Glu, Ser, Asn, Thr, Trp, Pro, Arg, or Gly
RXWKLQVX

SEQ ID NO: 162151 - protein, 9 aa, Artificial Sequence
  Description of Artificial Sequence: Synthetic peptide
  Seed: RRWKLQVLD (PRAME_HUMAN)
  misc_feature (2)..(2): Xaa can be Arg, Gln, Lys, His, Gly, Asn, Met, Glu, Ala, Leu, Ser, Thr, Val, Ile, Tyr, Asp, Pro, Trp, Cys, or Phe
  misc_feature (9)..(9): Xaa can be Leu, Ile, Lys, Arg, Phe, Met, Val, Tyr, His, Ala, Trp, Cys, Thr, Gln, Pro, Glu, Asn, Gly, Ser, or Asp
RXWKLQVLX

SEQ ID NO: 162152 - protein, 10 aa, Artificial Sequence
  Description of Artificial Sequence: Synthetic peptide
  Seed: RRWKLQVLDL (PRAME_HUMAN)
  misc_feature (2)..(2): Xaa can be Arg, Gln, Lys, His, Glu, or Met
  misc_feature (10)..(10): Xaa can be Leu, Phe, Met, Ile, Tyr, Val, Lys, Arg, Ala, Thr, Trp, Glu, Asp, Cys, Gly, Ser, His, Asn, Gln, or Pro
RXWKLQVLDX

SEQ ID NO: 162153 - protein, 11 aa, Artificial Sequence
  Description of Artificial Sequence: Synthetic peptide
  Seed: RRWKLQVLDLR (PRAME_HUMAN)
  misc_feature (2)..(2): Xaa can be Arg, Gln, Lys, Phe, Met, Ser, Ala, Ile, Leu, Tyr, Val, Trp, Thr, Asn, Cys, Gly, or His
  misc_feature (11)..(11): Xaa can be Arg, Lys, Leu, Ile, Met, Ala, Phe, Tyr, Val, Trp, Gly, Gln, Pro, Ser, Asn, Cys, Asp, Glu, Thr, or His
RXWKLQVLDLX

SEQ ID NO: 162154 - protein, 9 aa, Artificial Sequence
  Description of Artificial Sequence: Synthetic peptide
  Seed: RTFYDPEPI (PRAME_HUMAN)
  misc_feature (2)..(2): Xaa can be Gln, Met, Leu, Ile, Val, Thr, Ala, Ser, Lys, Asn, Phe, Gly, Tyr, His, Glu, Arg, Trp, Cys, Asp, or Pro
  misc_feature (9)..(9): Xaa can be Trp, Phe, Tyr, Met, Leu, Ile, Val, Lys, Arg, His, Ala, Cys, Gly, Thr, Ser, Asn, Pro, or Gl n
RXFYDPEPX

SEQ ID NO: 162155 - protein, 10 aa, Artificial Sequence
  Description of Artificial Sequence: Synthetic peptide
  Seed: RTFYDPEPIL (PRAME_HUMAN)
  misc_feature (2)..(2): Xaa can be Gln, Leu, Met, Val, Thr, Ser, Ala, Ile, Glu, Gly, Cys, Asn, Pro, Asp, Trp, Tyr, or Phe
  misc_feature (10)..(10): Xaa can be Trp, Phe, Leu, Met, Val, Tyr, Ile, Cys, Ala, or Thr
RXFYDPEPIX

SEQ ID NO: 162156 - protein, 11 aa, Artificial Sequence
  Description of Artificial Sequence: Synthetic peptide
  Seed: RTFYDPEPILC (PRAME_HUMAN)
  misc_feature (2)..(2): Xaa can be Ser, Thr, Ala, Cys, Val, Ile, Gly, Met, Asn, Pro, Asp, Gln, Leu, Tyr, His, Arg, Lys, Glu, Trp, or Phe
  misc_feature (11)..(11): Xaa can be Trp, Phe, Tyr, Met, Leu, Ile, Cys, or Val
RXFYDPEPILX

SEQ ID NO: 162157 - protein, 9 aa, Artificial Sequence
  Description of Artificial Sequence: Synthetic peptide
  Seed: RWKLQVLDL (PRAME_HUMAN)
  misc_feature (2)..(2): Xaa can be Arg, Thr, Ser, Val, Tyr, Met, Ile, Ala, Phe, Gln, Trp, Asn, Gly, Leu, Lys, Glu, Asp, Cys, His, or Pro
  misc_feature (9)..(9): Xaa can be Leu, Lys, Ile, Phe, Met, Val, Ala, Arg, Tyr, Ser, Thr, Gly, Cys, Pro, Trp, His, Gln, Asn, or Glu
RXKLQVLDX

SEQ ID NO: 162158 - protein, 10 aa, Artificial Sequence
  Description of Artificial Sequence: Synthetic peptide
  Seed: RWKLQVLDLR (PRAME_HUMAN)
  misc_feature (2)..(2): Xaa can be Leu, Met, Phe, Ile, Ser, Ala, Val, Thr, Trp, Gln, Tyr, Cys, Asn, or Gly
  misc_feature (10)..(10): Xaa can be Arg, or Lys
RXKLQVLDLX

SEQ ID NO: 162159 - protein, 11 aa, Artificial Sequence
  Description of Artificial Sequence: Synthetic peptide
  Seed: RWKLQVLDLRK (PRAME_HUMAN)
  misc_feature (2)..(2): Xaa can be Met, Phe, Val, Tyr, Ile, Leu, Trp, Thr, Cys, Asn, Lys, Arg, His, Gly, Gln, Asp, Ser, Glu, Pro, or Ala
  misc_feature (11)..(11): Xaa can be Arg, Lys, Glu, Ser, Asn, Met, Phe, Leu, Tyr, Cys, Thr, Trp, His, Asp, Val, Gly, Ala, Pro, Ile, or Gln
RXKLQVLDLRX

SEQ ID NO: 162160 - protein, 8 aa, Artificial Sequence
  Description of Artificial Sequence: Synthetic peptide
  Seed: RYISMSVW (PRAME_HUMAN)
  misc_feature (2)..(2): Xaa can be Tyr, Trp, or Phe
  misc_feature (8)..(8): Xaa can be Phe, Trp, Leu, Ile, Met, or Val
RXISMSVX

SEQ ID NO: 162161 - protein, 10 aa, Artificial Sequence
  Description of Artificial Sequence: Synthetic peptide
  Seed: RYISMSVWTS (PRAME_HUMAN)
  misc_feature (2)..(2): Xaa can be Tyr, Trp, Phe, Gln, Met, Thr, Ser, His, Val, Leu, Ala, Ile, Arg, Gly, Cys, Glu, Lys, Pro, Asp, or Asn
  misc_feature (10)..(10): Xaa can be Phe, Trp, Leu, Ile, Met, Val, Tyr, Thr, Ala, Gly, Cys, Ser, Asn, Pro, Asp, or Lys
RXISMSVWTX

SEQ ID NO: 162162 - protein, 9 aa, Artificial Sequence
  Description of Artificial Sequence: Synthetic peptide
  Seed: SALQSLLQH (PRAME_HUMAN)
  misc_feature (2)..(2): Xaa can be Ala, Gln, Thr, Ile, Met, Ser, Leu, Val, Gly, Cys, Asn, Tyr, Glu, Phe, Pro, Asp, Trp, Lys, His, or Arg
  misc_feature (9)..(9): Xaa can be Phe, Tyr, Lys, Met, Arg, Leu, Val, His, Ile, Trp, Ala, Gln, or Cys
SXLQSLLQX

SEQ ID NO: 162163 - protein, 10 aa, Artificial Sequence
  Description of Artificial Sequence: Synthetic peptide
  Seed: SALQSLLQHL (PRAME_HUMAN)
  misc_feature (2)..(2): Xaa can be Leu, Met, Val, Ala, Ile, Gln, Glu, Thr, Asn, Gly, Ser, Cys, His, Lys, Asp, Pro, Trp, Tyr, Phe, or Arg
  misc_feature (10)..(10): Xaa can be Val, Ile, Met, Ala, Leu, Trp, Phe, Tyr, Thr, Cys, or His
SXLQSLLQHX

SEQ ID NO: 162164 - protein, 11 aa, Artificial Sequence
  Description of Artificial Sequence: Synthetic peptide
  Seed: SANPCPHCGDR (PRAME_HUMAN)
  misc_feature (2)..(2): Xaa can be Ala, Ser, Val, Thr, Met, Ile, Gly, Leu, Gln, Phe, Asn, Glu, Asp, Cys, Tyr, or Trp
  misc_feature (11)..(11): Xaa can be Lys, Tyr, Arg, Phe, Met, Leu, His, or Trp
SXNPCPHCGDX

SEQ ID NO: 162165 - protein, 9 aa, Artificial Sequence
  Description of Artificial Sequence: Synthetic peptide
  Seed: SATLQDLVF (PRAME_HUMAN)
  misc_feature (2)..(2): Xaa can be Ala, Val, Arg, Gln, Ser, Thr, Met, Pro, Leu, Ile, Gly, Asn, Asp, Phe, Glu, His, Tyr, Lys, Trp, or Cys
  misc_feature (9)..(9): Xaa can be Tyr, Phe, Trp, Leu, Met, Lys, Arg, Ile, Val, His, or Ala
SXTLQDLVX

SEQ ID NO: 162166 - protein, 8 aa, Artificial Sequence
  Description of Artificial Sequence: Synthetic peptide
  Seed: SEGDVMHL (PRAME_HUMAN)
  misc_feature (2)..(2): Xaa can be Glu, Asp, Arg, Ala, Gln, Ser, Met, Tyr, His, Lys, Gly, Phe, Asn, Thr, Val, Ile, or Leu
  misc_feature (8)..(8): Xaa can be Leu, Met, Ile, Val, Phe, Trp, Tyr, Pro, Ala, Cys, Thr, or Ser
SXGDVMHX

SEQ ID NO: 162167 - protein, 9 aa, Artificial Sequence
  Description of Artificial Sequence: Synthetic peptide
  Seed: SEGDVMHLS (PRAME_HUMAN)
  misc_feature (2)..(2): Xaa can be Glu, Asp, or Gln
  misc_feature (9)..(9): Xaa can be Leu, Ala, Pro, Phe, Cys, Ile, Met, Val, Thr, Gln, Ser, Trp, Tyr, Asn, Lys, Glu, Gly, Asp, or Arg
SXGDVMHLX

SEQ ID NO: 162168 - protein, 10 aa, Artificial Sequence
  Description of Artificial Sequence: Synthetic peptide
  Seed: SEGDVMHLSQ (PRAME_HUMAN)
  misc_feature (2)..(2): Xaa can be Glu, Asp, or Gln
  misc_feature (10)..(10): Xaa can be Ala, Cys, Met, Val, Ile, Leu, Asp, Gly, Gln, Trp, Glu, Thr, Pro, Ser, Tyr, or Phe
SXGDVMHLSX

SEQ ID NO: 162169 - protein, 11 aa, Artificial Sequence
  Description of Artificial Sequence: Synthetic peptide
  Seed: SEGDVMHLSQS (PRAME_HUMAN)
  misc_feature (2)..(2): Xaa can be , or Glu
  misc_feature (11)..(11): Xaa can be Gly, Met, Thr, Ser, Cys, Val, Pro, Ile, Phe, Leu, or Ala
SXGDVMHLSQX

SEQ ID NO: 162170 - protein, 9 aa, Artificial Sequence
  Description of Artificial Sequence: Synthetic peptide
  Seed: SFPEPEAAQ (PRAME_HUMAN)
  misc_feature (2)..(2): Xaa can be Tyr, Phe, Trp, Met, Ala, Ile, Ser, Thr, Arg, Gln, Val, Leu, His, Gly, Cys, Asn, Pro, or Ly s
  misc_feature (9)..(9): Xaa can be Leu, Phe, Met, Tyr, Ile, Val, Trp, His, Cys, Lys, Ala, Arg, Ser, Thr, Gln, or Pro
SXPEPEAAX

SEQ ID NO: 162171 - protein, 11 aa, Artificial Sequence
  Description of Artificial Sequence: Synthetic peptide
  Seed: SFPEPEAAQPM (PRAME_HUMAN)
  misc_feature (2)..(2): Xaa can be Arg, Tyr, Ala, Phe, Gly, Val, Gln, Trp, Ser, Leu, Met, Thr, Ile, His, Cys, Lys, Glu, Pro, or Asn
  misc_feature (11)..(11): Xaa can be Leu, Met, Phe, Ile, Tyr, Val, Lys, Trp, His, Cys, Arg, or Ala
SXPEPEAAQPX

SEQ ID NO: 162172 - protein, 9 aa, Artificial Sequence
  Description of Artificial Sequence: Synthetic peptide
  Seed: SFYGNSISI (PRAME_HUMAN)
  misc_feature (2)..(2): Xaa can be Arg, Ala, Gln, Tyr, Met, Phe, Ser, Leu, Ile, Val, Thr, Asn, Trp, Pro, Gly, Lys, Glu, His, Cys, or Asp
  misc_feature (9)..(9): Xaa can be Tyr, Phe, Met, Val, Ile, Ala, Leu, Lys, His, Arg, Trp, Cys, Thr, Gly, Gln, Ser, Asn, Pro, or Glu
SXYGNSISX

SEQ ID NO: 162173 - protein, 10 aa, Artificial Sequence
  Description of Artificial Sequence: Synthetic peptide
  Seed: SGNRASLYSF (PRAME_HUMAN)
  misc_feature (2)..(2): Xaa can be Gln, Thr, Ser, Met, Leu, Ala, Glu, Lys, Asn, Arg, Val, His, Ile, Gly, Phe, Tyr, Cys, Trp, Asp, or Pro
  misc_feature (10)..(10): Xaa can be Phe, Tyr, Trp, Met, Leu, Ile, His, or Val
SXNRASLYSX

SEQ ID NO: 162174 - protein, 9 aa, Artificial Sequence
  Description of Artificial Sequence: Synthetic peptide
  Seed: SHCSQLTTL (PRAME_HUMAN)
  misc_feature (2)..(2): Xaa can be Arg, His, Gln, Ala, Lys, Glu, Tyr, Asn, Val, Asp, Thr, Leu, Gly, Met, Ser, Pro, Ile, Phe, Trp, or Cys
  misc_feature (9)..(9): Xaa can be Tyr, Met, Phe, Leu, Val, Ile, Trp, Ala, His, Cys, Thr, Pro, Ser, Gly, Arg, or Lys
SXCSQLTTX

SEQ ID NO: 162175 - protein, 11 aa, Artificial Sequence
  Description of Artificial Sequence: Synthetic peptide
  Seed: SHCSQLTTLSF (PRAME_HUMAN)
  misc_feature (2)..(2): Xaa can be His, Gln, Tyr, Arg, Thr, Met, Ser, Lys, Ile, Asn, Asp, Pro, Glu, Trp, Gly, Phe, Leu, Cys, Ala, or Val
  misc_feature (11)..(11): Xaa can be Trp, Phe, Tyr, Met, Leu, Val, Ile, or Cys
SXCSQLTTLSX

SEQ ID NO: 162176 - protein, 8 aa, Artificial Sequence
  Description of Artificial Sequence: Synthetic peptide
  Seed: SHIHASSY (PRAME_HUMAN)
  misc_feature (2)..(2): Xaa can be Gln, Met, His, Tyr, Lys, Arg, Glu, Asn, Pro, Leu, Val, Ile, Phe, Ser, Thr, Ala, Gly, or As p
  misc_feature (8)..(8): Xaa can be Tyr, Phe, Met, Leu, Trp, Ile, His, Ala, or Val
SXIHASSX

SEQ ID NO: 162177 - protein, 9 aa, Artificial Sequence
  Description of Artificial Sequence: Synthetic peptide
  Seed: SHIHASSYI (PRAME_HUMAN)
  misc_feature (2)..(2): Xaa can be Tyr, His, Gln, Phe, Met, Lys, Arg, Ala, Trp, Glu, Leu, Ser, Val, Ile, Thr, Gly, Pro, Asn, or Cys
  misc_feature (9)..(9): Xaa can be Tyr, Phe, Met, Leu, Ile, Trp, Val, Ala, His, Cys, Thr, Ser, Gly, Gln, or Pro
SXIHASSYX

SEQ ID NO: 162178 - protein, 10 aa, Artificial Sequence
  Description of Artificial Sequence: Synthetic peptide
  Seed: SHIHASSYIS (PRAME_HUMAN)
  misc_feature (2)..(2): Xaa can be His, or Arg
  misc_feature (10)..(10): Xaa can be Cys, Val, Ala, Thr, Ile, Met, Leu, Ser, or Pro
SXIHASSYIX

SEQ ID NO: 162179 - protein, 8 aa, Artificial Sequence
  Description of Artificial Sequence: Synthetic peptide
  Seed: SHQDFWTV (PRAME_HUMAN)
  misc_feature (2)..(2): Xaa can be His, or Arg
  misc_feature (8)..(8): Xaa can be Val, Ala, Leu, Trp, Phe, Ile, Met, Cys, or Thr
SXQDFWTX

SEQ ID NO: 162180 - protein, 9 aa, Artificial Sequence
  Description of Artificial Sequence: Synthetic peptide
  Seed: SHQDFWTVW (PRAME_HUMAN)
  misc_feature (2)..(2): Xaa can be His, Tyr, Gln, Phe, Arg, Trp, Met, Lys, Glu, Ser, Asn, Val, Thr, Pro, Ile, Leu, Ala, or Gl y
  misc_feature (9)..(9): Xaa can be Phe, Tyr, Trp, Leu, Met, Ile, Val, Ala, Cys, Thr, His, or Gly
SXQDFWTVX

SEQ ID NO: 162181 - protein, 9 aa, Artificial Sequence
  Description of Artificial Sequence: Synthetic peptide
  Seed: SIEDLEVTC (PRAME_HUMAN)
  misc_feature (2)..(2): Xaa can be Ala, Thr, Ile, Ser, Val, Leu, Phe, Met, Cys, Gly, Asp, Asn, Pro, Gln, Trp, Tyr, Glu, or Hi s
  misc_feature (9)..(9): Xaa can be Leu, Met, Val, Phe, Ile, Tyr, Cys, Trp, Ala, or Thr
SXEDLEVTX

SEQ ID NO: 162182 - protein, 11 aa, Artificial Sequence
  Description of Artificial Sequence: Synthetic peptide
  Seed: SIEDLEVTCTW (PRAME_HUMAN)
  misc_feature (2)..(2): Xaa can be Thr, Leu, Glu, Gln, Met, Ser, Ile, Val, Ala, Pro, Gly, Asn, Trp, Phe, Tyr, Cys, Asp, Lys, Arg, or His
  misc_feature (11)..(11): Xaa can be Trp, Tyr, Lys, Phe, Arg, Leu, His, Met, Ile, Val, or Gln
SXEDLEVTCTX

SEQ ID NO: 162183 - protein, 9 aa, Artificial Sequence
  Description of Artificial Sequence: Synthetic peptide
  Seed: SIQSRYISM (PRAME_HUMAN)
  misc_feature (2)..(2): Xaa can be Pro, Met, Tyr, Arg, Ala, Gln, Leu, Ser, Phe, Gly, Ile, Val, Thr, Asn, Glu, Trp, His, Lys, Cys, or Asp
  misc_feature (9)..(9): Xaa can be Tyr, Phe, Met, Val, Leu, Ile, Arg, Trp, Ala, Lys, Cys, His, Thr, Ser, Gly, Gln, or Pro
SXQSRYISX

SEQ ID NO: 162184 - protein, 11 aa, Artificial Sequence
  Description of Artificial Sequence: Synthetic peptide
  Seed: SIQSRYISMSV (PRAME_HUMAN)
  misc_feature (2)..(2): Xaa can be Tyr, Thr, Val, Arg, Phe, Trp, Lys, Met, Gly, Leu, Cys, Pro, Gln, Ile, Glu, Asp, Ala, His, Ser, or Asn
  misc_feature (11)..(11): Xaa can be Leu, Lys, Val, Met, Ile, Ala, Ser, Tyr, Gly, Thr, or Arg
SXQSRYISMSX

SEQ ID NO: 162185 - protein, 8 aa, Artificial Sequence
  Description of Artificial Sequence: Synthetic peptide
  Seed: SISALQSL (PRAME_HUMAN)
  misc_feature (2)..(2): Xaa can be Val, Ile, Thr, Ala, or Ser
  misc_feature (8)..(8): Xaa can be , or Leu
SXSALQSX

SEQ ID NO: 162186 - protein, 9 aa, Artificial Sequence
  Description of Artificial Sequence: Synthetic peptide
  Seed: SISALQSLL (PRAME_HUMAN)
  misc_feature (2)..(2): Xaa can be Met, Gln, Leu, Thr, Arg, Ser, Ala, Ile, Val, Gly, Glu, Asn, Phe, Tyr, Asp, Cys, Lys, His, Trp, or Pro
  misc_feature (9)..(9): Xaa can be Tyr, Phe, Leu, Lys, Met, Arg, Trp, Ile, Val, Ala, His, Thr, Cys, Gly, Ser, or Gln
SXSALQSLX

SEQ ID NO: 162187 - protein, 10 aa, Artificial Sequence
  Description of Artificial Sequence: Synthetic peptide
  Seed: SISISALQSL (PRAME_HUMAN)
  misc_feature (2)..(2): Xaa can be Leu, Met, Gln, Ile, Thr, Val, Phe, Trp, His, Cys, Glu, Asp, Asn, Pro, Ala, Lys, Tyr, Arg, Gly, or Ser
  misc_feature (10)..(10): Xaa can be Phe, Ile, Tyr, Val, Trp, Met, Leu, Ala, Thr, Cys, or Ser
SXSISALQSX

SEQ ID NO: 162188 - protein, 8 aa, Artificial Sequence
  Description of Artificial Sequence: Synthetic peptide
  Seed: SLFFLRGR (PRAME_HUMAN)
  misc_feature (2)..(2): Xaa can be Met, Phe, Thr, Trp, Tyr, Val, Ile, Gly, Gln, Ser, Ala, or Leu
  misc_feature (8)..(8): Xaa can be Arg, or Lys
SXFFLRGX

SEQ ID NO: 162189 - protein, 9 aa, Artificial Sequence
  Description of Artificial Sequence: Synthetic peptide
  Seed: SLFFLRGRL (PRAME_HUMAN)
  misc_feature (2)..(2): Xaa can be Leu, Met, Thr, Ile, Val, Gln, Ala, Ser, Asn, Gly, Phe, or Tyr
  misc_feature (9)..(9): Xaa can be Arg, Trp, Lys, Tyr, Phe, Val, Leu, Ile, Met, or Ala
SXFFLRGRX

SEQ ID NO: 162190 - protein, 9 aa, Artificial Sequence
  Description of Artificial Sequence: Synthetic peptide
  Seed: SLLKDEALA (PRAME_HUMAN)
  misc_feature (2)..(2): Xaa can be Met, Ile, Leu, Val, Gln, Thr, Ser, or Ala
  misc_feature (9)..(9): Xaa can be Val, Leu, Ile, Ala, or Met
SXLKDEALX

SEQ ID NO: 162191 - protein, 10 aa, Artificial Sequence
  Description of Artificial Sequence: Synthetic peptide
  Seed: SLLKDEALAI (PRAME_HUMAN)
  misc_feature (2)..(2): Xaa can be Gln, Met, Leu, Val, Ala, Ser, Ile, Glu, Thr, Lys, Phe, Gly, Asp, Cys, Asn, Arg, Tyr, Trp, His, or Pro
  misc_feature (10)..(10): Xaa can be Leu, Val, Ile, Ala, Trp, Phe, Met, Thr, Tyr, or Cys
SXLKDEALAX

SEQ ID NO: 162192 - protein, 11 aa, Artificial Sequence
  Description of Artificial Sequence: Synthetic peptide
  Seed: SLLKDEALAIA (PRAME_HUMAN)
  misc_feature (2)..(2): Xaa can be Leu, Met, Gln, Val, Phe, Tyr, Ile, Trp, Ala, Thr, Arg, Ser, Lys, or Gly
  misc_feature (11)..(11): Xaa can be Val, Leu, Ala, Ile, Met, or Thr
SXLKDEALAIX

SEQ ID NO: 162193 - protein, 9 aa, Artificial Sequence
  Description of Artificial Sequence: Synthetic peptide
  Seed: SLLQHLIGL (PRAME_HUMAN)
  misc_feature (2)..(2): Xaa can be Arg, Leu, Met, Gln, Val, Ala, Ile, Thr, Glu, Ser, Asn, His, Tyr, Pro, Cys, Phe, Gly, Trp, Lys, or Asp
  misc_feature (9)..(9): Xaa can be Lys, Arg, Tyr, Met, Phe, Val, Ile, Leu, Trp, Ala, His, Cys, Thr, Pro, Ser, Gln, Gly, Glu, or Asn
SXLQHLIGX

SEQ ID NO: 162194 - protein, 10 aa, Artificial Sequence
  Description of Artificial Sequence: Synthetic peptide
  Seed: SLLQHLIGLS (PRAME_HUMAN)
  misc_feature (2)..(2): Xaa can be Leu, Met, Gln, Trp, Tyr, Lys, Ala, Asn, Ile, Glu, Asp, Gly, Pro, Arg, His, Ser, Val, Cys, Thr, or Phe
  misc_feature (10)..(10): Xaa can be Ala, Leu, Val, Ile, Thr, Cys, Met, Phe, His, Lys, Gln, Glu, Ser, Pro, Asp, Arg, Tyr, Trp, Gly, or Asn
SXLQHLIGLX

SEQ ID NO: 162195 - protein, 9 aa, Artificial Sequence
  Description of Artificial Sequence: Synthetic peptide
  Seed: SLQCLQALY (PRAME_HUMAN)
  misc_feature (2)..(2): Xaa can be Ala, Gln, Met, Thr, Ser, Leu, Val, Ile, Phe, Glu, Lys, Trp, Gly, Tyr, Arg, Asn, His, Pro, Asp, or Cys
  misc_feature (9)..(9): Xaa can be Tyr, Phe, Lys, Arg, Met, Trp, Leu, His, Ile, or Val
SXQCLQALX

SEQ ID NO: 162196 - protein, 10 aa, Artificial Sequence
  Description of Artificial Sequence: Synthetic peptide
  Seed: SLQCLQALYV (PRAME_HUMAN)
  misc_feature (2)..(2): Xaa can be Leu, Met, Ile, Val, Gln, Phe, Thr, Ser, or Ala
  misc_feature (10)..(10): Xaa can be Val, Ile, Leu, Met, Ala, or Thr
SXQCLQALYX

SEQ ID NO: 162197 - protein, 11 aa, Artificial Sequence
  Description of Artificial Sequence: Synthetic peptide
  Seed: SLQCLQALYVD (PRAME_HUMAN)
  misc_feature (2)..(2): Xaa can be Leu, Met, Val, Ile, or Gln
  misc_feature (11)..(11): Xaa can be Val, Met, Ala, Phe, Leu, Thr, Ile, Cys, His, Ser, Trp, Tyr, Glu, Gly, Gln, Pro, Lys, Asp, Asn, or Arg
SXQCLQALYVX

SEQ ID NO: 162198 - protein, 10 aa, Artificial Sequence
  Description of Artificial Sequence: Synthetic peptide
  Seed: SLSGVMLTDV (PRAME_HUMAN)
  misc_feature (2)..(2): Xaa can be Leu, Met, Gln, Val, Ile, Thr, Ala, or Ser
  misc_feature (10)..(10): Xaa can be Val, Leu, Ile, Ala, Met, Ser, or Thr
SXSGVMLTDX

SEQ ID NO: 162199 - protein, 11 aa, Artificial Sequence
  Description of Artificial Sequence: Synthetic peptide
  Seed: SLSGVMLTDVS (PRAME_HUMAN)
  misc_feature (2)..(2): Xaa can be Met, Leu, Gln, Val, or Ile
  misc_feature (11)..(11): Xaa can be Val, Ser, Asp, Gly, Ile, Lys, Leu, Thr, Met, Trp, His, Asn, Tyr, Arg, Gln, Cys, Pro, Glu, Phe, or Ala
SXSGVMLTDVX

SEQ ID NO: 162200 - protein, 9 aa, Artificial Sequence
  Description of Artificial Sequence: Synthetic peptide
  Seed: SLSHCSQLT (PRAME_HUMAN)
  misc_feature (2)..(2): Xaa can be Met, Leu, Gln, Val, Ile, Thr, Ala, or Ser
  misc_feature (9)..(9): Xaa can be Val, Ile, Leu, Ala, Met, Thr, or Phe
SXSHCSQLX

SEQ ID NO: 162201 - protein, 10 aa, Artificial Sequence
  Description of Artificial Sequence: Synthetic peptide
  Seed: SLSHCSQLTT (PRAME_HUMAN)
  misc_feature (2)..(2): Xaa can be Met, Leu, Val, Ile, Gln, Thr, Ser, or Ala
  misc_feature (10)..(10): Xaa can be Val, Leu, Ile, Ala, Thr, or Met
SXSHCSQLTX

SEQ ID NO: 162202 - protein, 11 aa, Artificial Sequence
  Description of Artificial Sequence: Synthetic peptide
  Seed: SLSHCSQLTTL (PRAME_HUMAN)
  misc_feature (2)..(2): Xaa can be Met, Gln, Leu, Val, Ile, or Glu
  misc_feature (11)..(11): Xaa can be Phe, Trp, Val, Leu, Ile, Met, Ala, or Tyr
SXSHCSQLTTX

SEQ ID NO: 162203 - protein, 10 aa, Artificial Sequence
  Description of Artificial Sequence: Synthetic peptide
  Seed: SLYSFPEPEA (PRAME_HUMAN)
  misc_feature (2)..(2): Xaa can be Met, Leu, Val, Ile, Gln, Ala, Thr, Ser, or Phe
  misc_feature (10)..(10): Xaa can be Val, Leu, Ile, Ala, Met, Thr, Gly, Phe, Ser, or Cys
SXYSFPEPEX

SEQ ID NO: 162204 - protein, 11 aa, Artificial Sequence
  Description of Artificial Sequence: Synthetic peptide
  Seed: SLYSFPEPEAA (PRAME_HUMAN)
  misc_feature (2)..(2): Xaa can be Leu, Met, Ile, Val, Thr, or Gln
  misc_feature (11)..(11): Xaa can be Val, Ile, Leu, Met, Ala, Cys, or Thr
SXYSFPEPEAX

SEQ ID NO: 162205 - protein, 9 aa, Artificial Sequence
  Description of Artificial Sequence: Synthetic peptide
  Seed: SMSVWTSPR (PRAME_HUMAN)
  misc_feature (2)..(2): Xaa can be Thr, Val, Met, Leu, Ala, Ile, Ser, Tyr, Phe, Gln, Trp, Gly, His, Glu, Cys, Asp, Asn, Arg, Pro, or Lys
  misc_feature (9)..(9): Xaa can be Arg, Tyr, Lys, Phe, Met, His, Leu, Val, Ile, Ala, Trp, or Gln
SXSVWTSPX

SEQ ID NO: 162206 - protein, 10 aa, Artificial Sequence
  Description of Artificial Sequence: Synthetic peptide
  Seed: SMSVWTSPRR (PRAME_HUMAN)
  misc_feature (2)..(2): Xaa can be Tyr, Thr, Phe, Val, Leu, Met, Ser, Ile, Gln, Trp, Ala, Arg, Gly, Asn, Lys, Pro, Asp, Cys, His, or Glu
  misc_feature (10)..(10): Xaa can be Lys, Arg, Tyr, His, Trp, Gln, Ser, Ala, Asp, Gly, Leu, Pro, Asn, Thr, Glu, Ile, Cys, Met, Val, or Phe
SXSVWTSPRX

SEQ ID NO: 162207 - protein, 11 aa, Artificial Sequence
  Description of Artificial Sequence: Synthetic peptide
  Seed: SMSVWTSPRRL (PRAME_HUMAN)
  misc_feature (2)..(2): Xaa can be Met, Leu, or Ile
  misc_feature (11)..(11): Xaa can be Val, Ala, Ile, or Leu
SXSVWTSPRRX

SEQ ID NO: 162208 - protein, 9 aa, Artificial Sequence
  Description of Artificial Sequence: Synthetic peptide
  Seed: SMVWLSANP (PRAME_HUMAN)
  misc_feature (2)..(2): Xaa can be Met, Leu, Val, Gln, Ile, Thr, Ser, or Ala
  misc_feature (9)..(9): Xaa can be Val, Ile, Ala, Leu, Ser, Thr, Met, or Pro
SXVWLSANX

SEQ ID NO: 162209 - protein, 10 aa, Artificial Sequence
  Description of Artificial Sequence: Synthetic peptide
  Seed: SMVWLSANPC (PRAME_HUMAN)
  misc_feature (2)..(2): Xaa can be Met, Leu, Ile, Phe, Gln, Val, Tyr, Thr, Trp, Lys, Cys, Asp, Pro, Glu, Ala, Gly, His, Arg, Ser, or Asn
  misc_feature (10)..(10): Xaa can be Val, Ile, Leu, Ala, Met, Thr, or Cys
SXVWLSANPX

SEQ ID NO: 162210 - protein, 10 aa, Artificial Sequence
  Description of Artificial Sequence: Synthetic peptide
  Seed: SNLTHVLYPV (PRAME_HUMAN)
  misc_feature (2)..(2): Xaa can be Leu, Met, Gln, Tyr, Phe, Val, Ile, Thr, Trp, Lys, Glu, Ala, Cys, Ser, His, Asn, Pro, Asp, Arg, or Gly
  misc_feature (10)..(10): Xaa can be Val, Ala, Thr, Met, Leu, Ile, Cys, Ser, Phe, Pro, or Gly
SXLTHVLYPX

SEQ ID NO: 162211 - protein, 11 aa, Artificial Sequence
  Description of Artificial Sequence: Synthetic peptide
  Seed: SNLTHVLYPVP (PRAME_HUMAN)
  misc_feature (2)..(2): Xaa can be Gly, Lys, Tyr, Ile, Ser, Ala, Val, Arg, Asn, Glu, Gln, Thr, His, Leu, Cys, Met, Phe, Asp, Pro, or Trp
  misc_feature (11)..(11): Xaa can be Arg, Thr, Met, Glu, Asp, Pro, Phe, Lys, Trp, Val, His, Ala, Gln, Ile, Tyr, Gly, Cys, Asn, Ser, or Leu
SXLTHVLYPVX

SEQ ID NO: 162212 - protein, 8 aa, Artificial Sequence
  Description of Artificial Sequence: Synthetic peptide
  Seed: SPEKEEQY (PRAME_HUMAN)
  misc_feature (2)..(2): Xaa can be , or Pro
  misc_feature (8)..(8): Xaa can be , or Tyr
SXEKEEQX

SEQ ID NO: 162213 - protein, 9 aa, Artificial Sequence
  Description of Artificial Sequence: Synthetic peptide
  Seed: SPEKEEQYI (PRAME_HUMAN)
  misc_feature (2)..(2): Xaa can be Pro, or Ala
  misc_feature (9)..(9): Xaa can be Ile, Tyr, Leu, Phe, Met, or Val
SXEKEEQYX

SEQ ID NO: 162214 - protein, 10 aa, Artificial Sequence
  Description of Artificial Sequence: Synthetic peptide
  Seed: SPEKEEQYIA (PRAME_HUMAN)
  misc_feature (2)..(2): Xaa can be Thr, Gln, Tyr, Phe, Leu, Asn, Pro, Val, Ala, Trp, Ser, Met, Glu, His, Asp, Cys, Ile, Arg, Lys, or Gly
  misc_feature (10)..(10): Xaa can be , or Ala
SXEKEEQYIX

SEQ ID NO: 162215 - protein, 8 aa, Artificial Sequence
  Description of Artificial Sequence: Synthetic peptide
  Seed: SPEPLQAL (PRAME_HUMAN)
  misc_feature (2)..(2): Xaa can be Pro, Arg, Tyr, Ala, His, Phe, Gln, Ser, Thr, Glu, Val, Asn, Leu, Lys, Trp, Ile, Met, Gly, or Asp
  misc_feature (8)..(8): Xaa can be Leu, Met, Ile, Phe, Val, Thr, Tyr, Pro, or Ala
SXEPLQAX

SEQ ID NO: 162216 - protein, 9 aa, Artificial Sequence
  Description of Artificial Sequence: Synthetic peptide
  Seed: SPEPLQALL (PRAME_HUMAN)
  misc_feature (2)..(2): Xaa can be Pro, Phe, Ala, Arg, Tyr, Thr, Gly, Val, Ile, Trp, Ser, Met, Cys, Leu, Gln, Asn, Glu, His, Asp, or Lys
  misc_feature (9)..(9): Xaa can be Phe, Met, Leu, Val, Ile, Trp, Tyr, Cys, Ala, Ser, His, Thr, Pro, or Gly
SXEPLQALX

SEQ ID NO: 162217 - protein, 8 aa, Artificial Sequence
  Description of Artificial Sequence: Synthetic peptide
  Seed: SPRRLVEL (PRAME_HUMAN)
  misc_feature (2)..(2): Xaa can be Pro, Met, His, Ala, Arg, Leu, Gln, Ile, Phe, Glu, Ser, Lys, Gly, Asn, Thr, or Val
  misc_feature (8)..(8): Xaa can be Leu, Met, Ile, Val, Phe, Ser, Ala, Pro, Gly, Cys, Thr, or Tyr
SXRRLVEX

SEQ ID NO: 162218 - protein, 9 aa, Artificial Sequence
  Description of Artificial Sequence: Synthetic peptide
  Seed: SPRRLVELA (PRAME_HUMAN)
  misc_feature (2)..(2): Xaa can be Pro, Ala, Ile, Met, Leu, Val, Gln, Phe, Ser, Gly, Thr, Cys, or Asn
  misc_feature (9)..(9): Xaa can be Leu, Met, Ile, Val, Phe, Ala, Cys, Ser, Trp, Tyr, Gly, Pro, or Thr
SXRRLVELX

SEQ ID NO: 162219 - protein, 10 aa, Artificial Sequence
  Description of Artificial Sequence: Synthetic peptide
  Seed: SPRRLVELAG (PRAME_HUMAN)
  misc_feature (2)..(2): Xaa can be Pro, Val, Ile, or Ala
  misc_feature (10)..(10): Xaa can be Met, Leu, Thr, Ile, Ala, Gly, Trp, Phe, Val, Ser, Pro, Tyr, or Cys
SXRRLVELAX

SEQ ID NO: 162220 - protein, 9 aa, Artificial Sequence
  Description of Artificial Sequence: Synthetic peptide
  Seed: SPSVSQLSV (PRAME_HUMAN)
  misc_feature (2)..(2): Xaa can be Pro, His, Ala, Val, Arg, Ile, Ser, Thr, Gly, Gln, Met, Glu, Cys, Leu, Phe, Asn, or Lys
  misc_feature (9)..(9): Xaa can be Leu, Met, Ile, Val, Tyr, Trp, Ala, Phe, Cys, Thr, Pro, Gly, Ser, Arg, or His
SXSVSQLSX

SEQ ID NO: 162221 - protein, 10 aa, Artificial Sequence
  Description of Artificial Sequence: Synthetic peptide
  Seed: SPSVSQLSVL (PRAME_HUMAN)
  misc_feature (2)..(2): Xaa can be Pro, Ser, Thr, Met, Asn, His, Trp, Glu, Cys, Lys, Gln, Gly, Val, Arg, Ile, Asp, Leu, Ala, Tyr, or Phe
  misc_feature (10)..(10): Xaa can be Trp, Phe, Tyr, Met, Leu, Ile, Thr, Val, Ala, Cys, Gly, Pro, or Ser
SXSVSQLSVX

SEQ ID NO: 162222 - protein, 8 aa, Artificial Sequence
  Description of Artificial Sequence: Synthetic peptide
  Seed: SPYLGQMI (PRAME_HUMAN)
  misc_feature (2)..(2): Xaa can be Pro, Gln, Glu, Ala, Gly, Ser, Ile, Thr, Asp, Met, Asn, Lys, Val, His, Leu, or Phe
  misc_feature (8)..(8): Xaa can be Ile, Val, Leu, Met, Phe, Cys, Ala, Thr, Gly, Pro, Tyr, or Ser
SXYLGQMX

SEQ ID NO: 162223 - protein, 9 aa, Artificial Sequence
  Description of Artificial Sequence: Synthetic peptide
  Seed: SPYLGQMIN (PRAME_HUMAN)
  misc_feature (2)..(2): Xaa can be Pro, Ala, or Val
  misc_feature (9)..(9): Xaa can be Ala, Val, Lys, Gly, Pro, Tyr, Arg, Ile, Ser, Cys, Thr, His, Leu, Met, Gln, Glu, Phe, or As n
SXYLGQMIX

SEQ ID NO: 162224 - protein, 10 aa, Artificial Sequence
  Description of Artificial Sequence: Synthetic peptide
  Seed: SPYLGQMINL (PRAME_HUMAN)
  misc_feature (2)..(2): Xaa can be Pro, Ala, Tyr, Cys, Arg, Glu, Asn, Leu, Val, Asp, Ser, His, Trp, Ile, Lys, Met, Gln, Thr, Phe, or Gly
  misc_feature (10)..(10): Xaa can be Phe, Met, Ile, Val, Leu, Trp, Tyr, Gly, Ala, Thr, Ser, Cys, or Pro
SXYLGQMINX

SEQ ID NO: 162225 - protein, 8 aa, Artificial Sequence
  Description of Artificial Sequence: Synthetic peptide
  Seed: SQFLSLQC (PRAME_HUMAN)
  misc_feature (2)..(2): Xaa can be Gln, Glu, Ala, Ser, Lys, Ile, Asp, His, Val, Pro, Gly, Thr, Leu, Met, Asn, Arg, or Phe
  misc_feature (8)..(8): Xaa can be Val, Ile, Leu, Met, Phe, Ala, Thr, or Cys
SXFLSLQX

SEQ ID NO: 162226 - protein, 9 aa, Artificial Sequence
  Description of Artificial Sequence: Synthetic peptide
  Seed: SQFLSLQCL (PRAME_HUMAN)
  misc_feature (2)..(2): Xaa can be Glu, His, Arg, Gln, Met, Asp, Leu, Thr, Ile, Ala, Val, Lys, Ser, Asn, Pro, Gly, Phe, Tyr, Cys, or Trp
  misc_feature (9)..(9): Xaa can be Phe, Tyr, Met, Leu, Ile, Val, Ala, Trp, His, Cys, Thr, Pro, Ser, Gly, Lys, Arg, Glu, Gln, or Asp
SXFLSLQCX

SEQ ID NO: 162227 - protein, 8 aa, Artificial Sequence
  Description of Artificial Sequence: Synthetic peptide
  Seed: SQLSVLSL (PRAME_HUMAN)
  misc_feature (2)..(2): Xaa can be His, Glu, Gln, Arg, Asp, Ser, Met, Lys, Ala, Ile, Leu, Thr, Val, Gly, Asn, Phe, Pro, or Ty r
  misc_feature (8)..(8): Xaa can be Ile, Tyr, Val, Leu, Phe, Met, Ala, Cys, Thr, Pro, Ser, Trp, or Gly
SXLSVLSX

SEQ ID NO: 162228 - protein, 9 aa, Artificial Sequence
  Description of Artificial Sequence: Synthetic peptide
  Seed: SQLSVLSLS (PRAME_HUMAN)
  misc_feature (2)..(2): Xaa can be Leu, Gln, Met, Val, Thr, Ile, Ala, Ser, Gly, Asn, Cys, Phe, Glu, or Trp
  misc_feature (9)..(9): Xaa can be Val, Ile, Met, Leu, Ala, Thr, Cys, Phe, or Ser
SXLSVLSLX

SEQ ID NO: 162229 - protein, 11 aa, Artificial Sequence
  Description of Artificial Sequence: Synthetic peptide
  Seed: SQLSVLSLSGV (PRAME_HUMAN)
  misc_feature (2)..(2): Xaa can be Leu, Met, Gln, Phe, Tyr, Ile, Val, Lys, Thr, Gly, His, Arg, Ser, Ala, or Trp
  misc_feature (11)..(11): Xaa can be Val, Ile, Leu, Ala, or Met
SXLSVLSLSGX

SEQ ID NO: 162230 - protein, 8 aa, Artificial Sequence
  Description of Artificial Sequence: Synthetic peptide
  Seed: SQLTTLSF (PRAME_HUMAN)
  misc_feature (2)..(2): Xaa can be Gln, Met, Leu, Ala, Glu, Ser, Val, Thr, Pro, Asn, Lys, Asp, Ile, Gly, His, Tyr, Arg, or Ph e
  misc_feature (8)..(8): Xaa can be Tyr, Phe, Ile, Val, Leu, Met, Trp, Ala, or Cys
SXLTTLSX

SEQ ID NO: 162231 - protein, 9 aa, Artificial Sequence
  Description of Artificial Sequence: Synthetic peptide
  Seed: SQLTTLSFY (PRAME_HUMAN)
  misc_feature (2)..(2): Xaa can be Leu, Gln, Met, Glu, Arg, Thr, Ala, Ser, Ile, Val, Tyr, Phe, Lys, Asp, Asn, Gly, Pro, His, Trp, or Cys
  misc_feature (9)..(9): Xaa can be Tyr, Phe, Arg, Lys, Met, Leu, Trp, Val, His, Ile, or Ala
SXLTTLSFX

SEQ ID NO: 162232 - protein, 10 aa, Artificial Sequence
  Description of Artificial Sequence: Synthetic peptide
  Seed: SQLTTLSFYG (PRAME_HUMAN)
  misc_feature (2)..(2): Xaa can be Ser, Gln, Val, Met, Thr, Lys, Glu, Leu, His, Asn, Gly, Cys, Phe, Asp, Pro, Ala, Trp, Tyr, Ile, or Arg
  misc_feature (10)..(10): Xaa can be Phe, Tyr, Met, Leu, Thr, Pro, Asp, Trp, Glu, Asn, Gln, Lys, Arg, Ala, Cys, Val, Ile, His, Gly, or Ser
SXLTTLSFYX

SEQ ID NO: 162233 - protein, 9 aa, Artificial Sequence
  Description of Artificial Sequence: Synthetic peptide
  Seed: SQSPSVSQL (PRAME_HUMAN)
  misc_feature (2)..(2): Xaa can be Glu, Ala, Arg, His, Tyr, Met, Val, Ser, Gln, Leu, Ile, Asp, Phe, Thr, Gly, Pro, Trp, Asn, Cys, or Lys
  misc_feature (9)..(9): Xaa can be Trp, Tyr, Phe, Lys, Met, Leu, Val, Ile, Arg, His, Ala, Cys, Thr, Ser, Gln, Pro, Gly, Glu, Asn, or Asp
SXSPSVSQX

SEQ ID NO: 162234 - protein, 11 aa, Artificial Sequence
  Description of Artificial Sequence: Synthetic peptide
  Seed: SQSPSVSQLSV (PRAME_HUMAN)
  misc_feature (2)..(2): Xaa can be Gln, Arg, Met, Leu, Ile, Val, Ala, Glu, His, Asn, Thr, Tyr, Lys, Gly, Ser, Phe, Pro, Asp, Cys, or Trp
  misc_feature (11)..(11): Xaa can be Leu, Met, Phe, Trp, Ile, Val, Ala, Tyr, or Cys
SXSPSVSQLSX

SEQ ID NO: 162235 - protein, 8 aa, Artificial Sequence
  Description of Artificial Sequence: Synthetic peptide
  Seed: SQTLKAMV (PRAME_HUMAN)
  misc_feature (2)..(2): Xaa can be , or Gln
  misc_feature (8)..(8): Xaa can be Val, Ile, or Leu
SXTLKAMX

SEQ ID NO: 162236 - protein, 10 aa, Artificial Sequence
  Description of Artificial Sequence: Synthetic peptide
  Seed: SQTLKAMVQA (PRAME_HUMAN)
  misc_feature (2)..(2): Xaa can be Gln, Met, Leu, Tyr, Pro, Trp, Ile, Ser, Ala, Thr, Asp, Arg, Asn, His, Glu, Lys, Cys, Gly, Phe, or Val
  misc_feature (10)..(10): Xaa can be Val, Ile, Ala, or Leu
SXTLKAMVQX

SEQ ID NO: 162237 - protein, 11 aa, Artificial Sequence
  Description of Artificial Sequence: Synthetic peptide
  Seed: SQTLKAMVQAW (PRAME_HUMAN)
  misc_feature (2)..(2): Xaa can be Glu, Phe, Trp, Tyr, Lys, Ala, Ile, Leu, Asp, Arg, Met, Gln, Val, Thr, His, or Ser
  misc_feature (11)..(11): Xaa can be Trp, Tyr, Met, Leu, or Phe
SXTLKAMVQAX

SEQ ID NO: 162238 - protein, 8 aa, Artificial Sequence
  Description of Artificial Sequence: Synthetic peptide
  Seed: SRYISMSV (PRAME_HUMAN)
  misc_feature (2)..(2): Xaa can be His, Arg, Tyr, Gln, Pro, or Glu
  misc_feature (8)..(8): Xaa can be Leu, Ala, Phe, Tyr, Ile, Val, Met, Cys, Gly, Pro, or Thr
SXYISMSX

SEQ ID NO: 162239 - protein, 9 aa, Artificial Sequence
  Description of Artificial Sequence: Synthetic peptide
  Seed: SRYISMSVW (PRAME_HUMAN)
  misc_feature (2)..(2): Xaa can be Gln, Met, Lys, Arg, Ala, Glu, Leu, His, Ser, Val, Thr, Asn, Ile, Gly, Tyr, Phe, Pro, Cys, Asp, or Trp
  misc_feature (9)..(9): Xaa can be Phe, Met, Tyr, Leu, Trp, Ile, His, Val, Ala, Thr, Cys, Gly, Ser, Pro, Asn, Lys, Glu, Arg, or Gln
SXYISMSVX

SEQ ID NO: 162240 - protein, 8 aa, Artificial Sequence
  Description of Artificial Sequence: Synthetic peptide
  Seed: SSYISPEK (PRAME_HUMAN)
  misc_feature (2)..(2): Xaa can be Ala, Ile, Val, Ser, Thr, Leu, or Met
  misc_feature (8)..(8): Xaa can be Lys, or Arg
SXYISPEX

SEQ ID NO: 162241 - protein, 9 aa, Artificial Sequence
  Description of Artificial Sequence: Synthetic peptide
  Seed: STEAEQPFI (PRAME_HUMAN)
  misc_feature (2)..(2): Xaa can be Ile, Leu, Thr, Val, Ser, Ala, Phe, Met, Tyr, Cys, Gly, Gln, Trp, Asn, or Pro
  misc_feature (9)..(9): Xaa can be Trp, Leu, Met, Phe, Ile, or Val
SXEAEQPFX

SEQ ID NO: 162242 - protein, 9 aa, Artificial Sequence
  Description of Artificial Sequence: Synthetic peptide
  Seed: SVLSLSGVM (PRAME_HUMAN)
  misc_feature (2)..(2): Xaa can be Gln, Met, Ala, Thr, Ser, Leu, Lys, Ile, Gly, Val, Glu, His, Pro, Arg, Asn, Phe, Cys, Asp, Tyr, or Trp
  misc_feature (9)..(9): Xaa can be Tyr, Phe, Met, Trp, Lys, Leu, His, Arg, Ile, Val, Ala, Gly, Ser, Cys, or Thr
SXLSLSGVX

SEQ ID NO: 162243 - protein, 10 aa, Artificial Sequence
  Description of Artificial Sequence: Synthetic peptide
  Seed: SVLSLSGVML (PRAME_HUMAN)
  misc_feature (2)..(2): Xaa can be Ala, Leu, Met, Gln, Ser, Thr, Ile, Phe, Val, His, Asp, Lys, Arg, Glu, Trp, Tyr, Cys, Asn, Pro, or Gly
  misc_feature (10)..(10): Xaa can be Ala, Ile, Leu, Val, Met, Thr, or Phe
SXLSLSGVMX

SEQ ID NO: 162244 - protein, 8 aa, Artificial Sequence
  Description of Artificial Sequence: Synthetic peptide
  Seed: SVSQLSVL (PRAME_HUMAN)
  misc_feature (2)..(2): Xaa can be Val, Ser, Ala, Ile, or Thr
  misc_feature (8)..(8): Xaa can be , or Leu
SXSQLSVX

SEQ ID NO: 162245 - protein, 10 aa, Artificial Sequence
  Description of Artificial Sequence: Synthetic peptide
  Seed: SVSQLSVLSL (PRAME_HUMAN)
  misc_feature (2)..(2): Xaa can be Val, Leu, Ile, Met, Ala, Ser, Gln, Thr, Gly, Glu, Asn, Pro, Asp, Phe, Trp, His, Tyr, Cys, Lys, or Arg
  misc_feature (10)..(10): Xaa can be Tyr, Phe, Met, Trp, Leu, Lys, Arg, Val, Ile, Ala, His, or Thr
SXSQLSVLSX

SEQ ID NO: 162246 - protein, 8 aa, Artificial Sequence
  Description of Artificial Sequence: Synthetic peptide
  Seed: SVWTSPRR (PRAME_HUMAN)
  misc_feature (2)..(2): Xaa can be Thr, Val, Ser, Ile, Met, Trp, Tyr, Leu, Ala, or Phe
  misc_feature (8)..(8): Xaa can be Arg, or Lys
SXWTSPRX

SEQ ID NO: 162247 - protein, 9 aa, Artificial Sequence
  Description of Artificial Sequence: Synthetic peptide
  Seed: SVWTSPRRL (PRAME_HUMAN)
  misc_feature (2)..(2): Xaa can be Gln, Ala, Ser, Met, Thr, Leu, Val, Ile, Asn, Tyr, Gly, Glu, Phe, Asp, Arg, Cys, His, Pro, Trp, or Lys
  misc_feature (9)..(9): Xaa can be Leu, Trp, Met, Tyr, Phe, Ile, Val, Arg, Lys, Ala, Cys, Thr, or His
SXWTSPRRX

SEQ ID NO: 162248 - protein, 9 aa, Artificial Sequence
  Description of Artificial Sequence: Synthetic peptide
  Seed: SYEDIHGTL (PRAME_HUMAN)
  misc_feature (2)..(2): Xaa can be Phe, Ala, His, Tyr, Arg, Ser, Trp, Ile, Pro, Leu, Thr, Glu, Met, Gly, Val, Asn, Cys, Gln, Lys, or Asp
  misc_feature (9)..(9): Xaa can be Leu, Met, Tyr, Phe, Trp, Lys, Ile, Val, Arg, Cys, Ala, His, or Thr
SXEDIHGTX

SEQ ID NO: 162249 - protein, 10 aa, Artificial Sequence
  Description of Artificial Sequence: Synthetic peptide
  Seed: SYEDIHGTLH (PRAME_HUMAN)
  misc_feature (2)..(2): Xaa can be Tyr, Arg, His, Trp, Phe, Met, Gln, Leu, Ala, Lys, Val, or Ile
  misc_feature (10)..(10): Xaa can be Phe, Tyr, Met, Leu, Trp, Ile, His, Val, Arg, or Lys
SXEDIHGTLX

SEQ ID NO: 162250 - protein, 11 aa, Artificial Sequence
  Description of Artificial Sequence: Synthetic peptide
  Seed: SYEDIHGTLHL (PRAME_HUMAN)
  misc_feature (2)..(2): Xaa can be Tyr, Ala, Arg, Phe, Trp, Ile, Val, Gly, Met, Leu, Ser, Gln, Thr, Cys, His, Glu, Pro, Asp, or Asn
  misc_feature (11)..(11): Xaa can be Leu, Met, Phe, Lys, Ile, Val, Tyr, Trp, Arg, Cys, or His
SXEDIHGTLHX

SEQ ID NO: 162251 - protein, 11 aa, Artificial Sequence
  Description of Artificial Sequence: Synthetic peptide
  Seed: SYISPEKEEQY (PRAME_HUMAN)
  misc_feature (2)..(2): Xaa can be Arg, Tyr, Trp, Ala, Gln, Leu, Glu, Phe, Met, Pro, His, Val, Ile, Gly, Thr, Ser, Asp, Lys, Cys, or Asn
  misc_feature (11)..(11): Xaa can be Tyr, Phe, Met, Trp, Leu, Lys, Ile, His, Val, or Arg
SXISPEKEEQX

SEQ ID NO: 162252 - protein, 9 aa, Artificial Sequence
  Description of Artificial Sequence: Synthetic peptide
  Seed: SYLIEKVKR (PRAME_HUMAN)
  misc_feature (2)..(2): Xaa can be Ala, Tyr, Val, Leu, Phe, Thr, Met, Ser, Ile, Gln, His, Pro, Trp, Gly, Glu, Cys, Asn, or As p
  misc_feature (9)..(9): Xaa can be Arg, or Lys
SXLIEKVKX

SEQ ID NO: 162253 - protein, 10 aa, Artificial Sequence
  Description of Artificial Sequence: Synthetic peptide
  Seed: SYLIEKVKRK (PRAME_HUMAN)
  misc_feature (2)..(2): Xaa can be Met, Tyr, Thr, Val, Ile, Gln, Ser, Phe, Leu, or Trp
  misc_feature (10)..(10): Xaa can be Arg, or Lys
SXLIEKVKRX

SEQ ID NO: 162254 - protein, 9 aa, Artificial Sequence
  Description of Artificial Sequence: Synthetic peptide
  Seed: TCLPLGVLM (PRAME_HUMAN)
  misc_feature (2)..(2): Xaa can be Ala, Thr, Ser, Leu, Ile, Gly, Met, Val, Gln, Asn, Pro, Phe, Glu, Arg, Cys, Tyr, His, Asp, Trp, or Lys
  misc_feature (9)..(9): Xaa can be Met, Trp, Leu, Phe, Tyr, Val, Lys, Ile, Arg, His, Ala, Cys, Thr, or Gln
TXLPLGVLX

SEQ ID NO: 162255 - protein, 10 aa, Artificial Sequence
  Description of Artificial Sequence: Synthetic peptide
  Seed: TCLPLGVLMK (PRAME_HUMAN)
  misc_feature (2)..(2): Xaa can be Thr, Val, Gly, Ser, Leu, Met, Ala, Ile, Asp, Glu, Gln, Pro, Cys, Phe, or Asn
  misc_feature (10)..(10): Xaa can be Lys, Arg, Tyr, or His
TXLPLGVLMX

SEQ ID NO: 162256 - protein, 9 aa, Artificial Sequence
  Description of Artificial Sequence: Synthetic peptide
  Seed: TCTWKLPTL (PRAME_HUMAN)
  misc_feature (2)..(2): Xaa can be Arg, Ala, Gln, Ser, Thr, Leu, Val, Ile, Met, Gly, Asn, Phe, Pro, Cys, Tyr, Trp, Lys, Glu, or Asp
  misc_feature (9)..(9): Xaa can be Leu, Met, Tyr, Phe, Ile, Val, Trp, His, Ala, Lys, Cys, or Arg
TXTWKLPTX

SEQ ID NO: 162257 - protein, 8 aa, Artificial Sequence
  Description of Artificial Sequence: Synthetic peptide
  Seed: TDDQLLAL (PRAME_HUMAN)
  misc_feature (2)..(2): Xaa can be Glu, Phe, Tyr, Ala, Thr, Trp, Ser, Ile, Asp, Val, Gln, Asn, Met, Gly, Cys, His, Arg, Leu, Pro, or Lys
  misc_feature (8)..(8): Xaa can be Leu, Met, Phe, Ile, Val, Tyr, Cys, Trp, Ala, Ser, Pro, Thr, or Gly
TXDQLLAX

SEQ ID NO: 162258 - protein, 9 aa, Artificial Sequence
  Description of Artificial Sequence: Synthetic peptide
  Seed: TDDQLLALL (PRAME_HUMAN)
  misc_feature (2)..(2): Xaa can be Glu, Tyr, Ala, Phe, Asp, Leu, Thr, Ile, Trp, Met, Ser, Val, Gln, Arg, Cys, Gly, Asn, Lys, Pro, or His
  misc_feature (9)..(9): Xaa can be Met, Leu, Phe, Val, Ile, Tyr, Cys, Ala, Trp, Thr, Ser, Lys, Pro, Gln, His, Glu, Gly, Arg, or Asp
TXDQLLALX

SEQ ID NO: 162259 - protein, 8 aa, Artificial Sequence
  Description of Artificial Sequence: Synthetic peptide
  Seed: TDVSPEPL (PRAME_HUMAN)
  misc_feature (2)..(2): Xaa can be Glu, or Asp
  misc_feature (8)..(8): Xaa can be Val, Ile, Leu, Phe, Met, or Ala
TXVSPEPX

SEQ ID NO: 162260 - protein, 10 aa, Artificial Sequence
  Description of Artificial Sequence: Synthetic peptide
  Seed: TDVSPEPLQA (PRAME_HUMAN)
  misc_feature (2)..(2): Xaa can be Glu, Asp, or Gln
  misc_feature (10)..(10): Xaa can be Cys, Ala, Val, Leu, Ile, Tyr, Thr, Pro, Ser, Glu, Trp, Phe, Met, Gly, or Asp
TXVSPEPLQX

SEQ ID NO: 162261 - protein, 11 aa, Artificial Sequence
  Description of Artificial Sequence: Synthetic peptide
  Seed: TDVSPEPLQAL (PRAME_HUMAN)
  misc_feature (2)..(2): Xaa can be Glu, Gln, or Asp
  misc_feature (11)..(11): Xaa can be Met, Ile, Ala, Leu, Val, Phe, Cys, Trp, Lys, Gly, Ser, Tyr, Glu, Thr, Gln, or Pro
TXVSPEPLQAX

SEQ ID NO: 162262 - protein, 8 aa, Artificial Sequence
  Description of Artificial Sequence: Synthetic peptide
  Seed: TEAEQPFI (PRAME_HUMAN)
  misc_feature (2)..(2): Xaa can be Glu, or Asp
  misc_feature (8)..(8): Xaa can be Phe, Ile, Leu, Met, Val, Thr, Cys, Ala, or Pro
TXAEQPFX

SEQ ID NO: 162263 - protein, 9 aa, Artificial Sequence
  Description of Artificial Sequence: Synthetic peptide
  Seed: TEAEQPFIP (PRAME_HUMAN)
  misc_feature (2)..(2): Xaa can be Glu, Asp, or Gln
  misc_feature (9)..(9): Xaa can be Ala, Met, Ile, Cys, Leu, Val, Pro, Thr, Phe, Lys, Gly, Gln, Asp, Tyr, Arg, Ser, Trp, or Gl u
TXAEQPFIX

SEQ ID NO: 162264 - protein, 10 aa, Artificial Sequence
  Description of Artificial Sequence: Synthetic peptide
  Seed: TEAEQPFIPV (PRAME_HUMAN)
  misc_feature (2)..(2): Xaa can be Glu, Asp, or Gln
  misc_feature (10)..(10): Xaa can be Ala, Val, Leu, Phe, Ile, Gly, Ser, Pro, Cys, Tyr, Thr, Met, or Trp
TXAEQPFIPX

SEQ ID NO: 162265 - protein, 9 aa, Artificial Sequence
  Description of Artificial Sequence: Synthetic peptide
  Seed: TFKAVLDGL (PRAME_HUMAN)
  misc_feature (2)..(2): Xaa can be Tyr, Trp, Phe, Arg, Gln, His, Ala, or Glu
  misc_feature (9)..(9): Xaa can be Leu, Met, Ile, Phe, Trp, Tyr, or Val
TXKAVLDGX

SEQ ID NO: 162266 - protein, 8 aa, Artificial Sequence
  Description of Artificial Sequence: Synthetic peptide
  Seed: TFYDPEPI (PRAME_HUMAN)
  misc_feature (2)..(2): Xaa can be Tyr, Phe, or Trp
  misc_feature (8)..(8): Xaa can be Tyr, Phe, Met, Leu, Val, Ile, or His
TXYDPEPX

SEQ ID NO: 162267 - protein, 9 aa, Artificial Sequence
  Description of Artificial Sequence: Synthetic peptide
  Seed: TFYDPEPIL (PRAME_HUMAN)
  misc_feature (2)..(2): Xaa can be Ala, Arg, Tyr, Gln, Phe, Ser, Val, Met, Thr, Ile, Leu, Trp, Gly, Glu, Pro, Asn, Cys, Asp, His, or Lys
  misc_feature (9)..(9): Xaa can be Val, Leu, Ile, Met, Phe, Tyr, Lys, Arg, Trp, Ala, His, Cys, Thr, Pro, Gln, or Ser
TXYDPEPIX

SEQ ID NO: 162268 - protein, 10 aa, Artificial Sequence
  Description of Artificial Sequence: Synthetic peptide
  Seed: TFYDPEPILC (PRAME_HUMAN)
  misc_feature (2)..(2): Xaa can be Arg, Tyr, Gln, Phe, Trp, His, Ala, Lys, Met, Leu, Val, Glu, Ile, Gly, Asn, Thr, Ser, Pro, Cys, or Asp
  misc_feature (10)..(10): Xaa can be Phe, Met, Leu, Tyr, Lys, Val, Ile, Arg, Trp, His, Cys, Ala, Ser, Gln, Thr, Asn, Pro, Gly, or Glu
TXYDPEPILX

SEQ ID NO: 162269 - protein, 8 aa, Artificial Sequence
  Description of Artificial Sequence: Synthetic peptide
  Seed: THVLYPVP (PRAME_HUMAN)
  misc_feature (2)..(2): Xaa can be His, Arg, or Gln
  misc_feature (8)..(8): Xaa can be Ile, Val, Leu, Ala, Pro, Phe, Met, Thr, Cys, or Ser
TXVLYPVX

SEQ ID NO: 162270 - protein, 9 aa, Artificial Sequence
  Description of Artificial Sequence: Synthetic peptide
  Seed: THVLYPVPL (PRAME_HUMAN)
  misc_feature (2)..(2): Xaa can be Arg, Gln, His, Lys, Tyr, Met, Phe, Pro, Ala, Asn, Glu, Trp, Gly, Ser, Ile, Leu, Thr, Val, Cys, or Asp
  misc_feature (9)..(9): Xaa can be Leu, Phe, Met, Tyr, Ile, Val, Ala, His, Trp, Cys, Thr, Gly, Ser, Pro, Lys, or Arg
TXVLYPVPX

SEQ ID NO: 162271 - protein, 9 aa, Artificial Sequence
  Description of Artificial Sequence: Synthetic peptide
  Seed: TKKRKVDGL (PRAME_HUMAN)
  misc_feature (2)..(2): Xaa can be Arg, Gln, Ala, Thr, Ser, Met, Val, Ile, Leu, Asn, Gly, Glu, Phe, Cys, Asp, Lys, or Trp
  misc_feature (9)..(9): Xaa can be Leu, Ile, Phe, Lys, Arg, Met, Trp, His, Val, or Tyr
TXKRKVDGX

SEQ ID NO: 162272 - protein, 8 aa, Artificial Sequence
  Description of Artificial Sequence: Synthetic peptide
  Seed: TLAKFSPY (PRAME_HUMAN)
  misc_feature (2)..(2): Xaa can be Gln, Met, Lys, Ile, Phe, Ser, His, Tyr, Ala, Arg, Leu, Val, Glu, Pro, or Thr
  misc_feature (8)..(8): Xaa can be Tyr, Phe, Met, Leu, Ile, or Trp
TXAKFSPX

SEQ ID NO: 162273 - protein, 9 aa, Artificial Sequence
  Description of Artificial Sequence: Synthetic peptide
  Seed: TLAKFSPYL (PRAME_HUMAN)
  misc_feature (2)..(2): Xaa can be Met, Leu, Val, Gln, Thr, Ile, Tyr, Ala, Ser, Phe, Asn, Gly, Glu, Trp, Arg, Cys, Pro, His, Asp, or Lys
  misc_feature (9)..(9): Xaa can be Leu, Tyr, Val, Met, Ile, Phe, Arg, Lys, Trp, Ala, Thr, Cys, His, Ser, or Gly
TXAKFSPYX

SEQ ID NO: 162274 - protein, 10 aa, Artificial Sequence
  Description of Artificial Sequence: Synthetic peptide
  Seed: TLAKFSPYLG (PRAME_HUMAN)
  misc_feature (2)..(2): Xaa can be Met, Leu, Ile, Val, Gln, or Thr
  misc_feature (10)..(10): Xaa can be Val, Ile, Leu, Ala, Met, Tyr, Gln, Phe, Gly, Asn, Pro, His, Trp, Cys, Glu, Thr, Asp, Arg, Lys, or Ser
TXAKFSPYLX

SEQ ID NO: 162275 - protein, 9 aa, Artificial Sequence
  Description of Artificial Sequence: Synthetic peptide
  Seed: TLHLERLAY (PRAME_HUMAN)
  misc_feature (2)..(2): Xaa can be Gln, Ala, Met, Thr, Val, Ile, Ser, Pro, Leu, Gly, Lys, Glu, Arg, Asn, Tyr, Cys, Phe, His, Trp, or Asp
  misc_feature (9)..(9): Xaa can be Tyr, Met, Phe, Leu, Trp, His, Ile, Val, Lys, Arg, or Ala
TXHLERLAX

SEQ ID NO: 162276 - protein, 10 aa, Artificial Sequence
  Description of Artificial Sequence: Synthetic peptide
  Seed: TLHLERLAYL (PRAME_HUMAN)
  misc_feature (2)..(2): Xaa can be Met, Leu, Ile, Gln, Val, Thr, Ser, Ala, or Pro
  misc_feature (10)..(10): Xaa can be Val, Leu, Ala, Ile, Met, Thr, Ser, Cys, or Phe
TXHLERLAYX

SEQ ID NO: 162277 - protein, 11 aa, Artificial Sequence
  Description of Artificial Sequence: Synthetic peptide
  Seed: TLHLERLAYLH (PRAME_HUMAN)
  misc_feature (2)..(2): Xaa can be Leu, or Met
  misc_feature (11)..(11): Xaa can be Leu, Ala, Met, Val, Ile, Trp, Glu, Phe, Asn, Cys, Asp, Ser, Tyr, Pro, Gln, Gly, His, Lys, Arg, or Thr
TXHLERLAYLX

SEQ ID NO: 162278 - protein, 9 aa, Artificial Sequence
  Description of Artificial Sequence: Synthetic peptide
  Seed: TLKAMVQAW (PRAME_HUMAN)
  misc_feature (2)..(2): Xaa can be Gln, Met, Leu, Ala, Ser, Val, Thr, Gly, Pro, Ile, Glu, Asn, Phe, Lys, Asp, Tyr, Trp, Cys, Arg, or His
  misc_feature (9)..(9): Xaa can be Phe, Tyr, Trp, Met, Leu, Ile, Val, His, or Ala
TXKAMVQAX

SEQ ID NO: 162279 - protein, 11 aa, Artificial Sequence
  Description of Artificial Sequence: Synthetic peptide
  Seed: TLKAMVQAWPF (PRAME_HUMAN)
  misc_feature (2)..(2): Xaa can be Gln, Met, or Leu
  misc_feature (11)..(11): Xaa can be Phe, Tyr, or Met
TXKAMVQAWPX

SEQ ID NO: 162280 - protein, 10 aa, Artificial Sequence
  Description of Artificial Sequence: Synthetic peptide
  Seed: TLQDLVFDEC (PRAME_HUMAN)
  misc_feature (2)..(2): Xaa can be Leu, Met, Ile, Val, Gln, Thr, or Ala
  misc_feature (10)..(10): Xaa can be Leu, Val, Ile, Met, Phe, Ala, Cys, or Thr
TXQDLVFDEX

SEQ ID NO: 162281 - protein, 9 aa, Artificial Sequence
  Description of Artificial Sequence: Synthetic peptide
  Seed: TLSFYGNSI (PRAME_HUMAN)
  misc_feature (2)..(2): Xaa can be Met, Gln, Leu, Val, Ile, Thr, Phe, Ala, Ser, Tyr, Gly, Glu, Cys, Trp, or Pro
  misc_feature (9)..(9): Xaa can be Leu, Met, Phe, Ile, Val, Ala, Trp, Tyr, or Thr
TXSFYGNSX

SEQ ID NO: 162282 - protein, 11 aa, Artificial Sequence
  Description of Artificial Sequence: Synthetic peptide
  Seed: TLSFYGNSISI (PRAME_HUMAN)
  misc_feature (2)..(2): Xaa can be Leu, Met, or Ile
  misc_feature (11)..(11): Xaa can be Val, Leu, Ala, Ile, or Met
TXSFYGNSISX

SEQ ID NO: 162283 - protein, 9 aa, Artificial Sequence
  Description of Artificial Sequence: Synthetic peptide
  Seed: TLSITNCRL (PRAME_HUMAN)
  misc_feature (2)..(2): Xaa can be Met, Leu, Gln, Ile, Val, Thr, or Ala
  misc_feature (9)..(9): Xaa can be Val, Ile, Leu, Phe, Trp, Met, or Ala
TXSITNCRX

SEQ ID NO: 162284 - protein, 9 aa, Artificial Sequence
  Description of Artificial Sequence: Synthetic peptide
  Seed: TSPRRLVEL (PRAME_HUMAN)
  misc_feature (2)..(2): Xaa can be Ala, Ile, Ser, Val, Thr, Pro, Met, Leu, Gln, Arg, Glu, Tyr, Gly, Phe, Asp, Asn, His, Trp, Cys, or Lys
  misc_feature (9)..(9): Xaa can be Ile, Met, Phe, Val, Tyr, Leu, Trp, Ala, Cys, His, Lys, Arg, Thr, Ser, or Pro
TXPRRLVEX

SEQ ID NO: 162285 - protein, 10 aa, Artificial Sequence
  Description of Artificial Sequence: Synthetic peptide
  Seed: TSQFLSLQCL (PRAME_HUMAN)
  misc_feature (2)..(2): Xaa can be Asp, Arg, Trp, Phe, Glu, Gly, Lys, Pro, Gln, Ser, Val, His, Ile, Asn, Leu, Ala, Met, Cys, Tyr, or Thr
  misc_feature (10)..(10): Xaa can be Phe, Leu, Tyr, or Met
TXQFLSLQCX

SEQ ID NO: 162286 - protein, 10 aa, Artificial Sequence
  Description of Artificial Sequence: Synthetic peptide
  Seed: TTLSFYGNSI (PRAME_HUMAN)
  misc_feature (2)..(2): Xaa can be Leu, Tyr, Thr, Phe, Met, Pro, Asp, Ser, His, Lys, Val, Gly, Asn, Trp, Glu, Cys, Ala, Ile, Gln, or Arg
  misc_feature (10)..(10): Xaa can be Leu, Ile, Ala, Val, Met, or Thr
TXLSFYGNSX

SEQ ID NO: 162287 - protein, 10 aa, Artificial Sequence
  Description of Artificial Sequence: Synthetic peptide
  Seed: TVWSGNRASL (PRAME_HUMAN)
  misc_feature (2)..(2): Xaa can be Pro, Thr, Ala, Ile, Val, Ser, Met, Leu, Gln, Gly, Phe, Glu, Asn, Cys, Tyr, or Asp
  misc_feature (10)..(10): Xaa can be Tyr, Arg, Phe, Leu, Lys, Met, Ile, Val, Ala, His, Trp, Thr, or Cys
TXWSGNRASX

SEQ ID NO: 162288 - protein, 11 aa, Artificial Sequence
  Description of Artificial Sequence: Synthetic peptide
  Seed: TVWSGNRASLY (PRAME_HUMAN)
  misc_feature (2)..(2): Xaa can be Ala, Met, Thr, Ile, Val, Gln, Ser, Leu, Asp, Phe, Tyr, Asn, Gly, Glu, Trp, Pro, Cys, His, or Arg
  misc_feature (11)..(11): Xaa can be Tyr, Phe, Lys, Arg, Trp, Met, His, or Leu
TXWSGNRASLX

SEQ ID NO: 162289 - protein, 9 aa, Artificial Sequence
  Description of Artificial Sequence: Synthetic peptide
  Seed: TWKLPTLAK (PRAME_HUMAN)
  misc_feature (2)..(2): Xaa can be Thr, Ser, Val, Met, Ala, Ile, Leu, Tyr, Gln, Gly, Phe, Asp, Pro, Glu, Trp, His, Asn, Cys, or Lys
  misc_feature (9)..(9): Xaa can be Arg, Lys, Ala, Val, Leu, Tyr, His, Ile, Met, Gly, Ser, Thr, Gln, Cys, or Phe
TXKLPTLAX

SEQ ID NO: 162290 - protein, 10 aa, Artificial Sequence
  Description of Artificial Sequence: Synthetic peptide
  Seed: TWKLPTLAKF (PRAME_HUMAN)
  misc_feature (2)..(2): Xaa can be Tyr, Trp, Gln, Phe, Met, Lys, His, Ala, Thr, Val, Cys, Pro, Gly, Leu, Arg, Ile, Ser, Glu, Asn, or Asp
  misc_feature (10)..(10): Xaa can be Phe, Tyr, Met, Trp, Leu, Ile, or Val
TXKLPTLAKX

SEQ ID NO: 162291 - protein, 8 aa, Artificial Sequence
  Description of Artificial Sequence: Synthetic peptide
  Seed: VDGLSTEA (PRAME_HUMAN)
  misc_feature (2)..(2): Xaa can be Glu, or Asp
  misc_feature (8)..(8): Xaa can be Val, Ile, Ala, Leu, Met, Phe, Cys, Pro, or Thr
VXGLSTEX

SEQ ID NO: 162292 - protein, 9 aa, Artificial Sequence
  Description of Artificial Sequence: Synthetic peptide
  Seed: VDLFLKEGA (PRAME_HUMAN)
  misc_feature (2)..(2): Xaa can be Glu, or Asp
  misc_feature (9)..(9): Xaa can be Ala, Val, Leu, Ile, Phe, Met, Pro, Gly, Ser, Cys, or Thr
VXLFLKEGX

SEQ ID NO: 162293 - protein, 10 aa, Artificial Sequence
  Description of Artificial Sequence: Synthetic peptide
  Seed: VDSLFFLRGR (PRAME_HUMAN)
  misc_feature (2)..(2): Xaa can be Gln, Ile, Glu, Tyr, Ser, Leu, Met, Asn, Lys, Trp, Thr, Phe, Arg, Val, Gly, His, Ala, Asp, Cys, or Pro
  misc_feature (10)..(10): Xaa can be Arg, or Lys
VXSLFFLRGX

SEQ ID NO: 162294 - protein, 8 aa, Artificial Sequence
  Description of Artificial Sequence: Synthetic peptide
  Seed: VELAGQSL (PRAME_HUMAN)
  misc_feature (2)..(2): Xaa can be Glu, Asp, Gln, Arg, Ala, His, Met, Phe, Asn, Leu, Val, Ile, Thr, Pro, Ser, Gly, or Tyr
  misc_feature (8)..(8): Xaa can be Leu, Val, Ile, Met, Trp, Phe, Ala, Tyr, His, Pro, Thr, or Cys
VXLAGQSX

SEQ ID NO: 162295 - protein, 9 aa, Artificial Sequence
  Description of Artificial Sequence: Synthetic peptide
  Seed: VELAGQSLL (PRAME_HUMAN)
  misc_feature (2)..(2): Xaa can be Glu, Asp, Gln, His, Ala, Met, Leu, Ser, Val, Thr, Ile, Arg, Asn, Gly, Tyr, or Phe
  misc_feature (9)..(9): Xaa can be Leu, Ile, Val, Trp, Phe, Met, Tyr, Cys, Ala, Pro, Lys, Ser, His, Arg, Gly, or Thr
VXLAGQSLX

SEQ ID NO: 162296 - protein, 10 aa, Artificial Sequence
  Description of Artificial Sequence: Synthetic peptide
  Seed: VELAGQSLLK (PRAME_HUMAN)
  misc_feature (2)..(2): Xaa can be Glu, Ala, Thr, Gln, Met, Ser, Pro, Cys, Leu, Trp, Tyr, Val, Gly, Arg, Asp, Phe, Asn, His, Ile, or Lys
  misc_feature (10)..(10): Xaa can be Lys, Arg, Tyr, Leu, Phe, Met, or His
VXLAGQSLLX

SEQ ID NO: 162297 - protein, 8 aa, Artificial Sequence
  Description of Artificial Sequence: Synthetic peptide
  Seed: VEVLVDLF (PRAME_HUMAN)
  misc_feature (2)..(2): Xaa can be Glu, Asp, or Gln
  misc_feature (8)..(8): Xaa can be Phe, Val, Met, Ile, Leu, Trp, Thr, Tyr, Ala, Pro, or Cys
VXVLVDLX

SEQ ID NO: 162298 - protein, 9 aa, Artificial Sequence
  Description of Artificial Sequence: Synthetic peptide
  Seed: VEVLVDLFL (PRAME_HUMAN)
  misc_feature (2)..(2): Xaa can be Glu, Asp, or Gln
  misc_feature (9)..(9): Xaa can be Trp, Leu, Ile, Val, Phe, Met, Tyr, Thr, Ser, Pro, Ala, Gly, or Cys
VXVLVDLFX

SEQ ID NO: 162299 - protein, 10 aa, Artificial Sequence
  Description of Artificial Sequence: Synthetic peptide
  Seed: VEVLVDLFLK (PRAME_HUMAN)
  misc_feature (2)..(2): Xaa can be Met, Asp, Val, Ile, Trp, Gln, Glu, Phe, Asn, Lys, His, Gly, Pro, Thr, Arg, Leu, Ala, Ser, Cys, or Tyr
  misc_feature (10)..(10): Xaa can be Arg, or Lys
VXVLVDLFLX

SEQ ID NO: 162300 - protein, 9 aa, Artificial Sequence
  Description of Artificial Sequence: Synthetic peptide
  Seed: VFDECGITD (PRAME_HUMAN)
  misc_feature (2)..(2): Xaa can be Tyr, Phe, Trp, Leu, Ile, Val, His, Ser, Ala, Gly, Met, Pro, Thr, Cys, Gln, Asn, Arg, Asp, Glu, or Lys
  misc_feature (9)..(9): Xaa can be Ile, Phe, Leu, Val, Met, Tyr, Cys, Ala, Trp, Thr, Gln, Glu, Lys, Ser, Gly, Pro, Arg, His, Asn, or Asp
VXDECGITX

SEQ ID NO: 162301 - protein, 8 aa, Artificial Sequence
  Description of Artificial Sequence: Synthetic peptide
  Seed: VKRKKNVL (PRAME_HUMAN)
  misc_feature (2)..(2): Xaa can be Pro, Val, Ser, Ile, Met, Asn, Gly, Leu, Ala, Gln, Phe, Thr, Glu, Asp, His, Cys, Arg, Lys, Trp, or Tyr
  misc_feature (8)..(8): Xaa can be Leu, Ile, Met, Val, Phe, Ala, or Cys
VXRKKNVX

SEQ ID NO: 162302 - protein, 8 aa, Artificial Sequence
  Description of Artificial Sequence: Synthetic peptide
  Seed: VLDGLDVL (PRAME_HUMAN)
  misc_feature (2)..(2): Xaa can be Tyr, Thr, Ala, Ser, Phe, Cys, Met, Val, Trp, Gly, Leu, Ile, Asn, Gln, Pro, His, or Asp
  misc_feature (8)..(8): Xaa can be Leu, Met, Phe, Ile, Val, Tyr, or Trp
VXDGLDVX

SEQ ID NO: 162303 - protein, 9 aa, Artificial Sequence
  Description of Artificial Sequence: Synthetic peptide
  Seed: VLDGLDVLL (PRAME_HUMAN)
  misc_feature (2)..(2): Xaa can be Ala, Tyr, Thr, Phe, Ile, Val, Ser, Met, Leu, Gly, Gln, Arg, Trp, Cys, Glu, Asn, Pro, His, Lys, or Asp
  misc_feature (9)..(9): Xaa can be Phe, Val, Met, Trp, Tyr, Arg, Ile, Lys, Leu, Cys, Ala, His, Thr, Ser, Gln, Glu, Gly, Pro, or Asn
VXDGLDVLX

SEQ ID NO: 162304 - protein, 10 aa, Artificial Sequence
  Description of Artificial Sequence: Synthetic peptide
  Seed: VLDGLDVLLA (PRAME_HUMAN)
  misc_feature (2)..(2): Xaa can be Leu, Met, Ile, Val, Gln, Thr, Ser, Ala, Phe, or Cys
  misc_feature (10)..(10): Xaa can be Leu, Val, Met, Ile, Phe, Ala, Thr, Cys, Ser, or Tyr
VXDGLDVLLX

SEQ ID NO: 162305 - protein, 10 aa, Artificial Sequence
  Description of Artificial Sequence: Synthetic peptide
  Seed: VLLAQEVRPR (PRAME_HUMAN)
  misc_feature (2)..(2): Xaa can be Ile, Phe, Met, Trp, Ser, Ala, Tyr, Val, Thr, Leu, Gly, Arg, Gln, or Asn
  misc_feature (10)..(10): Xaa can be Arg, or Lys
VXLAQEVRPX

SEQ ID NO: 162306 - protein, 11 aa, Artificial Sequence
  Description of Artificial Sequence: Synthetic peptide
  Seed: VLLAQEVRPRR (PRAME_HUMAN)
  misc_feature (2)..(2): Xaa can be Val, Tyr, Ile, Phe, Met, Thr, Trp, Arg, Gln, Ser, or Leu
  misc_feature (11)..(11): Xaa can be Arg, or Lys
VXLAQEVRPRX

SEQ ID NO: 162307 - protein, 8 aa, Artificial Sequence
  Description of Artificial Sequence: Synthetic peptide
  Seed: VLMKGQHL (PRAME_HUMAN)
  misc_feature (2)..(2): Xaa can be Ala, Ser, Val, Ile, Phe, Gly, Thr, Gln, Pro, Leu, Asn, Asp, Glu, Met, His, Cys, or Tyr
  misc_feature (8)..(8): Xaa can be Leu, Val, Ile, Phe, Met, Tyr, or Trp
VXMKGQHX

SEQ ID NO: 162308 - protein, 9 aa, Artificial Sequence
  Description of Artificial Sequence: Synthetic peptide
  Seed: VLMKGQHLH (PRAME_HUMAN)
  misc_feature (2)..(2): Xaa can be Met, Leu, Thr, Gln, Ser, Tyr, Ile, Val, Phe, Ala, Trp, Glu, Gly, Asn, Lys, Cys, Asp, Pro, His, or Arg
  misc_feature (9)..(9): Xaa can be Tyr, Phe, Arg, Lys, Met, Leu, Trp, His, Ile, Val, or Ala
VXMKGQHLX

SEQ ID NO: 162309 - protein, 10 aa, Artificial Sequence
  Description of Artificial Sequence: Synthetic peptide
  Seed: VLMKGQHLHL (PRAME_HUMAN)
  misc_feature (2)..(2): Xaa can be Leu, Gln, Met, Ile, Val, Thr, Ser, Ala, Phe, Glu, Tyr, Gly, Asn, Trp, Cys, Arg, Pro, Asp, His, or Lys
  misc_feature (10)..(10): Xaa can be Val, Trp, Arg, Lys, Phe, Ile, Tyr, Leu, Met, Ala, Thr, or Cys
VXMKGQHLHX

SEQ ID NO: 162310 - protein, 9 aa, Artificial Sequence
  Description of Artificial Sequence: Synthetic peptide
  Seed: VLRLCCKKL (PRAME_HUMAN)
  misc_feature (2)..(2): Xaa can be Arg, Pro, Gln, Gly, Ile, Ala, Thr, Ser, Leu, Met, or Asn
  misc_feature (9)..(9): Xaa can be Leu, Met, Phe, Ile, Tyr, or Lys
VXRLCCKKX

SEQ ID NO: 162311 - protein, 10 aa, Artificial Sequence
  Description of Artificial Sequence: Synthetic peptide
  Seed: VLRLCCKKLK (PRAME_HUMAN)
  misc_feature (2)..(2): Xaa can be Arg, Tyr, Trp, Gly, Ile, Leu, Phe, Thr, Ser, Gln, Met, Val, Ala, Glu, Asp, Lys, Asn, His, Cys, or Pro
  misc_feature (10)..(10): Xaa can be Met, Phe, Leu, Lys, Arg, or Tyr
VXRLCCKKLX

SEQ ID NO: 162312 - protein, 9 aa, Artificial Sequence
  Description of Artificial Sequence: Synthetic peptide
  Seed: VLSLSGVML (PRAME_HUMAN)
  misc_feature (2)..(2): Xaa can be Arg, Ala, Gln, Met, Ser, Thr, Gly, Val, Ile, Leu, Asn, Tyr, Phe, Cys, Pro, Trp, Glu, His, Lys, or Asp
  misc_feature (9)..(9): Xaa can be Leu, Tyr, Met, Phe, Val, Ile, Lys, Trp, Arg, Ala, or His
VXSLSGVMX

SEQ ID NO: 162313 - protein, 10 aa, Artificial Sequence
  Description of Artificial Sequence: Synthetic peptide
  Seed: VLSLSGVMLT (PRAME_HUMAN)
  misc_feature (2)..(2): Xaa can be Met, Leu, Ile, Val, Gln, Ala, Phe, Thr, or Tyr
  misc_feature (10)..(10): Xaa can be Val, Leu, Ile, Ala, Met, Thr, or Ser
VXSLSGVMLX

SEQ ID NO: 162314 - protein, 9 aa, Artificial Sequence
  Description of Artificial Sequence: Synthetic peptide
  Seed: VLYPVPLES (PRAME_HUMAN)
  misc_feature (2)..(2): Xaa can be Met, Leu, Ile, Gln, Val, Thr, Ser, Ala, Asn, Gly, Phe, Glu, Cys, Trp, Tyr, or Asp
  misc_feature (9)..(9): Xaa can be Val, Leu, Ile, Ala, Met, Thr, Cys, Phe, Ser, Lys, Tyr, Arg, Gly, or Pro
VXYPVPLEX

SEQ ID NO: 162315 - protein, 10 aa, Artificial Sequence
  Description of Artificial Sequence: Synthetic peptide
  Seed: VLYPVPLESY (PRAME_HUMAN)
  misc_feature (2)..(2): Xaa can be Arg, Ala, Thr, Ser, Tyr, Gln, Phe, Val, Gly, Ile, Met, Leu, Trp, Asn, Glu, Cys, His, Pro, Lys, or Asp
  misc_feature (10)..(10): Xaa can be Met, Tyr, Phe, Leu, Trp, Arg, Lys, Ile, His, Val, Ala, Cys, Gln, Thr, or Ser
VXYPVPLESX

SEQ ID NO: 162316 - protein, 10 aa, Artificial Sequence
  Description of Artificial Sequence: Synthetic peptide
  Seed: VMHLSQSPSV (PRAME_HUMAN)
  misc_feature (2)..(2): Xaa can be Met, Leu, Val, Gln, or Ile
  misc_feature (10)..(10): Xaa can be Val, Leu, Ala, or Ile
VXHLSQSPSX

SEQ ID NO: 162317 - protein, 11 aa, Artificial Sequence
  Description of Artificial Sequence: Synthetic peptide
  Seed: VMLTDVSPEPL (PRAME_HUMAN)
  misc_feature (2)..(2): Xaa can be Met, Leu, Phe, Gln, Tyr, Trp, Gly, Val, Ile, Arg, Lys, Ala, or Ser
  misc_feature (11)..(11): Xaa can be Leu, Val, Ile, Met, Trp, Phe, or Ala
VXLTDVSPEPX

SEQ ID NO: 162318 - protein, 8 aa, Artificial Sequence
  Description of Artificial Sequence: Synthetic peptide
  Seed: VMNPLETL (PRAME_HUMAN)
  misc_feature (2)..(2): Xaa can be Ala, Thr, Ser, Gln, Ile, Gly, Val, Met, Asn, Leu, Glu, Phe, Asp, His, Arg, Tyr, Trp, Pro, Lys, or Cys
  misc_feature (8)..(8): Xaa can be Leu, Tyr, Ile, Phe, Met, Val, Lys, Arg, His, Trp, or Ala
VXNPLETX

SEQ ID NO: 162319 - protein, 10 aa, Artificial Sequence
  Description of Artificial Sequence: Synthetic peptide
  Seed: VMNPLETLSI (PRAME_HUMAN)
  misc_feature (2)..(2): Xaa can be Met, Gln, Leu, Thr, Ala, Ile, Val, Ser, Glu, Gly, Phe, Cys, Asn, Tyr, or Pro
  misc_feature (10)..(10): Xaa can be Leu, Met, Val, Tyr, Ile, Phe, Trp, Ala, Thr, His, or Cys
VXNPLETLSX

SEQ ID NO: 162320 - protein, 9 aa, Artificial Sequence
  Description of Artificial Sequence: Synthetic peptide
  Seed: VPLESYEDI (PRAME_HUMAN)
  misc_feature (2)..(2): Xaa can be Pro, Ala, Thr, Gly, Ser, or Val
  misc_feature (9)..(9): Xaa can be Trp, Ile, Phe, Val, Leu, Ala, Thr, Tyr, Pro, or Met
VXLESYEDX

SEQ ID NO: 162321 - protein, 9 aa, Artificial Sequence
  Description of Artificial Sequence: Synthetic peptide
  Seed: VQAWPFTCL (PRAME_HUMAN)
  misc_feature (2)..(2): Xaa can be Ala, His, Leu, Met, Thr, Glu, Ser, Gln, Arg, Ile, Val, Gly, Asn, Asp, Pro, Lys, Tyr, Phe, Cys, or Trp
  misc_feature (9)..(9): Xaa can be Phe, Tyr, Leu, Met, Ile, Val, His, Ala, Lys, Arg, Trp, Thr, Cys, Ser, Pro, or Gln
VXAWPFTCX

SEQ ID NO: 162322 - protein, 11 aa, Artificial Sequence
  Description of Artificial Sequence: Synthetic peptide
  Seed: VQAWPFTCLPL (PRAME_HUMAN)
  misc_feature (2)..(2): Xaa can be Gln, Met, Lys, Leu, Thr, Arg, Ala, Phe, Val, Tyr, His, Ser, Ile, Glu, or Gly
  misc_feature (11)..(11): Xaa can be Tyr, Phe, Val, Met, Leu, Ala, Ile, Trp, or His
VXAWPFTCLPX

SEQ ID NO: 162323 - protein, 9 aa, Artificial Sequence
  Description of Artificial Sequence: Synthetic peptide
  Seed: VQLDSIEDL (PRAME_HUMAN)
  misc_feature (2)..(2): Xaa can be Leu, Met, Glu, Ile, Val, His, Gln, Ala, Thr, Ser, Arg, Gly, Tyr, Asp, Phe, Asn, Trp, Cys, Pro, or Lys
  misc_feature (9)..(9): Xaa can be Lys, Tyr, Leu, Phe, Met, Arg, Val, Ile, Trp, Ala, His, Thr, Cys, or Pro
VXLDSIEDX

SEQ ID NO: 162324 - protein, 11 aa, Artificial Sequence
  Description of Artificial Sequence: Synthetic peptide
  Seed: VQLDSIEDLEV (PRAME_HUMAN)
  misc_feature (2)..(2): Xaa can be Leu, Met, Gln, Ile, Val, Thr, Ser, Glu, Ala, Asn, Phe, His, Gly, Lys, Arg, or Tyr
  misc_feature (11)..(11): Xaa can be Leu, Phe, Trp, Val, Ile, Met, Ala, Cys, Tyr, Thr, or Ser
VXLDSIEDLEX

SEQ ID NO: 162325 - protein, 8 aa, Artificial Sequence
  Description of Artificial Sequence: Synthetic peptide
  Seed: VRPRRWKL (PRAME_HUMAN)
  misc_feature (2)..(2): Xaa can be Arg, Tyr, Phe, Glu, His, or Gln
  misc_feature (8)..(8): Xaa can be Leu, Phe, or Tyr
VXPRRWKX

SEQ ID NO: 162326 - protein, 10 aa, Artificial Sequence
  Description of Artificial Sequence: Synthetic peptide
  Seed: VRPRRWKLQV (PRAME_HUMAN)
  misc_feature (2)..(2): Xaa can be Ser, Asn, Gln, Gly, Cys, Ala, Asp, Lys, Thr, Arg, Met, Pro, Tyr, Leu, His, Val, Phe, Glu, Trp, or Ile
  misc_feature (10)..(10): Xaa can be Phe, Leu, Ile, Val, or Met
VXPRRWKLQX

SEQ ID NO: 162327 - protein, 11 aa, Artificial Sequence
  Description of Artificial Sequence: Synthetic peptide
  Seed: VRPRRWKLQVL (PRAME_HUMAN)
  misc_feature (2)..(2): Xaa can be Pro, Phe, Arg, Met, Tyr, Ser, His, Lys, Ala, Trp, or Thr
  misc_feature (11)..(11): Xaa can be Leu, Met, Ile, or Val
VXPRRWKLQVX

SEQ ID NO: 162328 - protein, 8 aa, Artificial Sequence
  Description of Artificial Sequence: Synthetic peptide
  Seed: VSPEPLQA (PRAME_HUMAN)
  misc_feature (2)..(2): Xaa can be Ala, Ser, Met, Asn, Leu, Tyr, Gln, Cys, Gly, Thr, Phe, Ile, Val, Pro, His, Trp, Glu, Asp, Arg, or Lys
  misc_feature (8)..(8): Xaa can be Leu, Met, Ile, Phe, Val, Tyr, Ala, or Cys
VXPEPLQX

SEQ ID NO: 162329 - protein, 9 aa, Artificial Sequence
  Description of Artificial Sequence: Synthetic peptide
  Seed: VSPEPLQAL (PRAME_HUMAN)
  misc_feature (2)..(2): Xaa can be Pro, Ala, Tyr, Ser, Ile, Arg, Phe, Val, Met, Leu, Gly, Glu, Thr, Gln, Cys, His, Trp, Asp, Asn, or Lys
  misc_feature (9)..(9): Xaa can be Phe, Ile, Lys, Val, Leu, Trp, Tyr, His, Met, Ala, Cys, Arg, Thr, Pro, Gln, Ser, Gly, Asn, Glu, or Asp
VXPEPLQAX

SEQ ID NO: 162330 - protein, 10 aa, Artificial Sequence
  Description of Artificial Sequence: Synthetic peptide
  Seed: VSPEPLQALL (PRAME_HUMAN)
  misc_feature (2)..(2): Xaa can be Ala, Met, Thr, Ser, Ile, Val, Leu, Gln, Gly, Asn, Glu, Phe, Tyr, Cys, Arg, Trp, Asp, Pro, His, or Lys
  misc_feature (10)..(10): Xaa can be Leu, Met, Trp, Phe, Tyr, Lys, Ile, Arg, Val, His, or Ala
VXPEPLQALX

SEQ ID NO: 162331 - protein, 9 aa, Artificial Sequence
  Description of Artificial Sequence: Synthetic peptide
  Seed: VSQLSVLSL (PRAME_HUMAN)
  misc_feature (2)..(2): Xaa can be Gln, Glu, Ala, Arg, Asp, Ser, Tyr, Val, Thr, Gly, Ile, Lys, Asn, Phe, Met, His, Leu, Trp, Cys, or Pro
  misc_feature (9)..(9): Xaa can be Phe, Met, Tyr, Leu, Trp, Val, Ile, His, Lys, Arg, Ala, Cys, Thr, Gly, or Pro
VXQLSVLSX

SEQ ID NO: 162332 - protein, 10 aa, Artificial Sequence
  Description of Artificial Sequence: Synthetic peptide
  Seed: VTCTWKLPTL (PRAME_HUMAN)
  misc_feature (2)..(2): Xaa can be Ala, Thr, Ile, Val, Met, Leu, Arg, Gln, Ser, Gly, Asn, Cys, Asp, Glu, Pro, Lys, His, Tyr, Phe, or Trp
  misc_feature (10)..(10): Xaa can be Trp, Phe, Tyr, Leu, Met, Ile, Val, Ala, Thr, Arg, His, Lys, or Cys
VXCTWKLPTX

SEQ ID NO: 162333 - protein, 9 aa, Artificial Sequence
  Description of Artificial Sequence: Synthetic peptide
  Seed: VWSGNRASL (PRAME_HUMAN)
  misc_feature (2)..(2): Xaa can be Tyr, Arg, Phe, Ala, Met, Gly, Gln, Trp, Ile, Ser, His, Asn, Leu, Val, Thr, Glu, Cys, Lys, Asp, or Pro
  misc_feature (9)..(9): Xaa can be Met, Leu, Phe, Val, Ile, Tyr, Trp, Cys, Ala, His, Lys, Arg, or Thr
VXSGNRASX

SEQ ID NO: 162334 - protein, 10 aa, Artificial Sequence
  Description of Artificial Sequence: Synthetic peptide
  Seed: VWSGNRASLY (PRAME_HUMAN)
  misc_feature (2)..(2): Xaa can be Trp, Tyr, Gln, Phe, Met, Leu, Val, Pro, Ala, Glu, Ile, Ser, Thr, Asp, Lys, Arg, Cys, His, Asn, or Gly
  misc_feature (10)..(10): Xaa can be Tyr, Phe, Met, or Leu
VXSGNRASLX

SEQ ID NO: 162335 - protein, 8 aa, Artificial Sequence
  Description of Artificial Sequence: Synthetic peptide
  Seed: VWTSPRRL (PRAME_HUMAN)
  misc_feature (2)..(2): Xaa can be Tyr, Phe, or Trp
  misc_feature (8)..(8): Xaa can be Leu, Phe, Met, Ile, Tyr, or Val
VXTSPRRX

SEQ ID NO: 162336 - protein, 9 aa, Artificial Sequence
  Description of Artificial Sequence: Synthetic peptide
  Seed: VWTSPRRLV (PRAME_HUMAN)
  misc_feature (2)..(2): Xaa can be Phe, Tyr, Trp, Met, or Ala
  misc_feature (9)..(9): Xaa can be Phe, Met, Leu, Tyr, Ile, Val, or Trp
VXTSPRRLX

SEQ ID NO: 162337 - protein, 9 aa, Artificial Sequence
  Description of Artificial Sequence: Synthetic peptide
  Seed: WKLPTLAKF (PRAME_HUMAN)
  misc_feature (2)..(2): Xaa can be Gln, Arg, Met, His, Lys, Phe, Tyr, Leu, Ser, Glu, Ala, Val, Ile, Thr, Pro, Gly, Asn, Cys, Asp, or Trp
  misc_feature (9)..(9): Xaa can be Tyr, Phe, Met, Leu, Ile, Trp, His, Val, or Ala
WXLPTLAKX

SEQ ID NO: 162338 - protein, 9 aa, Artificial Sequence
  Description of Artificial Sequence: Synthetic peptide
  Seed: WLSANPCPH (PRAME_HUMAN)
  misc_feature (2)..(2): Xaa can be Gln, Met, Leu, Val, Ile, Ser, Ala, Thr, Phe, Glu, Gly, Pro, Cys, Lys, Asn, or Tyr
  misc_feature (9)..(9): Xaa can be Tyr, Phe, Met, Leu, Trp, His, Ile, or Val
WXSANPCPX

SEQ ID NO: 162339 - protein, 8 aa, Artificial Sequence
  Description of Artificial Sequence: Synthetic peptide
  Seed: WPFTCLPL (PRAME_HUMAN)
  misc_feature (2)..(2): Xaa can be Pro, Ala, Val, Thr, Met, or Ser
  misc_feature (8)..(8): Xaa can be Tyr, Met, Phe, Ile, Val, Leu, Trp, or Ala
WXFTCLPX

SEQ ID NO: 162340 - protein, 9 aa, Artificial Sequence
  Description of Artificial Sequence: Synthetic peptide
  Seed: WPFTCLPLG (PRAME_HUMAN)
  misc_feature (2)..(2): Xaa can be Pro, Ala, Ile, Met, Val, Thr, Ser, Cys, Gly, Gln, or Leu
  misc_feature (9)..(9): Xaa can be Tyr, Met, Phe, Trp, Ala, Leu, Thr, His, Cys, Ile, Gly, Val, Gln, Ser, or Pro
WXFTCLPLX

SEQ ID NO: 162341 - protein, 10 aa, Artificial Sequence
  Description of Artificial Sequence: Synthetic peptide
  Seed: WPFTCLPLGV (PRAME_HUMAN)
  misc_feature (2)..(2): Xaa can be , or Pro
  misc_feature (10)..(10): Xaa can be Val, Ser, Met, Ala, Leu, Phe, Ile, Pro, Cys, Thr, or Tyr
WXFTCLPLGX

SEQ ID NO: 162342 - protein, 11 aa, Artificial Sequence
  Description of Artificial Sequence: Synthetic peptide
  Seed: WPFTCLPLGVL (PRAME_HUMAN)
  misc_feature (2)..(2): Xaa can be , or Pro
  misc_feature (11)..(11): Xaa can be Met, Cys, Val, Phe, Ile, Leu, or Ala
WXFTCLPLGVX

SEQ ID NO: 162343 - protein, 8 aa, Artificial Sequence
  Description of Artificial Sequence: Synthetic peptide
  Seed: WSGNRASL (PRAME_HUMAN)
  misc_feature (2)..(2): Xaa can be Ala, Ser, or Thr
  misc_feature (8)..(8): Xaa can be Leu, Phe, Met, or Tyr
WXGNRASX

SEQ ID NO: 162344 - protein, 9 aa, Artificial Sequence
  Description of Artificial Sequence: Synthetic peptide
  Seed: WSGNRASLY (PRAME_HUMAN)
  misc_feature (2)..(2): Xaa can be Ala, Gln, Thr, Ser, Met, Lys, Val, His, Ile, Leu, Tyr, Glu, Trp, Arg, Phe, Pro, Asn, Gly, Asp, or Cys
  misc_feature (9)..(9): Xaa can be Tyr, Phe, Met, Trp, Leu, Lys, Ile, His, or Val
WXGNRASLX

SEQ ID NO: 162345 - protein, 11 aa, Artificial Sequence
  Description of Artificial Sequence: Synthetic peptide
  Seed: WSGNRASLYSF (PRAME_HUMAN)
  misc_feature (2)..(2): Xaa can be Thr, Ser, Cys, Val, Met, Ala, Gly, or Ile
  misc_feature (11)..(11): Xaa can be Trp, Tyr, or Phe
WXGNRASLYSX

SEQ ID NO: 162346 - protein, 8 aa, Artificial Sequence
  Description of Artificial Sequence: Synthetic peptide
  Seed: WTSPRRLV (PRAME_HUMAN)
  misc_feature (2)..(2): Xaa can be Thr, Ser, Ala, Val, or Gly
  misc_feature (8)..(8): Xaa can be Leu, Phe, Met, Tyr, Ile, or Val
WXSPRRLX

SEQ ID NO: 162347 - protein, 10 aa, Artificial Sequence
  Description of Artificial Sequence: Synthetic peptide
  Seed: WTSPRRLVEL (PRAME_HUMAN)
  misc_feature (2)..(2): Xaa can be Ala, Ser, Thr, Ile, Gly, Val, Met, Leu, Gln, Glu, Asn, Phe, or Cys
  misc_feature (10)..(10): Xaa can be Tyr, Trp, Met, Phe, Leu, Ile, Val, or His
WXSPRRLVEX

SEQ ID NO: 162348 - protein, 8 aa, Artificial Sequence
  Description of Artificial Sequence: Synthetic peptide
  Seed: WTVWSGNR (PRAME_HUMAN)
  misc_feature (2)..(2): Xaa can be , or Thr
  misc_feature (8)..(8): Xaa can be , or Arg
WXVWSGNX

SEQ ID NO: 162349 - protein, 9 aa, Artificial Sequence
  Description of Artificial Sequence: Synthetic peptide
  Seed: WTVWSGNRA (PRAME_HUMAN)
  misc_feature (2)..(2): Xaa can be Thr, Val, Ala, Ser, or Ile
  misc_feature (9)..(9): Xaa can be Val, Ala, Leu, Ile, or Met
WXVWSGNRX

SEQ ID NO: 162350 - protein, 11 aa, Artificial Sequence
  Description of Artificial Sequence: Synthetic peptide
  Seed: WTVWSGNRASL (PRAME_HUMAN)
  misc_feature (2)..(2): Xaa can be Thr, or Val
  misc_feature (11)..(11): Xaa can be Val, Ile, or Leu
WXVWSGNRASX

SEQ ID NO: 162351 - protein, 9 aa, Artificial Sequence
  Description of Artificial Sequence: Synthetic peptide
  Seed: YDPEPILCP (PRAME_HUMAN)
  misc_feature (2)..(2): Xaa can be Glu, Asp, or Gln
  misc_feature (9)..(9): Xaa can be Ala, Ile, Val, Cys, Pro, Leu, Ser, Tyr, Gly, Thr, Met, or Phe
YXPEPILCX

SEQ ID NO: 162352 - protein, 8 aa, Artificial Sequence
  Description of Artificial Sequence: Synthetic peptide
  Seed: YEDIHGTL (PRAME_HUMAN)
  misc_feature (2)..(2): Xaa can be Phe, Ala, Tyr, Ser, Thr, Gly, Ile, Val, Trp, Glu, Leu, Gln, Arg, Asn, Met, His, Cys, Lys, Pro, or Asp
  misc_feature (8)..(8): Xaa can be Tyr, Phe, Met, Ile, Val, Leu, Trp, Cys, Ala, Lys, Thr, Arg, Ser, Gln, His, Glu, or Pro
YXDIHGTX

SEQ ID NO: 162353 - protein, 9 aa, Artificial Sequence
  Description of Artificial Sequence: Synthetic peptide
  Seed: YEDIHGTLH (PRAME_HUMAN)
  misc_feature (2)..(2): Xaa can be Glu, Thr, Ser, Val, Ala, Ile, Asp, Gln, Leu, Met, Gly, Phe, Asn, Cys, Tyr, Trp, Pro, Lys, His, or Arg
  misc_feature (9)..(9): Xaa can be Tyr, Leu, Met, Lys, Phe, Arg, Trp, His, Ile, Val, Gln, Ala, Thr, Asn, Glu, Ser, Cys, Pro, Gly, or Asp
YXDIHGTLX

SEQ ID NO: 162354 - protein, 10 aa, Artificial Sequence
  Description of Artificial Sequence: Synthetic peptide
  Seed: YEDIHGTLHL (PRAME_HUMAN)
  misc_feature (2)..(2): Xaa can be Glu, Ala, Phe, Val, Tyr, Ser, Ile, Gly, Trp, Met, Thr, Leu, Gln, Cys, Pro, Asp, His, Arg, Asn, or Lys
  misc_feature (10)..(10): Xaa can be Phe, Leu, Met, Ile, Val, Trp, Tyr, Cys, Ala, Thr, Ser, Gly, or Pro
YXDIHGTLHX

SEQ ID NO: 162355 - protein, 9 aa, Artificial Sequence
  Description of Artificial Sequence: Synthetic peptide
  Seed: YGNSISISA (PRAME_HUMAN)
  misc_feature (2)..(2): Xaa can be Pro, Ala, Ser, Val, Thr, Ile, Gln, Met, Gly, Leu, Arg, Glu, Asp, Phe, Tyr, Asn, His, Cys, Trp, or Lys
  misc_feature (9)..(9): Xaa can be Leu, Phe, Val, Met, Ile, Tyr, His, Ala, Lys, Trp, Cys, Arg, Thr, Gln, Ser, Asn, Pro, Glu, Gly, or Asp
YXNSISISX

SEQ ID NO: 162356 - protein, 10 aa, Artificial Sequence
  Description of Artificial Sequence: Synthetic peptide
  Seed: YGNSISISAL (PRAME_HUMAN)
  misc_feature (2)..(2): Xaa can be Ala, Ser, Val, Thr, Ile, Gly, Gln, Leu, Met, Arg, Asn, Pro, Tyr, Glu, His, Cys, Phe, Asp, Trp, or Lys
  misc_feature (10)..(10): Xaa can be Leu, Tyr, Phe, Met, Lys, Ile, His, Arg, Val, Trp, Ala, Cys, Ser, Gln, or Thr
YXNSISISAX

SEQ ID NO: 162357 - protein, 9 aa, Artificial Sequence
  Description of Artificial Sequence: Synthetic peptide
  Seed: YIAQFTSQF (PRAME_HUMAN)
  misc_feature (2)..(2): Xaa can be Pro, Ala, Tyr, Leu, Gln, Met, Phe, Ile, Val, Thr, Ser, Arg, Gly, Cys, Asn, Trp, Glu, Lys, Asp, or His
  misc_feature (9)..(9): Xaa can be Phe, Val, Leu, Tyr, Met, Ile, Trp, His, Arg, Lys, Ala, Thr, Cys, Ser, Gln, Gly, Asn, Glu, Pro, or Asp
YXAQFTSQX

SEQ ID NO: 162358 - protein, 10 aa, Artificial Sequence
  Description of Artificial Sequence: Synthetic peptide
  Seed: YIAQFTSQFL (PRAME_HUMAN)
  misc_feature (2)..(2): Xaa can be Ala, Met, Leu, Ser, Thr, Ile, Val, Gln, Gly, Pro, Phe, Asn, Trp, Glu, Lys, Asp, Arg, Tyr, His, or Cys
  misc_feature (10)..(10): Xaa can be Phe, Tyr, Met, Val, Leu, Ile, Ala, Thr, His, Ser, Trp, Lys, Gly, Pro, Cys, Glu, Arg, Gln, Asp, or Asn
YXAQFTSQFX

SEQ ID NO: 162359 - protein, 9 aa, Artificial Sequence
  Description of Artificial Sequence: Synthetic peptide
  Seed: YISMSVWTS (PRAME_HUMAN)
  misc_feature (2)..(2): Xaa can be Met, Leu, Gln, Ile, Thr, Val, Ala, Ser, Gly, Phe, Trp, Cys, Asn, Glu, Lys, Tyr, Pro, or As p
  misc_feature (9)..(9): Xaa can be Val, Leu, Ile, Ala, Met, Thr, Cys, Ser, Phe, Gly, Pro, Glu, Gln, Arg, Lys, Asp, Tyr, or Tr p
YXSMSVWTX

SEQ ID NO: 162360 - protein, 11 aa, Artificial Sequence
  Description of Artificial Sequence: Synthetic peptide
  Seed: YISMSVWTSPR (PRAME_HUMAN)
  misc_feature (2)..(2): Xaa can be Thr, Met, Lys, Arg, Phe, His, Ala, Glu, Ser, Tyr, Val, Gly, Gln, Cys, Leu, Asp, Ile, Pro, Asn, or Trp
  misc_feature (11)..(11): Xaa can be Arg, Lys, or Tyr
YXSMSVWTSPX

SEQ ID NO: 162361 - protein, 10 aa, Artificial Sequence
  Description of Artificial Sequence: Synthetic peptide
  Seed: YISPEKEEQY (PRAME_HUMAN)
  misc_feature (2)..(2): Xaa can be Ala, Met, Gln, Thr, Pro, Ile, Val, Arg, Ser, Leu, Tyr, Asn, Phe, Glu, Gly, Lys, His, Trp, Cys, or Asp
  misc_feature (10)..(10): Xaa can be Tyr, Phe, Met, Leu, Trp, Lys, Ile, Arg, Val, His, Cys, or Ala
YXSPEKEEQX

SEQ ID NO: 162362 - protein, 11 aa, Artificial Sequence
  Description of Artificial Sequence: Synthetic peptide
  Seed: YISPEKEEQYI (PRAME_HUMAN)
  misc_feature (2)..(2): Xaa can be Ala, Leu, Gln, Met, Gly, Val, Ile, Ser, Thr, Glu, Asn, Phe, Cys, Pro, Tyr, Arg, Trp, or As p
  misc_feature (11)..(11): Xaa can be Phe, Leu, Met, Tyr, Lys, Trp, Ile, Val, Arg, Ala, Cys, or His
YXSPEKEEQYX

SEQ ID NO: 162363 - protein, 8 aa, Artificial Sequence
  Description of Artificial Sequence: Synthetic peptide
  Seed: YLGQMINL (PRAME_HUMAN)
  misc_feature (2)..(2): Xaa can be Ala, Ser, Thr, Gly, Ile, Arg, Val, Leu, Met, Gln, Asn, Glu, Asp, His, Tyr, Phe, or Cys
  misc_feature (8)..(8): Xaa can be Leu, Met, Ile, Val, Phe, Tyr, Lys, Ala, Trp, or Arg
YXGQMINX

SEQ ID NO: 162364 - protein, 9 aa, Artificial Sequence
  Description of Artificial Sequence: Synthetic peptide
  Seed: YLGQMINLR (PRAME_HUMAN)
  misc_feature (2)..(2): Xaa can be Leu, Met, Val, Ile, Ser, Thr, Gly, Asp, Trp, Glu, Asn, Ala, Gln, Phe, Pro, Tyr, Cys, or Hi s
  misc_feature (9)..(9): Xaa can be Arg, Lys, Tyr, Phe, Met, Leu, His, Val, or Ile
YXGQMINLX

SEQ ID NO: 162365 - protein, 10 aa, Artificial Sequence
  Description of Artificial Sequence: Synthetic peptide
  Seed: YLGQMINLRR (PRAME_HUMAN)
  misc_feature (2)..(2): Xaa can be Met, Leu, Thr, Gln, Phe, Ala, Ser, Val, Ile, Tyr, Trp, Lys, Gly, Asn, Pro, His, Arg, Cys, Glu, or Asp
  misc_feature (10)..(10): Xaa can be Arg, Lys, or Tyr
YXGQMINLRX

SEQ ID NO: 162366 - protein, 11 aa, Artificial Sequence
  Description of Artificial Sequence: Synthetic peptide
  Seed: YLGQMINLRRL (PRAME_HUMAN)
  misc_feature (2)..(2): Xaa can be Met, Leu, or Ile
  misc_feature (11)..(11): Xaa can be Val, Ile, Leu, or Ala
YXGQMINLRRX

SEQ ID NO: 162367 - protein, 9 aa, Artificial Sequence
  Description of Artificial Sequence: Synthetic peptide
  Seed: YLHARLREL (PRAME_HUMAN)
  misc_feature (2)..(2): Xaa can be Tyr, Pro, Ala, Met, Leu, Arg, Ser, Gln, Ile, Phe, Val, Thr, Glu, Trp, Gly, Asn, His, Asp, Cys, or Lys
  misc_feature (9)..(9): Xaa can be Met, Ile, Phe, Val, Leu, Tyr, Trp, Cys, His, Ala, Thr, Lys, Arg, Gly, Ser, Gln, Pro, or Gl u
YXHARLREX

SEQ ID NO: 162368 - protein, 10 aa, Artificial Sequence
  Description of Artificial Sequence: Synthetic peptide
  Seed: YLHARLRELL (PRAME_HUMAN)
  misc_feature (2)..(2): Xaa can be Pro, Met, Leu, Val, His, Ile, Gln, Ala, Ser, Thr, Glu, Arg, Lys, Trp, Asn, Phe, Cys, Gly, Tyr, or Asp
  misc_feature (10)..(10): Xaa can be Ile, Met, Phe, Leu, Val, Ala, Trp, Gln, Pro, Thr, Tyr, Asp, Glu, His, Cys, Asn, Arg, Gly, Lys, or Ser
YXHARLRELX

SEQ ID NO: 162369 - protein, 11 aa, Artificial Sequence
  Description of Artificial Sequence: Synthetic peptide
  Seed: YLHARLRELLC (PRAME_HUMAN)
  misc_feature (2)..(2): Xaa can be Leu, or Met
  misc_feature (11)..(11): Xaa can be Ala, Leu, Ile, Val, Met, Arg, Phe, His, Gln, Tyr, Pro, Trp, Asn, Cys, Ser, Thr, Gly, Asp, Glu, or Lys
YXHARLRELLX

SEQ ID NO: 162370 - protein, 8 aa, Artificial Sequence
  Description of Artificial Sequence: Synthetic peptide
  Seed: YLIEKVKR (PRAME_HUMAN)
  misc_feature (2)..(2): Xaa can be Ile, Met, Val, or Leu
  misc_feature (8)..(8): Xaa can be Lys, or Arg
YXIEKVKX

SEQ ID NO: 162371 - protein, 9 aa, Artificial Sequence
  Description of Artificial Sequence: Synthetic peptide
  Seed: YLIEKVKRK (PRAME_HUMAN)
  misc_feature (2)..(2): Xaa can be Leu, Met, Ile, Ser, Val, Ala, Thr, Gln, Phe, Tyr, Glu, Asp, Cys, Trp, Gly, Pro, or Asn
  misc_feature (9)..(9): Xaa can be Arg, Lys, Tyr, Leu, Ile, Val, Phe, Met, His, Ala, Thr, Gln, or Trp
YXIEKVKRX

SEQ ID NO: 162372 - protein, 10 aa, Artificial Sequence
  Description of Artificial Sequence: Synthetic peptide
  Seed: YLIEKVKRKK (PRAME_HUMAN)
  misc_feature (2)..(2): Xaa can be Leu, Met, Ile, Val, Gln, Thr, Ser, or Ala
  misc_feature (10)..(10): Xaa can be Lys, Arg, Tyr, Leu, Ile, Val, Phe, or Met
YXIEKVKRKX

SEQ ID NO: 162373 - protein, 8 aa, Artificial Sequence
  Description of Artificial Sequence: Synthetic peptide
  Seed: YPVPLESY (PRAME_HUMAN)
  misc_feature (2)..(2): Xaa can be Pro, Gln, Ala, Glu, Ile, Met, Leu, Asp, Val, Ser, Gly, Lys, Thr, Asn, Phe, or His
  misc_feature (8)..(8): Xaa can be Tyr, Phe, Met, Trp, Leu, Thr, Val, Ser, Cys, Pro, Gly, Ile, His, or Ala
YXVPLESX

SEQ ID NO: 162374 - protein, 9 aa, Artificial Sequence
  Description of Artificial Sequence: Synthetic peptide
  Seed: YPVPLESYE (PRAME_HUMAN)
  misc_feature (2)..(2): Xaa can be Pro, Ala, Val, Thr, Ser, Gln, Leu, Ile, Gly, Cys, Met, Phe, Asn, or Tyr
  misc_feature (9)..(9): Xaa can be Tyr, Met, Phe, Leu, Ile, His, Val, Ala, Trp, Asn, Glu, Ser, Cys, Gln, Thr, or Gly
YXVPLESYX

SEQ ID NO: 162375 - protein, 11 aa, Artificial Sequence
  Description of Artificial Sequence: Synthetic peptide
  Seed: YPVPLESYEDI (PRAME_HUMAN)
  misc_feature (2)..(2): Xaa can be Pro, Lys, Cys, Asp, His, Leu, Phe, Glu, Met, Gly, Val, Ala, Gln, Asn, Thr, Ile, Tyr, Trp, Arg, or Ser
  misc_feature (11)..(11): Xaa can be Trp, Val, Met, Phe, Ala, Leu, Ile, or Tyr
YXVPLESYEDX

SEQ ID NO: 162376 - protein, 8 aa, Artificial Sequence
  Description of Artificial Sequence: Synthetic peptide
  Seed: YSFPEPEA (PRAME_HUMAN)
  misc_feature (2)..(2): Xaa can be Ala, Ser, Ile, Val, Gly, Thr, Gln, Leu, Asn, Met, Pro, Cys, Asp, Phe, Trp, Glu, or Tyr
  misc_feature (8)..(8): Xaa can be Tyr, Leu, Phe, Met, Ile, Val, Lys, Arg, His, Trp, Ala, Cys, Gln, or Thr
YXFPEPEX

SEQ ID NO: 162377 - protein, 9 aa, Artificial Sequence
  Description of Artificial Sequence: Synthetic peptide
  Seed: YSFPEPEAA (PRAME_HUMAN)
  misc_feature (2)..(2): Xaa can be Pro, His, Arg, Ala, Ser, Thr, Val, Met, Leu, Gln, Ile, Gly, Tyr, Glu, Lys, Asn, Phe, Cys, Trp, or Asp
  misc_feature (9)..(9): Xaa can be Cys, Lys, Leu, His, Trp, Tyr, Ala, Met, Ile, Val, Phe, Arg, Thr, Gln, Pro, Ser, Gly, Glu, Asn, or Asp
YXFPEPEAX

SEQ ID NO: 162378 - protein, 10 aa, Artificial Sequence
  Description of Artificial Sequence: Synthetic peptide
  Seed: YSFPEPEAAQ (PRAME_HUMAN)
  misc_feature (2)..(2): Xaa can be Ala, Ser, Val, Thr, Met, Ile, Gln, Gly, Leu, Cys, Pro, Glu, Asn, Phe, Asp, Tyr, Trp, Lys, His, or Arg
  misc_feature (10)..(10): Xaa can be Phe, Tyr, Met, Lys, Leu, His, Arg, Trp, Ile, Val, Ala, Gln, Cys, Thr, Ser, Asn, Gly, Glu, or Pro
YXFPEPEAAX

SEQ ID NO: 162379 - protein, 8 aa, Artificial Sequence
  Description of Artificial Sequence: Synthetic peptide
  Seed: YVDSLFFL (PRAME_HUMAN)
  misc_feature (2)..(2): Xaa can be Met, Leu, Ile, Thr, Val, Phe, Gly, Ala, Gln, Tyr, Ser, Asn, Cys, Trp, Arg, His, Asp, Pro, Lys, or Glu
  misc_feature (8)..(8): Xaa can be Leu, Met, Phe, Ile, Val, Tyr, Ala, Cys, Thr, or Ser
YXDSLFFX

SEQ ID NO: 162380 - protein, 9 aa, Artificial Sequence
  Description of Artificial Sequence: Synthetic peptide
  Seed: YVDSLFFLR (PRAME_HUMAN)
  misc_feature (2)..(2): Xaa can be Thr, Ser, Ala, Val, Leu, Met, Ile, Phe, Gly, Cys, Tyr, Gln, Asn, Trp, Pro, Arg, Asp, Glu, Lys, or His
  misc_feature (9)..(9): Xaa can be Arg, Tyr, Lys, Phe, Met, Leu, His, Ile, Val, Trp, Gln, Ala, Glu, Asn, Thr, Cys, Ser, or Gl y
YXDSLFFLX

SEQ ID NO: 162381 - protein, 10 aa, Artificial Sequence
  Description of Artificial Sequence: Synthetic peptide
  Seed: YVDSLFFLRG (PRAME_HUMAN)
  misc_feature (2)..(2): Xaa can be Tyr, Val, Leu, Ile, Met, Thr, Phe, Gln, Ser, Trp, Ala, Gly, Asn, or His
  misc_feature (10)..(10): Xaa can be Arg, Lys, Tyr, His, Val, Phe, Ala, Trp, Ile, Leu, Met, Glu, Gln, Thr, Ser, Asn, Asp, Cys, Gly, or Pro
YXDSLFFLRX

SEQ ID NO: 162382 - protein, 11 aa, Artificial Sequence
  Description of Artificial Sequence: Synthetic peptide
  Seed: YVDSLFFLRGR (PRAME_HUMAN)
  misc_feature (2)..(2): Xaa can be Trp, Phe, Met, Leu, Tyr, Thr, Val, Gln, Ser, Lys, Pro, Ala, Ile, Arg, Asp, Cys, Glu, His, Asn, or Gly
  misc_feature (11)..(11): Xaa can be Arg, or Lys
YXDSLFFLRGX

SEQ ID NO: 162383 - protein, 9 aa, Artificial Sequence
  Description of Artificial Sequence: Synthetic peptide
  Seed: AFDDIAKYF (SSX2_HUMAN)
AADDIAKYF

SEQ ID NO: 162384 - protein, 9 aa, Artificial Sequence
  Description of Artificial Sequence: Synthetic peptide
  Seed: AFDDIAKYF (SSX2_HUMAN)
AADDIAKYL

SEQ ID NO: 162385 - protein, 9 aa, Artificial Sequence
  Description of Artificial Sequence: Synthetic peptide
  Seed: ASEKIFYVY (SSX2_HUMAN)
ATEKIFYVY

SEQ ID NO: 162386 - protein, 9 aa, Artificial Sequence
  Description of Artificial Sequence: Synthetic peptide
  Seed: AFDDIAKYF (SSX2_HUMAN)
AYDDIAKYF

SEQ ID NO: 162387 - protein, 9 aa, Artificial Sequence
  Description of Artificial Sequence: Synthetic peptide
  Seed: AFDDIAKYF (SSX2_HUMAN)
AYDDIAKYL

SEQ ID NO: 162388 - protein, 9 aa, Artificial Sequence
  Description of Artificial Sequence: Synthetic peptide
  Seed: AFDDIAKYF (SSX2_HUMAN)
AYDDIAKYM

SEQ ID NO: 162389 - protein, 9 aa, Artificial Sequence
  Description of Artificial Sequence: Synthetic peptide
  Seed: EAMTKLGFK (SSX2_HUMAN)
ETMTKLGFR

SEQ ID NO: 162390 - protein, 9 aa, Artificial Sequence
  Description of Artificial Sequence: Synthetic peptide
  Seed: EAMTKLGFK (SSX2_HUMAN)
EVMTKLGFR

SEQ ID NO: 162391 - protein, 9 aa, Artificial Sequence
  Description of Artificial Sequence: Synthetic peptide
  Seed: FKATLPPFM (SSX2_HUMAN)
FRATLPPFF

SEQ ID NO: 162392 - protein, 9 aa, Artificial Sequence
  Description of Artificial Sequence: Synthetic peptide
  Seed: KAFDDIAKY (SSX2_HUMAN)
KAFDDIAKL

SEQ ID NO: 162393 - protein, 9 aa, Artificial Sequence
  Description of Artificial Sequence: Synthetic peptide
  Seed: KAFDDIAKY (SSX2_HUMAN)
KMFDDIAKY

SEQ ID NO: 162394 - protein, 9 aa, Artificial Sequence
  Description of Artificial Sequence: Synthetic peptide
  Seed: KIFYVYMKR (SSX2_HUMAN)
KMFYVYMKK

SEQ ID NO: 162395 - protein, 9 aa, Artificial Sequence
  Description of Artificial Sequence: Synthetic peptide
  Seed: KIFYVYMKR (SSX2_HUMAN)
KMFYVYMKR

SEQ ID NO: 162396 - protein, 10 aa, Artificial Sequence
  Description of Artificial Sequence: Synthetic peptide
  Seed: KASEKIFYVY (SSX2_HUMAN)
KMSEKIFYVY

SEQ ID NO: 162397 - protein, 9 aa, Artificial Sequence
  Description of Artificial Sequence: Synthetic peptide
  Seed: KAFDDIAKY (SSX2_HUMAN)
KPFDDIAKY

SEQ ID NO: 162398 - protein, 9 aa, Artificial Sequence
  Description of Artificial Sequence: Synthetic peptide
  Seed: KASEKIFYV (SSX2_HUMAN)
KQSEKIFYL

SEQ ID NO: 162399 - protein, 9 aa, Artificial Sequence
  Description of Artificial Sequence: Synthetic peptide
  Seed: KASEKIFYV (SSX2_HUMAN)
KRSEKIFYF

SEQ ID NO: 162400 - protein, 9 aa, Artificial Sequence
  Description of Artificial Sequence: Synthetic peptide
  Seed: KASEKIFYV (SSX2_HUMAN)
KRSEKIFYL

SEQ ID NO: 162401 - protein, 9 aa, Artificial Sequence
  Description of Artificial Sequence: Synthetic peptide
  Seed: KAFDDIAKY (SSX2_HUMAN)
KTFDDIAKY

SEQ ID NO: 162402 - protein, 9 aa, Artificial Sequence
  Description of Artificial Sequence: Synthetic peptide
  Seed: KIFYVYMKR (SSX2_HUMAN)
KTFYVYMKK

SEQ ID NO: 162403 - protein, 9 aa, Artificial Sequence
  Description of Artificial Sequence: Synthetic peptide
  Seed: KIFYVYMKR (SSX2_HUMAN)
KTFYVYMKR

SEQ ID NO: 162404 - protein, 9 aa, Artificial Sequence
  Description of Artificial Sequence: Synthetic peptide
  Seed: KASEKIFYV (SSX2_HUMAN)
KTSEKIFYI

SEQ ID NO: 162405 - protein, 9 aa, Artificial Sequence
  Description of Artificial Sequence: Synthetic peptide
  Seed: KASEKIFYV (SSX2_HUMAN)
KTSEKIFYV

SEQ ID NO: 162406 - protein, 9 aa, Artificial Sequence
  Description of Artificial Sequence: Synthetic peptide
  Seed: KAFDDIAKY (SSX2_HUMAN)
KVFDDIAKL

SEQ ID NO: 162407 - protein, 9 aa, Artificial Sequence
  Description of Artificial Sequence: Synthetic peptide
  Seed: MTFGRLQGI (SSX2_HUMAN)
MAFGRLQGL

SEQ ID NO: 162408 - protein, 9 aa, Artificial Sequence
  Description of Artificial Sequence: Synthetic peptide
  Seed: MTFGRLQGI (SSX2_HUMAN)
MAFGRLQGV

SEQ ID NO: 162409 - protein, 9 aa, Artificial Sequence
  Description of Artificial Sequence: Synthetic peptide
  Seed: MTFGRLQGI (SSX2_HUMAN)
MAFGRLQGY

SEQ ID NO: 162410 - protein, 9 aa, Artificial Sequence
  Description of Artificial Sequence: Synthetic peptide
  Seed: MTFGRLQGI (SSX2_HUMAN)
MIFGRLQGV

SEQ ID NO: 162411 - protein, 9 aa, Artificial Sequence
  Description of Artificial Sequence: Synthetic peptide
  Seed: MTFGRLQGI (SSX2_HUMAN)
MRFGRLQGV

SEQ ID NO: 162412 - protein, 9 aa, Artificial Sequence
  Description of Artificial Sequence: Synthetic peptide
  Seed: MTFGRLQGI (SSX2_HUMAN)
MTFGRLQGF

SEQ ID NO: 162413 - protein, 9 aa, Artificial Sequence
  Description of Artificial Sequence: Synthetic peptide
  Seed: MTFGRLQGI (SSX2_HUMAN)
MTFGRLQGV

SEQ ID NO: 162414 - protein, 9 aa, Artificial Sequence
  Description of Artificial Sequence: Synthetic peptide
  Seed: MTFGRLQGI (SSX2_HUMAN)
MTFGRLQGY

SEQ ID NO: 162415 - protein, 9 aa, Artificial Sequence
  Description of Artificial Sequence: Synthetic peptide
  Seed: RLRERKQLV (SSX2_HUMAN)
RMRERKQLM

SEQ ID NO: 162416 - protein, 10 aa, Artificial Sequence
  Description of Artificial Sequence: Synthetic peptide
  Seed: VYMKRKYEAM (SSX2_HUMAN)
VYMKRKYEAF

SEQ ID NO: 162417 - protein, 10 aa, Artificial Sequence
  Description of Artificial Sequence: Synthetic peptide
  Seed: WEKMKASEKI (SSX2_HUMAN)
WEKMKASEKL

SEQ ID NO: 162418 - protein, 9 aa, Artificial Sequence
  Description of Artificial Sequence: Synthetic peptide
  Seed: YEAMTKLGF (SSX2_HUMAN)
YEAMTKLGM

SEQ ID NO: 162419 - protein, 9 aa, Artificial Sequence
  Description of Artificial Sequence: Synthetic peptide
  Seed: YEAMTKLGF (SSX2_HUMAN)
YEAMTKLGW

SEQ ID NO: 162420 - protein, 9 aa, Artificial Sequence
  Description of Artificial Sequence: Synthetic peptide
  Seed: YMKRKYEAM (SSX2_HUMAN)
YMKRKYEAY

SEQ ID NO: 162421 - protein, 10 aa, Homo sapiens
  Native (SSX2_HUMAN)
AEEGNDSEEV

SEQ ID NO: 162422 - protein, 9 aa, Homo sapiens
  Native (SSX2_HUMAN)
AMTKLGFKA

SEQ ID NO: 162423 - protein, 10 aa, Homo sapiens
  Native (SSX2_HUMAN)
ATLPPFMCNK

SEQ ID NO: 162424 - protein, 9 aa, Homo sapiens
  Native (SSX2_HUMAN)
DAFARRPTV

SEQ ID NO: 162425 - protein, 9 aa, Homo sapiens
  Native (SSX2_HUMAN)
EAMTKLGFK

SEQ ID NO: 162426 - protein, 8 aa, Homo sapiens
  Native (SSX2_HUMAN)
FKATLPPF

SEQ ID NO: 162427 - protein, 9 aa, Homo sapiens
  Native (SSX2_HUMAN)
FSKEEWEKM

SEQ ID NO: 162428 - protein, 9 aa, Homo sapiens
  Native (SSX2_HUMAN)
FYVYMKRKY

SEQ ID NO: 162429 - protein, 9 aa, Homo sapiens
  Native (SSX2_HUMAN)
GEHAWTHRL

SEQ ID NO: 162430 - protein, 9 aa, Homo sapiens
  Native (SSX2_HUMAN)
GISPKIMPK

SEQ ID NO: 162431 - protein, 10 aa, Homo sapiens
  Native (SSX2_HUMAN)
HAWTHRLRER

SEQ ID NO: 162432 - protein, 10 aa, Homo sapiens
  Native (SSX2_HUMAN)
IAKYFSKEEW

SEQ ID NO: 162433 - protein, 9 aa, Homo sapiens
  Native (SSX2_HUMAN)
IPEKIQKAF

SEQ ID NO: 162434 - protein, 9 aa, Homo sapiens
  Native (SSX2_HUMAN)
KAFDDIAKY

SEQ ID NO: 162435 - protein, 9 aa, Homo sapiens
  Native (SSX2_HUMAN)
KASEKIFYV

SEQ ID NO: 162436 - protein, 9 aa, Homo sapiens
  Native (SSX2_HUMAN)
KEEWEKMKA

SEQ ID NO: 162437 - protein, 9 aa, Homo sapiens
  Native (SSX2_HUMAN)
KIFYVYMKR

SEQ ID NO: 162438 - protein, 9 aa, Homo sapiens
  Native (SSX2_HUMAN)
KIHERSGPK

SEQ ID NO: 162439 - protein, 9 aa, Homo sapiens
  Native (SSX2_HUMAN)
KMKASEKIF

SEQ ID NO: 162440 - protein, 9 aa, Homo sapiens
  Native (SSX2_HUMAN)
KQLVIYEEI

SEQ ID NO: 162441 - protein, 10 aa, Homo sapiens
  Native (SSX2_HUMAN)
KRKYEAMTKL

SEQ ID NO: 162442 - protein, 9 aa, Homo sapiens
  Native (SSX2_HUMAN)
MTFGRLQGI

SEQ ID NO: 162443 - protein, 10 aa, Homo sapiens
  Native (SSX2_HUMAN)
NQVERPQMTF

SEQ ID NO: 162444 - protein, 9 aa, Homo sapiens
  Native (SSX2_HUMAN)
RERKQLVIY

SEQ ID NO: 162445 - protein, 9 aa, Homo sapiens
  Native (SSX2_HUMAN)
RKYEAMTKL

SEQ ID NO: 162446 - protein, 9 aa, Homo sapiens
  Native (SSX2_HUMAN)
RLQGISPKI

SEQ ID NO: 162447 - protein, 9 aa, Homo sapiens
  Native (SSX2_HUMAN)
RPQMTFGRL

SEQ ID NO: 162448 - protein, 11 aa, Homo sapiens
  Native (SSX2_HUMAN)
RSGPKRGEHAW

SEQ ID NO: 162449 - protein, 9 aa, Homo sapiens
  Native (SSX2_HUMAN)
TLPPFMCNK

SEQ ID NO: 162450 - protein, 9 aa, Homo sapiens
  Native (SSX2_HUMAN)
TTSEKIHER

SEQ ID NO: 162451 - protein, 9 aa, Homo sapiens
  Native (SSX2_HUMAN)
TVGAQIPEK

SEQ ID NO: 162452 - protein, 9 aa, Homo sapiens
  Native (SSX2_HUMAN)
YEAMTKLGF

SEQ ID NO: 162453 - protein, 9 aa, Homo sapiens
  Native (SSX2_HUMAN)
YMKRKYEAM

SEQ ID NO: 162454 - protein, 9 aa, Artificial Sequence
  Description of Artificial Sequence: Synthetic peptide
  Seed: RLRERKQLV (SSX2_HUMAN)
RYRERKQLY

SEQ ID NO: 162455 - protein, 9 aa, Artificial Sequence
  Description of Artificial Sequence: Synthetic peptide
  Seed: YMKRKYEAM (SSX2_HUMAN)
YLKRKYEAY

SEQ ID NO: 162456 - protein, 9 aa, Artificial Sequence
  Description of Artificial Sequence: Synthetic peptide
  Seed: KAFDDIAKY (SSX2_HUMAN)
KTFDDIAKI

SEQ ID NO: 162457 - protein, 10 aa, Artificial Sequence
  Description of Artificial Sequence: Synthetic peptide
  Seed: KAFDDIAKYF (SSX2_HUMAN)
KGFDDIAKYF

SEQ ID NO: 162458 - protein, 9 aa, Artificial Sequence
  Description of Artificial Sequence: Synthetic peptide
  Seed: RLQGISPKI (SSX2_HUMAN)
RNQGISPKY

SEQ ID NO: 162459 - protein, 9 aa, Artificial Sequence
  Description of Artificial Sequence: Synthetic peptide
  Seed: RERKQLVIY (SSX2_HUMAN)
RMRKQLVIY

SEQ ID NO: 162460 - protein, 10 aa, Artificial Sequence
  Description of Artificial Sequence: Synthetic peptide
  Seed: GRLQGISPKI (SSX2_HUMAN)
GRLQGISPKF

SEQ ID NO: 162461 - protein, 10 aa, Artificial Sequence
  Description of Artificial Sequence: Synthetic peptide
  Seed: LGFKATLPPF (SSX2_HUMAN)
LMFKATLPPY

SEQ ID NO: 162462 - protein, 9 aa, Artificial Sequence
  Description of Artificial Sequence: Synthetic peptide
  Seed: RKYEAMTKL (SSX2_HUMAN)
RSYEAMTKL

SEQ ID NO: 162463 - protein, 9 aa, Artificial Sequence
  Description of Artificial Sequence: Synthetic peptide
  Seed: KAFDDIAKY (SSX2_HUMAN)
KAFDDIAKF

SEQ ID NO: 162464 - protein, 10 aa, Artificial Sequence
  Description of Artificial Sequence: Synthetic peptide
  Seed: KIFYVYMKRK (SSX2_HUMAN)
KMFYVYMKRI

SEQ ID NO: 162465 - protein, 9 aa, Artificial Sequence
  Description of Artificial Sequence: Synthetic peptide
  Seed: MTFGRLQGI (SSX2_HUMAN)
MSFGRLQGM

SEQ ID NO: 162466 - protein, 9 aa, Artificial Sequence
  Description of Artificial Sequence: Synthetic peptide
  Seed: AFDDIAKYF (SSX2_HUMAN)
AIDDIAKYV

SEQ ID NO: 162467 - protein, 10 aa, Artificial Sequence
  Description of Artificial Sequence: Synthetic peptide
  Seed: RLQGISPKIM (SSX2_HUMAN)
RQQGISPKIF

SEQ ID NO: 162468 - protein, 10 aa, Artificial Sequence
  Description of Artificial Sequence: Synthetic peptide
  Seed: QGISPKIMPK (SSX2_HUMAN)
QMISPKIMPK

SEQ ID NO: 162469 - protein, 8 aa, Artificial Sequence
  Description of Artificial Sequence: Synthetic peptide
  Seed: KIFYVYMK (SSX2_HUMAN)
KSFYVYMR

SEQ ID NO: 162470 - protein, 9 aa, Artificial Sequence
  Description of Artificial Sequence: Synthetic peptide
  Seed: MTFGRLQGI (SSX2_HUMAN)
MVFGRLQGY

SEQ ID NO: 162471 - protein, 9 aa, Artificial Sequence
  Description of Artificial Sequence: Synthetic peptide
  Seed: RRPTVGAQI (SSX2_HUMAN)
RRPTVGAQY

SEQ ID NO: 162472 - protein, 11 aa, Artificial Sequence
  Description of Artificial Sequence: Synthetic peptide
  Seed: FGRLQGISPKI (SSX2_HUMAN)
FARLQGISPKL

SEQ ID NO: 162473 - protein, 9 aa, Artificial Sequence
  Description of Artificial Sequence: Synthetic peptide
  Seed: AFDDIAKYF (SSX2_HUMAN)
AIDDIAKYM

SEQ ID NO: 162474 - protein, 9 aa, Artificial Sequence
  Description of Artificial Sequence: Synthetic peptide
  Seed: KAFDDIAKY (SSX2_HUMAN)
KQFDDIAKL

SEQ ID NO: 162475 - protein, 11 aa, Artificial Sequence
  Description of Artificial Sequence: Synthetic peptide
  Seed: RKYEAMTKLGF (SSX2_HUMAN)
RRYEAMTKLGW

SEQ ID NO: 162476 - protein, 9 aa, Artificial Sequence
  Description of Artificial Sequence: Synthetic peptide
  Seed: FSKEEWEKM (SSX2_HUMAN)
FAKEEWEKL

SEQ ID NO: 162477 - protein, 9 aa, Artificial Sequence
  Description of Artificial Sequence: Synthetic peptide
  Seed: KAFDDIAKY (SSX2_HUMAN)
KEFDDIAKF

SEQ ID NO: 162478 - protein, 9 aa, Artificial Sequence
  Description of Artificial Sequence: Synthetic peptide
  Seed: KASEKIFYV (SSX2_HUMAN)
KISEKIFYK

SEQ ID NO: 162479 - protein, 10 aa, Artificial Sequence
  Description of Artificial Sequence: Synthetic peptide
  Seed: MTKLGFKATL (SSX2_HUMAN)
MEKLGFKATF

SEQ ID NO: 162480 - protein, 10 aa, Artificial Sequence
  Description of Artificial Sequence: Synthetic peptide
  Seed: QMTFGRLQGI (SSX2_HUMAN)
QDTFGRLQGV

SEQ ID NO: 162481 - protein, 9 aa, Artificial Sequence
  Description of Artificial Sequence: Synthetic peptide
  Seed: AFDDIAKYF (SSX2_HUMAN)
AYDDIAKYC

SEQ ID NO: 162482 - protein, 9 aa, Artificial Sequence
  Description of Artificial Sequence: Synthetic peptide
  Seed: RLRERKQLV (SSX2_HUMAN)
RVRERKQLI

SEQ ID NO: 162483 - protein, 8 aa, Artificial Sequence
  Description of Artificial Sequence: Synthetic peptide
  Seed: NQVERPQM (SSX2_HUMAN)
NQVERPQV

SEQ ID NO: 162484 - protein, 11 aa, Artificial Sequence
  Description of Artificial Sequence: Synthetic peptide
  Seed: KATLPPFMCNK (SSX2_HUMAN)
KITLPPFMCNR

SEQ ID NO: 162485 - protein, 9 aa, Artificial Sequence
  Description of Artificial Sequence: Synthetic peptide
  Seed: MPKKPAEEG (SSX2_HUMAN)
MPKKPAEEF

SEQ ID NO: 162486 - protein, 9 aa, Artificial Sequence
  Description of Artificial Sequence: Synthetic peptide
  Seed: NDSEEVPEA (SSX2_HUMAN)
NESEEVPEM

SEQ ID NO: 162487 - protein, 10 aa, Artificial Sequence
  Description of Artificial Sequence: Synthetic peptide
  Seed: SGPQNDGKEL (SSX2_HUMAN)
SVPQNDGKEL

SEQ ID NO: 162488 - protein, 10 aa, Artificial Sequence
  Description of Artificial Sequence: Synthetic peptide
  Seed: KMKASEKIFY (SSX2_HUMAN)
KSKASEKIFK

SEQ ID NO: 162489 - protein, 9 aa, Artificial Sequence
  Description of Artificial Sequence: Synthetic peptide
  Seed: MNGDDAFAR (SSX2_HUMAN)
MAGDDAFAL

SEQ ID NO: 162490 - protein, 9 aa, Artificial Sequence
  Description of Artificial Sequence: Synthetic peptide
  Seed: KQLVIYEEI (SSX2_HUMAN)
KTLVIYEEF

SEQ ID NO: 162491 - protein, 9 aa, Artificial Sequence
  Description of Artificial Sequence: Synthetic peptide
  Seed: AFDDIAKYF (SSX2_HUMAN)
AQDDIAKYV

SEQ ID NO: 162492 - protein, 10 aa, Artificial Sequence
  Description of Artificial Sequence: Synthetic peptide
  Seed: TLPPFMCNKR (SSX2_HUMAN)
TAPPFMCNKR

SEQ ID NO: 162493 - protein, 10 aa, Artificial Sequence
  Description of Artificial Sequence: Synthetic peptide
  Seed: TLPPFMCNKR (SSX2_HUMAN)
TIPPFMCNKR

SEQ ID NO: 162494 - protein, 9 aa, Artificial Sequence
  Description of Artificial Sequence: Synthetic peptide
  Seed: TTSEKIHER (SSX2_HUMAN)
TVSEKIHEK

SEQ ID NO: 162495 - protein, 9 aa, Artificial Sequence
  Description of Artificial Sequence: Synthetic peptide
  Seed: TTSEKIHER (SSX2_HUMAN)
TLSEKIHEY

SEQ ID NO: 162496 - protein, 11 aa, Artificial Sequence
  Description of Artificial Sequence: Synthetic peptide
  Seed: ASGPQNDGKEL (SSX2_HUMAN)
AAGPQNDGKEY

SEQ ID NO: 162497 - protein, 10 aa, Artificial Sequence
  Description of Artificial Sequence: Synthetic peptide
  Seed: KMKASEKIFY (SSX2_HUMAN)
KQKASEKIFF

SEQ ID NO: 162498 - protein, 9 aa, Artificial Sequence
  Description of Artificial Sequence: Synthetic peptide
  Seed: FKATLPPFM (SSX2_HUMAN)
FMATLPPFF

SEQ ID NO: 162499 - protein, 8 aa, Artificial Sequence
  Description of Artificial Sequence: Synthetic peptide
  Seed: VGAQIPEK (SSX2_HUMAN)
VAAQIPEM

SEQ ID NO: 162500 - protein, 9 aa, Artificial Sequence
  Description of Artificial Sequence: Synthetic peptide
  Seed: DDIAKYFSK (SSX2_HUMAN)
DIIAKYFSK

SEQ ID NO: 162501 - protein, 9 aa, Artificial Sequence
  Description of Artificial Sequence: Synthetic peptide
  Seed: AEDFQGNDL (SSX2_HUMAN)
AADFQGNDL

SEQ ID NO: 162502 - protein, 10 aa, Artificial Sequence
  Description of Artificial Sequence: Synthetic peptide
  Seed: KAFDDIAKYF (SSX2_HUMAN)
KTFDDIAKYR

SEQ ID NO: 162503 - protein, 9 aa, Artificial Sequence
  Description of Artificial Sequence: Synthetic peptide
  Seed: DAFARRPTV (SSX2_HUMAN)
DLFARRPTL

SEQ ID NO: 162504 - protein, 11 aa, Artificial Sequence
  Description of Artificial Sequence: Synthetic peptide
  Seed: FGRLQGISPKI (SSX2_HUMAN)
FMRLQGISPKV

SEQ ID NO: 162505 - protein, 9 aa, Artificial Sequence
  Description of Artificial Sequence: Synthetic peptide
  Seed: TTSEKIHER (SSX2_HUMAN)
TQSEKIHEL

SEQ ID NO: 162506 - protein, 11 aa, Artificial Sequence
  Description of Artificial Sequence: Synthetic peptide
  Seed: FGRLQGISPKI (SSX2_HUMAN)
FRRLQGISPKV

SEQ ID NO: 162507 - protein, 11 aa, Artificial Sequence
  Description of Artificial Sequence: Synthetic peptide
  Seed: KMKASEKIFYV (SSX2_HUMAN)
KTKASEKIFYV

SEQ ID NO: 162508 - protein, 10 aa, Artificial Sequence
  Description of Artificial Sequence: Synthetic peptide
  Seed: EKIFYVYMKR (SSX2_HUMAN)
EFIFYVYMKK

SEQ ID NO: 162509 - protein, 10 aa, Artificial Sequence
  Description of Artificial Sequence: Synthetic peptide
  Seed: VYMKRKYEAM (SSX2_HUMAN)
VNMKRKYEAM

SEQ ID NO: 162510 - protein, 9 aa, Artificial Sequence
  Description of Artificial Sequence: Synthetic peptide
  Seed: KAFDDIAKY (SSX2_HUMAN)
KQFDDIAKR

SEQ ID NO: 162511 - protein, 9 aa, Artificial Sequence
  Description of Artificial Sequence: Synthetic peptide
  Seed: MTFGRLQGI (SSX2_HUMAN)
MMFGRLQGT

SEQ ID NO: 162512 - protein, 11 aa, Artificial Sequence
  Description of Artificial Sequence: Synthetic peptide
  Seed: RSGPKRGEHAW (SSX2_HUMAN)
RMGPKRGEHAW

SEQ ID NO: 162513 - protein, 10 aa, Artificial Sequence
  Description of Artificial Sequence: Synthetic peptide
  Seed: ATLPPFMCNK (SSX2_HUMAN)
ALLPPFMCNK

SEQ ID NO: 162514 - protein, 10 aa, Artificial Sequence
  Description of Artificial Sequence: Synthetic peptide
  Seed: MTKLGFKATL (SSX2_HUMAN)
MAKLGFKATK

SEQ ID NO: 162515 - protein, 9 aa, Artificial Sequence
  Description of Artificial Sequence: Synthetic peptide
  Seed: MTFGRLQGI (SSX2_HUMAN)
MVFGRLQGF

SEQ ID NO: 162516 - protein, 9 aa, Artificial Sequence
  Description of Artificial Sequence: Synthetic peptide
  Seed: KASEKIFYV (SSX2_HUMAN)
KGSEKIFYY

SEQ ID NO: 162517 - protein, 9 aa, Artificial Sequence
  Description of Artificial Sequence: Synthetic peptide
  Seed: AQIPEKIQK (SSX2_HUMAN)
AKIPEKIQF

SEQ ID NO: 162518 - protein, 10 aa, Artificial Sequence
  Description of Artificial Sequence: Synthetic peptide
  Seed: KAFDDIAKYF (SSX2_HUMAN)
KTFDDIAKYI

SEQ ID NO: 162519 - protein, 9 aa, Artificial Sequence
  Description of Artificial Sequence: Synthetic peptide
  Seed: QIPEKIQKA (SSX2_HUMAN)
QSPEKIQKI

SEQ ID NO: 162520 - protein, 11 aa, Artificial Sequence
  Description of Artificial Sequence: Synthetic peptide
  Seed: KYFSKEEWEKM (SSX2_HUMAN)
KYFSKEEWEKF

SEQ ID NO: 162521 - protein, 9 aa, Artificial Sequence
  Description of Artificial Sequence: Synthetic peptide
  Seed: EAMTKLGFK (SSX2_HUMAN)
EIMTKLGFR

SEQ ID NO: 162522 - protein, 9 aa, Artificial Sequence
  Description of Artificial Sequence: Synthetic peptide
  Seed: MTFGRLQGI (SSX2_HUMAN)
MMFGRLQGM

SEQ ID NO: 162523 - protein, 9 aa, Artificial Sequence
  Description of Artificial Sequence: Synthetic peptide
  Seed: RLRERKQLV (SSX2_HUMAN)
RTRERKQLG

SEQ ID NO: 162524 - protein, 9 aa, Artificial Sequence
  Description of Artificial Sequence: Synthetic peptide
  Seed: TTSEKIHER (SSX2_HUMAN)
TMSEKIHEM

SEQ ID NO: 162525 - protein, 10 aa, Artificial Sequence
  Description of Artificial Sequence: Synthetic peptide
  Seed: EASGPQNDGK (SSX2_HUMAN)
ETSGPQNDGK

SEQ ID NO: 162526 - protein, 9 aa, Artificial Sequence
  Description of Artificial Sequence: Synthetic peptide
  Seed: TLPPFMCNK (SSX2_HUMAN)
TTPPFMCNK

SEQ ID NO: 162527 - protein, 9 aa, Artificial Sequence
  Description of Artificial Sequence: Synthetic peptide
  Seed: EAMTKLGFK (SSX2_HUMAN)
ESMTKLGFK

SEQ ID NO: 162528 - protein, 10 aa, Artificial Sequence
  Description of Artificial Sequence: Synthetic peptide
  Seed: KIFYVYMKRK (SSX2_HUMAN)
KAFYVYMKRK

SEQ ID NO: 162529 - protein, 10 aa, Artificial Sequence
  Description of Artificial Sequence: Synthetic peptide
  Seed: KASEKIFYVY (SSX2_HUMAN)
KKSEKIFYVW

SEQ ID NO: 162530 - protein, 9 aa, Artificial Sequence
  Description of Artificial Sequence: Synthetic peptide
  Seed: KQLVIYEEI (SSX2_HUMAN)
KQLVIYEEY

SEQ ID NO: 162531 - protein, 9 aa, Artificial Sequence
  Description of Artificial Sequence: Synthetic peptide
  Seed: RERKQLVIY (SSX2_HUMAN)
RIRKQLVIY

SEQ ID NO: 162532 - protein, 8 aa, Artificial Sequence
  Description of Artificial Sequence: Synthetic peptide
  Seed: AFDDIAKY (SSX2_HUMAN)
ATDDIAKM

SEQ ID NO: 162533 - protein, 9 aa, Artificial Sequence
  Description of Artificial Sequence: Synthetic peptide
  Seed: MTFGRLQGI (SSX2_HUMAN)
MQFGRLQGR

SEQ ID NO: 162534 - protein, 10 aa, Artificial Sequence
  Description of Artificial Sequence: Synthetic peptide
  Seed: KIFYVYMKRK (SSX2_HUMAN)
KAFYVYMKRR

SEQ ID NO: 162535 - protein, 11 aa, Artificial Sequence
  Description of Artificial Sequence: Synthetic peptide
  Seed: KATLPPFMCNK (SSX2_HUMAN)
KQTLPPFMCNR

SEQ ID NO: 162536 - protein, 10 aa, Artificial Sequence
  Description of Artificial Sequence: Synthetic peptide
  Seed: YMKRKYEAMT (SSX2_HUMAN)
YAKRKYEAML

SEQ ID NO: 162537 - protein, 10 aa, Artificial Sequence
  Description of Artificial Sequence: Synthetic peptide
  Seed: GISPKIMPKK (SSX2_HUMAN)
GSSPKIMPKK

SEQ ID NO: 162538 - protein, 9 aa, Artificial Sequence
  Description of Artificial Sequence: Synthetic peptide
  Seed: KQLVIYEEI (SSX2_HUMAN)
KILVIYEEW

SEQ ID NO: 162539 - protein, 10 aa, Artificial Sequence
  Description of Artificial Sequence: Synthetic peptide
  Seed: AFARRPTVGA (SSX2_HUMAN)
ATARRPTVGA

SEQ ID NO: 162540 - protein, 10 aa, Artificial Sequence
  Description of Artificial Sequence: Synthetic peptide
  Seed: QMTFGRLQGI (SSX2_HUMAN)
QQTFGRLQGV

SEQ ID NO: 162541 - protein, 9 aa, Artificial Sequence
  Description of Artificial Sequence: Synthetic peptide
  Seed: YMKRKYEAM (SSX2_HUMAN)
YKKRKYEAF

SEQ ID NO: 162542 - protein, 9 aa, Artificial Sequence
  Description of Artificial Sequence: Synthetic peptide
  Seed: YMKRKYEAM (SSX2_HUMAN)
YYKRKYEAM

SEQ ID NO: 162543 - protein, 9 aa, Artificial Sequence
  Description of Artificial Sequence: Synthetic peptide
  Seed: TTSEKIHER (SSX2_HUMAN)
TFSEKIHER

SEQ ID NO: 162544 - protein, 9 aa, Artificial Sequence
  Description of Artificial Sequence: Synthetic peptide
  Seed: AFDDIAKYF (SSX2_HUMAN)
AFDDIAKYW

SEQ ID NO: 162545 - protein, 9 aa, Artificial Sequence
  Description of Artificial Sequence: Synthetic peptide
  Seed: ASEKIFYVY (SSX2_HUMAN)
ASEKIFYVF

SEQ ID NO: 162546 - protein, 9 aa, Artificial Sequence
  Description of Artificial Sequence: Synthetic peptide
  Seed: GISPKIMPK (SSX2_HUMAN)
GQSPKIMPR

SEQ ID NO: 162547 - protein, 10 aa, Artificial Sequence
  Description of Artificial Sequence: Synthetic peptide
  Seed: NQVERPQMTF (SSX2_HUMAN)
NMVERPQMTY

SEQ ID NO: 162548 - protein, 10 aa, Artificial Sequence
  Description of Artificial Sequence: Synthetic peptide
  Seed: KMKASEKIFY (SSX2_HUMAN)
KMKASEKIFW

SEQ ID NO: 162549 - protein, 9 aa, Artificial Sequence
  Description of Artificial Sequence: Synthetic peptide
  Seed: KASEKIFYV (SSX2_HUMAN)
KNSEKIFYR

SEQ ID NO: 162550 - protein, 9 aa, Artificial Sequence
  Description of Artificial Sequence: Synthetic peptide
  Seed: SPKIMPKKP (SSX2_HUMAN)
SPKIMPKKI

SEQ ID NO: 162551 - protein, 9 aa, Artificial Sequence
  Description of Artificial Sequence: Synthetic peptide
  Seed: TTSEKIHER (SSX2_HUMAN)
TLSEKIHEF

SEQ ID NO: 162552 - protein, 10 aa, Artificial Sequence
  Description of Artificial Sequence: Synthetic peptide
  Seed: VYMKRKYEAM (SSX2_HUMAN)
VPMKRKYEAI

SEQ ID NO: 162553 - protein, 10 aa, Artificial Sequence
  Description of Artificial Sequence: Synthetic peptide
  Seed: SGPQNDGKEL (SSX2_HUMAN)
SMPQNDGKEM

SEQ ID NO: 162554 - protein, 9 aa, Artificial Sequence
  Description of Artificial Sequence: Synthetic peptide
  Seed: SEEVPEASG (SSX2_HUMAN)
SEEVPEASP

SEQ ID NO: 162555 - protein, 9 aa, Artificial Sequence
  Description of Artificial Sequence: Synthetic peptide
  Seed: AFDDIAKYF (SSX2_HUMAN)
AGDDIAKYM

SEQ ID NO: 162556 - protein, 10 aa, Artificial Sequence
  Description of Artificial Sequence: Synthetic peptide
  Seed: KAFDDIAKYF (SSX2_HUMAN)
KAFDDIAKYM

SEQ ID NO: 162557 - protein, 8 aa, Artificial Sequence
  Description of Artificial Sequence: Synthetic peptide
  Seed: YMKRKYEA (SSX2_HUMAN)
YVKRKYEL

SEQ ID NO: 162558 - protein, 8 aa, Artificial Sequence
  Description of Artificial Sequence: Synthetic peptide
  Seed: MKRKYEAM (SSX2_HUMAN)
MQRKYEAF

SEQ ID NO: 162559 - protein, 9 aa, Artificial Sequence
  Description of Artificial Sequence: Synthetic peptide
  Seed: YMKRKYEAM (SSX2_HUMAN)
YKKRKYEAL

SEQ ID NO: 162560 - protein, 9 aa, Artificial Sequence
  Description of Artificial Sequence: Synthetic peptide
  Seed: CPPGKPTTS (SSX2_HUMAN)
CPPGKPTTI

SEQ ID NO: 162561 - protein, 11 aa, Artificial Sequence
  Description of Artificial Sequence: Synthetic peptide
  Seed: KYEAMTKLGFK (SSX2_HUMAN)
KREAMTKLGFR

SEQ ID NO: 162562 - protein, 11 aa, Artificial Sequence
  Description of Artificial Sequence: Synthetic peptide
  Seed: KLGFKATLPPF (SSX2_HUMAN)
KYGFKATLPPW

SEQ ID NO: 162563 - protein, 11 aa, Artificial Sequence
  Description of Artificial Sequence: Synthetic peptide
  Seed: AQIPEKIQKAF (SSX2_HUMAN)
AAIPEKIQKAY

SEQ ID NO: 162564 - protein, 9 aa, Artificial Sequence
  Description of Artificial Sequence: Synthetic peptide
  Seed: RKYEAMTKL (SSX2_HUMAN)
RHYEAMTKM

SEQ ID NO: 162565 - protein, 9 aa, Artificial Sequence
  Description of Artificial Sequence: Synthetic peptide
  Seed: FARRPTVGA (SSX2_HUMAN)
FGRRPTVGY

SEQ ID NO: 162566 - protein, 9 aa, Artificial Sequence
  Description of Artificial Sequence: Synthetic peptide
  Seed: MNGDDAFAR (SSX2_HUMAN)
MSGDDAFAR

SEQ ID NO: 162567 - protein, 10 aa, Artificial Sequence
  Description of Artificial Sequence: Synthetic peptide
  Seed: KASEKIFYVY (SSX2_HUMAN)
KVSEKIFYVW

SEQ ID NO: 162568 - protein, 10 aa, Artificial Sequence
  Description of Artificial Sequence: Synthetic peptide
  Seed: MKASEKIFYV (SSX2_HUMAN)
MQASEKIFYI

SEQ ID NO: 162569 - protein, 9 aa, Artificial Sequence
  Description of Artificial Sequence: Synthetic peptide
  Seed: RKYEAMTKL (SSX2_HUMAN)
RRYEAMTKI

SEQ ID NO: 162570 - protein, 10 aa, Artificial Sequence
  Description of Artificial Sequence: Synthetic peptide
  Seed: QGISPKIMPK (SSX2_HUMAN)
QIISPKIMPR

SEQ ID NO: 162571 - protein, 10 aa, Artificial Sequence
  Description of Artificial Sequence: Synthetic peptide
  Seed: KIFYVYMKRK (SSX2_HUMAN)
KMFYVYMKRP

SEQ ID NO: 162572 - protein, 11 aa, Artificial Sequence
  Description of Artificial Sequence: Synthetic peptide
  Seed: YVYMKRKYEAM (SSX2_HUMAN)
YFYMKRKYEAL

SEQ ID NO: 162573 - protein, 9 aa, Artificial Sequence
  Description of Artificial Sequence: Synthetic peptide
  Seed: RLQGISPKI (SSX2_HUMAN)
RQQGISPKL

SEQ ID NO: 162574 - protein, 9 aa, Artificial Sequence
  Description of Artificial Sequence: Synthetic peptide
  Seed: GISPKIMPK (SSX2_HUMAN)
GVSPKIMPK

SEQ ID NO: 162575 - protein, 10 aa, Artificial Sequence
  Description of Artificial Sequence: Synthetic peptide
  Seed: MTKLGFKATL (SSX2_HUMAN)
MAKLGFKATY

SEQ ID NO: 162576 - protein, 9 aa, Artificial Sequence
  Description of Artificial Sequence: Synthetic peptide
  Seed: AKYFSKEEW (SSX2_HUMAN)
AKYFSKEEY

SEQ ID NO: 162577 - protein, 9 aa, Artificial Sequence
  Description of Artificial Sequence: Synthetic peptide
  Seed: RGEHAWTHR (SSX2_HUMAN)
RFEHAWTHR

SEQ ID NO: 162578 - protein, 9 aa, Artificial Sequence
  Description of Artificial Sequence: Synthetic peptide
  Seed: RKYEAMTKL (SSX2_HUMAN)
RIYEAMTKM

SEQ ID NO: 162579 - protein, 9 aa, Artificial Sequence
  Description of Artificial Sequence: Synthetic peptide
  Seed: TTSEKIHER (SSX2_HUMAN)
TSSEKIHEI

SEQ ID NO: 162580 - protein, 9 aa, Artificial Sequence
  Description of Artificial Sequence: Synthetic peptide
  Seed: YMKRKYEAM (SSX2_HUMAN)
YFKRKYEAA

SEQ ID NO: 162581 - protein, 9 aa, Artificial Sequence
  Description of Artificial Sequence: Synthetic peptide
  Seed: KIFYVYMKR (SSX2_HUMAN)
KIFYVYMKK

SEQ ID NO: 162582 - protein, 9 aa, Artificial Sequence
  Description of Artificial Sequence: Synthetic peptide
  Seed: KASEKIFYV (SSX2_HUMAN)
KMSEKIFYY

SEQ ID NO: 162583 - protein, 9 aa, Artificial Sequence
  Description of Artificial Sequence: Synthetic peptide
  Seed: TKLGFKATL (SSX2_HUMAN)
TQLGFKATL

SEQ ID NO: 162584 - protein, 11 aa, Artificial Sequence
  Description of Artificial Sequence: Synthetic peptide
  Seed: KRAEDFQGNDL (SSX2_HUMAN)
KHAEDFQGNDI

SEQ ID NO: 162585 - protein, 9 aa, Artificial Sequence
  Description of Artificial Sequence: Synthetic peptide
  Seed: QIPEKIQKA (SSX2_HUMAN)
QTPEKIQKL

SEQ ID NO: 162586 - protein, 9 aa, Artificial Sequence
  Description of Artificial Sequence: Synthetic peptide
  Seed: GFKATLPPF (SSX2_HUMAN)
GLKATLPPM

SEQ ID NO: 162587 - protein, 9 aa, Artificial Sequence
  Description of Artificial Sequence: Synthetic peptide
  Seed: RLRERKQLV (SSX2_HUMAN)
RTRERKQLT

SEQ ID NO: 162588 - protein, 9 aa, Artificial Sequence
  Description of Artificial Sequence: Synthetic peptide
  Seed: RRPTVGAQI (SSX2_HUMAN)
RAPTVGAQL

SEQ ID NO: 162589 - protein, 9 aa, Artificial Sequence
  Description of Artificial Sequence: Synthetic peptide
  Seed: HERSGPKRG (SSX2_HUMAN)
HERSGPKRV

SEQ ID NO: 162590 - protein, 11 aa, Artificial Sequence
  Description of Artificial Sequence: Synthetic peptide
  Seed: FGRLQGISPKI (SSX2_HUMAN)
FGRLQGISPKV

SEQ ID NO: 162591 - protein, 10 aa, Artificial Sequence
  Description of Artificial Sequence: Synthetic peptide
  Seed: LGFKATLPPF (SSX2_HUMAN)
LHFKATLPPF

SEQ ID NO: 162592 - protein, 10 aa, Artificial Sequence
  Description of Artificial Sequence: Synthetic peptide
  Seed: MKRKYEAMTK (SSX2_HUMAN)
MMRKYEAMTK

SEQ ID NO: 162593 - protein, 9 aa, Artificial Sequence
  Description of Artificial Sequence: Synthetic peptide
  Seed: KASEKIFYV (SSX2_HUMAN)
KFSEKIFYY

SEQ ID NO: 162594 - protein, 11 aa, Artificial Sequence
  Description of Artificial Sequence: Synthetic peptide
  Seed: YMKRKYEAMTK (SSX2_HUMAN)
YMKRKYEAMTM

SEQ ID NO: 162595 - protein, 9 aa, Artificial Sequence
  Description of Artificial Sequence: Synthetic peptide
  Seed: KAFDDIAKY (SSX2_HUMAN)
KTFDDIAKV

SEQ ID NO: 162596 - protein, 9 aa, Artificial Sequence
  Description of Artificial Sequence: Synthetic peptide
  Seed: KAFDDIAKY (SSX2_HUMAN)
KLFDDIAKK

SEQ ID NO: 162597 - protein, 9 aa, Artificial Sequence
  Description of Artificial Sequence: Synthetic peptide
  Seed: ASEKIFYVY (SSX2_HUMAN)
AQEKIFYVY

SEQ ID NO: 162598 - protein, 9 aa, Artificial Sequence
  Description of Artificial Sequence: Synthetic peptide
  Seed: FKATLPPFM (SSX2_HUMAN)
FMATLPPFM

SEQ ID NO: 162599 - protein, 11 aa, Artificial Sequence
  Description of Artificial Sequence: Synthetic peptide
  Seed: KMKASEKIFYV (SSX2_HUMAN)
KLKASEKIFYV

SEQ ID NO: 162600 - protein, 8 aa, Artificial Sequence
  Description of Artificial Sequence: Synthetic peptide
  Seed: MKRKYEAM (SSX2_HUMAN)
MPRKYEAM

SEQ ID NO: 162601 - protein, 10 aa, Artificial Sequence
  Description of Artificial Sequence: Synthetic peptide
  Seed: QGISPKIMPK (SSX2_HUMAN)
QVISPKIMPR

SEQ ID NO: 162602 - protein, 10 aa, Artificial Sequence
  Description of Artificial Sequence: Synthetic peptide
  Seed: VYMKRKYEAM (SSX2_HUMAN)
VFMKRKYEAM

SEQ ID NO: 162603 - protein, 10 aa, Artificial Sequence
  Description of Artificial Sequence: Synthetic peptide
  Seed: KAFDDIAKYF (SSX2_HUMAN)
KAFDDIAKYL

SEQ ID NO: 162604 - protein, 9 aa, Artificial Sequence
  Description of Artificial Sequence: Synthetic peptide
  Seed: KQLVIYEEI (SSX2_HUMAN)
KELVIYEEV

SEQ ID NO: 162605 - protein, 10 aa, Artificial Sequence
  Description of Artificial Sequence: Synthetic peptide
  Seed: MKASEKIFYV (SSX2_HUMAN)
MFASEKIFYV

SEQ ID NO: 162606 - protein, 8 aa, Artificial Sequence
  Description of Artificial Sequence: Synthetic peptide
  Seed: FDDIAKYF (SSX2_HUMAN)
FLDIAKYI

SEQ ID NO: 162607 - protein, 9 aa, Artificial Sequence
  Description of Artificial Sequence: Synthetic peptide
  Seed: AEDFQGNDL (SSX2_HUMAN)
AADFQGNDV

SEQ ID NO: 162608 - protein, 11 aa, Artificial Sequence
  Description of Artificial Sequence: Synthetic peptide
  Seed: FGRLQGISPKI (SSX2_HUMAN)
FFRLQGISPKL

SEQ ID NO: 162609 - protein, 10 aa, Artificial Sequence
  Description of Artificial Sequence: Synthetic peptide
  Seed: MKASEKIFYV (SSX2_HUMAN)
MIASEKIFYL

SEQ ID NO: 162610 - protein, 9 aa, Artificial Sequence
  Description of Artificial Sequence: Synthetic peptide
  Seed: AEDFQGNDL (SSX2_HUMAN)
AVDFQGNDI

SEQ ID NO: 162611 - protein, 9 aa, Artificial Sequence
  Description of Artificial Sequence: Synthetic peptide
  Seed: FSKEEWEKM (SSX2_HUMAN)
FQKEEWEKM

SEQ ID NO: 162612 - protein, 9 aa, Artificial Sequence
  Description of Artificial Sequence: Synthetic peptide
  Seed: GRLQGISPK (SSX2_HUMAN)
GRLQGISPM

SEQ ID NO: 162613 - protein, 9 aa, Artificial Sequence
  Description of Artificial Sequence: Synthetic peptide
  Seed: YEAMTKLGF (SSX2_HUMAN)
YLAMTKLGY

SEQ ID NO: 162614 - protein, 9 aa, Artificial Sequence
  Description of Artificial Sequence: Synthetic peptide
  Seed: YMKRKYEAM (SSX2_HUMAN)
YMKRKYEAC

SEQ ID NO: 162615 - protein, 8 aa, Artificial Sequence
  Description of Artificial Sequence: Synthetic peptide
  Seed: AFDDIAKY (SSX2_HUMAN)
AADDIAKL

SEQ ID NO: 162616 - protein, 9 aa, Artificial Sequence
  Description of Artificial Sequence: Synthetic peptide
  Seed: RLRERKQLV (SSX2_HUMAN)
RSRERKQLL

SEQ ID NO: 162617 - protein, 10 aa, Artificial Sequence
  Description of Artificial Sequence: Synthetic peptide
  Seed: KIHERSGPKR (SSX2_HUMAN)
KVHERSGPKK

SEQ ID NO: 162618 - protein, 11 aa, Artificial Sequence
  Description of Artificial Sequence: Synthetic peptide
  Seed: ASGPQNDGKEL (SSX2_HUMAN)
AAGPQNDGKEW

SEQ ID NO: 162619 - protein, 8 aa, Artificial Sequence
  Description of Artificial Sequence: Synthetic peptide
  Seed: YMKRKYEA (SSX2_HUMAN)
YPKRKYEI

SEQ ID NO: 162620 - protein, 10 aa, Artificial Sequence
  Description of Artificial Sequence: Synthetic peptide
  Seed: VYMKRKYEAM (SSX2_HUMAN)
VAMKRKYEAL

SEQ ID NO: 162621 - protein, 9 aa, Artificial Sequence
  Description of Artificial Sequence: Synthetic peptide
  Seed: GEHAWTHRL (SSX2_HUMAN)
GEHAWTHRW

SEQ ID NO: 162622 - protein, 9 aa, Artificial Sequence
  Description of Artificial Sequence: Synthetic peptide
  Seed: GEHAWTHRL (SSX2_HUMAN)
GEHAWTHRY

SEQ ID NO: 162623 - protein, 9 aa, Artificial Sequence
  Description of Artificial Sequence: Synthetic peptide
  Seed: KMKASEKIF (SSX2_HUMAN)
KLKASEKIY

SEQ ID NO: 162624 - protein, 9 aa, Artificial Sequence
  Description of Artificial Sequence: Synthetic peptide
  Seed: EEWEKMKAS (SSX2_HUMAN)
EEWEKMKAI

SEQ ID NO: 162625 - protein, 9 aa, Artificial Sequence
  Description of Artificial Sequence: Synthetic peptide
  Seed: SEKIFYVYM (SSX2_HUMAN)
SQKIFYVYY

SEQ ID NO: 162626 - protein, 9 aa, Artificial Sequence
  Description of Artificial Sequence: Synthetic peptide
  Seed: KIFYVYMKR (SSX2_HUMAN)
KTFYVYMKA

SEQ ID NO: 162627 - protein, 9 aa, Artificial Sequence
  Description of Artificial Sequence: Synthetic peptide
  Seed: RLRERKQLV (SSX2_HUMAN)
RIRERKQLM

SEQ ID NO: 162628 - protein, 9 aa, Artificial Sequence
  Description of Artificial Sequence: Synthetic peptide
  Seed: NDSEEVPEA (SSX2_HUMAN)
NESEEVPET

SEQ ID NO: 162629 - protein, 9 aa, Artificial Sequence
  Description of Artificial Sequence: Synthetic peptide
  Seed: GFKATLPPF (SSX2_HUMAN)
GKKATLPPY

SEQ ID NO: 162630 - protein, 9 aa, Artificial Sequence
  Description of Artificial Sequence: Synthetic peptide
  Seed: KASEKIFYV (SSX2_HUMAN)
KISEKIFYL

SEQ ID NO: 162631 - protein, 9 aa, Artificial Sequence
  Description of Artificial Sequence: Synthetic peptide
  Seed: KAFDDIAKY (SSX2_HUMAN)
KLFDDIAKY

SEQ ID NO: 162632 - protein, 11 aa, Artificial Sequence
  Description of Artificial Sequence: Synthetic peptide
  Seed: MKASEKIFYVY (SSX2_HUMAN)
MKASEKIFYVF

SEQ ID NO: 162633 - protein, 9 aa, Artificial Sequence
  Description of Artificial Sequence: Synthetic peptide
  Seed: GISPKIMPK (SSX2_HUMAN)
GSSPKIMPY

SEQ ID NO: 162634 - protein, 9 aa, Artificial Sequence
  Description of Artificial Sequence: Synthetic peptide
  Seed: KQLVIYEEI (SSX2_HUMAN)
KTLVIYEEY

SEQ ID NO: 162635 - protein, 11 aa, Artificial Sequence
  Description of Artificial Sequence: Synthetic peptide
  Seed: AQIPEKIQKAF (SSX2_HUMAN)
AMIPEKIQKAW

SEQ ID NO: 162636 - protein, 9 aa, Artificial Sequence
  Description of Artificial Sequence: Synthetic peptide
  Seed: TKLGFKATL (SSX2_HUMAN)
TRLGFKATI

SEQ ID NO: 162637 - protein, 11 aa, Artificial Sequence
  Description of Artificial Sequence: Synthetic peptide
  Seed: KYEAMTKLGFK (SSX2_HUMAN)
KLEAMTKLGFK

SEQ ID NO: 162638 - protein, 9 aa, Artificial Sequence
  Description of Artificial Sequence: Synthetic peptide
  Seed: KIHERSGPK (SSX2_HUMAN)
KVHERSGPI

SEQ ID NO: 162639 - protein, 9 aa, Artificial Sequence
  Description of Artificial Sequence: Synthetic peptide
  Seed: YMKRKYEAM (SSX2_HUMAN)
YMKRKYEAS

SEQ ID NO: 162640 - protein, 8 aa, Artificial Sequence
  Description of Artificial Sequence: Synthetic peptide
  Seed: YMKRKYEA (SSX2_HUMAN)
YVKRKYEM

SEQ ID NO: 162641 - protein, 9 aa, Artificial Sequence
  Description of Artificial Sequence: Synthetic peptide
  Seed: RLQGISPKI (SSX2_HUMAN)
RTQGISPKL

SEQ ID NO: 162642 - protein, 9 aa, Artificial Sequence
  Description of Artificial Sequence: Synthetic peptide
  Seed: TTSEKIHER (SSX2_HUMAN)
TASEKIHEV

SEQ ID NO: 162643 - protein, 9 aa, Artificial Sequence
  Description of Artificial Sequence: Synthetic peptide
  Seed: MTFGRLQGI (SSX2_HUMAN)
MSFGRLQGA

SEQ ID NO: 162644 - protein, 10 aa, Artificial Sequence
  Description of Artificial Sequence: Synthetic peptide
  Seed: AQIPEKIQKA (SSX2_HUMAN)
AEIPEKIQKI

SEQ ID NO: 162645 - protein, 9 aa, Artificial Sequence
  Description of Artificial Sequence: Synthetic peptide
  Seed: MTFGRLQGI (SSX2_HUMAN)
MTFGRLQGL

SEQ ID NO: 162646 - protein, 9 aa, Artificial Sequence
  Description of Artificial Sequence: Synthetic peptide
  Seed: IPEKIQKAF (SSX2_HUMAN)
IAEKIQKAY

SEQ ID NO: 162647 - protein, 9 aa, Artificial Sequence
  Description of Artificial Sequence: Synthetic peptide
  Seed: TTSEKIHER (SSX2_HUMAN)
TQSEKIHEM

SEQ ID NO: 162648 - protein, 9 aa, Artificial Sequence
  Description of Artificial Sequence: Synthetic peptide
  Seed: RKYEAMTKL (SSX2_HUMAN)
RTYEAMTKY

SEQ ID NO: 162649 - protein, 10 aa, Artificial Sequence
  Description of Artificial Sequence: Synthetic peptide
  Seed: KYFSKEEWEK (SSX2_HUMAN)
KIFSKEEWEK

SEQ ID NO: 162650 - protein, 8 aa, Artificial Sequence
  Description of Artificial Sequence: Synthetic peptide
  Seed: FDDIAKYF (SSX2_HUMAN)
FTDIAKYV

SEQ ID NO: 162651 - protein, 10 aa, Artificial Sequence
  Description of Artificial Sequence: Synthetic peptide
  Seed: KAFDDIAKYF (SSX2_HUMAN)
KSFDDIAKYR

SEQ ID NO: 162652 - protein, 9 aa, Artificial Sequence
  Description of Artificial Sequence: Synthetic peptide
  Seed: YMKRKYEAM (SSX2_HUMAN)
YCKRKYEAV

SEQ ID NO: 162653 - protein, 9 aa, Artificial Sequence
  Description of Artificial Sequence: Synthetic peptide
  Seed: AFDDIAKYF (SSX2_HUMAN)
ANDDIAKYI

SEQ ID NO: 162654 - protein, 9 aa, Artificial Sequence
  Description of Artificial Sequence: Synthetic peptide
  Seed: KASEKIFYV (SSX2_HUMAN)
KMSEKIFYP

SEQ ID NO: 162655 - protein, 9 aa, Artificial Sequence
  Description of Artificial Sequence: Synthetic peptide
  Seed: KATLPPFMC (SSX2_HUMAN)
KTTLPPFMW

SEQ ID NO: 162656 - protein, 9 aa, Artificial Sequence
  Description of Artificial Sequence: Synthetic peptide
  Seed: MKASEKIFY (SSX2_HUMAN)
MKASEKIFF

SEQ ID NO: 162657 - protein, 8 aa, Artificial Sequence
  Description of Artificial Sequence: Synthetic peptide
  Seed: YMKRKYEA (SSX2_HUMAN)
YLKRKYEL

SEQ ID NO: 162658 - protein, 10 aa, Artificial Sequence
  Description of Artificial Sequence: Synthetic peptide
  Seed: LGFKATLPPF (SSX2_HUMAN)
LKFKATLPPM

SEQ ID NO: 162659 - protein, 9 aa, Artificial Sequence
  Description of Artificial Sequence: Synthetic peptide
  Seed: QIPEKIQKA (SSX2_HUMAN)
QGPEKIQKM

SEQ ID NO: 162660 - protein, 9 aa, Artificial Sequence
  Description of Artificial Sequence: Synthetic peptide
  Seed: RRPTVGAQI (SSX2_HUMAN)
RYPTVGAQL

SEQ ID NO: 162661 - protein, 9 aa, Artificial Sequence
  Description of Artificial Sequence: Synthetic peptide
  Seed: DDIAKYFSK (SSX2_HUMAN)
DWIAKYFSR

SEQ ID NO: 162662 - protein, 10 aa, Artificial Sequence
  Description of Artificial Sequence: Synthetic peptide
  Seed: KAFDDIAKYF (SSX2_HUMAN)
KVFDDIAKYM

SEQ ID NO: 162663 - protein, 9 aa, Artificial Sequence
  Description of Artificial Sequence: Synthetic peptide
  Seed: KASEKIFYV (SSX2_HUMAN)
KASEKIFYW

SEQ ID NO: 162664 - protein, 9 aa, Artificial Sequence
  Description of Artificial Sequence: Synthetic peptide
  Seed: RKYEAMTKL (SSX2_HUMAN)
RMYEAMTKY

SEQ ID NO: 162665 - protein, 9 aa, Artificial Sequence
  Description of Artificial Sequence: Synthetic peptide
  Seed: AFDDIAKYF (SSX2_HUMAN)
ALDDIAKYW

SEQ ID NO: 162666 - protein, 9 aa, Artificial Sequence
  Description of Artificial Sequence: Synthetic peptide
  Seed: VYMKRKYEA (SSX2_HUMAN)
VYMKRKYEY

SEQ ID NO: 162667 - protein, 8 aa, Artificial Sequence
  Description of Artificial Sequence: Synthetic peptide
  Seed: AFDDIAKY (SSX2_HUMAN)
ATDDIAKI

SEQ ID NO: 162668 - protein, 9 aa, Artificial Sequence
  Description of Artificial Sequence: Synthetic peptide
  Seed: MTKLGFKAT (SSX2_HUMAN)
MAKLGFKAK

SEQ ID NO: 162669 - protein, 9 aa, Artificial Sequence
  Description of Artificial Sequence: Synthetic peptide
  Seed: KIHERSGPK (SSX2_HUMAN)
KLHERSGPR

SEQ ID NO: 162670 - protein, 11 aa, Artificial Sequence
  Description of Artificial Sequence: Synthetic peptide
  Seed: YVYMKRKYEAM (SSX2_HUMAN)
YTYMKRKYEAL

SEQ ID NO: 162671 - protein, 10 aa, Artificial Sequence
  Description of Artificial Sequence: Synthetic peptide
  Seed: YMKRKYEAMT (SSX2_HUMAN)
YMKRKYEAMM

SEQ ID NO: 162672 - protein, 9 aa, Artificial Sequence
  Description of Artificial Sequence: Synthetic peptide
  Seed: AQIPEKIQK (SSX2_HUMAN)
AMIPEKIQY

SEQ ID NO: 162673 - protein, 9 aa, Artificial Sequence
  Description of Artificial Sequence: Synthetic peptide
  Seed: FARRPTVGA (SSX2_HUMAN)
FARRPTVGV

SEQ ID NO: 162674 - protein, 10 aa, Artificial Sequence
  Description of Artificial Sequence: Synthetic peptide
  Seed: GRLQGISPKI (SSX2_HUMAN)
GMLQGISPKL

SEQ ID NO: 162675 - protein, 11 aa, Artificial Sequence
  Description of Artificial Sequence: Synthetic peptide
  Seed: YVYMKRKYEAM (SSX2_HUMAN)
YYYMKRKYEAL

SEQ ID NO: 162676 - protein, 9 aa, Artificial Sequence
  Description of Artificial Sequence: Synthetic peptide
  Seed: RLRERKQLV (SSX2_HUMAN)
RTRERKQLV

SEQ ID NO: 162677 - protein, 8 aa, Artificial Sequence
  Description of Artificial Sequence: Synthetic peptide
  Seed: SEKIFYVY (SSX2_HUMAN)
SEKIFYVF

SEQ ID NO: 162678 - protein, 8 aa, Artificial Sequence
  Description of Artificial Sequence: Synthetic peptide
  Seed: FDDIAKYF (SSX2_HUMAN)
FMDIAKYL

SEQ ID NO: 162679 - protein, 11 aa, Artificial Sequence
  Description of Artificial Sequence: Synthetic peptide
  Seed: YVYMKRKYEAM (SSX2_HUMAN)
YQYMKRKYEAL

SEQ ID NO: 162680 - protein, 11 aa, Artificial Sequence
  Description of Artificial Sequence: Synthetic peptide
  Seed: FGRLQGISPKI (SSX2_HUMAN)
FTRLQGISPKL

SEQ ID NO: 162681 - protein, 10 aa, Artificial Sequence
  Description of Artificial Sequence: Synthetic peptide
  Seed: AQIPEKIQKA (SSX2_HUMAN)
ALIPEKIQKF

SEQ ID NO: 162682 - protein, 9 aa, Artificial Sequence
  Description of Artificial Sequence: Synthetic peptide
  Seed: RLRERKQLV (SSX2_HUMAN)
RMRERKQLR

SEQ ID NO: 162683 - protein, 9 aa, Artificial Sequence
  Description of Artificial Sequence: Synthetic peptide
  Seed: MPKKPAEEG (SSX2_HUMAN)
MVKKPAEEM

SEQ ID NO: 162684 - protein, 11 aa, Artificial Sequence
  Description of Artificial Sequence: Synthetic peptide
  Seed: RKYEAMTKLGF (SSX2_HUMAN)
RMYEAMTKLGY

SEQ ID NO: 162685 - protein, 9 aa, Artificial Sequence
  Description of Artificial Sequence: Synthetic peptide
  Seed: KAFDDIAKY (SSX2_HUMAN)
KQFDDIAKM

SEQ ID NO: 162686 - protein, 9 aa, Artificial Sequence
  Description of Artificial Sequence: Synthetic peptide
  Seed: KIFYVYMKR (SSX2_HUMAN)
KTFYVYMKV

SEQ ID NO: 162687 - protein, 10 aa, Artificial Sequence
  Description of Artificial Sequence: Synthetic peptide
  Seed: YMKRKYEAMT (SSX2_HUMAN)
YMKRKYEAMW

SEQ ID NO: 162688 - protein, 9 aa, Artificial Sequence
  Description of Artificial Sequence: Synthetic peptide
  Seed: RLQGISPKI (SSX2_HUMAN)
RLQGISPKF

SEQ ID NO: 162689 - protein, 9 aa, Artificial Sequence
  Description of Artificial Sequence: Synthetic peptide
  Seed: YMKRKYEAM (SSX2_HUMAN)
YKKRKYEAY

SEQ ID NO: 162690 - protein, 9 aa, Artificial Sequence
  Description of Artificial Sequence: Synthetic peptide
  Seed: YMKRKYEAM (SSX2_HUMAN)
YEKRKYEAY

SEQ ID NO: 162691 - protein, 10 aa, Artificial Sequence
  Description of Artificial Sequence: Synthetic peptide
  Seed: KIFYVYMKRK (SSX2_HUMAN)
KMFYVYMKRM

SEQ ID NO: 162692 - protein, 11 aa, Artificial Sequence
  Description of Artificial Sequence: Synthetic peptide
  Seed: ATLPPFMCNKR (SSX2_HUMAN)
ALLPPFMCNKR

SEQ ID NO: 162693 - protein, 8 aa, Artificial Sequence
  Description of Artificial Sequence: Synthetic peptide
  Seed: FDDIAKYF (SSX2_HUMAN)
FGDIAKYF

SEQ ID NO: 162694 - protein, 10 aa, Artificial Sequence
  Description of Artificial Sequence: Synthetic peptide
  Seed: KMKASEKIFY (SSX2_HUMAN)
KVKASEKIFY

SEQ ID NO: 162695 - protein, 9 aa, Artificial Sequence
  Description of Artificial Sequence: Synthetic peptide
  Seed: EHAWTHRLR (SSX2_HUMAN)
EAAWTHRLR

SEQ ID NO: 162696 - protein, 10 aa, Artificial Sequence
  Description of Artificial Sequence: Synthetic peptide
  Seed: LGFKATLPPF (SSX2_HUMAN)
LSFKATLPPW

SEQ ID NO: 162697 - protein, 9 aa, Artificial Sequence
  Description of Artificial Sequence: Synthetic peptide
  Seed: KASEKIFYV (SSX2_HUMAN)
KTSEKIFYW

SEQ ID NO: 162698 - protein, 10 aa, Artificial Sequence
  Description of Artificial Sequence: Synthetic peptide
  Seed: QMTFGRLQGI (SSX2_HUMAN)
QGTFGRLQGV

SEQ ID NO: 162699 - protein, 8 aa, Artificial Sequence
  Description of Artificial Sequence: Synthetic peptide
  Seed: YMKRKYEA (SSX2_HUMAN)
YAKRKYEI

SEQ ID NO: 162700 - protein, 9 aa, Artificial Sequence
  Description of Artificial Sequence: Synthetic peptide
  Seed: AKYFSKEEW (SSX2_HUMAN)
AQYFSKEEW

SEQ ID NO: 162701 - protein, 9 aa, Artificial Sequence
  Description of Artificial Sequence: Synthetic peptide
  Seed: AEDFQGNDL (SSX2_HUMAN)
ATDFQGNDM

SEQ ID NO: 162702 - protein, 11 aa, Artificial Sequence
  Description of Artificial Sequence: Synthetic peptide
  Seed: RKYEAMTKLGF (SSX2_HUMAN)
RRYEAMTKLGL

SEQ ID NO: 162703 - protein, 9 aa, Artificial Sequence
  Description of Artificial Sequence: Synthetic peptide
  Seed: RERKQLVIY (SSX2_HUMAN)
RHRKQLVIY

SEQ ID NO: 162704 - protein, 9 aa, Artificial Sequence
  Description of Artificial Sequence: Synthetic peptide
  Seed: RLRERKQLV (SSX2_HUMAN)
RTRERKQLA

SEQ ID NO: 162705 - protein, 9 aa, Artificial Sequence
  Description of Artificial Sequence: Synthetic peptide
  Seed: RERKQLVIY (SSX2_HUMAN)
RMRKQLVIM

SEQ ID NO: 162706 - protein, 9 aa, Artificial Sequence
  Description of Artificial Sequence: Synthetic peptide
  Seed: YMKRKYEAM (SSX2_HUMAN)
YVKRKYEAL

SEQ ID NO: 162707 - protein, 9 aa, Artificial Sequence
  Description of Artificial Sequence: Synthetic peptide
  Seed: AKYFSKEEW (SSX2_HUMAN)
AAYFSKEEY

SEQ ID NO: 162708 - protein, 11 aa, Artificial Sequence
  Description of Artificial Sequence: Synthetic peptide
  Seed: KYEAMTKLGFK (SSX2_HUMAN)
KSEAMTKLGFR

SEQ ID NO: 162709 - protein, 9 aa, Artificial Sequence
  Description of Artificial Sequence: Synthetic peptide
  Seed: MTFGRLQGI (SSX2_HUMAN)
MQFGRLQGY

SEQ ID NO: 162710 - protein, 9 aa, Artificial Sequence
  Description of Artificial Sequence: Synthetic peptide
  Seed: RLRERKQLV (SSX2_HUMAN)
RQRERKQLY

SEQ ID NO: 162711 - protein, 9 aa, Artificial Sequence
  Description of Artificial Sequence: Synthetic peptide
  Seed: KIHERSGPK (SSX2_HUMAN)
KMHERSGPR

SEQ ID NO: 162712 - protein, 10 aa, Artificial Sequence
  Description of Artificial Sequence: Synthetic peptide
  Seed: KMKASEKIFY (SSX2_HUMAN)
KQKASEKIFY

SEQ ID NO: 162713 - protein, 9 aa, Artificial Sequence
  Description of Artificial Sequence: Synthetic peptide
  Seed: KIFYVYMKR (SSX2_HUMAN)
KCFYVYMKR

SEQ ID NO: 162714 - protein, 9 aa, Artificial Sequence
  Description of Artificial Sequence: Synthetic peptide
  Seed: KQLVIYEEI (SSX2_HUMAN)
KELVIYEEA

SEQ ID NO: 162715 - protein, 11 aa, Artificial Sequence
  Description of Artificial Sequence: Synthetic peptide
  Seed: AQIPEKIQKAF (SSX2_HUMAN)
ARIPEKIQKAL

SEQ ID NO: 162716 - protein, 10 aa, Artificial Sequence
  Description of Artificial Sequence: Synthetic peptide
  Seed: KASEKIFYVY (SSX2_HUMAN)
KHSEKIFYVW

SEQ ID NO: 162717 - protein, 9 aa, Artificial Sequence
  Description of Artificial Sequence: Synthetic peptide
  Seed: ASEKIFYVY (SSX2_HUMAN)
ATEKIFYVF

SEQ ID NO: 162718 - protein, 10 aa, Artificial Sequence
  Description of Artificial Sequence: Synthetic peptide
  Seed: KAFDDIAKYF (SSX2_HUMAN)
KWFDDIAKYF

SEQ ID NO: 162719 - protein, 10 aa, Artificial Sequence
  Description of Artificial Sequence: Synthetic peptide
  Seed: MKASEKIFYV (SSX2_HUMAN)
MMASEKIFYA

SEQ ID NO: 162720 - protein, 9 aa, Artificial Sequence
  Description of Artificial Sequence: Synthetic peptide
  Seed: TKLGFKATL (SSX2_HUMAN)
TRLGFKATY

SEQ ID NO: 162721 - protein, 10 aa, Artificial Sequence
  Description of Artificial Sequence: Synthetic peptide
  Seed: EKIFYVYMKR (SSX2_HUMAN)
EHIFYVYMKR

SEQ ID NO: 162722 - protein, 10 aa, Artificial Sequence
  Description of Artificial Sequence: Synthetic peptide
  Seed: YMKRKYEAMT (SSX2_HUMAN)
YPKRKYEAMF

SEQ ID NO: 162723 - protein, 9 aa, Artificial Sequence
  Description of Artificial Sequence: Synthetic peptide
  Seed: KIHERSGPK (SSX2_HUMAN)
KSHERSGPR

SEQ ID NO: 162724 - protein, 10 aa, Artificial Sequence
  Description of Artificial Sequence: Synthetic peptide
  Seed: QMTFGRLQGI (SSX2_HUMAN)
QCTFGRLQGV

SEQ ID NO: 162725 - protein, 9 aa, Artificial Sequence
  Description of Artificial Sequence: Synthetic peptide
  Seed: KATLPPFMC (SSX2_HUMAN)
KTTLPPFMF

SEQ ID NO: 162726 - protein, 9 aa, Artificial Sequence
  Description of Artificial Sequence: Synthetic peptide
  Seed: GFKATLPPF (SSX2_HUMAN)
GKKATLPPM

SEQ ID NO: 162727 - protein, 9 aa, Artificial Sequence
  Description of Artificial Sequence: Synthetic peptide
  Seed: MTFGRLQGI (SSX2_HUMAN)
MRFGRLQGI

SEQ ID NO: 162728 - protein, 9 aa, Artificial Sequence
  Description of Artificial Sequence: Synthetic peptide
  Seed: AFDDIAKYF (SSX2_HUMAN)
APDDIAKYF

SEQ ID NO: 162729 - protein, 9 aa, Artificial Sequence
  Description of Artificial Sequence: Synthetic peptide
  Seed: FARRPTVGA (SSX2_HUMAN)
FARRPTVGY

SEQ ID NO: 162730 - protein, 9 aa, Artificial Sequence
  Description of Artificial Sequence: Synthetic peptide
  Seed: YMKRKYEAM (SSX2_HUMAN)
YWKRKYEAL

SEQ ID NO: 162731 - protein, 9 aa, Artificial Sequence
  Description of Artificial Sequence: Synthetic peptide
  Seed: MKASEKIFY (SSX2_HUMAN)
MVASEKIFY

SEQ ID NO: 162732 - protein, 9 aa, Artificial Sequence
  Description of Artificial Sequence: Synthetic peptide
  Seed: RLRERKQLV (SSX2_HUMAN)
RTRERKQLI

SEQ ID NO: 162733 - protein, 9 aa, Artificial Sequence
  Description of Artificial Sequence: Synthetic peptide
  Seed: KQLVIYEEI (SSX2_HUMAN)
KLLVIYEEV

SEQ ID NO: 162734 - protein, 9 aa, Artificial Sequence
  Description of Artificial Sequence: Synthetic peptide
  Seed: YMKRKYEAM (SSX2_HUMAN)
YNKRKYEAL

SEQ ID NO: 162735 - protein, 9 aa, Artificial Sequence
  Description of Artificial Sequence: Synthetic peptide
  Seed: YMKRKYEAM (SSX2_HUMAN)
YCKRKYEAM

SEQ ID NO: 162736 - protein, 10 aa, Artificial Sequence
  Description of Artificial Sequence: Synthetic peptide
  Seed: AFARRPTVGA (SSX2_HUMAN)
AFARRPTVGK

SEQ ID NO: 162737 - protein, 8 aa, Artificial Sequence
  Description of Artificial Sequence: Synthetic peptide
  Seed: YMKRKYEA (SSX2_HUMAN)
YIKRKYEV

SEQ ID NO: 162738 - protein, 10 aa, Artificial Sequence
  Description of Artificial Sequence: Synthetic peptide
  Seed: KAFDDIAKYF (SSX2_HUMAN)
KYFDDIAKYY

SEQ ID NO: 162739 - protein, 9 aa, Artificial Sequence
  Description of Artificial Sequence: Synthetic peptide
  Seed: RKYEAMTKL (SSX2_HUMAN)
RHYEAMTKF

SEQ ID NO: 162740 - protein, 9 aa, Artificial Sequence
  Description of Artificial Sequence: Synthetic peptide
  Seed: YMKRKYEAM (SSX2_HUMAN)
YQKRKYEAL

SEQ ID NO: 162741 - protein, 10 aa, Artificial Sequence
  Description of Artificial Sequence: Synthetic peptide
  Seed: EKIFYVYMKR (SSX2_HUMAN)
ERIFYVYMKK

SEQ ID NO: 162742 - protein, 11 aa, Artificial Sequence
  Description of Artificial Sequence: Synthetic peptide
  Seed: IQKAFDDIAKY (SSX2_HUMAN)
ITKAFDDIAKY

SEQ ID NO: 162743 - protein, 9 aa, Artificial Sequence
  Description of Artificial Sequence: Synthetic peptide
  Seed: KQLVIYEEI (SSX2_HUMAN)
KMLVIYEEL

SEQ ID NO: 162744 - protein, 9 aa, Artificial Sequence
  Description of Artificial Sequence: Synthetic peptide
  Seed: MTFGRLQGI (SSX2_HUMAN)
MLFGRLQGY

SEQ ID NO: 162745 - protein, 9 aa, Artificial Sequence
  Description of Artificial Sequence: Synthetic peptide
  Seed: AQIPEKIQK (SSX2_HUMAN)
AVIPEKIQL

SEQ ID NO: 162746 - protein, 9 aa, Artificial Sequence
  Description of Artificial Sequence: Synthetic peptide
  Seed: RLQGISPKI (SSX2_HUMAN)
RIQGISPKI

SEQ ID NO: 162747 - protein, 9 aa, Artificial Sequence
  Description of Artificial Sequence: Synthetic peptide
  Seed: AKYFSKEEW (SSX2_HUMAN)
ALYFSKEEF

SEQ ID NO: 162748 - protein, 9 aa, Artificial Sequence
  Description of Artificial Sequence: Synthetic peptide
  Seed: KAFDDIAKY (SSX2_HUMAN)
KRFDDIAKI

SEQ ID NO: 162749 - protein, 9 aa, Artificial Sequence
  Description of Artificial Sequence: Synthetic peptide
  Seed: TTSEKIHER (SSX2_HUMAN)
TASEKIHEL

SEQ ID NO: 162750 - protein, 10 aa, Artificial Sequence
  Description of Artificial Sequence: Synthetic peptide
  Seed: KAFDDIAKYF (SSX2_HUMAN)
KQFDDIAKYF

SEQ ID NO: 162751 - protein, 9 aa, Artificial Sequence
  Description of Artificial Sequence: Synthetic peptide
  Seed: KRKYEAMTK (SSX2_HUMAN)
KSKYEAMTL

SEQ ID NO: 162752 - protein, 10 aa, Artificial Sequence
  Description of Artificial Sequence: Synthetic peptide
  Seed: KASEKIFYVY (SSX2_HUMAN)
KRSEKIFYVW

SEQ ID NO: 162753 - protein, 11 aa, Artificial Sequence
  Description of Artificial Sequence: Synthetic peptide
  Seed: FGRLQGISPKI (SSX2_HUMAN)
FYRLQGISPKV

SEQ ID NO: 162754 - protein, 11 aa, Artificial Sequence
  Description of Artificial Sequence: Synthetic peptide
  Seed: YVYMKRKYEAM (SSX2_HUMAN)
YPYMKRKYEAL

SEQ ID NO: 162755 - protein, 10 aa, Artificial Sequence
  Description of Artificial Sequence: Synthetic peptide
  Seed: MKASEKIFYV (SSX2_HUMAN)
MIASEKIFYM

SEQ ID NO: 162756 - protein, 10 aa, Artificial Sequence
  Description of Artificial Sequence: Synthetic peptide
  Seed: KIFYVYMKRK (SSX2_HUMAN)
KTFYVYMKRR

SEQ ID NO: 162757 - protein, 10 aa, Artificial Sequence
  Description of Artificial Sequence: Synthetic peptide
  Seed: MTKLGFKATL (SSX2_HUMAN)
MLKLGFKATY

SEQ ID NO: 162758 - protein, 11 aa, Artificial Sequence
  Description of Artificial Sequence: Synthetic peptide
  Seed: KYEAMTKLGFK (SSX2_HUMAN)
KYEAMTKLGFR

SEQ ID NO: 162759 - protein, 10 aa, Artificial Sequence
  Description of Artificial Sequence: Synthetic peptide
  Seed: LGFKATLPPF (SSX2_HUMAN)
LSFKATLPPF

SEQ ID NO: 162760 - protein, 10 aa, Artificial Sequence
  Description of Artificial Sequence: Synthetic peptide
  Seed: DGKELCPPGK (SSX2_HUMAN)
DTKELCPPGK

SEQ ID NO: 162761 - protein, 8 aa, Artificial Sequence
  Description of Artificial Sequence: Synthetic peptide
  Seed: FDDIAKYF (SSX2_HUMAN)
FIDIAKYL

SEQ ID NO: 162762 - protein, 8 aa, Artificial Sequence
  Description of Artificial Sequence: Synthetic peptide
  Seed: AFDDIAKY (SSX2_HUMAN)
ALDDIAKM

SEQ ID NO: 162763 - protein, 10 aa, Artificial Sequence
  Description of Artificial Sequence: Synthetic peptide
  Seed: VYMKRKYEAM (SSX2_HUMAN)
VIMKRKYEAM

SEQ ID NO: 162764 - protein, 10 aa, Artificial Sequence
  Description of Artificial Sequence: Synthetic peptide
  Seed: KASEKIFYVY (SSX2_HUMAN)
KTSEKIFYVW

SEQ ID NO: 162765 - protein, 9 aa, Artificial Sequence
  Description of Artificial Sequence: Synthetic peptide
  Seed: QIPEKIQKA (SSX2_HUMAN)
QMPEKIQKI

SEQ ID NO: 162766 - protein, 9 aa, Artificial Sequence
  Description of Artificial Sequence: Synthetic peptide
  Seed: KRKYEAMTK (SSX2_HUMAN)
KMKYEAMTV

SEQ ID NO: 162767 - protein, 9 aa, Artificial Sequence
  Description of Artificial Sequence: Synthetic peptide
  Seed: KQLVIYEEI (SSX2_HUMAN)
KQLVIYEEL

SEQ ID NO: 162768 - protein, 9 aa, Artificial Sequence
  Description of Artificial Sequence: Synthetic peptide
  Seed: MTFGRLQGI (SSX2_HUMAN)
MVFGRLQGK

SEQ ID NO: 162769 - protein, 9 aa, Artificial Sequence
  Description of Artificial Sequence: Synthetic peptide
  Seed: EAMTKLGFK (SSX2_HUMAN)
ELMTKLGFR

SEQ ID NO: 162770 - protein, 10 aa, Artificial Sequence
  Description of Artificial Sequence: Synthetic peptide
  Seed: LGFKATLPPF (SSX2_HUMAN)
LVFKATLPPF

SEQ ID NO: 162771 - protein, 9 aa, Artificial Sequence
  Description of Artificial Sequence: Synthetic peptide
  Seed: MPKKPAEEG (SSX2_HUMAN)
MPKKPAEEL

SEQ ID NO: 162772 - protein, 9 aa, Artificial Sequence
  Description of Artificial Sequence: Synthetic peptide
  Seed: NGDDAFARR (SSX2_HUMAN)
NVDDAFARY

SEQ ID NO: 162773 - protein, 9 aa, Artificial Sequence
  Description of Artificial Sequence: Synthetic peptide
  Seed: RLQGISPKI (SSX2_HUMAN)
RAQGISPKK

SEQ ID NO: 162774 - protein, 9 aa, Artificial Sequence
  Description of Artificial Sequence: Synthetic peptide
  Seed: RLQGISPKI (SSX2_HUMAN)
RSQGISPKK

SEQ ID NO: 162775 - protein, 9 aa, Artificial Sequence
  Description of Artificial Sequence: Synthetic peptide
  Seed: SEEVPEASG (SSX2_HUMAN)
SEEVPEASI

SEQ ID NO: 162776 - protein, 9 aa, Artificial Sequence
  Description of Artificial Sequence: Synthetic peptide
  Seed: TTSEKIHER (SSX2_HUMAN)
TVSEKIHEY

SEQ ID NO: 162777 - protein, 9 aa, Artificial Sequence
  Description of Artificial Sequence: Synthetic peptide
  Seed: YMKRKYEAM (SSX2_HUMAN)
YPKRKYEAL

SEQ ID NO: 162778 - protein, 11 aa, Artificial Sequence
  Description of Artificial Sequence: Synthetic peptide
  Seed: KYEAMTKLGFK (SSX2_HUMAN)
KMEAMTKLGFK

SEQ ID NO: 162779 - protein, 11 aa, Artificial Sequence
  Description of Artificial Sequence: Synthetic peptide
  Seed: YVYMKRKYEAM (SSX2_HUMAN)
YVYMKRKYEAL

SEQ ID NO: 162780 - protein, 8 aa, Artificial Sequence
  Description of Artificial Sequence: Synthetic peptide
  Seed: FDDIAKYF (SSX2_HUMAN)
FVDIAKYI

SEQ ID NO: 162781 - protein, 10 aa, Artificial Sequence
  Description of Artificial Sequence: Synthetic peptide
  Seed: MKASEKIFYV (SSX2_HUMAN)
MAASEKIFYV

SEQ ID NO: 162782 - protein, 9 aa, Artificial Sequence
  Description of Artificial Sequence: Synthetic peptide
  Seed: VYMKRKYEA (SSX2_HUMAN)
VYMKRKYEM

SEQ ID NO: 162783 - protein, 9 aa, Artificial Sequence
  Description of Artificial Sequence: Synthetic peptide
  Seed: KASEKIFYV (SSX2_HUMAN)
KQSEKIFYM

SEQ ID NO: 162784 - protein, 9 aa, Artificial Sequence
  Description of Artificial Sequence: Synthetic peptide
  Seed: KIHERSGPK (SSX2_HUMAN)
KYHERSGPR

SEQ ID NO: 162785 - protein, 9 aa, Artificial Sequence
  Description of Artificial Sequence: Synthetic peptide
  Seed: YMKRKYEAM (SSX2_HUMAN)
YYKRKYEAY

SEQ ID NO: 162786 - protein, 9 aa, Artificial Sequence
  Description of Artificial Sequence: Synthetic peptide
  Seed: RLQGISPKI (SSX2_HUMAN)
RGQGISPKW

SEQ ID NO: 162787 - protein, 10 aa, Artificial Sequence
  Description of Artificial Sequence: Synthetic peptide
  Seed: YEAMTKLGFK (SSX2_HUMAN)
YLAMTKLGFR

SEQ ID NO: 162788 - protein, 10 aa, Artificial Sequence
  Description of Artificial Sequence: Synthetic peptide
  Seed: LGFKATLPPF (SSX2_HUMAN)
LSFKATLPPY

SEQ ID NO: 162789 - protein, 9 aa, Artificial Sequence
  Description of Artificial Sequence: Synthetic peptide
  Seed: MNGDDAFAR (SSX2_HUMAN)
MYGDDAFAR

SEQ ID NO: 162790 - protein, 11 aa, Artificial Sequence
  Description of Artificial Sequence: Synthetic peptide
  Seed: FGRLQGISPKI (SSX2_HUMAN)
FKRLQGISPKV

SEQ ID NO: 162791 - protein, 9 aa, Artificial Sequence
  Description of Artificial Sequence: Synthetic peptide
  Seed: YMKRKYEAM (SSX2_HUMAN)
YFKRKYEAY

SEQ ID NO: 162792 - protein, 9 aa, Artificial Sequence
  Description of Artificial Sequence: Synthetic peptide
  Seed: RKYEAMTKL (SSX2_HUMAN)
RMYEAMTKF

SEQ ID NO: 162793 - protein, 11 aa, Artificial Sequence
  Description of Artificial Sequence: Synthetic peptide
  Seed: AMTKLGFKATL (SSX2_HUMAN)
ALTKLGFKATV

SEQ ID NO: 162794 - protein, 8 aa, Artificial Sequence
  Description of Artificial Sequence: Synthetic peptide
  Seed: MKASEKIF (SSX2_HUMAN)
MQASEKIY

SEQ ID NO: 162795 - protein, 8 aa, Artificial Sequence
  Description of Artificial Sequence: Synthetic peptide
  Seed: AFDDIAKY (SSX2_HUMAN)
AWDDIAKL

SEQ ID NO: 162796 - protein, 11 aa, Artificial Sequence
  Description of Artificial Sequence: Synthetic peptide
  Seed: FGRLQGISPKI (SSX2_HUMAN)
FVRLQGISPKV

SEQ ID NO: 162797 - protein, 9 aa, Artificial Sequence
  Description of Artificial Sequence: Synthetic peptide
  Seed: QVERPQMTF (SSX2_HUMAN)
QSERPQMTW

SEQ ID NO: 162798 - protein, 9 aa, Artificial Sequence
  Description of Artificial Sequence: Synthetic peptide
  Seed: MTKLGFKAT (SSX2_HUMAN)
MVKLGFKAK

SEQ ID NO: 162799 - protein, 9 aa, Artificial Sequence
  Description of Artificial Sequence: Synthetic peptide
  Seed: GFKATLPPF (SSX2_HUMAN)
GLKATLPPF

SEQ ID NO: 162800 - protein, 10 aa, Artificial Sequence
  Description of Artificial Sequence: Synthetic peptide
  Seed: MTKLGFKATL (SSX2_HUMAN)
MYKLGFKATF

SEQ ID NO: 162801 - protein, 8 aa, Artificial Sequence
  Description of Artificial Sequence: Synthetic peptide
  Seed: AFDDIAKY (SSX2_HUMAN)
AADDIAKM

SEQ ID NO: 162802 - protein, 9 aa, Artificial Sequence
  Description of Artificial Sequence: Synthetic peptide
  Seed: EAMTKLGFK (SSX2_HUMAN)
EYMTKLGFR

SEQ ID NO: 162803 - protein, 10 aa, Artificial Sequence
  Description of Artificial Sequence: Synthetic peptide
  Seed: QGISPKIMPK (SSX2_HUMAN)
QLISPKIMPR

SEQ ID NO: 162804 - protein, 10 aa, Artificial Sequence
  Description of Artificial Sequence: Synthetic peptide
  Seed: AFARRPTVGA (SSX2_HUMAN)
AYARRPTVGK

SEQ ID NO: 162805 - protein, 9 aa, Artificial Sequence
  Description of Artificial Sequence: Synthetic peptide
  Seed: AQIPEKIQK (SSX2_HUMAN)
AMIPEKIQR

SEQ ID NO: 162806 - protein, 9 aa, Artificial Sequence
  Description of Artificial Sequence: Synthetic peptide
  Seed: QIPEKIQKA (SSX2_HUMAN)
QIPEKIQKL

SEQ ID NO: 162807 - protein, 10 aa, Artificial Sequence
  Description of Artificial Sequence: Synthetic peptide
  Seed: MTFGRLQGIS (SSX2_HUMAN)
MVFGRLQGII

SEQ ID NO: 162808 - protein, 9 aa, Artificial Sequence
  Description of Artificial Sequence: Synthetic peptide
  Seed: KASEKIFYV (SSX2_HUMAN)
KTSEKIFYA

SEQ ID NO: 162809 - protein, 9 aa, Artificial Sequence
  Description of Artificial Sequence: Synthetic peptide
  Seed: VGAQIPEKI (SSX2_HUMAN)
VQAQIPEKL

SEQ ID NO: 162810 - protein, 10 aa, Artificial Sequence
  Description of Artificial Sequence: Synthetic peptide
  Seed: QMTFGRLQGI (SSX2_HUMAN)
QPTFGRLQGV

SEQ ID NO: 162811 - protein, 10 aa, Artificial Sequence
  Description of Artificial Sequence: Synthetic peptide
  Seed: VYMKRKYEAM (SSX2_HUMAN)
VWMKRKYEAL

SEQ ID NO: 162812 - protein, 9 aa, Artificial Sequence
  Description of Artificial Sequence: Synthetic peptide
  Seed: YEAMTKLGF (SSX2_HUMAN)
YEAMTKLGL

SEQ ID NO: 162813 - protein, 10 aa, Artificial Sequence
  Description of Artificial Sequence: Synthetic peptide
  Seed: KIFYVYMKRK (SSX2_HUMAN)
KFFYVYMKRK

SEQ ID NO: 162814 - protein, 9 aa, Artificial Sequence
  Description of Artificial Sequence: Synthetic peptide
  Seed: VGAQIPEKI (SSX2_HUMAN)
VMAQIPEKI

SEQ ID NO: 162815 - protein, 10 aa, Artificial Sequence
  Description of Artificial Sequence: Synthetic peptide
  Seed: QMTFGRLQGI (SSX2_HUMAN)
QLTFGRLQGL

SEQ ID NO: 162816 - protein, 9 aa, Artificial Sequence
  Description of Artificial Sequence: Synthetic peptide
  Seed: YEAMTKLGF (SSX2_HUMAN)
YSAMTKLGY

SEQ ID NO: 162817 - protein, 9 aa, Artificial Sequence
  Description of Artificial Sequence: Synthetic peptide
  Seed: FKATLPPFM (SSX2_HUMAN)
FLATLPPFF

SEQ ID NO: 162818 - protein, 10 aa, Artificial Sequence
  Description of Artificial Sequence: Synthetic peptide
  Seed: KAFDDIAKYF (SSX2_HUMAN)
KMFDDIAKYV

SEQ ID NO: 162819 - protein, 9 aa, Artificial Sequence
  Description of Artificial Sequence: Synthetic peptide
  Seed: KRKYEAMTK (SSX2_HUMAN)
KYKYEAMTA

SEQ ID NO: 162820 - protein, 9 aa, Artificial Sequence
  Description of Artificial Sequence: Synthetic peptide
  Seed: RKYEAMTKL (SSX2_HUMAN)
RMYEAMTKL

SEQ ID NO: 162821 - protein, 10 aa, Artificial Sequence
  Description of Artificial Sequence: Synthetic peptide
  Seed: QMTFGRLQGI (SSX2_HUMAN)
QLTFGRLQGA

SEQ ID NO: 162822 - protein, 10 aa, Artificial Sequence
  Description of Artificial Sequence: Synthetic peptide
  Seed: KYFSKEEWEK (SSX2_HUMAN)
KFFSKEEWEK

SEQ ID NO: 162823 - protein, 9 aa, Artificial Sequence
  Description of Artificial Sequence: Synthetic peptide
  Seed: MTFGRLQGI (SSX2_HUMAN)
MMFGRLQGY

SEQ ID NO: 162824 - protein, 9 aa, Artificial Sequence
  Description of Artificial Sequence: Synthetic peptide
  Seed: TTSEKIHER (SSX2_HUMAN)
TASEKIHEI

SEQ ID NO: 162825 - protein, 11 aa, Artificial Sequence
  Description of Artificial Sequence: Synthetic peptide
  Seed: YMKRKYEAMTK (SSX2_HUMAN)
YPKRKYEAMTM

SEQ ID NO: 162826 - protein, 9 aa, Artificial Sequence
  Description of Artificial Sequence: Synthetic peptide
  Seed: YMKRKYEAM (SSX2_HUMAN)
YVKRKYEAV

SEQ ID NO: 162827 - protein, 9 aa, Artificial Sequence
  Description of Artificial Sequence: Synthetic peptide
  Seed: RLRERKQLV (SSX2_HUMAN)
RIRERKQLS

SEQ ID NO: 162828 - protein, 9 aa, Artificial Sequence
  Description of Artificial Sequence: Synthetic peptide
  Seed: KAFDDIAKY (SSX2_HUMAN)
KEFDDIAKL

SEQ ID NO: 162829 - protein, 8 aa, Artificial Sequence
  Description of Artificial Sequence: Synthetic peptide
  Seed: FDDIAKYF (SSX2_HUMAN)
FFDIAKYI

SEQ ID NO: 162830 - protein, 10 aa, Artificial Sequence
  Description of Artificial Sequence: Synthetic peptide
  Seed: VYMKRKYEAM (SSX2_HUMAN)
VGMKRKYEAL

SEQ ID NO: 162831 - protein, 10 aa, Artificial Sequence
  Description of Artificial Sequence: Synthetic peptide
  Seed: YEAMTKLGFK (SSX2_HUMAN)
YVAMTKLGFR

SEQ ID NO: 162832 - protein, 9 aa, Artificial Sequence
  Description of Artificial Sequence: Synthetic peptide
  Seed: KASEKIFYV (SSX2_HUMAN)
KCSEKIFYV

SEQ ID NO: 162833 - protein, 9 aa, Artificial Sequence
  Description of Artificial Sequence: Synthetic peptide
  Seed: KASEKIFYV (SSX2_HUMAN)
KISEKIFYI

SEQ ID NO: 162834 - protein, 9 aa, Artificial Sequence
  Description of Artificial Sequence: Synthetic peptide
  Seed: TLPPFMCNK (SSX2_HUMAN)
TMPPFMCNK

SEQ ID NO: 162835 - protein, 10 aa, Artificial Sequence
  Description of Artificial Sequence: Synthetic peptide
  Seed: RLRERKQLVI (SSX2_HUMAN)
RTRERKQLVA

SEQ ID NO: 162836 - protein, 10 aa, Artificial Sequence
  Description of Artificial Sequence: Synthetic peptide
  Seed: RLRERKQLVI (SSX2_HUMAN)
RVRERKQLVK

SEQ ID NO: 162837 - protein, 10 aa, Artificial Sequence
  Description of Artificial Sequence: Synthetic peptide
  Seed: VYMKRKYEAM (SSX2_HUMAN)
VEMKRKYEAL

SEQ ID NO: 162838 - protein, 9 aa, Artificial Sequence
  Description of Artificial Sequence: Synthetic peptide
  Seed: EKMKASEKI (SSX2_HUMAN)
ERMKASEKL

SEQ ID NO: 162839 - protein, 8 aa, Artificial Sequence
  Description of Artificial Sequence: Synthetic peptide
  Seed: MKRKYEAM (SSX2_HUMAN)
MMRKYEAI

SEQ ID NO: 162840 - protein, 10 aa, Artificial Sequence
  Description of Artificial Sequence: Synthetic peptide
  Seed: AFARRPTVGA (SSX2_HUMAN)
ALARRPTVGK

SEQ ID NO: 162841 - protein, 9 aa, Artificial Sequence
  Description of Artificial Sequence: Synthetic peptide
  Seed: KIHERSGPK (SSX2_HUMAN)
KLHERSGPK

SEQ ID NO: 162842 - protein, 9 aa, Artificial Sequence
  Description of Artificial Sequence: Synthetic peptide
  Seed: RPTVGAQIP (SSX2_HUMAN)
RPTVGAQIM

SEQ ID NO: 162843 - protein, 10 aa, Artificial Sequence
  Description of Artificial Sequence: Synthetic peptide
  Seed: AQIPEKIQKA (SSX2_HUMAN)
AMIPEKIQKL

SEQ ID NO: 162844 - protein, 9 aa, Artificial Sequence
  Description of Artificial Sequence: Synthetic peptide
  Seed: FSKEEWEKM (SSX2_HUMAN)
FTKEEWEKF

SEQ ID NO: 162845 - protein, 9 aa, Artificial Sequence
  Description of Artificial Sequence: Synthetic peptide
  Seed: QVERPQMTF (SSX2_HUMAN)
QPERPQMTY

SEQ ID NO: 162846 - protein, 11 aa, Artificial Sequence
  Description of Artificial Sequence: Synthetic peptide
  Seed: YVYMKRKYEAM (SSX2_HUMAN)
YAYMKRKYEAL

SEQ ID NO: 162847 - protein, 9 aa, Artificial Sequence
  Description of Artificial Sequence: Synthetic peptide
  Seed: VGAQIPEKI (SSX2_HUMAN)
VSAQIPEKW

SEQ ID NO: 162848 - protein, 11 aa, Artificial Sequence
  Description of Artificial Sequence: Synthetic peptide
  Seed: RGEHAWTHRLR (SSX2_HUMAN)
RIEHAWTHRLR

SEQ ID NO: 162849 - protein, 10 aa, Artificial Sequence
  Description of Artificial Sequence: Synthetic peptide
  Seed: MKASEKIFYV (SSX2_HUMAN)
MMASEKIFYF

SEQ ID NO: 162850 - protein, 9 aa, Artificial Sequence
  Description of Artificial Sequence: Synthetic peptide
  Seed: KRGEHAWTH (SSX2_HUMAN)
KYGEHAWTF

SEQ ID NO: 162851 - protein, 11 aa, Artificial Sequence
  Description of Artificial Sequence: Synthetic peptide
  Seed: KMKASEKIFYV (SSX2_HUMAN)
KMKASEKIFYA

SEQ ID NO: 162852 - protein, 11 aa, Artificial Sequence
  Description of Artificial Sequence: Synthetic peptide
  Seed: KYFSKEEWEKM (SSX2_HUMAN)
KWFSKEEWEKF

SEQ ID NO: 162853 - protein, 9 aa, Artificial Sequence
  Description of Artificial Sequence: Synthetic peptide
  Seed: QIPEKIQKA (SSX2_HUMAN)
QTPEKIQKI

SEQ ID NO: 162854 - protein, 11 aa, Artificial Sequence
  Description of Artificial Sequence: Synthetic peptide
  Seed: SEKIFYVYMKR (SSX2_HUMAN)
SQKIFYVYMKR

SEQ ID NO: 162855 - protein, 9 aa, Artificial Sequence
  Description of Artificial Sequence: Synthetic peptide
  Seed: VGAQIPEKI (SSX2_HUMAN)
VSAQIPEKL

SEQ ID NO: 162856 - protein, 10 aa, Artificial Sequence
  Description of Artificial Sequence: Synthetic peptide
  Seed: LGFKATLPPF (SSX2_HUMAN)
LAFKATLPPY

SEQ ID NO: 162857 - protein, 9 aa, Artificial Sequence
  Description of Artificial Sequence: Synthetic peptide
  Seed: LQGISPKIM (SSX2_HUMAN)
LMGISPKIF

SEQ ID NO: 162858 - protein, 10 aa, Artificial Sequence
  Description of Artificial Sequence: Synthetic peptide
  Seed: MKASEKIFYV (SSX2_HUMAN)
MLASEKIFYV

SEQ ID NO: 162859 - protein, 10 aa, Artificial Sequence
  Description of Artificial Sequence: Synthetic peptide
  Seed: MTKLGFKATL (SSX2_HUMAN)
MTKLGFKATY

SEQ ID NO: 162860 - protein, 10 aa, Artificial Sequence
  Description of Artificial Sequence: Synthetic peptide
  Seed: YMKRKYEAMT (SSX2_HUMAN)
YIKRKYEAMI

SEQ ID NO: 162861 - protein, 9 aa, Artificial Sequence
  Description of Artificial Sequence: Synthetic peptide
  Seed: FKATLPPFM (SSX2_HUMAN)
FYATLPPFL

SEQ ID NO: 162862 - protein, 9 aa, Artificial Sequence
  Description of Artificial Sequence: Synthetic peptide
  Seed: KQLVIYEEI (SSX2_HUMAN)
KILVIYEEY

SEQ ID NO: 162863 - protein, 10 aa, Artificial Sequence
  Description of Artificial Sequence: Synthetic peptide
  Seed: KMKASEKIFY (SSX2_HUMAN)
KIKASEKIFY

SEQ ID NO: 162864 - protein, 10 aa, Artificial Sequence
  Description of Artificial Sequence: Synthetic peptide
  Seed: MTKLGFKATL (SSX2_HUMAN)
MTKLGFKATV

SEQ ID NO: 162865 - protein, 9 aa, Artificial Sequence
  Description of Artificial Sequence: Synthetic peptide
  Seed: AMTKLGFKA (SSX2_HUMAN)
AVTKLGFKV

SEQ ID NO: 162866 - protein, 9 aa, Artificial Sequence
  Description of Artificial Sequence: Synthetic peptide
  Seed: KIFYVYMKR (SSX2_HUMAN)
KVFYVYMKY

SEQ ID NO: 162867 - protein, 9 aa, Artificial Sequence
  Description of Artificial Sequence: Synthetic peptide
  Seed: YMKRKYEAM (SSX2_HUMAN)
YFKRKYEAV

SEQ ID NO: 162868 - protein, 9 aa, Artificial Sequence
  Description of Artificial Sequence: Synthetic peptide
  Seed: AQIPEKIQK (SSX2_HUMAN)
ATIPEKIQV

SEQ ID NO: 162869 - protein, 9 aa, Artificial Sequence
  Description of Artificial Sequence: Synthetic peptide
  Seed: FARRPTVGA (SSX2_HUMAN)
FSRRPTVGF

SEQ ID NO: 162870 - protein, 9 aa, Artificial Sequence
  Description of Artificial Sequence: Synthetic peptide
  Seed: ISPKIMPKK (SSX2_HUMAN)
IMPKIMPKK

SEQ ID NO: 162871 - protein, 10 aa, Artificial Sequence
  Description of Artificial Sequence: Synthetic peptide
  Seed: HAWTHRLRER (SSX2_HUMAN)
HYWTHRLREK

SEQ ID NO: 162872 - protein, 9 aa, Artificial Sequence
  Description of Artificial Sequence: Synthetic peptide
  Seed: TTSEKIHER (SSX2_HUMAN)
TISEKIHER

SEQ ID NO: 162873 - protein, 9 aa, Artificial Sequence
  Description of Artificial Sequence: Synthetic peptide
  Seed: KRGEHAWTH (SSX2_HUMAN)
KRGEHAWTF

SEQ ID NO: 162874 - protein, 9 aa, Artificial Sequence
  Description of Artificial Sequence: Synthetic peptide
  Seed: RLRERKQLV (SSX2_HUMAN)
RTRERKQLS

SEQ ID NO: 162875 - protein, 10 aa, Artificial Sequence
  Description of Artificial Sequence: Synthetic peptide
  Seed: RLRERKQLVI (SSX2_HUMAN)
RTRERKQLVI

SEQ ID NO: 162876 - protein, 9 aa, Artificial Sequence
  Description of Artificial Sequence: Synthetic peptide
  Seed: AQIPEKIQK (SSX2_HUMAN)
AMIPEKIQK

SEQ ID NO: 162877 - protein, 9 aa, Artificial Sequence
  Description of Artificial Sequence: Synthetic peptide
  Seed: RLRERKQLV (SSX2_HUMAN)
RVRERKQLV

SEQ ID NO: 162878 - protein, 10 aa, Artificial Sequence
  Description of Artificial Sequence: Synthetic peptide
  Seed: RLRERKQLVI (SSX2_HUMAN)
RTRERKQLVM

SEQ ID NO: 162879 - protein, 11 aa, Artificial Sequence
  Description of Artificial Sequence: Synthetic peptide
  Seed: AFDDIAKYFSK (SSX2_HUMAN)
AIDDIAKYFSY

SEQ ID NO: 162880 - protein, 11 aa, Artificial Sequence
  Description of Artificial Sequence: Synthetic peptide
  Seed: FGRLQGISPKI (SSX2_HUMAN)
FSRLQGISPKV

SEQ ID NO: 162881 - protein, 9 aa, Artificial Sequence
  Description of Artificial Sequence: Synthetic peptide
  Seed: EEGNDSEEV (SSX2_HUMAN)
EEGNDSEEW

SEQ ID NO: 162882 - protein, 10 aa, Artificial Sequence
  Description of Artificial Sequence: Synthetic peptide
  Seed: GRLQGISPKI (SSX2_HUMAN)
GRLQGISPKL

SEQ ID NO: 162883 - protein, 9 aa, Artificial Sequence
  Description of Artificial Sequence: Synthetic peptide
  Seed: ERPQMTFGR (SSX2_HUMAN)
EYPQMTFGR

SEQ ID NO: 162884 - protein, 10 aa, Artificial Sequence
  Description of Artificial Sequence: Synthetic peptide
  Seed: EKIFYVYMKR (SSX2_HUMAN)
ECIFYVYMKK

SEQ ID NO: 162885 - protein, 9 aa, Artificial Sequence
  Description of Artificial Sequence: Synthetic peptide
  Seed: AFDDIAKYF (SSX2_HUMAN)
AVDDIAKYY

SEQ ID NO: 162886 - protein, 10 aa, Artificial Sequence
  Description of Artificial Sequence: Synthetic peptide
  Seed: KIFYVYMKRK (SSX2_HUMAN)
KMFYVYMKRE

SEQ ID NO: 162887 - protein, 9 aa, Artificial Sequence
  Description of Artificial Sequence: Synthetic peptide
  Seed: TTSEKIHER (SSX2_HUMAN)
TASEKIHEM

SEQ ID NO: 162888 - protein, 9 aa, Artificial Sequence
  Description of Artificial Sequence: Synthetic peptide
  Seed: EVPEASGPQ (SSX2_HUMAN)
EAPEASGPR

SEQ ID NO: 162889 - protein, 10 aa, Artificial Sequence
  Description of Artificial Sequence: Synthetic peptide
  Seed: SGPKRGEHAW (SSX2_HUMAN)
STPKRGEHAW

SEQ ID NO: 162890 - protein, 10 aa, Artificial Sequence
  Description of Artificial Sequence: Synthetic peptide
  Seed: RLQGISPKIM (SSX2_HUMAN)
RKQGISPKIF

SEQ ID NO: 162891 - protein, 9 aa, Artificial Sequence
  Description of Artificial Sequence: Synthetic peptide
  Seed: KIHERSGPK (SSX2_HUMAN)
KIHERSGPR

SEQ ID NO: 162892 - protein, 9 aa, Artificial Sequence
  Description of Artificial Sequence: Synthetic peptide
  Seed: AEDFQGNDL (SSX2_HUMAN)
AIDFQGNDL

SEQ ID NO: 162893 - protein, 9 aa, Artificial Sequence
  Description of Artificial Sequence: Synthetic peptide
  Seed: RKYEAMTKL (SSX2_HUMAN)
RTYEAMTKI

SEQ ID NO: 162894 - protein, 9 aa, Artificial Sequence
  Description of Artificial Sequence: Synthetic peptide
  Seed: ASEKIFYVY (SSX2_HUMAN)
ATEKIFYVW

SEQ ID NO: 162895 - protein, 9 aa, Artificial Sequence
  Description of Artificial Sequence: Synthetic peptide
  Seed: KASEKIFYV (SSX2_HUMAN)
KCSEKIFYY

SEQ ID NO: 162896 - protein, 11 aa, Artificial Sequence
  Description of Artificial Sequence: Synthetic peptide
  Seed: KYFSKEEWEKM (SSX2_HUMAN)
KYFSKEEWEKL

SEQ ID NO: 162897 - protein, 9 aa, Artificial Sequence
  Description of Artificial Sequence: Synthetic peptide
  Seed: KASEKIFYV (SSX2_HUMAN)
KHSEKIFYF

SEQ ID NO: 162898 - protein, 8 aa, Artificial Sequence
  Description of Artificial Sequence: Synthetic peptide
  Seed: HAWTHRLR (SSX2_HUMAN)
HTWTHRLR

SEQ ID NO: 162899 - protein, 9 aa, Artificial Sequence
  Description of Artificial Sequence: Synthetic peptide
  Seed: KELCPPGKP (SSX2_HUMAN)
KELCPPGKV

SEQ ID NO: 162900 - protein, 10 aa, Artificial Sequence
  Description of Artificial Sequence: Synthetic peptide
  Seed: TLPPFMCNKR (SSX2_HUMAN)
TVPPFMCNKK

SEQ ID NO: 162901 - protein, 11 aa, Artificial Sequence
  Description of Artificial Sequence: Synthetic peptide
  Seed: FGRLQGISPKI (SSX2_HUMAN)
FIRLQGISPKL

SEQ ID NO: 162902 - protein, 10 aa, Artificial Sequence
  Description of Artificial Sequence: Synthetic peptide
  Seed: MTFGRLQGIS (SSX2_HUMAN)
MTFGRLQGIA

SEQ ID NO: 162903 - protein, 10 aa, Artificial Sequence
  Description of Artificial Sequence: Synthetic peptide
  Seed: VYMKRKYEAM (SSX2_HUMAN)
VDMKRKYEAL

SEQ ID NO: 162904 - protein, 11 aa, Artificial Sequence
  Description of Artificial Sequence: Synthetic peptide
  Seed: KLGFKATLPPF (SSX2_HUMAN)
KWGFKATLPPF

SEQ ID NO: 162905 - protein, 10 aa, Artificial Sequence
  Description of Artificial Sequence: Synthetic peptide
  Seed: AQIPEKIQKA (SSX2_HUMAN)
AEIPEKIQKY

SEQ ID NO: 162906 - protein, 9 aa, Artificial Sequence
  Description of Artificial Sequence: Synthetic peptide
  Seed: KQLVIYEEI (SSX2_HUMAN)
KKLVIYEEY

SEQ ID NO: 162907 - protein, 9 aa, Artificial Sequence
  Description of Artificial Sequence: Synthetic peptide
  Seed: KRKYEAMTK (SSX2_HUMAN)
KTKYEAMTK

SEQ ID NO: 162908 - protein, 10 aa, Artificial Sequence
  Description of Artificial Sequence: Synthetic peptide
  Seed: TLPPFMCNKR (SSX2_HUMAN)
TVPPFMCNKR

SEQ ID NO: 162909 - protein, 9 aa, Artificial Sequence
  Description of Artificial Sequence: Synthetic peptide
  Seed: SEEVPEASG (SSX2_HUMAN)
SEEVPEASA

SEQ ID NO: 162910 - protein, 10 aa, Artificial Sequence
  Description of Artificial Sequence: Synthetic peptide
  Seed: MKASEKIFYV (SSX2_HUMAN)
MTASEKIFYA

SEQ ID NO: 162911 - protein, 9 aa, Artificial Sequence
  Description of Artificial Sequence: Synthetic peptide
  Seed: EAMTKLGFK (SSX2_HUMAN)
ETMTKLGFK

SEQ ID NO: 162912 - protein, 10 aa, Artificial Sequence
  Description of Artificial Sequence: Synthetic peptide
  Seed: KASEKIFYVY (SSX2_HUMAN)
KQSEKIFYVW

SEQ ID NO: 162913 - protein, 9 aa, Artificial Sequence
  Description of Artificial Sequence: Synthetic peptide
  Seed: GISPKIMPK (SSX2_HUMAN)
GTSPKIMPK

SEQ ID NO: 162914 - protein, 9 aa, Artificial Sequence
  Description of Artificial Sequence: Synthetic peptide
  Seed: KASEKIFYV (SSX2_HUMAN)
KLSEKIFYP

SEQ ID NO: 162915 - protein, 11 aa, Artificial Sequence
  Description of Artificial Sequence: Synthetic peptide
  Seed: KYFSKEEWEKM (SSX2_HUMAN)
KYFSKEEWEKI

SEQ ID NO: 162916 - protein, 11 aa, Artificial Sequence
  Description of Artificial Sequence: Synthetic peptide
  Seed: KMKASEKIFYV (SSX2_HUMAN)
KMKASEKIFYI

SEQ ID NO: 162917 - protein, 9 aa, Artificial Sequence
  Description of Artificial Sequence: Synthetic peptide
  Seed: RLQGISPKI (SSX2_HUMAN)
RAQGISPKV

SEQ ID NO: 162918 - protein, 9 aa, Artificial Sequence
  Description of Artificial Sequence: Synthetic peptide
  Seed: KASEKIFYV (SSX2_HUMAN)
KNSEKIFYM

SEQ ID NO: 162919 - protein, 9 aa, Artificial Sequence
  Description of Artificial Sequence: Synthetic peptide
  Seed: DAFARRPTV (SSX2_HUMAN)
DGFARRPTV

SEQ ID NO: 162920 - protein, 9 aa, Artificial Sequence
  Description of Artificial Sequence: Synthetic peptide
  Seed: TTSEKIHER (SSX2_HUMAN)
TVSEKIHEM

SEQ ID NO: 162921 - protein, 10 aa, Artificial Sequence
  Description of Artificial Sequence: Synthetic peptide
  Seed: KYFSKEEWEK (SSX2_HUMAN)
KQFSKEEWEY

SEQ ID NO: 162922 - protein, 11 aa, Artificial Sequence
  Description of Artificial Sequence: Synthetic peptide
  Seed: RSGPKRGEHAW (SSX2_HUMAN)
RLGPKRGEHAW

SEQ ID NO: 162923 - protein, 9 aa, Artificial Sequence
  Description of Artificial Sequence: Synthetic peptide
  Seed: YFSKEEWEK (SSX2_HUMAN)
YISKEEWEY

SEQ ID NO: 162924 - protein, 10 aa, Artificial Sequence
  Description of Artificial Sequence: Synthetic peptide
  Seed: MTKLGFKATL (SSX2_HUMAN)
MMKLGFKATM

SEQ ID NO: 162925 - protein, 10 aa, Artificial Sequence
  Description of Artificial Sequence: Synthetic peptide
  Seed: QMTFGRLQGI (SSX2_HUMAN)
QWTFGRLQGV

SEQ ID NO: 162926 - protein, 10 aa, Artificial Sequence
  Description of Artificial Sequence: Synthetic peptide
  Seed: GISPKIMPKK (SSX2_HUMAN)
GMSPKIMPKR

SEQ ID NO: 162927 - protein, 9 aa, Artificial Sequence
  Description of Artificial Sequence: Synthetic peptide
  Seed: RLQGISPKI (SSX2_HUMAN)
RYQGISPKK

SEQ ID NO: 162928 - protein, 9 aa, Artificial Sequence
  Description of Artificial Sequence: Synthetic peptide
  Seed: KASEKIFYV (SSX2_HUMAN)
KTSEKIFYK

SEQ ID NO: 162929 - protein, 10 aa, Artificial Sequence
  Description of Artificial Sequence: Synthetic peptide
  Seed: YEAMTKLGFK (SSX2_HUMAN)
YQAMTKLGFR

SEQ ID NO: 162930 - protein, 9 aa, Artificial Sequence
  Description of Artificial Sequence: Synthetic peptide
  Seed: AFDDIAKYF (SSX2_HUMAN)
ALDDIAKYY

SEQ ID NO: 162931 - protein, 10 aa, Artificial Sequence
  Description of Artificial Sequence: Synthetic peptide
  Seed: QGISPKIMPK (SSX2_HUMAN)
QSISPKIMPK

SEQ ID NO: 162932 - protein, 9 aa, Artificial Sequence
  Description of Artificial Sequence: Synthetic peptide
  Seed: RLQGISPKI (SSX2_HUMAN)
RAQGISPKI

SEQ ID NO: 162933 - protein, 10 aa, Artificial Sequence
  Description of Artificial Sequence: Synthetic peptide
  Seed: AQIPEKIQKA (SSX2_HUMAN)
ALIPEKIQKV

SEQ ID NO: 162934 - protein, 10 aa, Artificial Sequence
  Description of Artificial Sequence: Synthetic peptide
  Seed: LGFKATLPPF (SSX2_HUMAN)
LKFKATLPPY

SEQ ID NO: 162935 - protein, 9 aa, Artificial Sequence
  Description of Artificial Sequence: Synthetic peptide
  Seed: KIFYVYMKR (SSX2_HUMAN)
KLFYVYMKR

SEQ ID NO: 162936 - protein, 9 aa, Artificial Sequence
  Description of Artificial Sequence: Synthetic peptide
  Seed: YMKRKYEAM (SSX2_HUMAN)
YLKRKYEAM

SEQ ID NO: 162937 - protein, 9 aa, Artificial Sequence
  Description of Artificial Sequence: Synthetic peptide
  Seed: KIFYVYMKR (SSX2_HUMAN)
KVFYVYMKA

SEQ ID NO: 162938 - protein, 10 aa, Artificial Sequence
  Description of Artificial Sequence: Synthetic peptide
  Seed: KIFYVYMKRK (SSX2_HUMAN)
KIFYVYMKRR

SEQ ID NO: 162939 - protein, 9 aa, Artificial Sequence
  Description of Artificial Sequence: Synthetic peptide
  Seed: FYVYMKRKY (SSX2_HUMAN)
FFVYMKRKL

SEQ ID NO: 162940 - protein, 9 aa, Artificial Sequence
  Description of Artificial Sequence: Synthetic peptide
  Seed: MTFGRLQGI (SSX2_HUMAN)
MSFGRLQGV

SEQ ID NO: 162941 - protein, 9 aa, Artificial Sequence
  Description of Artificial Sequence: Synthetic peptide
  Seed: RLQGISPKI (SSX2_HUMAN)
RAQGISPKY

SEQ ID NO: 162942 - protein, 10 aa, Artificial Sequence
  Description of Artificial Sequence: Synthetic peptide
  Seed: VYMKRKYEAM (SSX2_HUMAN)
VYMKRKYEAL

SEQ ID NO: 162943 - protein, 9 aa, Artificial Sequence
  Description of Artificial Sequence: Synthetic peptide
  Seed: TTSEKIHER (SSX2_HUMAN)
TMSEKIHEL

SEQ ID NO: 162944 - protein, 9 aa, Artificial Sequence
  Description of Artificial Sequence: Synthetic peptide
  Seed: KRGEHAWTH (SSX2_HUMAN)
KRGEHAWTY

SEQ ID NO: 162945 - protein, 9 aa, Artificial Sequence
  Description of Artificial Sequence: Synthetic peptide
  Seed: KAFDDIAKY (SSX2_HUMAN)
KCFDDIAKW

SEQ ID NO: 162946 - protein, 10 aa, Artificial Sequence
  Description of Artificial Sequence: Synthetic peptide
  Seed: KIFYVYMKRK (SSX2_HUMAN)
KMFYVYMKRH

SEQ ID NO: 162947 - protein, 8 aa, Artificial Sequence
  Description of Artificial Sequence: Synthetic peptide
  Seed: FDDIAKYF (SSX2_HUMAN)
FGDIAKYV

SEQ ID NO: 162948 - protein, 9 aa, Artificial Sequence
  Description of Artificial Sequence: Synthetic peptide
  Seed: GEHAWTHRL (SSX2_HUMAN)
GDHAWTHRL

SEQ ID NO: 162949 - protein, 10 aa, Artificial Sequence
  Description of Artificial Sequence: Synthetic peptide
  Seed: MTKLGFKATL (SSX2_HUMAN)
MNKLGFKATY

SEQ ID NO: 162950 - protein, 11 aa, Artificial Sequence
  Description of Artificial Sequence: Synthetic peptide
  Seed: AFDDIAKYFSK (SSX2_HUMAN)
AMDDIAKYFSR

SEQ ID NO: 162951 - protein, 9 aa, Artificial Sequence
  Description of Artificial Sequence: Synthetic peptide
  Seed: KRKYEAMTK (SSX2_HUMAN)
KSKYEAMTM

SEQ ID NO: 162952 - protein, 9 aa, Artificial Sequence
  Description of Artificial Sequence: Synthetic peptide
  Seed: MTFGRLQGI (SSX2_HUMAN)
MGFGRLQGF

SEQ ID NO: 162953 - protein, 9 aa, Artificial Sequence
  Description of Artificial Sequence: Synthetic peptide
  Seed: AKYFSKEEW (SSX2_HUMAN)
ADYFSKEEW

SEQ ID NO: 162954 - protein, 10 aa, Artificial Sequence
  Description of Artificial Sequence: Synthetic peptide
  Seed: DGKELCPPGK (SSX2_HUMAN)
DTKELCPPGR

SEQ ID NO: 162955 - protein, 9 aa, Artificial Sequence
  Description of Artificial Sequence: Synthetic peptide
  Seed: RLRERKQLV (SSX2_HUMAN)
RVRERKQLW

SEQ ID NO: 162956 - protein, 10 aa, Artificial Sequence
  Description of Artificial Sequence: Synthetic peptide
  Seed: MTKLGFKATL (SSX2_HUMAN)
MPKLGFKATF

SEQ ID NO: 162957 - protein, 9 aa, Artificial Sequence
  Description of Artificial Sequence: Synthetic peptide
  Seed: SEKIFYVYM (SSX2_HUMAN)
SEKIFYVYL

SEQ ID NO: 162958 - protein, 9 aa, Artificial Sequence
  Description of Artificial Sequence: Synthetic peptide
  Seed: KRKYEAMTK (SSX2_HUMAN)
KWKYEAMTK

SEQ ID NO: 162959 - protein, 10 aa, Artificial Sequence
  Description of Artificial Sequence: Synthetic peptide
  Seed: MTKLGFKATL (SSX2_HUMAN)
MSKLGFKATM

SEQ ID NO: 162960 - protein, 10 aa, Artificial Sequence
  Description of Artificial Sequence: Synthetic peptide
  Seed: KIFYVYMKRK (SSX2_HUMAN)
KMFYVYMKRG

SEQ ID NO: 162961 - protein, 9 aa, Artificial Sequence
  Description of Artificial Sequence: Synthetic peptide
  Seed: MTFGRLQGI (SSX2_HUMAN)
MLFGRLQGF

SEQ ID NO: 162962 - protein, 8 aa, Artificial Sequence
  Description of Artificial Sequence: Synthetic peptide
  Seed: FDDIAKYF (SSX2_HUMAN)
FQDIAKYM

SEQ ID NO: 162963 - protein, 9 aa, Artificial Sequence
  Description of Artificial Sequence: Synthetic peptide
  Seed: FYVYMKRKY (SSX2_HUMAN)
FYVYMKRKL

SEQ ID NO: 162964 - protein, 9 aa, Artificial Sequence
  Description of Artificial Sequence: Synthetic peptide
  Seed: KASEKIFYV (SSX2_HUMAN)
KMSEKIFYT

SEQ ID NO: 162965 - protein, 8 aa, Artificial Sequence
  Description of Artificial Sequence: Synthetic peptide
  Seed: MKRKYEAM (SSX2_HUMAN)
MMRKYEAV

SEQ ID NO: 162966 - protein, 9 aa, Artificial Sequence
  Description of Artificial Sequence: Synthetic peptide
  Seed: RLRERKQLV (SSX2_HUMAN)
RFRERKQLM

SEQ ID NO: 162967 - protein, 10 aa, Artificial Sequence
  Description of Artificial Sequence: Synthetic peptide
  Seed: AQIPEKIQKA (SSX2_HUMAN)
AEIPEKIQKP

SEQ ID NO: 162968 - protein, 9 aa, Artificial Sequence
  Description of Artificial Sequence: Synthetic peptide
  Seed: DDIAKYFSK (SSX2_HUMAN)
DFIAKYFSR

SEQ ID NO: 162969 - protein, 9 aa, Artificial Sequence
  Description of Artificial Sequence: Synthetic peptide
  Seed: DAFARRPTV (SSX2_HUMAN)
DIFARRPTM

SEQ ID NO: 162970 - protein, 10 aa, Artificial Sequence
  Description of Artificial Sequence: Synthetic peptide
  Seed: KYFSKEEWEK (SSX2_HUMAN)
KQFSKEEWER

SEQ ID NO: 162971 - protein, 9 aa, Artificial Sequence
  Description of Artificial Sequence: Synthetic peptide
  Seed: AFDDIAKYF (SSX2_HUMAN)
ATDDIAKYY

SEQ ID NO: 162972 - protein, 9 aa, Artificial Sequence
  Description of Artificial Sequence: Synthetic peptide
  Seed: YMKRKYEAM (SSX2_HUMAN)
YTKRKYEAM

SEQ ID NO: 162973 - protein, 9 aa, Artificial Sequence
  Description of Artificial Sequence: Synthetic peptide
  Seed: RLQGISPKI (SSX2_HUMAN)
RIQGISPKY

SEQ ID NO: 162974 - protein, 9 aa, Artificial Sequence
  Description of Artificial Sequence: Synthetic peptide
  Seed: ASEKIFYVY (SSX2_HUMAN)
AQEKIFYVM

SEQ ID NO: 162975 - protein, 9 aa, Artificial Sequence
  Description of Artificial Sequence: Synthetic peptide
  Seed: DAFARRPTV (SSX2_HUMAN)
DHFARRPTF

SEQ ID NO: 162976 - protein, 10 aa, Artificial Sequence
  Description of Artificial Sequence: Synthetic peptide
  Seed: KYFSKEEWEK (SSX2_HUMAN)
KLFSKEEWER

SEQ ID NO: 162977 - protein, 10 aa, Artificial Sequence
  Description of Artificial Sequence: Synthetic peptide
  Seed: KASEKIFYVY (SSX2_HUMAN)
KQSEKIFYVF

SEQ ID NO: 162978 - protein, 10 aa, Artificial Sequence
  Description of Artificial Sequence: Synthetic peptide
  Seed: RLRERKQLVI (SSX2_HUMAN)
RTRERKQLVV

SEQ ID NO: 162979 - protein, 10 aa, Artificial Sequence
  Description of Artificial Sequence: Synthetic peptide
  Seed: GISPKIMPKK (SSX2_HUMAN)
GVSPKIMPKR

SEQ ID NO: 162980 - protein, 8 aa, Artificial Sequence
  Description of Artificial Sequence: Synthetic peptide
  Seed: FDDIAKYF (SSX2_HUMAN)
FVDIAKYL

SEQ ID NO: 162981 - protein, 9 aa, Artificial Sequence
  Description of Artificial Sequence: Synthetic peptide
  Seed: GISPKIMPK (SSX2_HUMAN)
GYSPKIMPK

SEQ ID NO: 162982 - protein, 9 aa, Artificial Sequence
  Description of Artificial Sequence: Synthetic peptide
  Seed: TKLGFKATL (SSX2_HUMAN)
TRLGFKATF

SEQ ID NO: 162983 - protein, 9 aa, Artificial Sequence
  Description of Artificial Sequence: Synthetic peptide
  Seed: KASEKIFYV (SSX2_HUMAN)
KASEKIFYK

SEQ ID NO: 162984 - protein, 9 aa, Artificial Sequence
  Description of Artificial Sequence: Synthetic peptide
  Seed: RLQGISPKI (SSX2_HUMAN)
RLQGISPKM

SEQ ID NO: 162985 - protein, 10 aa, Artificial Sequence
  Description of Artificial Sequence: Synthetic peptide
  Seed: AQIPEKIQKA (SSX2_HUMAN)
AIIPEKIQKY

SEQ ID NO: 162986 - protein, 10 aa, Artificial Sequence
  Description of Artificial Sequence: Synthetic peptide
  Seed: EKIFYVYMKR (SSX2_HUMAN)
ESIFYVYMKK

SEQ ID NO: 162987 - protein, 9 aa, Artificial Sequence
  Description of Artificial Sequence: Synthetic peptide
  Seed: KAFDDIAKY (SSX2_HUMAN)
KRFDDIAKV

SEQ ID NO: 162988 - protein, 8 aa, Artificial Sequence
  Description of Artificial Sequence: Synthetic peptide
  Seed: YMKRKYEA (SSX2_HUMAN)
YMKRKYEM

SEQ ID NO: 162989 - protein, 9 aa, Artificial Sequence
  Description of Artificial Sequence: Synthetic peptide
  Seed: TTSEKIHER (SSX2_HUMAN)
TTSEKIHEI

SEQ ID NO: 162990 - protein, 9 aa, Artificial Sequence
  Description of Artificial Sequence: Synthetic peptide
  Seed: KAFDDIAKY (SSX2_HUMAN)
KAFDDIAKM

SEQ ID NO: 162991 - protein, 10 aa, Artificial Sequence
  Description of Artificial Sequence: Synthetic peptide
  Seed: KASEKIFYVY (SSX2_HUMAN)
KISEKIFYVY

SEQ ID NO: 162992 - protein, 11 aa, Artificial Sequence
  Description of Artificial Sequence: Synthetic peptide
  Seed: RLRERKQLVIY (SSX2_HUMAN)
RMRERKQLVIY

SEQ ID NO: 162993 - protein, 10 aa, Artificial Sequence
  Description of Artificial Sequence: Synthetic peptide
  Seed: YMKRKYEAMT (SSX2_HUMAN)
YMKRKYEAMC

SEQ ID NO: 162994 - protein, 9 aa, Artificial Sequence
  Description of Artificial Sequence: Synthetic peptide
  Seed: SEKIHERSG (SSX2_HUMAN)
SEKIHERSM

SEQ ID NO: 162995 - protein, 9 aa, Artificial Sequence
  Description of Artificial Sequence: Synthetic peptide
  Seed: KRKYEAMTK (SSX2_HUMAN)
KIKYEAMTI

SEQ ID NO: 162996 - protein, 9 aa, Artificial Sequence
  Description of Artificial Sequence: Synthetic peptide
  Seed: MNGDDAFAR (SSX2_HUMAN)
MTGDDAFAY

SEQ ID NO: 162997 - protein, 9 aa, Artificial Sequence
  Description of Artificial Sequence: Synthetic peptide
  Seed: VGAQIPEKI (SSX2_HUMAN)
VRAQIPEKV

SEQ ID NO: 162998 - protein, 8 aa, Artificial Sequence
  Description of Artificial Sequence: Synthetic peptide
  Seed: AFDDIAKY (SSX2_HUMAN)
AFDDIAKV

SEQ ID NO: 162999 - protein, 9 aa, Artificial Sequence
  Description of Artificial Sequence: Synthetic peptide
  Seed: KASEKIFYV (SSX2_HUMAN)
KSSEKIFYI

SEQ ID NO: 163000 - protein, 10 aa, Artificial Sequence
  Description of Artificial Sequence: Synthetic peptide
  Seed: AQIPEKIQKA (SSX2_HUMAN)
ATIPEKIQKV

SEQ ID NO: 163001 - protein, 9 aa, Artificial Sequence
  Description of Artificial Sequence: Synthetic peptide
  Seed: QIPEKIQKA (SSX2_HUMAN)
QYPEKIQKL

SEQ ID NO: 163002 - protein, 11 aa, Artificial Sequence
  Description of Artificial Sequence: Synthetic peptide
  Seed: AQIPEKIQKAF (SSX2_HUMAN)
AEIPEKIQKAF

SEQ ID NO: 163003 - protein, 10 aa, Artificial Sequence
  Description of Artificial Sequence: Synthetic peptide
  Seed: KAFDDIAKYF (SSX2_HUMAN)
KTFDDIAKYW

SEQ ID NO: 163004 - protein, 9 aa, Artificial Sequence
  Description of Artificial Sequence: Synthetic peptide
  Seed: DAFARRPTV (SSX2_HUMAN)
DVFARRPTW

SEQ ID NO: 163005 - protein, 10 aa, Artificial Sequence
  Description of Artificial Sequence: Synthetic peptide
  Seed: KYEAMTKLGF (SSX2_HUMAN)
KWEAMTKLGF

SEQ ID NO: 163006 - protein, 10 aa, Artificial Sequence
  Description of Artificial Sequence: Synthetic peptide
  Seed: LGFKATLPPF (SSX2_HUMAN)
LNFKATLPPY

SEQ ID NO: 163007 - protein, 10 aa, Artificial Sequence
  Description of Artificial Sequence: Synthetic peptide
  Seed: ATLPPFMCNK (SSX2_HUMAN)
AYLPPFMCNK

SEQ ID NO: 163008 - protein, 8 aa, Artificial Sequence
  Description of Artificial Sequence: Synthetic peptide
  Seed: YMKRKYEA (SSX2_HUMAN)
YGKRKYEL

SEQ ID NO: 163009 - protein, 9 aa, Artificial Sequence
  Description of Artificial Sequence: Synthetic peptide
  Seed: AEDFQGNDL (SSX2_HUMAN)
AVDFQGNDV

SEQ ID NO: 163010 - protein, 8 aa, Artificial Sequence
  Description of Artificial Sequence: Synthetic peptide
  Seed: AFDDIAKY (SSX2_HUMAN)
AWDDIAKI

SEQ ID NO: 163011 - protein, 9 aa, Artificial Sequence
  Description of Artificial Sequence: Synthetic peptide
  Seed: RLRERKQLV (SSX2_HUMAN)
RLRERKQLY

SEQ ID NO: 163012 - protein, 9 aa, Artificial Sequence
  Description of Artificial Sequence: Synthetic peptide
  Seed: AFDDIAKYF (SSX2_HUMAN)
AMDDIAKYI

SEQ ID NO: 163013 - protein, 9 aa, Artificial Sequence
  Description of Artificial Sequence: Synthetic peptide
  Seed: TTSEKIHER (SSX2_HUMAN)
TYSEKIHEY

SEQ ID NO: 163014 - protein, 9 aa, Artificial Sequence
  Description of Artificial Sequence: Synthetic peptide
  Seed: TTSEKIHER (SSX2_HUMAN)
TISEKIHEI

SEQ ID NO: 163015 - protein, 9 aa, Artificial Sequence
  Description of Artificial Sequence: Synthetic peptide
  Seed: KMKASEKIF (SSX2_HUMAN)
KIKASEKIY

SEQ ID NO: 163016 - protein, 9 aa, Artificial Sequence
  Description of Artificial Sequence: Synthetic peptide
  Seed: MNGDDAFAR (SSX2_HUMAN)
MVGDDAFAR

SEQ ID NO: 163017 - protein, 10 aa, Artificial Sequence
  Description of Artificial Sequence: Synthetic peptide
  Seed: KAFDDIAKYF (SSX2_HUMAN)
KMFDDIAKYK

SEQ ID NO: 163018 - protein, 9 aa, Artificial Sequence
  Description of Artificial Sequence: Synthetic peptide
  Seed: EAMTKLGFK (SSX2_HUMAN)
EMMTKLGFR

SEQ ID NO: 163019 - protein, 10 aa, Artificial Sequence
  Description of Artificial Sequence: Synthetic peptide
  Seed: GRLQGISPKI (SSX2_HUMAN)
GLLQGISPKV

SEQ ID NO: 163020 - protein, 9 aa, Artificial Sequence
  Description of Artificial Sequence: Synthetic peptide
  Seed: RLQGISPKI (SSX2_HUMAN)
RVQGISPKR

SEQ ID NO: 163021 - protein, 9 aa, Artificial Sequence
  Description of Artificial Sequence: Synthetic peptide
  Seed: TTSEKIHER (SSX2_HUMAN)
TGSEKIHEM

SEQ ID NO: 163022 - protein, 10 aa, Artificial Sequence
  Description of Artificial Sequence: Synthetic peptide
  Seed: KAFDDIAKYF (SSX2_HUMAN)
KPFDDIAKYF

SEQ ID NO: 163023 - protein, 9 aa, Artificial Sequence
  Description of Artificial Sequence: Synthetic peptide
  Seed: AEDFQGNDL (SSX2_HUMAN)
AADFQGNDI

SEQ ID NO: 163024 - protein, 10 aa, Artificial Sequence
  Description of Artificial Sequence: Synthetic peptide
  Seed: VYMKRKYEAM (SSX2_HUMAN)
VQMKRKYEAL

SEQ ID NO: 163025 - protein, 9 aa, Artificial Sequence
  Description of Artificial Sequence: Synthetic peptide
  Seed: QVERPQMTF (SSX2_HUMAN)
QSERPQMTF

SEQ ID NO: 163026 - protein, 10 aa, Artificial Sequence
  Description of Artificial Sequence: Synthetic peptide
  Seed: KAFDDIAKYF (SSX2_HUMAN)
KYFDDIAKYL

SEQ ID NO: 163027 - protein, 10 aa, Artificial Sequence
  Description of Artificial Sequence: Synthetic peptide
  Seed: RLRERKQLVI (SSX2_HUMAN)
RTRERKQLVS

SEQ ID NO: 163028 - protein, 9 aa, Artificial Sequence
  Description of Artificial Sequence: Synthetic peptide
  Seed: KASEKIFYV (SSX2_HUMAN)
KSSEKIFYR

SEQ ID NO: 163029 - protein, 9 aa, Artificial Sequence
  Description of Artificial Sequence: Synthetic peptide
  Seed: RLQGISPKI (SSX2_HUMAN)
RVQGISPKL

SEQ ID NO: 163030 - protein, 9 aa, Artificial Sequence
  Description of Artificial Sequence: Synthetic peptide
  Seed: EAMTKLGFK (SSX2_HUMAN)
EVMTKLGFM

SEQ ID NO: 163031 - protein, 9 aa, Artificial Sequence
  Description of Artificial Sequence: Synthetic peptide
  Seed: KAFDDIAKY (SSX2_HUMAN)
KNFDDIAKY

SEQ ID NO: 163032 - protein, 9 aa, Artificial Sequence
  Description of Artificial Sequence: Synthetic peptide
  Seed: KIQKAFDDI (SSX2_HUMAN)
KQQKAFDDL

SEQ ID NO: 163033 - protein, 9 aa, Artificial Sequence
  Description of Artificial Sequence: Synthetic peptide
  Seed: FARRPTVGA (SSX2_HUMAN)
FVRRPTVGM

SEQ ID NO: 163034 - protein, 9 aa, Artificial Sequence
  Description of Artificial Sequence: Synthetic peptide
  Seed: KRKYEAMTK (SSX2_HUMAN)
KSKYEAMTS

SEQ ID NO: 163035 - protein, 9 aa, Artificial Sequence
  Description of Artificial Sequence: Synthetic peptide
  Seed: YMKRKYEAM (SSX2_HUMAN)
YVKRKYEAF

SEQ ID NO: 163036 - protein, 9 aa, Artificial Sequence
  Description of Artificial Sequence: Synthetic peptide
  Seed: KRKYEAMTK (SSX2_HUMAN)
KLKYEAMTK

SEQ ID NO: 163037 - protein, 10 aa, Artificial Sequence
  Description of Artificial Sequence: Synthetic peptide
  Seed: EKIFYVYMKR (SSX2_HUMAN)
EAIFYVYMKK

SEQ ID NO: 163038 - protein, 9 aa, Artificial Sequence
  Description of Artificial Sequence: Synthetic peptide
  Seed: KASEKIFYV (SSX2_HUMAN)
KSSEKIFYF

SEQ ID NO: 163039 - protein, 10 aa, Artificial Sequence
  Description of Artificial Sequence: Synthetic peptide
  Seed: KAFDDIAKYF (SSX2_HUMAN)
KIFDDIAKYL

SEQ ID NO: 163040 - protein, 9 aa, Artificial Sequence
  Description of Artificial Sequence: Synthetic peptide
  Seed: TVGAQIPEK (SSX2_HUMAN)
TAGAQIPEL

SEQ ID NO: 163041 - protein, 9 aa, Artificial Sequence
  Description of Artificial Sequence: Synthetic peptide
  Seed: AFDDIAKYF (SSX2_HUMAN)
ASDDIAKYV

SEQ ID NO: 163042 - protein, 10 aa, Artificial Sequence
  Description of Artificial Sequence: Synthetic peptide
  Seed: QMTFGRLQGI (SSX2_HUMAN)
QKTFGRLQGV

SEQ ID NO: 163043 - protein, 9 aa, Artificial Sequence
  Description of Artificial Sequence: Synthetic peptide
  Seed: KQLVIYEEI (SSX2_HUMAN)
KMLVIYEEA

SEQ ID NO: 163044 - protein, 10 aa, Artificial Sequence
  Description of Artificial Sequence: Synthetic peptide
  Seed: LGFKATLPPF (SSX2_HUMAN)
LVFKATLPPY

SEQ ID NO: 163045 - protein, 9 aa, Artificial Sequence
  Description of Artificial Sequence: Synthetic peptide
  Seed: FARRPTVGA (SSX2_HUMAN)
FIRRPTVGL

SEQ ID NO: 163046 - protein, 9 aa, Artificial Sequence
  Description of Artificial Sequence: Synthetic peptide
  Seed: AFDDIAKYF (SSX2_HUMAN)
ARDDIAKYF

SEQ ID NO: 163047 - protein, 8 aa, Artificial Sequence
  Description of Artificial Sequence: Synthetic peptide
  Seed: KIFYVYMK (SSX2_HUMAN)
KVFYVYMR

SEQ ID NO: 163048 - protein, 8 aa, Artificial Sequence
  Description of Artificial Sequence: Synthetic peptide
  Seed: FDDIAKYF (SSX2_HUMAN)
FLDIAKYM

SEQ ID NO: 163049 - protein, 9 aa, Artificial Sequence
  Description of Artificial Sequence: Synthetic peptide
  Seed: KATLPPFMC (SSX2_HUMAN)
KGTLPPFMW

SEQ ID NO: 163050 - protein, 9 aa, Artificial Sequence
  Description of Artificial Sequence: Synthetic peptide
  Seed: RKYEAMTKL (SSX2_HUMAN)
RQYEAMTKC

SEQ ID NO: 163051 - protein, 9 aa, Artificial Sequence
  Description of Artificial Sequence: Synthetic peptide
  Seed: AFDDIAKYF (SSX2_HUMAN)
ATDDIAKYV

SEQ ID NO: 163052 - protein, 9 aa, Artificial Sequence
  Description of Artificial Sequence: Synthetic peptide
  Seed: GFKATLPPF (SSX2_HUMAN)
GVKATLPPY

SEQ ID NO: 163053 - protein, 11 aa, Artificial Sequence
  Description of Artificial Sequence: Synthetic peptide
  Seed: FGRLQGISPKI (SSX2_HUMAN)
FPRLQGISPKL

SEQ ID NO: 163054 - protein, 10 aa, Artificial Sequence
  Description of Artificial Sequence: Synthetic peptide
  Seed: AQIPEKIQKA (SSX2_HUMAN)
AIIPEKIQKL

SEQ ID NO: 163055 - protein, 9 aa, Artificial Sequence
  Description of Artificial Sequence: Synthetic peptide
  Seed: DAFARRPTV (SSX2_HUMAN)
DQFARRPTL

SEQ ID NO: 163056 - protein, 9 aa, Artificial Sequence
  Description of Artificial Sequence: Synthetic peptide
  Seed: AFDDIAKYF (SSX2_HUMAN)
ACDDIAKYL

SEQ ID NO: 163057 - protein, 9 aa, Artificial Sequence
  Description of Artificial Sequence: Synthetic peptide
  Seed: KQLVIYEEI (SSX2_HUMAN)
KVLVIYEEL

SEQ ID NO: 163058 - protein, 8 aa, Artificial Sequence
  Description of Artificial Sequence: Synthetic peptide
  Seed: FDDIAKYF (SSX2_HUMAN)
FMDIAKYM

SEQ ID NO: 163059 - protein, 9 aa, Artificial Sequence
  Description of Artificial Sequence: Synthetic peptide
  Seed: GEHAWTHRL (SSX2_HUMAN)
GQHAWTHRY

SEQ ID NO: 163060 - protein, 10 aa, Artificial Sequence
  Description of Artificial Sequence: Synthetic peptide
  Seed: YEAMTKLGFK (SSX2_HUMAN)
YIAMTKLGFR

SEQ ID NO: 163061 - protein, 10 aa, Artificial Sequence
  Description of Artificial Sequence: Synthetic peptide
  Seed: RLQGISPKIM (SSX2_HUMAN)
RMQGISPKIF

SEQ ID NO: 163062 - protein, 9 aa, Artificial Sequence
  Description of Artificial Sequence: Synthetic peptide
  Seed: KAFDDIAKY (SSX2_HUMAN)
KIFDDIAKL

SEQ ID NO: 163063 - protein, 9 aa, Artificial Sequence
  Description of Artificial Sequence: Synthetic peptide
  Seed: MPKKPAEEG (SSX2_HUMAN)
MIKKPAEEL

SEQ ID NO: 163064 - protein, 9 aa, Artificial Sequence
  Description of Artificial Sequence: Synthetic peptide
  Seed: KQLVIYEEI (SSX2_HUMAN)
KLLVIYEEY

SEQ ID NO: 163065 - protein, 10 aa, Artificial Sequence
  Description of Artificial Sequence: Synthetic peptide
  Seed: MKASEKIFYV (SSX2_HUMAN)
MAASEKIFYA

SEQ ID NO: 163066 - protein, 9 aa, Artificial Sequence
  Description of Artificial Sequence: Synthetic peptide
  Seed: VGAQIPEKI (SSX2_HUMAN)
VIAQIPEKI

SEQ ID NO: 163067 - protein, 10 aa, Artificial Sequence
  Description of Artificial Sequence: Synthetic peptide
  Seed: MKRKYEAMTK (SSX2_HUMAN)
MFRKYEAMTK

SEQ ID NO: 163068 - protein, 10 aa, Artificial Sequence
  Description of Artificial Sequence: Synthetic peptide
  Seed: AFARRPTVGA (SSX2_HUMAN)
AGARRPTVGK

SEQ ID NO: 163069 - protein, 10 aa, Artificial Sequence
  Description of Artificial Sequence: Synthetic peptide
  Seed: KAFDDIAKYF (SSX2_HUMAN)
KMFDDIAKYM

SEQ ID NO: 163070 - protein, 9 aa, Artificial Sequence
  Description of Artificial Sequence: Synthetic peptide
  Seed: RLRERKQLV (SSX2_HUMAN)
RYRERKQLK

SEQ ID NO: 163071 - protein, 9 aa, Artificial Sequence
  Description of Artificial Sequence: Synthetic peptide
  Seed: KQLVIYEEI (SSX2_HUMAN)
KDLVIYEEM

SEQ ID NO: 163072 - protein, 9 aa, Artificial Sequence
  Description of Artificial Sequence: Synthetic peptide
  Seed: RPQMTFGRL (SSX2_HUMAN)
RPQMTFGRV

SEQ ID NO: 163073 - protein, 9 aa, Artificial Sequence
  Description of Artificial Sequence: Synthetic peptide
  Seed: KQLVIYEEI (SSX2_HUMAN)
KELVIYEET

SEQ ID NO: 163074 - protein, 10 aa, Artificial Sequence
  Description of Artificial Sequence: Synthetic peptide
  Seed: KAFDDIAKYF (SSX2_HUMAN)
KYFDDIAKYW

SEQ ID NO: 163075 - protein, 10 aa, Artificial Sequence
  Description of Artificial Sequence: Synthetic peptide
  Seed: YEAMTKLGFK (SSX2_HUMAN)
YEAMTKLGFR

SEQ ID NO: 163076 - protein, 9 aa, Artificial Sequence
  Description of Artificial Sequence: Synthetic peptide
  Seed: KIFYVYMKR (SSX2_HUMAN)
KLFYVYMKK

SEQ ID NO: 163077 - protein, 9 aa, Artificial Sequence
  Description of Artificial Sequence: Synthetic peptide
  Seed: KRKYEAMTK (SSX2_HUMAN)
KMKYEAMTK

SEQ ID NO: 163078 - protein, 9 aa, Artificial Sequence
  Description of Artificial Sequence: Synthetic peptide
  Seed: KAFDDIAKY (SSX2_HUMAN)
KSFDDIAKI

SEQ ID NO: 163079 - protein, 11 aa, Artificial Sequence
  Description of Artificial Sequence: Synthetic peptide
  Seed: KYEAMTKLGFK (SSX2_HUMAN)
KVEAMTKLGFK

SEQ ID NO: 163080 - protein, 9 aa, Artificial Sequence
  Description of Artificial Sequence: Synthetic peptide
  Seed: GFKATLPPF (SSX2_HUMAN)
GKKATLPPF

SEQ ID NO: 163081 - protein, 9 aa, Artificial Sequence
  Description of Artificial Sequence: Synthetic peptide
  Seed: KIFYVYMKR (SSX2_HUMAN)
KVFYVYMKK

SEQ ID NO: 163082 - protein, 9 aa, Artificial Sequence
  Description of Artificial Sequence: Synthetic peptide
  Seed: TTSEKIHER (SSX2_HUMAN)
TRSEKIHEV

SEQ ID NO: 163083 - protein, 9 aa, Artificial Sequence
  Description of Artificial Sequence: Synthetic peptide
  Seed: MTKLGFKAT (SSX2_HUMAN)
MTKLGFKAK

SEQ ID NO: 163084 - protein, 9 aa, Artificial Sequence
  Description of Artificial Sequence: Synthetic peptide
  Seed: RLRERKQLV (SSX2_HUMAN)
RVRERKQLL

SEQ ID NO: 163085 - protein, 10 aa, Artificial Sequence
  Description of Artificial Sequence: Synthetic peptide
  Seed: NQVERPQMTF (SSX2_HUMAN)
NEVERPQMTW

SEQ ID NO: 163086 - protein, 10 aa, Artificial Sequence
  Description of Artificial Sequence: Synthetic peptide
  Seed: AFARRPTVGA (SSX2_HUMAN)
AQARRPTVGK

SEQ ID NO: 163087 - protein, 11 aa, Artificial Sequence
  Description of Artificial Sequence: Synthetic peptide
  Seed: ASGPQNDGKEL (SSX2_HUMAN)
AQGPQNDGKEL

SEQ ID NO: 163088 - protein, 9 aa, Artificial Sequence
  Description of Artificial Sequence: Synthetic peptide
  Seed: NDSEEVPEA (SSX2_HUMAN)
NESEEVPEP

SEQ ID NO: 163089 - protein, 9 aa, Artificial Sequence
  Description of Artificial Sequence: Synthetic peptide
  Seed: MTFGRLQGI (SSX2_HUMAN)
MQFGRLQGA

SEQ ID NO: 163090 - protein, 9 aa, Artificial Sequence
  Description of Artificial Sequence: Synthetic peptide
  Seed: DAFARRPTV (SSX2_HUMAN)
DRFARRPTV

SEQ ID NO: 163091 - protein, 10 aa, Artificial Sequence
  Description of Artificial Sequence: Synthetic peptide
  Seed: HAWTHRLRER (SSX2_HUMAN)
HSWTHRLRER

SEQ ID NO: 163092 - protein, 10 aa, Artificial Sequence
  Description of Artificial Sequence: Synthetic peptide
  Seed: KASEKIFYVY (SSX2_HUMAN)
KYSEKIFYVY

SEQ ID NO: 163093 - protein, 9 aa, Artificial Sequence
  Description of Artificial Sequence: Synthetic peptide
  Seed: RLRERKQLV (SSX2_HUMAN)
RVRERKQLA

SEQ ID NO: 163094 - protein, 8 aa, Artificial Sequence
  Description of Artificial Sequence: Synthetic peptide
  Seed: FDDIAKYF (SSX2_HUMAN)
FWDIAKYF

SEQ ID NO: 163095 - protein, 10 aa, Artificial Sequence
  Description of Artificial Sequence: Synthetic peptide
  Seed: KIFYVYMKRK (SSX2_HUMAN)
KMFYVYMKRW

SEQ ID NO: 163096 - protein, 10 aa, Artificial Sequence
  Description of Artificial Sequence: Synthetic peptide
  Seed: KYFSKEEWEK (SSX2_HUMAN)
KTFSKEEWEK

SEQ ID NO: 163097 - protein, 9 aa, Artificial Sequence
  Description of Artificial Sequence: Synthetic peptide
  Seed: QIPEKIQKA (SSX2_HUMAN)
QMPEKIQKV

SEQ ID NO: 163098 - protein, 9 aa, Artificial Sequence
  Description of Artificial Sequence: Synthetic peptide
  Seed: TTSEKIHER (SSX2_HUMAN)
TSSEKIHEY

SEQ ID NO: 163099 - protein, 9 aa, Artificial Sequence
  Description of Artificial Sequence: Synthetic peptide
  Seed: FKATLPPFM (SSX2_HUMAN)
FAATLPPFY

SEQ ID NO: 163100 - protein, 9 aa, Artificial Sequence
  Description of Artificial Sequence: Synthetic peptide
  Seed: GISPKIMPK (SSX2_HUMAN)
GASPKIMPV

SEQ ID NO: 163101 - protein, 9 aa, Artificial Sequence
  Description of Artificial Sequence: Synthetic peptide
  Seed: GFKATLPPF (SSX2_HUMAN)
GTKATLPPY

SEQ ID NO: 163102 - protein, 9 aa, Artificial Sequence
  Description of Artificial Sequence: Synthetic peptide
  Seed: YMKRKYEAM (SSX2_HUMAN)
YFKRKYEAM

SEQ ID NO: 163103 - protein, 10 aa, Artificial Sequence
  Description of Artificial Sequence: Synthetic peptide
  Seed: KYEAMTKLGF (SSX2_HUMAN)
KSEAMTKLGW

SEQ ID NO: 163104 - protein, 9 aa, Artificial Sequence
  Description of Artificial Sequence: Synthetic peptide
  Seed: MKASEKIFY (SSX2_HUMAN)
MSASEKIFY

SEQ ID NO: 163105 - protein, 9 aa, Artificial Sequence
  Description of Artificial Sequence: Synthetic peptide
  Seed: TTSEKIHER (SSX2_HUMAN)
TGSEKIHEF

SEQ ID NO: 163106 - protein, 9 aa, Artificial Sequence
  Description of Artificial Sequence: Synthetic peptide
  Seed: GFKATLPPF (SSX2_HUMAN)
GYKATLPPW

SEQ ID NO: 163107 - protein, 11 aa, Artificial Sequence
  Description of Artificial Sequence: Synthetic peptide
  Seed: YMKRKYEAMTK (SSX2_HUMAN)
YAKRKYEAMTL

SEQ ID NO: 163108 - protein, 8 aa, Artificial Sequence
  Description of Artificial Sequence: Synthetic peptide
  Seed: MKRKYEAM (SSX2_HUMAN)
MPRKYEAL

SEQ ID NO: 163109 - protein, 9 aa, Artificial Sequence
  Description of Artificial Sequence: Synthetic peptide
  Seed: AQIPEKIQK (SSX2_HUMAN)
ALIPEKIQR

SEQ ID NO: 163110 - protein, 9 aa, Artificial Sequence
  Description of Artificial Sequence: Synthetic peptide
  Seed: FARRPTVGA (SSX2_HUMAN)
FPRRPTVGT

SEQ ID NO: 163111 - protein, 9 aa, Artificial Sequence
  Description of Artificial Sequence: Synthetic peptide
  Seed: VYMKRKYEA (SSX2_HUMAN)
VFMKRKYEL

SEQ ID NO: 163112 - protein, 8 aa, Artificial Sequence
  Description of Artificial Sequence: Synthetic peptide
  Seed: AFDDIAKY (SSX2_HUMAN)
AVDDIAKL

SEQ ID NO: 163113 - protein, 9 aa, Artificial Sequence
  Description of Artificial Sequence: Synthetic peptide
  Seed: KASEKIFYV (SSX2_HUMAN)
KHSEKIFYY

SEQ ID NO: 163114 - protein, 10 aa, Artificial Sequence
  Description of Artificial Sequence: Synthetic peptide
  Seed: EKIFYVYMKR (SSX2_HUMAN)
ETIFYVYMKK

SEQ ID NO: 163115 - protein, 9 aa, Artificial Sequence
  Description of Artificial Sequence: Synthetic peptide
  Seed: MPKKPAEEG (SSX2_HUMAN)
MPKKPAEEY

SEQ ID NO: 163116 - protein, 9 aa, Artificial Sequence
  Description of Artificial Sequence: Synthetic peptide
  Seed: MTFGRLQGI (SSX2_HUMAN)
MAFGRLQGM

SEQ ID NO: 163117 - protein, 10 aa, Artificial Sequence
  Description of Artificial Sequence: Synthetic peptide
  Seed: AQIPEKIQKA (SSX2_HUMAN)
AAIPEKIQKV

SEQ ID NO: 163118 - protein, 10 aa, Artificial Sequence
  Description of Artificial Sequence: Synthetic peptide
  Seed: AQIPEKIQKA (SSX2_HUMAN)
AEIPEKIQKV

SEQ ID NO: 163119 - protein, 9 aa, Artificial Sequence
  Description of Artificial Sequence: Synthetic peptide
  Seed: FSKEEWEKM (SSX2_HUMAN)
FAKEEWEKH

SEQ ID NO: 163120 - protein, 9 aa, Artificial Sequence
  Description of Artificial Sequence: Synthetic peptide
  Seed: GISPKIMPK (SSX2_HUMAN)
GASPKIMPL

SEQ ID NO: 163121 - protein, 9 aa, Artificial Sequence
  Description of Artificial Sequence: Synthetic peptide
  Seed: KAFDDIAKY (SSX2_HUMAN)
KIFDDIAKK

SEQ ID NO: 163122 - protein, 8 aa, Artificial Sequence
  Description of Artificial Sequence: Synthetic peptide
  Seed: EEWEKMKA (SSX2_HUMAN)
EEWEKMKF

SEQ ID NO: 163123 - protein, 9 aa, Artificial Sequence
  Description of Artificial Sequence: Synthetic peptide
  Seed: KMKASEKIF (SSX2_HUMAN)
KKKASEKIY

SEQ ID NO: 163124 - protein, 10 aa, Artificial Sequence
  Description of Artificial Sequence: Synthetic peptide
  Seed: YEAMTKLGFK (SSX2_HUMAN)
YAAMTKLGFK

SEQ ID NO: 163125 - protein, 8 aa, Artificial Sequence
  Description of Artificial Sequence: Synthetic peptide
  Seed: FDDIAKYF (SSX2_HUMAN)
FLDIAKYL

SEQ ID NO: 163126 - protein, 9 aa, Artificial Sequence
  Description of Artificial Sequence: Synthetic peptide
  Seed: TTSEKIHER (SSX2_HUMAN)
TQSEKIHEY

SEQ ID NO: 163127 - protein, 9 aa, Artificial Sequence
  Description of Artificial Sequence: Synthetic peptide
  Seed: TLPPFMCNK (SSX2_HUMAN)
TIPPFMCNR

SEQ ID NO: 163128 - protein, 8 aa, Artificial Sequence
  Description of Artificial Sequence: Synthetic peptide
  Seed: FDDIAKYF (SSX2_HUMAN)
FCDIAKYL

SEQ ID NO: 163129 - protein, 10 aa, Artificial Sequence
  Description of Artificial Sequence: Synthetic peptide
  Seed: KAFDDIAKYF (SSX2_HUMAN)
KVFDDIAKYK

SEQ ID NO: 163130 - protein, 10 aa, Artificial Sequence
  Description of Artificial Sequence: Synthetic peptide
  Seed: KAFDDIAKYF (SSX2_HUMAN)
KSFDDIAKYF

SEQ ID NO: 163131 - protein, 9 aa, Artificial Sequence
  Description of Artificial Sequence: Synthetic peptide
  Seed: KAFDDIAKY (SSX2_HUMAN)
KVFDDIAKK

SEQ ID NO: 163132 - protein, 10 aa, Artificial Sequence
  Description of Artificial Sequence: Synthetic peptide
  Seed: YMKRKYEAMT (SSX2_HUMAN)
YLKRKYEAMA

SEQ ID NO: 163133 - protein, 10 aa, Artificial Sequence
  Description of Artificial Sequence: Synthetic peptide
  Seed: YVYMKRKYEA (SSX2_HUMAN)
YMYMKRKYEV

SEQ ID NO: 163134 - protein, 11 aa, Artificial Sequence
  Description of Artificial Sequence: Synthetic peptide
  Seed: SEKIFYVYMKR (SSX2_HUMAN)
SMKIFYVYMKR

SEQ ID NO: 163135 - protein, 10 aa, Artificial Sequence
  Description of Artificial Sequence: Synthetic peptide
  Seed: ATLPPFMCNK (SSX2_HUMAN)
ASLPPFMCNR

SEQ ID NO: 163136 - protein, 9 aa, Artificial Sequence
  Description of Artificial Sequence: Synthetic peptide
  Seed: RKYEAMTKL (SSX2_HUMAN)
RGYEAMTKF

SEQ ID NO: 163137 - protein, 9 aa, Artificial Sequence
  Description of Artificial Sequence: Synthetic peptide
  Seed: CPPGKPTTS (SSX2_HUMAN)
CPPGKPTTL

SEQ ID NO: 163138 - protein, 10 aa, Artificial Sequence
  Description of Artificial Sequence: Synthetic peptide
  Seed: MKASEKIFYV (SSX2_HUMAN)
MMASEKIFYG

SEQ ID NO: 163139 - protein, 9 aa, Artificial Sequence
  Description of Artificial Sequence: Synthetic peptide
  Seed: TKLGFKATL (SSX2_HUMAN)
TQLGFKATY

SEQ ID NO: 163140 - protein, 9 aa, Artificial Sequence
  Description of Artificial Sequence: Synthetic peptide
  Seed: KASEKIFYV (SSX2_HUMAN)
KFSEKIFYR

SEQ ID NO: 163141 - protein, 9 aa, Artificial Sequence
  Description of Artificial Sequence: Synthetic peptide
  Seed: AFDDIAKYF (SSX2_HUMAN)
AMDDIAKYY

SEQ ID NO: 163142 - protein, 10 aa, Artificial Sequence
  Description of Artificial Sequence: Synthetic peptide
  Seed: YEAMTKLGFK (SSX2_HUMAN)
YVAMTKLGFK

SEQ ID NO: 163143 - protein, 9 aa, Artificial Sequence
  Description of Artificial Sequence: Synthetic peptide
  Seed: KRKYEAMTK (SSX2_HUMAN)
KIKYEAMTK

SEQ ID NO: 163144 - protein, 10 aa, Artificial Sequence
  Description of Artificial Sequence: Synthetic peptide
  Seed: KAFDDIAKYF (SSX2_HUMAN)
KIFDDIAKYV

SEQ ID NO: 163145 - protein, 8 aa, Artificial Sequence
  Description of Artificial Sequence: Synthetic peptide
  Seed: TSEKIHER (SSX2_HUMAN)
TAEKIHEL

SEQ ID NO: 163146 - protein, 9 aa, Artificial Sequence
  Description of Artificial Sequence: Synthetic peptide
  Seed: GEHAWTHRL (SSX2_HUMAN)
GEHAWTHRA

SEQ ID NO: 163147 - protein, 10 aa, Artificial Sequence
  Description of Artificial Sequence: Synthetic peptide
  Seed: LGFKATLPPF (SSX2_HUMAN)
LQFKATLPPL

SEQ ID NO: 163148 - protein, 8 aa, Artificial Sequence
  Description of Artificial Sequence: Synthetic peptide
  Seed: MKASEKIF (SSX2_HUMAN)
MQASEKIF

SEQ ID NO: 163149 - protein, 9 aa, Artificial Sequence
  Description of Artificial Sequence: Synthetic peptide
  Seed: EVPEASGPQ (SSX2_HUMAN)
ETPEASGPK

SEQ ID NO: 163150 - protein, 9 aa, Artificial Sequence
  Description of Artificial Sequence: Synthetic peptide
  Seed: KIHERSGPK (SSX2_HUMAN)
KSHERSGPV

SEQ ID NO: 163151 - protein, 9 aa, Artificial Sequence
  Description of Artificial Sequence: Synthetic peptide
  Seed: RLRERKQLV (SSX2_HUMAN)
RMRERKQLF

SEQ ID NO: 163152 - protein, 9 aa, Artificial Sequence
  Description of Artificial Sequence: Synthetic peptide
  Seed: VGAQIPEKI (SSX2_HUMAN)
VTAQIPEKL

SEQ ID NO: 163153 - protein, 9 aa, Artificial Sequence
  Description of Artificial Sequence: Synthetic peptide
  Seed: EAMTKLGFK (SSX2_HUMAN)
ESMTKLGFR

SEQ ID NO: 163154 - protein, 9 aa, Artificial Sequence
  Description of Artificial Sequence: Synthetic peptide
  Seed: VGAQIPEKI (SSX2_HUMAN)
VSAQIPEKF

SEQ ID NO: 163155 - protein, 8 aa, Artificial Sequence
  Description of Artificial Sequence: Synthetic peptide
  Seed: FDDIAKYF (SSX2_HUMAN)
FGDIAKYL

SEQ ID NO: 163156 - protein, 9 aa, Artificial Sequence
  Description of Artificial Sequence: Synthetic peptide
  Seed: TKLGFKATL (SSX2_HUMAN)
THLGFKATT

SEQ ID NO: 163157 - protein, 9 aa, Artificial Sequence
  Description of Artificial Sequence: Synthetic peptide
  Seed: DAFARRPTV (SSX2_HUMAN)
DQFARRPTA

SEQ ID NO: 163158 - protein, 9 aa, Artificial Sequence
  Description of Artificial Sequence: Synthetic peptide
  Seed: DDIAKYFSK (SSX2_HUMAN)
DTIAKYFSK

SEQ ID NO: 163159 - protein, 9 aa, Artificial Sequence
  Description of Artificial Sequence: Synthetic peptide
  Seed: AQIPEKIQK (SSX2_HUMAN)
AVIPEKIQM

SEQ ID NO: 163160 - protein, 9 aa, Artificial Sequence
  Description of Artificial Sequence: Synthetic peptide
  Seed: EEWEKMKAS (SSX2_HUMAN)
EEWEKMKAT

SEQ ID NO: 163161 - protein, 9 aa, Artificial Sequence
  Description of Artificial Sequence: Synthetic peptide
  Seed: KAFDDIAKY (SSX2_HUMAN)
KQFDDIAKV

SEQ ID NO: 163162 - protein, 10 aa, Artificial Sequence
  Description of Artificial Sequence: Synthetic peptide
  Seed: RLRERKQLVI (SSX2_HUMAN)
RFRERKQLVK

SEQ ID NO: 163163 - protein, 9 aa, Artificial Sequence
  Description of Artificial Sequence: Synthetic peptide
  Seed: AFDDIAKYF (SSX2_HUMAN)
ASDDIAKYF

SEQ ID NO: 163164 - protein, 9 aa, Artificial Sequence
  Description of Artificial Sequence: Synthetic peptide
  Seed: RRPTVGAQI (SSX2_HUMAN)
RRPTVGAQL

SEQ ID NO: 163165 - protein, 9 aa, Artificial Sequence
  Description of Artificial Sequence: Synthetic peptide
  Seed: KASEKIFYV (SSX2_HUMAN)
KVSEKIFYK

SEQ ID NO: 163166 - protein, 11 aa, Artificial Sequence
  Description of Artificial Sequence: Synthetic peptide
  Seed: AQIPEKIQKAF (SSX2_HUMAN)
ALIPEKIQKAW

SEQ ID NO: 163167 - protein, 9 aa, Artificial Sequence
  Description of Artificial Sequence: Synthetic peptide
  Seed: RLRERKQLV (SSX2_HUMAN)
RFRERKQLV

SEQ ID NO: 163168 - protein, 10 aa, Artificial Sequence
  Description of Artificial Sequence: Synthetic peptide
  Seed: YVYMKRKYEA (SSX2_HUMAN)
YIYMKRKYEM

SEQ ID NO: 163169 - protein, 9 aa, Artificial Sequence
  Description of Artificial Sequence: Synthetic peptide
  Seed: FARRPTVGA (SSX2_HUMAN)
FARRPTVGM

SEQ ID NO: 163170 - protein, 10 aa, Artificial Sequence
  Description of Artificial Sequence: Synthetic peptide
  Seed: KAFDDIAKYF (SSX2_HUMAN)
KMFDDIAKYY

SEQ ID NO: 163171 - protein, 9 aa, Artificial Sequence
  Description of Artificial Sequence: Synthetic peptide
  Seed: AQIPEKIQK (SSX2_HUMAN)
AYIPEKIQM

SEQ ID NO: 163172 - protein, 9 aa, Artificial Sequence
  Description of Artificial Sequence: Synthetic peptide
  Seed: AFDDIAKYF (SSX2_HUMAN)
AYDDIAKYV

SEQ ID NO: 163173 - protein, 11 aa, Artificial Sequence
  Description of Artificial Sequence: Synthetic peptide
  Seed: KRAEDFQGNDL (SSX2_HUMAN)
KHAEDFQGNDM

SEQ ID NO: 163174 - protein, 10 aa, Artificial Sequence
  Description of Artificial Sequence: Synthetic peptide
  Seed: KMKASEKIFY (SSX2_HUMAN)
KVKASEKIFM

SEQ ID NO: 163175 - protein, 10 aa, Artificial Sequence
  Description of Artificial Sequence: Synthetic peptide
  Seed: MKASEKIFYV (SSX2_HUMAN)
MHASEKIFYV

SEQ ID NO: 163176 - protein, 8 aa, Artificial Sequence
  Description of Artificial Sequence: Synthetic peptide
  Seed: YMKRKYEA (SSX2_HUMAN)
YIKRKYEL

SEQ ID NO: 163177 - protein, 11 aa, Artificial Sequence
  Description of Artificial Sequence: Synthetic peptide
  Seed: KYEAMTKLGFK (SSX2_HUMAN)
KNEAMTKLGFR

SEQ ID NO: 163178 - protein, 9 aa, Artificial Sequence
  Description of Artificial Sequence: Synthetic peptide
  Seed: AFDDIAKYF (SSX2_HUMAN)
ASDDIAKYI

SEQ ID NO: 163179 - protein, 9 aa, Artificial Sequence
  Description of Artificial Sequence: Synthetic peptide
  Seed: DAFARRPTV (SSX2_HUMAN)
DTFARRPTR

SEQ ID NO: 163180 - protein, 9 aa, Artificial Sequence
  Description of Artificial Sequence: Synthetic peptide
  Seed: MKASEKIFY (SSX2_HUMAN)
MLASEKIFF

SEQ ID NO: 163181 - protein, 9 aa, Artificial Sequence
  Description of Artificial Sequence: Synthetic peptide
  Seed: KASEKIFYV (SSX2_HUMAN)
KESEKIFYY

SEQ ID NO: 163182 - protein, 9 aa, Artificial Sequence
  Description of Artificial Sequence: Synthetic peptide
  Seed: KATLPPFMC (SSX2_HUMAN)
KSTLPPFMY

SEQ ID NO: 163183 - protein, 10 aa, Artificial Sequence
  Description of Artificial Sequence: Synthetic peptide
  Seed: EKIFYVYMKR (SSX2_HUMAN)
EMIFYVYMKR

SEQ ID NO: 163184 - protein, 9 aa, Artificial Sequence
  Description of Artificial Sequence: Synthetic peptide
  Seed: AEDFQGNDL (SSX2_HUMAN)
AIDFQGNDM

SEQ ID NO: 163185 - protein, 9 aa, Artificial Sequence
  Description of Artificial Sequence: Synthetic peptide
  Seed: YMKRKYEAM (SSX2_HUMAN)
YMKRKYEAL

SEQ ID NO: 163186 - protein, 9 aa, Artificial Sequence
  Description of Artificial Sequence: Synthetic peptide
  Seed: YMKRKYEAM (SSX2_HUMAN)
YPKRKYEAA

SEQ ID NO: 163187 - protein, 11 aa, Artificial Sequence
  Description of Artificial Sequence: Synthetic peptide
  Seed: AQIPEKIQKAF (SSX2_HUMAN)
ATIPEKIQKAY

SEQ ID NO: 163188 - protein, 9 aa, Artificial Sequence
  Description of Artificial Sequence: Synthetic peptide
  Seed: FSKEEWEKM (SSX2_HUMAN)
FLKEEWEKY

SEQ ID NO: 163189 - protein, 10 aa, Artificial Sequence
  Description of Artificial Sequence: Synthetic peptide
  Seed: EKIFYVYMKR (SSX2_HUMAN)
EIIFYVYMKK

SEQ ID NO: 163190 - protein, 9 aa, Artificial Sequence
  Description of Artificial Sequence: Synthetic peptide
  Seed: VGAQIPEKI (SSX2_HUMAN)
VQAQIPEKM

SEQ ID NO: 163191 - protein, 9 aa, Artificial Sequence
  Description of Artificial Sequence: Synthetic peptide
  Seed: AEDFQGNDL (SSX2_HUMAN)
ATDFQGNDL

SEQ ID NO: 163192 - protein, 9 aa, Artificial Sequence
  Description of Artificial Sequence: Synthetic peptide
  Seed: EKMKASEKI (SSX2_HUMAN)
EHMKASEKL

SEQ ID NO: 163193 - protein, 9 aa, Artificial Sequence
  Description of Artificial Sequence: Synthetic peptide
  Seed: EHAWTHRLR (SSX2_HUMAN)
EMAWTHRLR

SEQ ID NO: 163194 - protein, 9 aa, Artificial Sequence
  Description of Artificial Sequence: Synthetic peptide
  Seed: NGDDAFARR (SSX2_HUMAN)
NIDDAFARR

SEQ ID NO: 163195 - protein, 9 aa, Artificial Sequence
  Description of Artificial Sequence: Synthetic peptide
  Seed: VGAQIPEKI (SSX2_HUMAN)
VQAQIPEKV

SEQ ID NO: 163196 - protein, 9 aa, Artificial Sequence
  Description of Artificial Sequence: Synthetic peptide
  Seed: RKYEAMTKL (SSX2_HUMAN)
RRYEAMTKM

SEQ ID NO: 163197 - protein, 9 aa, Artificial Sequence
  Description of Artificial Sequence: Synthetic peptide
  Seed: RLQGISPKI (SSX2_HUMAN)
RQQGISPKW

SEQ ID NO: 163198 - protein, 9 aa, Artificial Sequence
  Description of Artificial Sequence: Synthetic peptide
  Seed: TTSEKIHER (SSX2_HUMAN)
TYSEKIHER

SEQ ID NO: 163199 - protein, 9 aa, Artificial Sequence
  Description of Artificial Sequence: Synthetic peptide
  Seed: AMTKLGFKA (SSX2_HUMAN)
ALTKLGFKI

SEQ ID NO: 163200 - protein, 9 aa, Artificial Sequence
  Description of Artificial Sequence: Synthetic peptide
  Seed: ISPKIMPKK (SSX2_HUMAN)
IMPKIMPKR

SEQ ID NO: 163201 - protein, 10 aa, Artificial Sequence
  Description of Artificial Sequence: Synthetic peptide
  Seed: MTKLGFKATL (SSX2_HUMAN)
MTKLGFKATF

SEQ ID NO: 163202 - protein, 8 aa, Artificial Sequence
  Description of Artificial Sequence: Synthetic peptide
  Seed: MKRKYEAM (SSX2_HUMAN)
MQRKYEAM

SEQ ID NO: 163203 - protein, 9 aa, Artificial Sequence
  Description of Artificial Sequence: Synthetic peptide
  Seed: FARRPTVGA (SSX2_HUMAN)
FVRRPTVGK

SEQ ID NO: 163204 - protein, 9 aa, Artificial Sequence
  Description of Artificial Sequence: Synthetic peptide
  Seed: ASEKIFYVY (SSX2_HUMAN)
ASEKIFYVW

SEQ ID NO: 163205 - protein, 10 aa, Artificial Sequence
  Description of Artificial Sequence: Synthetic peptide
  Seed: YEAMTKLGFK (SSX2_HUMAN)
YNAMTKLGFR

SEQ ID NO: 163206 - protein, 9 aa, Artificial Sequence
  Description of Artificial Sequence: Synthetic peptide
  Seed: KIHERSGPK (SSX2_HUMAN)
KTHERSGPR

SEQ ID NO: 163207 - protein, 9 aa, Artificial Sequence
  Description of Artificial Sequence: Synthetic peptide
  Seed: VGAQIPEKI (SSX2_HUMAN)
VAAQIPEKI

SEQ ID NO: 163208 - protein, 9 aa, Artificial Sequence
  Description of Artificial Sequence: Synthetic peptide
  Seed: AQIPEKIQK (SSX2_HUMAN)
ATIPEKIQF

SEQ ID NO: 163209 - protein, 9 aa, Artificial Sequence
  Description of Artificial Sequence: Synthetic peptide
  Seed: YEAMTKLGF (SSX2_HUMAN)
YEAMTKLGI

SEQ ID NO: 163210 - protein, 10 aa, Artificial Sequence
  Description of Artificial Sequence: Synthetic peptide
  Seed: KAFDDIAKYF (SSX2_HUMAN)
KLFDDIAKYL

SEQ ID NO: 163211 - protein, 9 aa, Artificial Sequence
  Description of Artificial Sequence: Synthetic peptide
  Seed: KASEKIFYV (SSX2_HUMAN)
KFSEKIFYI

SEQ ID NO: 163212 - protein, 9 aa, Artificial Sequence
  Description of Artificial Sequence: Synthetic peptide
  Seed: MTFGRLQGI (SSX2_HUMAN)
MVFGRLQGW

SEQ ID NO: 163213 - protein, 9 aa, Artificial Sequence
  Description of Artificial Sequence: Synthetic peptide
  Seed: RLRERKQLV (SSX2_HUMAN)
RWRERKQLA

SEQ ID NO: 163214 - protein, 8 aa, Artificial Sequence
  Description of Artificial Sequence: Synthetic peptide
  Seed: AFDDIAKY (SSX2_HUMAN)
AFDDIAKL

SEQ ID NO: 163215 - protein, 11 aa, Artificial Sequence
  Description of Artificial Sequence: Synthetic peptide
  Seed: FGRLQGISPKI (SSX2_HUMAN)
FWRLQGISPKL

SEQ ID NO: 163216 - protein, 8 aa, Artificial Sequence
  Description of Artificial Sequence: Synthetic peptide
  Seed: FDDIAKYF (SSX2_HUMAN)
FLDIAKYV

SEQ ID NO: 163217 - protein, 10 aa, Artificial Sequence
  Description of Artificial Sequence: Synthetic peptide
  Seed: MNGDDAFARR (SSX2_HUMAN)
MTGDDAFARR

SEQ ID NO: 163218 - protein, 9 aa, Artificial Sequence
  Description of Artificial Sequence: Synthetic peptide
  Seed: FSKEEWEKM (SSX2_HUMAN)
FSKEEWEKL

SEQ ID NO: 163219 - protein, 10 aa, Artificial Sequence
  Description of Artificial Sequence: Synthetic peptide
  Seed: RLRERKQLVI (SSX2_HUMAN)
RSRERKQLVA

SEQ ID NO: 163220 - protein, 10 aa, Artificial Sequence
  Description of Artificial Sequence: Synthetic peptide
  Seed: MKASEKIFYV (SSX2_HUMAN)
MLASEKIFYS

SEQ ID NO: 163221 - protein, 9 aa, Artificial Sequence
  Description of Artificial Sequence: Synthetic peptide
  Seed: QIPEKIQKA (SSX2_HUMAN)
QVPEKIQKV

SEQ ID NO: 163222 - protein, 9 aa, Artificial Sequence
  Description of Artificial Sequence: Synthetic peptide
  Seed: KASEKIFYV (SSX2_HUMAN)
KTSEKIFYF

SEQ ID NO: 163223 - protein, 9 aa, Artificial Sequence
  Description of Artificial Sequence: Synthetic peptide
  Seed: AEDFQGNDL (SSX2_HUMAN)
ASDFQGNDM

SEQ ID NO: 163224 - protein, 9 aa, Artificial Sequence
  Description of Artificial Sequence: Synthetic peptide
  Seed: GISPKIMPK (SSX2_HUMAN)
GTSPKIMPY

SEQ ID NO: 163225 - protein, 10 aa, Artificial Sequence
  Description of Artificial Sequence: Synthetic peptide
  Seed: MTKLGFKATL (SSX2_HUMAN)
MQKLGFKATY

SEQ ID NO: 163226 - protein, 10 aa, Artificial Sequence
  Description of Artificial Sequence: Synthetic peptide
  Seed: KYFSKEEWEK (SSX2_HUMAN)
KVFSKEEWER

SEQ ID NO: 163227 - protein, 9 aa, Artificial Sequence
  Description of Artificial Sequence: Synthetic peptide
  Seed: TTSEKIHER (SSX2_HUMAN)
TMSEKIHEY

SEQ ID NO: 163228 - protein, 9 aa, Artificial Sequence
  Description of Artificial Sequence: Synthetic peptide
  Seed: TLPPFMCNK (SSX2_HUMAN)
TAPPFMCNK

SEQ ID NO: 163229 - protein, 9 aa, Artificial Sequence
  Description of Artificial Sequence: Synthetic peptide
  Seed: KEEWEKMKA (SSX2_HUMAN)
KEEWEKMKI

SEQ ID NO: 163230 - protein, 10 aa, Artificial Sequence
  Description of Artificial Sequence: Synthetic peptide
  Seed: HAWTHRLRER (SSX2_HUMAN)
HTWTHRLRER

SEQ ID NO: 163231 - protein, 10 aa, Artificial Sequence
  Description of Artificial Sequence: Synthetic peptide
  Seed: YMKRKYEAMT (SSX2_HUMAN)
YVKRKYEAMM

SEQ ID NO: 163232 - protein, 9 aa, Artificial Sequence
  Description of Artificial Sequence: Synthetic peptide
  Seed: NGDDAFARR (SSX2_HUMAN)
NADDAFARM

SEQ ID NO: 163233 - protein, 9 aa, Artificial Sequence
  Description of Artificial Sequence: Synthetic peptide
  Seed: DAFARRPTV (SSX2_HUMAN)
DPFARRPTY

SEQ ID NO: 163234 - protein, 9 aa, Artificial Sequence
  Description of Artificial Sequence: Synthetic peptide
  Seed: MKASEKIFY (SSX2_HUMAN)
MTASEKIFY

SEQ ID NO: 163235 - protein, 9 aa, Artificial Sequence
  Description of Artificial Sequence: Synthetic peptide
  Seed: KRKYEAMTK (SSX2_HUMAN)
KVKYEAMTS

SEQ ID NO: 163236 - protein, 10 aa, Artificial Sequence
  Description of Artificial Sequence: Synthetic peptide
  Seed: LGFKATLPPF (SSX2_HUMAN)
LHFKATLPPY

SEQ ID NO: 163237 - protein, 10 aa, Artificial Sequence
  Description of Artificial Sequence: Synthetic peptide
  Seed: AQIPEKIQKA (SSX2_HUMAN)
ARIPEKIQKY

SEQ ID NO: 163238 - protein, 11 aa, Artificial Sequence
  Description of Artificial Sequence: Synthetic peptide
  Seed: SEKIFYVYMKR (SSX2_HUMAN)
SVKIFYVYMKR

SEQ ID NO: 163239 - protein, 10 aa, Artificial Sequence
  Description of Artificial Sequence: Synthetic peptide
  Seed: AQIPEKIQKA (SSX2_HUMAN)
AAIPEKIQKY

SEQ ID NO: 163240 - protein, 9 aa, Artificial Sequence
  Description of Artificial Sequence: Synthetic peptide
  Seed: KIHERSGPK (SSX2_HUMAN)
KTHERSGPV

SEQ ID NO: 163241 - protein, 9 aa, Artificial Sequence
  Description of Artificial Sequence: Synthetic peptide
  Seed: AFDDIAKYF (SSX2_HUMAN)
ANDDIAKYY

SEQ ID NO: 163242 - protein, 11 aa, Artificial Sequence
  Description of Artificial Sequence: Synthetic peptide
  Seed: KATLPPFMCNK (SSX2_HUMAN)
KTTLPPFMCNK

SEQ ID NO: 163243 - protein, 10 aa, Artificial Sequence
  Description of Artificial Sequence: Synthetic peptide
  Seed: YVYMKRKYEA (SSX2_HUMAN)
YPYMKRKYEI

SEQ ID NO: 163244 - protein, 10 aa, Artificial Sequence
  Description of Artificial Sequence: Synthetic peptide
  Seed: AQIPEKIQKA (SSX2_HUMAN)
AEIPEKIQKF

SEQ ID NO: 163245 - protein, 10 aa, Artificial Sequence
  Description of Artificial Sequence: Synthetic peptide
  Seed: KASEKIFYVY (SSX2_HUMAN)
KMSEKIFYVF

SEQ ID NO: 163246 - protein, 9 aa, Artificial Sequence
  Description of Artificial Sequence: Synthetic peptide
  Seed: AEDFQGNDL (SSX2_HUMAN)
AIDFQGNDF

SEQ ID NO: 163247 - protein, 9 aa, Artificial Sequence
  Description of Artificial Sequence: Synthetic peptide
  Seed: MCNKRAEDF (SSX2_HUMAN)
MANKRAEDF

SEQ ID NO: 163248 - protein, 11 aa, Artificial Sequence
  Description of Artificial Sequence: Synthetic peptide
  Seed: KYEAMTKLGFK (SSX2_HUMAN)
KTEAMTKLGFK

SEQ ID NO: 163249 - protein, 9 aa, Artificial Sequence
  Description of Artificial Sequence: Synthetic peptide
  Seed: KIFYVYMKR (SSX2_HUMAN)
KSFYVYMKV

SEQ ID NO: 163250 - protein, 9 aa, Artificial Sequence
  Description of Artificial Sequence: Synthetic peptide
  Seed: QIPEKIQKA (SSX2_HUMAN)
QLPEKIQKL

SEQ ID NO: 163251 - protein, 9 aa, Artificial Sequence
  Description of Artificial Sequence: Synthetic peptide
  Seed: MNGDDAFAR (SSX2_HUMAN)
MTGDDAFAK

SEQ ID NO: 163252 - protein, 9 aa, Artificial Sequence
  Description of Artificial Sequence: Synthetic peptide
  Seed: AKYFSKEEW (SSX2_HUMAN)
AQYFSKEEM

SEQ ID NO: 163253 - protein, 10 aa, Artificial Sequence
  Description of Artificial Sequence: Synthetic peptide
  Seed: YMKRKYEAMT (SSX2_HUMAN)
YIKRKYEAMM

SEQ ID NO: 163254 - protein, 11 aa, Artificial Sequence
  Description of Artificial Sequence: Synthetic peptide
  Seed: KELCPPGKPTT (SSX2_HUMAN)
KELCPPGKPTI

SEQ ID NO: 163255 - protein, 9 aa, Artificial Sequence
  Description of Artificial Sequence: Synthetic peptide
  Seed: RKYEAMTKL (SSX2_HUMAN)
RDYEAMTKF

SEQ ID NO: 163256 - protein, 9 aa, Artificial Sequence
  Description of Artificial Sequence: Synthetic peptide
  Seed: RLQGISPKI (SSX2_HUMAN)
RQQGISPKY

SEQ ID NO: 163257 - protein, 10 aa, Artificial Sequence
  Description of Artificial Sequence: Synthetic peptide
  Seed: KAFDDIAKYF (SSX2_HUMAN)
KVFDDIAKYV

SEQ ID NO: 163258 - protein, 10 aa, Artificial Sequence
  Description of Artificial Sequence: Synthetic peptide
  Seed: LGFKATLPPF (SSX2_HUMAN)
LTFKATLPPL

SEQ ID NO: 163259 - protein, 8 aa, Artificial Sequence
  Description of Artificial Sequence: Synthetic peptide
  Seed: AFDDIAKY (SSX2_HUMAN)
AIDDIAKM

SEQ ID NO: 163260 - protein, 9 aa, Artificial Sequence
  Description of Artificial Sequence: Synthetic peptide
  Seed: QIPEKIQKA (SSX2_HUMAN)
QLPEKIQKI

SEQ ID NO: 163261 - protein, 10 aa, Artificial Sequence
  Description of Artificial Sequence: Synthetic peptide
  Seed: EKIFYVYMKR (SSX2_HUMAN)
EHIFYVYMKK

SEQ ID NO: 163262 - protein, 9 aa, Artificial Sequence
  Description of Artificial Sequence: Synthetic peptide
  Seed: RERKQLVIY (SSX2_HUMAN)
RQRKQLVIM

SEQ ID NO: 163263 - protein, 10 aa, Artificial Sequence
  Description of Artificial Sequence: Synthetic peptide
  Seed: YEAMTKLGFK (SSX2_HUMAN)
YTAMTKLGFK

SEQ ID NO: 163264 - protein, 10 aa, Artificial Sequence
  Description of Artificial Sequence: Synthetic peptide
  Seed: MNGDDAFARR (SSX2_HUMAN)
MSGDDAFARR

SEQ ID NO: 163265 - protein, 10 aa, Artificial Sequence
  Description of Artificial Sequence: Synthetic peptide
  Seed: YEAMTKLGFK (SSX2_HUMAN)
YPAMTKLGFR

SEQ ID NO: 163266 - protein, 9 aa, Artificial Sequence
  Description of Artificial Sequence: Synthetic peptide
  Seed: AEDFQGNDL (SSX2_HUMAN)
ATDFQGNDV

SEQ ID NO: 163267 - protein, 10 aa, Artificial Sequence
  Description of Artificial Sequence: Synthetic peptide
  Seed: AFARRPTVGA (SSX2_HUMAN)
ANARRPTVGK

SEQ ID NO: 163268 - protein, 9 aa, Artificial Sequence
  Description of Artificial Sequence: Synthetic peptide
  Seed: MTFGRLQGI (SSX2_HUMAN)
MQFGRLQGT

SEQ ID NO: 163269 - protein, 10 aa, Artificial Sequence
  Description of Artificial Sequence: Synthetic peptide
  Seed: KAFDDIAKYF (SSX2_HUMAN)
KKFDDIAKYF

SEQ ID NO: 163270 - protein, 10 aa, Artificial Sequence
  Description of Artificial Sequence: Synthetic peptide
  Seed: YMKRKYEAMT (SSX2_HUMAN)
YMKRKYEAMS

SEQ ID NO: 163271 - protein, 9 aa, Artificial Sequence
  Description of Artificial Sequence: Synthetic peptide
  Seed: KASEKIFYV (SSX2_HUMAN)
KTSEKIFYM

SEQ ID NO: 163272 - protein, 9 aa, Artificial Sequence
  Description of Artificial Sequence: Synthetic peptide
  Seed: TVGAQIPEK (SSX2_HUMAN)
TIGAQIPEK

SEQ ID NO: 163273 - protein, 9 aa, Artificial Sequence
  Description of Artificial Sequence: Synthetic peptide
  Seed: KAFDDIAKY (SSX2_HUMAN)
KIFDDIAKV

SEQ ID NO: 163274 - protein, 9 aa, Artificial Sequence
  Description of Artificial Sequence: Synthetic peptide
  Seed: KQLVIYEEI (SSX2_HUMAN)
KVLVIYEEV

SEQ ID NO: 163275 - protein, 10 aa, Artificial Sequence
  Description of Artificial Sequence: Synthetic peptide
  Seed: QMTFGRLQGI (SSX2_HUMAN)
QLTFGRLQGV

SEQ ID NO: 163276 - protein, 8 aa, Artificial Sequence
  Description of Artificial Sequence: Synthetic peptide
  Seed: AFDDIAKY (SSX2_HUMAN)
AADDIAKF

SEQ ID NO: 163277 - protein, 9 aa, Artificial Sequence
  Description of Artificial Sequence: Synthetic peptide
  Seed: KIHERSGPK (SSX2_HUMAN)
KTHERSGPI

SEQ ID NO: 163278 - protein, 10 aa, Artificial Sequence
  Description of Artificial Sequence: Synthetic peptide
  Seed: ASEKIFYVYM (SSX2_HUMAN)
AEEKIFYVYL

SEQ ID NO: 163279 - protein, 10 aa, Artificial Sequence
  Description of Artificial Sequence: Synthetic peptide
  Seed: KYFSKEEWEK (SSX2_HUMAN)
KLFSKEEWEK

SEQ ID NO: 163280 - protein, 9 aa, Artificial Sequence
  Description of Artificial Sequence: Synthetic peptide
  Seed: RKYEAMTKL (SSX2_HUMAN)
RMYEAMTKI

SEQ ID NO: 163281 - protein, 9 aa, Artificial Sequence
  Description of Artificial Sequence: Synthetic peptide
  Seed: QIPEKIQKA (SSX2_HUMAN)
QTPEKIQKM

SEQ ID NO: 163282 - protein, 9 aa, Artificial Sequence
  Description of Artificial Sequence: Synthetic peptide
  Seed: EAMTKLGFK (SSX2_HUMAN)
ELMTKLGFK

SEQ ID NO: 163283 - protein, 9 aa, Artificial Sequence
  Description of Artificial Sequence: Synthetic peptide
  Seed: KAFDDIAKY (SSX2_HUMAN)
KEFDDIAKY

SEQ ID NO: 163284 - protein, 9 aa, Artificial Sequence
  Description of Artificial Sequence: Synthetic peptide
  Seed: KASEKIFYV (SSX2_HUMAN)
KMSEKIFYM

SEQ ID NO: 163285 - protein, 10 aa, Artificial Sequence
  Description of Artificial Sequence: Synthetic peptide
  Seed: MKASEKIFYV (SSX2_HUMAN)
MMASEKIFYL

SEQ ID NO: 163286 - protein, 10 aa, Artificial Sequence
  Description of Artificial Sequence: Synthetic peptide
  Seed: KYEAMTKLGF (SSX2_HUMAN)
KMEAMTKLGW

SEQ ID NO: 163287 - protein, 10 aa, Artificial Sequence
  Description of Artificial Sequence: Synthetic peptide
  Seed: LGFKATLPPF (SSX2_HUMAN)
LVFKATLPPW

SEQ ID NO: 163288 - protein, 10 aa, Artificial Sequence
  Description of Artificial Sequence: Synthetic peptide
  Seed: KASEKIFYVY (SSX2_HUMAN)
KKSEKIFYVY

SEQ ID NO: 163289 - protein, 9 aa, Artificial Sequence
  Description of Artificial Sequence: Synthetic peptide
  Seed: RLRERKQLV (SSX2_HUMAN)
RSRERKQLI

SEQ ID NO: 163290 - protein, 10 aa, Artificial Sequence
  Description of Artificial Sequence: Synthetic peptide
  Seed: QGISPKIMPK (SSX2_HUMAN)
QLISPKIMPK

SEQ ID NO: 163291 - protein, 9 aa, Artificial Sequence
  Description of Artificial Sequence: Synthetic peptide
  Seed: AFDDIAKYF (SSX2_HUMAN)
AYDDIAKYI

SEQ ID NO: 163292 - protein, 10 aa, Artificial Sequence
  Description of Artificial Sequence: Synthetic peptide
  Seed: RLRERKQLVI (SSX2_HUMAN)
RLRERKQLVK

SEQ ID NO: 163293 - protein, 9 aa, Artificial Sequence
  Description of Artificial Sequence: Synthetic peptide
  Seed: RLQGISPKI (SSX2_HUMAN)
RSQGISPKV

SEQ ID NO: 163294 - protein, 10 aa, Artificial Sequence
  Description of Artificial Sequence: Synthetic peptide
  Seed: AFARRPTVGA (SSX2_HUMAN)
ADARRPTVGK

SEQ ID NO: 163295 - protein, 9 aa, Artificial Sequence
  Description of Artificial Sequence: Synthetic peptide
  Seed: KASEKIFYV (SSX2_HUMAN)
KLSEKIFYG

SEQ ID NO: 163296 - protein, 9 aa, Artificial Sequence
  Description of Artificial Sequence: Synthetic peptide
  Seed: KASEKIFYV (SSX2_HUMAN)
KISEKIFYM

SEQ ID NO: 163297 - protein, 10 aa, Artificial Sequence
  Description of Artificial Sequence: Synthetic peptide
  Seed: KYEAMTKLGF (SSX2_HUMAN)
KPEAMTKLGW

SEQ ID NO: 163298 - protein, 9 aa, Artificial Sequence
  Description of Artificial Sequence: Synthetic peptide
  Seed: RGEHAWTHR (SSX2_HUMAN)
RQEHAWTHR

SEQ ID NO: 163299 - protein, 9 aa, Artificial Sequence
  Description of Artificial Sequence: Synthetic peptide
  Seed: AEDFQGNDL (SSX2_HUMAN)
AGDFQGNDL

SEQ ID NO: 163300 - protein, 10 aa, Artificial Sequence
  Description of Artificial Sequence: Synthetic peptide
  Seed: MTKLGFKATL (SSX2_HUMAN)
MNKLGFKATF

SEQ ID NO: 163301 - protein, 9 aa, Artificial Sequence
  Description of Artificial Sequence: Synthetic peptide
  Seed: GPKRGEHAW (SSX2_HUMAN)
GPKRGEHAL

SEQ ID NO: 163302 - protein, 9 aa, Artificial Sequence
  Description of Artificial Sequence: Synthetic peptide
  Seed: KAFDDIAKY (SSX2_HUMAN)
KRFDDIAKM

SEQ ID NO: 163303 - protein, 9 aa, Artificial Sequence
  Description of Artificial Sequence: Synthetic peptide
  Seed: TTSEKIHER (SSX2_HUMAN)
TTSEKIHEM

SEQ ID NO: 163304 - protein, 10 aa, Artificial Sequence
  Description of Artificial Sequence: Synthetic peptide
  Seed: KAFDDIAKYF (SSX2_HUMAN)
KGFDDIAKYW

SEQ ID NO: 163305 - protein, 10 aa, Artificial Sequence
  Description of Artificial Sequence: Synthetic peptide
  Seed: LGFKATLPPF (SSX2_HUMAN)
LVFKATLPPM

SEQ ID NO: 163306 - protein, 9 aa, Artificial Sequence
  Description of Artificial Sequence: Synthetic peptide
  Seed: KASEKIFYV (SSX2_HUMAN)
KLSEKIFYM

SEQ ID NO: 163307 - protein, 10 aa, Artificial Sequence
  Description of Artificial Sequence: Synthetic peptide
  Seed: KYFSKEEWEK (SSX2_HUMAN)
KSFSKEEWEY

SEQ ID NO: 163308 - protein, 10 aa, Artificial Sequence
  Description of Artificial Sequence: Synthetic peptide
  Seed: YMKRKYEAMT (SSX2_HUMAN)
YAKRKYEAMM

SEQ ID NO: 163309 - protein, 9 aa, Artificial Sequence
  Description of Artificial Sequence: Synthetic peptide
  Seed: SEKIFYVYM (SSX2_HUMAN)
SEKIFYVYY

SEQ ID NO: 163310 - protein, 9 aa, Artificial Sequence
  Description of Artificial Sequence: Synthetic peptide
  Seed: KAFDDIAKY (SSX2_HUMAN)
KAFDDIAKV

SEQ ID NO: 163311 - protein, 9 aa, Artificial Sequence
  Description of Artificial Sequence: Synthetic peptide
  Seed: VGAQIPEKI (SSX2_HUMAN)
VRAQIPEKL

SEQ ID NO: 163312 - protein, 9 aa, Artificial Sequence
  Description of Artificial Sequence: Synthetic peptide
  Seed: MTFGRLQGI (SSX2_HUMAN)
MLFGRLQGV

SEQ ID NO: 163313 - protein, 11 aa, Artificial Sequence
  Description of Artificial Sequence: Synthetic peptide
  Seed: YVYMKRKYEAM (SSX2_HUMAN)
YHYMKRKYEAL

SEQ ID NO: 163314 - protein, 9 aa, Artificial Sequence
  Description of Artificial Sequence: Synthetic peptide
  Seed: TVGAQIPEK (SSX2_HUMAN)
TSGAQIPEM

SEQ ID NO: 163315 - protein, 9 aa, Artificial Sequence
  Description of Artificial Sequence: Synthetic peptide
  Seed: YFSKEEWEK (SSX2_HUMAN)
YTSKEEWEY

SEQ ID NO: 163316 - protein, 9 aa, Artificial Sequence
  Description of Artificial Sequence: Synthetic peptide
  Seed: KAFDDIAKY (SSX2_HUMAN)
KEFDDIAKI

SEQ ID NO: 163317 - protein, 9 aa, Artificial Sequence
  Description of Artificial Sequence: Synthetic peptide
  Seed: GEHAWTHRL (SSX2_HUMAN)
GKHAWTHRY

SEQ ID NO: 163318 - protein, 10 aa, Artificial Sequence
  Description of Artificial Sequence: Synthetic peptide
  Seed: KAFDDIAKYF (SSX2_HUMAN)
KHFDDIAKYY

SEQ ID NO: 163319 - protein, 9 aa, Artificial Sequence
  Description of Artificial Sequence: Synthetic peptide
  Seed: RLQGISPKI (SSX2_HUMAN)
RVQGISPKI

SEQ ID NO: 163320 - protein, 9 aa, Artificial Sequence
  Description of Artificial Sequence: Synthetic peptide
  Seed: EEWEKMKAS (SSX2_HUMAN)
EEWEKMKAV

SEQ ID NO: 163321 - protein, 9 aa, Artificial Sequence
  Description of Artificial Sequence: Synthetic peptide
  Seed: GEHAWTHRL (SSX2_HUMAN)
GHHAWTHRL

SEQ ID NO: 163322 - protein, 10 aa, Artificial Sequence
  Description of Artificial Sequence: Synthetic peptide
  Seed: RPQMTFGRLQ (SSX2_HUMAN)
RPQMTFGRLL

SEQ ID NO: 163323 - protein, 10 aa, Artificial Sequence
  Description of Artificial Sequence: Synthetic peptide
  Seed: MTKLGFKATL (SSX2_HUMAN)
MFKLGFKATF

SEQ ID NO: 163324 - protein, 9 aa, Artificial Sequence
  Description of Artificial Sequence: Synthetic peptide
  Seed: EKMKASEKI (SSX2_HUMAN)
ERMKASEKI

SEQ ID NO: 163325 - protein, 9 aa, Artificial Sequence
  Description of Artificial Sequence: Synthetic peptide
  Seed: KQLVIYEEI (SSX2_HUMAN)
KLLVIYEEI

SEQ ID NO: 163326 - protein, 9 aa, Artificial Sequence
  Description of Artificial Sequence: Synthetic peptide
  Seed: KAFDDIAKY (SSX2_HUMAN)
KFFDDIAKL

SEQ ID NO: 163327 - protein, 11 aa, Artificial Sequence
  Description of Artificial Sequence: Synthetic peptide
  Seed: AQIPEKIQKAF (SSX2_HUMAN)
ARIPEKIQKAM

SEQ ID NO: 163328 - protein, 9 aa, Artificial Sequence
  Description of Artificial Sequence: Synthetic peptide
  Seed: AFDDIAKYF (SSX2_HUMAN)
ASDDIAKYL

SEQ ID NO: 163329 - protein, 9 aa, Artificial Sequence
  Description of Artificial Sequence: Synthetic peptide
  Seed: ASEKIFYVY (SSX2_HUMAN)
AMEKIFYVF

SEQ ID NO: 163330 - protein, 8 aa, Artificial Sequence
  Description of Artificial Sequence: Synthetic peptide
  Seed: YMKRKYEA (SSX2_HUMAN)
YLKRKYEI

SEQ ID NO: 163331 - protein, 9 aa, Artificial Sequence
  Description of Artificial Sequence: Synthetic peptide
  Seed: GFKATLPPF (SSX2_HUMAN)
GYKATLPPF

SEQ ID NO: 163332 - protein, 9 aa, Artificial Sequence
  Description of Artificial Sequence: Synthetic peptide
  Seed: AQIPEKIQK (SSX2_HUMAN)
AAIPEKIQY

SEQ ID NO: 163333 - protein, 9 aa, Artificial Sequence
  Description of Artificial Sequence: Synthetic peptide
  Seed: RKYEAMTKL (SSX2_HUMAN)
RAYEAMTKF

SEQ ID NO: 163334 - protein, 9 aa, Artificial Sequence
  Description of Artificial Sequence: Synthetic peptide
  Seed: AFDDIAKYF (SSX2_HUMAN)
ANDDIAKYM

SEQ ID NO: 163335 - protein, 9 aa, Artificial Sequence
  Description of Artificial Sequence: Synthetic peptide
  Seed: KASEKIFYV (SSX2_HUMAN)
KWSEKIFYF

SEQ ID NO: 163336 - protein, 10 aa, Artificial Sequence
  Description of Artificial Sequence: Synthetic peptide
  Seed: MKASEKIFYV (SSX2_HUMAN)
MRASEKIFYV

SEQ ID NO: 163337 - protein, 10 aa, Artificial Sequence
  Description of Artificial Sequence: Synthetic peptide
  Seed: QMTFGRLQGI (SSX2_HUMAN)
QFTFGRLQGV

SEQ ID NO: 163338 - protein, 9 aa, Artificial Sequence
  Description of Artificial Sequence: Synthetic peptide
  Seed: FARRPTVGA (SSX2_HUMAN)
FMRRPTVGK

SEQ ID NO: 163339 - protein, 9 aa, Artificial Sequence
  Description of Artificial Sequence: Synthetic peptide
  Seed: YMKRKYEAM (SSX2_HUMAN)
YIKRKYEAC

SEQ ID NO: 163340 - protein, 9 aa, Artificial Sequence
  Description of Artificial Sequence: Synthetic peptide
  Seed: DDIAKYFSK (SSX2_HUMAN)
DSIAKYFSK

SEQ ID NO: 163341 - protein, 10 aa, Artificial Sequence
  Description of Artificial Sequence: Synthetic peptide
  Seed: KIFYVYMKRK (SSX2_HUMAN)
KVFYVYMKRK

SEQ ID NO: 163342 - protein, 10 aa, Artificial Sequence
  Description of Artificial Sequence: Synthetic peptide
  Seed: EKIFYVYMKR (SSX2_HUMAN)
EWIFYVYMKR

SEQ ID NO: 163343 - protein, 10 aa, Artificial Sequence
  Description of Artificial Sequence: Synthetic peptide
  Seed: KMKASEKIFY (SSX2_HUMAN)
KVKASEKIFL

SEQ ID NO: 163344 - protein, 9 aa, Artificial Sequence
  Description of Artificial Sequence: Synthetic peptide
  Seed: QIPEKIQKA (SSX2_HUMAN)
QGPEKIQKL

SEQ ID NO: 163345 - protein, 8 aa, Artificial Sequence
  Description of Artificial Sequence: Synthetic peptide
  Seed: FDDIAKYF (SSX2_HUMAN)
FVDIAKYF

SEQ ID NO: 163346 - protein, 8 aa, Artificial Sequence
  Description of Artificial Sequence: Synthetic peptide
  Seed: AFDDIAKY (SSX2_HUMAN)
ASDDIAKV

SEQ ID NO: 163347 - protein, 10 aa, Artificial Sequence
  Description of Artificial Sequence: Synthetic peptide
  Seed: KAFDDIAKYF (SSX2_HUMAN)
KPFDDIAKYY

SEQ ID NO: 163348 - protein, 10 aa, Artificial Sequence
  Description of Artificial Sequence: Synthetic peptide
  Seed: VYMKRKYEAM (SSX2_HUMAN)
VYMKRKYEAI

SEQ ID NO: 163349 - protein, 9 aa, Artificial Sequence
  Description of Artificial Sequence: Synthetic peptide
  Seed: KASEKIFYV (SSX2_HUMAN)
KESEKIFYV

SEQ ID NO: 163350 - protein, 9 aa, Artificial Sequence
  Description of Artificial Sequence: Synthetic peptide
  Seed: KIFYVYMKR (SSX2_HUMAN)
KSFYVYMKI

SEQ ID NO: 163351 - protein, 9 aa, Artificial Sequence
  Description of Artificial Sequence: Synthetic peptide
  Seed: RKYEAMTKL (SSX2_HUMAN)
RAYEAMTKL

SEQ ID NO: 163352 - protein, 9 aa, Artificial Sequence
  Description of Artificial Sequence: Synthetic peptide
  Seed: YMKRKYEAM (SSX2_HUMAN)
YAKRKYEAA

SEQ ID NO: 163353 - protein, 9 aa, Artificial Sequence
  Description of Artificial Sequence: Synthetic peptide
  Seed: AEDFQGNDL (SSX2_HUMAN)
AVDFQGNDM

SEQ ID NO: 163354 - protein, 9 aa, Artificial Sequence
  Description of Artificial Sequence: Synthetic peptide
  Seed: KASEKIFYV (SSX2_HUMAN)
KASEKIFYF

SEQ ID NO: 163355 - protein, 11 aa, Artificial Sequence
  Description of Artificial Sequence: Synthetic peptide
  Seed: KATLPPFMCNK (SSX2_HUMAN)
KLTLPPFMCNR

SEQ ID NO: 163356 - protein, 10 aa, Artificial Sequence
  Description of Artificial Sequence: Synthetic peptide
  Seed: YVYMKRKYEA (SSX2_HUMAN)
YQYMKRKYEM

SEQ ID NO: 163357 - protein, 11 aa, Artificial Sequence
  Description of Artificial Sequence: Synthetic peptide
  Seed: KLGFKATLPPF (SSX2_HUMAN)
KMGFKATLPPY

SEQ ID NO: 163358 - protein, 9 aa, Artificial Sequence
  Description of Artificial Sequence: Synthetic peptide
  Seed: KASEKIFYV (SSX2_HUMAN)
KRSEKIFYI

SEQ ID NO: 163359 - protein, 10 aa, Artificial Sequence
  Description of Artificial Sequence: Synthetic peptide
  Seed: MTKLGFKATL (SSX2_HUMAN)
MMKLGFKATL

SEQ ID NO: 163360 - protein, 10 aa, Artificial Sequence
  Description of Artificial Sequence: Synthetic peptide
  Seed: AQIPEKIQKA (SSX2_HUMAN)
AMIPEKIQKF

SEQ ID NO: 163361 - protein, 9 aa, Artificial Sequence
  Description of Artificial Sequence: Synthetic peptide
  Seed: AFDDIAKYF (SSX2_HUMAN)
ASDDIAKYM

SEQ ID NO: 163362 - protein, 10 aa, Artificial Sequence
  Description of Artificial Sequence: Synthetic peptide
  Seed: KAFDDIAKYF (SSX2_HUMAN)
KMFDDIAKYF

SEQ ID NO: 163363 - protein, 9 aa, Artificial Sequence
  Description of Artificial Sequence: Synthetic peptide
  Seed: IPEKIQKAF (SSX2_HUMAN)
IQEKIQKAY

SEQ ID NO: 163364 - protein, 10 aa, Artificial Sequence
  Description of Artificial Sequence: Synthetic peptide
  Seed: KAFDDIAKYF (SSX2_HUMAN)
KIFDDIAKYF

SEQ ID NO: 163365 - protein, 10 aa, Artificial Sequence
  Description of Artificial Sequence: Synthetic peptide
  Seed: KMKASEKIFY (SSX2_HUMAN)
KVKASEKIFV

SEQ ID NO: 163366 - protein, 9 aa, Artificial Sequence
  Description of Artificial Sequence: Synthetic peptide
  Seed: RKYEAMTKL (SSX2_HUMAN)
RLYEAMTKF

SEQ ID NO: 163367 - protein, 10 aa, Artificial Sequence
  Description of Artificial Sequence: Synthetic peptide
  Seed: AQIPEKIQKA (SSX2_HUMAN)
AMIPEKIQKM

SEQ ID NO: 163368 - protein, 9 aa, Artificial Sequence
  Description of Artificial Sequence: Synthetic peptide
  Seed: EVPEASGPQ (SSX2_HUMAN)
EIPEASGPR

SEQ ID NO: 163369 - protein, 9 aa, Artificial Sequence
  Description of Artificial Sequence: Synthetic peptide
  Seed: QIPEKIQKA (SSX2_HUMAN)
QIPEKIQKF

SEQ ID NO: 163370 - protein, 9 aa, Artificial Sequence
  Description of Artificial Sequence: Synthetic peptide
  Seed: RRPTVGAQI (SSX2_HUMAN)
RHPTVGAQL

SEQ ID NO: 163371 - protein, 11 aa, Artificial Sequence
  Description of Artificial Sequence: Synthetic peptide
  Seed: AMTKLGFKATL (SSX2_HUMAN)
AMTKLGFKATV

SEQ ID NO: 163372 - protein, 11 aa, Artificial Sequence
  Description of Artificial Sequence: Synthetic peptide
  Seed: AFDDIAKYFSK (SSX2_HUMAN)
AVDDIAKYFSY

SEQ ID NO: 163373 - protein, 9 aa, Artificial Sequence
  Description of Artificial Sequence: Synthetic peptide
  Seed: RKYEAMTKL (SSX2_HUMAN)
REYEAMTKY

SEQ ID NO: 163374 - protein, 9 aa, Artificial Sequence
  Description of Artificial Sequence: Synthetic peptide
  Seed: MNGDDAFAR (SSX2_HUMAN)
MAGDDAFAM

SEQ ID NO: 163375 - protein, 9 aa, Artificial Sequence
  Description of Artificial Sequence: Synthetic peptide
  Seed: RLQGISPKI (SSX2_HUMAN)
RIQGISPKL

SEQ ID NO: 163376 - protein, 9 aa, Artificial Sequence
  Description of Artificial Sequence: Synthetic peptide
  Seed: DAFARRPTV (SSX2_HUMAN)
DVFARRPTL

SEQ ID NO: 163377 - protein, 9 aa, Artificial Sequence
  Description of Artificial Sequence: Synthetic peptide
  Seed: QIPEKIQKA (SSX2_HUMAN)
QCPEKIQKL

SEQ ID NO: 163378 - protein, 9 aa, Artificial Sequence
  Description of Artificial Sequence: Synthetic peptide
  Seed: GEHAWTHRL (SSX2_HUMAN)
GQHAWTHRL

SEQ ID NO: 163379 - protein, 11 aa, Artificial Sequence
  Description of Artificial Sequence: Synthetic peptide
  Seed: FGRLQGISPKI (SSX2_HUMAN)
FLRLQGISPKL

SEQ ID NO: 163380 - protein, 9 aa, Artificial Sequence
  Description of Artificial Sequence: Synthetic peptide
  Seed: FKATLPPFM (SSX2_HUMAN)
FRATLPPFY

SEQ ID NO: 163381 - protein, 10 aa, Artificial Sequence
  Description of Artificial Sequence: Synthetic peptide
  Seed: KAFDDIAKYF (SSX2_HUMAN)
KGFDDIAKYY

SEQ ID NO: 163382 - protein, 9 aa, Artificial Sequence
  Description of Artificial Sequence: Synthetic peptide
  Seed: YMKRKYEAM (SSX2_HUMAN)
YNKRKYEAF

SEQ ID NO: 163383 - protein, 9 aa, Artificial Sequence
  Description of Artificial Sequence: Synthetic peptide
  Seed: AKYFSKEEW (SSX2_HUMAN)
AEYFSKEEF

SEQ ID NO: 163384 - protein, 10 aa, Artificial Sequence
  Description of Artificial Sequence: Synthetic peptide
  Seed: KIFYVYMKRK (SSX2_HUMAN)
KMFYVYMKRA

SEQ ID NO: 163385 - protein, 9 aa, Artificial Sequence
  Description of Artificial Sequence: Synthetic peptide
  Seed: MPKKPAEEG (SSX2_HUMAN)
MPKKPAEEI

SEQ ID NO: 163386 - protein, 11 aa, Artificial Sequence
  Description of Artificial Sequence: Synthetic peptide
  Seed: KATLPPFMCNK (SSX2_HUMAN)
KVTLPPFMCNR

SEQ ID NO: 163387 - protein, 11 aa, Artificial Sequence
  Description of Artificial Sequence: Synthetic peptide
  Seed: RKYEAMTKLGF (SSX2_HUMAN)
RQYEAMTKLGM

SEQ ID NO: 163388 - protein, 8 aa, Artificial Sequence
  Description of Artificial Sequence: Synthetic peptide
  Seed: YMKRKYEA (SSX2_HUMAN)
YFKRKYEL

SEQ ID NO: 163389 - protein, 9 aa, Artificial Sequence
  Description of Artificial Sequence: Synthetic peptide
  Seed: MTFGRLQGI (SSX2_HUMAN)
MRFGRLQGL

SEQ ID NO: 163390 - protein, 9 aa, Artificial Sequence
  Description of Artificial Sequence: Synthetic peptide
  Seed: YMKRKYEAM (SSX2_HUMAN)
YIKRKYEAF

SEQ ID NO: 163391 - protein, 9 aa, Artificial Sequence
  Description of Artificial Sequence: Synthetic peptide
  Seed: TKLGFKATL (SSX2_HUMAN)
TMLGFKATM

SEQ ID NO: 163392 - protein, 9 aa, Artificial Sequence
  Description of Artificial Sequence: Synthetic peptide
  Seed: YMKRKYEAM (SSX2_HUMAN)
YTKRKYEAL

SEQ ID NO: 163393 - protein, 9 aa, Artificial Sequence
  Description of Artificial Sequence: Synthetic peptide
  Seed: AQIPEKIQK (SSX2_HUMAN)
ALIPEKIQK

SEQ ID NO: 163394 - protein, 9 aa, Artificial Sequence
  Description of Artificial Sequence: Synthetic peptide
  Seed: KAFDDIAKY (SSX2_HUMAN)
KRFDDIAKF

SEQ ID NO: 163395 - protein, 9 aa, Artificial Sequence
  Description of Artificial Sequence: Synthetic peptide
  Seed: QIPEKIQKA (SSX2_HUMAN)
QVPEKIQKY

SEQ ID NO: 163396 - protein, 9 aa, Artificial Sequence
  Description of Artificial Sequence: Synthetic peptide
  Seed: RRPTVGAQI (SSX2_HUMAN)
RRPTVGAQM

SEQ ID NO: 163397 - protein, 9 aa, Artificial Sequence
  Description of Artificial Sequence: Synthetic peptide
  Seed: TKLGFKATL (SSX2_HUMAN)
THLGFKATM

SEQ ID NO: 163398 - protein, 10 aa, Artificial Sequence
  Description of Artificial Sequence: Synthetic peptide
  Seed: ATLPPFMCNK (SSX2_HUMAN)
AMLPPFMCNR

SEQ ID NO: 163399 - protein, 9 aa, Artificial Sequence
  Description of Artificial Sequence: Synthetic peptide
  Seed: GISPKIMPK (SSX2_HUMAN)
GNSPKIMPR

SEQ ID NO: 163400 - protein, 9 aa, Artificial Sequence
  Description of Artificial Sequence: Synthetic peptide
  Seed: GEHAWTHRL (SSX2_HUMAN)
GEHAWTHRT

SEQ ID NO: 163401 - protein, 10 aa, Artificial Sequence
  Description of Artificial Sequence: Synthetic peptide
  Seed: RLRERKQLVI (SSX2_HUMAN)
RSRERKQLVK

SEQ ID NO: 163402 - protein, 9 aa, Artificial Sequence
  Description of Artificial Sequence: Synthetic peptide
  Seed: RLQGISPKI (SSX2_HUMAN)
REQGISPKL

SEQ ID NO: 163403 - protein, 9 aa, Artificial Sequence
  Description of Artificial Sequence: Synthetic peptide
  Seed: RKYEAMTKL (SSX2_HUMAN)
RYYEAMTKY

SEQ ID NO: 163404 - protein, 9 aa, Artificial Sequence
  Description of Artificial Sequence: Synthetic peptide
  Seed: KIFYVYMKR (SSX2_HUMAN)
KVFYVYMKR

SEQ ID NO: 163405 - protein, 9 aa, Artificial Sequence
  Description of Artificial Sequence: Synthetic peptide
  Seed: ASEKIFYVY (SSX2_HUMAN)
AFEKIFYVY

SEQ ID NO: 163406 - protein, 9 aa, Artificial Sequence
  Description of Artificial Sequence: Synthetic peptide
  Seed: KIHERSGPK (SSX2_HUMAN)
KGHERSGPK

SEQ ID NO: 163407 - protein, 9 aa, Artificial Sequence
  Description of Artificial Sequence: Synthetic peptide
  Seed: KAFDDIAKY (SSX2_HUMAN)
KIFDDIAKW

SEQ ID NO: 163408 - protein, 9 aa, Artificial Sequence
  Description of Artificial Sequence: Synthetic peptide
  Seed: TTSEKIHER (SSX2_HUMAN)
TYSEKIHEM

SEQ ID NO: 163409 - protein, 9 aa, Artificial Sequence
  Description of Artificial Sequence: Synthetic peptide
  Seed: AFDDIAKYF (SSX2_HUMAN)
ARDDIAKYY

SEQ ID NO: 163410 - protein, 10 aa, Artificial Sequence
  Description of Artificial Sequence: Synthetic peptide
  Seed: SGPQNDGKEL (SSX2_HUMAN)
STPQNDGKEL

SEQ ID NO: 163411 - protein, 9 aa, Artificial Sequence
  Description of Artificial Sequence: Synthetic peptide
  Seed: DAFARRPTV (SSX2_HUMAN)
DAFARRPTR

SEQ ID NO: 163412 - protein, 10 aa, Artificial Sequence
  Description of Artificial Sequence: Synthetic peptide
  Seed: YEAMTKLGFK (SSX2_HUMAN)
YMAMTKLGFK

SEQ ID NO: 163413 - protein, 9 aa, Artificial Sequence
  Description of Artificial Sequence: Synthetic peptide
  Seed: AFDDIAKYF (SSX2_HUMAN)
AWDDIAKYL

SEQ ID NO: 163414 - protein, 9 aa, Artificial Sequence
  Description of Artificial Sequence: Synthetic peptide
  Seed: VGAQIPEKI (SSX2_HUMAN)
VTAQIPEKM

SEQ ID NO: 163415 - protein, 9 aa, Artificial Sequence
  Description of Artificial Sequence: Synthetic peptide
  Seed: KASEKIFYV (SSX2_HUMAN)
KGSEKIFYW

SEQ ID NO: 163416 - protein, 10 aa, Artificial Sequence
  Description of Artificial Sequence: Synthetic peptide
  Seed: YMKRKYEAMT (SSX2_HUMAN)
YMKRKYEAMG

SEQ ID NO: 163417 - protein, 9 aa, Artificial Sequence
  Description of Artificial Sequence: Synthetic peptide
  Seed: KASEKIFYV (SSX2_HUMAN)
KISEKIFYV

SEQ ID NO: 163418 - protein, 9 aa, Artificial Sequence
  Description of Artificial Sequence: Synthetic peptide
  Seed: MTFGRLQGI (SSX2_HUMAN)
MIFGRLQGR

SEQ ID NO: 163419 - protein, 11 aa, Artificial Sequence
  Description of Artificial Sequence: Synthetic peptide
  Seed: AQIPEKIQKAF (SSX2_HUMAN)
AMIPEKIQKAF

SEQ ID NO: 163420 - protein, 10 aa, Artificial Sequence
  Description of Artificial Sequence: Synthetic peptide
  Seed: MKASEKIFYV (SSX2_HUMAN)
MLASEKIFYG

SEQ ID NO: 163421 - protein, 9 aa, Artificial Sequence
  Description of Artificial Sequence: Synthetic peptide
  Seed: FKATLPPFM (SSX2_HUMAN)
FAATLPPFF

SEQ ID NO: 163422 - protein, 10 aa, Artificial Sequence
  Description of Artificial Sequence: Synthetic peptide
  Seed: SGPQNDGKEL (SSX2_HUMAN)
SIPQNDGKEM

SEQ ID NO: 163423 - protein, 10 aa, Artificial Sequence
  Description of Artificial Sequence: Synthetic peptide
  Seed: YVYMKRKYEA (SSX2_HUMAN)
YMYMKRKYEM

SEQ ID NO: 163424 - protein, 9 aa, Artificial Sequence
  Description of Artificial Sequence: Synthetic peptide
  Seed: KQLVIYEEI (SSX2_HUMAN)
KELVIYEEF

SEQ ID NO: 163425 - protein, 9 aa, Artificial Sequence
  Description of Artificial Sequence: Synthetic peptide
  Seed: KASEKIFYV (SSX2_HUMAN)
KVSEKIFYW

SEQ ID NO: 163426 - protein, 10 aa, Artificial Sequence
  Description of Artificial Sequence: Synthetic peptide
  Seed: KIFYVYMKRK (SSX2_HUMAN)
KFFYVYMKRR

SEQ ID NO: 163427 - protein, 9 aa, Artificial Sequence
  Description of Artificial Sequence: Synthetic peptide
  Seed: GFKATLPPF (SSX2_HUMAN)
GQKATLPPY

SEQ ID NO: 163428 - protein, 9 aa, Artificial Sequence
  Description of Artificial Sequence: Synthetic peptide
  Seed: KRKYEAMTK (SSX2_HUMAN)
KSKYEAMTK

SEQ ID NO: 163429 - protein, 9 aa, Artificial Sequence
  Description of Artificial Sequence: Synthetic peptide
  Seed: KASEKIFYV (SSX2_HUMAN)
KISEKIFYR

SEQ ID NO: 163430 - protein, 9 aa, Artificial Sequence
  Description of Artificial Sequence: Synthetic peptide
  Seed: TTSEKIHER (SSX2_HUMAN)
TVSEKIHEF

SEQ ID NO: 163431 - protein, 10 aa, Artificial Sequence
  Description of Artificial Sequence: Synthetic peptide
  Seed: MNGDDAFARR (SSX2_HUMAN)
MVGDDAFARK

SEQ ID NO: 163432 - protein, 10 aa, Artificial Sequence
  Description of Artificial Sequence: Synthetic peptide
  Seed: YMKRKYEAMT (SSX2_HUMAN)
YVKRKYEAML

SEQ ID NO: 163433 - protein, 11 aa, Artificial Sequence
  Description of Artificial Sequence: Synthetic peptide
  Seed: KMKASEKIFYV (SSX2_HUMAN)
KSKASEKIFYA

SEQ ID NO: 163434 - protein, 10 aa, Artificial Sequence
  Description of Artificial Sequence: Synthetic peptide
  Seed: MTKLGFKATL (SSX2_HUMAN)
MQKLGFKATM

SEQ ID NO: 163435 - protein, 9 aa, Artificial Sequence
  Description of Artificial Sequence: Synthetic peptide
  Seed: FYVYMKRKY (SSX2_HUMAN)
FYVYMKRKM

SEQ ID NO: 163436 - protein, 10 aa, Artificial Sequence
  Description of Artificial Sequence: Synthetic peptide
  Seed: ARRPTVGAQI (SSX2_HUMAN)
ARRPTVGAQF

SEQ ID NO: 163437 - protein, 9 aa, Artificial Sequence
  Description of Artificial Sequence: Synthetic peptide
  Seed: MTFGRLQGI (SSX2_HUMAN)
MRFGRLQGF

SEQ ID NO: 163438 - protein, 9 aa, Artificial Sequence
  Description of Artificial Sequence: Synthetic peptide
  Seed: FYVYMKRKY (SSX2_HUMAN)
FFVYMKRKF

SEQ ID NO: 163439 - protein, 8 aa, Artificial Sequence
  Description of Artificial Sequence: Synthetic peptide
  Seed: FKATLPPF (SSX2_HUMAN)
FQATLPPY

SEQ ID NO: 163440 - protein, 10 aa, Artificial Sequence
  Description of Artificial Sequence: Synthetic peptide
  Seed: MNGDDAFARR (SSX2_HUMAN)
MMGDDAFARR

SEQ ID NO: 163441 - protein, 9 aa, Artificial Sequence
  Description of Artificial Sequence: Synthetic peptide
  Seed: RLQGISPKI (SSX2_HUMAN)
RVQGISPKV

SEQ ID NO: 163442 - protein, 9 aa, Artificial Sequence
  Description of Artificial Sequence: Synthetic peptide
  Seed: YMKRKYEAM (SSX2_HUMAN)
YNKRKYEAV

SEQ ID NO: 163443 - protein, 9 aa, Artificial Sequence
  Description of Artificial Sequence: Synthetic peptide
  Seed: RGEHAWTHR (SSX2_HUMAN)
RMEHAWTHR

SEQ ID NO: 163444 - protein, 10 aa, Artificial Sequence
  Description of Artificial Sequence: Synthetic peptide
  Seed: KYFSKEEWEK (SSX2_HUMAN)
KAFSKEEWER

SEQ ID NO: 163445 - protein, 9 aa, Artificial Sequence
  Description of Artificial Sequence: Synthetic peptide
  Seed: RLRERKQLV (SSX2_HUMAN)
RSRERKQLM

SEQ ID NO: 163446 - protein, 9 aa, Artificial Sequence
  Description of Artificial Sequence: Synthetic peptide
  Seed: KASEKIFYV (SSX2_HUMAN)
KESEKIFYI

SEQ ID NO: 163447 - protein, 10 aa, Artificial Sequence
  Description of Artificial Sequence: Synthetic peptide
  Seed: LGFKATLPPF (SSX2_HUMAN)
LQFKATLPPI

SEQ ID NO: 163448 - protein, 9 aa, Artificial Sequence
  Description of Artificial Sequence: Synthetic peptide
  Seed: KQLVIYEEI (SSX2_HUMAN)
KELVIYEEP

SEQ ID NO: 163449 - protein, 9 aa, Artificial Sequence
  Description of Artificial Sequence: Synthetic peptide
  Seed: KIFYVYMKR (SSX2_HUMAN)
KQFYVYMKK

SEQ ID NO: 163450 - protein, 9 aa, Artificial Sequence
  Description of Artificial Sequence: Synthetic peptide
  Seed: MTFGRLQGI (SSX2_HUMAN)
MSFGRLQGL

SEQ ID NO: 163451 - protein, 10 aa, Artificial Sequence
  Description of Artificial Sequence: Synthetic peptide
  Seed: YVYMKRKYEA (SSX2_HUMAN)
YQYMKRKYEL

SEQ ID NO: 163452 - protein, 10 aa, Artificial Sequence
  Description of Artificial Sequence: Synthetic peptide
  Seed: MTKLGFKATL (SSX2_HUMAN)
MWKLGFKATY

SEQ ID NO: 163453 - protein, 10 aa, Artificial Sequence
  Description of Artificial Sequence: Synthetic peptide
  Seed: QMTFGRLQGI (SSX2_HUMAN)
QSTFGRLQGV

SEQ ID NO: 163454 - protein, 9 aa, Artificial Sequence
  Description of Artificial Sequence: Synthetic peptide
  Seed: AFDDIAKYF (SSX2_HUMAN)
AFDDIAKYV

SEQ ID NO: 163455 - protein, 9 aa, Artificial Sequence
  Description of Artificial Sequence: Synthetic peptide
  Seed: KAFDDIAKY (SSX2_HUMAN)
KAFDDIAKI

SEQ ID NO: 163456 - protein, 10 aa, Artificial Sequence
  Description of Artificial Sequence: Synthetic peptide
  Seed: RLQGISPKIM (SSX2_HUMAN)
RLQGISPKIY

SEQ ID NO: 163457 - protein, 10 aa, Artificial Sequence
  Description of Artificial Sequence: Synthetic peptide
  Seed: AQIPEKIQKA (SSX2_HUMAN)
AIIPEKIQKV

SEQ ID NO: 163458 - protein, 9 aa, Artificial Sequence
  Description of Artificial Sequence: Synthetic peptide
  Seed: RLQGISPKI (SSX2_HUMAN)
RFQGISPKK

SEQ ID NO: 163459 - protein, 9 aa, Artificial Sequence
  Description of Artificial Sequence: Synthetic peptide
  Seed: KASEKIFYV (SSX2_HUMAN)
KQSEKIFYF

SEQ ID NO: 163460 - protein, 10 aa, Artificial Sequence
  Description of Artificial Sequence: Synthetic peptide
  Seed: MKASEKIFYV (SSX2_HUMAN)
MQASEKIFYT

SEQ ID NO: 163461 - protein, 9 aa, Artificial Sequence
  Description of Artificial Sequence: Synthetic peptide
  Seed: RERKQLVIY (SSX2_HUMAN)
RTRKQLVIY

SEQ ID NO: 163462 - protein, 9 aa, Artificial Sequence
  Description of Artificial Sequence: Synthetic peptide
  Seed: VGAQIPEKI (SSX2_HUMAN)
VMAQIPEKM

SEQ ID NO: 163463 - protein, 9 aa, Artificial Sequence
  Description of Artificial Sequence: Synthetic peptide
  Seed: YMKRKYEAM (SSX2_HUMAN)
YQKRKYEAY

SEQ ID NO: 163464 - protein, 9 aa, Artificial Sequence
  Description of Artificial Sequence: Synthetic peptide
  Seed: AMTKLGFKA (SSX2_HUMAN)
ALTKLGFKA

SEQ ID NO: 163465 - protein, 9 aa, Artificial Sequence
  Description of Artificial Sequence: Synthetic peptide
  Seed: KAFDDIAKY (SSX2_HUMAN)
KFFDDIAKM

SEQ ID NO: 163466 - protein, 10 aa, Artificial Sequence
  Description of Artificial Sequence: Synthetic peptide
  Seed: KYFSKEEWEK (SSX2_HUMAN)
KIFSKEEWER

SEQ ID NO: 163467 - protein, 10 aa, Artificial Sequence
  Description of Artificial Sequence: Synthetic peptide
  Seed: YMKRKYEAMT (SSX2_HUMAN)
YMKRKYEAMN

SEQ ID NO: 163468 - protein, 10 aa, Artificial Sequence
  Description of Artificial Sequence: Synthetic peptide
  Seed: SGPQNDGKEL (SSX2_HUMAN)
SMPQNDGKEL

SEQ ID NO: 163469 - protein, 9 aa, Artificial Sequence
  Description of Artificial Sequence: Synthetic peptide
  Seed: AQIPEKIQK (SSX2_HUMAN)
AYIPEKIQF

SEQ ID NO: 163470 - protein, 9 aa, Artificial Sequence
  Description of Artificial Sequence: Synthetic peptide
  Seed: YMKRKYEAM (SSX2_HUMAN)
YTKRKYEAY

SEQ ID NO: 163471 - protein, 9 aa, Artificial Sequence
  Description of Artificial Sequence: Synthetic peptide
  Seed: YMKRKYEAM (SSX2_HUMAN)
YVKRKYEAM

SEQ ID NO: 163472 - protein, 9 aa, Artificial Sequence
  Description of Artificial Sequence: Synthetic peptide
  Seed: KQLVIYEEI (SSX2_HUMAN)
KSLVIYEEL

SEQ ID NO: 163473 - protein, 9 aa, Artificial Sequence
  Description of Artificial Sequence: Synthetic peptide
  Seed: GFKATLPPF (SSX2_HUMAN)
GQKATLPPF

SEQ ID NO: 163474 - protein, 9 aa, Artificial Sequence
  Description of Artificial Sequence: Synthetic peptide
  Seed: RKYEAMTKL (SSX2_HUMAN)
REYEAMTKM

SEQ ID NO: 163475 - protein, 10 aa, Artificial Sequence
  Description of Artificial Sequence: Synthetic peptide
  Seed: KASEKIFYVY (SSX2_HUMAN)
KDSEKIFYVW

SEQ ID NO: 163476 - protein, 9 aa, Artificial Sequence
  Description of Artificial Sequence: Synthetic peptide
  Seed: WTHRLRERK (SSX2_HUMAN)
WTHRLRERR

SEQ ID NO: 163477 - protein, 11 aa, Artificial Sequence
  Description of Artificial Sequence: Synthetic peptide
  Seed: YMKRKYEAMTK (SSX2_HUMAN)
YLKRKYEAMTL

SEQ ID NO: 163478 - protein, 9 aa, Artificial Sequence
  Description of Artificial Sequence: Synthetic peptide
  Seed: GEHAWTHRL (SSX2_HUMAN)
GHHAWTHRI

SEQ ID NO: 163479 - protein, 9 aa, Artificial Sequence
  Description of Artificial Sequence: Synthetic peptide
  Seed: MTFGRLQGI (SSX2_HUMAN)
MIFGRLQGA

SEQ ID NO: 163480 - protein, 9 aa, Artificial Sequence
  Description of Artificial Sequence: Synthetic peptide
  Seed: NGDDAFARR (SSX2_HUMAN)
NTDDAFARK

SEQ ID NO: 163481 - protein, 9 aa, Artificial Sequence
  Description of Artificial Sequence: Synthetic peptide
  Seed: KAFDDIAKY (SSX2_HUMAN)
KSFDDIAKV

SEQ ID NO: 163482 - protein, 9 aa, Artificial Sequence
  Description of Artificial Sequence: Synthetic peptide
  Seed: KASEKIFYV (SSX2_HUMAN)
KWSEKIFYY

SEQ ID NO: 163483 - protein, 9 aa, Artificial Sequence
  Description of Artificial Sequence: Synthetic peptide
  Seed: FARRPTVGA (SSX2_HUMAN)
FVRRPTVGL

SEQ ID NO: 163484 - protein, 9 aa, Artificial Sequence
  Description of Artificial Sequence: Synthetic peptide
  Seed: KAFDDIAKY (SSX2_HUMAN)
KPFDDIAKF

SEQ ID NO: 163485 - protein, 9 aa, Artificial Sequence
  Description of Artificial Sequence: Synthetic peptide
  Seed: QIPEKIQKA (SSX2_HUMAN)
QMPEKIQKF

SEQ ID NO: 163486 - protein, 10 aa, Artificial Sequence
  Description of Artificial Sequence: Synthetic peptide
  Seed: MTKLGFKATL (SSX2_HUMAN)
MEKLGFKATY

SEQ ID NO: 163487 - protein, 10 aa, Artificial Sequence
  Description of Artificial Sequence: Synthetic peptide
  Seed: VYMKRKYEAM (SSX2_HUMAN)
VLMKRKYEAM

SEQ ID NO: 163488 - protein, 10 aa, Artificial Sequence
  Description of Artificial Sequence: Synthetic peptide
  Seed: KAFDDIAKYF (SSX2_HUMAN)
KEFDDIAKYF

SEQ ID NO: 163489 - protein, 9 aa, Artificial Sequence
  Description of Artificial Sequence: Synthetic peptide
  Seed: KQLVIYEEI (SSX2_HUMAN)
KVLVIYEEI

SEQ ID NO: 163490 - protein, 9 aa, Artificial Sequence
  Description of Artificial Sequence: Synthetic peptide
  Seed: NGDDAFARR (SSX2_HUMAN)
NADDAFARR

SEQ ID NO: 163491 - protein, 10 aa, Artificial Sequence
  Description of Artificial Sequence: Synthetic peptide
  Seed: GRLQGISPKI (SSX2_HUMAN)
GRLQGISPKM

SEQ ID NO: 163492 - protein, 10 aa, Artificial Sequence
  Description of Artificial Sequence: Synthetic peptide
  Seed: KMKASEKIFY (SSX2_HUMAN)
KLKASEKIFK

SEQ ID NO: 163493 - protein, 10 aa, Artificial Sequence
  Description of Artificial Sequence: Synthetic peptide
  Seed: EKIFYVYMKR (SSX2_HUMAN)
ELIFYVYMKR

SEQ ID NO: 163494 - protein, 9 aa, Artificial Sequence
  Description of Artificial Sequence: Synthetic peptide
  Seed: AFDDIAKYF (SSX2_HUMAN)
AGDDIAKYF

SEQ ID NO: 163495 - protein, 9 aa, Artificial Sequence
  Description of Artificial Sequence: Synthetic peptide
  Seed: YMKRKYEAM (SSX2_HUMAN)
YPKRKYEAI

SEQ ID NO: 163496 - protein, 9 aa, Artificial Sequence
  Description of Artificial Sequence: Synthetic peptide
  Seed: LQGISPKIM (SSX2_HUMAN)
LMGISPKIY

SEQ ID NO: 163497 - protein, 10 aa, Artificial Sequence
  Description of Artificial Sequence: Synthetic peptide
  Seed: RLQGISPKIM (SSX2_HUMAN)
RMQGISPKIY

SEQ ID NO: 163498 - protein, 10 aa, Artificial Sequence
  Description of Artificial Sequence: Synthetic peptide
  Seed: KAFDDIAKYF (SSX2_HUMAN)
KLFDDIAKYV

SEQ ID NO: 163499 - protein, 9 aa, Artificial Sequence
  Description of Artificial Sequence: Synthetic peptide
  Seed: NDSEEVPEA (SSX2_HUMAN)
NESEEVPEC

SEQ ID NO: 163500 - protein, 9 aa, Artificial Sequence
  Description of Artificial Sequence: Synthetic peptide
  Seed: TTSEKIHER (SSX2_HUMAN)
TASEKIHEF

SEQ ID NO: 163501 - protein, 9 aa, Artificial Sequence
  Description of Artificial Sequence: Synthetic peptide
  Seed: RLQGISPKI (SSX2_HUMAN)
RLQGISPKA

SEQ ID NO: 163502 - protein, 10 aa, Artificial Sequence
  Description of Artificial Sequence: Synthetic peptide
  Seed: AQIPEKIQKA (SSX2_HUMAN)
AKIPEKIQKF

SEQ ID NO: 163503 - protein, 9 aa, Artificial Sequence
  Description of Artificial Sequence: Synthetic peptide
  Seed: FSKEEWEKM (SSX2_HUMAN)
FSKEEWEKY

SEQ ID NO: 163504 - protein, 9 aa, Artificial Sequence
  Description of Artificial Sequence: Synthetic peptide
  Seed: KATLPPFMC (SSX2_HUMAN)
KVTLPPFMW

SEQ ID NO: 163505 - protein, 9 aa, Artificial Sequence
  Description of Artificial Sequence: Synthetic peptide
  Seed: DDIAKYFSK (SSX2_HUMAN)
DQIAKYFSR

SEQ ID NO: 163506 - protein, 9 aa, Artificial Sequence
  Description of Artificial Sequence: Synthetic peptide
  Seed: TVGAQIPEK (SSX2_HUMAN)
TAGAQIPEF

SEQ ID NO: 163507 - protein, 9 aa, Artificial Sequence
  Description of Artificial Sequence: Synthetic peptide
  Seed: KASEKIFYV (SSX2_HUMAN)
KSSEKIFYV

SEQ ID NO: 163508 - protein, 10 aa, Artificial Sequence
  Description of Artificial Sequence: Synthetic peptide
  Seed: ARRPTVGAQI (SSX2_HUMAN)
ARRPTVGAQM

SEQ ID NO: 163509 - protein, 10 aa, Artificial Sequence
  Description of Artificial Sequence: Synthetic peptide
  Seed: KASEKIFYVY (SSX2_HUMAN)
KSSEKIFYVI

SEQ ID NO: 163510 - protein, 11 aa, Artificial Sequence
  Description of Artificial Sequence: Synthetic peptide
  Seed: FGRLQGISPKI (SSX2_HUMAN)
FPRLQGISPKV

SEQ ID NO: 163511 - protein, 9 aa, Artificial Sequence
  Description of Artificial Sequence: Synthetic peptide
  Seed: TKLGFKATL (SSX2_HUMAN)
TQLGFKATF

SEQ ID NO: 163512 - protein, 8 aa, Artificial Sequence
  Description of Artificial Sequence: Synthetic peptide
  Seed: YMKRKYEA (SSX2_HUMAN)
YLKRKYEM

SEQ ID NO: 163513 - protein, 9 aa, Artificial Sequence
  Description of Artificial Sequence: Synthetic peptide
  Seed: RKYEAMTKL (SSX2_HUMAN)
RGYEAMTKY

SEQ ID NO: 163514 - protein, 9 aa, Artificial Sequence
  Description of Artificial Sequence: Synthetic peptide
  Seed: TKLGFKATL (SSX2_HUMAN)
TMLGFKATF

SEQ ID NO: 163515 - protein, 9 aa, Artificial Sequence
  Description of Artificial Sequence: Synthetic peptide
  Seed: AQIPEKIQK (SSX2_HUMAN)
ASIPEKIQY

SEQ ID NO: 163516 - protein, 11 aa, Artificial Sequence
  Description of Artificial Sequence: Synthetic peptide
  Seed: ATLPPFMCNKR (SSX2_HUMAN)
AVLPPFMCNKR

SEQ ID NO: 163517 - protein, 9 aa, Artificial Sequence
  Description of Artificial Sequence: Synthetic peptide
  Seed: QVERPQMTF (SSX2_HUMAN)
QQERPQMTY

SEQ ID NO: 163518 - protein, 9 aa, Artificial Sequence
  Description of Artificial Sequence: Synthetic peptide
  Seed: AFDDIAKYF (SSX2_HUMAN)
AMDDIAKYW

SEQ ID NO: 163519 - protein, 9 aa, Artificial Sequence
  Description of Artificial Sequence: Synthetic peptide
  Seed: KMKASEKIF (SSX2_HUMAN)
KQKASEKIY

SEQ ID NO: 163520 - protein, 9 aa, Artificial Sequence
  Description of Artificial Sequence: Synthetic peptide
  Seed: GFKATLPPF (SSX2_HUMAN)
GSKATLPPY

SEQ ID NO: 163521 - protein, 9 aa, Artificial Sequence
  Description of Artificial Sequence: Synthetic peptide
  Seed: FSKEEWEKM (SSX2_HUMAN)
FMKEEWEKF

SEQ ID NO: 163522 - protein, 9 aa, Artificial Sequence
  Description of Artificial Sequence: Synthetic peptide
  Seed: KQLVIYEEI (SSX2_HUMAN)
KELVIYEEI

SEQ ID NO: 163523 - protein, 9 aa, Artificial Sequence
  Description of Artificial Sequence: Synthetic peptide
  Seed: KQLVIYEEI (SSX2_HUMAN)
KRLVIYEEF

SEQ ID NO: 163524 - protein, 10 aa, Artificial Sequence
  Description of Artificial Sequence: Synthetic peptide
  Seed: KASEKIFYVY (SSX2_HUMAN)
KLSEKIFYVW

SEQ ID NO: 163525 - protein, 9 aa, Artificial Sequence
  Description of Artificial Sequence: Synthetic peptide
  Seed: KQLVIYEEI (SSX2_HUMAN)
KTLVIYEEW

SEQ ID NO: 163526 - protein, 9 aa, Artificial Sequence
  Description of Artificial Sequence: Synthetic peptide
  Seed: RERKQLVIY (SSX2_HUMAN)
RQRKQLVIY

SEQ ID NO: 163527 - protein, 9 aa, Artificial Sequence
  Description of Artificial Sequence: Synthetic peptide
  Seed: EEWEKMKAS (SSX2_HUMAN)
EEWEKMKAM

SEQ ID NO: 163528 - protein, 9 aa, Artificial Sequence
  Description of Artificial Sequence: Synthetic peptide
  Seed: RLRERKQLV (SSX2_HUMAN)
RWRERKQLK

SEQ ID NO: 163529 - protein, 9 aa, Artificial Sequence
  Description of Artificial Sequence: Synthetic peptide
  Seed: YMKRKYEAM (SSX2_HUMAN)
YVKRKYEAA

SEQ ID NO: 163530 - protein, 9 aa, Artificial Sequence
  Description of Artificial Sequence: Synthetic peptide
  Seed: YMKRKYEAM (SSX2_HUMAN)
YVKRKYEAY

SEQ ID NO: 163531 - protein, 9 aa, Artificial Sequence
  Description of Artificial Sequence: Synthetic peptide
  Seed: AFDDIAKYF (SSX2_HUMAN)
ARDDIAKYL

SEQ ID NO: 163532 - protein, 9 aa, Artificial Sequence
  Description of Artificial Sequence: Synthetic peptide
  Seed: KASEKIFYV (SSX2_HUMAN)
KSSEKIFYW

SEQ ID NO: 163533 - protein, 10 aa, Artificial Sequence
  Description of Artificial Sequence: Synthetic peptide
  Seed: MTKLGFKATL (SSX2_HUMAN)
MHKLGFKATY

SEQ ID NO: 163534 - protein, 9 aa, Artificial Sequence
  Description of Artificial Sequence: Synthetic peptide
  Seed: KAFDDIAKY (SSX2_HUMAN)
KAFDDIAKW

SEQ ID NO: 163535 - protein, 9 aa, Artificial Sequence
  Description of Artificial Sequence: Synthetic peptide
  Seed: VGAQIPEKI (SSX2_HUMAN)
VQAQIPEKI

SEQ ID NO: 163536 - protein, 9 aa, Artificial Sequence
  Description of Artificial Sequence: Synthetic peptide
  Seed: KASEKIFYV (SSX2_HUMAN)
KASEKIFYM

SEQ ID NO: 163537 - protein, 9 aa, Artificial Sequence
  Description of Artificial Sequence: Synthetic peptide
  Seed: KASEKIFYV (SSX2_HUMAN)
KLSEKIFYV

SEQ ID NO: 163538 - protein, 9 aa, Artificial Sequence
  Description of Artificial Sequence: Synthetic peptide
  Seed: YMKRKYEAM (SSX2_HUMAN)
YLKRKYEAT

SEQ ID NO: 163539 - protein, 11 aa, Artificial Sequence
  Description of Artificial Sequence: Synthetic peptide
  Seed: AFDDIAKYFSK (SSX2_HUMAN)
ATDDIAKYFSY

SEQ ID NO: 163540 - protein, 10 aa, Artificial Sequence
  Description of Artificial Sequence: Synthetic peptide
  Seed: KIFYVYMKRK (SSX2_HUMAN)
KMFYVYMKRC

SEQ ID NO: 163541 - protein, 9 aa, Artificial Sequence
  Description of Artificial Sequence: Synthetic peptide
  Seed: YMKRKYEAM (SSX2_HUMAN)
YVKRKYEAC

SEQ ID NO: 163542 - protein, 9 aa, Artificial Sequence
  Description of Artificial Sequence: Synthetic peptide
  Seed: QIPEKIQKA (SSX2_HUMAN)
QTPEKIQKR

SEQ ID NO: 163543 - protein, 9 aa, Artificial Sequence
  Description of Artificial Sequence: Synthetic peptide
  Seed: GISPKIMPK (SSX2_HUMAN)
GVSPKIMPL

SEQ ID NO: 163544 - protein, 9 aa, Artificial Sequence
  Description of Artificial Sequence: Synthetic peptide
  Seed: YMKRKYEAM (SSX2_HUMAN)
YAKRKYEAM

SEQ ID NO: 163545 - protein, 10 aa, Artificial Sequence
  Description of Artificial Sequence: Synthetic peptide
  Seed: YMKRKYEAMT (SSX2_HUMAN)
YLKRKYEAMF

SEQ ID NO: 163546 - protein, 9 aa, Artificial Sequence
  Description of Artificial Sequence: Synthetic peptide
  Seed: ASEKIFYVY (SSX2_HUMAN)
AVEKIFYVY

SEQ ID NO: 163547 - protein, 9 aa, Artificial Sequence
  Description of Artificial Sequence: Synthetic peptide
  Seed: NDSEEVPEA (SSX2_HUMAN)
NESEEVPEV

SEQ ID NO: 163548 - protein, 10 aa, Artificial Sequence
  Description of Artificial Sequence: Synthetic peptide
  Seed: GRLQGISPKI (SSX2_HUMAN)
GMLQGISPKI

SEQ ID NO: 163549 - protein, 10 aa, Artificial Sequence
  Description of Artificial Sequence: Synthetic peptide
  Seed: YVYMKRKYEA (SSX2_HUMAN)
YVYMKRKYEM

SEQ ID NO: 163550 - protein, 10 aa, Artificial Sequence
  Description of Artificial Sequence: Synthetic peptide
  Seed: EKIFYVYMKR (SSX2_HUMAN)
ERIFYVYMKR

SEQ ID NO: 163551 - protein, 11 aa, Artificial Sequence
  Description of Artificial Sequence: Synthetic peptide
  Seed: KMKASEKIFYV (SSX2_HUMAN)
KLKASEKIFYA

SEQ ID NO: 163552 - protein, 9 aa, Artificial Sequence
  Description of Artificial Sequence: Synthetic peptide
  Seed: GISPKIMPK (SSX2_HUMAN)
GASPKIMPI

SEQ ID NO: 163553 - protein, 10 aa, Artificial Sequence
  Description of Artificial Sequence: Synthetic peptide
  Seed: KIFYVYMKRK (SSX2_HUMAN)
KMFYVYMKRN

SEQ ID NO: 163554 - protein, 10 aa, Artificial Sequence
  Description of Artificial Sequence: Synthetic peptide
  Seed: RLRERKQLVI (SSX2_HUMAN)
RTRERKQLVY

SEQ ID NO: 163555 - protein, 9 aa, Artificial Sequence
  Description of Artificial Sequence: Synthetic peptide
  Seed: AFDDIAKYF (SSX2_HUMAN)
APDDIAKYL

SEQ ID NO: 163556 - protein, 9 aa, Artificial Sequence
  Description of Artificial Sequence: Synthetic peptide
  Seed: KQLVIYEEI (SSX2_HUMAN)
KMLVIYEEI

SEQ ID NO: 163557 - protein, 9 aa, Artificial Sequence
  Description of Artificial Sequence: Synthetic peptide
  Seed: YMKRKYEAM (SSX2_HUMAN)
YMKRKYEAG

SEQ ID NO: 163558 - protein, 9 aa, Artificial Sequence
  Description of Artificial Sequence: Synthetic peptide
  Seed: RERKQLVIY (SSX2_HUMAN)
RMRKQLVIF

SEQ ID NO: 163559 - protein, 10 aa, Artificial Sequence
  Description of Artificial Sequence: Synthetic peptide
  Seed: MKRKYEAMTK (SSX2_HUMAN)
MSRKYEAMTK

SEQ ID NO: 163560 - protein, 10 aa, Artificial Sequence
  Description of Artificial Sequence: Synthetic peptide
  Seed: KRGEHAWTHR (SSX2_HUMAN)
KMGEHAWTHK

SEQ ID NO: 163561 - protein, 9 aa, Artificial Sequence
  Description of Artificial Sequence: Synthetic peptide
  Seed: SPKIMPKKP (SSX2_HUMAN)
SPKIMPKKM

SEQ ID NO: 163562 - protein, 10 aa, Artificial Sequence
  Description of Artificial Sequence: Synthetic peptide
  Seed: SGPQNDGKEL (SSX2_HUMAN)
SIPQNDGKEL

SEQ ID NO: 163563 - protein, 10 aa, Artificial Sequence
  Description of Artificial Sequence: Synthetic peptide
  Seed: MTKLGFKATL (SSX2_HUMAN)
MKKLGFKATM

SEQ ID NO: 163564 - protein, 9 aa, Artificial Sequence
  Description of Artificial Sequence: Synthetic peptide
  Seed: MTKLGFKAT (SSX2_HUMAN)
MQKLGFKAK

SEQ ID NO: 163565 - protein, 9 aa, Artificial Sequence
  Description of Artificial Sequence: Synthetic peptide
  Seed: RLRERKQLV (SSX2_HUMAN)
RVRERKQLF

SEQ ID NO: 163566 - protein, 9 aa, Artificial Sequence
  Description of Artificial Sequence: Synthetic peptide
  Seed: EKMKASEKI (SSX2_HUMAN)
EQMKASEKL

SEQ ID NO: 163567 - protein, 9 aa, Artificial Sequence
  Description of Artificial Sequence: Synthetic peptide
  Seed: KQLVIYEEI (SSX2_HUMAN)
KALVIYEEY

SEQ ID NO: 163568 - protein, 9 aa, Artificial Sequence
  Description of Artificial Sequence: Synthetic peptide
  Seed: KRKYEAMTK (SSX2_HUMAN)
KIKYEAMTV

SEQ ID NO: 163569 - protein, 9 aa, Artificial Sequence
  Description of Artificial Sequence: Synthetic peptide
  Seed: KASEKIFYV (SSX2_HUMAN)
KESEKIFYL

SEQ ID NO: 163570 - protein, 9 aa, Artificial Sequence
  Description of Artificial Sequence: Synthetic peptide
  Seed: HRLRERKQL (SSX2_HUMAN)
HHLRERKQL

SEQ ID NO: 163571 - protein, 9 aa, Artificial Sequence
  Description of Artificial Sequence: Synthetic peptide
  Seed: YEAMTKLGF (SSX2_HUMAN)
YLAMTKLGF

SEQ ID NO: 163572 - protein, 9 aa, Artificial Sequence
  Description of Artificial Sequence: Synthetic peptide
  Seed: YEAMTKLGF (SSX2_HUMAN)
YTAMTKLGY

SEQ ID NO: 163573 - protein, 9 aa, Artificial Sequence
  Description of Artificial Sequence: Synthetic peptide
  Seed: EAMTKLGFK (SSX2_HUMAN)
EFMTKLGFK

SEQ ID NO: 163574 - protein, 11 aa, Artificial Sequence
  Description of Artificial Sequence: Synthetic peptide
  Seed: FGRLQGISPKI (SSX2_HUMAN)
FWRLQGISPKV

SEQ ID NO: 163575 - protein, 10 aa, Artificial Sequence
  Description of Artificial Sequence: Synthetic peptide
  Seed: AQIPEKIQKA (SSX2_HUMAN)
AEIPEKIQKC

SEQ ID NO: 163576 - protein, 9 aa, Artificial Sequence
  Description of Artificial Sequence: Synthetic peptide
  Seed: RLRERKQLV (SSX2_HUMAN)
RFRERKQLY

SEQ ID NO: 163577 - protein, 9 aa, Artificial Sequence
  Description of Artificial Sequence: Synthetic peptide
  Seed: KELCPPGKP (SSX2_HUMAN)
KELCPPGKI

SEQ ID NO: 163578 - protein, 9 aa, Artificial Sequence
  Description of Artificial Sequence: Synthetic peptide
  Seed: VGAQIPEKI (SSX2_HUMAN)
VSAQIPEKV

SEQ ID NO: 163579 - protein, 10 aa, Artificial Sequence
  Description of Artificial Sequence: Synthetic peptide
  Seed: YMKRKYEAMT (SSX2_HUMAN)
YMKRKYEAMP

SEQ ID NO: 163580 - protein, 9 aa, Artificial Sequence
  Description of Artificial Sequence: Synthetic peptide
  Seed: RRPTVGAQI (SSX2_HUMAN)
RFPTVGAQL

SEQ ID NO: 163581 - protein, 9 aa, Artificial Sequence
  Description of Artificial Sequence: Synthetic peptide
  Seed: AQIPEKIQK (SSX2_HUMAN)
AIIPEKIQR

SEQ ID NO: 163582 - protein, 9 aa, Artificial Sequence
  Description of Artificial Sequence: Synthetic peptide
  Seed: FYVYMKRKY (SSX2_HUMAN)
FFVYMKRKY

SEQ ID NO: 163583 - protein, 9 aa, Artificial Sequence
  Description of Artificial Sequence: Synthetic peptide
  Seed: RKYEAMTKL (SSX2_HUMAN)
RKYEAMTKY

SEQ ID NO: 163584 - protein, 9 aa, Artificial Sequence
  Description of Artificial Sequence: Synthetic peptide
  Seed: DDIAKYFSK (SSX2_HUMAN)
DLIAKYFSK

SEQ ID NO: 163585 - protein, 9 aa, Artificial Sequence
  Description of Artificial Sequence: Synthetic peptide
  Seed: KRKYEAMTK (SSX2_HUMAN)
KMKYEAMTA

SEQ ID NO: 163586 - protein, 10 aa, Artificial Sequence
  Description of Artificial Sequence: Synthetic peptide
  Seed: KYFSKEEWEK (SSX2_HUMAN)
KMFSKEEWEY

SEQ ID NO: 163587 - protein, 9 aa, Artificial Sequence
  Description of Artificial Sequence: Synthetic peptide
  Seed: EAMTKLGFK (SSX2_HUMAN)
ECMTKLGFR

SEQ ID NO: 163588 - protein, 10 aa, Artificial Sequence
  Description of Artificial Sequence: Synthetic peptide
  Seed: KYEAMTKLGF (SSX2_HUMAN)
KNEAMTKLGW

SEQ ID NO: 163589 - protein, 9 aa, Artificial Sequence
  Description of Artificial Sequence: Synthetic peptide
  Seed: KAFDDIAKY (SSX2_HUMAN)
KMFDDIAKH

SEQ ID NO: 163590 - protein, 9 aa, Artificial Sequence
  Description of Artificial Sequence: Synthetic peptide
  Seed: KAFDDIAKY (SSX2_HUMAN)
KVFDDIAKY

SEQ ID NO: 163591 - protein, 9 aa, Artificial Sequence
  Description of Artificial Sequence: Synthetic peptide
  Seed: KASEKIFYV (SSX2_HUMAN)
KFSEKIFYK

SEQ ID NO: 163592 - protein, 9 aa, Artificial Sequence
  Description of Artificial Sequence: Synthetic peptide
  Seed: RERKQLVIY (SSX2_HUMAN)
RVRKQLVIF

SEQ ID NO: 163593 - protein, 10 aa, Artificial Sequence
  Description of Artificial Sequence: Synthetic peptide
  Seed: KIHERSGPKR (SSX2_HUMAN)
KLHERSGPKK

SEQ ID NO: 163594 - protein, 9 aa, Artificial Sequence
  Description of Artificial Sequence: Synthetic peptide
  Seed: KATLPPFMC (SSX2_HUMAN)
KTTLPPFML

SEQ ID NO: 163595 - protein, 11 aa, Artificial Sequence
  Description of Artificial Sequence: Synthetic peptide
  Seed: KYFSKEEWEKM (SSX2_HUMAN)
KFFSKEEWEKF

SEQ ID NO: 163596 - protein, 9 aa, Artificial Sequence
  Description of Artificial Sequence: Synthetic peptide
  Seed: GEHAWTHRL (SSX2_HUMAN)
GQHAWTHRI

SEQ ID NO: 163597 - protein, 9 aa, Artificial Sequence
  Description of Artificial Sequence: Synthetic peptide
  Seed: YEAMTKLGF (SSX2_HUMAN)
YQAMTKLGM

SEQ ID NO: 163598 - protein, 9 aa, Artificial Sequence
  Description of Artificial Sequence: Synthetic peptide
  Seed: KASEKIFYV (SSX2_HUMAN)
KTSEKIFYR

SEQ ID NO: 163599 - protein, 9 aa, Artificial Sequence
  Description of Artificial Sequence: Synthetic peptide
  Seed: AFDDIAKYF (SSX2_HUMAN)
AQDDIAKYI

SEQ ID NO: 163600 - protein, 11 aa, Artificial Sequence
  Description of Artificial Sequence: Synthetic peptide
  Seed: ATLPPFMCNKR (SSX2_HUMAN)
AVLPPFMCNKK

SEQ ID NO: 163601 - protein, 9 aa, Artificial Sequence
  Description of Artificial Sequence: Synthetic peptide
  Seed: ASEKIFYVY (SSX2_HUMAN)
AAEKIFYVW

SEQ ID NO: 163602 - protein, 10 aa, Artificial Sequence
  Description of Artificial Sequence: Synthetic peptide
  Seed: DGKELCPPGK (SSX2_HUMAN)
DAKELCPPGR

SEQ ID NO: 163603 - protein, 9 aa, Artificial Sequence
  Description of Artificial Sequence: Synthetic peptide
  Seed: RKYEAMTKL (SSX2_HUMAN)
RVYEAMTKF

SEQ ID NO: 163604 - protein, 9 aa, Artificial Sequence
  Description of Artificial Sequence: Synthetic peptide
  Seed: TTSEKIHER (SSX2_HUMAN)
TMSEKIHEV

SEQ ID NO: 163605 - protein, 9 aa, Artificial Sequence
  Description of Artificial Sequence: Synthetic peptide
  Seed: MTFGRLQGI (SSX2_HUMAN)
MMFGRLQGC

SEQ ID NO: 163606 - protein, 9 aa, Artificial Sequence
  Description of Artificial Sequence: Synthetic peptide
  Seed: VGAQIPEKI (SSX2_HUMAN)
VRAQIPEKM

SEQ ID NO: 163607 - protein, 9 aa, Artificial Sequence
  Description of Artificial Sequence: Synthetic peptide
  Seed: EHAWTHRLR (SSX2_HUMAN)
EYAWTHRLR

SEQ ID NO: 163608 - protein, 9 aa, Artificial Sequence
  Description of Artificial Sequence: Synthetic peptide
  Seed: MTKLGFKAT (SSX2_HUMAN)
MSKLGFKAA

SEQ ID NO: 163609 - protein, 9 aa, Artificial Sequence
  Description of Artificial Sequence: Synthetic peptide
  Seed: RLRERKQLV (SSX2_HUMAN)
RTRERKQLF

SEQ ID NO: 163610 - protein, 10 aa, Artificial Sequence
  Description of Artificial Sequence: Synthetic peptide
  Seed: KIHERSGPKR (SSX2_HUMAN)
KMHERSGPKR

SEQ ID NO: 163611 - protein, 9 aa, Artificial Sequence
  Description of Artificial Sequence: Synthetic peptide
  Seed: YEAMTKLGF (SSX2_HUMAN)
YMAMTKLGM

SEQ ID NO: 163612 - protein, 9 aa, Artificial Sequence
  Description of Artificial Sequence: Synthetic peptide
  Seed: TTSEKIHER (SSX2_HUMAN)
TGSEKIHER

SEQ ID NO: 163613 - protein, 9 aa, Artificial Sequence
  Description of Artificial Sequence: Synthetic peptide
  Seed: TTSEKIHER (SSX2_HUMAN)
TVSEKIHEL

SEQ ID NO: 163614 - protein, 9 aa, Artificial Sequence
  Description of Artificial Sequence: Synthetic peptide
  Seed: KASEKIFYV (SSX2_HUMAN)
KVSEKIFYM

SEQ ID NO: 163615 - protein, 9 aa, Artificial Sequence
  Description of Artificial Sequence: Synthetic peptide
  Seed: SPKIMPKKP (SSX2_HUMAN)
SPKIMPKKA

SEQ ID NO: 163616 - protein, 10 aa, Artificial Sequence
  Description of Artificial Sequence: Synthetic peptide
  Seed: KAFDDIAKYF (SSX2_HUMAN)
KIFDDIAKYM

SEQ ID NO: 163617 - protein, 11 aa, Artificial Sequence
  Description of Artificial Sequence: Synthetic peptide
  Seed: FGRLQGISPKI (SSX2_HUMAN)
FSRLQGISPKL

SEQ ID NO: 163618 - protein, 9 aa, Artificial Sequence
  Description of Artificial Sequence: Synthetic peptide
  Seed: KRKYEAMTK (SSX2_HUMAN)
KTKYEAMTY

SEQ ID NO: 163619 - protein, 10 aa, Artificial Sequence
  Description of Artificial Sequence: Synthetic peptide
  Seed: ATLPPFMCNK (SSX2_HUMAN)
ATLPPFMCNY

SEQ ID NO: 163620 - protein, 10 aa, Artificial Sequence
  Description of Artificial Sequence: Synthetic peptide
  Seed: ARRPTVGAQI (SSX2_HUMAN)
ARRPTVGAQL

SEQ ID NO: 163621 - protein, 9 aa, Artificial Sequence
  Description of Artificial Sequence: Synthetic peptide
  Seed: TTSEKIHER (SSX2_HUMAN)
TISEKIHEF

SEQ ID NO: 163622 - protein, 10 aa, Artificial Sequence
  Description of Artificial Sequence: Synthetic peptide
  Seed: VYMKRKYEAM (SSX2_HUMAN)
VTMKRKYEAL

SEQ ID NO: 163623 - protein, 9 aa, Artificial Sequence
  Description of Artificial Sequence: Synthetic peptide
  Seed: EAMTKLGFK (SSX2_HUMAN)
EMMTKLGFK

SEQ ID NO: 163624 - protein, 9 aa, Artificial Sequence
  Description of Artificial Sequence: Synthetic peptide
  Seed: VGAQIPEKI (SSX2_HUMAN)
VIAQIPEKL

SEQ ID NO: 163625 - protein, 10 aa, Artificial Sequence
  Description of Artificial Sequence: Synthetic peptide
  Seed: KYEAMTKLGF (SSX2_HUMAN)
KCEAMTKLGW

SEQ ID NO: 163626 - protein, 10 aa, Artificial Sequence
  Description of Artificial Sequence: Synthetic peptide
  Seed: KMKASEKIFY (SSX2_HUMAN)
KTKASEKIFS

SEQ ID NO: 163627 - protein, 8 aa, Artificial Sequence
  Description of Artificial Sequence: Synthetic peptide
  Seed: MKRKYEAM (SSX2_HUMAN)
MIRKYEAM

SEQ ID NO: 163628 - protein, 10 aa, Artificial Sequence
  Description of Artificial Sequence: Synthetic peptide
  Seed: EKIFYVYMKR (SSX2_HUMAN)
EGIFYVYMKR

SEQ ID NO: 163629 - protein, 10 aa, Artificial Sequence
  Description of Artificial Sequence: Synthetic peptide
  Seed: YMKRKYEAMT (SSX2_HUMAN)
YMKRKYEAMH

SEQ ID NO: 163630 - protein, 9 aa, Artificial Sequence
  Description of Artificial Sequence: Synthetic peptide
  Seed: MPKKPAEEG (SSX2_HUMAN)
MAKKPAEEF

SEQ ID NO: 163631 - protein, 9 aa, Artificial Sequence
  Description of Artificial Sequence: Synthetic peptide
  Seed: EKMKASEKI (SSX2_HUMAN)
EHMKASEKM

SEQ ID NO: 163632 - protein, 10 aa, Artificial Sequence
  Description of Artificial Sequence: Synthetic peptide
  Seed: KYEAMTKLGF (SSX2_HUMAN)
KWEAMTKLGW

SEQ ID NO: 163633 - protein, 9 aa, Artificial Sequence
  Description of Artificial Sequence: Synthetic peptide
  Seed: AFDDIAKYF (SSX2_HUMAN)
AVDDIAKYV

SEQ ID NO: 163634 - protein, 9 aa, Artificial Sequence
  Description of Artificial Sequence: Synthetic peptide
  Seed: KASEKIFYV (SSX2_HUMAN)
KTSEKIFYL

SEQ ID NO: 163635 - protein, 9 aa, Artificial Sequence
  Description of Artificial Sequence: Synthetic peptide
  Seed: QIPEKIQKA (SSX2_HUMAN)
QTPEKIQKV

SEQ ID NO: 163636 - protein, 10 aa, Artificial Sequence
  Description of Artificial Sequence: Synthetic peptide
  Seed: MTFGRLQGIS (SSX2_HUMAN)
MTFGRLQGIL

SEQ ID NO: 163637 - protein, 9 aa, Artificial Sequence
  Description of Artificial Sequence: Synthetic peptide
  Seed: AKYFSKEEW (SSX2_HUMAN)
ARYFSKEEY

SEQ ID NO: 163638 - protein, 11 aa, Artificial Sequence
  Description of Artificial Sequence: Synthetic peptide
  Seed: RKYEAMTKLGF (SSX2_HUMAN)
RYYEAMTKLGL

SEQ ID NO: 163639 - protein, 9 aa, Artificial Sequence
  Description of Artificial Sequence: Synthetic peptide
  Seed: TTSEKIHER (SSX2_HUMAN)
TYSEKIHEV

SEQ ID NO: 163640 - protein, 10 aa, Artificial Sequence
  Description of Artificial Sequence: Synthetic peptide
  Seed: LGFKATLPPF (SSX2_HUMAN)
LLFKATLPPM

SEQ ID NO: 163641 - protein, 11 aa, Artificial Sequence
  Description of Artificial Sequence: Synthetic peptide
  Seed: KIQKAFDDIAK (SSX2_HUMAN)
KTQKAFDDIAY

SEQ ID NO: 163642 - protein, 9 aa, Artificial Sequence
  Description of Artificial Sequence: Synthetic peptide
  Seed: KQLVIYEEI (SSX2_HUMAN)
KELVIYEEL

SEQ ID NO: 163643 - protein, 10 aa, Artificial Sequence
  Description of Artificial Sequence: Synthetic peptide
  Seed: KAFDDIAKYF (SSX2_HUMAN)
KTFDDIAKYK

SEQ ID NO: 163644 - protein, 9 aa, Artificial Sequence
  Description of Artificial Sequence: Synthetic peptide
  Seed: RKYEAMTKL (SSX2_HUMAN)
RMYEAMTKV

SEQ ID NO: 163645 - protein, 9 aa, Artificial Sequence
  Description of Artificial Sequence: Synthetic peptide
  Seed: KIFYVYMKR (SSX2_HUMAN)
KIFYVYMKY

SEQ ID NO: 163646 - protein, 9 aa, Artificial Sequence
  Description of Artificial Sequence: Synthetic peptide
  Seed: RLRERKQLV (SSX2_HUMAN)
RTRERKQLL

SEQ ID NO: 163647 - protein, 9 aa, Artificial Sequence
  Description of Artificial Sequence: Synthetic peptide
  Seed: KATLPPFMC (SSX2_HUMAN)
KATLPPFML

SEQ ID NO: 163648 - protein, 9 aa, Artificial Sequence
  Description of Artificial Sequence: Synthetic peptide
  Seed: KRKYEAMTK (SSX2_HUMAN)
KTKYEAMTI

SEQ ID NO: 163649 - protein, 9 aa, Artificial Sequence
  Description of Artificial Sequence: Synthetic peptide
  Seed: GISPKIMPK (SSX2_HUMAN)
GISPKIMPR

SEQ ID NO: 163650 - protein, 9 aa, Artificial Sequence
  Description of Artificial Sequence: Synthetic peptide
  Seed: RLQGISPKI (SSX2_HUMAN)
RYQGISPKY

SEQ ID NO: 163651 - protein, 10 aa, Artificial Sequence
  Description of Artificial Sequence: Synthetic peptide
  Seed: LGFKATLPPF (SSX2_HUMAN)
LTFKATLPPI

SEQ ID NO: 163652 - protein, 9 aa, Artificial Sequence
  Description of Artificial Sequence: Synthetic peptide
  Seed: MKASEKIFY (SSX2_HUMAN)
MYASEKIFY

SEQ ID NO: 163653 - protein, 9 aa, Artificial Sequence
  Description of Artificial Sequence: Synthetic peptide
  Seed: FARRPTVGA (SSX2_HUMAN)
FIRRPTVGK

SEQ ID NO: 163654 - protein, 9 aa, Artificial Sequence
  Description of Artificial Sequence: Synthetic peptide
  Seed: MTFGRLQGI (SSX2_HUMAN)
MVFGRLQGA

SEQ ID NO: 163655 - protein, 9 aa, Artificial Sequence
  Description of Artificial Sequence: Synthetic peptide
  Seed: RLQGISPKI (SSX2_HUMAN)
RGQGISPKY

SEQ ID NO: 163656 - protein, 9 aa, Artificial Sequence
  Description of Artificial Sequence: Synthetic peptide
  Seed: TVGAQIPEK (SSX2_HUMAN)
TVGAQIPEY

SEQ ID NO: 163657 - protein, 11 aa, Artificial Sequence
  Description of Artificial Sequence: Synthetic peptide
  Seed: AQIPEKIQKAF (SSX2_HUMAN)
AEIPEKIQKAY

SEQ ID NO: 163658 - protein, 10 aa, Artificial Sequence
  Description of Artificial Sequence: Synthetic peptide
  Seed: YEAMTKLGFK (SSX2_HUMAN)
YSAMTKLGFR

SEQ ID NO: 163659 - protein, 8 aa, Artificial Sequence
  Description of Artificial Sequence: Synthetic peptide
  Seed: YMKRKYEA (SSX2_HUMAN)
YSKRKYEM

SEQ ID NO: 163660 - protein, 9 aa, Artificial Sequence
  Description of Artificial Sequence: Synthetic peptide
  Seed: KASEKIFYV (SSX2_HUMAN)
KASEKIFYY

SEQ ID NO: 163661 - protein, 10 aa, Artificial Sequence
  Description of Artificial Sequence: Synthetic peptide
  Seed: EKIFYVYMKR (SSX2_HUMAN)
EKIFYVYMKK

SEQ ID NO: 163662 - protein, 9 aa, Artificial Sequence
  Description of Artificial Sequence: Synthetic peptide
  Seed: FARRPTVGA (SSX2_HUMAN)
FVRRPTVGF

SEQ ID NO: 163663 - protein, 10 aa, Artificial Sequence
  Description of Artificial Sequence: Synthetic peptide
  Seed: YVYMKRKYEA (SSX2_HUMAN)
YPYMKRKYEM

SEQ ID NO: 163664 - protein, 10 aa, Artificial Sequence
  Description of Artificial Sequence: Synthetic peptide
  Seed: ATLPPFMCNK (SSX2_HUMAN)
AFLPPFMCNK

SEQ ID NO: 163665 - protein, 11 aa, Artificial Sequence
  Description of Artificial Sequence: Synthetic peptide
  Seed: MKASEKIFYVY (SSX2_HUMAN)
MMASEKIFYVF

SEQ ID NO: 163666 - protein, 9 aa, Artificial Sequence
  Description of Artificial Sequence: Synthetic peptide
  Seed: AFDDIAKYF (SSX2_HUMAN)
AVDDIAKYM

SEQ ID NO: 163667 - protein, 10 aa, Artificial Sequence
  Description of Artificial Sequence: Synthetic peptide
  Seed: KRGEHAWTHR (SSX2_HUMAN)
KYGEHAWTHR

SEQ ID NO: 163668 - protein, 11 aa, Artificial Sequence
  Description of Artificial Sequence: Synthetic peptide
  Seed: FGRLQGISPKI (SSX2_HUMAN)
FVRLQGISPKL

SEQ ID NO: 163669 - protein, 9 aa, Artificial Sequence
  Description of Artificial Sequence: Synthetic peptide
  Seed: MKASEKIFY (SSX2_HUMAN)
MFASEKIFY

SEQ ID NO: 163670 - protein, 10 aa, Artificial Sequence
  Description of Artificial Sequence: Synthetic peptide
  Seed: VYMKRKYEAM (SSX2_HUMAN)
VHMKRKYEAL

SEQ ID NO: 163671 - protein, 9 aa, Artificial Sequence
  Description of Artificial Sequence: Synthetic peptide
  Seed: KIFYVYMKR (SSX2_HUMAN)
KSFYVYMKA

SEQ ID NO: 163672 - protein, 10 aa, Artificial Sequence
  Description of Artificial Sequence: Synthetic peptide
  Seed: RLQGISPKIM (SSX2_HUMAN)
RQQGISPKIW

SEQ ID NO: 163673 - protein, 9 aa, Artificial Sequence
  Description of Artificial Sequence: Synthetic peptide
  Seed: RKYEAMTKL (SSX2_HUMAN)
RAYEAMTKY

SEQ ID NO: 163674 - protein, 11 aa, Artificial Sequence
  Description of Artificial Sequence: Synthetic peptide
  Seed: ATLPPFMCNKR (SSX2_HUMAN)
AALPPFMCNKR

SEQ ID NO: 163675 - protein, 10 aa, Artificial Sequence
  Description of Artificial Sequence: Synthetic peptide
  Seed: KAFDDIAKYF (SSX2_HUMAN)
KCFDDIAKYW

SEQ ID NO: 163676 - protein, 9 aa, Artificial Sequence
  Description of Artificial Sequence: Synthetic peptide
  Seed: RLQGISPKI (SSX2_HUMAN)
RIQGISPKV

SEQ ID NO: 163677 - protein, 10 aa, Artificial Sequence
  Description of Artificial Sequence: Synthetic peptide
  Seed: EKIFYVYMKR (SSX2_HUMAN)
EVIFYVYMKK

SEQ ID NO: 163678 - protein, 9 aa, Artificial Sequence
  Description of Artificial Sequence: Synthetic peptide
  Seed: YMKRKYEAM (SSX2_HUMAN)
YIKRKYEAM

SEQ ID NO: 163679 - protein, 9 aa, Artificial Sequence
  Description of Artificial Sequence: Synthetic peptide
  Seed: ERPQMTFGR (SSX2_HUMAN)
EWPQMTFGR

SEQ ID NO: 163680 - protein, 10 aa, Artificial Sequence
  Description of Artificial Sequence: Synthetic peptide
  Seed: IAKYFSKEEW (SSX2_HUMAN)
ITKYFSKEEW

SEQ ID NO: 163681 - protein, 10 aa, Artificial Sequence
  Description of Artificial Sequence: Synthetic peptide
  Seed: IQKAFDDIAK (SSX2_HUMAN)
IAKAFDDIAY

SEQ ID NO: 163682 - protein, 10 aa, Artificial Sequence
  Description of Artificial Sequence: Synthetic peptide
  Seed: NQVERPQMTF (SSX2_HUMAN)
NHVERPQMTF

SEQ ID NO: 163683 - protein, 11 aa, Artificial Sequence
  Description of Artificial Sequence: Synthetic peptide
  Seed: KMKASEKIFYV (SSX2_HUMAN)
KMKASEKIFYM

SEQ ID NO: 163684 - protein, 10 aa, Artificial Sequence
  Description of Artificial Sequence: Synthetic peptide
  Seed: MTKLGFKATL (SSX2_HUMAN)
MSKLGFKATY

SEQ ID NO: 163685 - protein, 10 aa, Artificial Sequence
  Description of Artificial Sequence: Synthetic peptide
  Seed: KAFDDIAKYF (SSX2_HUMAN)
KLFDDIAKYK

SEQ ID NO: 163686 - protein, 9 aa, Artificial Sequence
  Description of Artificial Sequence: Synthetic peptide
  Seed: KAFDDIAKY (SSX2_HUMAN)
KHFDDIAKL

SEQ ID NO: 163687 - protein, 9 aa, Artificial Sequence
  Description of Artificial Sequence: Synthetic peptide
  Seed: RLQGISPKI (SSX2_HUMAN)
RLQGISPKK

SEQ ID NO: 163688 - protein, 9 aa, Artificial Sequence
  Description of Artificial Sequence: Synthetic peptide
  Seed: DAFARRPTV (SSX2_HUMAN)
DPFARRPTL

SEQ ID NO: 163689 - protein, 9 aa, Artificial Sequence
  Description of Artificial Sequence: Synthetic peptide
  Seed: RLQGISPKI (SSX2_HUMAN)
RTQGISPKI

SEQ ID NO: 163690 - protein, 10 aa, Artificial Sequence
  Description of Artificial Sequence: Synthetic peptide
  Seed: LGFKATLPPF (SSX2_HUMAN)
LLFKATLPPY

SEQ ID NO: 163691 - protein, 9 aa, Artificial Sequence
  Description of Artificial Sequence: Synthetic peptide
  Seed: DDIAKYFSK (SSX2_HUMAN)
DGIAKYFSR

SEQ ID NO: 163692 - protein, 11 aa, Artificial Sequence
  Description of Artificial Sequence: Synthetic peptide
  Seed: ASGPQNDGKEL (SSX2_HUMAN)
ASGPQNDGKEW

SEQ ID NO: 163693 - protein, 9 aa, Artificial Sequence
  Description of Artificial Sequence: Synthetic peptide
  Seed: TKLGFKATL (SSX2_HUMAN)
TRLGFKATV

SEQ ID NO: 163694 - protein, 10 aa, Artificial Sequence
  Description of Artificial Sequence: Synthetic peptide
  Seed: KAFDDIAKYF (SSX2_HUMAN)
KQFDDIAKYI

SEQ ID NO: 163695 - protein, 11 aa, Artificial Sequence
  Description of Artificial Sequence: Synthetic peptide
  Seed: KELCPPGKPTT (SSX2_HUMAN)
KELCPPGKPTA

SEQ ID NO: 163696 - protein, 9 aa, Artificial Sequence
  Description of Artificial Sequence: Synthetic peptide
  Seed: YMKRKYEAM (SSX2_HUMAN)
YTKRKYEAI

SEQ ID NO: 163697 - protein, 9 aa, Artificial Sequence
  Description of Artificial Sequence: Synthetic peptide
  Seed: KIFYVYMKR (SSX2_HUMAN)
KTFYVYMKL

SEQ ID NO: 163698 - protein, 10 aa, Artificial Sequence
  Description of Artificial Sequence: Synthetic peptide
  Seed: KYFSKEEWEK (SSX2_HUMAN)
KIFSKEEWEY

SEQ ID NO: 163699 - protein, 9 aa, Artificial Sequence
  Description of Artificial Sequence: Synthetic peptide
  Seed: KRKYEAMTK (SSX2_HUMAN)
KSKYEAMTV

SEQ ID NO: 163700 - protein, 10 aa, Artificial Sequence
  Description of Artificial Sequence: Synthetic peptide
  Seed: MKASEKIFYV (SSX2_HUMAN)
MSASEKIFYI

SEQ ID NO: 163701 - protein, 9 aa, Artificial Sequence
  Description of Artificial Sequence: Synthetic peptide
  Seed: MTFGRLQGI (SSX2_HUMAN)
MMFGRLQGS

SEQ ID NO: 163702 - protein, 10 aa, Artificial Sequence
  Description of Artificial Sequence: Synthetic peptide
  Seed: MKASEKIFYV (SSX2_HUMAN)
MEASEKIFYV

SEQ ID NO: 163703 - protein, 11 aa, Artificial Sequence
  Description of Artificial Sequence: Synthetic peptide
  Seed: KELCPPGKPTT (SSX2_HUMAN)
KELCPPGKPTC

SEQ ID NO: 163704 - protein, 10 aa, Artificial Sequence
  Description of Artificial Sequence: Synthetic peptide
  Seed: ATLPPFMCNK (SSX2_HUMAN)
AGLPPFMCNR

SEQ ID NO: 163705 - protein, 10 aa, Artificial Sequence
  Description of Artificial Sequence: Synthetic peptide
  Seed: RLRERKQLVI (SSX2_HUMAN)
RVRERKQLVV

SEQ ID NO: 163706 - protein, 9 aa, Artificial Sequence
  Description of Artificial Sequence: Synthetic peptide
  Seed: DDIAKYFSK (SSX2_HUMAN)
DYIAKYFSK

SEQ ID NO: 163707 - protein, 10 aa, Artificial Sequence
  Description of Artificial Sequence: Synthetic peptide
  Seed: KAFDDIAKYF (SSX2_HUMAN)
KYFDDIAKYM

SEQ ID NO: 163708 - protein, 10 aa, Artificial Sequence
  Description of Artificial Sequence: Synthetic peptide
  Seed: MTKLGFKATL (SSX2_HUMAN)
MQKLGFKATL

SEQ ID NO: 163709 - protein, 9 aa, Artificial Sequence
  Description of Artificial Sequence: Synthetic peptide
  Seed: FARRPTVGA (SSX2_HUMAN)
FIRRPTVGF

SEQ ID NO: 163710 - protein, 10 aa, Artificial Sequence
  Description of Artificial Sequence: Synthetic peptide
  Seed: DGKELCPPGK (SSX2_HUMAN)
DVKELCPPGK

SEQ ID NO: 163711 - protein, 9 aa, Artificial Sequence
  Description of Artificial Sequence: Synthetic peptide
  Seed: AQIPEKIQK (SSX2_HUMAN)
AVIPEKIQF

SEQ ID NO: 163712 - protein, 10 aa, Artificial Sequence
  Description of Artificial Sequence: Synthetic peptide
  Seed: QMTFGRLQGI (SSX2_HUMAN)
QTTFGRLQGV

SEQ ID NO: 163713 - protein, 10 aa, Artificial Sequence
  Description of Artificial Sequence: Synthetic peptide
  Seed: EKIFYVYMKR (SSX2_HUMAN)
EQIFYVYMKR

SEQ ID NO: 163714 - protein, 9 aa, Artificial Sequence
  Description of Artificial Sequence: Synthetic peptide
  Seed: YFSKEEWEK (SSX2_HUMAN)
YSSKEEWEY

SEQ ID NO: 163715 - protein, 10 aa, Artificial Sequence
  Description of Artificial Sequence: Synthetic peptide
  Seed: KYEAMTKLGF (SSX2_HUMAN)
KDEAMTKLGW

SEQ ID NO: 163716 - protein, 9 aa, Artificial Sequence
  Description of Artificial Sequence: Synthetic peptide
  Seed: MTFGRLQGI (SSX2_HUMAN)
MIFGRLQGT

SEQ ID NO: 163717 - protein, 9 aa, Artificial Sequence
  Description of Artificial Sequence: Synthetic peptide
  Seed: DDIAKYFSK (SSX2_HUMAN)
DAIAKYFSR

SEQ ID NO: 163718 - protein, 9 aa, Artificial Sequence
  Description of Artificial Sequence: Synthetic peptide
  Seed: VGAQIPEKI (SSX2_HUMAN)
VAAQIPEKM

SEQ ID NO: 163719 - protein, 10 aa, Artificial Sequence
  Description of Artificial Sequence: Synthetic peptide
  Seed: KMKASEKIFY (SSX2_HUMAN)
KIKASEKIFV

SEQ ID NO: 163720 - protein, 9 aa, Artificial Sequence
  Description of Artificial Sequence: Synthetic peptide
  Seed: KQLVIYEEI (SSX2_HUMAN)
KVLVIYEEF

SEQ ID NO: 163721 - protein, 9 aa, Artificial Sequence
  Description of Artificial Sequence: Synthetic peptide
  Seed: RRPTVGAQI (SSX2_HUMAN)
RFPTVGAQF

SEQ ID NO: 163722 - protein, 9 aa, Artificial Sequence
  Description of Artificial Sequence: Synthetic peptide
  Seed: AFDDIAKYF (SSX2_HUMAN)
AIDDIAKYW

SEQ ID NO: 163723 - protein, 9 aa, Artificial Sequence
  Description of Artificial Sequence: Synthetic peptide
  Seed: RERKQLVIY (SSX2_HUMAN)
RARKQLVIF

SEQ ID NO: 163724 - protein, 8 aa, Artificial Sequence
  Description of Artificial Sequence: Synthetic peptide
  Seed: RPTVGAQI (SSX2_HUMAN)
RPTVGAQM

SEQ ID NO: 163725 - protein, 9 aa, Artificial Sequence
  Description of Artificial Sequence: Synthetic peptide
  Seed: TTSEKIHER (SSX2_HUMAN)
TTSEKIHEK

SEQ ID NO: 163726 - protein, 9 aa, Artificial Sequence
  Description of Artificial Sequence: Synthetic peptide
  Seed: AFDDIAKYF (SSX2_HUMAN)
ACDDIAKYI

SEQ ID NO: 163727 - protein, 9 aa, Artificial Sequence
  Description of Artificial Sequence: Synthetic peptide
  Seed: KRKYEAMTK (SSX2_HUMAN)
KVKYEAMTL

SEQ ID NO: 163728 - protein, 9 aa, Artificial Sequence
  Description of Artificial Sequence: Synthetic peptide
  Seed: DAFARRPTV (SSX2_HUMAN)
DTFARRPTK

SEQ ID NO: 163729 - protein, 10 aa, Artificial Sequence
  Description of Artificial Sequence: Synthetic peptide
  Seed: MTKLGFKATL (SSX2_HUMAN)
MTKLGFKATK

SEQ ID NO: 163730 - protein, 9 aa, Artificial Sequence
  Description of Artificial Sequence: Synthetic peptide
  Seed: VGAQIPEKI (SSX2_HUMAN)
VTAQIPEKV

SEQ ID NO: 163731 - protein, 9 aa, Artificial Sequence
  Description of Artificial Sequence: Synthetic peptide
  Seed: KRKYEAMTK (SSX2_HUMAN)
KVKYEAMTI

SEQ ID NO: 163732 - protein, 9 aa, Artificial Sequence
  Description of Artificial Sequence: Synthetic peptide
  Seed: GISPKIMPK (SSX2_HUMAN)
GLSPKIMPR

SEQ ID NO: 163733 - protein, 10 aa, Artificial Sequence
  Description of Artificial Sequence: Synthetic peptide
  Seed: HAWTHRLRER (SSX2_HUMAN)
HQWTHRLRER

SEQ ID NO: 163734 - protein, 9 aa, Artificial Sequence
  Description of Artificial Sequence: Synthetic peptide
  Seed: KAFDDIAKY (SSX2_HUMAN)
KSFDDIAKF

SEQ ID NO: 163735 - protein, 9 aa, Artificial Sequence
  Description of Artificial Sequence: Synthetic peptide
  Seed: RKYEAMTKL (SSX2_HUMAN)
RMYEAMTKM

SEQ ID NO: 163736 - protein, 9 aa, Artificial Sequence
  Description of Artificial Sequence: Synthetic peptide
  Seed: YEAMTKLGF (SSX2_HUMAN)
YKAMTKLGL

SEQ ID NO: 163737 - protein, 10 aa, Artificial Sequence
  Description of Artificial Sequence: Synthetic peptide
  Seed: YEAMTKLGFK (SSX2_HUMAN)
YKAMTKLGFR

SEQ ID NO: 163738 - protein, 9 aa, Artificial Sequence
  Description of Artificial Sequence: Synthetic peptide
  Seed: YMKRKYEAM (SSX2_HUMAN)
YCKRKYEAI

SEQ ID NO: 163739 - protein, 9 aa, Artificial Sequence
  Description of Artificial Sequence: Synthetic peptide
  Seed: AFDDIAKYF (SSX2_HUMAN)
ALDDIAKYM

SEQ ID NO: 163740 - protein, 9 aa, Artificial Sequence
  Description of Artificial Sequence: Synthetic peptide
  Seed: QIPEKIQKA (SSX2_HUMAN)
QIPEKIQKR

SEQ ID NO: 163741 - protein, 8 aa, Artificial Sequence
  Description of Artificial Sequence: Synthetic peptide
  Seed: AFDDIAKY (SSX2_HUMAN)
ASDDIAKM

SEQ ID NO: 163742 - protein, 9 aa, Artificial Sequence
  Description of Artificial Sequence: Synthetic peptide
  Seed: KIFYVYMKR (SSX2_HUMAN)
KFFYVYMKK

SEQ ID NO: 163743 - protein, 9 aa, Artificial Sequence
  Description of Artificial Sequence: Synthetic peptide
  Seed: EEWEKMKAS (SSX2_HUMAN)
EEWEKMKAF

SEQ ID NO: 163744 - protein, 10 aa, Artificial Sequence
  Description of Artificial Sequence: Synthetic peptide
  Seed: KAFDDIAKYF (SSX2_HUMAN)
KAFDDIAKYI

SEQ ID NO: 163745 - protein, 9 aa, Artificial Sequence
  Description of Artificial Sequence: Synthetic peptide
  Seed: RKYEAMTKL (SSX2_HUMAN)
REYEAMTKV

SEQ ID NO: 163746 - protein, 11 aa, Artificial Sequence
  Description of Artificial Sequence: Synthetic peptide
  Seed: YMKRKYEAMTK (SSX2_HUMAN)
YPKRKYEAMTL

SEQ ID NO: 163747 - protein, 9 aa, Artificial Sequence
  Description of Artificial Sequence: Synthetic peptide
  Seed: AFDDIAKYF (SSX2_HUMAN)
AVDDIAKYI

SEQ ID NO: 163748 - protein, 9 aa, Artificial Sequence
  Description of Artificial Sequence: Synthetic peptide
  Seed: TLPPFMCNK (SSX2_HUMAN)
TVPPFMCNK

SEQ ID NO: 163749 - protein, 10 aa, Artificial Sequence
  Description of Artificial Sequence: Synthetic peptide
  Seed: YVYMKRKYEA (SSX2_HUMAN)
YLYMKRKYEL

SEQ ID NO: 163750 - protein, 9 aa, Artificial Sequence
  Description of Artificial Sequence: Synthetic peptide
  Seed: KIFYVYMKR (SSX2_HUMAN)
KYFYVYMKR

SEQ ID NO: 163751 - protein, 11 aa, Artificial Sequence
  Description of Artificial Sequence: Synthetic peptide
  Seed: RSGPKRGEHAW (SSX2_HUMAN)
RIGPKRGEHAW

SEQ ID NO: 163752 - protein, 9 aa, Artificial Sequence
  Description of Artificial Sequence: Synthetic peptide
  Seed: KAFDDIAKY (SSX2_HUMAN)
KRFDDIAKY

SEQ ID NO: 163753 - protein, 9 aa, Artificial Sequence
  Description of Artificial Sequence: Synthetic peptide
  Seed: EAMTKLGFK (SSX2_HUMAN)
EIMTKLGFK

SEQ ID NO: 163754 - protein, 9 aa, Artificial Sequence
  Description of Artificial Sequence: Synthetic peptide
  Seed: VYMKRKYEA (SSX2_HUMAN)
VFMKRKYEY

SEQ ID NO: 163755 - protein, 9 aa, Artificial Sequence
  Description of Artificial Sequence: Synthetic peptide
  Seed: KIHERSGPK (SSX2_HUMAN)
KMHERSGPK

SEQ ID NO: 163756 - protein, 9 aa, Artificial Sequence
  Description of Artificial Sequence: Synthetic peptide
  Seed: KMKASEKIF (SSX2_HUMAN)
KQKASEKIM

SEQ ID NO: 163757 - protein, 10 aa, Artificial Sequence
  Description of Artificial Sequence: Synthetic peptide
  Seed: KAFDDIAKYF (SSX2_HUMAN)
KLFDDIAKYF

SEQ ID NO: 163758 - protein, 10 aa, Artificial Sequence
  Description of Artificial Sequence: Synthetic peptide
  Seed: RLRERKQLVI (SSX2_HUMAN)
RTRERKQLVK

SEQ ID NO: 163759 - protein, 9 aa, Artificial Sequence
  Description of Artificial Sequence: Synthetic peptide
  Seed: VGAQIPEKI (SSX2_HUMAN)
VGAQIPEKW

SEQ ID NO: 163760 - protein, 9 aa, Artificial Sequence
  Description of Artificial Sequence: Synthetic peptide
  Seed: FKATLPPFM (SSX2_HUMAN)
FYATLPPFF

SEQ ID NO: 163761 - protein, 9 aa, Artificial Sequence
  Description of Artificial Sequence: Synthetic peptide
  Seed: KIHERSGPK (SSX2_HUMAN)
KYHERSGPK

SEQ ID NO: 163762 - protein, 10 aa, Artificial Sequence
  Description of Artificial Sequence: Synthetic peptide
  Seed: QMTFGRLQGI (SSX2_HUMAN)
QITFGRLQGV

SEQ ID NO: 163763 - protein, 9 aa, Artificial Sequence
  Description of Artificial Sequence: Synthetic peptide
  Seed: RKYEAMTKL (SSX2_HUMAN)
RKYEAMTKF

SEQ ID NO: 163764 - protein, 11 aa, Artificial Sequence
  Description of Artificial Sequence: Synthetic peptide
  Seed: ATLPPFMCNKR (SSX2_HUMAN)
ASLPPFMCNKK

SEQ ID NO: 163765 - protein, 9 aa, Artificial Sequence
  Description of Artificial Sequence: Synthetic peptide
  Seed: EAMTKLGFK (SSX2_HUMAN)
EVMTKLGFK

SEQ ID NO: 163766 - protein, 9 aa, Artificial Sequence
  Description of Artificial Sequence: Synthetic peptide
  Seed: FYVYMKRKY (SSX2_HUMAN)
FYVYMKRKF

SEQ ID NO: 163767 - protein, 9 aa, Artificial Sequence
  Description of Artificial Sequence: Synthetic peptide
  Seed: FKATLPPFM (SSX2_HUMAN)
FYATLPPFY

SEQ ID NO: 163768 - protein, 10 aa, Artificial Sequence
  Description of Artificial Sequence: Synthetic peptide
  Seed: LGFKATLPPF (SSX2_HUMAN)
LTFKATLPPF

SEQ ID NO: 163769 - protein, 10 aa, Artificial Sequence
  Description of Artificial Sequence: Synthetic peptide
  Seed: VYMKRKYEAM (SSX2_HUMAN)
VIMKRKYEAL

SEQ ID NO: 163770 - protein, 9 aa, Artificial Sequence
  Description of Artificial Sequence: Synthetic peptide
  Seed: AFDDIAKYF (SSX2_HUMAN)
ALDDIAKYL

SEQ ID NO: 163771 - protein, 9 aa, Artificial Sequence
  Description of Artificial Sequence: Synthetic peptide
  Seed: NDSEEVPEA (SSX2_HUMAN)
NDSEEVPEM

SEQ ID NO: 163772 - protein, 9 aa, Artificial Sequence
  Description of Artificial Sequence: Synthetic peptide
  Seed: TTSEKIHER (SSX2_HUMAN)
TISEKIHEY

SEQ ID NO: 163773 - protein, 11 aa, Artificial Sequence
  Description of Artificial Sequence: Synthetic peptide
  Seed: YVYMKRKYEAM (SSX2_HUMAN)
YAYMKRKYEAM

SEQ ID NO: 163774 - protein, 11 aa, Artificial Sequence
  Description of Artificial Sequence: Synthetic peptide
  Seed: ATLPPFMCNKR (SSX2_HUMAN)
AALPPFMCNKK

SEQ ID NO: 163775 - protein, 11 aa, Artificial Sequence
  Description of Artificial Sequence: Synthetic peptide
  Seed: YVYMKRKYEAM (SSX2_HUMAN)
YLYMKRKYEAL

SEQ ID NO: 163776 - protein, 9 aa, Artificial Sequence
  Description of Artificial Sequence: Synthetic peptide
  Seed: AFDDIAKYF (SSX2_HUMAN)
AIDDIAKYI

SEQ ID NO: 163777 - protein, 11 aa, Artificial Sequence
  Description of Artificial Sequence: Synthetic peptide
  Seed: KYEAMTKLGFK (SSX2_HUMAN)
KQEAMTKLGFR

SEQ ID NO: 163778 - protein, 9 aa, Artificial Sequence
  Description of Artificial Sequence: Synthetic peptide
  Seed: KIHERSGPK (SSX2_HUMAN)
KVHERSGPA

SEQ ID NO: 163779 - protein, 9 aa, Artificial Sequence
  Description of Artificial Sequence: Synthetic peptide
  Seed: MTFGRLQGI (SSX2_HUMAN)
MSFGRLQGI

SEQ ID NO: 163780 - protein, 10 aa, Artificial Sequence
  Description of Artificial Sequence: Synthetic peptide
  Seed: QMTFGRLQGI (SSX2_HUMAN)
QMTFGRLQGL

SEQ ID NO: 163781 - protein, 10 aa, Artificial Sequence
  Description of Artificial Sequence: Synthetic peptide
  Seed: MKASEKIFYV (SSX2_HUMAN)
MQASEKIFYM

SEQ ID NO: 163782 - protein, 10 aa, Artificial Sequence
  Description of Artificial Sequence: Synthetic peptide
  Seed: RPQMTFGRLQ (SSX2_HUMAN)
RPQMTFGRLM

SEQ ID NO: 163783 - protein, 9 aa, Artificial Sequence
  Description of Artificial Sequence: Synthetic peptide
  Seed: RLQGISPKI (SSX2_HUMAN)
RQQGISPKI

SEQ ID NO: 163784 - protein, 10 aa, Artificial Sequence
  Description of Artificial Sequence: Synthetic peptide
  Seed: KIFYVYMKRK (SSX2_HUMAN)
KMFYVYMKRQ

SEQ ID NO: 163785 - protein, 11 aa, Artificial Sequence
  Description of Artificial Sequence: Synthetic peptide
  Seed: ASGPQNDGKEL (SSX2_HUMAN)
ATGPQNDGKEW

SEQ ID NO: 163786 - protein, 10 aa, Artificial Sequence
  Description of Artificial Sequence: Synthetic peptide
  Seed: EASGPQNDGK (SSX2_HUMAN)
EASGPQNDGR

SEQ ID NO: 163787 - protein, 8 aa, Artificial Sequence
  Description of Artificial Sequence: Synthetic peptide
  Seed: FDDIAKYF (SSX2_HUMAN)
FTDIAKYM

SEQ ID NO: 163788 - protein, 10 aa, Artificial Sequence
  Description of Artificial Sequence: Synthetic peptide
  Seed: KYFSKEEWEK (SSX2_HUMAN)
KYFSKEEWEY

SEQ ID NO: 163789 - protein, 8 aa, Artificial Sequence
  Description of Artificial Sequence: Synthetic peptide
  Seed: MKRKYEAM (SSX2_HUMAN)
MRRKYEAL

SEQ ID NO: 163790 - protein, 9 aa, Artificial Sequence
  Description of Artificial Sequence: Synthetic peptide
  Seed: KAFDDIAKY (SSX2_HUMAN)
KFFDDIAKY

SEQ ID NO: 163791 - protein, 8 aa, Artificial Sequence
  Description of Artificial Sequence: Synthetic peptide
  Seed: FDDIAKYF (SSX2_HUMAN)
FFDIAKYF

SEQ ID NO: 163792 - protein, 9 aa, Artificial Sequence
  Description of Artificial Sequence: Synthetic peptide
  Seed: FARRPTVGA (SSX2_HUMAN)
FPRRPTVGI

SEQ ID NO: 163793 - protein, 10 aa, Artificial Sequence
  Description of Artificial Sequence: Synthetic peptide
  Seed: RLQGISPKIM (SSX2_HUMAN)
RQQGISPKIY

SEQ ID NO: 163794 - protein, 11 aa, Artificial Sequence
  Description of Artificial Sequence: Synthetic peptide
  Seed: KYEAMTKLGFK (SSX2_HUMAN)
KLEAMTKLGFR

SEQ ID NO: 163795 - protein, 10 aa, Artificial Sequence
  Description of Artificial Sequence: Synthetic peptide
  Seed: RLRERKQLVI (SSX2_HUMAN)
RFRERKQLVA

SEQ ID NO: 163796 - protein, 9 aa, Artificial Sequence
  Description of Artificial Sequence: Synthetic peptide
  Seed: RLRERKQLV (SSX2_HUMAN)
RFRERKQLA

SEQ ID NO: 163797 - protein, 9 aa, Artificial Sequence
  Description of Artificial Sequence: Synthetic peptide
  Seed: GEHAWTHRL (SSX2_HUMAN)
GEHAWTHRP

SEQ ID NO: 163798 - protein, 9 aa, Artificial Sequence
  Description of Artificial Sequence: Synthetic peptide
  Seed: FKATLPPFM (SSX2_HUMAN)
FMATLPPFY

SEQ ID NO: 163799 - protein, 11 aa, Artificial Sequence
  Description of Artificial Sequence: Synthetic peptide
  Seed: SEKIFYVYMKR (SSX2_HUMAN)
SYKIFYVYMKR

SEQ ID NO: 163800 - protein, 11 aa, Artificial Sequence
  Description of Artificial Sequence: Synthetic peptide
  Seed: KELCPPGKPTT (SSX2_HUMAN)
KELCPPGKPTV

SEQ ID NO: 163801 - protein, 9 aa, Artificial Sequence
  Description of Artificial Sequence: Synthetic peptide
  Seed: KAFDDIAKY (SSX2_HUMAN)
KTFDDIAKK

SEQ ID NO: 163802 - protein, 11 aa, Artificial Sequence
  Description of Artificial Sequence: Synthetic peptide
  Seed: RSGPKRGEHAW (SSX2_HUMAN)
RVGPKRGEHAW

SEQ ID NO: 163803 - protein, 9 aa, Artificial Sequence
  Description of Artificial Sequence: Synthetic peptide
  Seed: AEDFQGNDL (SSX2_HUMAN)
ASDFQGNDF

SEQ ID NO: 163804 - protein, 9 aa, Artificial Sequence
  Description of Artificial Sequence: Synthetic peptide
  Seed: EKMKASEKI (SSX2_HUMAN)
EHMKASEKI

SEQ ID NO: 163805 - protein, 10 aa, Artificial Sequence
  Description of Artificial Sequence: Synthetic peptide
  Seed: KELCPPGKPT (SSX2_HUMAN)
KELCPPGKPL

SEQ ID NO: 163806 - protein, 9 aa, Artificial Sequence
  Description of Artificial Sequence: Synthetic peptide
  Seed: MTFGRLQGI (SSX2_HUMAN)
MVFGRLQGV

SEQ ID NO: 163807 - protein, 9 aa, Artificial Sequence
  Description of Artificial Sequence: Synthetic peptide
  Seed: RRPTVGAQI (SSX2_HUMAN)
RFPTVGAQY

SEQ ID NO: 163808 - protein, 9 aa, Artificial Sequence
  Description of Artificial Sequence: Synthetic peptide
  Seed: MPKKPAEEG (SSX2_HUMAN)
MPKKPAEET

SEQ ID NO: 163809 - protein, 9 aa, Artificial Sequence
  Description of Artificial Sequence: Synthetic peptide
  Seed: YMKRKYEAM (SSX2_HUMAN)
YAKRKYEAF

SEQ ID NO: 163810 - protein, 10 aa, Artificial Sequence
  Description of Artificial Sequence: Synthetic peptide
  Seed: MKASEKIFYV (SSX2_HUMAN)
MMASEKIFYM

SEQ ID NO: 163811 - protein, 9 aa, Artificial Sequence
  Description of Artificial Sequence: Synthetic peptide
  Seed: EAMTKLGFK (SSX2_HUMAN)
ENMTKLGFR

SEQ ID NO: 163812 - protein, 9 aa, Artificial Sequence
  Description of Artificial Sequence: Synthetic peptide
  Seed: YMKRKYEAM (SSX2_HUMAN)
YLKRKYEAA

SEQ ID NO: 163813 - protein, 10 aa, Artificial Sequence
  Description of Artificial Sequence: Synthetic peptide
  Seed: YEAMTKLGFK (SSX2_HUMAN)
YRAMTKLGFR

SEQ ID NO: 163814 - protein, 9 aa, Artificial Sequence
  Description of Artificial Sequence: Synthetic peptide
  Seed: MTFGRLQGI (SSX2_HUMAN)
MMFGRLQGK

SEQ ID NO: 163815 - protein, 9 aa, Artificial Sequence
  Description of Artificial Sequence: Synthetic peptide
  Seed: RLRERKQLV (SSX2_HUMAN)
RGRERKQLK

SEQ ID NO: 163816 - protein, 10 aa, Artificial Sequence
  Description of Artificial Sequence: Synthetic peptide
  Seed: KMKASEKIFY (SSX2_HUMAN)
KIKASEKIFI

SEQ ID NO: 163817 - protein, 9 aa, Artificial Sequence
  Description of Artificial Sequence: Synthetic peptide
  Seed: DDIAKYFSK (SSX2_HUMAN)
DMIAKYFSR

SEQ ID NO: 163818 - protein, 10 aa, Artificial Sequence
  Description of Artificial Sequence: Synthetic peptide
  Seed: KAFDDIAKYF (SSX2_HUMAN)
KLFDDIAKYI

SEQ ID NO: 163819 - protein, 9 aa, Artificial Sequence
  Description of Artificial Sequence: Synthetic peptide
  Seed: MTFGRLQGI (SSX2_HUMAN)
MMFGRLQGR

SEQ ID NO: 163820 - protein, 9 aa, Artificial Sequence
  Description of Artificial Sequence: Synthetic peptide
  Seed: ASEKIFYVY (SSX2_HUMAN)
AMEKIFYVY

SEQ ID NO: 163821 - protein, 9 aa, Artificial Sequence
  Description of Artificial Sequence: Synthetic peptide
  Seed: DDIAKYFSK (SSX2_HUMAN)
DQIAKYFSK

SEQ ID NO: 163822 - protein, 9 aa, Artificial Sequence
  Description of Artificial Sequence: Synthetic peptide
  Seed: AFDDIAKYF (SSX2_HUMAN)
ASDDIAKYY

SEQ ID NO: 163823 - protein, 9 aa, Artificial Sequence
  Description of Artificial Sequence: Synthetic peptide
  Seed: AFDDIAKYF (SSX2_HUMAN)
AWDDIAKYI

SEQ ID NO: 163824 - protein, 9 aa, Artificial Sequence
  Description of Artificial Sequence: Synthetic peptide
  Seed: KASEKIFYV (SSX2_HUMAN)
KMSEKIFYL

SEQ ID NO: 163825 - protein, 10 aa, Artificial Sequence
  Description of Artificial Sequence: Synthetic peptide
  Seed: LGFKATLPPF (SSX2_HUMAN)
LNFKATLPPF

SEQ ID NO: 163826 - protein, 9 aa, Artificial Sequence
  Description of Artificial Sequence: Synthetic peptide
  Seed: KEEWEKMKA (SSX2_HUMAN)
KEEWEKMKL

SEQ ID NO: 163827 - protein, 10 aa, Artificial Sequence
  Description of Artificial Sequence: Synthetic peptide
  Seed: KAFDDIAKYF (SSX2_HUMAN)
KSFDDIAKYI

SEQ ID NO: 163828 - protein, 9 aa, Artificial Sequence
  Description of Artificial Sequence: Synthetic peptide
  Seed: RERKQLVIY (SSX2_HUMAN)
RERKQLVIV

SEQ ID NO: 163829 - protein, 11 aa, Artificial Sequence
  Description of Artificial Sequence: Synthetic peptide
  Seed: KLGFKATLPPF (SSX2_HUMAN)
KMGFKATLPPF

SEQ ID NO: 163830 - protein, 8 aa, Artificial Sequence
  Description of Artificial Sequence: Synthetic peptide
  Seed: AFDDIAKY (SSX2_HUMAN)
AFDDIAKF

SEQ ID NO: 163831 - protein, 9 aa, Artificial Sequence
  Description of Artificial Sequence: Synthetic peptide
  Seed: ASEKIFYVY (SSX2_HUMAN)
AKEKIFYVY

SEQ ID NO: 163832 - protein, 9 aa, Artificial Sequence
  Description of Artificial Sequence: Synthetic peptide
  Seed: KASEKIFYV (SSX2_HUMAN)
KSSEKIFYK

SEQ ID NO: 163833 - protein, 9 aa, Artificial Sequence
  Description of Artificial Sequence: Synthetic peptide
  Seed: HERSGPKRG (SSX2_HUMAN)
HERSGPKRA

SEQ ID NO: 163834 - protein, 9 aa, Artificial Sequence
  Description of Artificial Sequence: Synthetic peptide
  Seed: KIHERSGPK (SSX2_HUMAN)
KSHERSGPA

SEQ ID NO: 163835 - protein, 10 aa, Artificial Sequence
  Description of Artificial Sequence: Synthetic peptide
  Seed: MKASEKIFYV (SSX2_HUMAN)
MQASEKIFYV

SEQ ID NO: 163836 - protein, 9 aa, Artificial Sequence
  Description of Artificial Sequence: Synthetic peptide
  Seed: FSKEEWEKM (SSX2_HUMAN)
FTKEEWEKY

SEQ ID NO: 163837 - protein, 10 aa, Artificial Sequence
  Description of Artificial Sequence: Synthetic peptide
  Seed: MKASEKIFYV (SSX2_HUMAN)
MGASEKIFYV

SEQ ID NO: 163838 - protein, 11 aa, Artificial Sequence
  Description of Artificial Sequence: Synthetic peptide
  Seed: KYEAMTKLGFK (SSX2_HUMAN)
KHEAMTKLGFR

SEQ ID NO: 163839 - protein, 9 aa, Artificial Sequence
  Description of Artificial Sequence: Synthetic peptide
  Seed: ERPQMTFGR (SSX2_HUMAN)
ESPQMTFGR

SEQ ID NO: 163840 - protein, 9 aa, Artificial Sequence
  Description of Artificial Sequence: Synthetic peptide
  Seed: KASEKIFYV (SSX2_HUMAN)
KQSEKIFYY

SEQ ID NO: 163841 - protein, 11 aa, Artificial Sequence
  Description of Artificial Sequence: Synthetic peptide
  Seed: KYEAMTKLGFK (SSX2_HUMAN)
KGEAMTKLGFR

SEQ ID NO: 163842 - protein, 10 aa, Artificial Sequence
  Description of Artificial Sequence: Synthetic peptide
  Seed: KASEKIFYVY (SSX2_HUMAN)
KCSEKIFYVW

SEQ ID NO: 163843 - protein, 10 aa, Artificial Sequence
  Description of Artificial Sequence: Synthetic peptide
  Seed: QGISPKIMPK (SSX2_HUMAN)
QTISPKIMPK

SEQ ID NO: 163844 - protein, 8 aa, Artificial Sequence
  Description of Artificial Sequence: Synthetic peptide
  Seed: FDDIAKYF (SSX2_HUMAN)
FYDIAKYF

SEQ ID NO: 163845 - protein, 11 aa, Artificial Sequence
  Description of Artificial Sequence: Synthetic peptide
  Seed: YVYMKRKYEAM (SSX2_HUMAN)
YNYMKRKYEAL

SEQ ID NO: 163846 - protein, 9 aa, Artificial Sequence
  Description of Artificial Sequence: Synthetic peptide
  Seed: RKYEAMTKL (SSX2_HUMAN)
RRYEAMTKA

SEQ ID NO: 163847 - protein, 10 aa, Artificial Sequence
  Description of Artificial Sequence: Synthetic peptide
  Seed: KIFYVYMKRK (SSX2_HUMAN)
KYFYVYMKRK

SEQ ID NO: 163848 - protein, 9 aa, Artificial Sequence
  Description of Artificial Sequence: Synthetic peptide
  Seed: YMKRKYEAM (SSX2_HUMAN)
YMKRKYEAA

SEQ ID NO: 163849 - protein, 9 aa, Artificial Sequence
  Description of Artificial Sequence: Synthetic peptide
  Seed: AQIPEKIQK (SSX2_HUMAN)
ARIPEKIQI

SEQ ID NO: 163850 - protein, 11 aa, Artificial Sequence
  Description of Artificial Sequence: Synthetic peptide
  Seed: KMKASEKIFYV (SSX2_HUMAN)
KTKASEKIFYI

SEQ ID NO: 163851 - protein, 9 aa, Artificial Sequence
  Description of Artificial Sequence: Synthetic peptide
  Seed: MTFGRLQGI (SSX2_HUMAN)
MIFGRLQGM

SEQ ID NO: 163852 - protein, 10 aa, Artificial Sequence
  Description of Artificial Sequence: Synthetic peptide
  Seed: LGFKATLPPF (SSX2_HUMAN)
LMFKATLPPL

SEQ ID NO: 163853 - protein, 9 aa, Artificial Sequence
  Description of Artificial Sequence: Synthetic peptide
  Seed: RERKQLVIY (SSX2_HUMAN)
RKRKQLVIF

SEQ ID NO: 163854 - protein, 11 aa, Artificial Sequence
  Description of Artificial Sequence: Synthetic peptide
  Seed: MKASEKIFYVY (SSX2_HUMAN)
MMASEKIFYVY

SEQ ID NO: 163855 - protein, 9 aa, Artificial Sequence
  Description of Artificial Sequence: Synthetic peptide
  Seed: MKASEKIFY (SSX2_HUMAN)
MKASEKIFM

SEQ ID NO: 163856 - protein, 11 aa, Artificial Sequence
  Description of Artificial Sequence: Synthetic peptide
  Seed: FGRLQGISPKI (SSX2_HUMAN)
FIRLQGISPKV

SEQ ID NO: 163857 - protein, 9 aa, Artificial Sequence
  Description of Artificial Sequence: Synthetic peptide
  Seed: AQIPEKIQK (SSX2_HUMAN)
AQIPEKIQF

SEQ ID NO: 163858 - protein, 10 aa, Artificial Sequence
  Description of Artificial Sequence: Synthetic peptide
  Seed: KASEKIFYVY (SSX2_HUMAN)
KTSEKIFYVY

SEQ ID NO: 163859 - protein, 9 aa, Artificial Sequence
  Description of Artificial Sequence: Synthetic peptide
  Seed: AQIPEKIQK (SSX2_HUMAN)
AEIPEKIQF

SEQ ID NO: 163860 - protein, 9 aa, Artificial Sequence
  Description of Artificial Sequence: Synthetic peptide
  Seed: YMKRKYEAM (SSX2_HUMAN)
YGKRKYEAV

SEQ ID NO: 163861 - protein, 11 aa, Artificial Sequence
  Description of Artificial Sequence: Synthetic peptide
  Seed: ATLPPFMCNKR (SSX2_HUMAN)
AMLPPFMCNKK

SEQ ID NO: 163862 - protein, 9 aa, Artificial Sequence
  Description of Artificial Sequence: Synthetic peptide
  Seed: MKASEKIFY (SSX2_HUMAN)
MAASEKIFF

SEQ ID NO: 163863 - protein, 9 aa, Artificial Sequence
  Description of Artificial Sequence: Synthetic peptide
  Seed: RLQGISPKI (SSX2_HUMAN)
RLQGISPKV

SEQ ID NO: 163864 - protein, 9 aa, Artificial Sequence
  Description of Artificial Sequence: Synthetic peptide
  Seed: KAFDDIAKY (SSX2_HUMAN)
KLFDDIAKV

SEQ ID NO: 163865 - protein, 11 aa, Artificial Sequence
  Description of Artificial Sequence: Synthetic peptide
  Seed: KATLPPFMCNK (SSX2_HUMAN)
KFTLPPFMCNR

SEQ ID NO: 163866 - protein, 10 aa, Artificial Sequence
  Description of Artificial Sequence: Synthetic peptide
  Seed: KAFDDIAKYF (SSX2_HUMAN)
KQFDDIAKYV

SEQ ID NO: 163867 - protein, 10 aa, Artificial Sequence
  Description of Artificial Sequence: Synthetic peptide
  Seed: KYFSKEEWEK (SSX2_HUMAN)
KSFSKEEWER

SEQ ID NO: 163868 - protein, 9 aa, Artificial Sequence
  Description of Artificial Sequence: Synthetic peptide
  Seed: RKYEAMTKL (SSX2_HUMAN)
RIYEAMTKY

SEQ ID NO: 163869 - protein, 10 aa, Artificial Sequence
  Description of Artificial Sequence: Synthetic peptide
  Seed: KIFYVYMKRK (SSX2_HUMAN)
KWFYVYMKRR

SEQ ID NO: 163870 - protein, 11 aa, Artificial Sequence
  Description of Artificial Sequence: Synthetic peptide
  Seed: KYEAMTKLGFK (SSX2_HUMAN)
KAEAMTKLGFR

SEQ ID NO: 163871 - protein, 8 aa, Artificial Sequence
  Description of Artificial Sequence: Synthetic peptide
  Seed: FDDIAKYF (SSX2_HUMAN)
FADIAKYI

SEQ ID NO: 163872 - protein, 10 aa, Artificial Sequence
  Description of Artificial Sequence: Synthetic peptide
  Seed: KIHERSGPKR (SSX2_HUMAN)
KTHERSGPKK

SEQ ID NO: 163873 - protein, 9 aa, Artificial Sequence
  Description of Artificial Sequence: Synthetic peptide
  Seed: TVGAQIPEK (SSX2_HUMAN)
TTGAQIPEM

SEQ ID NO: 163874 - protein, 9 aa, Artificial Sequence
  Description of Artificial Sequence: Synthetic peptide
  Seed: YMKRKYEAM (SSX2_HUMAN)
YRKRKYEAM

SEQ ID NO: 163875 - protein, 11 aa, Artificial Sequence
  Description of Artificial Sequence: Synthetic peptide
  Seed: KATLPPFMCNK (SSX2_HUMAN)
KSTLPPFMCNK

SEQ ID NO: 163876 - protein, 10 aa, Artificial Sequence
  Description of Artificial Sequence: Synthetic peptide
  Seed: KYFSKEEWEK (SSX2_HUMAN)
KMFSKEEWER

SEQ ID NO: 163877 - protein, 10 aa, Artificial Sequence
  Description of Artificial Sequence: Synthetic peptide
  Seed: LGFKATLPPF (SSX2_HUMAN)
LQFKATLPPY

SEQ ID NO: 163878 - protein, 9 aa, Artificial Sequence
  Description of Artificial Sequence: Synthetic peptide
  Seed: AQIPEKIQK (SSX2_HUMAN)
AQIPEKIQY

SEQ ID NO: 163879 - protein, 9 aa, Artificial Sequence
  Description of Artificial Sequence: Synthetic peptide
  Seed: RKYEAMTKL (SSX2_HUMAN)
RRYEAMTKV

SEQ ID NO: 163880 - protein, 9 aa, Artificial Sequence
  Description of Artificial Sequence: Synthetic peptide
  Seed: FSKEEWEKM (SSX2_HUMAN)
FRKEEWEKY

SEQ ID NO: 163881 - protein, 11 aa, Artificial Sequence
  Description of Artificial Sequence: Synthetic peptide
  Seed: KATLPPFMCNK (SSX2_HUMAN)
KTTLPPFMCNR

SEQ ID NO: 163882 - protein, 10 aa, Artificial Sequence
  Description of Artificial Sequence: Synthetic peptide
  Seed: MKRKYEAMTK (SSX2_HUMAN)
MARKYEAMTK

SEQ ID NO: 163883 - protein, 10 aa, Artificial Sequence
  Description of Artificial Sequence: Synthetic peptide
  Seed: YEAMTKLGFK (SSX2_HUMAN)
YCAMTKLGFR

SEQ ID NO: 163884 - protein, 9 aa, Artificial Sequence
  Description of Artificial Sequence: Synthetic peptide
  Seed: TTSEKIHER (SSX2_HUMAN)
TSSEKIHER

SEQ ID NO: 163885 - protein, 9 aa, Artificial Sequence
  Description of Artificial Sequence: Synthetic peptide
  Seed: KRKYEAMTK (SSX2_HUMAN)
KTKYEAMTT

SEQ ID NO: 163886 - protein, 9 aa, Artificial Sequence
  Description of Artificial Sequence: Synthetic peptide
  Seed: RKYEAMTKL (SSX2_HUMAN)
RHYEAMTKY

SEQ ID NO: 163887 - protein, 9 aa, Artificial Sequence
  Description of Artificial Sequence: Synthetic peptide
  Seed: AQIPEKIQK (SSX2_HUMAN)
ASIPEKIQF

SEQ ID NO: 163888 - protein, 9 aa, Artificial Sequence
  Description of Artificial Sequence: Synthetic peptide
  Seed: KASEKIFYV (SSX2_HUMAN)
KNSEKIFYI

SEQ ID NO: 163889 - protein, 10 aa, Artificial Sequence
  Description of Artificial Sequence: Synthetic peptide
  Seed: YEAMTKLGFK (SSX2_HUMAN)
YHAMTKLGFR

SEQ ID NO: 163890 - protein, 9 aa, Artificial Sequence
  Description of Artificial Sequence: Synthetic peptide
  Seed: KAFDDIAKY (SSX2_HUMAN)
KIFDDIAKR

SEQ ID NO: 163891 - protein, 10 aa, Artificial Sequence
  Description of Artificial Sequence: Synthetic peptide
  Seed: AFARRPTVGA (SSX2_HUMAN)
AMARRPTVGK

SEQ ID NO: 163892 - protein, 8 aa, Artificial Sequence
  Description of Artificial Sequence: Synthetic peptide
  Seed: YMKRKYEA (SSX2_HUMAN)
YPKRKYEM

SEQ ID NO: 163893 - protein, 10 aa, Artificial Sequence
  Description of Artificial Sequence: Synthetic peptide
  Seed: IAKYFSKEEW (SSX2_HUMAN)
ITKYFSKEEF

SEQ ID NO: 163894 - protein, 10 aa, Artificial Sequence
  Description of Artificial Sequence: Synthetic peptide
  Seed: KIFYVYMKRK (SSX2_HUMAN)
KMFYVYMKRK

SEQ ID NO: 163895 - protein, 9 aa, Artificial Sequence
  Description of Artificial Sequence: Synthetic peptide
  Seed: DAFARRPTV (SSX2_HUMAN)
DAFARRPTM

SEQ ID NO: 163896 - protein, 9 aa, Artificial Sequence
  Description of Artificial Sequence: Synthetic peptide
  Seed: FYVYMKRKY (SSX2_HUMAN)
FMVYMKRKY

SEQ ID NO: 163897 - protein, 10 aa, Artificial Sequence
  Description of Artificial Sequence: Synthetic peptide
  Seed: KIHERSGPKR (SSX2_HUMAN)
KIHERSGPKK

SEQ ID NO: 163898 - protein, 10 aa, Artificial Sequence
  Description of Artificial Sequence: Synthetic peptide
  Seed: KIHERSGPKR (SSX2_HUMAN)
KLHERSGPKR

SEQ ID NO: 163899 - protein, 8 aa, Artificial Sequence
  Description of Artificial Sequence: Synthetic peptide
  Seed: FDDIAKYF (SSX2_HUMAN)
FTDIAKYI

SEQ ID NO: 163900 - protein, 9 aa, Artificial Sequence
  Description of Artificial Sequence: Synthetic peptide
  Seed: RLQGISPKI (SSX2_HUMAN)
RVQGISPKW

SEQ ID NO: 163901 - protein, 11 aa, Artificial Sequence
  Description of Artificial Sequence: Synthetic peptide
  Seed: KELCPPGKPTT (SSX2_HUMAN)
KELCPPGKPTL

SEQ ID NO: 163902 - protein, 9 aa, Artificial Sequence
  Description of Artificial Sequence: Synthetic peptide
  Seed: YMKRKYEAM (SSX2_HUMAN)
YPKRKYEAT

SEQ ID NO: 163903 - protein, 9 aa, Artificial Sequence
  Description of Artificial Sequence: Synthetic peptide
  Seed: VGAQIPEKI (SSX2_HUMAN)
VAAQIPEKW

SEQ ID NO: 163904 - protein, 9 aa, Artificial Sequence
  Description of Artificial Sequence: Synthetic peptide
  Seed: KIQKAFDDI (SSX2_HUMAN)
KQQKAFDDF

SEQ ID NO: 163905 - protein, 11 aa, Artificial Sequence
  Description of Artificial Sequence: Synthetic peptide
  Seed: YMKRKYEAMTK (SSX2_HUMAN)
YMKRKYEAMTV

SEQ ID NO: 163906 - protein, 9 aa, Artificial Sequence
  Description of Artificial Sequence: Synthetic peptide
  Seed: MPKKPAEEG (SSX2_HUMAN)
MAKKPAEEM

SEQ ID NO: 163907 - protein, 9 aa, Artificial Sequence
  Description of Artificial Sequence: Synthetic peptide
  Seed: KASEKIFYV (SSX2_HUMAN)
KLSEKIFYW

SEQ ID NO: 163908 - protein, 9 aa, Artificial Sequence
  Description of Artificial Sequence: Synthetic peptide
  Seed: RLQGISPKI (SSX2_HUMAN)
RLQGISPKL

SEQ ID NO: 163909 - protein, 9 aa, Artificial Sequence
  Description of Artificial Sequence: Synthetic peptide
  Seed: DAFARRPTV (SSX2_HUMAN)
DQFARRPTV

SEQ ID NO: 163910 - protein, 9 aa, Artificial Sequence
  Description of Artificial Sequence: Synthetic peptide
  Seed: EEWEKMKAS (SSX2_HUMAN)
EEWEKMKAL

SEQ ID NO: 163911 - protein, 10 aa, Artificial Sequence
  Description of Artificial Sequence: Synthetic peptide
  Seed: VYMKRKYEAM (SSX2_HUMAN)
VSMKRKYEAL

SEQ ID NO: 163912 - protein, 9 aa, Artificial Sequence
  Description of Artificial Sequence: Synthetic peptide
  Seed: DAFARRPTV (SSX2_HUMAN)
DIFARRPTR

SEQ ID NO: 163913 - protein, 11 aa, Artificial Sequence
  Description of Artificial Sequence: Synthetic peptide
  Seed: YVYMKRKYEAM (SSX2_HUMAN)
YMYMKRKYEAM

SEQ ID NO: 163914 - protein, 9 aa, Artificial Sequence
  Description of Artificial Sequence: Synthetic peptide
  Seed: KAFDDIAKY (SSX2_HUMAN)
KGFDDIAKF

SEQ ID NO: 163915 - protein, 9 aa, Artificial Sequence
  Description of Artificial Sequence: Synthetic peptide
  Seed: EAMTKLGFK (SSX2_HUMAN)
EVMTKLGFY

SEQ ID NO: 163916 - protein, 9 aa, Artificial Sequence
  Description of Artificial Sequence: Synthetic peptide
  Seed: KIHERSGPK (SSX2_HUMAN)
KSHERSGPK

SEQ ID NO: 163917 - protein, 9 aa, Artificial Sequence
  Description of Artificial Sequence: Synthetic peptide
  Seed: YMKRKYEAM (SSX2_HUMAN)
YDKRKYEAL

SEQ ID NO: 163918 - protein, 10 aa, Artificial Sequence
  Description of Artificial Sequence: Synthetic peptide
  Seed: ATLPPFMCNK (SSX2_HUMAN)
AQLPPFMCNK

SEQ ID NO: 163919 - protein, 8 aa, Artificial Sequence
  Description of Artificial Sequence: Synthetic peptide
  Seed: YMKRKYEA (SSX2_HUMAN)
YIKRKYEI

SEQ ID NO: 163920 - protein, 9 aa, Artificial Sequence
  Description of Artificial Sequence: Synthetic peptide
  Seed: YMKRKYEAM (SSX2_HUMAN)
YQKRKYEAV

SEQ ID NO: 163921 - protein, 9 aa, Artificial Sequence
  Description of Artificial Sequence: Synthetic peptide
  Seed: AQIPEKIQK (SSX2_HUMAN)
AIIPEKIQF

SEQ ID NO: 163922 - protein, 10 aa, Artificial Sequence
  Description of Artificial Sequence: Synthetic peptide
  Seed: HAWTHRLRER (SSX2_HUMAN)
HFWTHRLRER

SEQ ID NO: 163923 - protein, 9 aa, Artificial Sequence
  Description of Artificial Sequence: Synthetic peptide
  Seed: RKYEAMTKL (SSX2_HUMAN)
RRYEAMTKF

SEQ ID NO: 163924 - protein, 9 aa, Artificial Sequence
  Description of Artificial Sequence: Synthetic peptide
  Seed: YMKRKYEAM (SSX2_HUMAN)
YGKRKYEAL

SEQ ID NO: 163925 - protein, 9 aa, Artificial Sequence
  Description of Artificial Sequence: Synthetic peptide
  Seed: YMKRKYEAM (SSX2_HUMAN)
YGKRKYEAA

SEQ ID NO: 163926 - protein, 10 aa, Artificial Sequence
  Description of Artificial Sequence: Synthetic peptide
  Seed: KMKASEKIFY (SSX2_HUMAN)
KFKASEKIFK

SEQ ID NO: 163927 - protein, 10 aa, Artificial Sequence
  Description of Artificial Sequence: Synthetic peptide
  Seed: EKIFYVYMKR (SSX2_HUMAN)
EMIFYVYMKK

SEQ ID NO: 163928 - protein, 9 aa, Artificial Sequence
  Description of Artificial Sequence: Synthetic peptide
  Seed: KQLVIYEEI (SSX2_HUMAN)
KHLVIYEEL

SEQ ID NO: 163929 - protein, 10 aa, Artificial Sequence
  Description of Artificial Sequence: Synthetic peptide
  Seed: RLQGISPKIM (SSX2_HUMAN)
RMQGISPKIV

SEQ ID NO: 163930 - protein, 11 aa, Artificial Sequence
  Description of Artificial Sequence: Synthetic peptide
  Seed: AQIPEKIQKAF (SSX2_HUMAN)
ATIPEKIQKAW

SEQ ID NO: 163931 - protein, 10 aa, Artificial Sequence
  Description of Artificial Sequence: Synthetic peptide
  Seed: EASGPQNDGK (SSX2_HUMAN)
EVSGPQNDGK

SEQ ID NO: 163932 - protein, 9 aa, Artificial Sequence
  Description of Artificial Sequence: Synthetic peptide
  Seed: SEKIFYVYM (SSX2_HUMAN)
SEKIFYVYI

SEQ ID NO: 163933 - protein, 9 aa, Artificial Sequence
  Description of Artificial Sequence: Synthetic peptide
  Seed: FARRPTVGA (SSX2_HUMAN)
FQRRPTVGK

SEQ ID NO: 163934 - protein, 10 aa, Artificial Sequence
  Description of Artificial Sequence: Synthetic peptide
  Seed: QGISPKIMPK (SSX2_HUMAN)
QIISPKIMPK

SEQ ID NO: 163935 - protein, 10 aa, Artificial Sequence
  Description of Artificial Sequence: Synthetic peptide
  Seed: LGFKATLPPF (SSX2_HUMAN)
LQFKATLPPM

SEQ ID NO: 163936 - protein, 10 aa, Artificial Sequence
  Description of Artificial Sequence: Synthetic peptide
  Seed: AQIPEKIQKA (SSX2_HUMAN)
AQIPEKIQKF

SEQ ID NO: 163937 - protein, 9 aa, Artificial Sequence
  Description of Artificial Sequence: Synthetic peptide
  Seed: KIFYVYMKR (SSX2_HUMAN)
KGFYVYMKK

SEQ ID NO: 163938 - protein, 9 aa, Artificial Sequence
  Description of Artificial Sequence: Synthetic peptide
  Seed: KIFYVYMKR (SSX2_HUMAN)
KWFYVYMKK

SEQ ID NO: 163939 - protein, 9 aa, Artificial Sequence
  Description of Artificial Sequence: Synthetic peptide
  Seed: AFDDIAKYF (SSX2_HUMAN)
ATDDIAKYI

SEQ ID NO: 163940 - protein, 9 aa, Artificial Sequence
  Description of Artificial Sequence: Synthetic peptide
  Seed: GISPKIMPK (SSX2_HUMAN)
GVSPKIMPR

SEQ ID NO: 163941 - protein, 9 aa, Artificial Sequence
  Description of Artificial Sequence: Synthetic peptide
  Seed: KAFDDIAKY (SSX2_HUMAN)
KYFDDIAKK

SEQ ID NO: 163942 - protein, 9 aa, Artificial Sequence
  Description of Artificial Sequence: Synthetic peptide
  Seed: FSKEEWEKM (SSX2_HUMAN)
FRKEEWEKM

SEQ ID NO: 163943 - protein, 10 aa, Artificial Sequence
  Description of Artificial Sequence: Synthetic peptide
  Seed: KMKASEKIFY (SSX2_HUMAN)
KSKASEKIFI

SEQ ID NO: 163944 - protein, 9 aa, Artificial Sequence
  Description of Artificial Sequence: Synthetic peptide
  Seed: KASEKIFYV (SSX2_HUMAN)
KYSEKIFYL

SEQ ID NO: 163945 - protein, 9 aa, Artificial Sequence
  Description of Artificial Sequence: Synthetic peptide
  Seed: RLRERKQLV (SSX2_HUMAN)
RMRERKQLL

SEQ ID NO: 163946 - protein, 9 aa, Artificial Sequence
  Description of Artificial Sequence: Synthetic peptide
  Seed: GISPKIMPK (SSX2_HUMAN)
GMSPKIMPR

SEQ ID NO: 163947 - protein, 10 aa, Artificial Sequence
  Description of Artificial Sequence: Synthetic peptide
  Seed: HAWTHRLRER (SSX2_HUMAN)
HLWTHRLRER

SEQ ID NO: 163948 - protein, 9 aa, Artificial Sequence
  Description of Artificial Sequence: Synthetic peptide
  Seed: RKYEAMTKL (SSX2_HUMAN)
RKYEAMTKM

SEQ ID NO: 163949 - protein, 9 aa, Artificial Sequence
  Description of Artificial Sequence: Synthetic peptide
  Seed: YMKRKYEAM (SSX2_HUMAN)
YGKRKYEAI

SEQ ID NO: 163950 - protein, 9 aa, Artificial Sequence
  Description of Artificial Sequence: Synthetic peptide
  Seed: RKYEAMTKL (SSX2_HUMAN)
RDYEAMTKY

SEQ ID NO: 163951 - protein, 11 aa, Artificial Sequence
  Description of Artificial Sequence: Synthetic peptide
  Seed: FGRLQGISPKI (SSX2_HUMAN)
FERLQGISPKV

SEQ ID NO: 163952 - protein, 10 aa, Artificial Sequence
  Description of Artificial Sequence: Synthetic peptide
  Seed: VYMKRKYEAM (SSX2_HUMAN)
VAMKRKYEAM

SEQ ID NO: 163953 - protein, 9 aa, Artificial Sequence
  Description of Artificial Sequence: Synthetic peptide
  Seed: AEDFQGNDL (SSX2_HUMAN)
ALDFQGNDM

SEQ ID NO: 163954 - protein, 10 aa, Artificial Sequence
  Description of Artificial Sequence: Synthetic peptide
  Seed: KAFDDIAKYF (SSX2_HUMAN)
KMFDDIAKYW

SEQ ID NO: 163955 - protein, 9 aa, Artificial Sequence
  Description of Artificial Sequence: Synthetic peptide
  Seed: YMKRKYEAM (SSX2_HUMAN)
YNKRKYEAI

SEQ ID NO: 163956 - protein, 9 aa, Artificial Sequence
  Description of Artificial Sequence: Synthetic peptide
  Seed: RKYEAMTKL (SSX2_HUMAN)
RRYEAMTKW

SEQ ID NO: 163957 - protein, 9 aa, Artificial Sequence
  Description of Artificial Sequence: Synthetic peptide
  Seed: AQIPEKIQK (SSX2_HUMAN)
AQIPEKIQM

SEQ ID NO: 163958 - protein, 9 aa, Artificial Sequence
  Description of Artificial Sequence: Synthetic peptide
  Seed: EVPEASGPQ (SSX2_HUMAN)
ELPEASGPR

SEQ ID NO: 163959 - protein, 10 aa, Artificial Sequence
  Description of Artificial Sequence: Synthetic peptide
  Seed: EKIFYVYMKR (SSX2_HUMAN)
ETIFYVYMKY

SEQ ID NO: 163960 - protein, 9 aa, Artificial Sequence
  Description of Artificial Sequence: Synthetic peptide
  Seed: YFSKEEWEK (SSX2_HUMAN)
YLSKEEWEY

SEQ ID NO: 163961 - protein, 9 aa, Artificial Sequence
  Description of Artificial Sequence: Synthetic peptide
  Seed: KASEKIFYV (SSX2_HUMAN)
KLSEKIFYS

SEQ ID NO: 163962 - protein, 9 aa, Artificial Sequence
  Description of Artificial Sequence: Synthetic peptide
  Seed: AFDDIAKYF (SSX2_HUMAN)
ACDDIAKYF

SEQ ID NO: 163963 - protein, 9 aa, Artificial Sequence
  Description of Artificial Sequence: Synthetic peptide
  Seed: SEKIHERSG (SSX2_HUMAN)
SEKIHERSA

SEQ ID NO: 163964 - protein, 9 aa, Artificial Sequence
  Description of Artificial Sequence: Synthetic peptide
  Seed: KAFDDIAKY (SSX2_HUMAN)
KQFDDIAKI

SEQ ID NO: 163965 - protein, 9 aa, Artificial Sequence
  Description of Artificial Sequence: Synthetic peptide
  Seed: RLQGISPKI (SSX2_HUMAN)
RMQGISPKK

SEQ ID NO: 163966 - protein, 9 aa, Artificial Sequence
  Description of Artificial Sequence: Synthetic peptide
  Seed: AQIPEKIQK (SSX2_HUMAN)
ATIPEKIQK

SEQ ID NO: 163967 - protein, 9 aa, Artificial Sequence
  Description of Artificial Sequence: Synthetic peptide
  Seed: TKLGFKATL (SSX2_HUMAN)
THLGFKATA

SEQ ID NO: 163968 - protein, 9 aa, Artificial Sequence
  Description of Artificial Sequence: Synthetic peptide
  Seed: FKATLPPFM (SSX2_HUMAN)
FSATLPPFF

SEQ ID NO: 163969 - protein, 9 aa, Artificial Sequence
  Description of Artificial Sequence: Synthetic peptide
  Seed: RLQGISPKI (SSX2_HUMAN)
RTQGISPKW

SEQ ID NO: 163970 - protein, 9 aa, Artificial Sequence
  Description of Artificial Sequence: Synthetic peptide
  Seed: KIQKAFDDI (SSX2_HUMAN)
KQQKAFDDW

SEQ ID NO: 163971 - protein, 9 aa, Artificial Sequence
  Description of Artificial Sequence: Synthetic peptide
  Seed: RKYEAMTKL (SSX2_HUMAN)
RYYEAMTKL

SEQ ID NO: 163972 - protein, 9 aa, Artificial Sequence
  Description of Artificial Sequence: Synthetic peptide
  Seed: KQLVIYEEI (SSX2_HUMAN)
KLLVIYEEL

SEQ ID NO: 163973 - protein, 9 aa, Artificial Sequence
  Description of Artificial Sequence: Synthetic peptide
  Seed: KQLVIYEEI (SSX2_HUMAN)
KRLVIYEEL

SEQ ID NO: 163974 - protein, 10 aa, Artificial Sequence
  Description of Artificial Sequence: Synthetic peptide
  Seed: KAFDDIAKYF (SSX2_HUMAN)
KQFDDIAKYL

SEQ ID NO: 163975 - protein, 10 aa, Artificial Sequence
  Description of Artificial Sequence: Synthetic peptide
  Seed: KMKASEKIFY (SSX2_HUMAN)
KTKASEKIFM

SEQ ID NO: 163976 - protein, 9 aa, Artificial Sequence
  Description of Artificial Sequence: Synthetic peptide
  Seed: LQGISPKIM (SSX2_HUMAN)
LQGISPKIY

SEQ ID NO: 163977 - protein, 9 aa, Artificial Sequence
  Description of Artificial Sequence: Synthetic peptide
  Seed: QIPEKIQKA (SSX2_HUMAN)
QLPEKIQKA

SEQ ID NO: 163978 - protein, 9 aa, Artificial Sequence
  Description of Artificial Sequence: Synthetic peptide
  Seed: QIPEKIQKA (SSX2_HUMAN)
QMPEKIQKL

SEQ ID NO: 163979 - protein, 9 aa, Artificial Sequence
  Description of Artificial Sequence: Synthetic peptide
  Seed: RLQGISPKI (SSX2_HUMAN)
RMQGISPKL

SEQ ID NO: 163980 - protein, 10 aa, Artificial Sequence
  Description of Artificial Sequence: Synthetic peptide
  Seed: AQIPEKIQKA (SSX2_HUMAN)
AVIPEKIQKI

SEQ ID NO: 163981 - protein, 9 aa, Artificial Sequence
  Description of Artificial Sequence: Synthetic peptide
  Seed: DAFARRPTV (SSX2_HUMAN)
DPFARRPTI

SEQ ID NO: 163982 - protein, 9 aa, Artificial Sequence
  Description of Artificial Sequence: Synthetic peptide
  Seed: YEAMTKLGF (SSX2_HUMAN)
YIAMTKLGF

SEQ ID NO: 163983 - protein, 10 aa, Artificial Sequence
  Description of Artificial Sequence: Synthetic peptide
  Seed: AEEGNDSEEV (SSX2_HUMAN)
AEEGNDSEEA

SEQ ID NO: 163984 - protein, 9 aa, Artificial Sequence
  Description of Artificial Sequence: Synthetic peptide
  Seed: EVPEASGPQ (SSX2_HUMAN)
EVPEASGPR

SEQ ID NO: 163985 - protein, 10 aa, Artificial Sequence
  Description of Artificial Sequence: Synthetic peptide
  Seed: KAFDDIAKYF (SSX2_HUMAN)
KNFDDIAKYY

SEQ ID NO: 163986 - protein, 10 aa, Artificial Sequence
  Description of Artificial Sequence: Synthetic peptide
  Seed: KAFDDIAKYF (SSX2_HUMAN)
KYFDDIAKYF

SEQ ID NO: 163987 - protein, 8 aa, Artificial Sequence
  Description of Artificial Sequence: Synthetic peptide
  Seed: YMKRKYEA (SSX2_HUMAN)
YNKRKYEL

SEQ ID NO: 163988 - protein, 9 aa, Artificial Sequence
  Description of Artificial Sequence: Synthetic peptide
  Seed: EAMTKLGFK (SSX2_HUMAN)
EQMTKLGFR

SEQ ID NO: 163989 - protein, 9 aa, Artificial Sequence
  Description of Artificial Sequence: Synthetic peptide
  Seed: KAFDDIAKY (SSX2_HUMAN)
KYFDDIAKY

SEQ ID NO: 163990 - protein, 10 aa, Artificial Sequence
  Description of Artificial Sequence: Synthetic peptide
  Seed: LGFKATLPPF (SSX2_HUMAN)
LGFKATLPPY

SEQ ID NO: 163991 - protein, 9 aa, Artificial Sequence
  Description of Artificial Sequence: Synthetic peptide
  Seed: MTFGRLQGI (SSX2_HUMAN)
MIFGRLQGF

SEQ ID NO: 163992 - protein, 9 aa, Artificial Sequence
  Description of Artificial Sequence: Synthetic peptide
  Seed: AKYFSKEEW (SSX2_HUMAN)
ALYFSKEEY

SEQ ID NO: 163993 - protein, 9 aa, Artificial Sequence
  Description of Artificial Sequence: Synthetic peptide
  Seed: KMKASEKIF (SSX2_HUMAN)
KTKASEKIW

SEQ ID NO: 163994 - protein, 9 aa, Artificial Sequence
  Description of Artificial Sequence: Synthetic peptide
  Seed: TTSEKIHER (SSX2_HUMAN)
TYSEKIHEK

SEQ ID NO: 163995 - protein, 9 aa, Artificial Sequence
  Description of Artificial Sequence: Synthetic peptide
  Seed: VGAQIPEKI (SSX2_HUMAN)
VTAQIPEKY

SEQ ID NO: 163996 - protein, 9 aa, Artificial Sequence
  Description of Artificial Sequence: Synthetic peptide
  Seed: TVGAQIPEK (SSX2_HUMAN)
TTGAQIPEL

SEQ ID NO: 163997 - protein, 10 aa, Artificial Sequence
  Description of Artificial Sequence: Synthetic peptide
  Seed: YVYMKRKYEA (SSX2_HUMAN)
YLYMKRKYEF

SEQ ID NO: 163998 - protein, 9 aa, Artificial Sequence
  Description of Artificial Sequence: Synthetic peptide
  Seed: RGEHAWTHR (SSX2_HUMAN)
RTEHAWTHR

SEQ ID NO: 163999 - protein, 9 aa, Artificial Sequence
  Description of Artificial Sequence: Synthetic peptide
  Seed: AFDDIAKYF (SSX2_HUMAN)
ADDDIAKYL

SEQ ID NO: 164000 - protein, 9 aa, Artificial Sequence
  Description of Artificial Sequence: Synthetic peptide
  Seed: IFYVYMKRK (SSX2_HUMAN)
IMYVYMKRR

SEQ ID NO: 164001 - protein, 9 aa, Artificial Sequence
  Description of Artificial Sequence: Synthetic peptide
  Seed: RLRERKQLV (SSX2_HUMAN)
RMRERKQLV

SEQ ID NO: 164002 - protein, 9 aa, Artificial Sequence
  Description of Artificial Sequence: Synthetic peptide
  Seed: FSKEEWEKM (SSX2_HUMAN)
FQKEEWEKF

SEQ ID NO: 164003 - protein, 9 aa, Artificial Sequence
  Description of Artificial Sequence: Synthetic peptide
  Seed: QIPEKIQKA (SSX2_HUMAN)
QIPEKIQKV

SEQ ID NO: 164004 - protein, 10 aa, Artificial Sequence
  Description of Artificial Sequence: Synthetic peptide
  Seed: KMKASEKIFY (SSX2_HUMAN)
KTKASEKIFA

SEQ ID NO: 164005 - protein, 9 aa, Artificial Sequence
  Description of Artificial Sequence: Synthetic peptide
  Seed: DAFARRPTV (SSX2_HUMAN)
DVFARRPTV

SEQ ID NO: 164006 - protein, 9 aa, Artificial Sequence
  Description of Artificial Sequence: Synthetic peptide
  Seed: GISPKIMPK (SSX2_HUMAN)
GYSPKIMPR

SEQ ID NO: 164007 - protein, 10 aa, Artificial Sequence
  Description of Artificial Sequence: Synthetic peptide
  Seed: KASEKIFYVY (SSX2_HUMAN)
KPSEKIFYVW

SEQ ID NO: 164008 - protein, 9 aa, Artificial Sequence
  Description of Artificial Sequence: Synthetic peptide
  Seed: DDIAKYFSK (SSX2_HUMAN)
DSIAKYFSR

SEQ ID NO: 164009 - protein, 9 aa, Artificial Sequence
  Description of Artificial Sequence: Synthetic peptide
  Seed: KQLVIYEEI (SSX2_HUMAN)
KRLVIYEEM

SEQ ID NO: 164010 - protein, 11 aa, Artificial Sequence
  Description of Artificial Sequence: Synthetic peptide
  Seed: SEKIFYVYMKR (SSX2_HUMAN)
STKIFYVYMKR

SEQ ID NO: 164011 - protein, 9 aa, Artificial Sequence
  Description of Artificial Sequence: Synthetic peptide
  Seed: GEHAWTHRL (SSX2_HUMAN)
GEHAWTHRF

SEQ ID NO: 164012 - protein, 10 aa, Artificial Sequence
  Description of Artificial Sequence: Synthetic peptide
  Seed: AQIPEKIQKA (SSX2_HUMAN)
AEIPEKIQKS

SEQ ID NO: 164013 - protein, 8 aa, Artificial Sequence
  Description of Artificial Sequence: Synthetic peptide
  Seed: FDDIAKYF (SSX2_HUMAN)
FFDIAKYM

SEQ ID NO: 164014 - protein, 9 aa, Artificial Sequence
  Description of Artificial Sequence: Synthetic peptide
  Seed: RLRERKQLV (SSX2_HUMAN)
RLRERKQLK

SEQ ID NO: 164015 - protein, 8 aa, Artificial Sequence
  Description of Artificial Sequence: Synthetic peptide
  Seed: AFDDIAKY (SSX2_HUMAN)
AMDDIAKM

SEQ ID NO: 164016 - protein, 9 aa, Artificial Sequence
  Description of Artificial Sequence: Synthetic peptide
  Seed: MTFGRLQGI (SSX2_HUMAN)
MAFGRLQGF

SEQ ID NO: 164017 - protein, 10 aa, Artificial Sequence
  Description of Artificial Sequence: Synthetic peptide
  Seed: MTKLGFKATL (SSX2_HUMAN)
MSKLGFKATK

SEQ ID NO: 164018 - protein, 10 aa, Artificial Sequence
  Description of Artificial Sequence: Synthetic peptide
  Seed: KAFDDIAKYF (SSX2_HUMAN)
KTFDDIAKYY

SEQ ID NO: 164019 - protein, 9 aa, Artificial Sequence
  Description of Artificial Sequence: Synthetic peptide
  Seed: RPQMTFGRL (SSX2_HUMAN)
RPQMTFGRA

SEQ ID NO: 164020 - protein, 10 aa, Artificial Sequence
  Description of Artificial Sequence: Synthetic peptide
  Seed: SGPQNDGKEL (SSX2_HUMAN)
SSPQNDGKEL

SEQ ID NO: 164021 - protein, 9 aa, Artificial Sequence
  Description of Artificial Sequence: Synthetic peptide
  Seed: TTSEKIHER (SSX2_HUMAN)
TQSEKIHEI

SEQ ID NO: 164022 - protein, 9 aa, Artificial Sequence
  Description of Artificial Sequence: Synthetic peptide
  Seed: KASEKIFYV (SSX2_HUMAN)
KQSEKIFYV

SEQ ID NO: 164023 - protein, 9 aa, Artificial Sequence
  Description of Artificial Sequence: Synthetic peptide
  Seed: DAFARRPTV (SSX2_HUMAN)
DLFARRPTM

SEQ ID NO: 164024 - protein, 9 aa, Artificial Sequence
  Description of Artificial Sequence: Synthetic peptide
  Seed: KIHERSGPK (SSX2_HUMAN)
KFHERSGPK

SEQ ID NO: 164025 - protein, 9 aa, Artificial Sequence
  Description of Artificial Sequence: Synthetic peptide
  Seed: RLQGISPKI (SSX2_HUMAN)
RQQGISPKF

SEQ ID NO: 164026 - protein, 11 aa, Artificial Sequence
  Description of Artificial Sequence: Synthetic peptide
  Seed: KMKASEKIFYV (SSX2_HUMAN)
KVKASEKIFYK

SEQ ID NO: 164027 - protein, 10 aa, Artificial Sequence
  Description of Artificial Sequence: Synthetic peptide
  Seed: MTKLGFKATL (SSX2_HUMAN)
MDKLGFKATY

SEQ ID NO: 164028 - protein, 9 aa, Artificial Sequence
  Description of Artificial Sequence: Synthetic peptide
  Seed: RLRERKQLV (SSX2_HUMAN)
RIRERKQLA

SEQ ID NO: 164029 - protein, 10 aa, Artificial Sequence
  Description of Artificial Sequence: Synthetic peptide
  Seed: KIFYVYMKRK (SSX2_HUMAN)
KSFYVYMKRR

SEQ ID NO: 164030 - protein, 10 aa, Artificial Sequence
  Description of Artificial Sequence: Synthetic peptide
  Seed: RPQMTFGRLQ (SSX2_HUMAN)
RPQMTFGRLA

SEQ ID NO: 164031 - protein, 8 aa, Artificial Sequence
  Description of Artificial Sequence: Synthetic peptide
  Seed: YMKRKYEA (SSX2_HUMAN)
YLKRKYEF

SEQ ID NO: 164032 - protein, 9 aa, Artificial Sequence
  Description of Artificial Sequence: Synthetic peptide
  Seed: QVERPQMTF (SSX2_HUMAN)
QMERPQMTY

SEQ ID NO: 164033 - protein, 10 aa, Artificial Sequence
  Description of Artificial Sequence: Synthetic peptide
  Seed: KAFDDIAKYF (SSX2_HUMAN)
KIFDDIAKYR

SEQ ID NO: 164034 - protein, 8 aa, Artificial Sequence
  Description of Artificial Sequence: Synthetic peptide
  Seed: YMKRKYEA (SSX2_HUMAN)
YVKRKYEV

SEQ ID NO: 164035 - protein, 9 aa, Artificial Sequence
  Description of Artificial Sequence: Synthetic peptide
  Seed: FKATLPPFM (SSX2_HUMAN)
FKATLPPFF

SEQ ID NO: 164036 - protein, 9 aa, Artificial Sequence
  Description of Artificial Sequence: Synthetic peptide
  Seed: KIFYVYMKR (SSX2_HUMAN)
KGFYVYMKR

SEQ ID NO: 164037 - protein, 9 aa, Artificial Sequence
  Description of Artificial Sequence: Synthetic peptide
  Seed: MTFGRLQGI (SSX2_HUMAN)
MTFGRLQGM

SEQ ID NO: 164038 - protein, 10 aa, Artificial Sequence
  Description of Artificial Sequence: Synthetic peptide
  Seed: KYFSKEEWEK (SSX2_HUMAN)
KVFSKEEWEK

SEQ ID NO: 164039 - protein, 10 aa, Artificial Sequence
  Description of Artificial Sequence: Synthetic peptide
  Seed: KIFYVYMKRK (SSX2_HUMAN)
KMFYVYMKRY

SEQ ID NO: 164040 - protein, 10 aa, Artificial Sequence
  Description of Artificial Sequence: Synthetic peptide
  Seed: ASEKIFYVYM (SSX2_HUMAN)
ASEKIFYVYK

SEQ ID NO: 164041 - protein, 9 aa, Artificial Sequence
  Description of Artificial Sequence: Synthetic peptide
  Seed: YEAMTKLGF (SSX2_HUMAN)
YVAMTKLGF

SEQ ID NO: 164042 - protein, 10 aa, Artificial Sequence
  Description of Artificial Sequence: Synthetic peptide
  Seed: KIFYVYMKRK (SSX2_HUMAN)
KMFYVYMKRL

SEQ ID NO: 164043 - protein, 10 aa, Artificial Sequence
  Description of Artificial Sequence: Synthetic peptide
  Seed: MTKLGFKATL (SSX2_HUMAN)
MYKLGFKATY

SEQ ID NO: 164044 - protein, 10 aa, Artificial Sequence
  Description of Artificial Sequence: Synthetic peptide
  Seed: KAFDDIAKYF (SSX2_HUMAN)
KLFDDIAKYY

SEQ ID NO: 164045 - protein, 9 aa, Artificial Sequence
  Description of Artificial Sequence: Synthetic peptide
  Seed: FARRPTVGA (SSX2_HUMAN)
FSRRPTVGA

SEQ ID NO: 164046 - protein, 9 aa, Artificial Sequence
  Description of Artificial Sequence: Synthetic peptide
  Seed: KRGEHAWTH (SSX2_HUMAN)
KYGEHAWTY

SEQ ID NO: 164047 - protein, 10 aa, Artificial Sequence
  Description of Artificial Sequence: Synthetic peptide
  Seed: GRLQGISPKI (SSX2_HUMAN)
GVLQGISPKV

SEQ ID NO: 164048 - protein, 9 aa, Artificial Sequence
  Description of Artificial Sequence: Synthetic peptide
  Seed: AMTKLGFKA (SSX2_HUMAN)
AMTKLGFKV

SEQ ID NO: 164049 - protein, 9 aa, Artificial Sequence
  Description of Artificial Sequence: Synthetic peptide
  Seed: EHAWTHRLR (SSX2_HUMAN)
EWAWTHRLR

SEQ ID NO: 164050 - protein, 9 aa, Artificial Sequence
  Description of Artificial Sequence: Synthetic peptide
  Seed: YMKRKYEAM (SSX2_HUMAN)
YLKRKYEAL

SEQ ID NO: 164051 - protein, 9 aa, Artificial Sequence
  Description of Artificial Sequence: Synthetic peptide
  Seed: GISPKIMPK (SSX2_HUMAN)
GSSPKIMPM

SEQ ID NO: 164052 - protein, 9 aa, Artificial Sequence
  Description of Artificial Sequence: Synthetic peptide
  Seed: SEEVPEASG (SSX2_HUMAN)
SEEVPEASL

SEQ ID NO: 164053 - protein, 9 aa, Artificial Sequence
  Description of Artificial Sequence: Synthetic peptide
  Seed: KASEKIFYV (SSX2_HUMAN)
KISEKIFYW

SEQ ID NO: 164054 - protein, 11 aa, Artificial Sequence
  Description of Artificial Sequence: Synthetic peptide
  Seed: KMKASEKIFYV (SSX2_HUMAN)
KAKASEKIFYK

SEQ ID NO: 164055 - protein, 10 aa, Artificial Sequence
  Description of Artificial Sequence: Synthetic peptide
  Seed: KMKASEKIFY (SSX2_HUMAN)
KYKASEKIFK

SEQ ID NO: 164056 - protein, 10 aa, Artificial Sequence
  Description of Artificial Sequence: Synthetic peptide
  Seed: MTKLGFKATL (SSX2_HUMAN)
MMKLGFKATF

SEQ ID NO: 164057 - protein, 9 aa, Artificial Sequence
  Description of Artificial Sequence: Synthetic peptide
  Seed: RLQGISPKI (SSX2_HUMAN)
RIQGISPKW

SEQ ID NO: 164058 - protein, 9 aa, Artificial Sequence
  Description of Artificial Sequence: Synthetic peptide
  Seed: YMKRKYEAM (SSX2_HUMAN)
YAKRKYEAV

SEQ ID NO: 164059 - protein, 10 aa, Artificial Sequence
  Description of Artificial Sequence: Synthetic peptide
  Seed: KASEKIFYVY (SSX2_HUMAN)
KMSEKIFYVM

SEQ ID NO: 164060 - protein, 9 aa, Artificial Sequence
  Description of Artificial Sequence: Synthetic peptide
  Seed: QIPEKIQKA (SSX2_HUMAN)
QAPEKIQKR

SEQ ID NO: 164061 - protein, 9 aa, Artificial Sequence
  Description of Artificial Sequence: Synthetic peptide
  Seed: RKYEAMTKL (SSX2_HUMAN)
RAYEAMTKM

SEQ ID NO: 164062 - protein, 9 aa, Artificial Sequence
  Description of Artificial Sequence: Synthetic peptide
  Seed: RLRERKQLV (SSX2_HUMAN)
RTRERKQLK

SEQ ID NO: 164063 - protein, 9 aa, Artificial Sequence
  Description of Artificial Sequence: Synthetic peptide
  Seed: RLQGISPKI (SSX2_HUMAN)
RMQGISPKV

SEQ ID NO: 164064 - protein, 9 aa, Artificial Sequence
  Description of Artificial Sequence: Synthetic peptide
  Seed: FARRPTVGA (SSX2_HUMAN)
FTRRPTVGF

SEQ ID NO: 164065 - protein, 9 aa, Artificial Sequence
  Description of Artificial Sequence: Synthetic peptide
  Seed: MTFGRLQGI (SSX2_HUMAN)
MQFGRLQGV

SEQ ID NO: 164066 - protein, 9 aa, Artificial Sequence
  Description of Artificial Sequence: Synthetic peptide
  Seed: GFKATLPPF (SSX2_HUMAN)
GVKATLPPF

SEQ ID NO: 164067 - protein, 9 aa, Artificial Sequence
  Description of Artificial Sequence: Synthetic peptide
  Seed: KIFYVYMKR (SSX2_HUMAN)
KTFYVYMKI

SEQ ID NO: 164068 - protein, 9 aa, Artificial Sequence
  Description of Artificial Sequence: Synthetic peptide
  Seed: FKATLPPFM (SSX2_HUMAN)
FQATLPPFL

SEQ ID NO: 164069 - protein, 9 aa, Artificial Sequence
  Description of Artificial Sequence: Synthetic peptide
  Seed: RLRERKQLV (SSX2_HUMAN)
RFRERKQLK

SEQ ID NO: 164070 - protein, 10 aa, Artificial Sequence
  Description of Artificial Sequence: Synthetic peptide
  Seed: YMKRKYEAMT (SSX2_HUMAN)
YLKRKYEAML

SEQ ID NO: 164071 - protein, 9 aa, Artificial Sequence
  Description of Artificial Sequence: Synthetic peptide
  Seed: EAMTKLGFK (SSX2_HUMAN)
EYMTKLGFK

SEQ ID NO: 164072 - protein, 10 aa, Artificial Sequence
  Description of Artificial Sequence: Synthetic peptide
  Seed: ARRPTVGAQI (SSX2_HUMAN)
ARRPTVGAQY

SEQ ID NO: 164073 - protein, 9 aa, Artificial Sequence
  Description of Artificial Sequence: Synthetic peptide
  Seed: RLRERKQLV (SSX2_HUMAN)
RSRERKQLA

SEQ ID NO: 164074 - protein, 8 aa, Artificial Sequence
  Description of Artificial Sequence: Synthetic peptide
  Seed: AFDDIAKY (SSX2_HUMAN)
ATDDIAKV

SEQ ID NO: 164075 - protein, 10 aa, Artificial Sequence
  Description of Artificial Sequence: Synthetic peptide
  Seed: YMKRKYEAMT (SSX2_HUMAN)
YMKRKYEAMK

SEQ ID NO: 164076 - protein, 9 aa, Artificial Sequence
  Description of Artificial Sequence: Synthetic peptide
  Seed: AFDDIAKYF (SSX2_HUMAN)
AADDIAKYC

SEQ ID NO: 164077 - protein, 9 aa, Artificial Sequence
  Description of Artificial Sequence: Synthetic peptide
  Seed: DAFARRPTV (SSX2_HUMAN)
DRFARRPTI

SEQ ID NO: 164078 - protein, 9 aa, Artificial Sequence
  Description of Artificial Sequence: Synthetic peptide
  Seed: RERKQLVIY (SSX2_HUMAN)
RERKQLVIW

SEQ ID NO: 164079 - protein, 10 aa, Artificial Sequence
  Description of Artificial Sequence: Synthetic peptide
  Seed: QMTFGRLQGI (SSX2_HUMAN)
QATFGRLQGV

SEQ ID NO: 164080 - protein, 9 aa, Artificial Sequence
  Description of Artificial Sequence: Synthetic peptide
  Seed: DAFARRPTV (SSX2_HUMAN)
DSFARRPTI

SEQ ID NO: 164081 - protein, 9 aa, Artificial Sequence
  Description of Artificial Sequence: Synthetic peptide
  Seed: KASEKIFYV (SSX2_HUMAN)
KVSEKIFYC

SEQ ID NO: 164082 - protein, 10 aa, Artificial Sequence
  Description of Artificial Sequence: Synthetic peptide
  Seed: EKIFYVYMKR (SSX2_HUMAN)
EPIFYVYMKK

SEQ ID NO: 164083 - protein, 9 aa, Artificial Sequence
  Description of Artificial Sequence: Synthetic peptide
  Seed: EHAWTHRLR (SSX2_HUMAN)
EFAWTHRLR

SEQ ID NO: 164084 - protein, 10 aa, Artificial Sequence
  Description of Artificial Sequence: Synthetic peptide
  Seed: SPKIMPKKPA (SSX2_HUMAN)
SPKIMPKKPM

SEQ ID NO: 164085 - protein, 9 aa, Artificial Sequence
  Description of Artificial Sequence: Synthetic peptide
  Seed: AQIPEKIQK (SSX2_HUMAN)
AMIPEKIQM

SEQ ID NO: 164086 - protein, 9 aa, Artificial Sequence
  Description of Artificial Sequence: Synthetic peptide
  Seed: YMKRKYEAM (SSX2_HUMAN)
YQKRKYEAM

SEQ ID NO: 164087 - protein, 9 aa, Artificial Sequence
  Description of Artificial Sequence: Synthetic peptide
  Seed: RERKQLVIY (SSX2_HUMAN)
RERKQLVIL

SEQ ID NO: 164088 - protein, 10 aa, Artificial Sequence
  Description of Artificial Sequence: Synthetic peptide
  Seed: KAFDDIAKYF (SSX2_HUMAN)
KTFDDIAKYF

SEQ ID NO: 164089 - protein, 9 aa, Artificial Sequence
  Description of Artificial Sequence: Synthetic peptide
  Seed: ISPKIMPKK (SSX2_HUMAN)
ITPKIMPKK

SEQ ID NO: 164090 - protein, 9 aa, Artificial Sequence
  Description of Artificial Sequence: Synthetic peptide
  Seed: RERKQLVIY (SSX2_HUMAN)
RLRKQLVIM

SEQ ID NO: 164091 - protein, 10 aa, Artificial Sequence
  Description of Artificial Sequence: Synthetic peptide
  Seed: HAWTHRLRER (SSX2_HUMAN)
HVWTHRLRER

SEQ ID NO: 164092 - protein, 10 aa, Artificial Sequence
  Description of Artificial Sequence: Synthetic peptide
  Seed: KASEKIFYVY (SSX2_HUMAN)
KSSEKIFYVY

SEQ ID NO: 164093 - protein, 9 aa, Artificial Sequence
  Description of Artificial Sequence: Synthetic peptide
  Seed: KASEKIFYV (SSX2_HUMAN)
KFSEKIFYF

SEQ ID NO: 164094 - protein, 9 aa, Artificial Sequence
  Description of Artificial Sequence: Synthetic peptide
  Seed: RRPTVGAQI (SSX2_HUMAN)
RAPTVGAQF

SEQ ID NO: 164095 - protein, 9 aa, Artificial Sequence
  Description of Artificial Sequence: Synthetic peptide
  Seed: AFDDIAKYF (SSX2_HUMAN)
AWDDIAKYM

SEQ ID NO: 164096 - protein, 9 aa, Artificial Sequence
  Description of Artificial Sequence: Synthetic peptide
  Seed: TTSEKIHER (SSX2_HUMAN)
TMSEKIHEF

SEQ ID NO: 164097 - protein, 9 aa, Artificial Sequence
  Description of Artificial Sequence: Synthetic peptide
  Seed: FARRPTVGA (SSX2_HUMAN)
FPRRPTVGG

SEQ ID NO: 164098 - protein, 9 aa, Artificial Sequence
  Description of Artificial Sequence: Synthetic peptide
  Seed: AFDDIAKYF (SSX2_HUMAN)
AEDDIAKYF

SEQ ID NO: 164099 - protein, 9 aa, Artificial Sequence
  Description of Artificial Sequence: Synthetic peptide
  Seed: RLQGISPKI (SSX2_HUMAN)
RWQGISPKY

SEQ ID NO: 164100 - protein, 10 aa, Artificial Sequence
  Description of Artificial Sequence: Synthetic peptide
  Seed: YMKRKYEAMT (SSX2_HUMAN)
YPKRKYEAMI

SEQ ID NO: 164101 - protein, 8 aa, Artificial Sequence
  Description of Artificial Sequence: Synthetic peptide
  Seed: AFDDIAKY (SSX2_HUMAN)
ATDDIAKY

SEQ ID NO: 164102 - protein, 10 aa, Artificial Sequence
  Description of Artificial Sequence: Synthetic peptide
  Seed: KAFDDIAKYF (SSX2_HUMAN)
KSFDDIAKYW

SEQ ID NO: 164103 - protein, 10 aa, Artificial Sequence
  Description of Artificial Sequence: Synthetic peptide
  Seed: EASGPQNDGK (SSX2_HUMAN)
EVSGPQNDGR

SEQ ID NO: 164104 - protein, 11 aa, Artificial Sequence
  Description of Artificial Sequence: Synthetic peptide
  Seed: FGRLQGISPKI (SSX2_HUMAN)
FFRLQGISPKV

SEQ ID NO: 164105 - protein, 9 aa, Artificial Sequence
  Description of Artificial Sequence: Synthetic peptide
  Seed: VGAQIPEKI (SSX2_HUMAN)
VPAQIPEKI

SEQ ID NO: 164106 - protein, 9 aa, Artificial Sequence
  Description of Artificial Sequence: Synthetic peptide
  Seed: TTSEKIHER (SSX2_HUMAN)
TASEKIHEW

SEQ ID NO: 164107 - protein, 11 aa, Artificial Sequence
  Description of Artificial Sequence: Synthetic peptide
  Seed: YVYMKRKYEAM (SSX2_HUMAN)
YWYMKRKYEAL

SEQ ID NO: 164108 - protein, 9 aa, Artificial Sequence
  Description of Artificial Sequence: Synthetic peptide
  Seed: NDSEEVPEA (SSX2_HUMAN)
NESEEVPEL

SEQ ID NO: 164109 - protein, 9 aa, Artificial Sequence
  Description of Artificial Sequence: Synthetic peptide
  Seed: AEDFQGNDL (SSX2_HUMAN)
ASDFQGNDI

SEQ ID NO: 164110 - protein, 9 aa, Artificial Sequence
  Description of Artificial Sequence: Synthetic peptide
  Seed: YMKRKYEAM (SSX2_HUMAN)
YIKRKYEAI

SEQ ID NO: 164111 - protein, 9 aa, Artificial Sequence
  Description of Artificial Sequence: Synthetic peptide
  Seed: KAFDDIAKY (SSX2_HUMAN)
KTFDDIAKR

SEQ ID NO: 164112 - protein, 10 aa, Artificial Sequence
  Description of Artificial Sequence: Synthetic peptide
  Seed: DGKELCPPGK (SSX2_HUMAN)
DYKELCPPGR

SEQ ID NO: 164113 - protein, 8 aa, Artificial Sequence
  Description of Artificial Sequence: Synthetic peptide
  Seed: YMKRKYEA (SSX2_HUMAN)
YIKRKYEF

SEQ ID NO: 164114 - protein, 9 aa, Artificial Sequence
  Description of Artificial Sequence: Synthetic peptide
  Seed: RLQGISPKI (SSX2_HUMAN)
RLQGISPKR

SEQ ID NO: 164115 - protein, 10 aa, Artificial Sequence
  Description of Artificial Sequence: Synthetic peptide
  Seed: KMKASEKIFY (SSX2_HUMAN)
KSKASEKIFL

SEQ ID NO: 164116 - protein, 9 aa, Artificial Sequence
  Description of Artificial Sequence: Synthetic peptide
  Seed: AFDDIAKYF (SSX2_HUMAN)
AWDDIAKYV

SEQ ID NO: 164117 - protein, 9 aa, Artificial Sequence
  Description of Artificial Sequence: Synthetic peptide
  Seed: AFDDIAKYF (SSX2_HUMAN)
AQDDIAKYY

SEQ ID NO: 164118 - protein, 9 aa, Artificial Sequence
  Description of Artificial Sequence: Synthetic peptide
  Seed: KAFDDIAKY (SSX2_HUMAN)
KMFDDIAKF

SEQ ID NO: 164119 - protein, 9 aa, Artificial Sequence
  Description of Artificial Sequence: Synthetic peptide
  Seed: TTSEKIHER (SSX2_HUMAN)
TSSEKIHEK

SEQ ID NO: 164120 - protein, 10 aa, Artificial Sequence
  Description of Artificial Sequence: Synthetic peptide
  Seed: IAKYFSKEEW (SSX2_HUMAN)
ISKYFSKEEF

SEQ ID NO: 164121 - protein, 10 aa, Artificial Sequence
  Description of Artificial Sequence: Synthetic peptide
  Seed: LGFKATLPPF (SSX2_HUMAN)
LTFKATLPPW

SEQ ID NO: 164122 - protein, 9 aa, Artificial Sequence
  Description of Artificial Sequence: Synthetic peptide
  Seed: SEEVPEASG (SSX2_HUMAN)
SEEVPEASM

SEQ ID NO: 164123 - protein, 11 aa, Artificial Sequence
  Description of Artificial Sequence: Synthetic peptide
  Seed: YVYMKRKYEAM (SSX2_HUMAN)
YEYMKRKYEAL

SEQ ID NO: 164124 - protein, 9 aa, Artificial Sequence
  Description of Artificial Sequence: Synthetic peptide
  Seed: GPKRGEHAW (SSX2_HUMAN)
GPKRGEHAV

SEQ ID NO: 164125 - protein, 9 aa, Artificial Sequence
  Description of Artificial Sequence: Synthetic peptide
  Seed: MTFGRLQGI (SSX2_HUMAN)
MMFGRLQGW

SEQ ID NO: 164126 - protein, 10 aa, Artificial Sequence
  Description of Artificial Sequence: Synthetic peptide
  Seed: VYMKRKYEAM (SSX2_HUMAN)
VPMKRKYEAM

SEQ ID NO: 164127 - protein, 11 aa, Artificial Sequence
  Description of Artificial Sequence: Synthetic peptide
  Seed: FGRLQGISPKI (SSX2_HUMAN)
FKRLQGISPKL

SEQ ID NO: 164128 - protein, 9 aa, Artificial Sequence
  Description of Artificial Sequence: Synthetic peptide
  Seed: EEVPEASGP (SSX2_HUMAN)
EEVPEASGA

SEQ ID NO: 164129 - protein, 10 aa, Artificial Sequence
  Description of Artificial Sequence: Synthetic peptide
  Seed: LGFKATLPPF (SSX2_HUMAN)
LEFKATLPPY

SEQ ID NO: 164130 - protein, 10 aa, Artificial Sequence
  Description of Artificial Sequence: Synthetic peptide
  Seed: QMTFGRLQGI (SSX2_HUMAN)
QMTFGRLQGV

SEQ ID NO: 164131 - protein, 9 aa, Artificial Sequence
  Description of Artificial Sequence: Synthetic peptide
  Seed: SEKIFYVYM (SSX2_HUMAN)
SEKIFYVYW

SEQ ID NO: 164132 - protein, 9 aa, Artificial Sequence
  Description of Artificial Sequence: Synthetic peptide
  Seed: EEWEKMKAS (SSX2_HUMAN)
EEWEKMKAA

SEQ ID NO: 164133 - protein, 9 aa, Artificial Sequence
  Description of Artificial Sequence: Synthetic peptide
  Seed: QVERPQMTF (SSX2_HUMAN)
QAERPQMTW

SEQ ID NO: 164134 - protein, 9 aa, Artificial Sequence
  Description of Artificial Sequence: Synthetic peptide
  Seed: MTFGRLQGI (SSX2_HUMAN)
MTFGRLQGT

SEQ ID NO: 164135 - protein, 8 aa, Artificial Sequence
  Description of Artificial Sequence: Synthetic peptide
  Seed: AFDDIAKY (SSX2_HUMAN)
ACDDIAKL

SEQ ID NO: 164136 - protein, 8 aa, Artificial Sequence
  Description of Artificial Sequence: Synthetic peptide
  Seed: TSEKIHER (SSX2_HUMAN)
TTEKIHEY

SEQ ID NO: 164137 - protein, 10 aa, Artificial Sequence
  Description of Artificial Sequence: Synthetic peptide
  Seed: MTKLGFKATL (SSX2_HUMAN)
MPKLGFKATY

SEQ ID NO: 164138 - protein, 9 aa, Artificial Sequence
  Description of Artificial Sequence: Synthetic peptide
  Seed: AKYFSKEEW (SSX2_HUMAN)
AMYFSKEEF

SEQ ID NO: 164139 - protein, 9 aa, Artificial Sequence
  Description of Artificial Sequence: Synthetic peptide
  Seed: AQIPEKIQK (SSX2_HUMAN)
ASIPEKIQL

SEQ ID NO: 164140 - protein, 10 aa, Artificial Sequence
  Description of Artificial Sequence: Synthetic peptide
  Seed: MKASEKIFYV (SSX2_HUMAN)
MLASEKIFYI

SEQ ID NO: 164141 - protein, 9 aa, Artificial Sequence
  Description of Artificial Sequence: Synthetic peptide
  Seed: VGAQIPEKI (SSX2_HUMAN)
VAAQIPEKV

SEQ ID NO: 164142 - protein, 10 aa, Artificial Sequence
  Description of Artificial Sequence: Synthetic peptide
  Seed: QGISPKIMPK (SSX2_HUMAN)
QAISPKIMPK

SEQ ID NO: 164143 - protein, 9 aa, Artificial Sequence
  Description of Artificial Sequence: Synthetic peptide
  Seed: FARRPTVGA (SSX2_HUMAN)
FPRRPTVGV

SEQ ID NO: 164144 - protein, 9 aa, Artificial Sequence
  Description of Artificial Sequence: Synthetic peptide
  Seed: GFKATLPPF (SSX2_HUMAN)
GQKATLPPL

SEQ ID NO: 164145 - protein, 9 aa, Artificial Sequence
  Description of Artificial Sequence: Synthetic peptide
  Seed: KASEKIFYV (SSX2_HUMAN)
KSSEKIFYY

SEQ ID NO: 164146 - protein, 10 aa, Artificial Sequence
  Description of Artificial Sequence: Synthetic peptide
  Seed: EKIFYVYMKR (SSX2_HUMAN)
EAIFYVYMKR

SEQ ID NO: 164147 - protein, 9 aa, Artificial Sequence
  Description of Artificial Sequence: Synthetic peptide
  Seed: RERKQLVIY (SSX2_HUMAN)
RKRKQLVIM

SEQ ID NO: 164148 - protein, 9 aa, Artificial Sequence
  Description of Artificial Sequence: Synthetic peptide
  Seed: AFDDIAKYF (SSX2_HUMAN)
AADDIAKYY

SEQ ID NO: 164149 - protein, 9 aa, Artificial Sequence
  Description of Artificial Sequence: Synthetic peptide
  Seed: AFDDIAKYF (SSX2_HUMAN)
AFDDIAKYI

SEQ ID NO: 164150 - protein, 9 aa, Artificial Sequence
  Description of Artificial Sequence: Synthetic peptide
  Seed: YFSKEEWEK (SSX2_HUMAN)
YASKEEWEF

SEQ ID NO: 164151 - protein, 9 aa, Artificial Sequence
  Description of Artificial Sequence: Synthetic peptide
  Seed: TTSEKIHER (SSX2_HUMAN)
TFSEKIHEY

SEQ ID NO: 164152 - protein, 9 aa, Artificial Sequence
  Description of Artificial Sequence: Synthetic peptide
  Seed: DAFARRPTV (SSX2_HUMAN)
DPFARRPTV

SEQ ID NO: 164153 - protein, 10 aa, Artificial Sequence
  Description of Artificial Sequence: Synthetic peptide
  Seed: QGISPKIMPK (SSX2_HUMAN)
QTISPKIMPR

SEQ ID NO: 164154 - protein, 9 aa, Artificial Sequence
  Description of Artificial Sequence: Synthetic peptide
  Seed: QVERPQMTF (SSX2_HUMAN)
QQERPQMTL

SEQ ID NO: 164155 - protein, 10 aa, Artificial Sequence
  Description of Artificial Sequence: Synthetic peptide
  Seed: QGISPKIMPK (SSX2_HUMAN)
QKISPKIMPK

SEQ ID NO: 164156 - protein, 9 aa, Artificial Sequence
  Description of Artificial Sequence: Synthetic peptide
  Seed: RLQGISPKI (SSX2_HUMAN)
RTQGISPKR

SEQ ID NO: 164157 - protein, 10 aa, Artificial Sequence
  Description of Artificial Sequence: Synthetic peptide
  Seed: RKQLVIYEEI (SSX2_HUMAN)
RRQLVIYEEF

SEQ ID NO: 164158 - protein, 10 aa, Artificial Sequence
  Description of Artificial Sequence: Synthetic peptide
  Seed: KAFDDIAKYF (SSX2_HUMAN)
KSFDDIAKYL

SEQ ID NO: 164159 - protein, 10 aa, Artificial Sequence
  Description of Artificial Sequence: Synthetic peptide
  Seed: LGFKATLPPF (SSX2_HUMAN)
LRFKATLPPF

SEQ ID NO: 164160 - protein, 9 aa, Artificial Sequence
  Description of Artificial Sequence: Synthetic peptide
  Seed: TTSEKIHER (SSX2_HUMAN)
TISEKIHEL

SEQ ID NO: 164161 - protein, 9 aa, Artificial Sequence
  Description of Artificial Sequence: Synthetic peptide
  Seed: TTSEKIHER (SSX2_HUMAN)
TRSEKIHEL

SEQ ID NO: 164162 - protein, 9 aa, Artificial Sequence
  Description of Artificial Sequence: Synthetic peptide
  Seed: AEDFQGNDL (SSX2_HUMAN)
AIDFQGNDI

SEQ ID NO: 164163 - protein, 9 aa, Artificial Sequence
  Description of Artificial Sequence: Synthetic peptide
  Seed: KQLVIYEEI (SSX2_HUMAN)
KRLVIYEEV

SEQ ID NO: 164164 - protein, 9 aa, Artificial Sequence
  Description of Artificial Sequence: Synthetic peptide
  Seed: KAFDDIAKY (SSX2_HUMAN)
KMFDDIAKW

SEQ ID NO: 164165 - protein, 9 aa, Artificial Sequence
  Description of Artificial Sequence: Synthetic peptide
  Seed: KASEKIFYV (SSX2_HUMAN)
KMSEKIFYF

SEQ ID NO: 164166 - protein, 9 aa, Artificial Sequence
  Description of Artificial Sequence: Synthetic peptide
  Seed: AFDDIAKYF (SSX2_HUMAN)
ANDDIAKYL

SEQ ID NO: 164167 - protein, 9 aa, Artificial Sequence
  Description of Artificial Sequence: Synthetic peptide
  Seed: AFDDIAKYF (SSX2_HUMAN)
AMDDIAKYV

SEQ ID NO: 164168 - protein, 10 aa, Artificial Sequence
  Description of Artificial Sequence: Synthetic peptide
  Seed: GISPKIMPKK (SSX2_HUMAN)
GMSPKIMPKK

SEQ ID NO: 164169 - protein, 9 aa, Artificial Sequence
  Description of Artificial Sequence: Synthetic peptide
  Seed: AEDFQGNDL (SSX2_HUMAN)
ATDFQGNDI

SEQ ID NO: 164170 - protein, 10 aa, Artificial Sequence
  Description of Artificial Sequence: Synthetic peptide
  Seed: KRGEHAWTHR (SSX2_HUMAN)
KQGEHAWTHR

SEQ ID NO: 164171 - protein, 9 aa, Artificial Sequence
  Description of Artificial Sequence: Synthetic peptide
  Seed: KAFDDIAKY (SSX2_HUMAN)
KQFDDIAKK

SEQ ID NO: 164172 - protein, 9 aa, Artificial Sequence
  Description of Artificial Sequence: Synthetic peptide
  Seed: DAFARRPTV (SSX2_HUMAN)
DHFARRPTM

SEQ ID NO: 164173 - protein, 10 aa, Artificial Sequence
  Description of Artificial Sequence: Synthetic peptide
  Seed: HAWTHRLRER (SSX2_HUMAN)
HTWTHRLREK

SEQ ID NO: 164174 - protein, 9 aa, Artificial Sequence
  Description of Artificial Sequence: Synthetic peptide
  Seed: KAFDDIAKY (SSX2_HUMAN)
KPFDDIAKW

SEQ ID NO: 164175 - protein, 10 aa, Artificial Sequence
  Description of Artificial Sequence: Synthetic peptide
  Seed: KAFDDIAKYF (SSX2_HUMAN)
KSFDDIAKYV

SEQ ID NO: 164176 - protein, 10 aa, Artificial Sequence
  Description of Artificial Sequence: Synthetic peptide
  Seed: MTKLGFKATL (SSX2_HUMAN)
MSKLGFKATW

SEQ ID NO: 164177 - protein, 10 aa, Artificial Sequence
  Description of Artificial Sequence: Synthetic peptide
  Seed: MKASEKIFYV (SSX2_HUMAN)
MLASEKIFYM

SEQ ID NO: 164178 - protein, 9 aa, Artificial Sequence
  Description of Artificial Sequence: Synthetic peptide
  Seed: AFDDIAKYF (SSX2_HUMAN)
AADDIAKYI

SEQ ID NO: 164179 - protein, 10 aa, Artificial Sequence
  Description of Artificial Sequence: Synthetic peptide
  Seed: MKASEKIFYV (SSX2_HUMAN)
MLASEKIFYT

SEQ ID NO: 164180 - protein, 9 aa, Artificial Sequence
  Description of Artificial Sequence: Synthetic peptide
  Seed: AFDDIAKYF (SSX2_HUMAN)
AMDDIAKYF

SEQ ID NO: 164181 - protein, 9 aa, Artificial Sequence
  Description of Artificial Sequence: Synthetic peptide
  Seed: KASEKIFYV (SSX2_HUMAN)
KQSEKIFYR

SEQ ID NO: 164182 - protein, 11 aa, Artificial Sequence
  Description of Artificial Sequence: Synthetic peptide
  Seed: KATLPPFMCNK (SSX2_HUMAN)
KSTLPPFMCNR

SEQ ID NO: 164183 - protein, 9 aa, Artificial Sequence
  Description of Artificial Sequence: Synthetic peptide
  Seed: TTSEKIHER (SSX2_HUMAN)
TISEKIHEV

SEQ ID NO: 164184 - protein, 10 aa, Artificial Sequence
  Description of Artificial Sequence: Synthetic peptide
  Seed: KRGEHAWTHR (SSX2_HUMAN)
KMGEHAWTHR

SEQ ID NO: 164185 - protein, 9 aa, Artificial Sequence
  Description of Artificial Sequence: Synthetic peptide
  Seed: QVERPQMTF (SSX2_HUMAN)
QTERPQMTY

SEQ ID NO: 164186 - protein, 9 aa, Artificial Sequence
  Description of Artificial Sequence: Synthetic peptide
  Seed: KMKASEKIF (SSX2_HUMAN)
KQKASEKIF

SEQ ID NO: 164187 - protein, 9 aa, Artificial Sequence
  Description of Artificial Sequence: Synthetic peptide
  Seed: KASEKIFYV (SSX2_HUMAN)
KSSEKIFYA

SEQ ID NO: 164188 - protein, 9 aa, Artificial Sequence
  Description of Artificial Sequence: Synthetic peptide
  Seed: AFDDIAKYF (SSX2_HUMAN)
ANDDIAKYF

SEQ ID NO: 164189 - protein, 9 aa, Artificial Sequence
  Description of Artificial Sequence: Synthetic peptide
  Seed: FKATLPPFM (SSX2_HUMAN)
FKATLPPFY

SEQ ID NO: 164190 - protein, 10 aa, Artificial Sequence
  Description of Artificial Sequence: Synthetic peptide
  Seed: YVYMKRKYEA (SSX2_HUMAN)
YAYMKRKYEM

SEQ ID NO: 164191 - protein, 11 aa, Artificial Sequence
  Description of Artificial Sequence: Synthetic peptide
  Seed: KMKASEKIFYV (SSX2_HUMAN)
KYKASEKIFYK

SEQ ID NO: 164192 - protein, 9 aa, Artificial Sequence
  Description of Artificial Sequence: Synthetic peptide
  Seed: FSKEEWEKM (SSX2_HUMAN)
FTKEEWEKL

SEQ ID NO: 164193 - protein, 8 aa, Artificial Sequence
  Description of Artificial Sequence: Synthetic peptide
  Seed: VGAQIPEK (SSX2_HUMAN)
VSAQIPEL

SEQ ID NO: 164194 - protein, 9 aa, Artificial Sequence
  Description of Artificial Sequence: Synthetic peptide
  Seed: KAFDDIAKY (SSX2_HUMAN)
KKFDDIAKF

SEQ ID NO: 164195 - protein, 10 aa, Artificial Sequence
  Description of Artificial Sequence: Synthetic peptide
  Seed: HAWTHRLRER (SSX2_HUMAN)
HMWTHRLRER

SEQ ID NO: 164196 - protein, 9 aa, Artificial Sequence
  Description of Artificial Sequence: Synthetic peptide
  Seed: KAFDDIAKY (SSX2_HUMAN)
KSFDDIAKW

SEQ ID NO: 164197 - protein, 9 aa, Artificial Sequence
  Description of Artificial Sequence: Synthetic peptide
  Seed: KRKYEAMTK (SSX2_HUMAN)
KTKYEAMTA

SEQ ID NO: 164198 - protein, 9 aa, Artificial Sequence
  Description of Artificial Sequence: Synthetic peptide
  Seed: AQIPEKIQK (SSX2_HUMAN)
ARIPEKIQM

SEQ ID NO: 164199 - protein, 9 aa, Artificial Sequence
  Description of Artificial Sequence: Synthetic peptide
  Seed: FARRPTVGA (SSX2_HUMAN)
FPRRPTVGA

SEQ ID NO: 164200 - protein, 10 aa, Artificial Sequence
  Description of Artificial Sequence: Synthetic peptide
  Seed: KMKASEKIFY (SSX2_HUMAN)
KIKASEKIFA

SEQ ID NO: 164201 - protein, 9 aa, Artificial Sequence
  Description of Artificial Sequence: Synthetic peptide
  Seed: QVERPQMTF (SSX2_HUMAN)
QVERPQMTW

SEQ ID NO: 164202 - protein, 10 aa, Artificial Sequence
  Description of Artificial Sequence: Synthetic peptide
  Seed: MTFGRLQGIS (SSX2_HUMAN)
MVFGRLQGIV

SEQ ID NO: 164203 - protein, 10 aa, Artificial Sequence
  Description of Artificial Sequence: Synthetic peptide
  Seed: VYMKRKYEAM (SSX2_HUMAN)
VWMKRKYEAM

SEQ ID NO: 164204 - protein, 9 aa, Artificial Sequence
  Description of Artificial Sequence: Synthetic peptide
  Seed: KASEKIFYV (SSX2_HUMAN)
KMSEKIFYW

SEQ ID NO: 164205 - protein, 9 aa, Artificial Sequence
  Description of Artificial Sequence: Synthetic peptide
  Seed: FARRPTVGA (SSX2_HUMAN)
FTRRPTVGA

SEQ ID NO: 164206 - protein, 10 aa, Artificial Sequence
  Description of Artificial Sequence: Synthetic peptide
  Seed: KIFYVYMKRK (SSX2_HUMAN)
KMFYVYMKRT

SEQ ID NO: 164207 - protein, 8 aa, Artificial Sequence
  Description of Artificial Sequence: Synthetic peptide
  Seed: FDDIAKYF (SSX2_HUMAN)
FIDIAKYF

SEQ ID NO: 164208 - protein, 9 aa, Artificial Sequence
  Description of Artificial Sequence: Synthetic peptide
  Seed: NGDDAFARR (SSX2_HUMAN)
NTDDAFARF

SEQ ID NO: 164209 - protein, 10 aa, Artificial Sequence
  Description of Artificial Sequence: Synthetic peptide
  Seed: NQVERPQMTF (SSX2_HUMAN)
NEVERPQMTY

SEQ ID NO: 164210 - protein, 8 aa, Artificial Sequence
  Description of Artificial Sequence: Synthetic peptide
  Seed: MKRKYEAM (SSX2_HUMAN)
MMRKYEAL

SEQ ID NO: 164211 - protein, 9 aa, Artificial Sequence
  Description of Artificial Sequence: Synthetic peptide
  Seed: RLRERKQLV (SSX2_HUMAN)
RLRERKQLA

SEQ ID NO: 164212 - protein, 11 aa, Artificial Sequence
  Description of Artificial Sequence: Synthetic peptide
  Seed: KMKASEKIFYV (SSX2_HUMAN)
KIKASEKIFYV

SEQ ID NO: 164213 - protein, 9 aa, Artificial Sequence
  Description of Artificial Sequence: Synthetic peptide
  Seed: KAFDDIAKY (SSX2_HUMAN)
KVFDDIAKF

SEQ ID NO: 164214 - protein, 9 aa, Artificial Sequence
  Description of Artificial Sequence: Synthetic peptide
  Seed: MKASEKIFY (SSX2_HUMAN)
MQASEKIFL

SEQ ID NO: 164215 - protein, 10 aa, Artificial Sequence
  Description of Artificial Sequence: Synthetic peptide
  Seed: MNGDDAFARR (SSX2_HUMAN)
MIGDDAFARR

SEQ ID NO: 164216 - protein, 9 aa, Artificial Sequence
  Description of Artificial Sequence: Synthetic peptide
  Seed: RLRERKQLV (SSX2_HUMAN)
RSRERKQLS

SEQ ID NO: 164217 - protein, 9 aa, Artificial Sequence
  Description of Artificial Sequence: Synthetic peptide
  Seed: KRGEHAWTH (SSX2_HUMAN)
KYGEHAWTM

SEQ ID NO: 164218 - protein, 9 aa, Artificial Sequence
  Description of Artificial Sequence: Synthetic peptide
  Seed: ISPKIMPKK (SSX2_HUMAN)
IVPKIMPKR

SEQ ID NO: 164219 - protein, 9 aa, Artificial Sequence
  Description of Artificial Sequence: Synthetic peptide
  Seed: AFDDIAKYF (SSX2_HUMAN)
ACDDIAKYM

SEQ ID NO: 164220 - protein, 8 aa, Artificial Sequence
  Description of Artificial Sequence: Synthetic peptide
  Seed: YMKRKYEA (SSX2_HUMAN)
YMKRKYEI

SEQ ID NO: 164221 - protein, 9 aa, Artificial Sequence
  Description of Artificial Sequence: Synthetic peptide
  Seed: KIFYVYMKR (SSX2_HUMAN)
KLFYVYMKY

SEQ ID NO: 164222 - protein, 9 aa, Artificial Sequence
  Description of Artificial Sequence: Synthetic peptide
  Seed: DDIAKYFSK (SSX2_HUMAN)
DYIAKYFSR

SEQ ID NO: 164223 - protein, 10 aa, Artificial Sequence
  Description of Artificial Sequence: Synthetic peptide
  Seed: KELCPPGKPT (SSX2_HUMAN)
KELCPPGKPA

SEQ ID NO: 164224 - protein, 9 aa, Artificial Sequence
  Description of Artificial Sequence: Synthetic peptide
  Seed: YMKRKYEAM (SSX2_HUMAN)
YGKRKYEAF

SEQ ID NO: 164225 - protein, 9 aa, Artificial Sequence
  Description of Artificial Sequence: Synthetic peptide
  Seed: KQLVIYEEI (SSX2_HUMAN)
KILVIYEEV

SEQ ID NO: 164226 - protein, 9 aa, Artificial Sequence
  Description of Artificial Sequence: Synthetic peptide
  Seed: KQLVIYEEI (SSX2_HUMAN)
KMLVIYEEM

SEQ ID NO: 164227 - protein, 10 aa, Artificial Sequence
  Description of Artificial Sequence: Synthetic peptide
  Seed: MKASEKIFYV (SSX2_HUMAN)
MSASEKIFYV

SEQ ID NO: 164228 - protein, 11 aa, Artificial Sequence
  Description of Artificial Sequence: Synthetic peptide
  Seed: KATLPPFMCNK (SSX2_HUMAN)
KMTLPPFMCNR

SEQ ID NO: 164229 - protein, 9 aa, Artificial Sequence
  Description of Artificial Sequence: Synthetic peptide
  Seed: KQLVIYEEI (SSX2_HUMAN)
KKLVIYEEF

SEQ ID NO: 164230 - protein, 8 aa, Artificial Sequence
  Description of Artificial Sequence: Synthetic peptide
  Seed: MKRKYEAM (SSX2_HUMAN)
MMRKYEAF

SEQ ID NO: 164231 - protein, 9 aa, Artificial Sequence
  Description of Artificial Sequence: Synthetic peptide
  Seed: AQIPEKIQK (SSX2_HUMAN)
ARIPEKIQL

SEQ ID NO: 164232 - protein, 9 aa, Artificial Sequence
  Description of Artificial Sequence: Synthetic peptide
  Seed: TKLGFKATL (SSX2_HUMAN)
TYLGFKATM

SEQ ID NO: 164233 - protein, 9 aa, Artificial Sequence
  Description of Artificial Sequence: Synthetic peptide
  Seed: RLRERKQLV (SSX2_HUMAN)
RQRERKQLK

SEQ ID NO: 164234 - protein, 10 aa, Artificial Sequence
  Description of Artificial Sequence: Synthetic peptide
  Seed: KYEAMTKLGF (SSX2_HUMAN)
KKEAMTKLGW

SEQ ID NO: 164235 - protein, 11 aa, Artificial Sequence
  Description of Artificial Sequence: Synthetic peptide
  Seed: KYEAMTKLGFK (SSX2_HUMAN)
KDEAMTKLGFR

SEQ ID NO: 164236 - protein, 9 aa, Artificial Sequence
  Description of Artificial Sequence: Synthetic peptide
  Seed: MTFGRLQGI (SSX2_HUMAN)
MLFGRLQGA

SEQ ID NO: 164237 - protein, 11 aa, Artificial Sequence
  Description of Artificial Sequence: Synthetic peptide
  Seed: KYEAMTKLGFK (SSX2_HUMAN)
KMEAMTKLGFR

SEQ ID NO: 164238 - protein, 10 aa, Artificial Sequence
  Description of Artificial Sequence: Synthetic peptide
  Seed: AQIPEKIQKA (SSX2_HUMAN)
AMIPEKIQKA

SEQ ID NO: 164239 - protein, 9 aa, Artificial Sequence
  Description of Artificial Sequence: Synthetic peptide
  Seed: IPEKIQKAF (SSX2_HUMAN)
IPEKIQKAM

SEQ ID NO: 164240 - protein, 9 aa, Artificial Sequence
  Description of Artificial Sequence: Synthetic peptide
  Seed: NGDDAFARR (SSX2_HUMAN)
NADDAFARF

SEQ ID NO: 164241 - protein, 9 aa, Artificial Sequence
  Description of Artificial Sequence: Synthetic peptide
  Seed: KAFDDIAKY (SSX2_HUMAN)
KQFDDIAKY

SEQ ID NO: 164242 - protein, 9 aa, Artificial Sequence
  Description of Artificial Sequence: Synthetic peptide
  Seed: MKASEKIFY (SSX2_HUMAN)
MQASEKIFM

SEQ ID NO: 164243 - protein, 11 aa, Artificial Sequence
  Description of Artificial Sequence: Synthetic peptide
  Seed: SEKIFYVYMKR (SSX2_HUMAN)
SFKIFYVYMKR

SEQ ID NO: 164244 - protein, 9 aa, Artificial Sequence
  Description of Artificial Sequence: Synthetic peptide
  Seed: IPEKIQKAF (SSX2_HUMAN)
IMEKIQKAF

SEQ ID NO: 164245 - protein, 9 aa, Artificial Sequence
  Description of Artificial Sequence: Synthetic peptide
  Seed: DAFARRPTV (SSX2_HUMAN)
DRFARRPTA

SEQ ID NO: 164246 - protein, 10 aa, Artificial Sequence
  Description of Artificial Sequence: Synthetic peptide
  Seed: KAFDDIAKYF (SSX2_HUMAN)
KFFDDIAKYW

SEQ ID NO: 164247 - protein, 10 aa, Artificial Sequence
  Description of Artificial Sequence: Synthetic peptide
  Seed: KIFYVYMKRK (SSX2_HUMAN)
KMFYVYMKRV

SEQ ID NO: 164248 - protein, 9 aa, Artificial Sequence
  Description of Artificial Sequence: Synthetic peptide
  Seed: KASEKIFYV (SSX2_HUMAN)
KQSEKIFYI

SEQ ID NO: 164249 - protein, 9 aa, Artificial Sequence
  Description of Artificial Sequence: Synthetic peptide
  Seed: AKYFSKEEW (SSX2_HUMAN)
AQYFSKEEL

SEQ ID NO: 164250 - protein, 9 aa, Artificial Sequence
  Description of Artificial Sequence: Synthetic peptide
  Seed: KIFYVYMKR (SSX2_HUMAN)
KFFYVYMKR

SEQ ID NO: 164251 - protein, 10 aa, Artificial Sequence
  Description of Artificial Sequence: Synthetic peptide
  Seed: EKIFYVYMKR (SSX2_HUMAN)
EFIFYVYMKR

SEQ ID NO: 164252 - protein, 10 aa, Artificial Sequence
  Description of Artificial Sequence: Synthetic peptide
  Seed: KMKASEKIFY (SSX2_HUMAN)
KVKASEKIFS

SEQ ID NO: 164253 - protein, 10 aa, Artificial Sequence
  Description of Artificial Sequence: Synthetic peptide
  Seed: MKRKYEAMTK (SSX2_HUMAN)
MVRKYEAMTK

SEQ ID NO: 164254 - protein, 9 aa, Artificial Sequence
  Description of Artificial Sequence: Synthetic peptide
  Seed: YMKRKYEAM (SSX2_HUMAN)
YSKRKYEAM

SEQ ID NO: 164255 - protein, 9 aa, Artificial Sequence
  Description of Artificial Sequence: Synthetic peptide
  Seed: AQIPEKIQK (SSX2_HUMAN)
AMIPEKIQF

SEQ ID NO: 164256 - protein, 10 aa, Artificial Sequence
  Description of Artificial Sequence: Synthetic peptide
  Seed: AQIPEKIQKA (SSX2_HUMAN)
AEIPEKIQKT

SEQ ID NO: 164257 - protein, 9 aa, Artificial Sequence
  Description of Artificial Sequence: Synthetic peptide
  Seed: VGAQIPEKI (SSX2_HUMAN)
VIAQIPEKV

SEQ ID NO: 164258 - protein, 10 aa, Artificial Sequence
  Description of Artificial Sequence: Synthetic peptide
  Seed: KASEKIFYVY (SSX2_HUMAN)
KESEKIFYVW

SEQ ID NO: 164259 - protein, 10 aa, Artificial Sequence
  Description of Artificial Sequence: Synthetic peptide
  Seed: KYEAMTKLGF (SSX2_HUMAN)
KLEAMTKLGW

SEQ ID NO: 164260 - protein, 9 aa, Artificial Sequence
  Description of Artificial Sequence: Synthetic peptide
  Seed: MTFGRLQGI (SSX2_HUMAN)
MIFGRLQGK

SEQ ID NO: 164261 - protein, 8 aa, Artificial Sequence
  Description of Artificial Sequence: Synthetic peptide
  Seed: AFDDIAKY (SSX2_HUMAN)
AFDDIAKI

SEQ ID NO: 164262 - protein, 11 aa, Artificial Sequence
  Description of Artificial Sequence: Synthetic peptide
  Seed: FGRLQGISPKI (SSX2_HUMAN)
FMRLQGISPKL

SEQ ID NO: 164263 - protein, 10 aa, Artificial Sequence
  Description of Artificial Sequence: Synthetic peptide
  Seed: KAFDDIAKYF (SSX2_HUMAN)
KLFDDIAKYW

SEQ ID NO: 164264 - protein, 9 aa, Artificial Sequence
  Description of Artificial Sequence: Synthetic peptide
  Seed: AFDDIAKYF (SSX2_HUMAN)
AFDDIAKYL

SEQ ID NO: 164265 - protein, 9 aa, Artificial Sequence
  Description of Artificial Sequence: Synthetic peptide
  Seed: RLQGISPKI (SSX2_HUMAN)
RSQGISPKL

SEQ ID NO: 164266 - protein, 8 aa, Artificial Sequence
  Description of Artificial Sequence: Synthetic peptide
  Seed: YMKRKYEA (SSX2_HUMAN)
YVKRKYEI

SEQ ID NO: 164267 - protein, 8 aa, Artificial Sequence
  Description of Artificial Sequence: Synthetic peptide
  Seed: SEKIFYVY (SSX2_HUMAN)
SQKIFYVY

SEQ ID NO: 164268 - protein, 9 aa, Artificial Sequence
  Description of Artificial Sequence: Synthetic peptide
  Seed: KAFDDIAKY (SSX2_HUMAN)
KNFDDIAKL

SEQ ID NO: 164269 - protein, 9 aa, Artificial Sequence
  Description of Artificial Sequence: Synthetic peptide
  Seed: VGAQIPEKI (SSX2_HUMAN)
VMAQIPEKL

SEQ ID NO: 164270 - protein, 9 aa, Artificial Sequence
  Description of Artificial Sequence: Synthetic peptide
  Seed: KAFDDIAKY (SSX2_HUMAN)
KLFDDIAKL

SEQ ID NO: 164271 - protein, 10 aa, Artificial Sequence
  Description of Artificial Sequence: Synthetic peptide
  Seed: KYFSKEEWEK (SSX2_HUMAN)
KFFSKEEWER

SEQ ID NO: 164272 - protein, 9 aa, Artificial Sequence
  Description of Artificial Sequence: Synthetic peptide
  Seed: DAFARRPTV (SSX2_HUMAN)
DVFARRPTR

SEQ ID NO: 164273 - protein, 9 aa, Artificial Sequence
  Description of Artificial Sequence: Synthetic peptide
  Seed: KQLVIYEEI (SSX2_HUMAN)
KDLVIYEEL

SEQ ID NO: 164274 - protein, 10 aa, Artificial Sequence
  Description of Artificial Sequence: Synthetic peptide
  Seed: MKASEKIFYV (SSX2_HUMAN)
MIASEKIFYV

SEQ ID NO: 164275 - protein, 9 aa, Artificial Sequence
  Description of Artificial Sequence: Synthetic peptide
  Seed: KAFDDIAKY (SSX2_HUMAN)
KIFDDIAKI

SEQ ID NO: 164276 - protein, 9 aa, Artificial Sequence
  Description of Artificial Sequence: Synthetic peptide
  Seed: MKASEKIFY (SSX2_HUMAN)
MMASEKIFY

SEQ ID NO: 164277 - protein, 9 aa, Artificial Sequence
  Description of Artificial Sequence: Synthetic peptide
  Seed: IPEKIQKAF (SSX2_HUMAN)
IMEKIQKAY

SEQ ID NO: 164278 - protein, 9 aa, Artificial Sequence
  Description of Artificial Sequence: Synthetic peptide
  Seed: KRKYEAMTK (SSX2_HUMAN)
KTKYEAMTG

SEQ ID NO: 164279 - protein, 8 aa, Artificial Sequence
  Description of Artificial Sequence: Synthetic peptide
  Seed: AFDDIAKY (SSX2_HUMAN)
AFDDIAKM

SEQ ID NO: 164280 - protein, 9 aa, Artificial Sequence
  Description of Artificial Sequence: Synthetic peptide
  Seed: YMKRKYEAM (SSX2_HUMAN)
YFKRKYEAL

SEQ ID NO: 164281 - protein, 8 aa, Artificial Sequence
  Description of Artificial Sequence: Synthetic peptide
  Seed: FDDIAKYF (SSX2_HUMAN)
FNDIAKYV

SEQ ID NO: 164282 - protein, 9 aa, Artificial Sequence
  Description of Artificial Sequence: Synthetic peptide
  Seed: KAFDDIAKY (SSX2_HUMAN)
KVFDDIAKM

SEQ ID NO: 164283 - protein, 9 aa, Artificial Sequence
  Description of Artificial Sequence: Synthetic peptide
  Seed: AFDDIAKYF (SSX2_HUMAN)
ALDDIAKYV

SEQ ID NO: 164284 - protein, 8 aa, Artificial Sequence
  Description of Artificial Sequence: Synthetic peptide
  Seed: FDDIAKYF (SSX2_HUMAN)
FVDIAKYV

SEQ ID NO: 164285 - protein, 10 aa, Artificial Sequence
  Description of Artificial Sequence: Synthetic peptide
  Seed: EASGPQNDGK (SSX2_HUMAN)
ESSGPQNDGR

SEQ ID NO: 164286 - protein, 10 aa, Artificial Sequence
  Description of Artificial Sequence: Synthetic peptide
  Seed: MTKLGFKATL (SSX2_HUMAN)
MRKLGFKATY

SEQ ID NO: 164287 - protein, 9 aa, Artificial Sequence
  Description of Artificial Sequence: Synthetic peptide
  Seed: RKYEAMTKL (SSX2_HUMAN)
RMYEAMTKH

SEQ ID NO: 164288 - protein, 9 aa, Artificial Sequence
  Description of Artificial Sequence: Synthetic peptide
  Seed: MTFGRLQGI (SSX2_HUMAN)
MGFGRLQGW

SEQ ID NO: 164289 - protein, 10 aa, Artificial Sequence
  Description of Artificial Sequence: Synthetic peptide
  Seed: MKASEKIFYV (SSX2_HUMAN)
MTASEKIFYM

SEQ ID NO: 164290 - protein, 11 aa, Artificial Sequence
  Description of Artificial Sequence: Synthetic peptide
  Seed: RKYEAMTKLGF (SSX2_HUMAN)
RRYEAMTKLGY

SEQ ID NO: 164291 - protein, 10 aa, Artificial Sequence
  Description of Artificial Sequence: Synthetic peptide
  Seed: MKRKYEAMTK (SSX2_HUMAN)
MIRKYEAMTK

SEQ ID NO: 164292 - protein, 9 aa, Artificial Sequence
  Description of Artificial Sequence: Synthetic peptide
  Seed: RLRERKQLV (SSX2_HUMAN)
RVRERKQLT

SEQ ID NO: 164293 - protein, 10 aa, Artificial Sequence
  Description of Artificial Sequence: Synthetic peptide
  Seed: KASEKIFYVY (SSX2_HUMAN)
KGSEKIFYVW

SEQ ID NO: 164294 - protein, 10 aa, Artificial Sequence
  Description of Artificial Sequence: Synthetic peptide
  Seed: YEAMTKLGFK (SSX2_HUMAN)
YSAMTKLGFK

SEQ ID NO: 164295 - protein, 9 aa, Artificial Sequence
  Description of Artificial Sequence: Synthetic peptide
  Seed: GISPKIMPK (SSX2_HUMAN)
GTSPKIMPF

SEQ ID NO: 164296 - protein, 9 aa, Artificial Sequence
  Description of Artificial Sequence: Synthetic peptide
  Seed: YEAMTKLGF (SSX2_HUMAN)
YMAMTKLGL

SEQ ID NO: 164297 - protein, 9 aa, Artificial Sequence
  Description of Artificial Sequence: Synthetic peptide
  Seed: RKYEAMTKL (SSX2_HUMAN)
RTYEAMTKM

SEQ ID NO: 164298 - protein, 9 aa, Artificial Sequence
  Description of Artificial Sequence: Synthetic peptide
  Seed: MPKKPAEEG (SSX2_HUMAN)
MAKKPAEEY

SEQ ID NO: 164299 - protein, 9 aa, Artificial Sequence
  Description of Artificial Sequence: Synthetic peptide
  Seed: FKATLPPFM (SSX2_HUMAN)
FRATLPPFL

SEQ ID NO: 164300 - protein, 9 aa, Artificial Sequence
  Description of Artificial Sequence: Synthetic peptide
  Seed: KRKYEAMTK (SSX2_HUMAN)
KRKYEAMTM

SEQ ID NO: 164301 - protein, 9 aa, Artificial Sequence
  Description of Artificial Sequence: Synthetic peptide
  Seed: AFDDIAKYF (SSX2_HUMAN)
ATDDIAKYF

SEQ ID NO: 164302 - protein, 9 aa, Artificial Sequence
  Description of Artificial Sequence: Synthetic peptide
  Seed: TTSEKIHER (SSX2_HUMAN)
TLSEKIHEV

SEQ ID NO: 164303 - protein, 9 aa, Artificial Sequence
  Description of Artificial Sequence: Synthetic peptide
  Seed: FSKEEWEKM (SSX2_HUMAN)
FVKEEWEKW

SEQ ID NO: 164304 - protein, 9 aa, Artificial Sequence
  Description of Artificial Sequence: Synthetic peptide
  Seed: AMTKLGFKA (SSX2_HUMAN)
ALTKLGFKL

SEQ ID NO: 164305 - protein, 8 aa, Artificial Sequence
  Description of Artificial Sequence: Synthetic peptide
  Seed: FDDIAKYF (SSX2_HUMAN)
FIDIAKYM

SEQ ID NO: 164306 - protein, 9 aa, Artificial Sequence
  Description of Artificial Sequence: Synthetic peptide
  Seed: MNGDDAFAR (SSX2_HUMAN)
MTGDDAFAR

SEQ ID NO: 164307 - protein, 10 aa, Artificial Sequence
  Description of Artificial Sequence: Synthetic peptide
  Seed: MTFGRLQGIS (SSX2_HUMAN)
MSFGRLQGIV

SEQ ID NO: 164308 - protein, 9 aa, Artificial Sequence
  Description of Artificial Sequence: Synthetic peptide
  Seed: KMKASEKIF (SSX2_HUMAN)
KSKASEKIW

SEQ ID NO: 164309 - protein, 9 aa, Artificial Sequence
  Description of Artificial Sequence: Synthetic peptide
  Seed: RERKQLVIY (SSX2_HUMAN)
RYRKQLVIY

SEQ ID NO: 164310 - protein, 9 aa, Artificial Sequence
  Description of Artificial Sequence: Synthetic peptide
  Seed: TLPPFMCNK (SSX2_HUMAN)
TAPPFMCNR

SEQ ID NO: 164311 - protein, 9 aa, Artificial Sequence
  Description of Artificial Sequence: Synthetic peptide
  Seed: KRKYEAMTK (SSX2_HUMAN)
KRKYEAMTL

SEQ ID NO: 164312 - protein, 9 aa, Artificial Sequence
  Description of Artificial Sequence: Synthetic peptide
  Seed: RLQGISPKI (SSX2_HUMAN)
RMQGISPKY

SEQ ID NO: 164313 - protein, 8 aa, Artificial Sequence
  Description of Artificial Sequence: Synthetic peptide
  Seed: FKATLPPF (SSX2_HUMAN)
FQATLPPF

SEQ ID NO: 164314 - protein, 11 aa, Artificial Sequence
  Description of Artificial Sequence: Synthetic peptide
  Seed: KYEAMTKLGFK (SSX2_HUMAN)
KIEAMTKLGFK

SEQ ID NO: 164315 - protein, 9 aa, Artificial Sequence
  Description of Artificial Sequence: Synthetic peptide
  Seed: KASEKIFYV (SSX2_HUMAN)
KLSEKIFYF

SEQ ID NO: 164316 - protein, 10 aa, Artificial Sequence
  Description of Artificial Sequence: Synthetic peptide
  Seed: KAFDDIAKYF (SSX2_HUMAN)
KCFDDIAKYF

SEQ ID NO: 164317 - protein, 9 aa, Artificial Sequence
  Description of Artificial Sequence: Synthetic peptide
  Seed: EAMTKLGFK (SSX2_HUMAN)
ETMTKLGFM

SEQ ID NO: 164318 - protein, 10 aa, Artificial Sequence
  Description of Artificial Sequence: Synthetic peptide
  Seed: KAFDDIAKYF (SSX2_HUMAN)
KRFDDIAKYF

SEQ ID NO: 164319 - protein, 9 aa, Artificial Sequence
  Description of Artificial Sequence: Synthetic peptide
  Seed: ERPQMTFGR (SSX2_HUMAN)
EAPQMTFGR

SEQ ID NO: 164320 - protein, 11 aa, Artificial Sequence
  Description of Artificial Sequence: Synthetic peptide
  Seed: FGRLQGISPKI (SSX2_HUMAN)
FNRLQGISPKL

SEQ ID NO: 164321 - protein, 9 aa, Artificial Sequence
  Description of Artificial Sequence: Synthetic peptide
  Seed: KRKYEAMTK (SSX2_HUMAN)
KFKYEAMTA

SEQ ID NO: 164322 - protein, 11 aa, Artificial Sequence
  Description of Artificial Sequence: Synthetic peptide
  Seed: KMKASEKIFYV (SSX2_HUMAN)
KQKASEKIFYV

SEQ ID NO: 164323 - protein, 10 aa, Artificial Sequence
  Description of Artificial Sequence: Synthetic peptide
  Seed: KAFDDIAKYF (SSX2_HUMAN)
KVFDDIAKYY

SEQ ID NO: 164324 - protein, 8 aa, Artificial Sequence
  Description of Artificial Sequence: Synthetic peptide
  Seed: FDDIAKYF (SSX2_HUMAN)
FWDIAKYM

SEQ ID NO: 164325 - protein, 9 aa, Artificial Sequence
  Description of Artificial Sequence: Synthetic peptide
  Seed: YEAMTKLGF (SSX2_HUMAN)
YEAMTKLGV

SEQ ID NO: 164326 - protein, 10 aa, Artificial Sequence
  Description of Artificial Sequence: Synthetic peptide
  Seed: AEEGNDSEEV (SSX2_HUMAN)
AEEGNDSEEL

SEQ ID NO: 164327 - protein, 11 aa, Artificial Sequence
  Description of Artificial Sequence: Synthetic peptide
  Seed: KMKASEKIFYV (SSX2_HUMAN)
KTKASEKIFYK

SEQ ID NO: 164328 - protein, 9 aa, Artificial Sequence
  Description of Artificial Sequence: Synthetic peptide
  Seed: KASEKIFYV (SSX2_HUMAN)
KSSEKIFYL

SEQ ID NO: 164329 - protein, 9 aa, Artificial Sequence
  Description of Artificial Sequence: Synthetic peptide
  Seed: TKLGFKATL (SSX2_HUMAN)
TQLGFKATM

SEQ ID NO: 164330 - protein, 9 aa, Artificial Sequence
  Description of Artificial Sequence: Synthetic peptide
  Seed: ASEKIFYVY (SSX2_HUMAN)
AIEKIFYVY

SEQ ID NO: 164331 - protein, 9 aa, Artificial Sequence
  Description of Artificial Sequence: Synthetic peptide
  Seed: MTFGRLQGI (SSX2_HUMAN)
MQFGRLQGC

SEQ ID NO: 164332 - protein, 10 aa, Artificial Sequence
  Description of Artificial Sequence: Synthetic peptide
  Seed: LGFKATLPPF (SSX2_HUMAN)
LRFKATLPPY

SEQ ID NO: 164333 - protein, 9 aa, Artificial Sequence
  Description of Artificial Sequence: Synthetic peptide
  Seed: ASEKIFYVY (SSX2_HUMAN)
AKEKIFYVF

SEQ ID NO: 164334 - protein, 9 aa, Artificial Sequence
  Description of Artificial Sequence: Synthetic peptide
  Seed: KRKYEAMTK (SSX2_HUMAN)
KVKYEAMTM

SEQ ID NO: 164335 - protein, 10 aa, Artificial Sequence
  Description of Artificial Sequence: Synthetic peptide
  Seed: YMKRKYEAMT (SSX2_HUMAN)
YPKRKYEAML

SEQ ID NO: 164336 - protein, 9 aa, Artificial Sequence
  Description of Artificial Sequence: Synthetic peptide
  Seed: TVGAQIPEK (SSX2_HUMAN)
TSGAQIPEY

SEQ ID NO: 164337 - protein, 9 aa, Artificial Sequence
  Description of Artificial Sequence: Synthetic peptide
  Seed: MTFGRLQGI (SSX2_HUMAN)
MIFGRLQGY

SEQ ID NO: 164338 - protein, 9 aa, Artificial Sequence
  Description of Artificial Sequence: Synthetic peptide
  Seed: GEHAWTHRL (SSX2_HUMAN)
GEHAWTHRV

SEQ ID NO: 164339 - protein, 9 aa, Artificial Sequence
  Description of Artificial Sequence: Synthetic peptide
  Seed: KAFDDIAKY (SSX2_HUMAN)
KSFDDIAKM

SEQ ID NO: 164340 - protein, 11 aa, Artificial Sequence
  Description of Artificial Sequence: Synthetic peptide
  Seed: AQIPEKIQKAF (SSX2_HUMAN)
AQIPEKIQKAW

SEQ ID NO: 164341 - protein, 10 aa, Artificial Sequence
  Description of Artificial Sequence: Synthetic peptide
  Seed: KMKASEKIFY (SSX2_HUMAN)
KSKASEKIFA

SEQ ID NO: 164342 - protein, 10 aa, Artificial Sequence
  Description of Artificial Sequence: Synthetic peptide
  Seed: YMKRKYEAMT (SSX2_HUMAN)
YIKRKYEAML

SEQ ID NO: 164343 - protein, 9 aa, Artificial Sequence
  Description of Artificial Sequence: Synthetic peptide
  Seed: KAFDDIAKY (SSX2_HUMAN)
KNFDDIAKI

SEQ ID NO: 164344 - protein, 9 aa, Artificial Sequence
  Description of Artificial Sequence: Synthetic peptide
  Seed: MPKKPAEEG (SSX2_HUMAN)
MAKKPAEEL

SEQ ID NO: 164345 - protein, 9 aa, Artificial Sequence
  Description of Artificial Sequence: Synthetic peptide
  Seed: VGAQIPEKI (SSX2_HUMAN)
VLAQIPEKM

SEQ ID NO: 164346 - protein, 9 aa, Artificial Sequence
  Description of Artificial Sequence: Synthetic peptide
  Seed: VGAQIPEKI (SSX2_HUMAN)
VTAQIPEKW

SEQ ID NO: 164347 - protein, 10 aa, Artificial Sequence
  Description of Artificial Sequence: Synthetic peptide
  Seed: MKASEKIFYV (SSX2_HUMAN)
MMASEKIFYT

SEQ ID NO: 164348 - protein, 9 aa, Artificial Sequence
  Description of Artificial Sequence: Synthetic peptide
  Seed: FSKEEWEKM (SSX2_HUMAN)
FGKEEWEKY

SEQ ID NO: 164349 - protein, 9 aa, Artificial Sequence
  Description of Artificial Sequence: Synthetic peptide
  Seed: AKYFSKEEW (SSX2_HUMAN)
AEYFSKEEY

SEQ ID NO: 164350 - protein, 8 aa, Artificial Sequence
  Description of Artificial Sequence: Synthetic peptide
  Seed: AFDDIAKY (SSX2_HUMAN)
AYDDIAKM

SEQ ID NO: 164351 - protein, 9 aa, Artificial Sequence
  Description of Artificial Sequence: Synthetic peptide
  Seed: FARRPTVGA (SSX2_HUMAN)
FTRRPTVGY

SEQ ID NO: 164352 - protein, 9 aa, Artificial Sequence
  Description of Artificial Sequence: Synthetic peptide
  Seed: MTKLGFKAT (SSX2_HUMAN)
MTKLGFKAV

SEQ ID NO: 164353 - protein, 9 aa, Artificial Sequence
  Description of Artificial Sequence: Synthetic peptide
  Seed: NGDDAFARR (SSX2_HUMAN)
NTDDAFARY

SEQ ID NO: 164354 - protein, 9 aa, Artificial Sequence
  Description of Artificial Sequence: Synthetic peptide
  Seed: FSKEEWEKM (SSX2_HUMAN)
FIKEEWEKF

SEQ ID NO: 164355 - protein, 9 aa, Artificial Sequence
  Description of Artificial Sequence: Synthetic peptide
  Seed: RLQGISPKI (SSX2_HUMAN)
RLQGISPKW

SEQ ID NO: 164356 - protein, 9 aa, Artificial Sequence
  Description of Artificial Sequence: Synthetic peptide
  Seed: RKYEAMTKL (SSX2_HUMAN)
RVYEAMTKY

SEQ ID NO: 164357 - protein, 9 aa, Artificial Sequence
  Description of Artificial Sequence: Synthetic peptide
  Seed: DAFARRPTV (SSX2_HUMAN)
DTFARRPTW

SEQ ID NO: 164358 - protein, 9 aa, Artificial Sequence
  Description of Artificial Sequence: Synthetic peptide
  Seed: NDSEEVPEA (SSX2_HUMAN)
NDSEEVPEL

SEQ ID NO: 164359 - protein, 9 aa, Artificial Sequence
  Description of Artificial Sequence: Synthetic peptide
  Seed: DDIAKYFSK (SSX2_HUMAN)
DMIAKYFSK

SEQ ID NO: 164360 - protein, 9 aa, Artificial Sequence
  Description of Artificial Sequence: Synthetic peptide
  Seed: SEEVPEASG (SSX2_HUMAN)
SEEVPEASV

SEQ ID NO: 164361 - protein, 9 aa, Artificial Sequence
  Description of Artificial Sequence: Synthetic peptide
  Seed: AQIPEKIQK (SSX2_HUMAN)
AIIPEKIQY

SEQ ID NO: 164362 - protein, 9 aa, Artificial Sequence
  Description of Artificial Sequence: Synthetic peptide
  Seed: GEHAWTHRL (SSX2_HUMAN)
GKHAWTHRF

SEQ ID NO: 164363 - protein, 9 aa, Artificial Sequence
  Description of Artificial Sequence: Synthetic peptide
  Seed: AQIPEKIQK (SSX2_HUMAN)
AAIPEKIQV

SEQ ID NO: 164364 - protein, 9 aa, Artificial Sequence
  Description of Artificial Sequence: Synthetic peptide
  Seed: RRPTVGAQI (SSX2_HUMAN)
RFPTVGAQM

SEQ ID NO: 164365 - protein, 10 aa, Artificial Sequence
  Description of Artificial Sequence: Synthetic peptide
  Seed: KASEKIFYVY (SSX2_HUMAN)
KSSEKIFYVM

SEQ ID NO: 164366 - protein, 9 aa, Artificial Sequence
  Description of Artificial Sequence: Synthetic peptide
  Seed: MTFGRLQGI (SSX2_HUMAN)
MTFGRLQGW

SEQ ID NO: 164367 - protein, 9 aa, Artificial Sequence
  Description of Artificial Sequence: Synthetic peptide
  Seed: YEAMTKLGF (SSX2_HUMAN)
YMAMTKLGY

SEQ ID NO: 164368 - protein, 10 aa, Artificial Sequence
  Description of Artificial Sequence: Synthetic peptide
  Seed: EKIFYVYMKR (SSX2_HUMAN)
ENIFYVYMKK

SEQ ID NO: 164369 - protein, 9 aa, Artificial Sequence
  Description of Artificial Sequence: Synthetic peptide
  Seed: QIPEKIQKA (SSX2_HUMAN)
QSPEKIQKL

SEQ ID NO: 164370 - protein, 9 aa, Artificial Sequence
  Description of Artificial Sequence: Synthetic peptide
  Seed: KIHERSGPK (SSX2_HUMAN)
KSHERSGPY

SEQ ID NO: 164371 - protein, 9 aa, Artificial Sequence
  Description of Artificial Sequence: Synthetic peptide
  Seed: MTFGRLQGI (SSX2_HUMAN)
MPFGRLQGL

SEQ ID NO: 164372 - protein, 10 aa, Artificial Sequence
  Description of Artificial Sequence: Synthetic peptide
  Seed: MTKLGFKATL (SSX2_HUMAN)
MSKLGFKATF

SEQ ID NO: 164373 - protein, 9 aa, Artificial Sequence
  Description of Artificial Sequence: Synthetic peptide
  Seed: VGAQIPEKI (SSX2_HUMAN)
VLAQIPEKL

SEQ ID NO: 164374 - protein, 9 aa, Artificial Sequence
  Description of Artificial Sequence: Synthetic peptide
  Seed: AWTHRLRER (SSX2_HUMAN)
AMTHRLRER

SEQ ID NO: 164375 - protein, 11 aa, Artificial Sequence
  Description of Artificial Sequence: Synthetic peptide
  Seed: KYEAMTKLGFK (SSX2_HUMAN)
KVEAMTKLGFR

SEQ ID NO: 164376 - protein, 9 aa, Artificial Sequence
  Description of Artificial Sequence: Synthetic peptide
  Seed: RGEHAWTHR (SSX2_HUMAN)
RYEHAWTHR

SEQ ID NO: 164377 - protein, 9 aa, Artificial Sequence
  Description of Artificial Sequence: Synthetic peptide
  Seed: KRGEHAWTH (SSX2_HUMAN)
KRGEHAWTM

SEQ ID NO: 164378 - protein, 11 aa, Artificial Sequence
  Description of Artificial Sequence: Synthetic peptide
  Seed: FGRLQGISPKI (SSX2_HUMAN)
FRRLQGISPKL

SEQ ID NO: 164379 - protein, 9 aa, Artificial Sequence
  Description of Artificial Sequence: Synthetic peptide
  Seed: AQIPEKIQK (SSX2_HUMAN)
AAIPEKIQF

SEQ ID NO: 164380 - protein, 8 aa, Artificial Sequence
  Description of Artificial Sequence: Synthetic peptide
  Seed: FDDIAKYF (SSX2_HUMAN)
FADIAKYV

SEQ ID NO: 164381 - protein, 9 aa, Artificial Sequence
  Description of Artificial Sequence: Synthetic peptide
  Seed: KAFDDIAKY (SSX2_HUMAN)
KNFDDIAKW

SEQ ID NO: 164382 - protein, 10 aa, Artificial Sequence
  Description of Artificial Sequence: Synthetic peptide
  Seed: KASEKIFYVY (SSX2_HUMAN)
KFSEKIFYVY

SEQ ID NO: 164383 - protein, 9 aa, Artificial Sequence
  Description of Artificial Sequence: Synthetic peptide
  Seed: KEEWEKMKA (SSX2_HUMAN)
KEEWEKMKV

SEQ ID NO: 164384 - protein, 8 aa, Artificial Sequence
  Description of Artificial Sequence: Synthetic peptide
  Seed: YVYMKRKY (SSX2_HUMAN)
YQYMKRKY

SEQ ID NO: 164385 - protein, 8 aa, Artificial Sequence
  Description of Artificial Sequence: Synthetic peptide
  Seed: FDDIAKYF (SSX2_HUMAN)
FIDIAKYI

SEQ ID NO: 164386 - protein, 10 aa, Artificial Sequence
  Description of Artificial Sequence: Synthetic peptide
  Seed: KIFYVYMKRK (SSX2_HUMAN)
KLFYVYMKRR

SEQ ID NO: 164387 - protein, 9 aa, Artificial Sequence
  Description of Artificial Sequence: Synthetic peptide
  Seed: RLQGISPKI (SSX2_HUMAN)
RQQGISPKM

SEQ ID NO: 164388 - protein, 9 aa, Artificial Sequence
  Description of Artificial Sequence: Synthetic peptide
  Seed: TVGAQIPEK (SSX2_HUMAN)
TVGAQIPER

SEQ ID NO: 164389 - protein, 9 aa, Artificial Sequence
  Description of Artificial Sequence: Synthetic peptide
  Seed: YFSKEEWEK (SSX2_HUMAN)
YVSKEEWEY

SEQ ID NO: 164390 - protein, 10 aa, Artificial Sequence
  Description of Artificial Sequence: Synthetic peptide
  Seed: KAFDDIAKYF (SSX2_HUMAN)
KFFDDIAKYY

SEQ ID NO: 164391 - protein, 10 aa, Artificial Sequence
  Description of Artificial Sequence: Synthetic peptide
  Seed: YVYMKRKYEA (SSX2_HUMAN)
YMYMKRKYEF

SEQ ID NO: 164392 - protein, 9 aa, Artificial Sequence
  Description of Artificial Sequence: Synthetic peptide
  Seed: KAFDDIAKY (SSX2_HUMAN)
KMFDDIAKM

SEQ ID NO: 164393 - protein, 10 aa, Artificial Sequence
  Description of Artificial Sequence: Synthetic peptide
  Seed: MTKLGFKATL (SSX2_HUMAN)
MGKLGFKATY

SEQ ID NO: 164394 - protein, 10 aa, Artificial Sequence
  Description of Artificial Sequence: Synthetic peptide
  Seed: YMKRKYEAMT (SSX2_HUMAN)
YPKRKYEAMA

SEQ ID NO: 164395 - protein, 9 aa, Artificial Sequence
  Description of Artificial Sequence: Synthetic peptide
  Seed: YMKRKYEAM (SSX2_HUMAN)
YTKRKYEAV

SEQ ID NO: 164396 - protein, 10 aa, Artificial Sequence
  Description of Artificial Sequence: Synthetic peptide
  Seed: KYFSKEEWEK (SSX2_HUMAN)
KMFSKEEWEK

SEQ ID NO: 164397 - protein, 10 aa, Artificial Sequence
  Description of Artificial Sequence: Synthetic peptide
  Seed: KAFDDIAKYF (SSX2_HUMAN)
KVFDDIAKYW

SEQ ID NO: 164398 - protein, 9 aa, Artificial Sequence
  Description of Artificial Sequence: Synthetic peptide
  Seed: MTFGRLQGI (SSX2_HUMAN)
MVFGRLQGL

SEQ ID NO: 164399 - protein, 9 aa, Artificial Sequence
  Description of Artificial Sequence: Synthetic peptide
  Seed: RLRERKQLV (SSX2_HUMAN)
RIRERKQLV

SEQ ID NO: 164400 - protein, 9 aa, Artificial Sequence
  Description of Artificial Sequence: Synthetic peptide
  Seed: MTFGRLQGI (SSX2_HUMAN)
MAFGRLQGA

SEQ ID NO: 164401 - protein, 10 aa, Artificial Sequence
  Description of Artificial Sequence: Synthetic peptide
  Seed: KYFSKEEWEK (SSX2_HUMAN)
KWFSKEEWER

SEQ ID NO: 164402 - protein, 9 aa, Artificial Sequence
  Description of Artificial Sequence: Synthetic peptide
  Seed: VGAQIPEKI (SSX2_HUMAN)
VAAQIPEKL

SEQ ID NO: 164403 - protein, 8 aa, Artificial Sequence
  Description of Artificial Sequence: Synthetic peptide
  Seed: FDDIAKYF (SSX2_HUMAN)
FADIAKYM

SEQ ID NO: 164404 - protein, 10 aa, Artificial Sequence
  Description of Artificial Sequence: Synthetic peptide
  Seed: GISPKIMPKK (SSX2_HUMAN)
GTSPKIMPKR

SEQ ID NO: 164405 - protein, 10 aa, Artificial Sequence
  Description of Artificial Sequence: Synthetic peptide
  Seed: LGFKATLPPF (SSX2_HUMAN)
LAFKATLPPM

SEQ ID NO: 164406 - protein, 9 aa, Artificial Sequence
  Description of Artificial Sequence: Synthetic peptide
  Seed: AFDDIAKYF (SSX2_HUMAN)
AADDIAKYM

SEQ ID NO: 164407 - protein, 9 aa, Artificial Sequence
  Description of Artificial Sequence: Synthetic peptide
  Seed: VGAQIPEKI (SSX2_HUMAN)
VIAQIPEKW

SEQ ID NO: 164408 - protein, 10 aa, Artificial Sequence
  Description of Artificial Sequence: Synthetic peptide
  Seed: EKIFYVYMKR (SSX2_HUMAN)
EDIFYVYMKR

SEQ ID NO: 164409 - protein, 10 aa, Artificial Sequence
  Description of Artificial Sequence: Synthetic peptide
  Seed: ATLPPFMCNK (SSX2_HUMAN)
AWLPPFMCNR

SEQ ID NO: 164410 - protein, 9 aa, Artificial Sequence
  Description of Artificial Sequence: Synthetic peptide
  Seed: AKYFSKEEW (SSX2_HUMAN)
AAYFSKEEF

SEQ ID NO: 164411 - protein, 9 aa, Artificial Sequence
  Description of Artificial Sequence: Synthetic peptide
  Seed: RLQGISPKI (SSX2_HUMAN)
RIQGISPKR

SEQ ID NO: 164412 - protein, 10 aa, Artificial Sequence
  Description of Artificial Sequence: Synthetic peptide
  Seed: YEAMTKLGFK (SSX2_HUMAN)
YTAMTKLGFR

SEQ ID NO: 164413 - protein, 9 aa, Artificial Sequence
  Description of Artificial Sequence: Synthetic peptide
  Seed: FSKEEWEKM (SSX2_HUMAN)
FVKEEWEKF

SEQ ID NO: 164414 - protein, 10 aa, Artificial Sequence
  Description of Artificial Sequence: Synthetic peptide
  Seed: KRGEHAWTHR (SSX2_HUMAN)
KSGEHAWTHR

SEQ ID NO: 164415 - protein, 9 aa, Artificial Sequence
  Description of Artificial Sequence: Synthetic peptide
  Seed: QIPEKIQKA (SSX2_HUMAN)
QVPEKIQKL

SEQ ID NO: 164416 - protein, 9 aa, Artificial Sequence
  Description of Artificial Sequence: Synthetic peptide
  Seed: AQIPEKIQK (SSX2_HUMAN)
AFIPEKIQY

SEQ ID NO: 164417 - protein, 9 aa, Artificial Sequence
  Description of Artificial Sequence: Synthetic peptide
  Seed: ERPQMTFGR (SSX2_HUMAN)
EVPQMTFGR

SEQ ID NO: 164418 - protein, 10 aa, Artificial Sequence
  Description of Artificial Sequence: Synthetic peptide
  Seed: ATLPPFMCNK (SSX2_HUMAN)
AYLPPFMCNR

SEQ ID NO: 164419 - protein, 8 aa, Artificial Sequence
  Description of Artificial Sequence: Synthetic peptide
  Seed: FKATLPPF (SSX2_HUMAN)
FMATLPPY

SEQ ID NO: 164420 - protein, 10 aa, Artificial Sequence
  Description of Artificial Sequence: Synthetic peptide
  Seed: KAFDDIAKYF (SSX2_HUMAN)
KFFDDIAKYF

SEQ ID NO: 164421 - protein, 8 aa, Artificial Sequence
  Description of Artificial Sequence: Synthetic peptide
  Seed: FDDIAKYF (SSX2_HUMAN)
FSDIAKYF

SEQ ID NO: 164422 - protein, 10 aa, Artificial Sequence
  Description of Artificial Sequence: Synthetic peptide
  Seed: KRGEHAWTHR (SSX2_HUMAN)
KFGEHAWTHR

SEQ ID NO: 164423 - protein, 9 aa, Artificial Sequence
  Description of Artificial Sequence: Synthetic peptide
  Seed: KQLVIYEEI (SSX2_HUMAN)
KQLVIYEEF

SEQ ID NO: 164424 - protein, 8 aa, Artificial Sequence
  Description of Artificial Sequence: Synthetic peptide
  Seed: YMKRKYEA (SSX2_HUMAN)
YPKRKYEV

SEQ ID NO: 164425 - protein, 10 aa, Artificial Sequence
  Description of Artificial Sequence: Synthetic peptide
  Seed: MKASEKIFYV (SSX2_HUMAN)
MVASEKIFYL

SEQ ID NO: 164426 - protein, 9 aa, Artificial Sequence
  Description of Artificial Sequence: Synthetic peptide
  Seed: MTFGRLQGI (SSX2_HUMAN)
MLFGRLQGK

SEQ ID NO: 164427 - protein, 10 aa, Artificial Sequence
  Description of Artificial Sequence: Synthetic peptide
  Seed: EKIFYVYMKR (SSX2_HUMAN)
EVIFYVYMKR

SEQ ID NO: 164428 - protein, 9 aa, Artificial Sequence
  Description of Artificial Sequence: Synthetic peptide
  Seed: TLPPFMCNK (SSX2_HUMAN)
TSPPFMCNR

SEQ ID NO: 164429 - protein, 10 aa, Artificial Sequence
  Description of Artificial Sequence: Synthetic peptide
  Seed: LGFKATLPPF (SSX2_HUMAN)
LQFKATLPPH

SEQ ID NO: 164430 - protein, 9 aa, Artificial Sequence
  Description of Artificial Sequence: Synthetic peptide
  Seed: RLQGISPKI (SSX2_HUMAN)
RAQGISPKF

SEQ ID NO: 164431 - protein, 9 aa, Artificial Sequence
  Description of Artificial Sequence: Synthetic peptide
  Seed: MTFGRLQGI (SSX2_HUMAN)
MVFGRLQGR

SEQ ID NO: 164432 - protein, 8 aa, Artificial Sequence
  Description of Artificial Sequence: Synthetic peptide
  Seed: AFDDIAKY (SSX2_HUMAN)
AADDIAKI

SEQ ID NO: 164433 - protein, 10 aa, Artificial Sequence
  Description of Artificial Sequence: Synthetic peptide
  Seed: MKRKYEAMTK (SSX2_HUMAN)
MSRKYEAMTA

SEQ ID NO: 164434 - protein, 9 aa, Artificial Sequence
  Description of Artificial Sequence: Synthetic peptide
  Seed: RKYEAMTKL (SSX2_HUMAN)
RIYEAMTKI

SEQ ID NO: 164435 - protein, 9 aa, Artificial Sequence
  Description of Artificial Sequence: Synthetic peptide
  Seed: MTFGRLQGI (SSX2_HUMAN)
MSFGRLQGY

SEQ ID NO: 164436 - protein, 9 aa, Artificial Sequence
  Description of Artificial Sequence: Synthetic peptide
  Seed: KEEWEKMKA (SSX2_HUMAN)
KEEWEKMKM

SEQ ID NO: 164437 - protein, 8 aa, Artificial Sequence
  Description of Artificial Sequence: Synthetic peptide
  Seed: FDDIAKYF (SSX2_HUMAN)
FSDIAKYI

SEQ ID NO: 164438 - protein, 9 aa, Artificial Sequence
  Description of Artificial Sequence: Synthetic peptide
  Seed: KASEKIFYV (SSX2_HUMAN)
KISEKIFYF

SEQ ID NO: 164439 - protein, 8 aa, Artificial Sequence
  Description of Artificial Sequence: Synthetic peptide
  Seed: MKRKYEAM (SSX2_HUMAN)
MLRKYEAV

SEQ ID NO: 164440 - protein, 9 aa, Artificial Sequence
  Description of Artificial Sequence: Synthetic peptide
  Seed: AFDDIAKYF (SSX2_HUMAN)
AIDDIAKYF

SEQ ID NO: 164441 - protein, 9 aa, Artificial Sequence
  Description of Artificial Sequence: Synthetic peptide
  Seed: AQIPEKIQK (SSX2_HUMAN)
ALIPEKIQY

SEQ ID NO: 164442 - protein, 10 aa, Artificial Sequence
  Description of Artificial Sequence: Synthetic peptide
  Seed: YMKRKYEAMT (SSX2_HUMAN)
YMKRKYEAMR

SEQ ID NO: 164443 - protein, 9 aa, Artificial Sequence
  Description of Artificial Sequence: Synthetic peptide
  Seed: RGEHAWTHR (SSX2_HUMAN)
RMEHAWTHK

SEQ ID NO: 164444 - protein, 10 aa, Artificial Sequence
  Description of Artificial Sequence: Synthetic peptide
  Seed: AQIPEKIQKA (SSX2_HUMAN)
AKIPEKIQKY

SEQ ID NO: 164445 - protein, 9 aa, Artificial Sequence
  Description of Artificial Sequence: Synthetic peptide
  Seed: TTSEKIHER (SSX2_HUMAN)
TVSEKIHEV

SEQ ID NO: 164446 - protein, 10 aa, Artificial Sequence
  Description of Artificial Sequence: Synthetic peptide
  Seed: KYEAMTKLGF (SSX2_HUMAN)
KQEAMTKLGW

SEQ ID NO: 164447 - protein, 9 aa, Artificial Sequence
  Description of Artificial Sequence: Synthetic peptide
  Seed: KRKYEAMTK (SSX2_HUMAN)
KTKYEAMTM

SEQ ID NO: 164448 - protein, 9 aa, Artificial Sequence
  Description of Artificial Sequence: Synthetic peptide
  Seed: RLRERKQLV (SSX2_HUMAN)
RVRERKQLK

SEQ ID NO: 164449 - protein, 9 aa, Artificial Sequence
  Description of Artificial Sequence: Synthetic peptide
  Seed: FSKEEWEKM (SSX2_HUMAN)
FAKEEWEKW

SEQ ID NO: 164450 - protein, 8 aa, Artificial Sequence
  Description of Artificial Sequence: Synthetic peptide
  Seed: KIFYVYMK (SSX2_HUMAN)
KFFYVYMR

SEQ ID NO: 164451 - protein, 9 aa, Artificial Sequence
  Description of Artificial Sequence: Synthetic peptide
  Seed: TKLGFKATL (SSX2_HUMAN)
TELGFKATY

SEQ ID NO: 164452 - protein, 10 aa, Artificial Sequence
  Description of Artificial Sequence: Synthetic peptide
  Seed: RKQLVIYEEI (SSX2_HUMAN)
RRQLVIYEEI

SEQ ID NO: 164453 - protein, 9 aa, Artificial Sequence
  Description of Artificial Sequence: Synthetic peptide
  Seed: SPKIMPKKP (SSX2_HUMAN)
SPKIMPKKL

SEQ ID NO: 164454 - protein, 9 aa, Artificial Sequence
  Description of Artificial Sequence: Synthetic peptide
  Seed: MTFGRLQGI (SSX2_HUMAN)
MQFGRLQGW

SEQ ID NO: 164455 - protein, 9 aa, Artificial Sequence
  Description of Artificial Sequence: Synthetic peptide
  Seed: FARRPTVGA (SSX2_HUMAN)
FSRRPTVGL

SEQ ID NO: 164456 - protein, 9 aa, Artificial Sequence
  Description of Artificial Sequence: Synthetic peptide
  Seed: VGAQIPEKI (SSX2_HUMAN)
VVAQIPEKF

SEQ ID NO: 164457 - protein, 10 aa, Artificial Sequence
  Description of Artificial Sequence: Synthetic peptide
  Seed: GISPKIMPKK (SSX2_HUMAN)
GASPKIMPKK

SEQ ID NO: 164458 - protein, 9 aa, Artificial Sequence
  Description of Artificial Sequence: Synthetic peptide
  Seed: AFDDIAKYF (SSX2_HUMAN)
AVDDIAKYF

SEQ ID NO: 164459 - protein, 10 aa, Artificial Sequence
  Description of Artificial Sequence: Synthetic peptide
  Seed: MKRKYEAMTK (SSX2_HUMAN)
MTRKYEAMTK

SEQ ID NO: 164460 - protein, 8 aa, Artificial Sequence
  Description of Artificial Sequence: Synthetic peptide
  Seed: AFDDIAKY (SSX2_HUMAN)
AMDDIAKL

SEQ ID NO: 164461 - protein, 9 aa, Artificial Sequence
  Description of Artificial Sequence: Synthetic peptide
  Seed: FKATLPPFM (SSX2_HUMAN)
FQATLPPFY

SEQ ID NO: 164462 - protein, 10 aa, Artificial Sequence
  Description of Artificial Sequence: Synthetic peptide
  Seed: GRLQGISPKI (SSX2_HUMAN)
GQLQGISPKV

SEQ ID NO: 164463 - protein, 9 aa, Artificial Sequence
  Description of Artificial Sequence: Synthetic peptide
  Seed: RERKQLVIY (SSX2_HUMAN)
RKRKQLVIY

SEQ ID NO: 164464 - protein, 9 aa, Artificial Sequence
  Description of Artificial Sequence: Synthetic peptide
  Seed: FSKEEWEKM (SSX2_HUMAN)
FVKEEWEKY

SEQ ID NO: 164465 - protein, 10 aa, Artificial Sequence
  Description of Artificial Sequence: Synthetic peptide
  Seed: AFARRPTVGA (SSX2_HUMAN)
AHARRPTVGK

SEQ ID NO: 164466 - protein, 9 aa, Artificial Sequence
  Description of Artificial Sequence: Synthetic peptide
  Seed: YMKRKYEAM (SSX2_HUMAN)
YMKRKYEAI

SEQ ID NO: 164467 - protein, 9 aa, Artificial Sequence
  Description of Artificial Sequence: Synthetic peptide
  Seed: GISPKIMPK (SSX2_HUMAN)
GGSPKIMPR

SEQ ID NO: 164468 - protein, 10 aa, Artificial Sequence
  Description of Artificial Sequence: Synthetic peptide
  Seed: KYFSKEEWEK (SSX2_HUMAN)
KLFSKEEWEY

SEQ ID NO: 164469 - protein, 9 aa, Artificial Sequence
  Description of Artificial Sequence: Synthetic peptide
  Seed: RKYEAMTKL (SSX2_HUMAN)
RLYEAMTKL

SEQ ID NO: 164470 - protein, 11 aa, Artificial Sequence
  Description of Artificial Sequence: Synthetic peptide
  Seed: FGRLQGISPKI (SSX2_HUMAN)
FDRLQGISPKL

SEQ ID NO: 164471 - protein, 9 aa, Artificial Sequence
  Description of Artificial Sequence: Synthetic peptide
  Seed: EAMTKLGFK (SSX2_HUMAN)
ETMTKLGFY

SEQ ID NO: 164472 - protein, 10 aa, Artificial Sequence
  Description of Artificial Sequence: Synthetic peptide
  Seed: YVYMKRKYEA (SSX2_HUMAN)
YPYMKRKYEF

SEQ ID NO: 164473 - protein, 9 aa, Artificial Sequence
  Description of Artificial Sequence: Synthetic peptide
  Seed: AFDDIAKYF (SSX2_HUMAN)
AIDDIAKYY

SEQ ID NO: 164474 - protein, 9 aa, Artificial Sequence
  Description of Artificial Sequence: Synthetic peptide
  Seed: KIFYVYMKR (SSX2_HUMAN)
KYFYVYMKK

SEQ ID NO: 164475 - protein, 10 aa, Artificial Sequence
  Description of Artificial Sequence: Synthetic peptide
  Seed: KIFYVYMKRK (SSX2_HUMAN)
KNFYVYMKRR

SEQ ID NO: 164476 - protein, 10 aa, Artificial Sequence
  Description of Artificial Sequence: Synthetic peptide
  Seed: MKASEKIFYV (SSX2_HUMAN)
MTASEKIFYV

SEQ ID NO: 164477 - protein, 10 aa, Artificial Sequence
  Description of Artificial Sequence: Synthetic peptide
  Seed: WEKMKASEKI (SSX2_HUMAN)
WEKMKASEKM

SEQ ID NO: 164478 - protein, 9 aa, Artificial Sequence
  Description of Artificial Sequence: Synthetic peptide
  Seed: KMKASEKIF (SSX2_HUMAN)
KTKASEKIF

SEQ ID NO: 164479 - protein, 9 aa, Artificial Sequence
  Description of Artificial Sequence: Synthetic peptide
  Seed: RRPTVGAQI (SSX2_HUMAN)
RYPTVGAQF

SEQ ID NO: 164480 - protein, 9 aa, Artificial Sequence
  Description of Artificial Sequence: Synthetic peptide
  Seed: GISPKIMPK (SSX2_HUMAN)
GTSPKIMPL

SEQ ID NO: 164481 - protein, 10 aa, Artificial Sequence
  Description of Artificial Sequence: Synthetic peptide
  Seed: KIFYVYMKRK (SSX2_HUMAN)
KQFYVYMKRR

SEQ ID NO: 164482 - protein, 9 aa, Artificial Sequence
  Description of Artificial Sequence: Synthetic peptide
  Seed: VGAQIPEKI (SSX2_HUMAN)
VVAQIPEKW

SEQ ID NO: 164483 - protein, 10 aa, Artificial Sequence
  Description of Artificial Sequence: Synthetic peptide
  Seed: KIFYVYMKRK (SSX2_HUMAN)
KVFYVYMKRR

SEQ ID NO: 164484 - protein, 10 aa, Artificial Sequence
  Description of Artificial Sequence: Synthetic peptide
  Seed: MKASEKIFYV (SSX2_HUMAN)
MMASEKIFYS

SEQ ID NO: 164485 - protein, 9 aa, Artificial Sequence
  Description of Artificial Sequence: Synthetic peptide
  Seed: KAFDDIAKY (SSX2_HUMAN)
KFFDDIAKF

SEQ ID NO: 164486 - protein, 10 aa, Artificial Sequence
  Description of Artificial Sequence: Synthetic peptide
  Seed: RLRERKQLVI (SSX2_HUMAN)
RSRERKQLVV

SEQ ID NO: 164487 - protein, 9 aa, Artificial Sequence
  Description of Artificial Sequence: Synthetic peptide
  Seed: TLPPFMCNK (SSX2_HUMAN)
TTPPFMCNR

SEQ ID NO: 164488 - protein, 9 aa, Artificial Sequence
  Description of Artificial Sequence: Synthetic peptide
  Seed: ERPQMTFGR (SSX2_HUMAN)
ETPQMTFGR

SEQ ID NO: 164489 - protein, 9 aa, Artificial Sequence
  Description of Artificial Sequence: Synthetic peptide
  Seed: AFDDIAKYF (SSX2_HUMAN)
AQDDIAKYL

SEQ ID NO: 164490 - protein, 8 aa, Artificial Sequence
  Description of Artificial Sequence: Synthetic peptide
  Seed: YMKRKYEA (SSX2_HUMAN)
YSKRKYEL

SEQ ID NO: 164491 - protein, 10 aa, Artificial Sequence
  Description of Artificial Sequence: Synthetic peptide
  Seed: MKASEKIFYV (SSX2_HUMAN)
MGASEKIFYI

SEQ ID NO: 164492 - protein, 9 aa, Artificial Sequence
  Description of Artificial Sequence: Synthetic peptide
  Seed: DAFARRPTV (SSX2_HUMAN)
DTFARRPTL

SEQ ID NO: 164493 - protein, 9 aa, Artificial Sequence
  Description of Artificial Sequence: Synthetic peptide
  Seed: TTSEKIHER (SSX2_HUMAN)
TMSEKIHEI

SEQ ID NO: 164494 - protein, 9 aa, Artificial Sequence
  Description of Artificial Sequence: Synthetic peptide
  Seed: DAFARRPTV (SSX2_HUMAN)
DHFARRPTL

SEQ ID NO: 164495 - protein, 10 aa, Artificial Sequence
  Description of Artificial Sequence: Synthetic peptide
  Seed: RLRERKQLVI (SSX2_HUMAN)
RIRERKQLVK

SEQ ID NO: 164496 - protein, 9 aa, Artificial Sequence
  Description of Artificial Sequence: Synthetic peptide
  Seed: MTFGRLQGI (SSX2_HUMAN)
MLFGRLQGL

SEQ ID NO: 164497 - protein, 10 aa, Artificial Sequence
  Description of Artificial Sequence: Synthetic peptide
  Seed: KYFSKEEWEK (SSX2_HUMAN)
KVFSKEEWEY

SEQ ID NO: 164498 - protein, 9 aa, Artificial Sequence
  Description of Artificial Sequence: Synthetic peptide
  Seed: TTSEKIHER (SSX2_HUMAN)
TSSEKIHEV

SEQ ID NO: 164499 - protein, 11 aa, Artificial Sequence
  Description of Artificial Sequence: Synthetic peptide
  Seed: VGAQIPEKIQK (SSX2_HUMAN)
VTAQIPEKIQY

SEQ ID NO: 164500 - protein, 10 aa, Artificial Sequence
  Description of Artificial Sequence: Synthetic peptide
  Seed: KRGEHAWTHR (SSX2_HUMAN)
KTGEHAWTHR

SEQ ID NO: 164501 - protein, 10 aa, Artificial Sequence
  Description of Artificial Sequence: Synthetic peptide
  Seed: HAWTHRLRER (SSX2_HUMAN)
HFWTHRLREK

SEQ ID NO: 164502 - protein, 9 aa, Artificial Sequence
  Description of Artificial Sequence: Synthetic peptide
  Seed: YFSKEEWEK (SSX2_HUMAN)
YASKEEWEM

SEQ ID NO: 164503 - protein, 10 aa, Artificial Sequence
  Description of Artificial Sequence: Synthetic peptide
  Seed: AFARRPTVGA (SSX2_HUMAN)
ARARRPTVGK

SEQ ID NO: 164504 - protein, 10 aa, Artificial Sequence
  Description of Artificial Sequence: Synthetic peptide
  Seed: KAFDDIAKYF (SSX2_HUMAN)
KTFDDIAKYL

SEQ ID NO: 164505 - protein, 10 aa, Artificial Sequence
  Description of Artificial Sequence: Synthetic peptide
  Seed: QGISPKIMPK (SSX2_HUMAN)
QMISPKIMPR

SEQ ID NO: 164506 - protein, 10 aa, Artificial Sequence
  Description of Artificial Sequence: Synthetic peptide
  Seed: KIFYVYMKRK (SSX2_HUMAN)
KYFYVYMKRR

SEQ ID NO: 164507 - protein, 9 aa, Artificial Sequence
  Description of Artificial Sequence: Synthetic peptide
  Seed: KATLPPFMC (SSX2_HUMAN)
KITLPPFMW

SEQ ID NO: 164508 - protein, 9 aa, Artificial Sequence
  Description of Artificial Sequence: Synthetic peptide
  Seed: MTFGRLQGI (SSX2_HUMAN)
MLFGRLQGC

SEQ ID NO: 164509 - protein, 10 aa, Artificial Sequence
  Description of Artificial Sequence: Synthetic peptide
  Seed: KAFDDIAKYF (SSX2_HUMAN)
KLFDDIAKYR

SEQ ID NO: 164510 - protein, 11 aa, Artificial Sequence
  Description of Artificial Sequence: Synthetic peptide
  Seed: YMKRKYEAMTK (SSX2_HUMAN)
YMKRKYEAMTL

SEQ ID NO: 164511 - protein, 9 aa, Artificial Sequence
  Description of Artificial Sequence: Synthetic peptide
  Seed: KQLVIYEEI (SSX2_HUMAN)
KTLVIYEEV

SEQ ID NO: 164512 - protein, 9 aa, Artificial Sequence
  Description of Artificial Sequence: Synthetic peptide
  Seed: KASEKIFYV (SSX2_HUMAN)
KVSEKIFYL

SEQ ID NO: 164513 - protein, 9 aa, Artificial Sequence
  Description of Artificial Sequence: Synthetic peptide
  Seed: KRKYEAMTK (SSX2_HUMAN)
KAKYEAMTK

SEQ ID NO: 164514 - protein, 10 aa, Artificial Sequence
  Description of Artificial Sequence: Synthetic peptide
  Seed: YVYMKRKYEA (SSX2_HUMAN)
YLYMKRKYEI

SEQ ID NO: 164515 - protein, 9 aa, Artificial Sequence
  Description of Artificial Sequence: Synthetic peptide
  Seed: YMKRKYEAM (SSX2_HUMAN)
YPKRKYEAV

SEQ ID NO: 164516 - protein, 9 aa, Artificial Sequence
  Description of Artificial Sequence: Synthetic peptide
  Seed: MKASEKIFY (SSX2_HUMAN)
MLASEKIFY

SEQ ID NO: 164517 - protein, 9 aa, Artificial Sequence
  Description of Artificial Sequence: Synthetic peptide
  Seed: YMKRKYEAM (SSX2_HUMAN)
YIKRKYEAL

SEQ ID NO: 164518 - protein, 9 aa, Artificial Sequence
  Description of Artificial Sequence: Synthetic peptide
  Seed: FSKEEWEKM (SSX2_HUMAN)
FYKEEWEKY

SEQ ID NO: 164519 - protein, 10 aa, Artificial Sequence
  Description of Artificial Sequence: Synthetic peptide
  Seed: MKASEKIFYV (SSX2_HUMAN)
MLASEKIFYF

SEQ ID NO: 164520 - protein, 9 aa, Artificial Sequence
  Description of Artificial Sequence: Synthetic peptide
  Seed: AKYFSKEEW (SSX2_HUMAN)
AKYFSKEEF

SEQ ID NO: 164521 - protein, 10 aa, Artificial Sequence
  Description of Artificial Sequence: Synthetic peptide
  Seed: EKIFYVYMKR (SSX2_HUMAN)
ECIFYVYMKR

SEQ ID NO: 164522 - protein, 9 aa, Artificial Sequence
  Description of Artificial Sequence: Synthetic peptide
  Seed: TTSEKIHER (SSX2_HUMAN)
TWSEKIHEY

SEQ ID NO: 164523 - protein, 9 aa, Artificial Sequence
  Description of Artificial Sequence: Synthetic peptide
  Seed: KIHERSGPK (SSX2_HUMAN)
KAHERSGPR

SEQ ID NO: 164524 - protein, 9 aa, Artificial Sequence
  Description of Artificial Sequence: Synthetic peptide
  Seed: FSKEEWEKM (SSX2_HUMAN)
FPKEEWEKY

SEQ ID NO: 164525 - protein, 9 aa, Artificial Sequence
  Description of Artificial Sequence: Synthetic peptide
  Seed: DDIAKYFSK (SSX2_HUMAN)
DVIAKYFSK

SEQ ID NO: 164526 - protein, 9 aa, Artificial Sequence
  Description of Artificial Sequence: Synthetic peptide
  Seed: TTSEKIHER (SSX2_HUMAN)
TRSEKIHEF

SEQ ID NO: 164527 - protein, 9 aa, Artificial Sequence
  Description of Artificial Sequence: Synthetic peptide
  Seed: DAFARRPTV (SSX2_HUMAN)
DRFARRPTM

SEQ ID NO: 164528 - protein, 9 aa, Artificial Sequence
  Description of Artificial Sequence: Synthetic peptide
  Seed: MTFGRLQGI (SSX2_HUMAN)
MSFGRLQGK

SEQ ID NO: 164529 - protein, 9 aa, Artificial Sequence
  Description of Artificial Sequence: Synthetic peptide
  Seed: GFKATLPPF (SSX2_HUMAN)
GMKATLPPM

SEQ ID NO: 164530 - protein, 8 aa, Artificial Sequence
  Description of Artificial Sequence: Synthetic peptide
  Seed: AFDDIAKY (SSX2_HUMAN)
AQDDIAKL

SEQ ID NO: 164531 - protein, 9 aa, Artificial Sequence
  Description of Artificial Sequence: Synthetic peptide
  Seed: AMTKLGFKA (SSX2_HUMAN)
AMTKLGFKI

SEQ ID NO: 164532 - protein, 10 aa, Artificial Sequence
  Description of Artificial Sequence: Synthetic peptide
  Seed: VYMKRKYEAM (SSX2_HUMAN)
VMMKRKYEAF

SEQ ID NO: 164533 - protein, 10 aa, Artificial Sequence
  Description of Artificial Sequence: Synthetic peptide
  Seed: AQIPEKIQKA (SSX2_HUMAN)
AEIPEKIQKA

SEQ ID NO: 164534 - protein, 9 aa, Artificial Sequence
  Description of Artificial Sequence: Synthetic peptide
  Seed: TKLGFKATL (SSX2_HUMAN)
TRLGFKATA

SEQ ID NO: 164535 - protein, 11 aa, Artificial Sequence
  Description of Artificial Sequence: Synthetic peptide
  Seed: YVYMKRKYEAM (SSX2_HUMAN)
YMYMKRKYEAI

SEQ ID NO: 164536 - protein, 9 aa, Artificial Sequence
  Description of Artificial Sequence: Synthetic peptide
  Seed: IPEKIQKAF (SSX2_HUMAN)
IPEKIQKAL

SEQ ID NO: 164537 - protein, 9 aa, Artificial Sequence
  Description of Artificial Sequence: Synthetic peptide
  Seed: KASEKIFYV (SSX2_HUMAN)
KMSEKIFYK

SEQ ID NO: 164538 - protein, 9 aa, Artificial Sequence
  Description of Artificial Sequence: Synthetic peptide
  Seed: KRGEHAWTH (SSX2_HUMAN)
KRGEHAWTL

SEQ ID NO: 164539 - protein, 8 aa, Artificial Sequence
  Description of Artificial Sequence: Synthetic peptide
  Seed: AFDDIAKY (SSX2_HUMAN)
AVDDIAKM

SEQ ID NO: 164540 - protein, 10 aa, Artificial Sequence
  Description of Artificial Sequence: Synthetic peptide
  Seed: RLQGISPKIM (SSX2_HUMAN)
RQQGISPKIL

SEQ ID NO: 164541 - protein, 9 aa, Artificial Sequence
  Description of Artificial Sequence: Synthetic peptide
  Seed: KIHERSGPK (SSX2_HUMAN)
KTHERSGPL

SEQ ID NO: 164542 - protein, 9 aa, Artificial Sequence
  Description of Artificial Sequence: Synthetic peptide
  Seed: RERKQLVIY (SSX2_HUMAN)
RQRKQLVIL

SEQ ID NO: 164543 - protein, 9 aa, Artificial Sequence
  Description of Artificial Sequence: Synthetic peptide
  Seed: DAFARRPTV (SSX2_HUMAN)
DTFARRPTY

SEQ ID NO: 164544 - protein, 9 aa, Artificial Sequence
  Description of Artificial Sequence: Synthetic peptide
  Seed: KQLVIYEEI (SSX2_HUMAN)
KQLVIYEEW

SEQ ID NO: 164545 - protein, 9 aa, Artificial Sequence
  Description of Artificial Sequence: Synthetic peptide
  Seed: KAFDDIAKY (SSX2_HUMAN)
KVFDDIAKI

SEQ ID NO: 164546 - protein, 11 aa, Artificial Sequence
  Description of Artificial Sequence: Synthetic peptide
  Seed: ASGPQNDGKEL (SSX2_HUMAN)
AQGPQNDGKEW

SEQ ID NO: 164547 - protein, 10 aa, Artificial Sequence
  Description of Artificial Sequence: Synthetic peptide
  Seed: MTKLGFKATL (SSX2_HUMAN)
MTKLGFKATM

SEQ ID NO: 164548 - protein, 9 aa, Artificial Sequence
  Description of Artificial Sequence: Synthetic peptide
  Seed: AFDDIAKYF (SSX2_HUMAN)
AGDDIAKYV

SEQ ID NO: 164549 - protein, 9 aa, Artificial Sequence
  Description of Artificial Sequence: Synthetic peptide
  Seed: TTSEKIHER (SSX2_HUMAN)
TMSEKIHEK

SEQ ID NO: 164550 - protein, 9 aa, Artificial Sequence
  Description of Artificial Sequence: Synthetic peptide
  Seed: NGDDAFARR (SSX2_HUMAN)
NLDDAFARY

SEQ ID NO: 164551 - protein, 9 aa, Artificial Sequence
  Description of Artificial Sequence: Synthetic peptide
  Seed: VGAQIPEKI (SSX2_HUMAN)
VVAQIPEKL

SEQ ID NO: 164552 - protein, 9 aa, Artificial Sequence
  Description of Artificial Sequence: Synthetic peptide
  Seed: RLRERKQLV (SSX2_HUMAN)
RSRERKQLT

SEQ ID NO: 164553 - protein, 10 aa, Artificial Sequence
  Description of Artificial Sequence: Synthetic peptide
  Seed: KYFSKEEWEK (SSX2_HUMAN)
KFFSKEEWEY

SEQ ID NO: 164554 - protein, 9 aa, Artificial Sequence
  Description of Artificial Sequence: Synthetic peptide
  Seed: QIPEKIQKA (SSX2_HUMAN)
QVPEKIQKR

SEQ ID NO: 164555 - protein, 9 aa, Artificial Sequence
  Description of Artificial Sequence: Synthetic peptide
  Seed: MTFGRLQGI (SSX2_HUMAN)
MQFGRLQGM

SEQ ID NO: 164556 - protein, 10 aa, Artificial Sequence
  Description of Artificial Sequence: Synthetic peptide
  Seed: KAFDDIAKYF (SSX2_HUMAN)
KKFDDIAKYY

SEQ ID NO: 164557 - protein, 10 aa, Artificial Sequence
  Description of Artificial Sequence: Synthetic peptide
  Seed: MKASEKIFYV (SSX2_HUMAN)
MSASEKIFYA

SEQ ID NO: 164558 - protein, 9 aa, Artificial Sequence
  Description of Artificial Sequence: Synthetic peptide
  Seed: DAFARRPTV (SSX2_HUMAN)
DVFARRPTK

SEQ ID NO: 164559 - protein, 9 aa, Artificial Sequence
  Description of Artificial Sequence: Synthetic peptide
  Seed: AMTKLGFKA (SSX2_HUMAN)
AITKLGFKV

SEQ ID NO: 164560 - protein, 9 aa, Artificial Sequence
  Description of Artificial Sequence: Synthetic peptide
  Seed: AQIPEKIQK (SSX2_HUMAN)
ASIPEKIQM

SEQ ID NO: 164561 - protein, 9 aa, Artificial Sequence
  Description of Artificial Sequence: Synthetic peptide
  Seed: KASEKIFYV (SSX2_HUMAN)
KRSEKIFYY

SEQ ID NO: 164562 - protein, 8 aa, Artificial Sequence
  Description of Artificial Sequence: Synthetic peptide
  Seed: FDDIAKYF (SSX2_HUMAN)
FSDIAKYL

SEQ ID NO: 164563 - protein, 9 aa, Artificial Sequence
  Description of Artificial Sequence: Synthetic peptide
  Seed: MTFGRLQGI (SSX2_HUMAN)
MTFGRLQGA

SEQ ID NO: 164564 - protein, 9 aa, Artificial Sequence
  Description of Artificial Sequence: Synthetic peptide
  Seed: KRKYEAMTK (SSX2_HUMAN)
KTKYEAMTL

SEQ ID NO: 164565 - protein, 9 aa, Artificial Sequence
  Description of Artificial Sequence: Synthetic peptide
  Seed: QIPEKIQKA (SSX2_HUMAN)
QVPEKIQKM

SEQ ID NO: 164566 - protein, 10 aa, Artificial Sequence
  Description of Artificial Sequence: Synthetic peptide
  Seed: VYMKRKYEAM (SSX2_HUMAN)
VMMKRKYEAL

SEQ ID NO: 164567 - protein, 9 aa, Artificial Sequence
  Description of Artificial Sequence: Synthetic peptide
  Seed: TTSEKIHER (SSX2_HUMAN)
TTSEKIHEY

SEQ ID NO: 164568 - protein, 10 aa, Artificial Sequence
  Description of Artificial Sequence: Synthetic peptide
  Seed: AQIPEKIQKA (SSX2_HUMAN)
AEIPEKIQKM

SEQ ID NO: 164569 - protein, 9 aa, Artificial Sequence
  Description of Artificial Sequence: Synthetic peptide
  Seed: EEWEKMKAS (SSX2_HUMAN)
EEWEKMKAY

SEQ ID NO: 164570 - protein, 11 aa, Artificial Sequence
  Description of Artificial Sequence: Synthetic peptide
  Seed: RGEHAWTHRLR (SSX2_HUMAN)
RSEHAWTHRLR

SEQ ID NO: 164571 - protein, 10 aa, Artificial Sequence
  Description of Artificial Sequence: Synthetic peptide
  Seed: GRLQGISPKI (SSX2_HUMAN)
GYLQGISPKV

SEQ ID NO: 164572 - protein, 11 aa, Artificial Sequence
  Description of Artificial Sequence: Synthetic peptide
  Seed: AFDDIAKYFSK (SSX2_HUMAN)
AADDIAKYFSY

SEQ ID NO: 164573 - protein, 9 aa, Artificial Sequence
  Description of Artificial Sequence: Synthetic peptide
  Seed: FKATLPPFM (SSX2_HUMAN)
FQATLPPFF

SEQ ID NO: 164574 - protein, 9 aa, Artificial Sequence
  Description of Artificial Sequence: Synthetic peptide
  Seed: FARRPTVGA (SSX2_HUMAN)
FVRRPTVGY

SEQ ID NO: 164575 - protein, 9 aa, Artificial Sequence
  Description of Artificial Sequence: Synthetic peptide
  Seed: YMKRKYEAM (SSX2_HUMAN)
YLKRKYEAI

SEQ ID NO: 164576 - protein, 10 aa, Artificial Sequence
  Description of Artificial Sequence: Synthetic peptide
  Seed: KAFDDIAKYF (SSX2_HUMAN)
KIFDDIAKYY

SEQ ID NO: 164577 - protein, 10 aa, Artificial Sequence
  Description of Artificial Sequence: Synthetic peptide
  Seed: YVYMKRKYEA (SSX2_HUMAN)
YLYMKRKYEM

SEQ ID NO: 164578 - protein, 9 aa, Artificial Sequence
  Description of Artificial Sequence: Synthetic peptide
  Seed: EHAWTHRLR (SSX2_HUMAN)
ELAWTHRLR

SEQ ID NO: 164579 - protein, 9 aa, Artificial Sequence
  Description of Artificial Sequence: Synthetic peptide
  Seed: RLQGISPKI (SSX2_HUMAN)
RIQGISPKF

SEQ ID NO: 164580 - protein, 8 aa, Artificial Sequence
  Description of Artificial Sequence: Synthetic peptide
  Seed: FDDIAKYF (SSX2_HUMAN)
FGDIAKYM

SEQ ID NO: 164581 - protein, 9 aa, Artificial Sequence
  Description of Artificial Sequence: Synthetic peptide
  Seed: KASEKIFYV (SSX2_HUMAN)
KMSEKIFYG

SEQ ID NO: 164582 - protein, 9 aa, Artificial Sequence
  Description of Artificial Sequence: Synthetic peptide
  Seed: KAFDDIAKY (SSX2_HUMAN)
KYFDDIAKM

SEQ ID NO: 164583 - protein, 8 aa, Artificial Sequence
  Description of Artificial Sequence: Synthetic peptide
  Seed: YMKRKYEA (SSX2_HUMAN)
YLKRKYEV

SEQ ID NO: 164584 - protein, 9 aa, Artificial Sequence
  Description of Artificial Sequence: Synthetic peptide
  Seed: KASEKIFYV (SSX2_HUMAN)
KRSEKIFYM

SEQ ID NO: 164585 - protein, 9 aa, Artificial Sequence
  Description of Artificial Sequence: Synthetic peptide
  Seed: RKYEAMTKL (SSX2_HUMAN)
RQYEAMTKY

SEQ ID NO: 164586 - protein, 11 aa, Artificial Sequence
  Description of Artificial Sequence: Synthetic peptide
  Seed: KYEAMTKLGFK (SSX2_HUMAN)
KPEAMTKLGFR

SEQ ID NO: 164587 - protein, 9 aa, Artificial Sequence
  Description of Artificial Sequence: Synthetic peptide
  Seed: AQIPEKIQK (SSX2_HUMAN)
AYIPEKIQL

SEQ ID NO: 164588 - protein, 9 aa, Artificial Sequence
  Description of Artificial Sequence: Synthetic peptide
  Seed: DAFARRPTV (SSX2_HUMAN)
DHFARRPTI

SEQ ID NO: 164589 - protein, 9 aa, Artificial Sequence
  Description of Artificial Sequence: Synthetic peptide
  Seed: FSKEEWEKM (SSX2_HUMAN)
FVKEEWEKL

SEQ ID NO: 164590 - protein, 9 aa, Artificial Sequence
  Description of Artificial Sequence: Synthetic peptide
  Seed: GISPKIMPK (SSX2_HUMAN)
GASPKIMPM

SEQ ID NO: 164591 - protein, 10 aa, Artificial Sequence
  Description of Artificial Sequence: Synthetic peptide
  Seed: KIFYVYMKRK (SSX2_HUMAN)
KGFYVYMKRR

SEQ ID NO: 164592 - protein, 10 aa, Artificial Sequence
  Description of Artificial Sequence: Synthetic peptide
  Seed: KASEKIFYVY (SSX2_HUMAN)
KSSEKIFYVL

SEQ ID NO: 164593 - protein, 9 aa, Artificial Sequence
  Description of Artificial Sequence: Synthetic peptide
  Seed: KIFYVYMKR (SSX2_HUMAN)
KTFYVYMKY

SEQ ID NO: 164594 - protein, 9 aa, Artificial Sequence
  Description of Artificial Sequence: Synthetic peptide
  Seed: AFDDIAKYF (SSX2_HUMAN)
AYDDIAKYY

SEQ ID NO: 164595 - protein, 10 aa, Artificial Sequence
  Description of Artificial Sequence: Synthetic peptide
  Seed: KASEKIFYVY (SSX2_HUMAN)
KQSEKIFYVM

SEQ ID NO: 164596 - protein, 10 aa, Artificial Sequence
  Description of Artificial Sequence: Synthetic peptide
  Seed: KIFYVYMKRK (SSX2_HUMAN)
KSFYVYMKRK

SEQ ID NO: 164597 - protein, 9 aa, Artificial Sequence
  Description of Artificial Sequence: Synthetic peptide
  Seed: RERKQLVIY (SSX2_HUMAN)
RSRKQLVIY

SEQ ID NO: 164598 - protein, 9 aa, Artificial Sequence
  Description of Artificial Sequence: Synthetic peptide
  Seed: AQIPEKIQK (SSX2_HUMAN)
AAIPEKIQI

SEQ ID NO: 164599 - protein, 9 aa, Artificial Sequence
  Description of Artificial Sequence: Synthetic peptide
  Seed: KMKASEKIF (SSX2_HUMAN)
KMKASEKIY

SEQ ID NO: 164600 - protein, 10 aa, Artificial Sequence
  Description of Artificial Sequence: Synthetic peptide
  Seed: KAFDDIAKYF (SSX2_HUMAN)
KTFDDIAKYV

SEQ ID NO: 164601 - protein, 9 aa, Artificial Sequence
  Description of Artificial Sequence: Synthetic peptide
  Seed: TVGAQIPEK (SSX2_HUMAN)
TAGAQIPEY

SEQ ID NO: 164602 - protein, 9 aa, Artificial Sequence
  Description of Artificial Sequence: Synthetic peptide
  Seed: KASEKIFYV (SSX2_HUMAN)
KQSEKIFYW

SEQ ID NO: 164603 - protein, 10 aa, Artificial Sequence
  Description of Artificial Sequence: Synthetic peptide
  Seed: MTKLGFKATL (SSX2_HUMAN)
MLKLGFKATF

SEQ ID NO: 164604 - protein, 9 aa, Artificial Sequence
  Description of Artificial Sequence: Synthetic peptide
  Seed: FSKEEWEKM (SSX2_HUMAN)
FSKEEWEKF

SEQ ID NO: 164605 - protein, 9 aa, Artificial Sequence
  Description of Artificial Sequence: Synthetic peptide
  Seed: MTFGRLQGI (SSX2_HUMAN)
MLFGRLQGR

SEQ ID NO: 164606 - protein, 9 aa, Artificial Sequence
  Description of Artificial Sequence: Synthetic peptide
  Seed: YEAMTKLGF (SSX2_HUMAN)
YMAMTKLGF

SEQ ID NO: 164607 - protein, 8 aa, Artificial Sequence
  Description of Artificial Sequence: Synthetic peptide
  Seed: MKRKYEAM (SSX2_HUMAN)
MMRKYEAY

SEQ ID NO: 164608 - protein, 9 aa, Artificial Sequence
  Description of Artificial Sequence: Synthetic peptide
  Seed: KASEKIFYV (SSX2_HUMAN)
KQSEKIFYT

SEQ ID NO: 164609 - protein, 9 aa, Artificial Sequence
  Description of Artificial Sequence: Synthetic peptide
  Seed: TTSEKIHER (SSX2_HUMAN)
TSSEKIHEF

SEQ ID NO: 164610 - protein, 10 aa, Artificial Sequence
  Description of Artificial Sequence: Synthetic peptide
  Seed: RLQGISPKIM (SSX2_HUMAN)
RKQGISPKIY

SEQ ID NO: 164611 - protein, 10 aa, Artificial Sequence
  Description of Artificial Sequence: Synthetic peptide
  Seed: KYFSKEEWEK (SSX2_HUMAN)
KTFSKEEWEY

SEQ ID NO: 164612 - protein, 10 aa, Artificial Sequence
  Description of Artificial Sequence: Synthetic peptide
  Seed: MTKLGFKATL (SSX2_HUMAN)
MIKLGFKATY

SEQ ID NO: 164613 - protein, 9 aa, Artificial Sequence
  Description of Artificial Sequence: Synthetic peptide
  Seed: GFKATLPPF (SSX2_HUMAN)
GIKATLPPF

SEQ ID NO: 164614 - protein, 9 aa, Artificial Sequence
  Description of Artificial Sequence: Synthetic peptide
  Seed: RKYEAMTKL (SSX2_HUMAN)
RMYEAMTKW

SEQ ID NO: 164615 - protein, 10 aa, Artificial Sequence
  Description of Artificial Sequence: Synthetic peptide
  Seed: YMKRKYEAMT (SSX2_HUMAN)
YMKRKYEAME

SEQ ID NO: 164616 - protein, 10 aa, Artificial Sequence
  Description of Artificial Sequence: Synthetic peptide
  Seed: LGFKATLPPF (SSX2_HUMAN)
LMFKATLPPW

SEQ ID NO: 164617 - protein, 9 aa, Artificial Sequence
  Description of Artificial Sequence: Synthetic peptide
  Seed: MTFGRLQGI (SSX2_HUMAN)
MIFGRLQGI

SEQ ID NO: 164618 - protein, 10 aa, Artificial Sequence
  Description of Artificial Sequence: Synthetic peptide
  Seed: KYFSKEEWEK (SSX2_HUMAN)
KWFSKEEWEY

SEQ ID NO: 164619 - protein, 10 aa, Artificial Sequence
  Description of Artificial Sequence: Synthetic peptide
  Seed: KAFDDIAKYF (SSX2_HUMAN)
KVFDDIAKYR

SEQ ID NO: 164620 - protein, 10 aa, Artificial Sequence
  Description of Artificial Sequence: Synthetic peptide
  Seed: KIFYVYMKRK (SSX2_HUMAN)
KLFYVYMKRK

SEQ ID NO: 164621 - protein, 10 aa, Artificial Sequence
  Description of Artificial Sequence: Synthetic peptide
  Seed: RLRERKQLVI (SSX2_HUMAN)
RQRERKQLVK

SEQ ID NO: 164622 - protein, 10 aa, Artificial Sequence
  Description of Artificial Sequence: Synthetic peptide
  Seed: ATLPPFMCNK (SSX2_HUMAN)
AALPPFMCNR

SEQ ID NO: 164623 - protein, 10 aa, Artificial Sequence
  Description of Artificial Sequence: Synthetic peptide
  Seed: QMTFGRLQGI (SSX2_HUMAN)
QETFGRLQGV

SEQ ID NO: 164624 - protein, 10 aa, Artificial Sequence
  Description of Artificial Sequence: Synthetic peptide
  Seed: YEAMTKLGFK (SSX2_HUMAN)
YLAMTKLGFK

SEQ ID NO: 164625 - protein, 11 aa, Artificial Sequence
  Description of Artificial Sequence: Synthetic peptide
  Seed: RKYEAMTKLGF (SSX2_HUMAN)
RQYEAMTKLGF

SEQ ID NO: 164626 - protein, 10 aa, Artificial Sequence
  Description of Artificial Sequence: Synthetic peptide
  Seed: KAFDDIAKYF (SSX2_HUMAN)
KWFDDIAKYY

SEQ ID NO: 164627 - protein, 9 aa, Artificial Sequence
  Description of Artificial Sequence: Synthetic peptide
  Seed: KAFDDIAKY (SSX2_HUMAN)
KVFDDIAKW

SEQ ID NO: 164628 - protein, 9 aa, Artificial Sequence
  Description of Artificial Sequence: Synthetic peptide
  Seed: ERPQMTFGR (SSX2_HUMAN)
EMPQMTFGR

SEQ ID NO: 164629 - protein, 9 aa, Artificial Sequence
  Description of Artificial Sequence: Synthetic peptide
  Seed: KASEKIFYV (SSX2_HUMAN)
KGSEKIFYI

SEQ ID NO: 164630 - protein, 9 aa, Artificial Sequence
  Description of Artificial Sequence: Synthetic peptide
  Seed: KASEKIFYV (SSX2_HUMAN)
KNSEKIFYW

SEQ ID NO: 164631 - protein, 9 aa, Artificial Sequence
  Description of Artificial Sequence: Synthetic peptide
  Seed: YMKRKYEAM (SSX2_HUMAN)
YTKRKYEAA

SEQ ID NO: 164632 - protein, 8 aa, Artificial Sequence
  Description of Artificial Sequence: Synthetic peptide
  Seed: KIFYVYMK (SSX2_HUMAN)
KLFYVYMR

SEQ ID NO: 164633 - protein, 9 aa, Artificial Sequence
  Description of Artificial Sequence: Synthetic peptide
  Seed: KEEWEKMKA (SSX2_HUMAN)
KEEWEKMKF

SEQ ID NO: 164634 - protein, 9 aa, Artificial Sequence
  Description of Artificial Sequence: Synthetic peptide
  Seed: RLRERKQLV (SSX2_HUMAN)
RYRERKQLV

SEQ ID NO: 164635 - protein, 11 aa, Artificial Sequence
  Description of Artificial Sequence: Synthetic peptide
  Seed: YVYMKRKYEAM (SSX2_HUMAN)
YPYMKRKYEAM

SEQ ID NO: 164636 - protein, 9 aa, Artificial Sequence
  Description of Artificial Sequence: Synthetic peptide
  Seed: KRKYEAMTK (SSX2_HUMAN)
KFKYEAMTK

SEQ ID NO: 164637 - protein, 10 aa, Artificial Sequence
  Description of Artificial Sequence: Synthetic peptide
  Seed: AFARRPTVGA (SSX2_HUMAN)
ASARRPTVGA

SEQ ID NO: 164638 - protein, 10 aa, Artificial Sequence
  Description of Artificial Sequence: Synthetic peptide
  Seed: RLRERKQLVI (SSX2_HUMAN)
RYRERKQLVA

SEQ ID NO: 164639 - protein, 9 aa, Artificial Sequence
  Description of Artificial Sequence: Synthetic peptide
  Seed: FARRPTVGA (SSX2_HUMAN)
FPRRPTVGP

SEQ ID NO: 164640 - protein, 10 aa, Artificial Sequence
  Description of Artificial Sequence: Synthetic peptide
  Seed: YMKRKYEAMT (SSX2_HUMAN)
YMKRKYEAMD

SEQ ID NO: 164641 - protein, 10 aa, Artificial Sequence
  Description of Artificial Sequence: Synthetic peptide
  Seed: KAFDDIAKYF (SSX2_HUMAN)
KRFDDIAKYI

SEQ ID NO: 164642 - protein, 9 aa, Artificial Sequence
  Description of Artificial Sequence: Synthetic peptide
  Seed: AFDDIAKYF (SSX2_HUMAN)
AGDDIAKYL

SEQ ID NO: 164643 - protein, 10 aa, Artificial Sequence
  Description of Artificial Sequence: Synthetic peptide
  Seed: YVYMKRKYEA (SSX2_HUMAN)
YIYMKRKYEI

SEQ ID NO: 164644 - protein, 10 aa, Artificial Sequence
  Description of Artificial Sequence: Synthetic peptide
  Seed: TLPPFMCNKR (SSX2_HUMAN)
TTPPFMCNKR

SEQ ID NO: 164645 - protein, 9 aa, Artificial Sequence
  Description of Artificial Sequence: Synthetic peptide
  Seed: KRGEHAWTH (SSX2_HUMAN)
KYGEHAWTL

SEQ ID NO: 164646 - protein, 9 aa, Artificial Sequence
  Description of Artificial Sequence: Synthetic peptide
  Seed: QIPEKIQKA (SSX2_HUMAN)
QMPEKIQKM

SEQ ID NO: 164647 - protein, 9 aa, Artificial Sequence
  Description of Artificial Sequence: Synthetic peptide
  Seed: RLRERKQLV (SSX2_HUMAN)
RARERKQLV

SEQ ID NO: 164648 - protein, 8 aa, Artificial Sequence
  Description of Artificial Sequence: Synthetic peptide
  Seed: FDDIAKYF (SSX2_HUMAN)
FQDIAKYL

SEQ ID NO: 164649 - protein, 8 aa, Artificial Sequence
  Description of Artificial Sequence: Synthetic peptide
  Seed: YMKRKYEA (SSX2_HUMAN)
YMKRKYEV

SEQ ID NO: 164650 - protein, 10 aa, Artificial Sequence
  Description of Artificial Sequence: Synthetic peptide
  Seed: DGKELCPPGK (SSX2_HUMAN)
DVKELCPPGR

SEQ ID NO: 164651 - protein, 9 aa, Artificial Sequence
  Description of Artificial Sequence: Synthetic peptide
  Seed: YMKRKYEAM (SSX2_HUMAN)
YFKRKYEAF

SEQ ID NO: 164652 - protein, 9 aa, Artificial Sequence
  Description of Artificial Sequence: Synthetic peptide
  Seed: KAFDDIAKY (SSX2_HUMAN)
KSFDDIAKY

SEQ ID NO: 164653 - protein, 9 aa, Artificial Sequence
  Description of Artificial Sequence: Synthetic peptide
  Seed: QIPEKIQKA (SSX2_HUMAN)
QAPEKIQKV

SEQ ID NO: 164654 - protein, 9 aa, Artificial Sequence
  Description of Artificial Sequence: Synthetic peptide
  Seed: MKASEKIFY (SSX2_HUMAN)
MMASEKIFM

SEQ ID NO: 164655 - protein, 9 aa, Artificial Sequence
  Description of Artificial Sequence: Synthetic peptide
  Seed: FSKEEWEKM (SSX2_HUMAN)
FMKEEWEKY

SEQ ID NO: 164656 - protein, 8 aa, Artificial Sequence
  Description of Artificial Sequence: Synthetic peptide
  Seed: MKRKYEAM (SSX2_HUMAN)
MIRKYEAL

SEQ ID NO: 164657 - protein, 9 aa, Artificial Sequence
  Description of Artificial Sequence: Synthetic peptide
  Seed: KAFDDIAKY (SSX2_HUMAN)
KSFDDIAKK

SEQ ID NO: 164658 - protein, 9 aa, Artificial Sequence
  Description of Artificial Sequence: Synthetic peptide
  Seed: ERPQMTFGR (SSX2_HUMAN)
EGPQMTFGR

SEQ ID NO: 164659 - protein, 9 aa, Artificial Sequence
  Description of Artificial Sequence: Synthetic peptide
  Seed: KIHERSGPK (SSX2_HUMAN)
KTHERSGPA

SEQ ID NO: 164660 - protein, 10 aa, Artificial Sequence
  Description of Artificial Sequence: Synthetic peptide
  Seed: NQVERPQMTF (SSX2_HUMAN)
NEVERPQMTF

SEQ ID NO: 164661 - protein, 10 aa, Artificial Sequence
  Description of Artificial Sequence: Synthetic peptide
  Seed: AQIPEKIQKA (SSX2_HUMAN)
AQIPEKIQKW

SEQ ID NO: 164662 - protein, 9 aa, Artificial Sequence
  Description of Artificial Sequence: Synthetic peptide
  Seed: MTFGRLQGI (SSX2_HUMAN)
MNFGRLQGV

SEQ ID NO: 164663 - protein, 10 aa, Artificial Sequence
  Description of Artificial Sequence: Synthetic peptide
  Seed: KAFDDIAKYF (SSX2_HUMAN)
KQFDDIAKYW

SEQ ID NO: 164664 - protein, 9 aa, Artificial Sequence
  Description of Artificial Sequence: Synthetic peptide
  Seed: KASEKIFYV (SSX2_HUMAN)
KQSEKIFYA

SEQ ID NO: 164665 - protein, 9 aa, Artificial Sequence
  Description of Artificial Sequence: Synthetic peptide
  Seed: AFDDIAKYF (SSX2_HUMAN)
ARDDIAKYM

SEQ ID NO: 164666 - protein, 9 aa, Artificial Sequence
  Description of Artificial Sequence: Synthetic peptide
  Seed: MCNKRAEDF (SSX2_HUMAN)
MANKRAEDY

SEQ ID NO: 164667 - protein, 9 aa, Artificial Sequence
  Description of Artificial Sequence: Synthetic peptide
  Seed: MPKKPAEEG (SSX2_HUMAN)
MPKKPAEEM

SEQ ID NO: 164668 - protein, 9 aa, Artificial Sequence
  Description of Artificial Sequence: Synthetic peptide
  Seed: FKATLPPFM (SSX2_HUMAN)
FRATLPPFV

SEQ ID NO: 164669 - protein, 11 aa, Artificial Sequence
  Description of Artificial Sequence: Synthetic peptide
  Seed: KYEAMTKLGFK (SSX2_HUMAN)
KWEAMTKLGFR

SEQ ID NO: 164670 - protein, 10 aa, Artificial Sequence
  Description of Artificial Sequence: Synthetic peptide
  Seed: EKIFYVYMKR (SSX2_HUMAN)
EIIFYVYMKR

SEQ ID NO: 164671 - protein, 11 aa, Artificial Sequence
  Description of Artificial Sequence: Synthetic peptide
  Seed: YVYMKRKYEAM (SSX2_HUMAN)
YIYMKRKYEAL

SEQ ID NO: 164672 - protein, 10 aa, Artificial Sequence
  Description of Artificial Sequence: Synthetic peptide
  Seed: EKIFYVYMKR (SSX2_HUMAN)
EQIFYVYMKK

SEQ ID NO: 164673 - protein, 9 aa, Artificial Sequence
  Description of Artificial Sequence: Synthetic peptide
  Seed: AFDDIAKYF (SSX2_HUMAN)
AEDDIAKYL

SEQ ID NO: 164674 - protein, 10 aa, Artificial Sequence
  Description of Artificial Sequence: Synthetic peptide
  Seed: YMKRKYEAMT (SSX2_HUMAN)
YLKRKYEAMM

SEQ ID NO: 164675 - protein, 9 aa, Artificial Sequence
  Description of Artificial Sequence: Synthetic peptide
  Seed: AFDDIAKYF (SSX2_HUMAN)
ATDDIAKYW

SEQ ID NO: 164676 - protein, 9 aa, Artificial Sequence
  Description of Artificial Sequence: Synthetic peptide
  Seed: GISPKIMPK (SSX2_HUMAN)
GWSPKIMPR

SEQ ID NO: 164677 - protein, 10 aa, Artificial Sequence
  Description of Artificial Sequence: Synthetic peptide
  Seed: AFARRPTVGA (SSX2_HUMAN)
AAARRPTVGK

SEQ ID NO: 164678 - protein, 9 aa, Artificial Sequence
  Description of Artificial Sequence: Synthetic peptide
  Seed: TKLGFKATL (SSX2_HUMAN)
THLGFKATL

SEQ ID NO: 164679 - protein, 9 aa, Artificial Sequence
  Description of Artificial Sequence: Synthetic peptide
  Seed: DAFARRPTV (SSX2_HUMAN)
DAFARRPTY

SEQ ID NO: 164680 - protein, 9 aa, Artificial Sequence
  Description of Artificial Sequence: Synthetic peptide
  Seed: RKYEAMTKL (SSX2_HUMAN)
RAYEAMTKI

SEQ ID NO: 164681 - protein, 9 aa, Artificial Sequence
  Description of Artificial Sequence: Synthetic peptide
  Seed: TTSEKIHER (SSX2_HUMAN)
TLSEKIHER

SEQ ID NO: 164682 - protein, 10 aa, Artificial Sequence
  Description of Artificial Sequence: Synthetic peptide
  Seed: KMKASEKIFY (SSX2_HUMAN)
KSKASEKIFY

SEQ ID NO: 164683 - protein, 9 aa, Artificial Sequence
  Description of Artificial Sequence: Synthetic peptide
  Seed: RKYEAMTKL (SSX2_HUMAN)
REYEAMTKI

SEQ ID NO: 164684 - protein, 9 aa, Artificial Sequence
  Description of Artificial Sequence: Synthetic peptide
  Seed: FSKEEWEKM (SSX2_HUMAN)
FYKEEWEKL

SEQ ID NO: 164685 - protein, 9 aa, Artificial Sequence
  Description of Artificial Sequence: Synthetic peptide
  Seed: RKYEAMTKL (SSX2_HUMAN)
RQYEAMTKM

SEQ ID NO: 164686 - protein, 9 aa, Artificial Sequence
  Description of Artificial Sequence: Synthetic peptide
  Seed: AQIPEKIQK (SSX2_HUMAN)
AVIPEKIQR

SEQ ID NO: 164687 - protein, 10 aa, Artificial Sequence
  Description of Artificial Sequence: Synthetic peptide
  Seed: QGISPKIMPK (SSX2_HUMAN)
QQISPKIMPK

SEQ ID NO: 164688 - protein, 11 aa, Artificial Sequence
  Description of Artificial Sequence: Synthetic peptide
  Seed: AQIPEKIQKAF (SSX2_HUMAN)
AQIPEKIQKAL

SEQ ID NO: 164689 - protein, 9 aa, Artificial Sequence
  Description of Artificial Sequence: Synthetic peptide
  Seed: DAFARRPTV (SSX2_HUMAN)
DNFARRPTL

SEQ ID NO: 164690 - protein, 10 aa, Artificial Sequence
  Description of Artificial Sequence: Synthetic peptide
  Seed: MKASEKIFYV (SSX2_HUMAN)
MSASEKIFYL

SEQ ID NO: 164691 - protein, 9 aa, Artificial Sequence
  Description of Artificial Sequence: Synthetic peptide
  Seed: RLQGISPKI (SSX2_HUMAN)
RIQGISPKK

SEQ ID NO: 164692 - protein, 9 aa, Artificial Sequence
  Description of Artificial Sequence: Synthetic peptide
  Seed: EAMTKLGFK (SSX2_HUMAN)
EWMTKLGFR

SEQ ID NO: 164693 - protein, 9 aa, Artificial Sequence
  Description of Artificial Sequence: Synthetic peptide
  Seed: MKASEKIFY (SSX2_HUMAN)
MAASEKIFY

SEQ ID NO: 164694 - protein, 10 aa, Artificial Sequence
  Description of Artificial Sequence: Synthetic peptide
  Seed: YVYMKRKYEA (SSX2_HUMAN)
YIYMKRKYEL

SEQ ID NO: 164695 - protein, 10 aa, Artificial Sequence
  Description of Artificial Sequence: Synthetic peptide
  Seed: AQIPEKIQKA (SSX2_HUMAN)
AEIPEKIQKL

SEQ ID NO: 164696 - protein, 11 aa, Artificial Sequence
  Description of Artificial Sequence: Synthetic peptide
  Seed: YVYMKRKYEAM (SSX2_HUMAN)
YGYMKRKYEAL

SEQ ID NO: 164697 - protein, 9 aa, Artificial Sequence
  Description of Artificial Sequence: Synthetic peptide
  Seed: MTFGRLQGI (SSX2_HUMAN)
MPFGRLQGV

SEQ ID NO: 164698 - protein, 10 aa, Artificial Sequence
  Description of Artificial Sequence: Synthetic peptide
  Seed: RKQLVIYEEI (SSX2_HUMAN)
RRQLVIYEEM

SEQ ID NO: 164699 - protein, 10 aa, Artificial Sequence
  Description of Artificial Sequence: Synthetic peptide
  Seed: KYEAMTKLGF (SSX2_HUMAN)
KGEAMTKLGW

SEQ ID NO: 164700 - protein, 9 aa, Artificial Sequence
  Description of Artificial Sequence: Synthetic peptide
  Seed: MTFGRLQGI (SSX2_HUMAN)
MMFGRLQGV

SEQ ID NO: 164701 - protein, 10 aa, Artificial Sequence
  Description of Artificial Sequence: Synthetic peptide
  Seed: KAFDDIAKYF (SSX2_HUMAN)
KTFDDIAKYM

SEQ ID NO: 164702 - protein, 9 aa, Artificial Sequence
  Description of Artificial Sequence: Synthetic peptide
  Seed: KASEKIFYV (SSX2_HUMAN)
KNSEKIFYV

SEQ ID NO: 164703 - protein, 10 aa, Artificial Sequence
  Description of Artificial Sequence: Synthetic peptide
  Seed: MNGDDAFARR (SSX2_HUMAN)
MFGDDAFARR

SEQ ID NO: 164704 - protein, 9 aa, Artificial Sequence
  Description of Artificial Sequence: Synthetic peptide
  Seed: KAFDDIAKY (SSX2_HUMAN)
KYFDDIAKI

SEQ ID NO: 164705 - protein, 9 aa, Artificial Sequence
  Description of Artificial Sequence: Synthetic peptide
  Seed: RLQGISPKI (SSX2_HUMAN)
RLQGISPKY

SEQ ID NO: 164706 - protein, 9 aa, Artificial Sequence
  Description of Artificial Sequence: Synthetic peptide
  Seed: TVGAQIPEK (SSX2_HUMAN)
TAGAQIPEM

SEQ ID NO: 164707 - protein, 9 aa, Artificial Sequence
  Description of Artificial Sequence: Synthetic peptide
  Seed: FSKEEWEKM (SSX2_HUMAN)
FAKEEWEKV

SEQ ID NO: 164708 - protein, 9 aa, Artificial Sequence
  Description of Artificial Sequence: Synthetic peptide
  Seed: YMKRKYEAM (SSX2_HUMAN)
YQKRKYEAF

SEQ ID NO: 164709 - protein, 11 aa, Artificial Sequence
  Description of Artificial Sequence: Synthetic peptide
  Seed: MKASEKIFYVY (SSX2_HUMAN)
MQASEKIFYVF

SEQ ID NO: 164710 - protein, 9 aa, Artificial Sequence
  Description of Artificial Sequence: Synthetic peptide
  Seed: NGDDAFARR (SSX2_HUMAN)
NIDDAFARY

SEQ ID NO: 164711 - protein, 9 aa, Artificial Sequence
  Description of Artificial Sequence: Synthetic peptide
  Seed: TTSEKIHER (SSX2_HUMAN)
TGSEKIHEV

SEQ ID NO: 164712 - protein, 9 aa, Artificial Sequence
  Description of Artificial Sequence: Synthetic peptide
  Seed: FYVYMKRKY (SSX2_HUMAN)
FTVYMKRKY

SEQ ID NO: 164713 - protein, 11 aa, Artificial Sequence
  Description of Artificial Sequence: Synthetic peptide
  Seed: RKYEAMTKLGF (SSX2_HUMAN)
RYYEAMTKLGI

SEQ ID NO: 164714 - protein, 9 aa, Artificial Sequence
  Description of Artificial Sequence: Synthetic peptide
  Seed: YMKRKYEAM (SSX2_HUMAN)
YSKRKYEAF

SEQ ID NO: 164715 - protein, 9 aa, Artificial Sequence
  Description of Artificial Sequence: Synthetic peptide
  Seed: MCNKRAEDF (SSX2_HUMAN)
MANKRAEDL

SEQ ID NO: 164716 - protein, 9 aa, Artificial Sequence
  Description of Artificial Sequence: Synthetic peptide
  Seed: KMKASEKIF (SSX2_HUMAN)
KAKASEKIW

SEQ ID NO: 164717 - protein, 10 aa, Artificial Sequence
  Description of Artificial Sequence: Synthetic peptide
  Seed: NQVERPQMTF (SSX2_HUMAN)
NQVERPQMTY

SEQ ID NO: 164718 - protein, 9 aa, Artificial Sequence
  Description of Artificial Sequence: Synthetic peptide
  Seed: RKYEAMTKL (SSX2_HUMAN)
RNYEAMTKL

SEQ ID NO: 164719 - protein, 9 aa, Artificial Sequence
  Description of Artificial Sequence: Synthetic peptide
  Seed: QVERPQMTF (SSX2_HUMAN)
QSERPQMTY

SEQ ID NO: 164720 - protein, 10 aa, Artificial Sequence
  Description of Artificial Sequence: Synthetic peptide
  Seed: RLRERKQLVI (SSX2_HUMAN)
RVRERKQLVA

SEQ ID NO: 164721 - protein, 9 aa, Artificial Sequence
  Description of Artificial Sequence: Synthetic peptide
  Seed: NGDDAFARR (SSX2_HUMAN)
NTDDAFARR

SEQ ID NO: 164722 - protein, 10 aa, Artificial Sequence
  Description of Artificial Sequence: Synthetic peptide
  Seed: KMKASEKIFY (SSX2_HUMAN)
KYKASEKIFA

SEQ ID NO: 164723 - protein, 10 aa, Artificial Sequence
  Description of Artificial Sequence: Synthetic peptide
  Seed: LGFKATLPPF (SSX2_HUMAN)
LEFKATLPPM

SEQ ID NO: 164724 - protein, 9 aa, Artificial Sequence
  Description of Artificial Sequence: Synthetic peptide
  Seed: AKYFSKEEW (SSX2_HUMAN)
AEYFSKEEW

SEQ ID NO: 164725 - protein, 9 aa, Artificial Sequence
  Description of Artificial Sequence: Synthetic peptide
  Seed: AFDDIAKYF (SSX2_HUMAN)
AVDDIAKYL

SEQ ID NO: 164726 - protein, 9 aa, Artificial Sequence
  Description of Artificial Sequence: Synthetic peptide
  Seed: RLQGISPKI (SSX2_HUMAN)
RVQGISPKK

SEQ ID NO: 164727 - protein, 11 aa, Artificial Sequence
  Description of Artificial Sequence: Synthetic peptide
  Seed: KMKASEKIFYV (SSX2_HUMAN)
KMKASEKIFYL

SEQ ID NO: 164728 - protein, 10 aa, Artificial Sequence
  Description of Artificial Sequence: Synthetic peptide
  Seed: YEAMTKLGFK (SSX2_HUMAN)
YFAMTKLGFR

SEQ ID NO: 164729 - protein, 9 aa, Artificial Sequence
  Description of Artificial Sequence: Synthetic peptide
  Seed: MTFGRLQGI (SSX2_HUMAN)
MQFGRLQGF

SEQ ID NO: 164730 - protein, 9 aa, Artificial Sequence
  Description of Artificial Sequence: Synthetic peptide
  Seed: TTSEKIHER (SSX2_HUMAN)
TVSEKIHEI

SEQ ID NO: 164731 - protein, 10 aa, Artificial Sequence
  Description of Artificial Sequence: Synthetic peptide
  Seed: QKAFDDIAKY (SSX2_HUMAN)
QQAFDDIAKF

SEQ ID NO: 164732 - protein, 10 aa, Artificial Sequence
  Description of Artificial Sequence: Synthetic peptide
  Seed: YMKRKYEAMT (SSX2_HUMAN)
YPKRKYEAMV

SEQ ID NO: 164733 - protein, 10 aa, Artificial Sequence
  Description of Artificial Sequence: Synthetic peptide
  Seed: MKASEKIFYV (SSX2_HUMAN)
MMASEKIFYV

SEQ ID NO: 164734 - protein, 10 aa, Artificial Sequence
  Description of Artificial Sequence: Synthetic peptide
  Seed: KMKASEKIFY (SSX2_HUMAN)
KMKASEKIFV

SEQ ID NO: 164735 - protein, 10 aa, Artificial Sequence
  Description of Artificial Sequence: Synthetic peptide
  Seed: YVYMKRKYEA (SSX2_HUMAN)
YFYMKRKYEL

SEQ ID NO: 164736 - protein, 10 aa, Artificial Sequence
  Description of Artificial Sequence: Synthetic peptide
  Seed: ATLPPFMCNK (SSX2_HUMAN)
ARLPPFMCNR

SEQ ID NO: 164737 - protein, 9 aa, Artificial Sequence
  Description of Artificial Sequence: Synthetic peptide
  Seed: KASEKIFYV (SSX2_HUMAN)
KNSEKIFYY

SEQ ID NO: 164738 - protein, 10 aa, Artificial Sequence
  Description of Artificial Sequence: Synthetic peptide
  Seed: QGISPKIMPK (SSX2_HUMAN)
QSISPKIMPR

SEQ ID NO: 164739 - protein, 10 aa, Artificial Sequence
  Description of Artificial Sequence: Synthetic peptide
  Seed: ATLPPFMCNK (SSX2_HUMAN)
AVLPPFMCNR

SEQ ID NO: 164740 - protein, 10 aa, Artificial Sequence
  Description of Artificial Sequence: Synthetic peptide
  Seed: SGPQNDGKEL (SSX2_HUMAN)
SAPQNDGKEL

SEQ ID NO: 164741 - protein, 9 aa, Artificial Sequence
  Description of Artificial Sequence: Synthetic peptide
  Seed: FSKEEWEKM (SSX2_HUMAN)
FAKEEWEKM

SEQ ID NO: 164742 - protein, 8 aa, Artificial Sequence
  Description of Artificial Sequence: Synthetic peptide
  Seed: MKRKYEAM (SSX2_HUMAN)
MMRKYEAM

SEQ ID NO: 164743 - protein, 9 aa, Artificial Sequence
  Description of Artificial Sequence: Synthetic peptide
  Seed: KRKYEAMTK (SSX2_HUMAN)
KGKYEAMTK

SEQ ID NO: 164744 - protein, 9 aa, Artificial Sequence
  Description of Artificial Sequence: Synthetic peptide
  Seed: VYMKRKYEA (SSX2_HUMAN)
VFMKRKYEM

SEQ ID NO: 164745 - protein, 9 aa, Artificial Sequence
  Description of Artificial Sequence: Synthetic peptide
  Seed: QIPEKIQKA (SSX2_HUMAN)
QSPEKIQKM

SEQ ID NO: 164746 - protein, 8 aa, Artificial Sequence
  Description of Artificial Sequence: Synthetic peptide
  Seed: FDDIAKYF (SSX2_HUMAN)
FVDIAKYM

SEQ ID NO: 164747 - protein, 9 aa, Artificial Sequence
  Description of Artificial Sequence: Synthetic peptide
  Seed: AQIPEKIQK (SSX2_HUMAN)
AVIPEKIQK

SEQ ID NO: 164748 - protein, 9 aa, Artificial Sequence
  Description of Artificial Sequence: Synthetic peptide
  Seed: YMKRKYEAM (SSX2_HUMAN)
YIKRKYEAA

SEQ ID NO: 164749 - protein, 9 aa, Artificial Sequence
  Description of Artificial Sequence: Synthetic peptide
  Seed: MTFGRLQGI (SSX2_HUMAN)
MLFGRLQGT

SEQ ID NO: 164750 - protein, 9 aa, Artificial Sequence
  Description of Artificial Sequence: Synthetic peptide
  Seed: AQIPEKIQK (SSX2_HUMAN)
ATIPEKIQL

SEQ ID NO: 164751 - protein, 9 aa, Artificial Sequence
  Description of Artificial Sequence: Synthetic peptide
  Seed: AEDFQGNDL (SSX2_HUMAN)
ATDFQGNDF

SEQ ID NO: 164752 - protein, 10 aa, Artificial Sequence
  Description of Artificial Sequence: Synthetic peptide
  Seed: VYMKRKYEAM (SSX2_HUMAN)
VKMKRKYEAL

SEQ ID NO: 164753 - protein, 10 aa, Artificial Sequence
  Description of Artificial Sequence: Synthetic peptide
  Seed: AQIPEKIQKA (SSX2_HUMAN)
ALIPEKIQKM

SEQ ID NO: 164754 - protein, 9 aa, Artificial Sequence
  Description of Artificial Sequence: Synthetic peptide
  Seed: KATLPPFMC (SSX2_HUMAN)
KSTLPPFMM

SEQ ID NO: 164755 - protein, 9 aa, Artificial Sequence
  Description of Artificial Sequence: Synthetic peptide
  Seed: AFDDIAKYF (SSX2_HUMAN)
ANDDIAKYV

SEQ ID NO: 164756 - protein, 11 aa, Artificial Sequence
  Description of Artificial Sequence: Synthetic peptide
  Seed: KYEAMTKLGFK (SSX2_HUMAN)
KKEAMTKLGFR

SEQ ID NO: 164757 - protein, 9 aa, Artificial Sequence
  Description of Artificial Sequence: Synthetic peptide
  Seed: DAFARRPTV (SSX2_HUMAN)
DMFARRPTL

SEQ ID NO: 164758 - protein, 8 aa, Artificial Sequence
  Description of Artificial Sequence: Synthetic peptide
  Seed: YMKRKYEA (SSX2_HUMAN)
YAKRKYEM

SEQ ID NO: 164759 - protein, 9 aa, Artificial Sequence
  Description of Artificial Sequence: Synthetic peptide
  Seed: KAFDDIAKY (SSX2_HUMAN)
KMFDDIAKV

SEQ ID NO: 164760 - protein, 9 aa, Artificial Sequence
  Description of Artificial Sequence: Synthetic peptide
  Seed: TTSEKIHER (SSX2_HUMAN)
TGSEKIHEI

SEQ ID NO: 164761 - protein, 10 aa, Artificial Sequence
  Description of Artificial Sequence: Synthetic peptide
  Seed: KASEKIFYVY (SSX2_HUMAN)
KTSEKIFYVM

SEQ ID NO: 164762 - protein, 8 aa, Artificial Sequence
  Description of Artificial Sequence: Synthetic peptide
  Seed: AFDDIAKY (SSX2_HUMAN)
AVDDIAKI

SEQ ID NO: 164763 - protein, 8 aa, Artificial Sequence
  Description of Artificial Sequence: Synthetic peptide
  Seed: FDDIAKYF (SSX2_HUMAN)
FWDIAKYL

SEQ ID NO: 164764 - protein, 9 aa, Artificial Sequence
  Description of Artificial Sequence: Synthetic peptide
  Seed: TTSEKIHER (SSX2_HUMAN)
TLSEKIHEL

SEQ ID NO: 164765 - protein, 10 aa, Artificial Sequence
  Description of Artificial Sequence: Synthetic peptide
  Seed: ATLPPFMCNK (SSX2_HUMAN)
AVLPPFMCNK

SEQ ID NO: 164766 - protein, 9 aa, Artificial Sequence
  Description of Artificial Sequence: Synthetic peptide
  Seed: YMKRKYEAM (SSX2_HUMAN)
YSKRKYEAV

SEQ ID NO: 164767 - protein, 9 aa, Artificial Sequence
  Description of Artificial Sequence: Synthetic peptide
  Seed: AFDDIAKYF (SSX2_HUMAN)
ACDDIAKYV

SEQ ID NO: 164768 - protein, 8 aa, Artificial Sequence
  Description of Artificial Sequence: Synthetic peptide
  Seed: NQVERPQM (SSX2_HUMAN)
NQVERPQL

SEQ ID NO: 164769 - protein, 10 aa, Artificial Sequence
  Description of Artificial Sequence: Synthetic peptide
  Seed: LGFKATLPPF (SSX2_HUMAN)
LIFKATLPPW

SEQ ID NO: 164770 - protein, 10 aa, Artificial Sequence
  Description of Artificial Sequence: Synthetic peptide
  Seed: DGKELCPPGK (SSX2_HUMAN)
DMKELCPPGR

SEQ ID NO: 164771 - protein, 10 aa, Artificial Sequence
  Description of Artificial Sequence: Synthetic peptide
  Seed: KMKASEKIFY (SSX2_HUMAN)
KVKASEKIFI

SEQ ID NO: 164772 - protein, 9 aa, Artificial Sequence
  Description of Artificial Sequence: Synthetic peptide
  Seed: AQIPEKIQK (SSX2_HUMAN)
AQIPEKIQL

SEQ ID NO: 164773 - protein, 9 aa, Artificial Sequence
  Description of Artificial Sequence: Synthetic peptide
  Seed: YEAMTKLGF (SSX2_HUMAN)
YKAMTKLGF

SEQ ID NO: 164774 - protein, 9 aa, Artificial Sequence
  Description of Artificial Sequence: Synthetic peptide
  Seed: DAFARRPTV (SSX2_HUMAN)
DRFARRPTL

SEQ ID NO: 164775 - protein, 9 aa, Artificial Sequence
  Description of Artificial Sequence: Synthetic peptide
  Seed: KAFDDIAKY (SSX2_HUMAN)
KLFDDIAKF

SEQ ID NO: 164776 - protein, 9 aa, Artificial Sequence
  Description of Artificial Sequence: Synthetic peptide
  Seed: KQLVIYEEI (SSX2_HUMAN)
KMLVIYEEY

SEQ ID NO: 164777 - protein, 9 aa, Artificial Sequence
  Description of Artificial Sequence: Synthetic peptide
  Seed: RLRERKQLV (SSX2_HUMAN)
RARERKQLK

SEQ ID NO: 164778 - protein, 9 aa, Artificial Sequence
  Description of Artificial Sequence: Synthetic peptide
  Seed: RGEHAWTHR (SSX2_HUMAN)
RLEHAWTHR

SEQ ID NO: 164779 - protein, 9 aa, Artificial Sequence
  Description of Artificial Sequence: Synthetic peptide
  Seed: DAFARRPTV (SSX2_HUMAN)
DKFARRPTL

SEQ ID NO: 164780 - protein, 10 aa, Artificial Sequence
  Description of Artificial Sequence: Synthetic peptide
  Seed: KAFDDIAKYF (SSX2_HUMAN)
KAFDDIAKYV

SEQ ID NO: 164781 - protein, 9 aa, Artificial Sequence
  Description of Artificial Sequence: Synthetic peptide
  Seed: YMKRKYEAM (SSX2_HUMAN)
YYKRKYEAL

SEQ ID NO: 164782 - protein, 10 aa, Artificial Sequence
  Description of Artificial Sequence: Synthetic peptide
  Seed: DGKELCPPGK (SSX2_HUMAN)
DIKELCPPGR

SEQ ID NO: 164783 - protein, 9 aa, Artificial Sequence
  Description of Artificial Sequence: Synthetic peptide
  Seed: VGAQIPEKI (SSX2_HUMAN)
VLAQIPEKF

SEQ ID NO: 164784 - protein, 9 aa, Artificial Sequence
  Description of Artificial Sequence: Synthetic peptide
  Seed: RKYEAMTKL (SSX2_HUMAN)
RNYEAMTKY

SEQ ID NO: 164785 - protein, 10 aa, Artificial Sequence
  Description of Artificial Sequence: Synthetic peptide
  Seed: LGFKATLPPF (SSX2_HUMAN)
LQFKATLPPW

SEQ ID NO: 164786 - protein, 9 aa, Artificial Sequence
  Description of Artificial Sequence: Synthetic peptide
  Seed: RKYEAMTKL (SSX2_HUMAN)
RVYEAMTKL

SEQ ID NO: 164787 - protein, 9 aa, Artificial Sequence
  Description of Artificial Sequence: Synthetic peptide
  Seed: KAFDDIAKY (SSX2_HUMAN)
KTFDDIAKL

SEQ ID NO: 164788 - protein, 11 aa, Artificial Sequence
  Description of Artificial Sequence: Synthetic peptide
  Seed: KMKASEKIFYV (SSX2_HUMAN)
KLKASEKIFYM

SEQ ID NO: 164789 - protein, 9 aa, Artificial Sequence
  Description of Artificial Sequence: Synthetic peptide
  Seed: KAFDDIAKY (SSX2_HUMAN)
KAFDDIAKK

SEQ ID NO: 164790 - protein, 9 aa, Artificial Sequence
  Description of Artificial Sequence: Synthetic peptide
  Seed: KAFDDIAKY (SSX2_HUMAN)
KLFDDIAKR

SEQ ID NO: 164791 - protein, 9 aa, Artificial Sequence
  Description of Artificial Sequence: Synthetic peptide
  Seed: RRPTVGAQI (SSX2_HUMAN)
RYPTVGAQM

SEQ ID NO: 164792 - protein, 9 aa, Artificial Sequence
  Description of Artificial Sequence: Synthetic peptide
  Seed: KIHERSGPK (SSX2_HUMAN)
KFHERSGPR

SEQ ID NO: 164793 - protein, 9 aa, Artificial Sequence
  Description of Artificial Sequence: Synthetic peptide
  Seed: VGAQIPEKI (SSX2_HUMAN)
VMAQIPEKV

SEQ ID NO: 164794 - protein, 9 aa, Artificial Sequence
  Description of Artificial Sequence: Synthetic peptide
  Seed: KASEKIFYV (SSX2_HUMAN)
KMSEKIFYI

SEQ ID NO: 164795 - protein, 11 aa, Artificial Sequence
  Description of Artificial Sequence: Synthetic peptide
  Seed: YVYMKRKYEAM (SSX2_HUMAN)
YDYMKRKYEAL

SEQ ID NO: 164796 - protein, 9 aa, Artificial Sequence
  Description of Artificial Sequence: Synthetic peptide
  Seed: NGDDAFARR (SSX2_HUMAN)
NTDDAFARL

SEQ ID NO: 164797 - protein, 9 aa, Artificial Sequence
  Description of Artificial Sequence: Synthetic peptide
  Seed: RLRERKQLV (SSX2_HUMAN)
RSRERKQLK

SEQ ID NO: 164798 - protein, 10 aa, Artificial Sequence
  Description of Artificial Sequence: Synthetic peptide
  Seed: YMKRKYEAMT (SSX2_HUMAN)
YMKRKYEAML

SEQ ID NO: 164799 - protein, 11 aa, Artificial Sequence
  Description of Artificial Sequence: Synthetic peptide
  Seed: FGRLQGISPKI (SSX2_HUMAN)
FDRLQGISPKV

SEQ ID NO: 164800 - protein, 9 aa, Artificial Sequence
  Description of Artificial Sequence: Synthetic peptide
  Seed: MTFGRLQGI (SSX2_HUMAN)
MVFGRLQGI

SEQ ID NO: 164801 - protein, 8 aa, Artificial Sequence
  Description of Artificial Sequence: Synthetic peptide
  Seed: FKATLPPF (SSX2_HUMAN)
FQATLPPM

SEQ ID NO: 164802 - protein, 9 aa, Artificial Sequence
  Description of Artificial Sequence: Synthetic peptide
  Seed: RKYEAMTKL (SSX2_HUMAN)
RIYEAMTKV

SEQ ID NO: 164803 - protein, 10 aa, Artificial Sequence
  Description of Artificial Sequence: Synthetic peptide
  Seed: YMKRKYEAMT (SSX2_HUMAN)
YMKRKYEAMI

SEQ ID NO: 164804 - protein, 10 aa, Artificial Sequence
  Description of Artificial Sequence: Synthetic peptide
  Seed: KMKASEKIFY (SSX2_HUMAN)
KVKASEKIFA

SEQ ID NO: 164805 - protein, 9 aa, Artificial Sequence
  Description of Artificial Sequence: Synthetic peptide
  Seed: YMKRKYEAM (SSX2_HUMAN)
YIKRKYEAV

SEQ ID NO: 164806 - protein, 10 aa, Artificial Sequence
  Description of Artificial Sequence: Synthetic peptide
  Seed: RLRERKQLVI (SSX2_HUMAN)
RMRERKQLVK

SEQ ID NO: 164807 - protein, 9 aa, Artificial Sequence
  Description of Artificial Sequence: Synthetic peptide
  Seed: MTFGRLQGI (SSX2_HUMAN)
MRFGRLQGM

SEQ ID NO: 164808 - protein, 9 aa, Artificial Sequence
  Description of Artificial Sequence: Synthetic peptide
  Seed: FKATLPPFM (SSX2_HUMAN)
FYATLPPFM

SEQ ID NO: 164809 - protein, 10 aa, Artificial Sequence
  Description of Artificial Sequence: Synthetic peptide
  Seed: VYMKRKYEAM (SSX2_HUMAN)
VWMKRKYEAF

SEQ ID NO: 164810 - protein, 9 aa, Artificial Sequence
  Description of Artificial Sequence: Synthetic peptide
  Seed: KIHERSGPK (SSX2_HUMAN)
KVHERSGPK

SEQ ID NO: 164811 - protein, 9 aa, Artificial Sequence
  Description of Artificial Sequence: Synthetic peptide
  Seed: VYMKRKYEA (SSX2_HUMAN)
VYMKRKYEL

SEQ ID NO: 164812 - protein, 10 aa, Artificial Sequence
  Description of Artificial Sequence: Synthetic peptide
  Seed: YEAMTKLGFK (SSX2_HUMAN)
YGAMTKLGFR

SEQ ID NO: 164813 - protein, 9 aa, Artificial Sequence
  Description of Artificial Sequence: Synthetic peptide
  Seed: GRLQGISPK (SSX2_HUMAN)
GRLQGISPL

SEQ ID NO: 164814 - protein, 9 aa, Artificial Sequence
  Description of Artificial Sequence: Synthetic peptide
  Seed: KASEKIFYV (SSX2_HUMAN)
KISEKIFYY

SEQ ID NO: 164815 - protein, 9 aa, Artificial Sequence
  Description of Artificial Sequence: Synthetic peptide
  Seed: AQIPEKIQK (SSX2_HUMAN)
ATIPEKIQM

SEQ ID NO: 164816 - protein, 10 aa, Artificial Sequence
  Description of Artificial Sequence: Synthetic peptide
  Seed: KASEKIFYVY (SSX2_HUMAN)
KWSEKIFYVW

SEQ ID NO: 164817 - protein, 9 aa, Artificial Sequence
  Description of Artificial Sequence: Synthetic peptide
  Seed: KASEKIFYV (SSX2_HUMAN)
KLSEKIFYY

SEQ ID NO: 164818 - protein, 11 aa, Artificial Sequence
  Description of Artificial Sequence: Synthetic peptide
  Seed: KMKASEKIFYV (SSX2_HUMAN)
KVKASEKIFYA

SEQ ID NO: 164819 - protein, 8 aa, Artificial Sequence
  Description of Artificial Sequence: Synthetic peptide
  Seed: AFDDIAKY (SSX2_HUMAN)
AIDDIAKI

SEQ ID NO: 164820 - protein, 10 aa, Artificial Sequence
  Description of Artificial Sequence: Synthetic peptide
  Seed: AQIPEKIQKA (SSX2_HUMAN)
AMIPEKIQKY

SEQ ID NO: 164821 - protein, 10 aa, Artificial Sequence
  Description of Artificial Sequence: Synthetic peptide
  Seed: MKASEKIFYV (SSX2_HUMAN)
MLASEKIFYC

SEQ ID NO: 164822 - protein, 10 aa, Artificial Sequence
  Description of Artificial Sequence: Synthetic peptide
  Seed: AQIPEKIQKA (SSX2_HUMAN)
AMIPEKIQKV

SEQ ID NO: 164823 - protein, 9 aa, Artificial Sequence
  Description of Artificial Sequence: Synthetic peptide
  Seed: VYMKRKYEA (SSX2_HUMAN)
VYMKRKYEF

SEQ ID NO: 164824 - protein, 9 aa, Artificial Sequence
  Description of Artificial Sequence: Synthetic peptide
  Seed: NGDDAFARR (SSX2_HUMAN)
NSDDAFARR

SEQ ID NO: 164825 - protein, 11 aa, Artificial Sequence
  Description of Artificial Sequence: Synthetic peptide
  Seed: YVYMKRKYEAM (SSX2_HUMAN)
YMYMKRKYEAL

SEQ ID NO: 164826 - protein, 11 aa, Artificial Sequence
  Description of Artificial Sequence: Synthetic peptide
  Seed: KYEAMTKLGFK (SSX2_HUMAN)
KIEAMTKLGFR

SEQ ID NO: 164827 - protein, 9 aa, Artificial Sequence
  Description of Artificial Sequence: Synthetic peptide
  Seed: VGAQIPEKI (SSX2_HUMAN)
VSAQIPEKM

SEQ ID NO: 164828 - protein, 9 aa, Artificial Sequence
  Description of Artificial Sequence: Synthetic peptide
  Seed: AQIPEKIQK (SSX2_HUMAN)
AMIPEKIQL

SEQ ID NO: 164829 - protein, 9 aa, Artificial Sequence
  Description of Artificial Sequence: Synthetic peptide
  Seed: KASEKIFYV (SSX2_HUMAN)
KYSEKIFYY

SEQ ID NO: 164830 - protein, 9 aa, Artificial Sequence
  Description of Artificial Sequence: Synthetic peptide
  Seed: GEHAWTHRL (SSX2_HUMAN)
GQHAWTHRV

SEQ ID NO: 164831 - protein, 9 aa, Artificial Sequence
  Description of Artificial Sequence: Synthetic peptide
  Seed: TTSEKIHER (SSX2_HUMAN)
TVSEKIHER

SEQ ID NO: 164832 - protein, 9 aa, Artificial Sequence
  Description of Artificial Sequence: Synthetic peptide
  Seed: RPQMTFGRL (SSX2_HUMAN)
RPQMTFGRI

SEQ ID NO: 164833 - protein, 9 aa, Artificial Sequence
  Description of Artificial Sequence: Synthetic peptide
  Seed: RKYEAMTKL (SSX2_HUMAN)
RSYEAMTKF

SEQ ID NO: 164834 - protein, 9 aa, Artificial Sequence
  Description of Artificial Sequence: Synthetic peptide
  Seed: GFKATLPPF (SSX2_HUMAN)
GQKATLPPM

SEQ ID NO: 164835 - protein, 9 aa, Artificial Sequence
  Description of Artificial Sequence: Synthetic peptide
  Seed: FSKEEWEKM (SSX2_HUMAN)
FIKEEWEKY

SEQ ID NO: 164836 - protein, 9 aa, Artificial Sequence
  Description of Artificial Sequence: Synthetic peptide
  Seed: RLRERKQLV (SSX2_HUMAN)
RVRERKQLG

SEQ ID NO: 164837 - protein, 9 aa, Artificial Sequence
  Description of Artificial Sequence: Synthetic peptide
  Seed: YEAMTKLGF (SSX2_HUMAN)
YQAMTKLGL

SEQ ID NO: 164838 - protein, 9 aa, Artificial Sequence
  Description of Artificial Sequence: Synthetic peptide
  Seed: NGDDAFARR (SSX2_HUMAN)
NYDDAFARR

SEQ ID NO: 164839 - protein, 11 aa, Artificial Sequence
  Description of Artificial Sequence: Synthetic peptide
  Seed: RSGPKRGEHAW (SSX2_HUMAN)
RTGPKRGEHAW

SEQ ID NO: 164840 - protein, 10 aa, Artificial Sequence
  Description of Artificial Sequence: Synthetic peptide
  Seed: KAFDDIAKYF (SSX2_HUMAN)
KMFDDIAKYL

SEQ ID NO: 164841 - protein, 10 aa, Artificial Sequence
  Description of Artificial Sequence: Synthetic peptide
  Seed: RLRERKQLVI (SSX2_HUMAN)
RYRERKQLVK

SEQ ID NO: 164842 - protein, 9 aa, Artificial Sequence
  Description of Artificial Sequence: Synthetic peptide
  Seed: KRKYEAMTK (SSX2_HUMAN)
KSKYEAMTI

SEQ ID NO: 164843 - protein, 9 aa, Artificial Sequence
  Description of Artificial Sequence: Synthetic peptide
  Seed: FYVYMKRKY (SSX2_HUMAN)
FFVYMKRKM

SEQ ID NO: 164844 - protein, 11 aa, Artificial Sequence
  Description of Artificial Sequence: Synthetic peptide
  Seed: YMKRKYEAMTK (SSX2_HUMAN)
YLKRKYEAMTM

SEQ ID NO: 164845 - protein, 9 aa, Artificial Sequence
  Description of Artificial Sequence: Synthetic peptide
  Seed: EVPEASGPQ (SSX2_HUMAN)
ETPEASGPR

SEQ ID NO: 164846 - protein, 9 aa, Artificial Sequence
  Description of Artificial Sequence: Synthetic peptide
  Seed: VGAQIPEKI (SSX2_HUMAN)
VLAQIPEKW

SEQ ID NO: 164847 - protein, 9 aa, Artificial Sequence
  Description of Artificial Sequence: Synthetic peptide
  Seed: QVERPQMTF (SSX2_HUMAN)
QTERPQMTW

SEQ ID NO: 164848 - protein, 10 aa, Artificial Sequence
  Description of Artificial Sequence: Synthetic peptide
  Seed: VYMKRKYEAM (SSX2_HUMAN)
VMMKRKYEAV

SEQ ID NO: 164849 - protein, 9 aa, Artificial Sequence
  Description of Artificial Sequence: Synthetic peptide
  Seed: AQIPEKIQK (SSX2_HUMAN)
ARIPEKIQV

SEQ ID NO: 164850 - protein, 9 aa, Artificial Sequence
  Description of Artificial Sequence: Synthetic peptide
  Seed: TTSEKIHER (SSX2_HUMAN)
TTSEKIHEF

SEQ ID NO: 164851 - protein, 9 aa, Artificial Sequence
  Description of Artificial Sequence: Synthetic peptide
  Seed: ASEKIFYVY (SSX2_HUMAN)
AQEKIFYVF

SEQ ID NO: 164852 - protein, 10 aa, Artificial Sequence
  Description of Artificial Sequence: Synthetic peptide
  Seed: MTKLGFKATL (SSX2_HUMAN)
MMKLGFKATY

SEQ ID NO: 164853 - protein, 9 aa, Artificial Sequence
  Description of Artificial Sequence: Synthetic peptide
  Seed: TKLGFKATL (SSX2_HUMAN)
TLLGFKATY

SEQ ID NO: 164854 - protein, 10 aa, Artificial Sequence
  Description of Artificial Sequence: Synthetic peptide
  Seed: AQIPEKIQKA (SSX2_HUMAN)
AQIPEKIQKV

SEQ ID NO: 164855 - protein, 10 aa, Artificial Sequence
  Description of Artificial Sequence: Synthetic peptide
  Seed: SGPQNDGKEL (SSX2_HUMAN)
SLPQNDGKEM

SEQ ID NO: 164856 - protein, 9 aa, Artificial Sequence
  Description of Artificial Sequence: Synthetic peptide
  Seed: RLRERKQLV (SSX2_HUMAN)
RSRERKQLV

SEQ ID NO: 164857 - protein, 10 aa, Artificial Sequence
  Description of Artificial Sequence: Synthetic peptide
  Seed: MNGDDAFARR (SSX2_HUMAN)
MAGDDAFARR

SEQ ID NO: 164858 - protein, 11 aa, Artificial Sequence
  Description of Artificial Sequence: Synthetic peptide
  Seed: KYEAMTKLGFK (SSX2_HUMAN)
KCEAMTKLGFR

SEQ ID NO: 164859 - protein, 9 aa, Artificial Sequence
  Description of Artificial Sequence: Synthetic peptide
  Seed: RPQMTFGRL (SSX2_HUMAN)
RPQMTFGRM

SEQ ID NO: 164860 - protein, 9 aa, Artificial Sequence
  Description of Artificial Sequence: Synthetic peptide
  Seed: RERKQLVIY (SSX2_HUMAN)
RFRKQLVIY

SEQ ID NO: 164861 - protein, 10 aa, Artificial Sequence
  Description of Artificial Sequence: Synthetic peptide
  Seed: VYMKRKYEAM (SSX2_HUMAN)
VRMKRKYEAL

SEQ ID NO: 164862 - protein, 9 aa, Artificial Sequence
  Description of Artificial Sequence: Synthetic peptide
  Seed: MTFGRLQGI (SSX2_HUMAN)
MAFGRLQGI

SEQ ID NO: 164863 - protein, 9 aa, Artificial Sequence
  Description of Artificial Sequence: Synthetic peptide
  Seed: KASEKIFYV (SSX2_HUMAN)
KNSEKIFYL

SEQ ID NO: 164864 - protein, 9 aa, Artificial Sequence
  Description of Artificial Sequence: Synthetic peptide
  Seed: RLRERKQLV (SSX2_HUMAN)
RIRERKQLI

SEQ ID NO: 164865 - protein, 10 aa, Artificial Sequence
  Description of Artificial Sequence: Synthetic peptide
  Seed: KASEKIFYVY (SSX2_HUMAN)
KSSEKIFYVF

SEQ ID NO: 164866 - protein, 9 aa, Artificial Sequence
  Description of Artificial Sequence: Synthetic peptide
  Seed: RLQGISPKI (SSX2_HUMAN)
RSQGISPKW

SEQ ID NO: 164867 - protein, 9 aa, Artificial Sequence
  Description of Artificial Sequence: Synthetic peptide
  Seed: AQIPEKIQK (SSX2_HUMAN)
AAIPEKIQL

SEQ ID NO: 164868 - protein, 9 aa, Artificial Sequence
  Description of Artificial Sequence: Synthetic peptide
  Seed: MTFGRLQGI (SSX2_HUMAN)
MFFGRLQGY

SEQ ID NO: 164869 - protein, 11 aa, Artificial Sequence
  Description of Artificial Sequence: Synthetic peptide
  Seed: FGRLQGISPKI (SSX2_HUMAN)
FHRLQGISPKV

SEQ ID NO: 164870 - protein, 10 aa, Artificial Sequence
  Description of Artificial Sequence: Synthetic peptide
  Seed: LGFKATLPPF (SSX2_HUMAN)
LTFKATLPPY

SEQ ID NO: 164871 - protein, 9 aa, Artificial Sequence
  Description of Artificial Sequence: Synthetic peptide
  Seed: VGAQIPEKI (SSX2_HUMAN)
VVAQIPEKV

SEQ ID NO: 164872 - protein, 9 aa, Artificial Sequence
  Description of Artificial Sequence: Synthetic peptide
  Seed: MTFGRLQGI (SSX2_HUMAN)
MTFGRLQGK

SEQ ID NO: 164873 - protein, 9 aa, Artificial Sequence
  Description of Artificial Sequence: Synthetic peptide
  Seed: EHAWTHRLR (SSX2_HUMAN)
EGAWTHRLR

SEQ ID NO: 164874 - protein, 9 aa, Artificial Sequence
  Description of Artificial Sequence: Synthetic peptide
  Seed: GFKATLPPF (SSX2_HUMAN)
GYKATLPPL

SEQ ID NO: 164875 - protein, 10 aa, Artificial Sequence
  Description of Artificial Sequence: Synthetic peptide
  Seed: KYEAMTKLGF (SSX2_HUMAN)
KIEAMTKLGW

SEQ ID NO: 164876 - protein, 10 aa, Artificial Sequence
  Description of Artificial Sequence: Synthetic peptide
  Seed: KAFDDIAKYF (SSX2_HUMAN)
KIFDDIAKYW

SEQ ID NO: 164877 - protein, 9 aa, Artificial Sequence
  Description of Artificial Sequence: Synthetic peptide
  Seed: QIPEKIQKA (SSX2_HUMAN)
QVPEKIQKF

SEQ ID NO: 164878 - protein, 9 aa, Artificial Sequence
  Description of Artificial Sequence: Synthetic peptide
  Seed: KASEKIFYV (SSX2_HUMAN)
KYSEKIFYK

SEQ ID NO: 164879 - protein, 9 aa, Artificial Sequence
  Description of Artificial Sequence: Synthetic peptide
  Seed: TTSEKIHER (SSX2_HUMAN)
TTSEKIHEL

SEQ ID NO: 164880 - protein, 10 aa, Artificial Sequence
  Description of Artificial Sequence: Synthetic peptide
  Seed: EASGPQNDGK (SSX2_HUMAN)
ETSGPQNDGR

SEQ ID NO: 164881 - protein, 10 aa, Artificial Sequence
  Description of Artificial Sequence: Synthetic peptide
  Seed: KASEKIFYVY (SSX2_HUMAN)
KSSEKIFYVW

SEQ ID NO: 164882 - protein, 9 aa, Artificial Sequence
  Description of Artificial Sequence: Synthetic peptide
  Seed: AEDFQGNDL (SSX2_HUMAN)
AMDFQGNDM

SEQ ID NO: 164883 - protein, 9 aa, Artificial Sequence
  Description of Artificial Sequence: Synthetic peptide
  Seed: AKYFSKEEW (SSX2_HUMAN)
ARYFSKEEF

SEQ ID NO: 164884 - protein, 9 aa, Artificial Sequence
  Description of Artificial Sequence: Synthetic peptide
  Seed: MTFGRLQGI (SSX2_HUMAN)
MAFGRLQGR

SEQ ID NO: 164885 - protein, 11 aa, Artificial Sequence
  Description of Artificial Sequence: Synthetic peptide
  Seed: KYEAMTKLGFK (SSX2_HUMAN)
KFEAMTKLGFR

SEQ ID NO: 164886 - protein, 10 aa, Artificial Sequence
  Description of Artificial Sequence: Synthetic peptide
  Seed: RPQMTFGRLQ (SSX2_HUMAN)
RPQMTFGRLI

SEQ ID NO: 164887 - protein, 10 aa, Artificial Sequence
  Description of Artificial Sequence: Synthetic peptide
  Seed: KMKASEKIFY (SSX2_HUMAN)
KVKASEKIFK

SEQ ID NO: 164888 - protein, 10 aa, Artificial Sequence
  Description of Artificial Sequence: Synthetic peptide
  Seed: LGFKATLPPF (SSX2_HUMAN)
LSFKATLPPI

SEQ ID NO: 164889 - protein, 9 aa, Artificial Sequence
  Description of Artificial Sequence: Synthetic peptide
  Seed: KAFDDIAKY (SSX2_HUMAN)
KSFDDIAKR

SEQ ID NO: 164890 - protein, 9 aa, Artificial Sequence
  Description of Artificial Sequence: Synthetic peptide
  Seed: KASEKIFYV (SSX2_HUMAN)
KFSEKIFYL

SEQ ID NO: 164891 - protein, 9 aa, Artificial Sequence
  Description of Artificial Sequence: Synthetic peptide
  Seed: AFDDIAKYF (SSX2_HUMAN)
AFDDIAKYM

SEQ ID NO: 164892 - protein, 9 aa, Artificial Sequence
  Description of Artificial Sequence: Synthetic peptide
  Seed: YMKRKYEAM (SSX2_HUMAN)
YAKRKYEAI

SEQ ID NO: 164893 - protein, 9 aa, Artificial Sequence
  Description of Artificial Sequence: Synthetic peptide
  Seed: RKYEAMTKL (SSX2_HUMAN)
RQYEAMTKW

SEQ ID NO: 164894 - protein, 9 aa, Artificial Sequence
  Description of Artificial Sequence: Synthetic peptide
  Seed: KAFDDIAKY (SSX2_HUMAN)
KAFDDIAKR

SEQ ID NO: 164895 - protein, 9 aa, Artificial Sequence
  Description of Artificial Sequence: Synthetic peptide
  Seed: RKYEAMTKL (SSX2_HUMAN)
RAYEAMTKV

SEQ ID NO: 164896 - protein, 8 aa, Artificial Sequence
  Description of Artificial Sequence: Synthetic peptide
  Seed: AFDDIAKY (SSX2_HUMAN)
AYDDIAKL

SEQ ID NO: 164897 - protein, 9 aa, Artificial Sequence
  Description of Artificial Sequence: Synthetic peptide
  Seed: NDSEEVPEA (SSX2_HUMAN)
NESEEVPEA

SEQ ID NO: 164898 - protein, 9 aa, Artificial Sequence
  Description of Artificial Sequence: Synthetic peptide
  Seed: KASEKIFYV (SSX2_HUMAN)
KQSEKIFYK

SEQ ID NO: 164899 - protein, 10 aa, Artificial Sequence
  Description of Artificial Sequence: Synthetic peptide
  Seed: EKIFYVYMKR (SSX2_HUMAN)
EPIFYVYMKR

SEQ ID NO: 164900 - protein, 9 aa, Artificial Sequence
  Description of Artificial Sequence: Synthetic peptide
  Seed: KASEKIFYV (SSX2_HUMAN)
KASEKIFYR

SEQ ID NO: 164901 - protein, 10 aa, Artificial Sequence
  Description of Artificial Sequence: Synthetic peptide
  Seed: NQVERPQMTF (SSX2_HUMAN)
NHVERPQMTM

SEQ ID NO: 164902 - protein, 9 aa, Artificial Sequence
  Description of Artificial Sequence: Synthetic peptide
  Seed: TTSEKIHER (SSX2_HUMAN)
TASEKIHEY

SEQ ID NO: 164903 - protein, 9 aa, Artificial Sequence
  Description of Artificial Sequence: Synthetic peptide
  Seed: AFDDIAKYF (SSX2_HUMAN)
AGDDIAKYI

SEQ ID NO: 164904 - protein, 9 aa, Artificial Sequence
  Description of Artificial Sequence: Synthetic peptide
  Seed: RKYEAMTKL (SSX2_HUMAN)
RIYEAMTKF

SEQ ID NO: 164905 - protein, 9 aa, Artificial Sequence
  Description of Artificial Sequence: Synthetic peptide
  Seed: DAFARRPTV (SSX2_HUMAN)
DTFARRPTV

SEQ ID NO: 164906 - protein, 10 aa, Artificial Sequence
  Description of Artificial Sequence: Synthetic peptide
  Seed: EKIFYVYMKR (SSX2_HUMAN)
ENIFYVYMKR

SEQ ID NO: 164907 - protein, 9 aa, Artificial Sequence
  Description of Artificial Sequence: Synthetic peptide
  Seed: KIHERSGPK (SSX2_HUMAN)
KAHERSGPK

SEQ ID NO: 164908 - protein, 10 aa, Artificial Sequence
  Description of Artificial Sequence: Synthetic peptide
  Seed: KYFSKEEWEK (SSX2_HUMAN)
KAFSKEEWEY

SEQ ID NO: 164909 - protein, 9 aa, Artificial Sequence
  Description of Artificial Sequence: Synthetic peptide
  Seed: TTSEKIHER (SSX2_HUMAN)
TGSEKIHEL

SEQ ID NO: 164910 - protein, 11 aa, Artificial Sequence
  Description of Artificial Sequence: Synthetic peptide
  Seed: FGRLQGISPKI (SSX2_HUMAN)
FARLQGISPKV

SEQ ID NO: 164911 - protein, 9 aa, Artificial Sequence
  Description of Artificial Sequence: Synthetic peptide
  Seed: YMKRKYEAM (SSX2_HUMAN)
YSKRKYEAI

SEQ ID NO: 164912 - protein, 9 aa, Artificial Sequence
  Description of Artificial Sequence: Synthetic peptide
  Seed: IFYVYMKRK (SSX2_HUMAN)
ITYVYMKRR

SEQ ID NO: 164913 - protein, 10 aa, Artificial Sequence
  Description of Artificial Sequence: Synthetic peptide
  Seed: MKASEKIFYV (SSX2_HUMAN)
MVASEKIFYM

SEQ ID NO: 164914 - protein, 10 aa, Artificial Sequence
  Description of Artificial Sequence: Synthetic peptide
  Seed: YEAMTKLGFK (SSX2_HUMAN)
YMAMTKLGFR

SEQ ID NO: 164915 - protein, 9 aa, Artificial Sequence
  Description of Artificial Sequence: Synthetic peptide
  Seed: EEVPEASGP (SSX2_HUMAN)
EEVPEASGV

SEQ ID NO: 164916 - protein, 9 aa, Artificial Sequence
  Description of Artificial Sequence: Synthetic peptide
  Seed: MPKKPAEEG (SSX2_HUMAN)
MPKKPAEEC

SEQ ID NO: 164917 - protein, 9 aa, Artificial Sequence
  Description of Artificial Sequence: Synthetic peptide
  Seed: RLRERKQLV (SSX2_HUMAN)
RIRERKQLK

SEQ ID NO: 164918 - protein, 9 aa, Artificial Sequence
  Description of Artificial Sequence: Synthetic peptide
  Seed: AEDFQGNDL (SSX2_HUMAN)
ALDFQGNDL

SEQ ID NO: 164919 - protein, 8 aa, Artificial Sequence
  Description of Artificial Sequence: Synthetic peptide
  Seed: AFDDIAKY (SSX2_HUMAN)
AWDDIAKM

SEQ ID NO: 164920 - protein, 9 aa, Artificial Sequence
  Description of Artificial Sequence: Synthetic peptide
  Seed: GPKRGEHAW (SSX2_HUMAN)
GTKRGEHAW

SEQ ID NO: 164921 - protein, 8 aa, Artificial Sequence
  Description of Artificial Sequence: Synthetic peptide
  Seed: QLVIYEEI (SSX2_HUMAN)
QQVIYEEI

SEQ ID NO: 164922 - protein, 10 aa, Artificial Sequence
  Description of Artificial Sequence: Synthetic peptide
  Seed: LGFKATLPPF (SSX2_HUMAN)
LKFKATLPPF

SEQ ID NO: 164923 - protein, 9 aa, Artificial Sequence
  Description of Artificial Sequence: Synthetic peptide
  Seed: KAFDDIAKY (SSX2_HUMAN)
KMFDDIAKK

SEQ ID NO: 164924 - protein, 9 aa, Artificial Sequence
  Description of Artificial Sequence: Synthetic peptide
  Seed: KQLVIYEEI (SSX2_HUMAN)
KQLVIYEEV

SEQ ID NO: 164925 - protein, 10 aa, Artificial Sequence
  Description of Artificial Sequence: Synthetic peptide
  Seed: LGFKATLPPF (SSX2_HUMAN)
LQFKATLPPF

SEQ ID NO: 164926 - protein, 9 aa, Artificial Sequence
  Description of Artificial Sequence: Synthetic peptide
  Seed: KATLPPFMC (SSX2_HUMAN)
KSTLPPFMF

SEQ ID NO: 164927 - protein, 9 aa, Artificial Sequence
  Description of Artificial Sequence: Synthetic peptide
  Seed: KIHERSGPK (SSX2_HUMAN)
KQHERSGPK

SEQ ID NO: 164928 - protein, 10 aa, Artificial Sequence
  Description of Artificial Sequence: Synthetic peptide
  Seed: MKASEKIFYV (SSX2_HUMAN)
MVASEKIFYI

SEQ ID NO: 164929 - protein, 9 aa, Artificial Sequence
  Description of Artificial Sequence: Synthetic peptide
  Seed: GISPKIMPK (SSX2_HUMAN)
GFSPKIMPR

SEQ ID NO: 164930 - protein, 10 aa, Artificial Sequence
  Description of Artificial Sequence: Synthetic peptide
  Seed: KAFDDIAKYF (SSX2_HUMAN)
KMFDDIAKYI

SEQ ID NO: 164931 - protein, 10 aa, Artificial Sequence
  Description of Artificial Sequence: Synthetic peptide
  Seed: MKASEKIFYV (SSX2_HUMAN)
MFASEKIFYI

SEQ ID NO: 164932 - protein, 9 aa, Artificial Sequence
  Description of Artificial Sequence: Synthetic peptide
  Seed: KAFDDIAKY (SSX2_HUMAN)
KIFDDIAKM

SEQ ID NO: 164933 - protein, 9 aa, Artificial Sequence
  Description of Artificial Sequence: Synthetic peptide
  Seed: MNGDDAFAR (SSX2_HUMAN)
MSGDDAFAY

SEQ ID NO: 164934 - protein, 10 aa, Artificial Sequence
  Description of Artificial Sequence: Synthetic peptide
  Seed: KMKASEKIFY (SSX2_HUMAN)
KMKASEKIFK

SEQ ID NO: 164935 - protein, 10 aa, Artificial Sequence
  Description of Artificial Sequence: Synthetic peptide
  Seed: KYEAMTKLGF (SSX2_HUMAN)
KVEAMTKLGW

SEQ ID NO: 164936 - protein, 9 aa, Artificial Sequence
  Description of Artificial Sequence: Synthetic peptide
  Seed: FSKEEWEKM (SSX2_HUMAN)
FYKEEWEKF

SEQ ID NO: 164937 - protein, 9 aa, Artificial Sequence
  Description of Artificial Sequence: Synthetic peptide
  Seed: RKYEAMTKL (SSX2_HUMAN)
RVYEAMTKV

SEQ ID NO: 164938 - protein, 9 aa, Artificial Sequence
  Description of Artificial Sequence: Synthetic peptide
  Seed: KAFDDIAKY (SSX2_HUMAN)
KIFDDIAKF

SEQ ID NO: 164939 - protein, 9 aa, Artificial Sequence
  Description of Artificial Sequence: Synthetic peptide
  Seed: TKLGFKATL (SSX2_HUMAN)
THLGFKATI

SEQ ID NO: 164940 - protein, 8 aa, Artificial Sequence
  Description of Artificial Sequence: Synthetic peptide
  Seed: NQVERPQM (SSX2_HUMAN)
NHVERPQL

SEQ ID NO: 164941 - protein, 9 aa, Artificial Sequence
  Description of Artificial Sequence: Synthetic peptide
  Seed: RLQGISPKI (SSX2_HUMAN)
RTQGISPKK

SEQ ID NO: 164942 - protein, 9 aa, Artificial Sequence
  Description of Artificial Sequence: Synthetic peptide
  Seed: GFKATLPPF (SSX2_HUMAN)
GTKATLPPF

SEQ ID NO: 164943 - protein, 9 aa, Artificial Sequence
  Description of Artificial Sequence: Synthetic peptide
  Seed: FYVYMKRKY (SSX2_HUMAN)
FLVYMKRKY

SEQ ID NO: 164944 - protein, 9 aa, Artificial Sequence
  Description of Artificial Sequence: Synthetic peptide
  Seed: YEAMTKLGF (SSX2_HUMAN)
YVAMTKLGY

SEQ ID NO: 164945 - protein, 10 aa, Artificial Sequence
  Description of Artificial Sequence: Synthetic peptide
  Seed: KAFDDIAKYF (SSX2_HUMAN)
KEFDDIAKYY

SEQ ID NO: 164946 - protein, 9 aa, Artificial Sequence
  Description of Artificial Sequence: Synthetic peptide
  Seed: VGAQIPEKI (SSX2_HUMAN)
VLAQIPEKV

SEQ ID NO: 164947 - protein, 11 aa, Artificial Sequence
  Description of Artificial Sequence: Synthetic peptide
  Seed: RKYEAMTKLGF (SSX2_HUMAN)
RMYEAMTKLGF

SEQ ID NO: 164948 - protein, 9 aa, Artificial Sequence
  Description of Artificial Sequence: Synthetic peptide
  Seed: FARRPTVGA (SSX2_HUMAN)
FGRRPTVGK

SEQ ID NO: 164949 - protein, 10 aa, Artificial Sequence
  Description of Artificial Sequence: Synthetic peptide
  Seed: MKASEKIFYV (SSX2_HUMAN)
MMASEKIFYI

SEQ ID NO: 164950 - protein, 9 aa, Artificial Sequence
  Description of Artificial Sequence: Synthetic peptide
  Seed: GFKATLPPF (SSX2_HUMAN)
GAKATLPPY

SEQ ID NO: 164951 - protein, 11 aa, Artificial Sequence
  Description of Artificial Sequence: Synthetic peptide
  Seed: RGEHAWTHRLR (SSX2_HUMAN)
RLEHAWTHRLR

SEQ ID NO: 164952 - protein, 9 aa, Artificial Sequence
  Description of Artificial Sequence: Synthetic peptide
  Seed: KASEKIFYV (SSX2_HUMAN)
KVSEKIFYA

SEQ ID NO: 164953 - protein, 9 aa, Artificial Sequence
  Description of Artificial Sequence: Synthetic peptide
  Seed: RKYEAMTKL (SSX2_HUMAN)
RQYEAMTKL

SEQ ID NO: 164954 - protein, 9 aa, Artificial Sequence
  Description of Artificial Sequence: Synthetic peptide
  Seed: KRKYEAMTK (SSX2_HUMAN)
KSKYEAMTA

SEQ ID NO: 164955 - protein, 9 aa, Artificial Sequence
  Description of Artificial Sequence: Synthetic peptide
  Seed: KASEKIFYV (SSX2_HUMAN)
KLSEKIFYA

SEQ ID NO: 164956 - protein, 11 aa, Artificial Sequence
  Description of Artificial Sequence: Synthetic peptide
  Seed: KMKASEKIFYV (SSX2_HUMAN)
KMKASEKIFYK

SEQ ID NO: 164957 - protein, 10 aa, Artificial Sequence
  Description of Artificial Sequence: Synthetic peptide
  Seed: ATLPPFMCNK (SSX2_HUMAN)
ASLPPFMCNK

SEQ ID NO: 164958 - protein, 9 aa, Artificial Sequence
  Description of Artificial Sequence: Synthetic peptide
  Seed: IPEKIQKAF (SSX2_HUMAN)
IPEKIQKAW

SEQ ID NO: 164959 - protein, 9 aa, Artificial Sequence
  Description of Artificial Sequence: Synthetic peptide
  Seed: SEEVPEASG (SSX2_HUMAN)
SEEVPEAST

SEQ ID NO: 164960 - protein, 10 aa, Artificial Sequence
  Description of Artificial Sequence: Synthetic peptide
  Seed: YMKRKYEAMT (SSX2_HUMAN)
YIKRKYEAMV

SEQ ID NO: 164961 - protein, 9 aa, Artificial Sequence
  Description of Artificial Sequence: Synthetic peptide
  Seed: KAFDDIAKY (SSX2_HUMAN)
KYFDDIAKV

SEQ ID NO: 164962 - protein, 9 aa, Artificial Sequence
  Description of Artificial Sequence: Synthetic peptide
  Seed: QIPEKIQKA (SSX2_HUMAN)
QSPEKIQKR

SEQ ID NO: 164963 - protein, 9 aa, Artificial Sequence
  Description of Artificial Sequence: Synthetic peptide
  Seed: KAFDDIAKY (SSX2_HUMAN)
KQFDDIAKW

SEQ ID NO: 164964 - protein, 9 aa, Artificial Sequence
  Description of Artificial Sequence: Synthetic peptide
  Seed: RLQGISPKI (SSX2_HUMAN)
RMQGISPKI

SEQ ID NO: 164965 - protein, 9 aa, Artificial Sequence
  Description of Artificial Sequence: Synthetic peptide
  Seed: FARRPTVGA (SSX2_HUMAN)
FYRRPTVGK

SEQ ID NO: 164966 - protein, 9 aa, Artificial Sequence
  Description of Artificial Sequence: Synthetic peptide
  Seed: RLQGISPKI (SSX2_HUMAN)
RSQGISPKI

SEQ ID NO: 164967 - protein, 9 aa, Artificial Sequence
  Description of Artificial Sequence: Synthetic peptide
  Seed: AKYFSKEEW (SSX2_HUMAN)
AQYFSKEEY

SEQ ID NO: 164968 - protein, 9 aa, Artificial Sequence
  Description of Artificial Sequence: Synthetic peptide
  Seed: KRKYEAMTK (SSX2_HUMAN)
KAKYEAMTA

SEQ ID NO: 164969 - protein, 9 aa, Artificial Sequence
  Description of Artificial Sequence: Synthetic peptide
  Seed: KRKYEAMTK (SSX2_HUMAN)
KQKYEAMTK

SEQ ID NO: 164970 - protein, 10 aa, Artificial Sequence
  Description of Artificial Sequence: Synthetic peptide
  Seed: MKASEKIFYV (SSX2_HUMAN)
MCASEKIFYV

SEQ ID NO: 164971 - protein, 11 aa, Artificial Sequence
  Description of Artificial Sequence: Synthetic peptide
  Seed: MKASEKIFYVY (SSX2_HUMAN)
MQASEKIFYVY

SEQ ID NO: 164972 - protein, 11 aa, Artificial Sequence
  Description of Artificial Sequence: Synthetic peptide
  Seed: FGRLQGISPKI (SSX2_HUMAN)
FMRLQGISPKI

SEQ ID NO: 164973 - protein, 8 aa, Artificial Sequence
  Description of Artificial Sequence: Synthetic peptide
  Seed: FDDIAKYF (SSX2_HUMAN)
FIDIAKYV

SEQ ID NO: 164974 - protein, 10 aa, Artificial Sequence
  Description of Artificial Sequence: Synthetic peptide
  Seed: KYEAMTKLGF (SSX2_HUMAN)
KYEAMTKLGW

SEQ ID NO: 164975 - protein, 10 aa, Artificial Sequence
  Description of Artificial Sequence: Synthetic peptide
  Seed: LGFKATLPPF (SSX2_HUMAN)
LTFKATLPPM

SEQ ID NO: 164976 - protein, 10 aa, Artificial Sequence
  Description of Artificial Sequence: Synthetic peptide
  Seed: VYMKRKYEAM (SSX2_HUMAN)
VNMKRKYEAL

SEQ ID NO: 164977 - protein, 9 aa, Artificial Sequence
  Description of Artificial Sequence: Synthetic peptide
  Seed: YEAMTKLGF (SSX2_HUMAN)
YHAMTKLGF

SEQ ID NO: 164978 - protein, 9 aa, Artificial Sequence
  Description of Artificial Sequence: Synthetic peptide
  Seed: AFDDIAKYF (SSX2_HUMAN)
ASDDIAKYW

SEQ ID NO: 164979 - protein, 9 aa, Artificial Sequence
  Description of Artificial Sequence: Synthetic peptide
  Seed: QIPEKIQKA (SSX2_HUMAN)
QLPEKIQKM

SEQ ID NO: 164980 - protein, 10 aa, Artificial Sequence
  Description of Artificial Sequence: Synthetic peptide
  Seed: EKIFYVYMKR (SSX2_HUMAN)
ELIFYVYMKK

SEQ ID NO: 164981 - protein, 8 aa, Artificial Sequence
  Description of Artificial Sequence: Synthetic peptide
  Seed: AFDDIAKY (SSX2_HUMAN)
ASDDIAKF

SEQ ID NO: 164982 - protein, 9 aa, Artificial Sequence
  Description of Artificial Sequence: Synthetic peptide
  Seed: VYMKRKYEA (SSX2_HUMAN)
VFMKRKYEF

SEQ ID NO: 164983 - protein, 9 aa, Artificial Sequence
  Description of Artificial Sequence: Synthetic peptide
  Seed: QIPEKIQKA (SSX2_HUMAN)
QFPEKIQKL

SEQ ID NO: 164984 - protein, 9 aa, Artificial Sequence
  Description of Artificial Sequence: Synthetic peptide
  Seed: RLQGISPKI (SSX2_HUMAN)
RMQGISPKM

SEQ ID NO: 164985 - protein, 8 aa, Artificial Sequence
  Description of Artificial Sequence: Synthetic peptide
  Seed: AFDDIAKY (SSX2_HUMAN)
ANDDIAKL

SEQ ID NO: 164986 - protein, 9 aa, Artificial Sequence
  Description of Artificial Sequence: Synthetic peptide
  Seed: KASEKIFYV (SSX2_HUMAN)
KCSEKIFYW

SEQ ID NO: 164987 - protein, 10 aa, Artificial Sequence
  Description of Artificial Sequence: Synthetic peptide
  Seed: KRGEHAWTHR (SSX2_HUMAN)
KVGEHAWTHR

SEQ ID NO: 164988 - protein, 9 aa, Artificial Sequence
  Description of Artificial Sequence: Synthetic peptide
  Seed: QIPEKIQKA (SSX2_HUMAN)
QQPEKIQKV

SEQ ID NO: 164989 - protein, 9 aa, Artificial Sequence
  Description of Artificial Sequence: Synthetic peptide
  Seed: RKYEAMTKL (SSX2_HUMAN)
RLYEAMTKV

SEQ ID NO: 164990 - protein, 9 aa, Artificial Sequence
  Description of Artificial Sequence: Synthetic peptide
  Seed: RERKQLVIY (SSX2_HUMAN)
RVRKQLVIY

SEQ ID NO: 164991 - protein, 10 aa, Artificial Sequence
  Description of Artificial Sequence: Synthetic peptide
  Seed: KASEKIFYVY (SSX2_HUMAN)
KNSEKIFYVW

SEQ ID NO: 164992 - protein, 9 aa, Artificial Sequence
  Description of Artificial Sequence: Synthetic peptide
  Seed: KATLPPFMC (SSX2_HUMAN)
KATLPPFMF

SEQ ID NO: 164993 - protein, 9 aa, Artificial Sequence
  Description of Artificial Sequence: Synthetic peptide
  Seed: KATLPPFMC (SSX2_HUMAN)
KTTLPPFMM

SEQ ID NO: 164994 - protein, 9 aa, Artificial Sequence
  Description of Artificial Sequence: Synthetic peptide
  Seed: VGAQIPEKI (SSX2_HUMAN)
VIAQIPEKF

SEQ ID NO: 164995 - protein, 10 aa, Artificial Sequence
  Description of Artificial Sequence: Synthetic peptide
  Seed: SGPQNDGKEL (SSX2_HUMAN)
SVPQNDGKEM

SEQ ID NO: 164996 - protein, 9 aa, Artificial Sequence
  Description of Artificial Sequence: Synthetic peptide
  Seed: AQIPEKIQK (SSX2_HUMAN)
AIIPEKIQK

SEQ ID NO: 164997 - protein, 10 aa, Artificial Sequence
  Description of Artificial Sequence: Synthetic peptide
  Seed: HAWTHRLRER (SSX2_HUMAN)
HIWTHRLRER

SEQ ID NO: 164998 - protein, 9 aa, Artificial Sequence
  Description of Artificial Sequence: Synthetic peptide
  Seed: RKYEAMTKL (SSX2_HUMAN)
RTYEAMTKF

SEQ ID NO: 164999 - protein, 9 aa, Artificial Sequence
  Description of Artificial Sequence: Synthetic peptide
  Seed: YMKRKYEAM (SSX2_HUMAN)
YLKRKYEAV

SEQ ID NO: 165000 - protein, 9 aa, Artificial Sequence
  Description of Artificial Sequence: Synthetic peptide
  Seed: EHAWTHRLR (SSX2_HUMAN)
ETAWTHRLR

SEQ ID NO: 165001 - protein, 10 aa, Artificial Sequence
  Description of Artificial Sequence: Synthetic peptide
  Seed: AFARRPTVGA (SSX2_HUMAN)
AVARRPTVGK

SEQ ID NO: 165002 - protein, 9 aa, Artificial Sequence
  Description of Artificial Sequence: Synthetic peptide
  Seed: KAFDDIAKY (SSX2_HUMAN)
KQFDDIAKF

SEQ ID NO: 165003 - protein, 9 aa, Artificial Sequence
  Description of Artificial Sequence: Synthetic peptide
  Seed: AQIPEKIQK (SSX2_HUMAN)
ARIPEKIQF

SEQ ID NO: 165004 - protein, 8 aa, Artificial Sequence
  Description of Artificial Sequence: Synthetic peptide
  Seed: VERPQMTF (SSX2_HUMAN)
VQRPQMTY

SEQ ID NO: 165005 - protein, 9 aa, Artificial Sequence
  Description of Artificial Sequence: Synthetic peptide
  Seed: EHAWTHRLR (SSX2_HUMAN)
EQAWTHRLR

SEQ ID NO: 165006 - protein, 10 aa, Artificial Sequence
  Description of Artificial Sequence: Synthetic peptide
  Seed: VYMKRKYEAM (SSX2_HUMAN)
VMMKRKYEAI

SEQ ID NO: 165007 - protein, 9 aa, Artificial Sequence
  Description of Artificial Sequence: Synthetic peptide
  Seed: KATLPPFMC (SSX2_HUMAN)
KSTLPPFMW

SEQ ID NO: 165008 - protein, 10 aa, Artificial Sequence
  Description of Artificial Sequence: Synthetic peptide
  Seed: HAWTHRLRER (SSX2_HUMAN)
HMWTHRLREK

SEQ ID NO: 165009 - protein, 9 aa, Artificial Sequence
  Description of Artificial Sequence: Synthetic peptide
  Seed: MTFGRLQGI (SSX2_HUMAN)
MMFGRLQGI

SEQ ID NO: 165010 - protein, 10 aa, Artificial Sequence
  Description of Artificial Sequence: Synthetic peptide
  Seed: MKASEKIFYV (SSX2_HUMAN)
MQASEKIFYA

SEQ ID NO: 165011 - protein, 9 aa, Artificial Sequence
  Description of Artificial Sequence: Synthetic peptide
  Seed: KQLVIYEEI (SSX2_HUMAN)
KILVIYEEI

SEQ ID NO: 165012 - protein, 9 aa, Artificial Sequence
  Description of Artificial Sequence: Synthetic peptide
  Seed: TTSEKIHER (SSX2_HUMAN)
TLSEKIHEM

SEQ ID NO: 165013 - protein, 9 aa, Artificial Sequence
  Description of Artificial Sequence: Synthetic peptide
  Seed: AFDDIAKYF (SSX2_HUMAN)
AQDDIAKYF

SEQ ID NO: 165014 - protein, 9 aa, Artificial Sequence
  Description of Artificial Sequence: Synthetic peptide
  Seed: RLRERKQLV (SSX2_HUMAN)
RTRERKQLR

SEQ ID NO: 165015 - protein, 10 aa, Artificial Sequence
  Description of Artificial Sequence: Synthetic peptide
  Seed: MTFGRLQGIS (SSX2_HUMAN)
MAFGRLQGIV

SEQ ID NO: 165016 - protein, 9 aa, Artificial Sequence
  Description of Artificial Sequence: Synthetic peptide
  Seed: TLPPFMCNK (SSX2_HUMAN)
TVPPFMCNR

SEQ ID NO: 165017 - protein, 9 aa, Artificial Sequence
  Description of Artificial Sequence: Synthetic peptide
  Seed: KASEKIFYV (SSX2_HUMAN)
KTSEKIFYY

SEQ ID NO: 165018 - protein, 9 aa, Artificial Sequence
  Description of Artificial Sequence: Synthetic peptide
  Seed: NGDDAFARR (SSX2_HUMAN)
NMDDAFARY

SEQ ID NO: 165019 - protein, 10 aa, Artificial Sequence
  Description of Artificial Sequence: Synthetic peptide
  Seed: MTKLGFKATL (SSX2_HUMAN)
MKKLGFKATF

SEQ ID NO: 165020 - protein, 9 aa, Artificial Sequence
  Description of Artificial Sequence: Synthetic peptide
  Seed: MTFGRLQGI (SSX2_HUMAN)
MSFGRLQGR

SEQ ID NO: 165021 - protein, 9 aa, Artificial Sequence
  Description of Artificial Sequence: Synthetic peptide
  Seed: KQLVIYEEI (SSX2_HUMAN)
KLLVIYEEW

SEQ ID NO: 165022 - protein, 9 aa, Artificial Sequence
  Description of Artificial Sequence: Synthetic peptide
  Seed: VGAQIPEKI (SSX2_HUMAN)
VAAQIPEKY

SEQ ID NO: 165023 - protein, 10 aa, Artificial Sequence
  Description of Artificial Sequence: Synthetic peptide
  Seed: YVYMKRKYEA (SSX2_HUMAN)
YLYMKRKYEV

SEQ ID NO: 165024 - protein, 10 aa, Artificial Sequence
  Description of Artificial Sequence: Synthetic peptide
  Seed: RPQMTFGRLQ (SSX2_HUMAN)
RPQMTFGRLF

SEQ ID NO: 165025 - protein, 11 aa, Artificial Sequence
  Description of Artificial Sequence: Synthetic peptide
  Seed: ATLPPFMCNKR (SSX2_HUMAN)
ATLPPFMCNKK

SEQ ID NO: 165026 - protein, 8 aa, Artificial Sequence
  Description of Artificial Sequence: Synthetic peptide
  Seed: AFDDIAKY (SSX2_HUMAN)
AIDDIAKF

SEQ ID NO: 165027 - protein, 10 aa, Artificial Sequence
  Description of Artificial Sequence: Synthetic peptide
  Seed: YEAMTKLGFK (SSX2_HUMAN)
YWAMTKLGFR

SEQ ID NO: 165028 - protein, 9 aa, Artificial Sequence
  Description of Artificial Sequence: Synthetic peptide
  Seed: MTKLGFKAT (SSX2_HUMAN)
MGKLGFKAK

SEQ ID NO: 165029 - protein, 10 aa, Artificial Sequence
  Description of Artificial Sequence: Synthetic peptide
  Seed: QGISPKIMPK (SSX2_HUMAN)
QVISPKIMPK

SEQ ID NO: 165030 - protein, 10 aa, Artificial Sequence
  Description of Artificial Sequence: Synthetic peptide
  Seed: KMKASEKIFY (SSX2_HUMAN)
KFKASEKIFA

SEQ ID NO: 165031 - protein, 9 aa, Artificial Sequence
  Description of Artificial Sequence: Synthetic peptide
  Seed: MTFGRLQGI (SSX2_HUMAN)
MSFGRLQGW

SEQ ID NO: 165032 - protein, 10 aa, Artificial Sequence
  Description of Artificial Sequence: Synthetic peptide
  Seed: EKIFYVYMKR (SSX2_HUMAN)
ETIFYVYMKR

SEQ ID NO: 165033 - protein, 9 aa, Artificial Sequence
  Description of Artificial Sequence: Synthetic peptide
  Seed: RLRERKQLV (SSX2_HUMAN)
RVRERKQLS

SEQ ID NO: 165034 - protein, 9 aa, Artificial Sequence
  Description of Artificial Sequence: Synthetic peptide
  Seed: KASEKIFYV (SSX2_HUMAN)
KASEKIFYA

SEQ ID NO: 165035 - protein, 9 aa, Artificial Sequence
  Description of Artificial Sequence: Synthetic peptide
  Seed: TKLGFKATL (SSX2_HUMAN)
TRLGFKATL

SEQ ID NO: 165036 - protein, 9 aa, Artificial Sequence
  Description of Artificial Sequence: Synthetic peptide
  Seed: AFDDIAKYF (SSX2_HUMAN)
AEDDIAKYM

SEQ ID NO: 165037 - protein, 10 aa, Artificial Sequence
  Description of Artificial Sequence: Synthetic peptide
  Seed: AFARRPTVGA (SSX2_HUMAN)
ASARRPTVGK

SEQ ID NO: 165038 - protein, 9 aa, Artificial Sequence
  Description of Artificial Sequence: Synthetic peptide
  Seed: AQIPEKIQK (SSX2_HUMAN)
AIIPEKIQL

SEQ ID NO: 165039 - protein, 9 aa, Artificial Sequence
  Description of Artificial Sequence: Synthetic peptide
  Seed: RLRERKQLV (SSX2_HUMAN)
RMRERKQLW

SEQ ID NO: 165040 - protein, 8 aa, Artificial Sequence
  Description of Artificial Sequence: Synthetic peptide
  Seed: YMKRKYEA (SSX2_HUMAN)
YPKRKYEL

SEQ ID NO: 165041 - protein, 9 aa, Artificial Sequence
  Description of Artificial Sequence: Synthetic peptide
  Seed: AKYFSKEEW (SSX2_HUMAN)
ANYFSKEEY

SEQ ID NO: 165042 - protein, 9 aa, Artificial Sequence
  Description of Artificial Sequence: Synthetic peptide
  Seed: AQIPEKIQK (SSX2_HUMAN)
ALIPEKIQF

SEQ ID NO: 165043 - protein, 8 aa, Artificial Sequence
  Description of Artificial Sequence: Synthetic peptide
  Seed: FDDIAKYF (SSX2_HUMAN)
FWDIAKYI

SEQ ID NO: 165044 - protein, 9 aa, Artificial Sequence
  Description of Artificial Sequence: Synthetic peptide
  Seed: RKYEAMTKL (SSX2_HUMAN)
RSYEAMTKI

SEQ ID NO: 165045 - protein, 9 aa, Artificial Sequence
  Description of Artificial Sequence: Synthetic peptide
  Seed: AEDFQGNDL (SSX2_HUMAN)
AIDFQGNDV

SEQ ID NO: 165046 - protein, 9 aa, Artificial Sequence
  Description of Artificial Sequence: Synthetic peptide
  Seed: VGAQIPEKI (SSX2_HUMAN)
VTAQIPEKF

SEQ ID NO: 165047 - protein, 10 aa, Artificial Sequence
  Description of Artificial Sequence: Synthetic peptide
  Seed: QGISPKIMPK (SSX2_HUMAN)
QYISPKIMPR

SEQ ID NO: 165048 - protein, 9 aa, Artificial Sequence
  Description of Artificial Sequence: Synthetic peptide
  Seed: RKYEAMTKL (SSX2_HUMAN)
RFYEAMTKF

SEQ ID NO: 165049 - protein, 10 aa, Artificial Sequence
  Description of Artificial Sequence: Synthetic peptide
  Seed: EKIFYVYMKR (SSX2_HUMAN)
EYIFYVYMKR

SEQ ID NO: 165050 - protein, 11 aa, Artificial Sequence
  Description of Artificial Sequence: Synthetic peptide
  Seed: KELCPPGKPTT (SSX2_HUMAN)
KELCPPGKPTM

SEQ ID NO: 165051 - protein, 9 aa, Artificial Sequence
  Description of Artificial Sequence: Synthetic peptide
  Seed: YMKRKYEAM (SSX2_HUMAN)
YVKRKYEAI

SEQ ID NO: 165052 - protein, 9 aa, Artificial Sequence
  Description of Artificial Sequence: Synthetic peptide
  Seed: FARRPTVGA (SSX2_HUMAN)
FIRRPTVGM

SEQ ID NO: 165053 - protein, 9 aa, Artificial Sequence
  Description of Artificial Sequence: Synthetic peptide
  Seed: DAFARRPTV (SSX2_HUMAN)
DAFARRPTI

SEQ ID NO: 165054 - protein, 11 aa, Artificial Sequence
  Description of Artificial Sequence: Synthetic peptide
  Seed: QGISPKIMPKK (SSX2_HUMAN)
QTISPKIMPKK

SEQ ID NO: 165055 - protein, 9 aa, Artificial Sequence
  Description of Artificial Sequence: Synthetic peptide
  Seed: TTSEKIHER (SSX2_HUMAN)
TSSEKIHEM

SEQ ID NO: 165056 - protein, 9 aa, Artificial Sequence
  Description of Artificial Sequence: Synthetic peptide
  Seed: GISPKIMPK (SSX2_HUMAN)
GASPKIMPK

SEQ ID NO: 165057 - protein, 10 aa, Artificial Sequence
  Description of Artificial Sequence: Synthetic peptide
  Seed: VYMKRKYEAM (SSX2_HUMAN)
VCMKRKYEAL

SEQ ID NO: 165058 - protein, 9 aa, Artificial Sequence
  Description of Artificial Sequence: Synthetic peptide
  Seed: GFKATLPPF (SSX2_HUMAN)
GLKATLPPY

SEQ ID NO: 165059 - protein, 9 aa, Artificial Sequence
  Description of Artificial Sequence: Synthetic peptide
  Seed: GISPKIMPK (SSX2_HUMAN)
GSSPKIMPL

SEQ ID NO: 165060 - protein, 10 aa, Artificial Sequence
  Description of Artificial Sequence: Synthetic peptide
  Seed: MKASEKIFYV (SSX2_HUMAN)
MQASEKIFYL

SEQ ID NO: 165061 - protein, 9 aa, Artificial Sequence
  Description of Artificial Sequence: Synthetic peptide
  Seed: YEAMTKLGF (SSX2_HUMAN)
YAAMTKLGY

SEQ ID NO: 165062 - protein, 10 aa, Artificial Sequence
  Description of Artificial Sequence: Synthetic peptide
  Seed: KYFSKEEWEK (SSX2_HUMAN)
KTFSKEEWER

SEQ ID NO: 165063 - protein, 11 aa, Artificial Sequence
  Description of Artificial Sequence: Synthetic peptide
  Seed: RKYEAMTKLGF (SSX2_HUMAN)
RQYEAMTKLGY

SEQ ID NO: 165064 - protein, 9 aa, Artificial Sequence
  Description of Artificial Sequence: Synthetic peptide
  Seed: AQIPEKIQK (SSX2_HUMAN)
AAIPEKIQM

SEQ ID NO: 165065 - protein, 9 aa, Artificial Sequence
  Description of Artificial Sequence: Synthetic peptide
  Seed: KASEKIFYV (SSX2_HUMAN)
KLSEKIFYT

SEQ ID NO: 165066 - protein, 11 aa, Artificial Sequence
  Description of Artificial Sequence: Synthetic peptide
  Seed: KATLPPFMCNK (SSX2_HUMAN)
KRTLPPFMCNR

SEQ ID NO: 165067 - protein, 9 aa, Artificial Sequence
  Description of Artificial Sequence: Synthetic peptide
  Seed: YEAMTKLGF (SSX2_HUMAN)
YHAMTKLGY

SEQ ID NO: 165068 - protein, 10 aa, Artificial Sequence
  Description of Artificial Sequence: Synthetic peptide
  Seed: KAFDDIAKYF (SSX2_HUMAN)
KEFDDIAKYL

SEQ ID NO: 165069 - protein, 9 aa, Artificial Sequence
  Description of Artificial Sequence: Synthetic peptide
  Seed: AFDDIAKYF (SSX2_HUMAN)
AADDIAKYV

SEQ ID NO: 165070 - protein, 9 aa, Artificial Sequence
  Description of Artificial Sequence: Synthetic peptide
  Seed: KAFDDIAKY (SSX2_HUMAN)
KNFDDIAKV

SEQ ID NO: 165071 - protein, 9 aa, Artificial Sequence
  Description of Artificial Sequence: Synthetic peptide
  Seed: NGDDAFARR (SSX2_HUMAN)
NADDAFARY

SEQ ID NO: 165072 - protein, 10 aa, Artificial Sequence
  Description of Artificial Sequence: Synthetic peptide
  Seed: AFARRPTVGA (SSX2_HUMAN)
ATARRPTVGK

SEQ ID NO: 165073 - protein, 11 aa, Artificial Sequence
  Description of Artificial Sequence: Synthetic peptide
  Seed: RKYEAMTKLGF (SSX2_HUMAN)
RRYEAMTKLGF

SEQ ID NO: 165074 - protein, 10 aa, Artificial Sequence
  Description of Artificial Sequence: Synthetic peptide
  Seed: GRLQGISPKI (SSX2_HUMAN)
GFLQGISPKL

SEQ ID NO: 165075 - protein, 11 aa, Artificial Sequence
  Description of Artificial Sequence: Synthetic peptide
  Seed: RKYEAMTKLGF (SSX2_HUMAN)
RWYEAMTKLGF

SEQ ID NO: 165076 - protein, 9 aa, Artificial Sequence
  Description of Artificial Sequence: Synthetic peptide
  Seed: VGAQIPEKI (SSX2_HUMAN)
VPAQIPEKV

SEQ ID NO: 165077 - protein, 9 aa, Artificial Sequence
  Description of Artificial Sequence: Synthetic peptide
  Seed: YMKRKYEAM (SSX2_HUMAN)
YQKRKYEAA

SEQ ID NO: 165078 - protein, 9 aa, Artificial Sequence
  Description of Artificial Sequence: Synthetic peptide
  Seed: DDIAKYFSK (SSX2_HUMAN)
DWIAKYFSK

SEQ ID NO: 165079 - protein, 9 aa, Artificial Sequence
  Description of Artificial Sequence: Synthetic peptide
  Seed: KQLVIYEEI (SSX2_HUMAN)
KMLVIYEEW

SEQ ID NO: 165080 - protein, 9 aa, Artificial Sequence
  Description of Artificial Sequence: Synthetic peptide
  Seed: RGEHAWTHR (SSX2_HUMAN)
RVEHAWTHR

SEQ ID NO: 165081 - protein, 11 aa, Artificial Sequence
  Description of Artificial Sequence: Synthetic peptide
  Seed: RKYEAMTKLGF (SSX2_HUMAN)
RYYEAMTKLGF

SEQ ID NO: 165082 - protein, 9 aa, Artificial Sequence
  Description of Artificial Sequence: Synthetic peptide
  Seed: KIFYVYMKR (SSX2_HUMAN)
KAFYVYMKR

SEQ ID NO: 165083 - protein, 11 aa, Artificial Sequence
  Description of Artificial Sequence: Synthetic peptide
  Seed: RGEHAWTHRLR (SSX2_HUMAN)
RVEHAWTHRLR

SEQ ID NO: 165084 - protein, 10 aa, Artificial Sequence
  Description of Artificial Sequence: Synthetic peptide
  Seed: KAFDDIAKYF (SSX2_HUMAN)
KVFDDIAKYI

SEQ ID NO: 165085 - protein, 10 aa, Artificial Sequence
  Description of Artificial Sequence: Synthetic peptide
  Seed: MTKLGFKATL (SSX2_HUMAN)
MKKLGFKATY

SEQ ID NO: 165086 - protein, 9 aa, Artificial Sequence
  Description of Artificial Sequence: Synthetic peptide
  Seed: KIFYVYMKR (SSX2_HUMAN)
KSFYVYMKR

SEQ ID NO: 165087 - protein, 9 aa, Artificial Sequence
  Description of Artificial Sequence: Synthetic peptide
  Seed: KAFDDIAKY (SSX2_HUMAN)
KGFDDIAKI

SEQ ID NO: 165088 - protein, 9 aa, Artificial Sequence
  Description of Artificial Sequence: Synthetic peptide
  Seed: MTFGRLQGI (SSX2_HUMAN)
MWFGRLQGY

SEQ ID NO: 165089 - protein, 8 aa, Artificial Sequence
  Description of Artificial Sequence: Synthetic peptide
  Seed: MKRKYEAM (SSX2_HUMAN)
MLRKYEAI

SEQ ID NO: 165090 - protein, 8 aa, Artificial Sequence
  Description of Artificial Sequence: Synthetic peptide
  Seed: EEWEKMKA (SSX2_HUMAN)
EEWEKMKY

SEQ ID NO: 165091 - protein, 10 aa, Artificial Sequence
  Description of Artificial Sequence: Synthetic peptide
  Seed: KRGEHAWTHR (SSX2_HUMAN)
KIGEHAWTHR

SEQ ID NO: 165092 - protein, 10 aa, Artificial Sequence
  Description of Artificial Sequence: Synthetic peptide
  Seed: MKASEKIFYV (SSX2_HUMAN)
MDASEKIFYV

SEQ ID NO: 165093 - protein, 9 aa, Artificial Sequence
  Description of Artificial Sequence: Synthetic peptide
  Seed: RKYEAMTKL (SSX2_HUMAN)
RSYEAMTKY

SEQ ID NO: 165094 - protein, 10 aa, Artificial Sequence
  Description of Artificial Sequence: Synthetic peptide
  Seed: MKASEKIFYV (SSX2_HUMAN)
MTASEKIFYT

SEQ ID NO: 165095 - protein, 10 aa, Artificial Sequence
  Description of Artificial Sequence: Synthetic peptide
  Seed: KASEKIFYVY (SSX2_HUMAN)
KKSEKIFYVF

SEQ ID NO: 165096 - protein, 10 aa, Artificial Sequence
  Description of Artificial Sequence: Synthetic peptide
  Seed: KMKASEKIFY (SSX2_HUMAN)
KLKASEKIFY

SEQ ID NO: 165097 - protein, 10 aa, Artificial Sequence
  Description of Artificial Sequence: Synthetic peptide
  Seed: LGFKATLPPF (SSX2_HUMAN)
LAFKATLPPF

SEQ ID NO: 165098 - protein, 9 aa, Artificial Sequence
  Description of Artificial Sequence: Synthetic peptide
  Seed: KAFDDIAKY (SSX2_HUMAN)
KVFDDIAKR

SEQ ID NO: 165099 - protein, 9 aa, Artificial Sequence
  Description of Artificial Sequence: Synthetic peptide
  Seed: ISPKIMPKK (SSX2_HUMAN)
ILPKIMPKL

SEQ ID NO: 165100 - protein, 10 aa, Artificial Sequence
  Description of Artificial Sequence: Synthetic peptide
  Seed: AFARRPTVGA (SSX2_HUMAN)
AKARRPTVGK

SEQ ID NO: 165101 - protein, 10 aa, Artificial Sequence
  Description of Artificial Sequence: Synthetic peptide
  Seed: MTKLGFKATL (SSX2_HUMAN)
MMKLGFKATK

SEQ ID NO: 165102 - protein, 8 aa, Artificial Sequence
  Description of Artificial Sequence: Synthetic peptide
  Seed: FDDIAKYF (SSX2_HUMAN)
FNDIAKYI

SEQ ID NO: 165103 - protein, 10 aa, Artificial Sequence
  Description of Artificial Sequence: Synthetic peptide
  Seed: AQIPEKIQKA (SSX2_HUMAN)
ALIPEKIQKY

SEQ ID NO: 165104 - protein, 8 aa, Artificial Sequence
  Description of Artificial Sequence: Synthetic peptide
  Seed: FDDIAKYF (SSX2_HUMAN)
FSDIAKYV

SEQ ID NO: 165105 - protein, 9 aa, Artificial Sequence
  Description of Artificial Sequence: Synthetic peptide
  Seed: KQLVIYEEI (SSX2_HUMAN)
KELVIYEEM

SEQ ID NO: 165106 - protein, 9 aa, Artificial Sequence
  Description of Artificial Sequence: Synthetic peptide
  Seed: KIFYVYMKR (SSX2_HUMAN)
KSFYVYMKY

SEQ ID NO: 165107 - protein, 8 aa, Artificial Sequence
  Description of Artificial Sequence: Synthetic peptide
  Seed: MKRKYEAM (SSX2_HUMAN)
MQRKYEAY

SEQ ID NO: 165108 - protein, 10 aa, Artificial Sequence
  Description of Artificial Sequence: Synthetic peptide
  Seed: MKASEKIFYV (SSX2_HUMAN)
MYASEKIFYV

SEQ ID NO: 165109 - protein, 9 aa, Artificial Sequence
  Description of Artificial Sequence: Synthetic peptide
  Seed: RLRERKQLV (SSX2_HUMAN)
RTRERKQLY

SEQ ID NO: 165110 - protein, 9 aa, Artificial Sequence
  Description of Artificial Sequence: Synthetic peptide
  Seed: DAFARRPTV (SSX2_HUMAN)
DVFARRPTF

SEQ ID NO: 165111 - protein, 9 aa, Artificial Sequence
  Description of Artificial Sequence: Synthetic peptide
  Seed: KASEKIFYV (SSX2_HUMAN)
KNSEKIFYK

SEQ ID NO: 165112 - protein, 10 aa, Artificial Sequence
  Description of Artificial Sequence: Synthetic peptide
  Seed: KIFYVYMKRK (SSX2_HUMAN)
KMFYVYMKRF

SEQ ID NO: 165113 - protein, 9 aa, Artificial Sequence
  Description of Artificial Sequence: Synthetic peptide
  Seed: ISPKIMPKK (SSX2_HUMAN)
ITPKIMPKR

SEQ ID NO: 165114 - protein, 10 aa, Artificial Sequence
  Description of Artificial Sequence: Synthetic peptide
  Seed: YVYMKRKYEA (SSX2_HUMAN)
YMYMKRKYEA

SEQ ID NO: 165115 - protein, 9 aa, Artificial Sequence
  Description of Artificial Sequence: Synthetic peptide
  Seed: YEAMTKLGF (SSX2_HUMAN)
YRAMTKLGF

SEQ ID NO: 165116 - protein, 9 aa, Artificial Sequence
  Description of Artificial Sequence: Synthetic peptide
  Seed: DAFARRPTV (SSX2_HUMAN)
DHFARRPTA

SEQ ID NO: 165117 - protein, 9 aa, Artificial Sequence
  Description of Artificial Sequence: Synthetic peptide
  Seed: SEKIHERSG (SSX2_HUMAN)
SEKIHERSL

SEQ ID NO: 165118 - protein, 10 aa, Artificial Sequence
  Description of Artificial Sequence: Synthetic peptide
  Seed: KYEAMTKLGF (SSX2_HUMAN)
KAEAMTKLGW

SEQ ID NO: 165119 - protein, 10 aa, Artificial Sequence
  Description of Artificial Sequence: Synthetic peptide
  Seed: LGFKATLPPF (SSX2_HUMAN)
LIFKATLPPM

SEQ ID NO: 165120 - protein, 9 aa, Artificial Sequence
  Description of Artificial Sequence: Synthetic peptide
  Seed: GRLQGISPK (SSX2_HUMAN)
GRLQGISPF

SEQ ID NO: 165121 - protein, 9 aa, Artificial Sequence
  Description of Artificial Sequence: Synthetic peptide
  Seed: IPEKIQKAF (SSX2_HUMAN)
IPEKIQKAY

SEQ ID NO: 165122 - protein, 9 aa, Artificial Sequence
  Description of Artificial Sequence: Synthetic peptide
  Seed: RLRERKQLV (SSX2_HUMAN)
RYRERKQLM

SEQ ID NO: 165123 - protein, 8 aa, Artificial Sequence
  Description of Artificial Sequence: Synthetic peptide
  Seed: KYFSKEEW (SSX2_HUMAN)
KYFSKEEF

SEQ ID NO: 165124 - protein, 9 aa, Artificial Sequence
  Description of Artificial Sequence: Synthetic peptide
  Seed: QIPEKIQKA (SSX2_HUMAN)
QAPEKIQKL

SEQ ID NO: 165125 - protein, 11 aa, Artificial Sequence
  Description of Artificial Sequence: Synthetic peptide
  Seed: KYEAMTKLGFK (SSX2_HUMAN)
KEEAMTKLGFR

SEQ ID NO: 165126 - protein, 11 aa, Artificial Sequence
  Description of Artificial Sequence: Synthetic peptide
  Seed: FGRLQGISPKI (SSX2_HUMAN)
FLRLQGISPKV

SEQ ID NO: 165127 - protein, 10 aa, Artificial Sequence
  Description of Artificial Sequence: Synthetic peptide
  Seed: KIFYVYMKRK (SSX2_HUMAN)
KMFYVYMKRD

SEQ ID NO: 165128 - protein, 9 aa, Artificial Sequence
  Description of Artificial Sequence: Synthetic peptide
  Seed: TTSEKIHER (SSX2_HUMAN)
TRSEKIHEI

SEQ ID NO: 165129 - protein, 9 aa, Artificial Sequence
  Description of Artificial Sequence: Synthetic peptide
  Seed: GISPKIMPK (SSX2_HUMAN)
GTSPKIMPM

SEQ ID NO: 165130 - protein, 9 aa, Artificial Sequence
  Description of Artificial Sequence: Synthetic peptide
  Seed: KRKYEAMTK (SSX2_HUMAN)
KTKYEAMTV

SEQ ID NO: 165131 - protein, 10 aa, Artificial Sequence
  Description of Artificial Sequence: Synthetic peptide
  Seed: AQIPEKIQKA (SSX2_HUMAN)
AQIPEKIQKL

SEQ ID NO: 165132 - protein, 9 aa, Artificial Sequence
  Description of Artificial Sequence: Synthetic peptide
  Seed: TTSEKIHER (SSX2_HUMAN)
TASEKIHER

SEQ ID NO: 165133 - protein, 9 aa, Artificial Sequence
  Description of Artificial Sequence: Synthetic peptide
  Seed: KAFDDIAKY (SSX2_HUMAN)
KYFDDIAKF

SEQ ID NO: 165134 - protein, 10 aa, Artificial Sequence
  Description of Artificial Sequence: Synthetic peptide
  Seed: GRLQGISPKI (SSX2_HUMAN)
GLLQGISPKI

SEQ ID NO: 165135 - protein, 10 aa, Artificial Sequence
  Description of Artificial Sequence: Synthetic peptide
  Seed: MTFGRLQGIS (SSX2_HUMAN)
MTFGRLQGII

SEQ ID NO: 165136 - protein, 10 aa, Artificial Sequence
  Description of Artificial Sequence: Synthetic peptide
  Seed: MKASEKIFYV (SSX2_HUMAN)
MVASEKIFYA

SEQ ID NO: 165137 - protein, 9 aa, Artificial Sequence
  Description of Artificial Sequence: Synthetic peptide
  Seed: RKYEAMTKL (SSX2_HUMAN)
RHYEAMTKL

SEQ ID NO: 165138 - protein, 8 aa, Artificial Sequence
  Description of Artificial Sequence: Synthetic peptide
  Seed: AFDDIAKY (SSX2_HUMAN)
AMDDIAKI

SEQ ID NO: 165139 - protein, 8 aa, Artificial Sequence
  Description of Artificial Sequence: Synthetic peptide
  Seed: FDDIAKYF (SSX2_HUMAN)
FQDIAKYI

SEQ ID NO: 165140 - protein, 9 aa, Artificial Sequence
  Description of Artificial Sequence: Synthetic peptide
  Seed: DDIAKYFSK (SSX2_HUMAN)
DTIAKYFSR

SEQ ID NO: 165141 - protein, 11 aa, Artificial Sequence
  Description of Artificial Sequence: Synthetic peptide
  Seed: KYEAMTKLGFK (SSX2_HUMAN)
KTEAMTKLGFR

SEQ ID NO: 165142 - protein, 10 aa, Artificial Sequence
  Description of Artificial Sequence: Synthetic peptide
  Seed: KASEKIFYVY (SSX2_HUMAN)
KQSEKIFYVY

SEQ ID NO: 165143 - protein, 9 aa, Artificial Sequence
  Description of Artificial Sequence: Synthetic peptide
  Seed: RKYEAMTKL (SSX2_HUMAN)
RYYEAMTKM

SEQ ID NO: 165144 - protein, 9 aa, Artificial Sequence
  Description of Artificial Sequence: Synthetic peptide
  Seed: RKYEAMTKL (SSX2_HUMAN)
RSYEAMTKV

SEQ ID NO: 165145 - protein, 9 aa, Artificial Sequence
  Description of Artificial Sequence: Synthetic peptide
  Seed: TKLGFKATL (SSX2_HUMAN)
TYLGFKATF

SEQ ID NO: 165146 - protein, 9 aa, Artificial Sequence
  Description of Artificial Sequence: Synthetic peptide
  Seed: MNGDDAFAR (SSX2_HUMAN)
MIGDDAFAR

SEQ ID NO: 165147 - protein, 9 aa, Artificial Sequence
  Description of Artificial Sequence: Synthetic peptide
  Seed: TTSEKIHER (SSX2_HUMAN)
TYSEKIHEF

SEQ ID NO: 165148 - protein, 9 aa, Artificial Sequence
  Description of Artificial Sequence: Synthetic peptide
  Seed: RLQGISPKI (SSX2_HUMAN)
RMQGISPKR

SEQ ID NO: 165149 - protein, 9 aa, Artificial Sequence
  Description of Artificial Sequence: Synthetic peptide
  Seed: EKMKASEKI (SSX2_HUMAN)
EHMKASEKV

SEQ ID NO: 165150 - protein, 9 aa, Artificial Sequence
  Description of Artificial Sequence: Synthetic peptide
  Seed: YMKRKYEAM (SSX2_HUMAN)
YLKRKYEAC

SEQ ID NO: 165151 - protein, 9 aa, Artificial Sequence
  Description of Artificial Sequence: Synthetic peptide
  Seed: MTFGRLQGI (SSX2_HUMAN)
MPFGRLQGI

SEQ ID NO: 165152 - protein, 9 aa, Artificial Sequence
  Description of Artificial Sequence: Synthetic peptide
  Seed: GPKRGEHAW (SSX2_HUMAN)
GSKRGEHAW

SEQ ID NO: 165153 - protein, 10 aa, Artificial Sequence
  Description of Artificial Sequence: Synthetic peptide
  Seed: MKASEKIFYV (SSX2_HUMAN)
MPASEKIFYI

SEQ ID NO: 165154 - protein, 9 aa, Artificial Sequence
  Description of Artificial Sequence: Synthetic peptide
  Seed: MKASEKIFY (SSX2_HUMAN)
MQASEKIFF

SEQ ID NO: 165155 - protein, 10 aa, Artificial Sequence
  Description of Artificial Sequence: Synthetic peptide
  Seed: SPKIMPKKPA (SSX2_HUMAN)
SPKIMPKKPL

SEQ ID NO: 165156 - protein, 9 aa, Artificial Sequence
  Description of Artificial Sequence: Synthetic peptide
  Seed: ERPQMTFGR (SSX2_HUMAN)
ELPQMTFGR

SEQ ID NO: 165157 - protein, 10 aa, Artificial Sequence
  Description of Artificial Sequence: Synthetic peptide
  Seed: KAFDDIAKYF (SSX2_HUMAN)
KPFDDIAKYW

SEQ ID NO: 165158 - protein, 11 aa, Artificial Sequence
  Description of Artificial Sequence: Synthetic peptide
  Seed: YVYMKRKYEAM (SSX2_HUMAN)
YSYMKRKYEAL

SEQ ID NO: 165159 - protein, 9 aa, Artificial Sequence
  Description of Artificial Sequence: Synthetic peptide
  Seed: YFSKEEWEK (SSX2_HUMAN)
YASKEEWEY

SEQ ID NO: 165160 - protein, 9 aa, Artificial Sequence
  Description of Artificial Sequence: Synthetic peptide
  Seed: TTSEKIHER (SSX2_HUMAN)
TFSEKIHEM

SEQ ID NO: 165161 - protein, 8 aa, Artificial Sequence
  Description of Artificial Sequence: Synthetic peptide
  Seed: KIFYVYMK (SSX2_HUMAN)
KQFYVYMR

SEQ ID NO: 165162 - protein, 9 aa, Artificial Sequence
  Description of Artificial Sequence: Synthetic peptide
  Seed: KAFDDIAKY (SSX2_HUMAN)
KVFDDIAKV

SEQ ID NO: 165163 - protein, 9 aa, Artificial Sequence
  Description of Artificial Sequence: Synthetic peptide
  Seed: AFDDIAKYF (SSX2_HUMAN)
AIDDIAKYL

SEQ ID NO: 165164 - protein, 9 aa, Artificial Sequence
  Description of Artificial Sequence: Synthetic peptide
  Seed: DAFARRPTV (SSX2_HUMAN)
DPFARRPTM

SEQ ID NO: 165165 - protein, 11 aa, Artificial Sequence
  Description of Artificial Sequence: Synthetic peptide
  Seed: YVYMKRKYEAM (SSX2_HUMAN)
YCYMKRKYEAL

SEQ ID NO: 165166 - protein, 9 aa, Artificial Sequence
  Description of Artificial Sequence: Synthetic peptide
  Seed: RERKQLVIY (SSX2_HUMAN)
RERKQLVII

SEQ ID NO: 165167 - protein, 9 aa, Artificial Sequence
  Description of Artificial Sequence: Synthetic peptide
  Seed: MTFGRLQGI (SSX2_HUMAN)
MMFGRLQGF

SEQ ID NO: 165168 - protein, 9 aa, Artificial Sequence
  Description of Artificial Sequence: Synthetic peptide
  Seed: YEAMTKLGF (SSX2_HUMAN)
YSAMTKLGF

SEQ ID NO: 165169 - protein, 9 aa, Artificial Sequence
  Description of Artificial Sequence: Synthetic peptide
  Seed: KASEKIFYV (SSX2_HUMAN)
KLSEKIFYL

SEQ ID NO: 165170 - protein, 11 aa, Artificial Sequence
  Description of Artificial Sequence: Synthetic peptide
  Seed: FGRLQGISPKI (SSX2_HUMAN)
FCRLQGISPKL

SEQ ID NO: 165171 - protein, 9 aa, Artificial Sequence
  Description of Artificial Sequence: Synthetic peptide
  Seed: TTSEKIHER (SSX2_HUMAN)
TGSEKIHEY

SEQ ID NO: 165172 - protein, 10 aa, Artificial Sequence
  Description of Artificial Sequence: Synthetic peptide
  Seed: MTKLGFKATL (SSX2_HUMAN)
MLKLGFKATL

SEQ ID NO: 165173 - protein, 9 aa, Artificial Sequence
  Description of Artificial Sequence: Synthetic peptide
  Seed: RKYEAMTKL (SSX2_HUMAN)
RVYEAMTKM

SEQ ID NO: 165174 - protein, 9 aa, Artificial Sequence
  Description of Artificial Sequence: Synthetic peptide
  Seed: RSGPKRGEH (SSX2_HUMAN)
RAGPKRGEY

SEQ ID NO: 165175 - protein, 10 aa, Artificial Sequence
  Description of Artificial Sequence: Synthetic peptide
  Seed: ATLPPFMCNK (SSX2_HUMAN)
AFLPPFMCNR

SEQ ID NO: 165176 - protein, 9 aa, Artificial Sequence
  Description of Artificial Sequence: Synthetic peptide
  Seed: AFDDIAKYF (SSX2_HUMAN)
AQDDIAKYW

SEQ ID NO: 165177 - protein, 9 aa, Artificial Sequence
  Description of Artificial Sequence: Synthetic peptide
  Seed: TTSEKIHER (SSX2_HUMAN)
TMSEKIHER

SEQ ID NO: 165178 - protein, 9 aa, Artificial Sequence
  Description of Artificial Sequence: Synthetic peptide
  Seed: DAFARRPTV (SSX2_HUMAN)
DQFARRPTF

SEQ ID NO: 165179 - protein, 9 aa, Artificial Sequence
  Description of Artificial Sequence: Synthetic peptide
  Seed: AFDDIAKYF (SSX2_HUMAN)
AFDDIAKYY

SEQ ID NO: 165180 - protein, 10 aa, Artificial Sequence
  Description of Artificial Sequence: Synthetic peptide
  Seed: MTKLGFKATL (SSX2_HUMAN)
MCKLGFKATF

SEQ ID NO: 165181 - protein, 9 aa, Artificial Sequence
  Description of Artificial Sequence: Synthetic peptide
  Seed: DAFARRPTV (SSX2_HUMAN)
DMFARRPTI

SEQ ID NO: 165182 - protein, 9 aa, Artificial Sequence
  Description of Artificial Sequence: Synthetic peptide
  Seed: RLQGISPKI (SSX2_HUMAN)
RVQGISPKF

SEQ ID NO: 165183 - protein, 9 aa, Artificial Sequence
  Description of Artificial Sequence: Synthetic peptide
  Seed: QIPEKIQKA (SSX2_HUMAN)
QMPEKIQKA

SEQ ID NO: 165184 - protein, 9 aa, Artificial Sequence
  Description of Artificial Sequence: Synthetic peptide
  Seed: KELCPPGKP (SSX2_HUMAN)
KELCPPGKL

SEQ ID NO: 165185 - protein, 9 aa, Artificial Sequence
  Description of Artificial Sequence: Synthetic peptide
  Seed: RLQGISPKI (SSX2_HUMAN)
RQQGISPKK

SEQ ID NO: 165186 - protein, 9 aa, Artificial Sequence
  Description of Artificial Sequence: Synthetic peptide
  Seed: FSKEEWEKM (SSX2_HUMAN)
FSKEEWEKW

SEQ ID NO: 165187 - protein, 9 aa, Artificial Sequence
  Description of Artificial Sequence: Synthetic peptide
  Seed: TTSEKIHER (SSX2_HUMAN)
TLSEKIHEK

SEQ ID NO: 165188 - protein, 9 aa, Artificial Sequence
  Description of Artificial Sequence: Synthetic peptide
  Seed: KRKYEAMTK (SSX2_HUMAN)
KVKYEAMTA

SEQ ID NO: 165189 - protein, 10 aa, Artificial Sequence
  Description of Artificial Sequence: Synthetic peptide
  Seed: LGFKATLPPF (SSX2_HUMAN)
LMFKATLPPF

SEQ ID NO: 165190 - protein, 8 aa, Artificial Sequence
  Description of Artificial Sequence: Synthetic peptide
  Seed: YMKRKYEA (SSX2_HUMAN)
YAKRKYEV

SEQ ID NO: 165191 - protein, 10 aa, Artificial Sequence
  Description of Artificial Sequence: Synthetic peptide
  Seed: YVYMKRKYEA (SSX2_HUMAN)
YMYMKRKYEI

SEQ ID NO: 165192 - protein, 10 aa, Artificial Sequence
  Description of Artificial Sequence: Synthetic peptide
  Seed: YVYMKRKYEA (SSX2_HUMAN)
YGYMKRKYEL

SEQ ID NO: 165193 - protein, 11 aa, Artificial Sequence
  Description of Artificial Sequence: Synthetic peptide
  Seed: FGRLQGISPKI (SSX2_HUMAN)
FTRLQGISPKV

SEQ ID NO: 165194 - protein, 9 aa, Artificial Sequence
  Description of Artificial Sequence: Synthetic peptide
  Seed: RLQGISPKI (SSX2_HUMAN)
RMQGISPKF

SEQ ID NO: 165195 - protein, 10 aa, Artificial Sequence
  Description of Artificial Sequence: Synthetic peptide
  Seed: YVYMKRKYEA (SSX2_HUMAN)
YPYMKRKYEL

SEQ ID NO: 165196 - protein, 9 aa, Artificial Sequence
  Description of Artificial Sequence: Synthetic peptide
  Seed: MTKLGFKAT (SSX2_HUMAN)
MYKLGFKAK

SEQ ID NO: 165197 - protein, 9 aa, Artificial Sequence
  Description of Artificial Sequence: Synthetic peptide
  Seed: RLQGISPKI (SSX2_HUMAN)
RVQGISPKY

SEQ ID NO: 165198 - protein, 9 aa, Artificial Sequence
  Description of Artificial Sequence: Synthetic peptide
  Seed: KRKYEAMTK (SSX2_HUMAN)
KAKYEAMTV

SEQ ID NO: 165199 - protein, 9 aa, Artificial Sequence
  Description of Artificial Sequence: Synthetic peptide
  Seed: GEHAWTHRL (SSX2_HUMAN)
GEHAWTHRM

SEQ ID NO: 165200 - protein, 9 aa, Artificial Sequence
  Description of Artificial Sequence: Synthetic peptide
  Seed: DDIAKYFSK (SSX2_HUMAN)
DNIAKYFSR

SEQ ID NO: 165201 - protein, 8 aa, Artificial Sequence
  Description of Artificial Sequence: Synthetic peptide
  Seed: AFDDIAKY (SSX2_HUMAN)
ALDDIAKI

SEQ ID NO: 165202 - protein, 11 aa, Artificial Sequence
  Description of Artificial Sequence: Synthetic peptide
  Seed: AQIPEKIQKAF (SSX2_HUMAN)
AMIPEKIQKAY

SEQ ID NO: 165203 - protein, 9 aa, Artificial Sequence
  Description of Artificial Sequence: Synthetic peptide
  Seed: GISPKIMPK (SSX2_HUMAN)
GASPKIMPY

SEQ ID NO: 165204 - protein, 10 aa, Artificial Sequence
  Description of Artificial Sequence: Synthetic peptide
  Seed: QMTFGRLQGI (SSX2_HUMAN)
QMTFGRLQGA

SEQ ID NO: 165205 - protein, 9 aa, Artificial Sequence
  Description of Artificial Sequence: Synthetic peptide
  Seed: NGDDAFARR (SSX2_HUMAN)
NADDAFARL

SEQ ID NO: 165206 - protein, 9 aa, Artificial Sequence
  Description of Artificial Sequence: Synthetic peptide
  Seed: KAFDDIAKY (SSX2_HUMAN)
KMFDDIAKI

SEQ ID NO: 165207 - protein, 9 aa, Artificial Sequence
  Description of Artificial Sequence: Synthetic peptide
  Seed: DAFARRPTV (SSX2_HUMAN)
DEFARRPTL

SEQ ID NO: 165208 - protein, 9 aa, Artificial Sequence
  Description of Artificial Sequence: Synthetic peptide
  Seed: YFSKEEWEK (SSX2_HUMAN)
YMSKEEWEY

SEQ ID NO: 165209 - protein, 9 aa, Artificial Sequence
  Description of Artificial Sequence: Synthetic peptide
  Seed: KASEKIFYV (SSX2_HUMAN)
KISEKIFYA

SEQ ID NO: 165210 - protein, 9 aa, Artificial Sequence
  Description of Artificial Sequence: Synthetic peptide
  Seed: KASEKIFYV (SSX2_HUMAN)
KMSEKIFYV

SEQ ID NO: 165211 - protein, 9 aa, Artificial Sequence
  Description of Artificial Sequence: Synthetic peptide
  Seed: KRKYEAMTK (SSX2_HUMAN)
KYKYEAMTK

SEQ ID NO: 165212 - protein, 10 aa, Artificial Sequence
  Description of Artificial Sequence: Synthetic peptide
  Seed: MKASEKIFYV (SSX2_HUMAN)
MDASEKIFYI

SEQ ID NO: 165213 - protein, 10 aa, Artificial Sequence
  Description of Artificial Sequence: Synthetic peptide
  Seed: AQIPEKIQKA (SSX2_HUMAN)
AVIPEKIQKL

SEQ ID NO: 165214 - protein, 9 aa, Artificial Sequence
  Description of Artificial Sequence: Synthetic peptide
  Seed: YMKRKYEAM (SSX2_HUMAN)
YMKRKYEAT

SEQ ID NO: 165215 - protein, 9 aa, Artificial Sequence
  Description of Artificial Sequence: Synthetic peptide
  Seed: GFKATLPPF (SSX2_HUMAN)
GYKATLPPI

SEQ ID NO: 165216 - protein, 8 aa, Artificial Sequence
  Description of Artificial Sequence: Synthetic peptide
  Seed: AFDDIAKY (SSX2_HUMAN)
AYDDIAKI

SEQ ID NO: 165217 - protein, 10 aa, Artificial Sequence
  Description of Artificial Sequence: Synthetic peptide
  Seed: MKASEKIFYV (SSX2_HUMAN)
MWASEKIFYV

SEQ ID NO: 165218 - protein, 9 aa, Artificial Sequence
  Description of Artificial Sequence: Synthetic peptide
  Seed: GISPKIMPK (SSX2_HUMAN)
GQSPKIMPK

SEQ ID NO: 165219 - protein, 9 aa, Artificial Sequence
  Description of Artificial Sequence: Synthetic peptide
  Seed: FARRPTVGA (SSX2_HUMAN)
FPRRPTVGL

SEQ ID NO: 165220 - protein, 9 aa, Artificial Sequence
  Description of Artificial Sequence: Synthetic peptide
  Seed: MTFGRLQGI (SSX2_HUMAN)
MAFGRLQGH

SEQ ID NO: 165221 - protein, 9 aa, Artificial Sequence
  Description of Artificial Sequence: Synthetic peptide
  Seed: FARRPTVGA (SSX2_HUMAN)
FPRRPTVGC

SEQ ID NO: 165222 - protein, 10 aa, Artificial Sequence
  Description of Artificial Sequence: Synthetic peptide
  Seed: KAFDDIAKYF (SSX2_HUMAN)
KQFDDIAKYM

SEQ ID NO: 165223 - protein, 9 aa, Artificial Sequence
  Description of Artificial Sequence: Synthetic peptide
  Seed: KRKYEAMTK (SSX2_HUMAN)
KRKYEAMTF

SEQ ID NO: 165224 - protein, 10 aa, Artificial Sequence
  Description of Artificial Sequence: Synthetic peptide
  Seed: KAFDDIAKYF (SSX2_HUMAN)
KVFDDIAKYL

SEQ ID NO: 165225 - protein, 10 aa, Artificial Sequence
  Description of Artificial Sequence: Synthetic peptide
  Seed: AEEGNDSEEV (SSX2_HUMAN)
AEEGNDSEEW

SEQ ID NO: 165226 - protein, 9 aa, Artificial Sequence
  Description of Artificial Sequence: Synthetic peptide
  Seed: EAMTKLGFK (SSX2_HUMAN)
EIMTKLGFY

SEQ ID NO: 165227 - protein, 9 aa, Artificial Sequence
  Description of Artificial Sequence: Synthetic peptide
  Seed: TLPPFMCNK (SSX2_HUMAN)
TFPPFMCNR

SEQ ID NO: 165228 - protein, 9 aa, Artificial Sequence
  Description of Artificial Sequence: Synthetic peptide
  Seed: RERKQLVIY (SSX2_HUMAN)
RERKQLVIM

SEQ ID NO: 165229 - protein, 9 aa, Artificial Sequence
  Description of Artificial Sequence: Synthetic peptide
  Seed: YMKRKYEAM (SSX2_HUMAN)
YMKRKYEAF

SEQ ID NO: 165230 - protein, 9 aa, Artificial Sequence
  Description of Artificial Sequence: Synthetic peptide
  Seed: CPPGKPTTS (SSX2_HUMAN)
CPPGKPTTV

SEQ ID NO: 165231 - protein, 11 aa, Artificial Sequence
  Description of Artificial Sequence: Synthetic peptide
  Seed: YVYMKRKYEAM (SSX2_HUMAN)
YLYMKRKYEAM

SEQ ID NO: 165232 - protein, 11 aa, Artificial Sequence
  Description of Artificial Sequence: Synthetic peptide
  Seed: KLGFKATLPPF (SSX2_HUMAN)
KYGFKATLPPF

SEQ ID NO: 165233 - protein, 8 aa, Artificial Sequence
  Description of Artificial Sequence: Synthetic peptide
  Seed: KIFYVYMK (SSX2_HUMAN)
KMFYVYMR

SEQ ID NO: 165234 - protein, 10 aa, Artificial Sequence
  Description of Artificial Sequence: Synthetic peptide
  Seed: MTKLGFKATL (SSX2_HUMAN)
MVKLGFKATF

SEQ ID NO: 165235 - protein, 9 aa, Artificial Sequence
  Description of Artificial Sequence: Synthetic peptide
  Seed: KMKASEKIF (SSX2_HUMAN)
KAKASEKIY

SEQ ID NO: 165236 - protein, 9 aa, Artificial Sequence
  Description of Artificial Sequence: Synthetic peptide
  Seed: KAFDDIAKY (SSX2_HUMAN)
KTFDDIAKW

SEQ ID NO: 165237 - protein, 9 aa, Artificial Sequence
  Description of Artificial Sequence: Synthetic peptide
  Seed: RLQGISPKI (SSX2_HUMAN)
RAQGISPKW

SEQ ID NO: 165238 - protein, 10 aa, Artificial Sequence
  Description of Artificial Sequence: Synthetic peptide
  Seed: KASEKIFYVY (SSX2_HUMAN)
KYSEKIFYVW

SEQ ID NO: 165239 - protein, 8 aa, Artificial Sequence
  Description of Artificial Sequence: Synthetic peptide
  Seed: YMKRKYEA (SSX2_HUMAN)
YIKRKYEM

SEQ ID NO: 165240 - protein, 10 aa, Artificial Sequence
  Description of Artificial Sequence: Synthetic peptide
  Seed: GRLQGISPKI (SSX2_HUMAN)
GMLQGISPKV

SEQ ID NO: 165241 - protein, 9 aa, Artificial Sequence
  Description of Artificial Sequence: Synthetic peptide
  Seed: FSKEEWEKM (SSX2_HUMAN)
FAKEEWEKY

SEQ ID NO: 165242 - protein, 9 aa, Artificial Sequence
  Description of Artificial Sequence: Synthetic peptide
  Seed: KASEKIFYV (SSX2_HUMAN)
KLSEKIFYI

SEQ ID NO: 165243 - protein, 9 aa, Artificial Sequence
  Description of Artificial Sequence: Synthetic peptide
  Seed: KIHERSGPK (SSX2_HUMAN)
KTHERSGPM

SEQ ID NO: 165244 - protein, 9 aa, Artificial Sequence
  Description of Artificial Sequence: Synthetic peptide
  Seed: KASEKIFYV (SSX2_HUMAN)
KTSEKIFYC

SEQ ID NO: 165245 - protein, 10 aa, Artificial Sequence
  Description of Artificial Sequence: Synthetic peptide
  Seed: KYEAMTKLGF (SSX2_HUMAN)
KEEAMTKLGW

SEQ ID NO: 165246 - protein, 10 aa, Artificial Sequence
  Description of Artificial Sequence: Synthetic peptide
  Seed: VYMKRKYEAM (SSX2_HUMAN)
VLMKRKYEAI

SEQ ID NO: 165247 - protein, 9 aa, Artificial Sequence
  Description of Artificial Sequence: Synthetic peptide
  Seed: ASEKIFYVY (SSX2_HUMAN)
AYEKIFYVY

SEQ ID NO: 165248 - protein, 9 aa, Artificial Sequence
  Description of Artificial Sequence: Synthetic peptide
  Seed: KQLVIYEEI (SSX2_HUMAN)
KILVIYEEF

SEQ ID NO: 165249 - protein, 9 aa, Artificial Sequence
  Description of Artificial Sequence: Synthetic peptide
  Seed: DAFARRPTV (SSX2_HUMAN)
DGFARRPTI

SEQ ID NO: 165250 - protein, 9 aa, Artificial Sequence
  Description of Artificial Sequence: Synthetic peptide
  Seed: RERKQLVIY (SSX2_HUMAN)
RERKQLVIF

SEQ ID NO: 165251 - protein, 9 aa, Artificial Sequence
  Description of Artificial Sequence: Synthetic peptide
  Seed: RPTVGAQIP (SSX2_HUMAN)
RPTVGAQIL

SEQ ID NO: 165252 - protein, 10 aa, Artificial Sequence
  Description of Artificial Sequence: Synthetic peptide
  Seed: EKIFYVYMKR (SSX2_HUMAN)
EWIFYVYMKK

SEQ ID NO: 165253 - protein, 9 aa, Artificial Sequence
  Description of Artificial Sequence: Synthetic peptide
  Seed: AEDFQGNDL (SSX2_HUMAN)
AMDFQGNDL

SEQ ID NO: 165254 - protein, 9 aa, Artificial Sequence
  Description of Artificial Sequence: Synthetic peptide
  Seed: FARRPTVGA (SSX2_HUMAN)
FPRRPTVGM

SEQ ID NO: 165255 - protein, 10 aa, Artificial Sequence
  Description of Artificial Sequence: Synthetic peptide
  Seed: MKASEKIFYV (SSX2_HUMAN)
MLASEKIFYL

SEQ ID NO: 165256 - protein, 8 aa, Artificial Sequence
  Description of Artificial Sequence: Synthetic peptide
  Seed: FKATLPPF (SSX2_HUMAN)
FKATLPPY

SEQ ID NO: 165257 - protein, 9 aa, Artificial Sequence
  Description of Artificial Sequence: Synthetic peptide
  Seed: KASEKIFYV (SSX2_HUMAN)
KYSEKIFYR

SEQ ID NO: 165258 - protein, 11 aa, Artificial Sequence
  Description of Artificial Sequence: Synthetic peptide
  Seed: KMKASEKIFYV (SSX2_HUMAN)
KVKASEKIFYV

SEQ ID NO: 165259 - protein, 10 aa, Artificial Sequence
  Description of Artificial Sequence: Synthetic peptide
  Seed: YVYMKRKYEA (SSX2_HUMAN)
YAYMKRKYEL

SEQ ID NO: 165260 - protein, 9 aa, Artificial Sequence
  Description of Artificial Sequence: Synthetic peptide
  Seed: KQLVIYEEI (SSX2_HUMAN)
KRLVIYEEI

SEQ ID NO: 165261 - protein, 9 aa, Artificial Sequence
  Description of Artificial Sequence: Synthetic peptide
  Seed: KRKYEAMTK (SSX2_HUMAN)
KMKYEAMTI

SEQ ID NO: 165262 - protein, 10 aa, Artificial Sequence
  Description of Artificial Sequence: Synthetic peptide
  Seed: VYMKRKYEAM (SSX2_HUMAN)
VLMKRKYEAV

SEQ ID NO: 165263 - protein, 9 aa, Artificial Sequence
  Description of Artificial Sequence: Synthetic peptide
  Seed: AQIPEKIQK (SSX2_HUMAN)
ARIPEKIQY

SEQ ID NO: 165264 - protein, 9 aa, Artificial Sequence
  Description of Artificial Sequence: Synthetic peptide
  Seed: FARRPTVGA (SSX2_HUMAN)
FARRPTVGF

SEQ ID NO: 165265 - protein, 10 aa, Artificial Sequence
  Description of Artificial Sequence: Synthetic peptide
  Seed: YMKRKYEAMT (SSX2_HUMAN)
YLKRKYEAMC

SEQ ID NO: 165266 - protein, 9 aa, Artificial Sequence
  Description of Artificial Sequence: Synthetic peptide
  Seed: EAMTKLGFK (SSX2_HUMAN)
EGMTKLGFR

SEQ ID NO: 165267 - protein, 9 aa, Artificial Sequence
  Description of Artificial Sequence: Synthetic peptide
  Seed: TLPPFMCNK (SSX2_HUMAN)
TIPPFMCNK

SEQ ID NO: 165268 - protein, 8 aa, Artificial Sequence
  Description of Artificial Sequence: Synthetic peptide
  Seed: KIFYVYMK (SSX2_HUMAN)
KWFYVYMR

SEQ ID NO: 165269 - protein, 10 aa, Artificial Sequence
  Description of Artificial Sequence: Synthetic peptide
  Seed: YVYMKRKYEA (SSX2_HUMAN)
YNYMKRKYEL

SEQ ID NO: 165270 - protein, 10 aa, Artificial Sequence
  Description of Artificial Sequence: Synthetic peptide
  Seed: QGISPKIMPK (SSX2_HUMAN)
QFISPKIMPR

SEQ ID NO: 165271 - protein, 9 aa, Artificial Sequence
  Description of Artificial Sequence: Synthetic peptide
  Seed: TTSEKIHER (SSX2_HUMAN)
TSSEKIHEL

SEQ ID NO: 165272 - protein, 9 aa, Artificial Sequence
  Description of Artificial Sequence: Synthetic peptide
  Seed: RERKQLVIY (SSX2_HUMAN)
RLRKQLVIY

SEQ ID NO: 165273 - protein, 10 aa, Artificial Sequence
  Description of Artificial Sequence: Synthetic peptide
  Seed: EKIFYVYMKR (SSX2_HUMAN)
EGIFYVYMKK

SEQ ID NO: 165274 - protein, 9 aa, Artificial Sequence
  Description of Artificial Sequence: Synthetic peptide
  Seed: KIFYVYMKR (SSX2_HUMAN)
KSFYVYMKK

SEQ ID NO: 165275 - protein, 10 aa, Artificial Sequence
  Description of Artificial Sequence: Synthetic peptide
  Seed: LGFKATLPPF (SSX2_HUMAN)
LEFKATLPPF

SEQ ID NO: 165276 - protein, 9 aa, Artificial Sequence
  Description of Artificial Sequence: Synthetic peptide
  Seed: RLRERKQLV (SSX2_HUMAN)
RIRERKQLW

SEQ ID NO: 165277 - protein, 9 aa, Artificial Sequence
  Description of Artificial Sequence: Synthetic peptide
  Seed: KRKYEAMTK (SSX2_HUMAN)
KIKYEAMTA

SEQ ID NO: 165278 - protein, 9 aa, Artificial Sequence
  Description of Artificial Sequence: Synthetic peptide
  Seed: GPKRGEHAW (SSX2_HUMAN)
GPKRGEHAF

SEQ ID NO: 165279 - protein, 9 aa, Artificial Sequence
  Description of Artificial Sequence: Synthetic peptide
  Seed: KQLVIYEEI (SSX2_HUMAN)
KALVIYEEF

SEQ ID NO: 165280 - protein, 8 aa, Artificial Sequence
  Description of Artificial Sequence: Synthetic peptide
  Seed: FKATLPPF (SSX2_HUMAN)
FMATLPPF

SEQ ID NO: 165281 - protein, 9 aa, Artificial Sequence
  Description of Artificial Sequence: Synthetic peptide
  Seed: KQLVIYEEI (SSX2_HUMAN)
KDLVIYEEF

SEQ ID NO: 165282 - protein, 9 aa, Artificial Sequence
  Description of Artificial Sequence: Synthetic peptide
  Seed: FARRPTVGA (SSX2_HUMAN)
FSRRPTVGY

SEQ ID NO: 165283 - protein, 9 aa, Artificial Sequence
  Description of Artificial Sequence: Synthetic peptide
  Seed: NGDDAFARR (SSX2_HUMAN)
NVDDAFARR

SEQ ID NO: 165284 - protein, 10 aa, Artificial Sequence
  Description of Artificial Sequence: Synthetic peptide
  Seed: EKIFYVYMKR (SSX2_HUMAN)
EYIFYVYMKK

SEQ ID NO: 165285 - protein, 9 aa, Artificial Sequence
  Description of Artificial Sequence: Synthetic peptide
  Seed: EVPEASGPQ (SSX2_HUMAN)
ESPEASGPR

SEQ ID NO: 165286 - protein, 9 aa, Artificial Sequence
  Description of Artificial Sequence: Synthetic peptide
  Seed: KIHERSGPK (SSX2_HUMAN)
KTHERSGPK

SEQ ID NO: 165287 - protein, 9 aa, Artificial Sequence
  Description of Artificial Sequence: Synthetic peptide
  Seed: AMTKLGFKA (SSX2_HUMAN)
AQTKLGFKV

SEQ ID NO: 165288 - protein, 9 aa, Artificial Sequence
  Description of Artificial Sequence: Synthetic peptide
  Seed: RLRERKQLV (SSX2_HUMAN)
RVRERKQLR

SEQ ID NO: 165289 - protein, 9 aa, Artificial Sequence
  Description of Artificial Sequence: Synthetic peptide
  Seed: RKYEAMTKL (SSX2_HUMAN)
REYEAMTKL

SEQ ID NO: 165290 - protein, 9 aa, Artificial Sequence
  Description of Artificial Sequence: Synthetic peptide
  Seed: VGAQIPEKI (SSX2_HUMAN)
VSAQIPEKY

SEQ ID NO: 165291 - protein, 9 aa, Artificial Sequence
  Description of Artificial Sequence: Synthetic peptide
  Seed: KAFDDIAKY (SSX2_HUMAN)
KGFDDIAKV

SEQ ID NO: 165292 - protein, 10 aa, Artificial Sequence
  Description of Artificial Sequence: Synthetic peptide
  Seed: YEAMTKLGFK (SSX2_HUMAN)
YIAMTKLGFK

SEQ ID NO: 165293 - protein, 11 aa, Artificial Sequence
  Description of Artificial Sequence: Synthetic peptide
  Seed: YMKRKYEAMTK (SSX2_HUMAN)
YMKRKYEAMTI

SEQ ID NO: 165294 - protein, 9 aa, Artificial Sequence
  Description of Artificial Sequence: Synthetic peptide
  Seed: TVGAQIPEK (SSX2_HUMAN)
TSGAQIPEL

SEQ ID NO: 165295 - protein, 9 aa, Artificial Sequence
  Description of Artificial Sequence: Synthetic peptide
  Seed: TVGAQIPEK (SSX2_HUMAN)
TTGAQIPER

SEQ ID NO: 165296 - protein, 10 aa, Artificial Sequence
  Description of Artificial Sequence: Synthetic peptide
  Seed: KMKASEKIFY (SSX2_HUMAN)
KTKASEKIFY

SEQ ID NO: 165297 - protein, 9 aa, Artificial Sequence
  Description of Artificial Sequence: Synthetic peptide
  Seed: EHAWTHRLR (SSX2_HUMAN)
EVAWTHRLR

SEQ ID NO: 165298 - protein, 10 aa, Artificial Sequence
  Description of Artificial Sequence: Synthetic peptide
  Seed: GISPKIMPKK (SSX2_HUMAN)
GVSPKIMPKK

SEQ ID NO: 165299 - protein, 9 aa, Artificial Sequence
  Description of Artificial Sequence: Synthetic peptide
  Seed: AEDFQGNDL (SSX2_HUMAN)
ASDFQGNDL

SEQ ID NO: 165300 - protein, 9 aa, Artificial Sequence
  Description of Artificial Sequence: Synthetic peptide
  Seed: DAFARRPTV (SSX2_HUMAN)
DSFARRPTV

SEQ ID NO: 165301 - protein, 9 aa, Artificial Sequence
  Description of Artificial Sequence: Synthetic peptide
  Seed: YMKRKYEAM (SSX2_HUMAN)
YPKRKYEAF

SEQ ID NO: 165302 - protein, 9 aa, Artificial Sequence
  Description of Artificial Sequence: Synthetic peptide
  Seed: FSKEEWEKM (SSX2_HUMAN)
FQKEEWEKY

SEQ ID NO: 165303 - protein, 9 aa, Artificial Sequence
  Description of Artificial Sequence: Synthetic peptide
  Seed: KRGEHAWTH (SSX2_HUMAN)
KRGEHAWTI

SEQ ID NO: 165304 - protein, 9 aa, Artificial Sequence
  Description of Artificial Sequence: Synthetic peptide
  Seed: GFKATLPPF (SSX2_HUMAN)
GMKATLPPF

SEQ ID NO: 165305 - protein, 10 aa, Artificial Sequence
  Description of Artificial Sequence: Synthetic peptide
  Seed: KASEKIFYVY (SSX2_HUMAN)
KVSEKIFYVY

SEQ ID NO: 165306 - protein, 10 aa, Artificial Sequence
  Description of Artificial Sequence: Synthetic peptide
  Seed: KASEKIFYVY (SSX2_HUMAN)
KLSEKIFYVF

SEQ ID NO: 165307 - protein, 11 aa, Artificial Sequence
  Description of Artificial Sequence: Synthetic peptide
  Seed: FGRLQGISPKI (SSX2_HUMAN)
FCRLQGISPKV

SEQ ID NO: 165308 - protein, 10 aa, Artificial Sequence
  Description of Artificial Sequence: Synthetic peptide
  Seed: ASEKIFYVYM (SSX2_HUMAN)
ATEKIFYVYK

SEQ ID NO: 165309 - protein, 9 aa, Artificial Sequence
  Description of Artificial Sequence: Synthetic peptide
  Seed: YEAMTKLGF (SSX2_HUMAN)
YEAMTKLGY

SEQ ID NO: 165310 - protein, 9 aa, Artificial Sequence
  Description of Artificial Sequence: Synthetic peptide
  Seed: KAFDDIAKY (SSX2_HUMAN)
KLFDDIAKM

SEQ ID NO: 165311 - protein, 9 aa, Artificial Sequence
  Description of Artificial Sequence: Synthetic peptide
  Seed: LQGISPKIM (SSX2_HUMAN)
LQGISPKIF

SEQ ID NO: 165312 - protein, 8 aa, Artificial Sequence
  Description of Artificial Sequence: Synthetic peptide
  Seed: FDDIAKYF (SSX2_HUMAN)
FYDIAKYM

SEQ ID NO: 165313 - protein, 9 aa, Artificial Sequence
  Description of Artificial Sequence: Synthetic peptide
  Seed: AFDDIAKYF (SSX2_HUMAN)
AQDDIAKYM

SEQ ID NO: 165314 - protein, 9 aa, Artificial Sequence
  Description of Artificial Sequence: Synthetic peptide
  Seed: FARRPTVGA (SSX2_HUMAN)
FPRRPTVGS

SEQ ID NO: 165315 - protein, 9 aa, Artificial Sequence
  Description of Artificial Sequence: Synthetic peptide
  Seed: RRPTVGAQI (SSX2_HUMAN)
RRPTVGAQF

SEQ ID NO: 165316 - protein, 8 aa, Artificial Sequence
  Description of Artificial Sequence: Synthetic peptide
  Seed: YMKRKYEA (SSX2_HUMAN)
YAKRKYEL

SEQ ID NO: 165317 - protein, 10 aa, Artificial Sequence
  Description of Artificial Sequence: Synthetic peptide
  Seed: YEAMTKLGFK (SSX2_HUMAN)
YYAMTKLGFR

SEQ ID NO: 165318 - protein, 9 aa, Artificial Sequence
  Description of Artificial Sequence: Synthetic peptide
  Seed: MKASEKIFY (SSX2_HUMAN)
MMASEKIFF

SEQ ID NO: 165319 - protein, 10 aa, Artificial Sequence
  Description of Artificial Sequence: Synthetic peptide
  Seed: YMKRKYEAMT (SSX2_HUMAN)
YLKRKYEAMV

SEQ ID NO: 165320 - protein, 10 aa, Artificial Sequence
  Description of Artificial Sequence: Synthetic peptide
  Seed: YMKRKYEAMT (SSX2_HUMAN)
YMKRKYEAMY

SEQ ID NO: 165321 - protein, 10 aa, Artificial Sequence
  Description of Artificial Sequence: Synthetic peptide
  Seed: AQIPEKIQKA (SSX2_HUMAN)
AQIPEKIQKI

SEQ ID NO: 165322 - protein, 10 aa, Artificial Sequence
  Description of Artificial Sequence: Synthetic peptide
  Seed: EKIFYVYMKR (SSX2_HUMAN)
ESIFYVYMKR

SEQ ID NO: 165323 - protein, 9 aa, Artificial Sequence
  Description of Artificial Sequence: Synthetic peptide
  Seed: KRGEHAWTH (SSX2_HUMAN)
KRGEHAWTV

SEQ ID NO: 165324 - protein, 11 aa, Artificial Sequence
  Description of Artificial Sequence: Synthetic peptide
  Seed: FGRLQGISPKI (SSX2_HUMAN)
FGRLQGISPKL

SEQ ID NO: 165325 - protein, 10 aa, Artificial Sequence
  Description of Artificial Sequence: Synthetic peptide
  Seed: MKASEKIFYV (SSX2_HUMAN)
MNASEKIFYI

SEQ ID NO: 165326 - protein, 10 aa, Artificial Sequence
  Description of Artificial Sequence: Synthetic peptide
  Seed: MKRKYEAMTK (SSX2_HUMAN)
MYRKYEAMTK

SEQ ID NO: 165327 - protein, 11 aa, Artificial Sequence
  Description of Artificial Sequence: Synthetic peptide
  Seed: RKYEAMTKLGF (SSX2_HUMAN)
RYYEAMTKLGW

SEQ ID NO: 165328 - protein, 9 aa, Artificial Sequence
  Description of Artificial Sequence: Synthetic peptide
  Seed: KASEKIFYV (SSX2_HUMAN)
KASEKIFYI

SEQ ID NO: 165329 - protein, 8 aa, Artificial Sequence
  Description of Artificial Sequence: Synthetic peptide
  Seed: YMKRKYEA (SSX2_HUMAN)
YMKRKYEL

SEQ ID NO: 165330 - protein, 9 aa, Artificial Sequence
  Description of Artificial Sequence: Synthetic peptide
  Seed: AQIPEKIQK (SSX2_HUMAN)
AKIPEKIQY

SEQ ID NO: 165331 - protein, 9 aa, Artificial Sequence
  Description of Artificial Sequence: Synthetic peptide
  Seed: QIPEKIQKA (SSX2_HUMAN)
QAPEKIQKI

SEQ ID NO: 165332 - protein, 10 aa, Artificial Sequence
  Description of Artificial Sequence: Synthetic peptide
  Seed: YMKRKYEAMT (SSX2_HUMAN)
YMKRKYEAMQ

SEQ ID NO: 165333 - protein, 11 aa, Artificial Sequence
  Description of Artificial Sequence: Synthetic peptide
  Seed: RGEHAWTHRLR (SSX2_HUMAN)
RMEHAWTHRLR

SEQ ID NO: 165334 - protein, 11 aa, Artificial Sequence
  Description of Artificial Sequence: Synthetic peptide
  Seed: YVYMKRKYEAM (SSX2_HUMAN)
YKYMKRKYEAL

SEQ ID NO: 165335 - protein, 10 aa, Artificial Sequence
  Description of Artificial Sequence: Synthetic peptide
  Seed: GISPKIMPKK (SSX2_HUMAN)
GLSPKIMPKK

SEQ ID NO: 165336 - protein, 10 aa, Artificial Sequence
  Description of Artificial Sequence: Synthetic peptide
  Seed: GISPKIMPKK (SSX2_HUMAN)
GTSPKIMPKK

SEQ ID NO: 165337 - protein, 10 aa, Artificial Sequence
  Description of Artificial Sequence: Synthetic peptide
  Seed: MKASEKIFYV (SSX2_HUMAN)
MVASEKIFYV

SEQ ID NO: 165338 - protein, 10 aa, Artificial Sequence
  Description of Artificial Sequence: Synthetic peptide
  Seed: YVYMKRKYEA (SSX2_HUMAN)
YLYMKRKYEA

SEQ ID NO: 165339 - protein, 9 aa, Artificial Sequence
  Description of Artificial Sequence: Synthetic peptide
  Seed: KQLVIYEEI (SSX2_HUMAN)
KMLVIYEEV

SEQ ID NO: 165340 - protein, 10 aa, Artificial Sequence
  Description of Artificial Sequence: Synthetic peptide
  Seed: RLQGISPKIM (SSX2_HUMAN)
RQQGISPKIM

SEQ ID NO: 165341 - protein, 9 aa, Artificial Sequence
  Description of Artificial Sequence: Synthetic peptide
  Seed: YEAMTKLGF (SSX2_HUMAN)
YQAMTKLGW

SEQ ID NO: 165342 - protein, 10 aa, Artificial Sequence
  Description of Artificial Sequence: Synthetic peptide
  Seed: KYEAMTKLGF (SSX2_HUMAN)
KTEAMTKLGW

SEQ ID NO: 165343 - protein, 9 aa, Artificial Sequence
  Description of Artificial Sequence: Synthetic peptide
  Seed: RKYEAMTKL (SSX2_HUMAN)
RCYEAMTKY

SEQ ID NO: 165344 - protein, 9 aa, Artificial Sequence
  Description of Artificial Sequence: Synthetic peptide
  Seed: DAFARRPTV (SSX2_HUMAN)
DMFARRPTV

SEQ ID NO: 165345 - protein, 10 aa, Artificial Sequence
  Description of Artificial Sequence: Synthetic peptide
  Seed: YMKRKYEAMT (SSX2_HUMAN)
YMKRKYEAMV

SEQ ID NO: 165346 - protein, 9 aa, Artificial Sequence
  Description of Artificial Sequence: Synthetic peptide
  Seed: AQIPEKIQK (SSX2_HUMAN)
AHIPEKIQY

SEQ ID NO: 165347 - protein, 9 aa, Artificial Sequence
  Description of Artificial Sequence: Synthetic peptide
  Seed: TKLGFKATL (SSX2_HUMAN)
TKLGFKATY

SEQ ID NO: 165348 - protein, 10 aa, Artificial Sequence
  Description of Artificial Sequence: Synthetic peptide
  Seed: KASEKIFYVY (SSX2_HUMAN)
KTSEKIFYVF

SEQ ID NO: 165349 - protein, 9 aa, Artificial Sequence
  Description of Artificial Sequence: Synthetic peptide
  Seed: DDIAKYFSK (SSX2_HUMAN)
DFIAKYFSK

SEQ ID NO: 165350 - protein, 10 aa, Artificial Sequence
  Description of Artificial Sequence: Synthetic peptide
  Seed: KYEAMTKLGF (SSX2_HUMAN)
KHEAMTKLGW

SEQ ID NO: 165351 - protein, 9 aa, Artificial Sequence
  Description of Artificial Sequence: Synthetic peptide
  Seed: YEAMTKLGF (SSX2_HUMAN)
YRAMTKLGY

SEQ ID NO: 165352 - protein, 10 aa, Artificial Sequence
  Description of Artificial Sequence: Synthetic peptide
  Seed: MKASEKIFYV (SSX2_HUMAN)
MPASEKIFYV

SEQ ID NO: 165353 - protein, 9 aa, Artificial Sequence
  Description of Artificial Sequence: Synthetic peptide
  Seed: FARRPTVGA (SSX2_HUMAN)
FARRPTVGL

SEQ ID NO: 165354 - protein, 9 aa, Artificial Sequence
  Description of Artificial Sequence: Synthetic peptide
  Seed: EKMKASEKI (SSX2_HUMAN)
EHMKASEKF

SEQ ID NO: 165355 - protein, 9 aa, Artificial Sequence
  Description of Artificial Sequence: Synthetic peptide
  Seed: KATLPPFMC (SSX2_HUMAN)
KATLPPFMW

SEQ ID NO: 165356 - protein, 9 aa, Artificial Sequence
  Description of Artificial Sequence: Synthetic peptide
  Seed: KAFDDIAKY (SSX2_HUMAN)
KRFDDIAKL

SEQ ID NO: 165357 - protein, 9 aa, Artificial Sequence
  Description of Artificial Sequence: Synthetic peptide
  Seed: NDSEEVPEA (SSX2_HUMAN)
NDSEEVPEF

SEQ ID NO: 165358 - protein, 9 aa, Artificial Sequence
  Description of Artificial Sequence: Synthetic peptide
  Seed: KQLVIYEEI (SSX2_HUMAN)
KLLVIYEEA

SEQ ID NO: 165359 - protein, 9 aa, Artificial Sequence
  Description of Artificial Sequence: Synthetic peptide
  Seed: RLQGISPKI (SSX2_HUMAN)
RSQGISPKY

SEQ ID NO: 165360 - protein, 10 aa, Artificial Sequence
  Description of Artificial Sequence: Synthetic peptide
  Seed: MKASEKIFYV (SSX2_HUMAN)
MIASEKIFYI

SEQ ID NO: 165361 - protein, 9 aa, Artificial Sequence
  Description of Artificial Sequence: Synthetic peptide
  Seed: DAFARRPTV (SSX2_HUMAN)
DSFARRPTR

SEQ ID NO: 165362 - protein, 9 aa, Artificial Sequence
  Description of Artificial Sequence: Synthetic peptide
  Seed: KAFDDIAKY (SSX2_HUMAN)
KSFDDIAKL

SEQ ID NO: 165363 - protein, 10 aa, Artificial Sequence
  Description of Artificial Sequence: Synthetic peptide
  Seed: KMKASEKIFY (SSX2_HUMAN)
KTKASEKIFL

SEQ ID NO: 165364 - protein, 9 aa, Artificial Sequence
  Description of Artificial Sequence: Synthetic peptide
  Seed: EHAWTHRLR (SSX2_HUMAN)
EIAWTHRLR

SEQ ID NO: 165365 - protein, 9 aa, Artificial Sequence
  Description of Artificial Sequence: Synthetic peptide
  Seed: KRKYEAMTK (SSX2_HUMAN)
KTKYEAMTS

SEQ ID NO: 165366 - protein, 11 aa, Artificial Sequence
  Description of Artificial Sequence: Synthetic peptide
  Seed: KYFSKEEWEKM (SSX2_HUMAN)
KYFSKEEWEKW

SEQ ID NO: 165367 - protein, 9 aa, Artificial Sequence
  Description of Artificial Sequence: Synthetic peptide
  Seed: MTKLGFKAT (SSX2_HUMAN)
MSKLGFKAK

SEQ ID NO: 165368 - protein, 9 aa, Artificial Sequence
  Description of Artificial Sequence: Synthetic peptide
  Seed: TTSEKIHER (SSX2_HUMAN)
TNSEKIHER

SEQ ID NO: 165369 - protein, 10 aa, Artificial Sequence
  Description of Artificial Sequence: Synthetic peptide
  Seed: QMTFGRLQGI (SSX2_HUMAN)
QNTFGRLQGV

SEQ ID NO: 165370 - protein, 9 aa, Artificial Sequence
  Description of Artificial Sequence: Synthetic peptide
  Seed: AEDFQGNDL (SSX2_HUMAN)
AVDFQGNDL

SEQ ID NO: 165371 - protein, 9 aa, Artificial Sequence
  Description of Artificial Sequence: Synthetic peptide
  Seed: YMKRKYEAM (SSX2_HUMAN)
YGKRKYEAM

SEQ ID NO: 165372 - protein, 9 aa, Artificial Sequence
  Description of Artificial Sequence: Synthetic peptide
  Seed: AMTKLGFKA (SSX2_HUMAN)
AQTKLGFKL

SEQ ID NO: 165373 - protein, 8 aa, Artificial Sequence
  Description of Artificial Sequence: Synthetic peptide
  Seed: FDDIAKYF (SSX2_HUMAN)
FADIAKYF

SEQ ID NO: 165374 - protein, 8 aa, Artificial Sequence
  Description of Artificial Sequence: Synthetic peptide
  Seed: FDDIAKYF (SSX2_HUMAN)
FADIAKYL

SEQ ID NO: 165375 - protein, 10 aa, Artificial Sequence
  Description of Artificial Sequence: Synthetic peptide
  Seed: AEEGNDSEEV (SSX2_HUMAN)
AEEGNDSEEY

SEQ ID NO: 165376 - protein, 9 aa, Artificial Sequence
  Description of Artificial Sequence: Synthetic peptide
  Seed: AFDDIAKYF (SSX2_HUMAN)
APDDIAKYY

SEQ ID NO: 165377 - protein, 10 aa, Artificial Sequence
  Description of Artificial Sequence: Synthetic peptide
  Seed: MKRKYEAMTK (SSX2_HUMAN)
MGRKYEAMTK

SEQ ID NO: 165378 - protein, 9 aa, Artificial Sequence
  Description of Artificial Sequence: Synthetic peptide
  Seed: RRPTVGAQI (SSX2_HUMAN)
RSPTVGAQL

SEQ ID NO: 165379 - protein, 11 aa, Artificial Sequence
  Description of Artificial Sequence: Synthetic peptide
  Seed: KMKASEKIFYV (SSX2_HUMAN)
KTKASEKIFYA

SEQ ID NO: 165380 - protein, 11 aa, Artificial Sequence
  Description of Artificial Sequence: Synthetic peptide
  Seed: KRAEDFQGNDL (SSX2_HUMAN)
KHAEDFQGNDL

SEQ ID NO: 165381 - protein, 9 aa, Artificial Sequence
  Description of Artificial Sequence: Synthetic peptide
  Seed: AQIPEKIQK (SSX2_HUMAN)
ATIPEKIQR

SEQ ID NO: 165382 - protein, 9 aa, Artificial Sequence
  Description of Artificial Sequence: Synthetic peptide
  Seed: KASEKIFYV (SSX2_HUMAN)
KYSEKIFYM

SEQ ID NO: 165383 - protein, 10 aa, Artificial Sequence
  Description of Artificial Sequence: Synthetic peptide
  Seed: AQIPEKIQKA (SSX2_HUMAN)
AQIPEKIQKM

SEQ ID NO: 165384 - protein, 10 aa, Artificial Sequence
  Description of Artificial Sequence: Synthetic peptide
  Seed: EKIFYVYMKR (SSX2_HUMAN)
EEIFYVYMKR

SEQ ID NO: 165385 - protein, 10 aa, Artificial Sequence
  Description of Artificial Sequence: Synthetic peptide
  Seed: KAFDDIAKYF (SSX2_HUMAN)
KSFDDIAKYY

SEQ ID NO: 165386 - protein, 11 aa, Artificial Sequence
  Description of Artificial Sequence: Synthetic peptide
  Seed: SEKIFYVYMKR (SSX2_HUMAN)
SSKIFYVYMKR

SEQ ID NO: 165387 - protein, 9 aa, Artificial Sequence
  Description of Artificial Sequence: Synthetic peptide
  Seed: RKYEAMTKL (SSX2_HUMAN)
RNYEAMTKF

SEQ ID NO: 165388 - protein, 9 aa, Artificial Sequence
  Description of Artificial Sequence: Synthetic peptide
  Seed: TKLGFKATL (SSX2_HUMAN)
TRLGFKATM

SEQ ID NO: 165389 - protein, 10 aa, Artificial Sequence
  Description of Artificial Sequence: Synthetic peptide
  Seed: KMKASEKIFY (SSX2_HUMAN)
KAKASEKIFK

SEQ ID NO: 165390 - protein, 9 aa, Artificial Sequence
  Description of Artificial Sequence: Synthetic peptide
  Seed: YMKRKYEAM (SSX2_HUMAN)
YMKRKYEAV

SEQ ID NO: 165391 - protein, 8 aa, Artificial Sequence
  Description of Artificial Sequence: Synthetic peptide
  Seed: FDDIAKYF (SSX2_HUMAN)
FDDIAKYL

SEQ ID NO: 165392 - protein, 11 aa, Artificial Sequence
  Description of Artificial Sequence: Synthetic peptide
  Seed: AFDDIAKYFSK (SSX2_HUMAN)
ASDDIAKYFSY

SEQ ID NO: 165393 - protein, 9 aa, Artificial Sequence
  Description of Artificial Sequence: Synthetic peptide
  Seed: KASEKIFYV (SSX2_HUMAN)
KMSEKIFYR

SEQ ID NO: 165394 - protein, 9 aa, Artificial Sequence
  Description of Artificial Sequence: Synthetic peptide
  Seed: KASEKIFYV (SSX2_HUMAN)
KISEKIFYT

SEQ ID NO: 165395 - protein, 10 aa, Artificial Sequence
  Description of Artificial Sequence: Synthetic peptide
  Seed: QGISPKIMPK (SSX2_HUMAN)
QAISPKIMPR

SEQ ID NO: 165396 - protein, 9 aa, Artificial Sequence
  Description of Artificial Sequence: Synthetic peptide
  Seed: RKYEAMTKL (SSX2_HUMAN)
RTYEAMTKV

SEQ ID NO: 165397 - protein, 8 aa, Artificial Sequence
  Description of Artificial Sequence: Synthetic peptide
  Seed: MKRKYEAM (SSX2_HUMAN)
MLRKYEAM

SEQ ID NO: 165398 - protein, 8 aa, Artificial Sequence
  Description of Artificial Sequence: Synthetic peptide
  Seed: AFDDIAKY (SSX2_HUMAN)
AIDDIAKL

SEQ ID NO: 165399 - protein, 9 aa, Artificial Sequence
  Description of Artificial Sequence: Synthetic peptide
  Seed: AFDDIAKYF (SSX2_HUMAN)
AMDDIAKYL

SEQ ID NO: 165400 - protein, 9 aa, Artificial Sequence
  Description of Artificial Sequence: Synthetic peptide
  Seed: DDIAKYFSK (SSX2_HUMAN)
DCIAKYFSR

SEQ ID NO: 165401 - protein, 9 aa, Artificial Sequence
  Description of Artificial Sequence: Synthetic peptide
  Seed: MPKKPAEEG (SSX2_HUMAN)
MPKKPAEEP

SEQ ID NO: 165402 - protein, 10 aa, Artificial Sequence
  Description of Artificial Sequence: Synthetic peptide
  Seed: KMKASEKIFY (SSX2_HUMAN)
KIKASEKIFK

SEQ ID NO: 165403 - protein, 11 aa, Artificial Sequence
  Description of Artificial Sequence: Synthetic peptide
  Seed: ATLPPFMCNKR (SSX2_HUMAN)
ASLPPFMCNKR

SEQ ID NO: 165404 - protein, 8 aa, Artificial Sequence
  Description of Artificial Sequence: Synthetic peptide
  Seed: KIFYVYMK (SSX2_HUMAN)
KIFYVYMR

SEQ ID NO: 165405 - protein, 10 aa, Artificial Sequence
  Description of Artificial Sequence: Synthetic peptide
  Seed: MKASEKIFYV (SSX2_HUMAN)
MLASEKIFYA

SEQ ID NO: 165406 - protein, 10 aa, Artificial Sequence
  Description of Artificial Sequence: Synthetic peptide
  Seed: YEAMTKLGFK (SSX2_HUMAN)
YAAMTKLGFR

SEQ ID NO: 165407 - protein, 9 aa, Artificial Sequence
  Description of Artificial Sequence: Synthetic peptide
  Seed: KIFYVYMKR (SSX2_HUMAN)
KWFYVYMKR

SEQ ID NO: 165408 - protein, 9 aa, Artificial Sequence
  Description of Artificial Sequence: Synthetic peptide
  Seed: GISPKIMPK (SSX2_HUMAN)
GLSPKIMPK

SEQ ID NO: 165409 - protein, 9 aa, Artificial Sequence
  Description of Artificial Sequence: Synthetic peptide
  Seed: AKYFSKEEW (SSX2_HUMAN)
AMYFSKEEY

SEQ ID NO: 165410 - protein, 9 aa, Artificial Sequence
  Description of Artificial Sequence: Synthetic peptide
  Seed: DAFARRPTV (SSX2_HUMAN)
DQFARRPTM

SEQ ID NO: 165411 - protein, 10 aa, Artificial Sequence
  Description of Artificial Sequence: Synthetic peptide
  Seed: MNGDDAFARR (SSX2_HUMAN)
MVGDDAFARR

SEQ ID NO: 165412 - protein, 10 aa, Artificial Sequence
  Description of Artificial Sequence: Synthetic peptide
  Seed: VYMKRKYEAM (SSX2_HUMAN)
VVMKRKYEAL

SEQ ID NO: 165413 - protein, 11 aa, Artificial Sequence
  Description of Artificial Sequence: Synthetic peptide
  Seed: AQIPEKIQKAF (SSX2_HUMAN)
AQIPEKIQKAI

SEQ ID NO: 165414 - protein, 10 aa, Artificial Sequence
  Description of Artificial Sequence: Synthetic peptide
  Seed: KAFDDIAKYF (SSX2_HUMAN)
KIFDDIAKYK

SEQ ID NO: 165415 - protein, 8 aa, Artificial Sequence
  Description of Artificial Sequence: Synthetic peptide
  Seed: TSEKIHER (SSX2_HUMAN)
TSEKIHEY

SEQ ID NO: 165416 - protein, 11 aa, Artificial Sequence
  Description of Artificial Sequence: Synthetic peptide
  Seed: IQKAFDDIAKY (SSX2_HUMAN)
IQKAFDDIAKF

SEQ ID NO: 165417 - protein, 9 aa, Artificial Sequence
  Description of Artificial Sequence: Synthetic peptide
  Seed: TTSEKIHER (SSX2_HUMAN)
TQSEKIHEV

SEQ ID NO: 165418 - protein, 9 aa, Artificial Sequence
  Description of Artificial Sequence: Synthetic peptide
  Seed: AEDFQGNDL (SSX2_HUMAN)
AADFQGNDM

SEQ ID NO: 165419 - protein, 9 aa, Artificial Sequence
  Description of Artificial Sequence: Synthetic peptide
  Seed: KIQKAFDDI (SSX2_HUMAN)
KLQKAFDDV

SEQ ID NO: 165420 - protein, 9 aa, Artificial Sequence
  Description of Artificial Sequence: Synthetic peptide
  Seed: RLRERKQLV (SSX2_HUMAN)
RYRERKQLA

SEQ ID NO: 165421 - protein, 11 aa, Artificial Sequence
  Description of Artificial Sequence: Synthetic peptide
  Seed: FGRLQGISPKI (SSX2_HUMAN)
FNRLQGISPKV

SEQ ID NO: 165422 - protein, 10 aa, Artificial Sequence
  Description of Artificial Sequence: Synthetic peptide
  Seed: KIFYVYMKRK (SSX2_HUMAN)
KMFYVYMKRS

SEQ ID NO: 165423 - protein, 9 aa, Artificial Sequence
  Description of Artificial Sequence: Synthetic peptide
  Seed: GPKRGEHAW (SSX2_HUMAN)
GPKRGEHAM

SEQ ID NO: 165424 - protein, 9 aa, Artificial Sequence
  Description of Artificial Sequence: Synthetic peptide
  Seed: QIPEKIQKA (SSX2_HUMAN)
QIPEKIQKI

SEQ ID NO: 165425 - protein, 10 aa, Artificial Sequence
  Description of Artificial Sequence: Synthetic peptide
  Seed: AFARRPTVGA (SSX2_HUMAN)
AIARRPTVGK

SEQ ID NO: 165426 - protein, 10 aa, Artificial Sequence
  Description of Artificial Sequence: Synthetic peptide
  Seed: LGFKATLPPF (SSX2_HUMAN)
LSFKATLPPL

SEQ ID NO: 165427 - protein, 11 aa, Artificial Sequence
  Description of Artificial Sequence: Synthetic peptide
  Seed: KMKASEKIFYV (SSX2_HUMAN)
KIKASEKIFYI

SEQ ID NO: 165428 - protein, 9 aa, Artificial Sequence
  Description of Artificial Sequence: Synthetic peptide
  Seed: AQIPEKIQK (SSX2_HUMAN)
ATIPEKIQY

SEQ ID NO: 165429 - protein, 9 aa, Artificial Sequence
  Description of Artificial Sequence: Synthetic peptide
  Seed: FSKEEWEKM (SSX2_HUMAN)
FYKEEWEKM

SEQ ID NO: 165430 - protein, 10 aa, Artificial Sequence
  Description of Artificial Sequence: Synthetic peptide
  Seed: KMKASEKIFY (SSX2_HUMAN)
KLKASEKIFW

SEQ ID NO: 165431 - protein, 10 aa, Artificial Sequence
  Description of Artificial Sequence: Synthetic peptide
  Seed: LGFKATLPPF (SSX2_HUMAN)
LIFKATLPPF

SEQ ID NO: 165432 - protein, 10 aa, Artificial Sequence
  Description of Artificial Sequence: Synthetic peptide
  Seed: MTFGRLQGIS (SSX2_HUMAN)
MTFGRLQGIV

SEQ ID NO: 165433 - protein, 9 aa, Artificial Sequence
  Description of Artificial Sequence: Synthetic peptide
  Seed: TTSEKIHER (SSX2_HUMAN)
TYSEKIHEI

SEQ ID NO: 165434 - protein, 9 aa, Artificial Sequence
  Description of Artificial Sequence: Synthetic peptide
  Seed: KASEKIFYV (SSX2_HUMAN)
KISEKIFYC

SEQ ID NO: 165435 - protein, 9 aa, Artificial Sequence
  Description of Artificial Sequence: Synthetic peptide
  Seed: MTFGRLQGI (SSX2_HUMAN)
MVFGRLQGM

SEQ ID NO: 165436 - protein, 8 aa, Artificial Sequence
  Description of Artificial Sequence: Synthetic peptide
  Seed: ISPKIMPK (SSX2_HUMAN)
IAPKIMPL

SEQ ID NO: 165437 - protein, 9 aa, Artificial Sequence
  Description of Artificial Sequence: Synthetic peptide
  Seed: VGAQIPEKI (SSX2_HUMAN)
VSAQIPEKI

SEQ ID NO: 165438 - protein, 9 aa, Artificial Sequence
  Description of Artificial Sequence: Synthetic peptide
  Seed: KASEKIFYV (SSX2_HUMAN)
KMSEKIFYC

SEQ ID NO: 165439 - protein, 10 aa, Artificial Sequence
  Description of Artificial Sequence: Synthetic peptide
  Seed: MKASEKIFYV (SSX2_HUMAN)
MAASEKIFYL

SEQ ID NO: 165440 - protein, 9 aa, Artificial Sequence
  Description of Artificial Sequence: Synthetic peptide
  Seed: GEHAWTHRL (SSX2_HUMAN)
GQHAWTHRM

SEQ ID NO: 165441 - protein, 9 aa, Artificial Sequence
  Description of Artificial Sequence: Synthetic peptide
  Seed: KAFDDIAKY (SSX2_HUMAN)
KMFDDIAKR

SEQ ID NO: 165442 - protein, 11 aa, Artificial Sequence
  Description of Artificial Sequence: Synthetic peptide
  Seed: ATLPPFMCNKR (SSX2_HUMAN)
AMLPPFMCNKR

SEQ ID NO: 165443 - protein, 10 aa, Artificial Sequence
  Description of Artificial Sequence: Synthetic peptide
  Seed: GRLQGISPKI (SSX2_HUMAN)
GILQGISPKV

SEQ ID NO: 165444 - protein, 11 aa, Artificial Sequence
  Description of Artificial Sequence: Synthetic peptide
  Seed: FGRLQGISPKI (SSX2_HUMAN)
FQRLQGISPKV

SEQ ID NO: 165445 - protein, 9 aa, Artificial Sequence
  Description of Artificial Sequence: Synthetic peptide
  Seed: DAFARRPTV (SSX2_HUMAN)
DTFARRPTF

SEQ ID NO: 165446 - protein, 8 aa, Artificial Sequence
  Description of Artificial Sequence: Synthetic peptide
  Seed: MKRKYEAM (SSX2_HUMAN)
MARKYEAL

SEQ ID NO: 165447 - protein, 9 aa, Artificial Sequence
  Description of Artificial Sequence: Synthetic peptide
  Seed: GISPKIMPK (SSX2_HUMAN)
GMSPKIMPK

SEQ ID NO: 165448 - protein, 9 aa, Artificial Sequence
  Description of Artificial Sequence: Synthetic peptide
  Seed: MTFGRLQGI (SSX2_HUMAN)
MSFGRLQGF

SEQ ID NO: 165449 - protein, 10 aa, Artificial Sequence
  Description of Artificial Sequence: Synthetic peptide
  Seed: RLQGISPKIM (SSX2_HUMAN)
RLQGISPKIV

SEQ ID NO: 165450 - protein, 9 aa, Artificial Sequence
  Description of Artificial Sequence: Synthetic peptide
  Seed: KIFYVYMKR (SSX2_HUMAN)
KMFYVYMKY

SEQ ID NO: 165451 - protein, 10 aa, Artificial Sequence
  Description of Artificial Sequence: Synthetic peptide
  Seed: YVYMKRKYEA (SSX2_HUMAN)
YAYMKRKYEI

SEQ ID NO: 165452 - protein, 9 aa, Artificial Sequence
  Description of Artificial Sequence: Synthetic peptide
  Seed: DAFARRPTV (SSX2_HUMAN)
DGFARRPTL

SEQ ID NO: 165453 - protein, 9 aa, Artificial Sequence
  Description of Artificial Sequence: Synthetic peptide
  Seed: RLQGISPKI (SSX2_HUMAN)
RMQGISPKA

SEQ ID NO: 165454 - protein, 9 aa, Artificial Sequence
  Description of Artificial Sequence: Synthetic peptide
  Seed: KASEKIFYV (SSX2_HUMAN)
KHSEKIFYL

SEQ ID NO: 165455 - protein, 9 aa, Artificial Sequence
  Description of Artificial Sequence: Synthetic peptide
  Seed: AQIPEKIQK (SSX2_HUMAN)
AAIPEKIQH

SEQ ID NO: 165456 - protein, 9 aa, Artificial Sequence
  Description of Artificial Sequence: Synthetic peptide
  Seed: RLRERKQLV (SSX2_HUMAN)
RSRERKQLY

SEQ ID NO: 165457 - protein, 11 aa, Artificial Sequence
  Description of Artificial Sequence: Synthetic peptide
  Seed: GRLQGISPKIM (SSX2_HUMAN)
GRLQGISPKIF

SEQ ID NO: 165458 - protein, 9 aa, Artificial Sequence
  Description of Artificial Sequence: Synthetic peptide
  Seed: RKYEAMTKL (SSX2_HUMAN)
RRYEAMTKL

SEQ ID NO: 165459 - protein, 10 aa, Artificial Sequence
  Description of Artificial Sequence: Synthetic peptide
  Seed: VYMKRKYEAM (SSX2_HUMAN)
VVMKRKYEAM

SEQ ID NO: 165460 - protein, 9 aa, Artificial Sequence
  Description of Artificial Sequence: Synthetic peptide
  Seed: KASEKIFYV (SSX2_HUMAN)
KVSEKIFYI

SEQ ID NO: 165461 - protein, 9 aa, Artificial Sequence
  Description of Artificial Sequence: Synthetic peptide
  Seed: KAFDDIAKY (SSX2_HUMAN)
KIFDDIAKY

SEQ ID NO: 165462 - protein, 9 aa, Artificial Sequence
  Description of Artificial Sequence: Synthetic peptide
  Seed: RERKQLVIY (SSX2_HUMAN)
RLRKQLVIF

SEQ ID NO: 165463 - protein, 9 aa, Artificial Sequence
  Description of Artificial Sequence: Synthetic peptide
  Seed: ASEKIFYVY (SSX2_HUMAN)
AVEKIFYVW

SEQ ID NO: 165464 - protein, 9 aa, Artificial Sequence
  Description of Artificial Sequence: Synthetic peptide
  Seed: MTKLGFKAT (SSX2_HUMAN)
MTKLGFKAA

SEQ ID NO: 165465 - protein, 9 aa, Artificial Sequence
  Description of Artificial Sequence: Synthetic peptide
  Seed: GISPKIMPK (SSX2_HUMAN)
GASPKIMPR

SEQ ID NO: 165466 - protein, 9 aa, Artificial Sequence
  Description of Artificial Sequence: Synthetic peptide
  Seed: AFDDIAKYF (SSX2_HUMAN)
AMDDIAKYM

SEQ ID NO: 165467 - protein, 9 aa, Artificial Sequence
  Description of Artificial Sequence: Synthetic peptide
  Seed: GISPKIMPK (SSX2_HUMAN)
GSSPKIMPF

SEQ ID NO: 165468 - protein, 9 aa, Artificial Sequence
  Description of Artificial Sequence: Synthetic peptide
  Seed: KQLVIYEEI (SSX2_HUMAN)
KALVIYEEL

SEQ ID NO: 165469 - protein, 10 aa, Artificial Sequence
  Description of Artificial Sequence: Synthetic peptide
  Seed: AQIPEKIQKA (SSX2_HUMAN)
AVIPEKIQKV

SEQ ID NO: 165470 - protein, 10 aa, Artificial Sequence
  Description of Artificial Sequence: Synthetic peptide
  Seed: MTKLGFKATL (SSX2_HUMAN)
MVKLGFKATY

SEQ ID NO: 165471 - protein, 9 aa, Artificial Sequence
  Description of Artificial Sequence: Synthetic peptide
  Seed: MPKKPAEEG (SSX2_HUMAN)
MPKKPAEEA

SEQ ID NO: 165472 - protein, 9 aa, Artificial Sequence
  Description of Artificial Sequence: Synthetic peptide
  Seed: NQVERPQMT (SSX2_HUMAN)
NHVERPQMV

SEQ ID NO: 165473 - protein, 10 aa, Artificial Sequence
  Description of Artificial Sequence: Synthetic peptide
  Seed: KMKASEKIFY (SSX2_HUMAN)
KSKASEKIFM

SEQ ID NO: 165474 - protein, 10 aa, Artificial Sequence
  Description of Artificial Sequence: Synthetic peptide
  Seed: MTKLGFKATL (SSX2_HUMAN)
MFKLGFKATY

SEQ ID NO: 165475 - protein, 10 aa, Artificial Sequence
  Description of Artificial Sequence: Synthetic peptide
  Seed: YVYMKRKYEA (SSX2_HUMAN)
YPYMKRKYEV

SEQ ID NO: 165476 - protein, 9 aa, Artificial Sequence
  Description of Artificial Sequence: Synthetic peptide
  Seed: QIPEKIQKA (SSX2_HUMAN)
QAPEKIQKM

SEQ ID NO: 165477 - protein, 9 aa, Artificial Sequence
  Description of Artificial Sequence: Synthetic peptide
  Seed: MKASEKIFY (SSX2_HUMAN)
MQASEKIFY

SEQ ID NO: 165478 - protein, 9 aa, Artificial Sequence
  Description of Artificial Sequence: Synthetic peptide
  Seed: RRPTVGAQI (SSX2_HUMAN)
RQPTVGAQL

SEQ ID NO: 165479 - protein, 10 aa, Artificial Sequence
  Description of Artificial Sequence: Synthetic peptide
  Seed: MTKLGFKATL (SSX2_HUMAN)
MRKLGFKATF

SEQ ID NO: 165480 - protein, 10 aa, Artificial Sequence
  Description of Artificial Sequence: Synthetic peptide
  Seed: KMKASEKIFY (SSX2_HUMAN)
KMKASEKIFA

SEQ ID NO: 165481 - protein, 9 aa, Artificial Sequence
  Description of Artificial Sequence: Synthetic peptide
  Seed: RLRERKQLV (SSX2_HUMAN)
RMRERKQLK

SEQ ID NO: 165482 - protein, 10 aa, Artificial Sequence
  Description of Artificial Sequence: Synthetic peptide
  Seed: KIHERSGPKR (SSX2_HUMAN)
KMHERSGPKK

SEQ ID NO: 165483 - protein, 9 aa, Artificial Sequence
  Description of Artificial Sequence: Synthetic peptide
  Seed: KIHERSGPK (SSX2_HUMAN)
KTHERSGPS

SEQ ID NO: 165484 - protein, 11 aa, Artificial Sequence
  Description of Artificial Sequence: Synthetic peptide
  Seed: KMKASEKIFYV (SSX2_HUMAN)
KSKASEKIFYK

SEQ ID NO: 165485 - protein, 11 aa, Artificial Sequence
  Description of Artificial Sequence: Synthetic peptide
  Seed: KATLPPFMCNK (SSX2_HUMAN)
KYTLPPFMCNR

SEQ ID NO: 165486 - protein, 9 aa, Artificial Sequence
  Description of Artificial Sequence: Synthetic peptide
  Seed: RLRERKQLV (SSX2_HUMAN)
RMRERKQLI

SEQ ID NO: 165487 - protein, 9 aa, Artificial Sequence
  Description of Artificial Sequence: Synthetic peptide
  Seed: AKYFSKEEW (SSX2_HUMAN)
AHYFSKEEY

SEQ ID NO: 165488 - protein, 9 aa, Artificial Sequence
  Description of Artificial Sequence: Synthetic peptide
  Seed: KAFDDIAKY (SSX2_HUMAN)
KKFDDIAKM

SEQ ID NO: 165489 - protein, 9 aa, Artificial Sequence
  Description of Artificial Sequence: Synthetic peptide
  Seed: KASEKIFYV (SSX2_HUMAN)
KGSEKIFYV

SEQ ID NO: 165490 - protein, 10 aa, Artificial Sequence
  Description of Artificial Sequence: Synthetic peptide
  Seed: LGFKATLPPF (SSX2_HUMAN)
LHFKATLPPM

SEQ ID NO: 165491 - protein, 9 aa, Artificial Sequence
  Description of Artificial Sequence: Synthetic peptide
  Seed: KAFDDIAKY (SSX2_HUMAN)
KLFDDIAKI

SEQ ID NO: 165492 - protein, 11 aa, Artificial Sequence
  Description of Artificial Sequence: Synthetic peptide
  Seed: KRAEDFQGNDL (SSX2_HUMAN)
KHAEDFQGNDF

SEQ ID NO: 165493 - protein, 9 aa, Artificial Sequence
  Description of Artificial Sequence: Synthetic peptide
  Seed: TLPPFMCNK (SSX2_HUMAN)
TLPPFMCNR

SEQ ID NO: 165494 - protein, 9 aa, Artificial Sequence
  Description of Artificial Sequence: Synthetic peptide
  Seed: YEAMTKLGF (SSX2_HUMAN)
YKAMTKLGY

SEQ ID NO: 165495 - protein, 9 aa, Artificial Sequence
  Description of Artificial Sequence: Synthetic peptide
  Seed: YEAMTKLGF (SSX2_HUMAN)
YEAMTKLGA

SEQ ID NO: 165496 - protein, 8 aa, Artificial Sequence
  Description of Artificial Sequence: Synthetic peptide
  Seed: FDDIAKYF (SSX2_HUMAN)
FMDIAKYI

SEQ ID NO: 165497 - protein, 9 aa, Artificial Sequence
  Description of Artificial Sequence: Synthetic peptide
  Seed: RKYEAMTKL (SSX2_HUMAN)
RLYEAMTKI

SEQ ID NO: 165498 - protein, 10 aa, Artificial Sequence
  Description of Artificial Sequence: Synthetic peptide
  Seed: KMKASEKIFY (SSX2_HUMAN)
KSKASEKIFV

SEQ ID NO: 165499 - protein, 11 aa, Artificial Sequence
  Description of Artificial Sequence: Synthetic peptide
  Seed: YMKRKYEAMTK (SSX2_HUMAN)
YVKRKYEAMTL

SEQ ID NO: 165500 - protein, 9 aa, Artificial Sequence
  Description of Artificial Sequence: Synthetic peptide
  Seed: FSKEEWEKM (SSX2_HUMAN)
FAKEEWEKF

SEQ ID NO: 165501 - protein, 10 aa, Artificial Sequence
  Description of Artificial Sequence: Synthetic peptide
  Seed: SGPQNDGKEL (SSX2_HUMAN)
SLPQNDGKEL

SEQ ID NO: 165502 - protein, 9 aa, Artificial Sequence
  Description of Artificial Sequence: Synthetic peptide
  Seed: RERKQLVIY (SSX2_HUMAN)
RIRKQLVIF

SEQ ID NO: 165503 - protein, 10 aa, Artificial Sequence
  Description of Artificial Sequence: Synthetic peptide
  Seed: RKQLVIYEEI (SSX2_HUMAN)
RRQLVIYEEL

SEQ ID NO: 165504 - protein, 11 aa, Artificial Sequence
  Description of Artificial Sequence: Synthetic peptide
  Seed: ATLPPFMCNKR (SSX2_HUMAN)
AILPPFMCNKK

SEQ ID NO: 165505 - protein, 10 aa, Artificial Sequence
  Description of Artificial Sequence: Synthetic peptide
  Seed: QMTFGRLQGI (SSX2_HUMAN)
QVTFGRLQGV

SEQ ID NO: 165506 - protein, 10 aa, Artificial Sequence
  Description of Artificial Sequence: Synthetic peptide
  Seed: KAFDDIAKYF (SSX2_HUMAN)
KQFDDIAKYY

SEQ ID NO: 165507 - protein, 9 aa, Artificial Sequence
  Description of Artificial Sequence: Synthetic peptide
  Seed: NQVERPQMT (SSX2_HUMAN)
NHVERPQMA

SEQ ID NO: 165508 - protein, 9 aa, Artificial Sequence
  Description of Artificial Sequence: Synthetic peptide
  Seed: RRPTVGAQI (SSX2_HUMAN)
RAPTVGAQM

SEQ ID NO: 165509 - protein, 9 aa, Artificial Sequence
  Description of Artificial Sequence: Synthetic peptide
  Seed: RLRERKQLV (SSX2_HUMAN)
RIRERKQLL

SEQ ID NO: 165510 - protein, 9 aa, Artificial Sequence
  Description of Artificial Sequence: Synthetic peptide
  Seed: RLRERKQLV (SSX2_HUMAN)
RVRERKQLM

SEQ ID NO: 165511 - protein, 9 aa, Artificial Sequence
  Description of Artificial Sequence: Synthetic peptide
  Seed: AFDDIAKYF (SSX2_HUMAN)
AWDDIAKYF

SEQ ID NO: 165512 - protein, 8 aa, Artificial Sequence
  Description of Artificial Sequence: Synthetic peptide
  Seed: FDDIAKYF (SSX2_HUMAN)
FYDIAKYL

SEQ ID NO: 165513 - protein, 9 aa, Artificial Sequence
  Description of Artificial Sequence: Synthetic peptide
  Seed: GFKATLPPF (SSX2_HUMAN)
GSKATLPPF

SEQ ID NO: 165514 - protein, 10 aa, Artificial Sequence
  Description of Artificial Sequence: Synthetic peptide
  Seed: QGISPKIMPK (SSX2_HUMAN)
QRISPKIMPK

SEQ ID NO: 165515 - protein, 9 aa, Artificial Sequence
  Description of Artificial Sequence: Synthetic peptide
  Seed: KASEKIFYV (SSX2_HUMAN)
KASEKIFYL

SEQ ID NO: 165516 - protein, 10 aa, Artificial Sequence
  Description of Artificial Sequence: Synthetic peptide
  Seed: GRLQGISPKI (SSX2_HUMAN)
GFLQGISPKV

SEQ ID NO: 165517 - protein, 9 aa, Artificial Sequence
  Description of Artificial Sequence: Synthetic peptide
  Seed: NGDDAFARR (SSX2_HUMAN)
NSDDAFARY

SEQ ID NO: 165518 - protein, 10 aa, Artificial Sequence
  Description of Artificial Sequence: Synthetic peptide
  Seed: HAWTHRLRER (SSX2_HUMAN)
HYWTHRLRER

SEQ ID NO: 165519 - protein, 10 aa, Artificial Sequence
  Description of Artificial Sequence: Synthetic peptide
  Seed: ATLPPFMCNK (SSX2_HUMAN)
AQLPPFMCNR

SEQ ID NO: 165520 - protein, 9 aa, Artificial Sequence
  Description of Artificial Sequence: Synthetic peptide
  Seed: DDIAKYFSK (SSX2_HUMAN)
DIIAKYFSR

SEQ ID NO: 165521 - protein, 9 aa, Artificial Sequence
  Description of Artificial Sequence: Synthetic peptide
  Seed: RLQGISPKI (SSX2_HUMAN)
RTQGISPKM

SEQ ID NO: 165522 - protein, 9 aa, Artificial Sequence
  Description of Artificial Sequence: Synthetic peptide
  Seed: KAFDDIAKY (SSX2_HUMAN)
KMFDDIAKL

SEQ ID NO: 165523 - protein, 10 aa, Artificial Sequence
  Description of Artificial Sequence: Synthetic peptide
  Seed: KAFDDIAKYF (SSX2_HUMAN)
KRFDDIAKYY

SEQ ID NO: 165524 - protein, 9 aa, Artificial Sequence
  Description of Artificial Sequence: Synthetic peptide
  Seed: RKYEAMTKL (SSX2_HUMAN)
RNYEAMTKV

SEQ ID NO: 165525 - protein, 10 aa, Artificial Sequence
  Description of Artificial Sequence: Synthetic peptide
  Seed: LGFKATLPPF (SSX2_HUMAN)
LMFKATLPPM

SEQ ID NO: 165526 - protein, 9 aa, Artificial Sequence
  Description of Artificial Sequence: Synthetic peptide
  Seed: VGAQIPEKI (SSX2_HUMAN)
VVAQIPEKI

SEQ ID NO: 165527 - protein, 9 aa, Artificial Sequence
  Description of Artificial Sequence: Synthetic peptide
  Seed: KASEKIFYV (SSX2_HUMAN)
KWSEKIFYK

SEQ ID NO: 165528 - protein, 9 aa, Artificial Sequence
  Description of Artificial Sequence: Synthetic peptide
  Seed: KASEKIFYV (SSX2_HUMAN)
KGSEKIFYR

SEQ ID NO: 165529 - protein, 9 aa, Artificial Sequence
  Description of Artificial Sequence: Synthetic peptide
  Seed: MKASEKIFY (SSX2_HUMAN)
MWASEKIFY

SEQ ID NO: 165530 - protein, 10 aa, Artificial Sequence
  Description of Artificial Sequence: Synthetic peptide
  Seed: KMKASEKIFY (SSX2_HUMAN)
KQKASEKIFK

SEQ ID NO: 165531 - protein, 9 aa, Artificial Sequence
  Description of Artificial Sequence: Synthetic peptide
  Seed: IPEKIQKAF (SSX2_HUMAN)
IPEKIQKAA

SEQ ID NO: 165532 - protein, 9 aa, Artificial Sequence
  Description of Artificial Sequence: Synthetic peptide
  Seed: GPKRGEHAW (SSX2_HUMAN)
GPKRGEHAI

SEQ ID NO: 165533 - protein, 9 aa, Artificial Sequence
  Description of Artificial Sequence: Synthetic peptide
  Seed: EEVPEASGP (SSX2_HUMAN)
EEVPEASGL

SEQ ID NO: 165534 - protein, 9 aa, Artificial Sequence
  Description of Artificial Sequence: Synthetic peptide
  Seed: RLRERKQLV (SSX2_HUMAN)
RLRERKQLW

SEQ ID NO: 165535 - protein, 9 aa, Artificial Sequence
  Description of Artificial Sequence: Synthetic peptide
  Seed: KRKYEAMTK (SSX2_HUMAN)
KVKYEAMTV

SEQ ID NO: 165536 - protein, 9 aa, Artificial Sequence
  Description of Artificial Sequence: Synthetic peptide
  Seed: KQLVIYEEI (SSX2_HUMAN)
KMLVIYEEF

SEQ ID NO: 165537 - protein, 9 aa, Artificial Sequence
  Description of Artificial Sequence: Synthetic peptide
  Seed: VGAQIPEKI (SSX2_HUMAN)
VVAQIPEKM

SEQ ID NO: 165538 - protein, 10 aa, Artificial Sequence
  Description of Artificial Sequence: Synthetic peptide
  Seed: VYMKRKYEAM (SSX2_HUMAN)
VFMKRKYEAF

SEQ ID NO: 165539 - protein, 9 aa, Artificial Sequence
  Description of Artificial Sequence: Synthetic peptide
  Seed: RKYEAMTKL (SSX2_HUMAN)
RFYEAMTKY

SEQ ID NO: 165540 - protein, 9 aa, Artificial Sequence
  Description of Artificial Sequence: Synthetic peptide
  Seed: MTFGRLQGI (SSX2_HUMAN)
MMFGRLQGA

SEQ ID NO: 165541 - protein, 10 aa, Artificial Sequence
  Description of Artificial Sequence: Synthetic peptide
  Seed: KAFDDIAKYF (SSX2_HUMAN)
KAFDDIAKYY

SEQ ID NO: 165542 - protein, 10 aa, Artificial Sequence
  Description of Artificial Sequence: Synthetic peptide
  Seed: KAFDDIAKYF (SSX2_HUMAN)
KRFDDIAKYL

SEQ ID NO: 165543 - protein, 8 aa, Artificial Sequence
  Description of Artificial Sequence: Synthetic peptide
  Seed: MKRKYEAM (SSX2_HUMAN)
MVRKYEAL

SEQ ID NO: 165544 - protein, 9 aa, Artificial Sequence
  Description of Artificial Sequence: Synthetic peptide
  Seed: DAFARRPTV (SSX2_HUMAN)
DQFARRPTI

SEQ ID NO: 165545 - protein, 10 aa, Artificial Sequence
  Description of Artificial Sequence: Synthetic peptide
  Seed: MTKLGFKATL (SSX2_HUMAN)
MDKLGFKATF

SEQ ID NO: 165546 - protein, 10 aa, Artificial Sequence
  Description of Artificial Sequence: Synthetic peptide
  Seed: KYEAMTKLGF (SSX2_HUMAN)
KFEAMTKLGW

SEQ ID NO: 165547 - protein, 10 aa, Artificial Sequence
  Description of Artificial Sequence: Synthetic peptide
  Seed: QMTFGRLQGI (SSX2_HUMAN)
QHTFGRLQGV

SEQ ID NO: 165548 - protein, 9 aa, Artificial Sequence
  Description of Artificial Sequence: Synthetic peptide
  Seed: TTSEKIHER (SSX2_HUMAN)
TRSEKIHEY

SEQ ID NO: 165549 - protein, 9 aa, Artificial Sequence
  Description of Artificial Sequence: Synthetic peptide
  Seed: KAFDDIAKY (SSX2_HUMAN)
KGFDDIAKW

SEQ ID NO: 165550 - protein, 10 aa, Artificial Sequence
  Description of Artificial Sequence: Synthetic peptide
  Seed: ATLPPFMCNK (SSX2_HUMAN)
ATLPPFMCNR

SEQ ID NO: 165551 - protein, 9 aa, Artificial Sequence
  Description of Artificial Sequence: Synthetic peptide
  Seed: KASEKIFYV (SSX2_HUMAN)
KFSEKIFYV

SEQ ID NO: 165552 - protein, 9 aa, Artificial Sequence
  Description of Artificial Sequence: Synthetic peptide
  Seed: TLPPFMCNK (SSX2_HUMAN)
TMPPFMCNR

SEQ ID NO: 165553 - protein, 8 aa, Artificial Sequence
  Description of Artificial Sequence: Synthetic peptide
  Seed: HAWTHRLR (SSX2_HUMAN)
HMWTHRLR

SEQ ID NO: 165554 - protein, 8 aa, Artificial Sequence
  Description of Artificial Sequence: Synthetic peptide
  Seed: KIFYVYMK (SSX2_HUMAN)
KTFYVYMR

SEQ ID NO: 165555 - protein, 10 aa, Artificial Sequence
  Description of Artificial Sequence: Synthetic peptide
  Seed: GRLQGISPKI (SSX2_HUMAN)
GWLQGISPKV

SEQ ID NO: 165556 - protein, 9 aa, Artificial Sequence
  Description of Artificial Sequence: Synthetic peptide
  Seed: AKYFSKEEW (SSX2_HUMAN)
AQYFSKEEF

SEQ ID NO: 165557 - protein, 9 aa, Artificial Sequence
  Description of Artificial Sequence: Synthetic peptide
  Seed: FKATLPPFM (SSX2_HUMAN)
FRATLPPFI

SEQ ID NO: 165558 - protein, 11 aa, Artificial Sequence
  Description of Artificial Sequence: Synthetic peptide
  Seed: RKYEAMTKLGF (SSX2_HUMAN)
RFYEAMTKLGF

SEQ ID NO: 165559 - protein, 9 aa, Artificial Sequence
  Description of Artificial Sequence: Synthetic peptide
  Seed: FARRPTVGA (SSX2_HUMAN)
FTRRPTVGK

SEQ ID NO: 165560 - protein, 10 aa, Artificial Sequence
  Description of Artificial Sequence: Synthetic peptide
  Seed: MTKLGFKATL (SSX2_HUMAN)
MQKLGFKATF

SEQ ID NO: 165561 - protein, 10 aa, Artificial Sequence
  Description of Artificial Sequence: Synthetic peptide
  Seed: RLRERKQLVI (SSX2_HUMAN)
RARERKQLVK

SEQ ID NO: 165562 - protein, 10 aa, Artificial Sequence
  Description of Artificial Sequence: Synthetic peptide
  Seed: KAFDDIAKYF (SSX2_HUMAN)
KVFDDIAKYF

SEQ ID NO: 165563 - protein, 9 aa, Artificial Sequence
  Description of Artificial Sequence: Synthetic peptide
  Seed: KIFYVYMKR (SSX2_HUMAN)
KMFYVYMKH

SEQ ID NO: 165564 - protein, 11 aa, Artificial Sequence
  Description of Artificial Sequence: Synthetic peptide
  Seed: YMKRKYEAMTK (SSX2_HUMAN)
YIKRKYEAMTL

SEQ ID NO: 165565 - protein, 9 aa, Artificial Sequence
  Description of Artificial Sequence: Synthetic peptide
  Seed: AFDDIAKYF (SSX2_HUMAN)
ALDDIAKYF

SEQ ID NO: 165566 - protein, 9 aa, Artificial Sequence
  Description of Artificial Sequence: Synthetic peptide
  Seed: KIFYVYMKR (SSX2_HUMAN)
KNFYVYMKR

SEQ ID NO: 165567 - protein, 10 aa, Artificial Sequence
  Description of Artificial Sequence: Synthetic peptide
  Seed: MKASEKIFYV (SSX2_HUMAN)
MCASEKIFYI

SEQ ID NO: 165568 - protein, 11 aa, Artificial Sequence
  Description of Artificial Sequence: Synthetic peptide
  Seed: FGRLQGISPKI (SSX2_HUMAN)
FERLQGISPKL

SEQ ID NO: 165569 - protein, 9 aa, Artificial Sequence
  Description of Artificial Sequence: Synthetic peptide
  Seed: GISPKIMPK (SSX2_HUMAN)
GSSPKIMPR

SEQ ID NO: 165570 - protein, 9 aa, Artificial Sequence
  Description of Artificial Sequence: Synthetic peptide
  Seed: AKYFSKEEW (SSX2_HUMAN)
AQYFSKEEV

SEQ ID NO: 165571 - protein, 11 aa, Artificial Sequence
  Description of Artificial Sequence: Synthetic peptide
  Seed: YVYMKRKYEAM (SSX2_HUMAN)
YIYMKRKYEAM

SEQ ID NO: 165572 - protein, 10 aa, Artificial Sequence
  Description of Artificial Sequence: Synthetic peptide
  Seed: AQIPEKIQKA (SSX2_HUMAN)
ALIPEKIQKL

SEQ ID NO: 165573 - protein, 9 aa, Artificial Sequence
  Description of Artificial Sequence: Synthetic peptide
  Seed: TTSEKIHER (SSX2_HUMAN)
TFSEKIHEF

SEQ ID NO: 165574 - protein, 9 aa, Artificial Sequence
  Description of Artificial Sequence: Synthetic peptide
  Seed: KAFDDIAKY (SSX2_HUMAN)
KTFDDIAKM

SEQ ID NO: 165575 - protein, 10 aa, Artificial Sequence
  Description of Artificial Sequence: Synthetic peptide
  Seed: LGFKATLPPF (SSX2_HUMAN)
LLFKATLPPF

SEQ ID NO: 165576 - protein, 10 aa, Artificial Sequence
  Description of Artificial Sequence: Synthetic peptide
  Seed: ATLPPFMCNK (SSX2_HUMAN)
ALLPPFMCNR

SEQ ID NO: 165577 - protein, 8 aa, Artificial Sequence
  Description of Artificial Sequence: Synthetic peptide
  Seed: FDDIAKYF (SSX2_HUMAN)
FSDIAKYM

SEQ ID NO: 165578 - protein, 9 aa, Artificial Sequence
  Description of Artificial Sequence: Synthetic peptide
  Seed: KELCPPGKP (SSX2_HUMAN)
KELCPPGKA

SEQ ID NO: 165579 - protein, 10 aa, Artificial Sequence
  Description of Artificial Sequence: Synthetic peptide
  Seed: LGFKATLPPF (SSX2_HUMAN)
LSFKATLPPM

SEQ ID NO: 165580 - protein, 9 aa, Artificial Sequence
  Description of Artificial Sequence: Synthetic peptide
  Seed: YMKRKYEAM (SSX2_HUMAN)
YYKRKYEAF

SEQ ID NO: 165581 - protein, 10 aa, Artificial Sequence
  Description of Artificial Sequence: Synthetic peptide
  Seed: VYMKRKYEAM (SSX2_HUMAN)
VYMKRKYEAW

SEQ ID NO: 165582 - protein, 9 aa, Artificial Sequence
  Description of Artificial Sequence: Synthetic peptide
  Seed: KASEKIFYV (SSX2_HUMAN)
KVSEKIFYF

SEQ ID NO: 165583 - protein, 10 aa, Artificial Sequence
  Description of Artificial Sequence: Synthetic peptide
  Seed: QMTFGRLQGI (SSX2_HUMAN)
QLTFGRLQGI

SEQ ID NO: 165584 - protein, 9 aa, Artificial Sequence
  Description of Artificial Sequence: Synthetic peptide
  Seed: RLRERKQLV (SSX2_HUMAN)
RMRERKQLA

SEQ ID NO: 165585 - protein, 10 aa, Artificial Sequence
  Description of Artificial Sequence: Synthetic peptide
  Seed: NQVERPQMTF (SSX2_HUMAN)
NHVERPQMTI

SEQ ID NO: 165586 - protein, 10 aa, Artificial Sequence
  Description of Artificial Sequence: Synthetic peptide
  Seed: NQVERPQMTF (SSX2_HUMAN)
NHVERPQMTL

SEQ ID NO: 165587 - protein, 10 aa, Artificial Sequence
  Description of Artificial Sequence: Synthetic peptide
  Seed: SEEVPEASGP (SSX2_HUMAN)
SEEVPEASGA

SEQ ID NO: 165588 - protein, 9 aa, Artificial Sequence
  Description of Artificial Sequence: Synthetic peptide
  Seed: DDIAKYFSK (SSX2_HUMAN)
DAIAKYFSK

SEQ ID NO: 165589 - protein, 9 aa, Artificial Sequence
  Description of Artificial Sequence: Synthetic peptide
  Seed: RLQGISPKI (SSX2_HUMAN)
RTQGISPKF

SEQ ID NO: 165590 - protein, 9 aa, Artificial Sequence
  Description of Artificial Sequence: Synthetic peptide
  Seed: TTSEKIHER (SSX2_HUMAN)
TRSEKIHEM

SEQ ID NO: 165591 - protein, 9 aa, Artificial Sequence
  Description of Artificial Sequence: Synthetic peptide
  Seed: DAFARRPTV (SSX2_HUMAN)
DSFARRPTL

SEQ ID NO: 165592 - protein, 8 aa, Artificial Sequence
  Description of Artificial Sequence: Synthetic peptide
  Seed: AFDDIAKY (SSX2_HUMAN)
ATDDIAKL

SEQ ID NO: 165593 - protein, 9 aa, Artificial Sequence
  Description of Artificial Sequence: Synthetic peptide
  Seed: QIPEKIQKA (SSX2_HUMAN)
QIPEKIQKM

SEQ ID NO: 165594 - protein, 10 aa, Artificial Sequence
  Description of Artificial Sequence: Synthetic peptide
  Seed: KMKASEKIFY (SSX2_HUMAN)
KTKASEKIFV

SEQ ID NO: 165595 - protein, 9 aa, Artificial Sequence
  Description of Artificial Sequence: Synthetic peptide
  Seed: FSKEEWEKM (SSX2_HUMAN)
FTKEEWEKW

SEQ ID NO: 165596 - protein, 9 aa, Artificial Sequence
  Description of Artificial Sequence: Synthetic peptide
  Seed: RKYEAMTKL (SSX2_HUMAN)
RIYEAMTKL

SEQ ID NO: 165597 - protein, 9 aa, Artificial Sequence
  Description of Artificial Sequence: Synthetic peptide
  Seed: TTSEKIHER (SSX2_HUMAN)
TISEKIHEM

SEQ ID NO: 165598 - protein, 10 aa, Artificial Sequence
  Description of Artificial Sequence: Synthetic peptide
  Seed: MTKLGFKATL (SSX2_HUMAN)
MAKLGFKATF

SEQ ID NO: 165599 - protein, 9 aa, Artificial Sequence
  Description of Artificial Sequence: Synthetic peptide
  Seed: FARRPTVGA (SSX2_HUMAN)
FPRRPTVGF

SEQ ID NO: 165600 - protein, 9 aa, Artificial Sequence
  Description of Artificial Sequence: Synthetic peptide
  Seed: AMTKLGFKA (SSX2_HUMAN)
ALTKLGFKV

SEQ ID NO: 165601 - protein, 9 aa, Artificial Sequence
  Description of Artificial Sequence: Synthetic peptide
  Seed: MTFGRLQGI (SSX2_HUMAN)
MLFGRLQGW

SEQ ID NO: 165602 - protein, 10 aa, Artificial Sequence
  Description of Artificial Sequence: Synthetic peptide
  Seed: RPQMTFGRLQ (SSX2_HUMAN)
RPQMTFGRLV

SEQ ID NO: 165603 - protein, 8 aa, Artificial Sequence
  Description of Artificial Sequence: Synthetic peptide
  Seed: YMKRKYEA (SSX2_HUMAN)
YMKRKYEF

SEQ ID NO: 165604 - protein, 9 aa, Artificial Sequence
  Description of Artificial Sequence: Synthetic peptide
  Seed: RPTVGAQIP (SSX2_HUMAN)
RPTVGAQIA

SEQ ID NO: 165605 - protein, 10 aa, Artificial Sequence
  Description of Artificial Sequence: Synthetic peptide
  Seed: KASEKIFYVY (SSX2_HUMAN)
KLSEKIFYVY

SEQ ID NO: 165606 - protein, 9 aa, Artificial Sequence
  Description of Artificial Sequence: Synthetic peptide
  Seed: MNGDDAFAR (SSX2_HUMAN)
MAGDDAFAR

SEQ ID NO: 165607 - protein, 9 aa, Artificial Sequence
  Description of Artificial Sequence: Synthetic peptide
  Seed: QIPEKIQKA (SSX2_HUMAN)
QLPEKIQKF

SEQ ID NO: 165608 - protein, 10 aa, Artificial Sequence
  Description of Artificial Sequence: Synthetic peptide
  Seed: ATLPPFMCNK (SSX2_HUMAN)
AALPPFMCNK

SEQ ID NO: 165609 - protein, 10 aa, Artificial Sequence
  Description of Artificial Sequence: Synthetic peptide
  Seed: KAFDDIAKYF (SSX2_HUMAN)
KAFDDIAKYW

SEQ ID NO: 165610 - protein, 10 aa, Artificial Sequence
  Description of Artificial Sequence: Synthetic peptide
  Seed: LGFKATLPPF (SSX2_HUMAN)
LAFKATLPPW

SEQ ID NO: 165611 - protein, 9 aa, Artificial Sequence
  Description of Artificial Sequence: Synthetic peptide
  Seed: RLRERKQLV (SSX2_HUMAN)
RMRERKQLY

SEQ ID NO: 165612 - protein, 8 aa, Artificial Sequence
  Description of Artificial Sequence: Synthetic peptide
  Seed: AFDDIAKY (SSX2_HUMAN)
AGDDIAKL

SEQ ID NO: 165613 - protein, 9 aa, Artificial Sequence
  Description of Artificial Sequence: Synthetic peptide
  Seed: KIHERSGPK (SSX2_HUMAN)
KVHERSGPR

SEQ ID NO: 165614 - protein, 11 aa, Artificial Sequence
  Description of Artificial Sequence: Synthetic peptide
  Seed: AFDDIAKYFSK (SSX2_HUMAN)
ALDDIAKYFSY

SEQ ID NO: 165615 - protein, 9 aa, Artificial Sequence
  Description of Artificial Sequence: Synthetic peptide
  Seed: TTSEKIHER (SSX2_HUMAN)
TASEKIHEH

SEQ ID NO: 165616 - protein, 9 aa, Artificial Sequence
  Description of Artificial Sequence: Synthetic peptide
  Seed: TKLGFKATL (SSX2_HUMAN)
TMLGFKATY

SEQ ID NO: 165617 - protein, 11 aa, Artificial Sequence
  Description of Artificial Sequence: Synthetic peptide
  Seed: KMKASEKIFYV (SSX2_HUMAN)
KLKASEKIFYL

SEQ ID NO: 165618 - protein, 9 aa, Artificial Sequence
  Description of Artificial Sequence: Synthetic peptide
  Seed: YMKRKYEAM (SSX2_HUMAN)
YIKRKYEAT

SEQ ID NO: 165619 - protein, 9 aa, Artificial Sequence
  Description of Artificial Sequence: Synthetic peptide
  Seed: TVGAQIPEK (SSX2_HUMAN)
TAGAQIPER

SEQ ID NO: 165620 - protein, 10 aa, Artificial Sequence
  Description of Artificial Sequence: Synthetic peptide
  Seed: KAFDDIAKYF (SSX2_HUMAN)
KAFDDIAKYR

SEQ ID NO: 165621 - protein, 10 aa, Artificial Sequence
  Description of Artificial Sequence: Synthetic peptide
  Seed: MKASEKIFYV (SSX2_HUMAN)
MAASEKIFYI

SEQ ID NO: 165622 - protein, 9 aa, Artificial Sequence
  Description of Artificial Sequence: Synthetic peptide
  Seed: KASEKIFYV (SSX2_HUMAN)
KSSEKIFYM

SEQ ID NO: 165623 - protein, 9 aa, Artificial Sequence
  Description of Artificial Sequence: Synthetic peptide
  Seed: MCNKRAEDF (SSX2_HUMAN)
MANKRAEDM

SEQ ID NO: 165624 - protein, 9 aa, Artificial Sequence
  Description of Artificial Sequence: Synthetic peptide
  Seed: GEHAWTHRL (SSX2_HUMAN)
GQHAWTHRW

SEQ ID NO: 165625 - protein, 9 aa, Artificial Sequence
  Description of Artificial Sequence: Synthetic peptide
  Seed: EHAWTHRLR (SSX2_HUMAN)
ESAWTHRLR

SEQ ID NO: 165626 - protein, 10 aa, Artificial Sequence
  Description of Artificial Sequence: Synthetic peptide
  Seed: KAFDDIAKYF (SSX2_HUMAN)
KHFDDIAKYF

SEQ ID NO: 165627 - protein, 10 aa, Artificial Sequence
  Description of Artificial Sequence: Synthetic peptide
  Seed: MKASEKIFYV (SSX2_HUMAN)
MNASEKIFYV

SEQ ID NO: 165628 - protein, 8 aa, Artificial Sequence
  Description of Artificial Sequence: Synthetic peptide
  Seed: KIFYVYMK (SSX2_HUMAN)
KYFYVYMR

SEQ ID NO: 165629 - protein, 9 aa, Artificial Sequence
  Description of Artificial Sequence: Synthetic peptide
  Seed: YMKRKYEAM (SSX2_HUMAN)
YAKRKYEAY

SEQ ID NO: 165630 - protein, 10 aa, Artificial Sequence
  Description of Artificial Sequence: Synthetic peptide
  Seed: KIFYVYMKRK (SSX2_HUMAN)
KWFYVYMKRK

SEQ ID NO: 165631 - protein, 10 aa, Artificial Sequence
  Description of Artificial Sequence: Synthetic peptide
  Seed: YMKRKYEAMT (SSX2_HUMAN)
YMKRKYEAMF

SEQ ID NO: 165632 - protein, 9 aa, Artificial Sequence
  Description of Artificial Sequence: Synthetic peptide
  Seed: FARRPTVGA (SSX2_HUMAN)
FIRRPTVGY

SEQ ID NO: 165633 - protein, 9 aa, Artificial Sequence
  Description of Artificial Sequence: Synthetic peptide
  Seed: GFKATLPPF (SSX2_HUMAN)
GAKATLPPF

SEQ ID NO: 165634 - protein, 9 aa, Artificial Sequence
  Description of Artificial Sequence: Synthetic peptide
  Seed: FARRPTVGA (SSX2_HUMAN)
FSRRPTVGM

SEQ ID NO: 165635 - protein, 10 aa, Artificial Sequence
  Description of Artificial Sequence: Synthetic peptide
  Seed: YMKRKYEAMT (SSX2_HUMAN)
YLKRKYEAMI

SEQ ID NO: 165636 - protein, 9 aa, Artificial Sequence
  Description of Artificial Sequence: Synthetic peptide
  Seed: KAFDDIAKY (SSX2_HUMAN)
KAFDDIAKH

SEQ ID NO: 165637 - protein, 11 aa, Artificial Sequence
  Description of Artificial Sequence: Synthetic peptide
  Seed: KIQKAFDDIAK (SSX2_HUMAN)
KMQKAFDDIAR

SEQ ID NO: 165638 - protein, 10 aa, Artificial Sequence
  Description of Artificial Sequence: Synthetic peptide
  Seed: EASGPQNDGK (SSX2_HUMAN)
EISGPQNDGR

SEQ ID NO: 165639 - protein, 9 aa, Artificial Sequence
  Description of Artificial Sequence: Synthetic peptide
  Seed: RKYEAMTKL (SSX2_HUMAN)
RQYEAMTKV

SEQ ID NO: 165640 - protein, 9 aa, Artificial Sequence
  Description of Artificial Sequence: Synthetic peptide
  Seed: QIPEKIQKA (SSX2_HUMAN)
QVPEKIQKI

SEQ ID NO: 165641 - protein, 10 aa, Artificial Sequence
  Description of Artificial Sequence: Synthetic peptide
  Seed: MKASEKIFYV (SSX2_HUMAN)
MTASEKIFYL

SEQ ID NO: 165642 - protein, 10 aa, Artificial Sequence
  Description of Artificial Sequence: Synthetic peptide
  Seed: VYMKRKYEAM (SSX2_HUMAN)
VFMKRKYEAL

SEQ ID NO: 165643 - protein, 9 aa, Artificial Sequence
  Description of Artificial Sequence: Synthetic peptide
  Seed: VGAQIPEKI (SSX2_HUMAN)
VTAQIPEKI

SEQ ID NO: 165644 - protein, 9 aa, Artificial Sequence
  Description of Artificial Sequence: Synthetic peptide
  Seed: MNGDDAFAR (SSX2_HUMAN)
MVGDDAFAK

SEQ ID NO: 165645 - protein, 9 aa, Artificial Sequence
  Description of Artificial Sequence: Synthetic peptide
  Seed: FSKEEWEKM (SSX2_HUMAN)
FLKEEWEKF

SEQ ID NO: 165646 - protein, 9 aa, Artificial Sequence
  Description of Artificial Sequence: Synthetic peptide
  Seed: SEKIHERSG (SSX2_HUMAN)
SEKIHERSV

SEQ ID NO: 165647 - protein, 11 aa, Artificial Sequence
  Description of Artificial Sequence: Synthetic peptide
  Seed: FGRLQGISPKI (SSX2_HUMAN)
FQRLQGISPKL

SEQ ID NO: 165648 - protein, 10 aa, Artificial Sequence
  Description of Artificial Sequence: Synthetic peptide
  Seed: VYMKRKYEAM (SSX2_HUMAN)
VMMKRKYEAM

SEQ ID NO: 165649 - protein, 10 aa, Artificial Sequence
  Description of Artificial Sequence: Synthetic peptide
  Seed: KRGEHAWTHR (SSX2_HUMAN)
KLGEHAWTHR

SEQ ID NO: 165650 - protein, 9 aa, Artificial Sequence
  Description of Artificial Sequence: Synthetic peptide
  Seed: AFDDIAKYF (SSX2_HUMAN)
ATDDIAKYL

SEQ ID NO: 165651 - protein, 9 aa, Artificial Sequence
  Description of Artificial Sequence: Synthetic peptide
  Seed: KAFDDIAKY (SSX2_HUMAN)
KWFDDIAKF

SEQ ID NO: 165652 - protein, 9 aa, Artificial Sequence
  Description of Artificial Sequence: Synthetic peptide
  Seed: YMKRKYEAM (SSX2_HUMAN)
YNKRKYEAM

SEQ ID NO: 165653 - protein, 9 aa, Artificial Sequence
  Description of Artificial Sequence: Synthetic peptide
  Seed: RLQGISPKI (SSX2_HUMAN)
RAQGISPKL

SEQ ID NO: 165654 - protein, 8 aa, Artificial Sequence
  Description of Artificial Sequence: Synthetic peptide
  Seed: RERKQLVI (SSX2_HUMAN)
RERKQLVL

SEQ ID NO: 165655 - protein, 9 aa, Artificial Sequence
  Description of Artificial Sequence: Synthetic peptide
  Seed: QIPEKIQKA (SSX2_HUMAN)
QQPEKIQKL

SEQ ID NO: 165656 - protein, 10 aa, Artificial Sequence
  Description of Artificial Sequence: Synthetic peptide
  Seed: YMKRKYEAMT (SSX2_HUMAN)
YPKRKYEAMM

SEQ ID NO: 165657 - protein, 8 aa, Artificial Sequence
  Description of Artificial Sequence: Synthetic peptide
  Seed: YMKRKYEA (SSX2_HUMAN)
YQKRKYEL

SEQ ID NO: 165658 - protein, 10 aa, Artificial Sequence
  Description of Artificial Sequence: Synthetic peptide
  Seed: KAFDDIAKYF (SSX2_HUMAN)
KRFDDIAKYM

SEQ ID NO: 165659 - protein, 10 aa, Artificial Sequence
  Description of Artificial Sequence: Synthetic peptide
  Seed: KASEKIFYVY (SSX2_HUMAN)
KISEKIFYVW

SEQ ID NO: 165660 - protein, 9 aa, Artificial Sequence
  Description of Artificial Sequence: Synthetic peptide
  Seed: FARRPTVGA (SSX2_HUMAN)
FARRPTVGK

SEQ ID NO: 165661 - protein, 10 aa, Artificial Sequence
  Description of Artificial Sequence: Synthetic peptide
  Seed: KEEWEKMKAS (SSX2_HUMAN)
KEEWEKMKAA

SEQ ID NO: 165662 - protein, 9 aa, Artificial Sequence
  Description of Artificial Sequence: Synthetic peptide
  Seed: VGAQIPEKI (SSX2_HUMAN)
VQAQIPEKW

SEQ ID NO: 165663 - protein, 9 aa, Artificial Sequence
  Description of Artificial Sequence: Synthetic peptide
  Seed: CPPGKPTTS (SSX2_HUMAN)
CPPGKPTTM

SEQ ID NO: 165664 - protein, 9 aa, Artificial Sequence
  Description of Artificial Sequence: Synthetic peptide
  Seed: YEAMTKLGF (SSX2_HUMAN)
YIAMTKLGY

SEQ ID NO: 165665 - protein, 10 aa, Artificial Sequence
  Description of Artificial Sequence: Synthetic peptide
  Seed: AFARRPTVGA (SSX2_HUMAN)
AWARRPTVGK

SEQ ID NO: 165666 - protein, 8 aa, Artificial Sequence
  Description of Artificial Sequence: Synthetic peptide
  Seed: FDDIAKYF (SSX2_HUMAN)
FFDIAKYL

SEQ ID NO: 165667 - protein, 9 aa, Artificial Sequence
  Description of Artificial Sequence: Synthetic peptide
  Seed: MTFGRLQGI (SSX2_HUMAN)
MGFGRLQGY

SEQ ID NO: 165668 - protein, 10 aa, Artificial Sequence
  Description of Artificial Sequence: Synthetic peptide
  Seed: FGRLQGISPK (SSX2_HUMAN)
FSRLQGISPK

SEQ ID NO: 165669 - protein, 8 aa, Artificial Sequence
  Description of Artificial Sequence: Synthetic peptide
  Seed: FDDIAKYF (SSX2_HUMAN)
FTDIAKYL

SEQ ID NO: 165670 - protein, 9 aa, Artificial Sequence
  Description of Artificial Sequence: Synthetic peptide
  Seed: RERKQLVIY (SSX2_HUMAN)
RARKQLVIY

SEQ ID NO: 165671 - protein, 9 aa, Artificial Sequence
  Description of Artificial Sequence: Synthetic peptide
  Seed: ISPKIMPKK (SSX2_HUMAN)
IMPKIMPKL

SEQ ID NO: 165672 - protein, 9 aa, Artificial Sequence
  Description of Artificial Sequence: Synthetic peptide
  Seed: KASEKIFYV (SSX2_HUMAN)
KGSEKIFYL

SEQ ID NO: 165673 - protein, 9 aa, Artificial Sequence
  Description of Artificial Sequence: Synthetic peptide
  Seed: KQLVIYEEI (SSX2_HUMAN)
KELVIYEEC

SEQ ID NO: 165674 - protein, 9 aa, Artificial Sequence
  Description of Artificial Sequence: Synthetic peptide
  Seed: RLRERKQLV (SSX2_HUMAN)
RIRERKQLY

SEQ ID NO: 165675 - protein, 9 aa, Artificial Sequence
  Description of Artificial Sequence: Synthetic peptide
  Seed: YMKRKYEAM (SSX2_HUMAN)
YQKRKYEAI

SEQ ID NO: 165676 - protein, 10 aa, Artificial Sequence
  Description of Artificial Sequence: Synthetic peptide
  Seed: AQIPEKIQKA (SSX2_HUMAN)
AQIPEKIQKY

SEQ ID NO: 165677 - protein, 9 aa, Artificial Sequence
  Description of Artificial Sequence: Synthetic peptide
  Seed: FARRPTVGA (SSX2_HUMAN)
FFRRPTVGK

SEQ ID NO: 165678 - protein, 9 aa, Artificial Sequence
  Description of Artificial Sequence: Synthetic peptide
  Seed: DAFARRPTV (SSX2_HUMAN)
DRFARRPTF

SEQ ID NO: 165679 - protein, 9 aa, Artificial Sequence
  Description of Artificial Sequence: Synthetic peptide
  Seed: MPKKPAEEG (SSX2_HUMAN)
MVKKPAEEL

SEQ ID NO: 165680 - protein, 9 aa, Artificial Sequence
  Description of Artificial Sequence: Synthetic peptide
  Seed: AEDFQGNDL (SSX2_HUMAN)
AVDFQGNDF

SEQ ID NO: 165681 - protein, 9 aa, Artificial Sequence
  Description of Artificial Sequence: Synthetic peptide
  Seed: RLRERKQLV (SSX2_HUMAN)
RPRERKQLL

SEQ ID NO: 165682 - protein, 9 aa, Artificial Sequence
  Description of Artificial Sequence: Synthetic peptide
  Seed: VGAQIPEKI (SSX2_HUMAN)
VAAQIPEKF

SEQ ID NO: 165683 - protein, 9 aa, Artificial Sequence
  Description of Artificial Sequence: Synthetic peptide
  Seed: MTFGRLQGI (SSX2_HUMAN)
MQFGRLQGI

SEQ ID NO: 165684 - protein, 10 aa, Artificial Sequence
  Description of Artificial Sequence: Synthetic peptide
  Seed: MTKLGFKATL (SSX2_HUMAN)
MCKLGFKATY

SEQ ID NO: 165685 - protein, 11 aa, Artificial Sequence
  Description of Artificial Sequence: Synthetic peptide
  Seed: ASGPQNDGKEL (SSX2_HUMAN)
AQGPQNDGKEF

SEQ ID NO: 165686 - protein, 9 aa, Artificial Sequence
  Description of Artificial Sequence: Synthetic peptide
  Seed: KQLVIYEEI (SSX2_HUMAN)
KTLVIYEEL

SEQ ID NO: 165687 - protein, 9 aa, Artificial Sequence
  Description of Artificial Sequence: Synthetic peptide
  Seed: KIHERSGPK (SSX2_HUMAN)
KVHERSGPV

SEQ ID NO: 165688 - protein, 9 aa, Artificial Sequence
  Description of Artificial Sequence: Synthetic peptide
  Seed: EAMTKLGFK (SSX2_HUMAN)
EAMTKLGFR

SEQ ID NO: 165689 - protein, 9 aa, Artificial Sequence
  Description of Artificial Sequence: Synthetic peptide
  Seed: DAFARRPTV (SSX2_HUMAN)
DIFARRPTL

SEQ ID NO: 165690 - protein, 9 aa, Artificial Sequence
  Description of Artificial Sequence: Synthetic peptide
  Seed: GISPKIMPK (SSX2_HUMAN)
GASPKIMPF

SEQ ID NO: 165691 - protein, 9 aa, Artificial Sequence
  Description of Artificial Sequence: Synthetic peptide
  Seed: MPKKPAEEG (SSX2_HUMAN)
MPKKPAEEV

SEQ ID NO: 165692 - protein, 9 aa, Artificial Sequence
  Description of Artificial Sequence: Synthetic peptide
  Seed: AQIPEKIQK (SSX2_HUMAN)
AVIPEKIQY

SEQ ID NO: 165693 - protein, 9 aa, Artificial Sequence
  Description of Artificial Sequence: Synthetic peptide
  Seed: FSKEEWEKM (SSX2_HUMAN)
FVKEEWEKM

SEQ ID NO: 165694 - protein, 9 aa, Artificial Sequence
  Description of Artificial Sequence: Synthetic peptide
  Seed: YMKRKYEAM (SSX2_HUMAN)
YIKRKYEAY

SEQ ID NO: 165695 - protein, 9 aa, Artificial Sequence
  Description of Artificial Sequence: Synthetic peptide
  Seed: TTSEKIHER (SSX2_HUMAN)
TASEKIHEK

SEQ ID NO: 165696 - protein, 9 aa, Artificial Sequence
  Description of Artificial Sequence: Synthetic peptide
  Seed: KAFDDIAKY (SSX2_HUMAN)
KLFDDIAKW

SEQ ID NO: 165697 - protein, 9 aa, Artificial Sequence
  Description of Artificial Sequence: Synthetic peptide
  Seed: RKYEAMTKL (SSX2_HUMAN)
RQYEAMTKF

SEQ ID NO: 165698 - protein, 11 aa, Artificial Sequence
  Description of Artificial Sequence: Synthetic peptide
  Seed: ATLPPFMCNKR (SSX2_HUMAN)
ALLPPFMCNKK

SEQ ID NO: 165699 - protein, 9 aa, Artificial Sequence
  Description of Artificial Sequence: Synthetic peptide
  Seed: EVPEASGPQ (SSX2_HUMAN)
EVPEASGPK

SEQ ID NO: 165700 - protein, 10 aa, Artificial Sequence
  Description of Artificial Sequence: Synthetic peptide
  Seed: YVYMKRKYEA (SSX2_HUMAN)
YMYMKRKYEL

SEQ ID NO: 165701 - protein, 9 aa, Artificial Sequence
  Description of Artificial Sequence: Synthetic peptide
  Seed: YMKRKYEAM (SSX2_HUMAN)
YAKRKYEAL

SEQ ID NO: 165702 - protein, 10 aa, Artificial Sequence
  Description of Artificial Sequence: Synthetic peptide
  Seed: KASEKIFYVY (SSX2_HUMAN)
KMSEKIFYVW

SEQ ID NO: 165703 - protein, 9 aa, Artificial Sequence
  Description of Artificial Sequence: Synthetic peptide
  Seed: TLPPFMCNK (SSX2_HUMAN)
TSPPFMCNK

SEQ ID NO: 165704 - protein, 9 aa, Artificial Sequence
  Description of Artificial Sequence: Synthetic peptide
  Seed: KASEKIFYV (SSX2_HUMAN)
KRSEKIFYV

SEQ ID NO: 165705 - protein, 9 aa, Artificial Sequence
  Description of Artificial Sequence: Synthetic peptide
  Seed: SEKIFYVYM (SSX2_HUMAN)
SEKIFYVYA

SEQ ID NO: 165706 - protein, 8 aa, Artificial Sequence
  Description of Artificial Sequence: Synthetic peptide
  Seed: YMKRKYEA (SSX2_HUMAN)
YPKRKYEF

SEQ ID NO: 165707 - protein, 11 aa, Artificial Sequence
  Description of Artificial Sequence: Synthetic peptide
  Seed: FGRLQGISPKI (SSX2_HUMAN)
FHRLQGISPKL

SEQ ID NO: 165708 - protein, 9 aa, Artificial Sequence
  Description of Artificial Sequence: Synthetic peptide
  Seed: IFYVYMKRK (SSX2_HUMAN)
IYYVYMKRR

SEQ ID NO: 165709 - protein, 9 aa, Artificial Sequence
  Description of Artificial Sequence: Synthetic peptide
  Seed: YMKRKYEAM (SSX2_HUMAN)
YSKRKYEAY

SEQ ID NO: 165710 - protein, 9 aa, Artificial Sequence
  Description of Artificial Sequence: Synthetic peptide
  Seed: MTFGRLQGI (SSX2_HUMAN)
MIFGRLQGW

SEQ ID NO: 165711 - protein, 9 aa, Artificial Sequence
  Description of Artificial Sequence: Synthetic peptide
  Seed: YMKRKYEAM (SSX2_HUMAN)
YLKRKYEAF

SEQ ID NO: 165712 - protein, 11 aa, Artificial Sequence
  Description of Artificial Sequence: Synthetic peptide
  Seed: FGRLQGISPKI (SSX2_HUMAN)
FYRLQGISPKL

SEQ ID NO: 165713 - protein, 10 aa, Artificial Sequence
  Description of Artificial Sequence: Synthetic peptide
  Seed: GRLQGISPKI (SSX2_HUMAN)
GKLQGISPKV

SEQ ID NO: 165714 - protein, 8 aa, Artificial Sequence
  Description of Artificial Sequence: Synthetic peptide
  Seed: RPTVGAQI (SSX2_HUMAN)
RPTVGAQL

SEQ ID NO: 165715 - protein, 9 aa, Artificial Sequence
  Description of Artificial Sequence: Synthetic peptide
  Seed: GEHAWTHRL (SSX2_HUMAN)
GEHAWTHRI

SEQ ID NO: 165716 - protein, 9 aa, Artificial Sequence
  Description of Artificial Sequence: Synthetic peptide
  Seed: AEDFQGNDL (SSX2_HUMAN)
AADFQGNDF

SEQ ID NO: 165717 - protein, 9 aa, Artificial Sequence
  Description of Artificial Sequence: Synthetic peptide
  Seed: EAMTKLGFK (SSX2_HUMAN)
EFMTKLGFR

SEQ ID NO: 165718 - protein, 9 aa, Artificial Sequence
  Description of Artificial Sequence: Synthetic peptide
  Seed: AMTKLGFKA (SSX2_HUMAN)
AQTKLGFKI

SEQ ID NO: 165719 - protein, 8 aa, Artificial Sequence
  Description of Artificial Sequence: Synthetic peptide
  Seed: FDDIAKYF (SSX2_HUMAN)
FNDIAKYM

SEQ ID NO: 165720 - protein, 9 aa, Artificial Sequence
  Description of Artificial Sequence: Synthetic peptide
  Seed: EEWEKMKAS (SSX2_HUMAN)
EEWEKMKAP

SEQ ID NO: 165721 - protein, 9 aa, Artificial Sequence
  Description of Artificial Sequence: Synthetic peptide
  Seed: KAFDDIAKY (SSX2_HUMAN)
KHFDDIAKF

SEQ ID NO: 165722 - protein, 9 aa, Artificial Sequence
  Description of Artificial Sequence: Synthetic peptide
  Seed: GFKATLPPF (SSX2_HUMAN)
GIKATLPPY

SEQ ID NO: 165723 - protein, 8 aa, Artificial Sequence
  Description of Artificial Sequence: Synthetic peptide
  Seed: AFDDIAKY (SSX2_HUMAN)
ASDDIAKL

SEQ ID NO: 165724 - protein, 9 aa, Artificial Sequence
  Description of Artificial Sequence: Synthetic peptide
  Seed: TKLGFKATL (SSX2_HUMAN)
THLGFKATV

SEQ ID NO: 165725 - protein, 9 aa, Artificial Sequence
  Description of Artificial Sequence: Synthetic peptide
  Seed: AFDDIAKYF (SSX2_HUMAN)
ALDDIAKYI

SEQ ID NO: 165726 - protein, 8 aa, Artificial Sequence
  Description of Artificial Sequence: Synthetic peptide
  Seed: VGAQIPEK (SSX2_HUMAN)
VAAQIPEL

SEQ ID NO: 165727 - protein, 10 aa, Artificial Sequence
  Description of Artificial Sequence: Synthetic peptide
  Seed: MTKLGFKATL (SSX2_HUMAN)
MWKLGFKATF

SEQ ID NO: 165728 - protein, 9 aa, Artificial Sequence
  Description of Artificial Sequence: Synthetic peptide
  Seed: ERPQMTFGR (SSX2_HUMAN)
EIPQMTFGR

SEQ ID NO: 165729 - protein, 10 aa, Artificial Sequence
  Description of Artificial Sequence: Synthetic peptide
  Seed: AFARRPTVGA (SSX2_HUMAN)
AEARRPTVGK

SEQ ID NO: 165730 - protein, 9 aa, Artificial Sequence
  Description of Artificial Sequence: Synthetic peptide
  Seed: NGDDAFARR (SSX2_HUMAN)
NVDDAFARK

SEQ ID NO: 165731 - protein, 9 aa, Artificial Sequence
  Description of Artificial Sequence: Synthetic peptide
  Seed: KAFDDIAKY (SSX2_HUMAN)
KKFDDIAKY

SEQ ID NO: 165732 - protein, 9 aa, Artificial Sequence
  Description of Artificial Sequence: Synthetic peptide
  Seed: YMKRKYEAM (SSX2_HUMAN)
YSKRKYEAL

SEQ ID NO: 165733 - protein, 11 aa, Artificial Sequence
  Description of Artificial Sequence: Synthetic peptide
  Seed: RSGPKRGEHAW (SSX2_HUMAN)
RAGPKRGEHAW

SEQ ID NO: 165734 - protein, 9 aa, Artificial Sequence
  Description of Artificial Sequence: Synthetic peptide
  Seed: KAFDDIAKY (SSX2_HUMAN)
KTFDDIAKF

SEQ ID NO: 165735 - protein, 9 aa, Artificial Sequence
  Description of Artificial Sequence: Synthetic peptide
  Seed: YMKRKYEAM (SSX2_HUMAN)
YSKRKYEAA

SEQ ID NO: 165736 - protein, 9 aa, Artificial Sequence
  Description of Artificial Sequence: Synthetic peptide
  Seed: RRPTVGAQI (SSX2_HUMAN)
RYPTVGAQY

SEQ ID NO: 165737 - protein, 8 aa, Artificial Sequence
  Description of Artificial Sequence: Synthetic peptide
  Seed: AFDDIAKY (SSX2_HUMAN)
ASDDIAKI

SEQ ID NO: 165738 - protein, 10 aa, Artificial Sequence
  Description of Artificial Sequence: Synthetic peptide
  Seed: ATLPPFMCNK (SSX2_HUMAN)
AILPPFMCNK

SEQ ID NO: 165739 - protein, 11 aa, Artificial Sequence
  Description of Artificial Sequence: Synthetic peptide
  Seed: ATLPPFMCNKR (SSX2_HUMAN)
AILPPFMCNKR

SEQ ID NO: 165740 - protein, 9 aa, Artificial Sequence
  Description of Artificial Sequence: Synthetic peptide
  Seed: KAFDDIAKY (SSX2_HUMAN)
KGFDDIAKL

SEQ ID NO: 165741 - protein, 10 aa, Artificial Sequence
  Description of Artificial Sequence: Synthetic peptide
  Seed: KMKASEKIFY (SSX2_HUMAN)
KTKASEKIFK

SEQ ID NO: 165742 - protein, 9 aa, Artificial Sequence
  Description of Artificial Sequence: Synthetic peptide
  Seed: GEHAWTHRL (SSX2_HUMAN)
GQHAWTHRF

SEQ ID NO: 165743 - protein, 9 aa, Artificial Sequence
  Description of Artificial Sequence: Synthetic peptide
  Seed: GISPKIMPK (SSX2_HUMAN)
GTSPKIMPR

SEQ ID NO: 165744 - protein, 9 aa, Artificial Sequence
  Description of Artificial Sequence: Synthetic peptide
  Seed: KASEKIFYV (SSX2_HUMAN)
KVSEKIFYT

SEQ ID NO: 165745 - protein, 9 aa, Artificial Sequence
  Description of Artificial Sequence: Synthetic peptide
  Seed: TTSEKIHER (SSX2_HUMAN)
TWSEKIHER

SEQ ID NO: 165746 - protein, 9 aa, Artificial Sequence
  Description of Artificial Sequence: Synthetic peptide
  Seed: RKYEAMTKL (SSX2_HUMAN)
RLYEAMTKY

SEQ ID NO: 165747 - protein, 9 aa, Artificial Sequence
  Description of Artificial Sequence: Synthetic peptide
  Seed: RLRERKQLV (SSX2_HUMAN)
RTRERKQLW

SEQ ID NO: 165748 - protein, 9 aa, Artificial Sequence
  Description of Artificial Sequence: Synthetic peptide
  Seed: DAFARRPTV (SSX2_HUMAN)
DVFARRPTY

SEQ ID NO: 165749 - protein, 10 aa, Artificial Sequence
  Description of Artificial Sequence: Synthetic peptide
  Seed: AQIPEKIQKA (SSX2_HUMAN)
AMIPEKIQKI

SEQ ID NO: 165750 - protein, 11 aa, Artificial Sequence
  Description of Artificial Sequence: Synthetic peptide
  Seed: AQIPEKIQKAF (SSX2_HUMAN)
AQIPEKIQKAY

SEQ ID NO: 165751 - protein, 10 aa, Artificial Sequence
  Description of Artificial Sequence: Synthetic peptide
  Seed: VYMKRKYEAM (SSX2_HUMAN)
VPMKRKYEAL

SEQ ID NO: 165752 - protein, 8 aa, Artificial Sequence
  Description of Artificial Sequence: Synthetic peptide
  Seed: MKRKYEAM (SSX2_HUMAN)
MLRKYEAL

SEQ ID NO: 165753 - protein, 9 aa, Artificial Sequence
  Description of Artificial Sequence: Synthetic peptide
  Seed: FKATLPPFM (SSX2_HUMAN)
FQATLPPFM

SEQ ID NO: 165754 - protein, 10 aa, Artificial Sequence
  Description of Artificial Sequence: Synthetic peptide
  Seed: KASEKIFYVY (SSX2_HUMAN)
KASEKIFYVW

SEQ ID NO: 165755 - protein, 10 aa, Artificial Sequence
  Description of Artificial Sequence: Synthetic peptide
  Seed: YVYMKRKYEA (SSX2_HUMAN)
YTYMKRKYEL

SEQ ID NO: 165756 - protein, 9 aa, Artificial Sequence
  Description of Artificial Sequence: Synthetic peptide
  Seed: YEAMTKLGF (SSX2_HUMAN)
YAAMTKLGF

SEQ ID NO: 165757 - protein, 9 aa, Artificial Sequence
  Description of Artificial Sequence: Synthetic peptide
  Seed: FARRPTVGA (SSX2_HUMAN)
FARRPTVGH

SEQ ID NO: 165758 - protein, 9 aa, Artificial Sequence
  Description of Artificial Sequence: Synthetic peptide
  Seed: AQIPEKIQK (SSX2_HUMAN)
AAIPEKIQK

SEQ ID NO: 165759 - protein, 9 aa, Artificial Sequence
  Description of Artificial Sequence: Synthetic peptide
  Seed: KIFYVYMKR (SSX2_HUMAN)
KAFYVYMKK

SEQ ID NO: 165760 - protein, 10 aa, Artificial Sequence
  Description of Artificial Sequence: Synthetic peptide
  Seed: MKRKYEAMTK (SSX2_HUMAN)
MTRKYEAMTA

SEQ ID NO: 165761 - protein, 9 aa, Artificial Sequence
  Description of Artificial Sequence: Synthetic peptide
  Seed: DAFARRPTV (SSX2_HUMAN)
DHFARRPTV

SEQ ID NO: 165762 - protein, 9 aa, Artificial Sequence
  Description of Artificial Sequence: Synthetic peptide
  Seed: RERKQLVIY (SSX2_HUMAN)
RQRKQLVIF

SEQ ID NO: 165763 - protein, 9 aa, Artificial Sequence
  Description of Artificial Sequence: Synthetic peptide
  Seed: DDIAKYFSK (SSX2_HUMAN)
DLIAKYFSR

SEQ ID NO: 165764 - protein, 9 aa, Artificial Sequence
  Description of Artificial Sequence: Synthetic peptide
  Seed: FSKEEWEKM (SSX2_HUMAN)
FRKEEWEKF

SEQ ID NO: 165765 - protein, 9 aa, Artificial Sequence
  Description of Artificial Sequence: Synthetic peptide
  Seed: TKLGFKATL (SSX2_HUMAN)
TALGFKATY

SEQ ID NO: 165766 - protein, 9 aa, Artificial Sequence
  Description of Artificial Sequence: Synthetic peptide
  Seed: KASEKIFYV (SSX2_HUMAN)
KLSEKIFYK

SEQ ID NO: 165767 - protein, 9 aa, Artificial Sequence
  Description of Artificial Sequence: Synthetic peptide
  Seed: TTSEKIHER (SSX2_HUMAN)
TNSEKIHEL

SEQ ID NO: 165768 - protein, 9 aa, Artificial Sequence
  Description of Artificial Sequence: Synthetic peptide
  Seed: FSKEEWEKM (SSX2_HUMAN)
FTKEEWEKM

SEQ ID NO: 165769 - protein, 9 aa, Artificial Sequence
  Description of Artificial Sequence: Synthetic peptide
  Seed: KASEKIFYV (SSX2_HUMAN)
KVSEKIFYR

SEQ ID NO: 165770 - protein, 9 aa, Artificial Sequence
  Description of Artificial Sequence: Synthetic peptide
  Seed: TTSEKIHER (SSX2_HUMAN)
TISEKIHEK

SEQ ID NO: 165771 - protein, 9 aa, Artificial Sequence
  Description of Artificial Sequence: Synthetic peptide
  Seed: KATLPPFMC (SSX2_HUMAN)
KSTLPPFML

SEQ ID NO: 165772 - protein, 9 aa, Artificial Sequence
  Description of Artificial Sequence: Synthetic peptide
  Seed: SEKIHERSG (SSX2_HUMAN)
SEKIHERSI

SEQ ID NO: 165773 - protein, 9 aa, Artificial Sequence
  Description of Artificial Sequence: Synthetic peptide
  Seed: AEDFQGNDL (SSX2_HUMAN)
ASDFQGNDV

SEQ ID NO: 165774 - protein, 10 aa, Artificial Sequence
  Description of Artificial Sequence: Synthetic peptide
  Seed: QMTFGRLQGI (SSX2_HUMAN)
QYTFGRLQGV

SEQ ID NO: 165775 - protein, 11 aa, Artificial Sequence
  Description of Artificial Sequence: Synthetic peptide
  Seed: AFDDIAKYFSK (SSX2_HUMAN)
AMDDIAKYFSY

SEQ ID NO: 165776 - protein, 10 aa, Artificial Sequence
  Description of Artificial Sequence: Synthetic peptide
  Seed: MTKLGFKATL (SSX2_HUMAN)
MTKLGFKATW

SEQ ID NO: 165777 - protein, 9 aa, Artificial Sequence
  Description of Artificial Sequence: Synthetic peptide
  Seed: KAFDDIAKY (SSX2_HUMAN)
KWFDDIAKY

SEQ ID NO: 165778 - protein, 9 aa, Artificial Sequence
  Description of Artificial Sequence: Synthetic peptide
  Seed: KQLVIYEEI (SSX2_HUMAN)
KVLVIYEEW

SEQ ID NO: 165779 - protein, 9 aa, Artificial Sequence
  Description of Artificial Sequence: Synthetic peptide
  Seed: NDSEEVPEA (SSX2_HUMAN)
NESEEVPEI

SEQ ID NO: 165780 - protein, 9 aa, Artificial Sequence
  Description of Artificial Sequence: Synthetic peptide
  Seed: DAFARRPTV (SSX2_HUMAN)
DAFARRPTL

SEQ ID NO: 165781 - protein, 9 aa, Artificial Sequence
  Description of Artificial Sequence: Synthetic peptide
  Seed: KAFDDIAKY (SSX2_HUMAN)
KGFDDIAKY

SEQ ID NO: 165782 - protein, 10 aa, Artificial Sequence
  Description of Artificial Sequence: Synthetic peptide
  Seed: QKAFDDIAKY (SSX2_HUMAN)
QPAFDDIAKY

SEQ ID NO: 165783 - protein, 9 aa, Artificial Sequence
  Description of Artificial Sequence: Synthetic peptide
  Seed: AFDDIAKYF (SSX2_HUMAN)
ATDDIAKYM

SEQ ID NO: 165784 - protein, 10 aa, Artificial Sequence
  Description of Artificial Sequence: Synthetic peptide
  Seed: AQIPEKIQKA (SSX2_HUMAN)
AIIPEKIQKI

SEQ ID NO: 165785 - protein, 10 aa, Artificial Sequence
  Description of Artificial Sequence: Synthetic peptide
  Seed: KAFDDIAKYF (SSX2_HUMAN)
KIFDDIAKYI

SEQ ID NO: 165786 - protein, 8 aa, Artificial Sequence
  Description of Artificial Sequence: Synthetic peptide
  Seed: VGAQIPEK (SSX2_HUMAN)
VTAQIPEL

SEQ ID NO: 165787 - protein, 9 aa, Artificial Sequence
  Description of Artificial Sequence: Synthetic peptide
  Seed: KIFYVYMKR (SSX2_HUMAN)
KQFYVYMKR

SEQ ID NO: 165788 - protein, 9 aa, Artificial Sequence
  Description of Artificial Sequence: Synthetic peptide
  Seed: ERPQMTFGR (SSX2_HUMAN)
EFPQMTFGR

SEQ ID NO: 165789 - protein, 10 aa, Artificial Sequence
  Description of Artificial Sequence: Synthetic peptide
  Seed: YVYMKRKYEA (SSX2_HUMAN)
YSYMKRKYEL

SEQ ID NO: 165790 - protein, 10 aa, Artificial Sequence
  Description of Artificial Sequence: Synthetic peptide
  Seed: KIFYVYMKRK (SSX2_HUMAN)
KTFYVYMKRK

SEQ ID NO: 165791 - protein, 10 aa, Artificial Sequence
  Description of Artificial Sequence: Synthetic peptide
  Seed: HAWTHRLRER (SSX2_HUMAN)
HVWTHRLREK

SEQ ID NO: 165792 - protein, 9 aa, Artificial Sequence
  Description of Artificial Sequence: Synthetic peptide
  Seed: RKYEAMTKL (SSX2_HUMAN)
RSYEAMTKM

SEQ ID NO: 165793 - protein, 8 aa, Artificial Sequence
  Description of Artificial Sequence: Synthetic peptide
  Seed: FDDIAKYF (SSX2_HUMAN)
FYDIAKYI

SEQ ID NO: 165794 - protein, 9 aa, Artificial Sequence
  Description of Artificial Sequence: Synthetic peptide
  Seed: KATLPPFMC (SSX2_HUMAN)
KVTLPPFMF

SEQ ID NO: 165795 - protein, 11 aa, Artificial Sequence
  Description of Artificial Sequence: Synthetic peptide
  Seed: AQIPEKIQKAF (SSX2_HUMAN)
AEIPEKIQKAW

SEQ ID NO: 165796 - protein, 10 aa, Artificial Sequence
  Description of Artificial Sequence: Synthetic peptide
  Seed: KIFYVYMKRK (SSX2_HUMAN)
KQFYVYMKRK

SEQ ID NO: 165797 - protein, 10 aa, Artificial Sequence
  Description of Artificial Sequence: Synthetic peptide
  Seed: MKASEKIFYV (SSX2_HUMAN)
MIASEKIFYA

SEQ ID NO: 165798 - protein, 10 aa, Artificial Sequence
  Description of Artificial Sequence: Synthetic peptide
  Seed: YMKRKYEAMT (SSX2_HUMAN)
YMKRKYEAMA

SEQ ID NO: 165799 - protein, 9 aa, Artificial Sequence
  Description of Artificial Sequence: Synthetic peptide
  Seed: KQLVIYEEI (SSX2_HUMAN)
KVLVIYEEY

SEQ ID NO: 165800 - protein, 10 aa, Artificial Sequence
  Description of Artificial Sequence: Synthetic peptide
  Seed: IAKYFSKEEW (SSX2_HUMAN)
ISKYFSKEEW

SEQ ID NO: 165801 - protein, 8 aa, Artificial Sequence
  Description of Artificial Sequence: Synthetic peptide
  Seed: FDDIAKYF (SSX2_HUMAN)
FGDIAKYI

SEQ ID NO: 165802 - protein, 9 aa, Artificial Sequence
  Description of Artificial Sequence: Synthetic peptide
  Seed: RGEHAWTHR (SSX2_HUMAN)
RIEHAWTHR

SEQ ID NO: 165803 - protein, 9 aa, Artificial Sequence
  Description of Artificial Sequence: Synthetic peptide
  Seed: GFKATLPPF (SSX2_HUMAN)
GYKATLPPM

SEQ ID NO: 165804 - protein, 9 aa, Artificial Sequence
  Description of Artificial Sequence: Synthetic peptide
  Seed: TVGAQIPEK (SSX2_HUMAN)
TTGAQIPEK

SEQ ID NO: 165805 - protein, 9 aa, Artificial Sequence
  Description of Artificial Sequence: Synthetic peptide
  Seed: QIPEKIQKA (SSX2_HUMAN)
QAPEKIQKF

SEQ ID NO: 165806 - protein, 9 aa, Artificial Sequence
  Description of Artificial Sequence: Synthetic peptide
  Seed: RERKQLVIY (SSX2_HUMAN)
RERKQLVIA

SEQ ID NO: 165807 - protein, 9 aa, Artificial Sequence
  Description of Artificial Sequence: Synthetic peptide
  Seed: RRPTVGAQI (SSX2_HUMAN)
RQPTVGAQF

SEQ ID NO: 165808 - protein, 9 aa, Artificial Sequence
  Description of Artificial Sequence: Synthetic peptide
  Seed: KASEKIFYV (SSX2_HUMAN)
KMSEKIFYS

SEQ ID NO: 165809 - protein, 10 aa, Artificial Sequence
  Description of Artificial Sequence: Synthetic peptide
  Seed: TLPPFMCNKR (SSX2_HUMAN)
TTPPFMCNKK

SEQ ID NO: 165810 - protein, 10 aa, Artificial Sequence
  Description of Artificial Sequence: Synthetic peptide
  Seed: MTKLGFKATL (SSX2_HUMAN)
MIKLGFKATF

SEQ ID NO: 165811 - protein, 9 aa, Artificial Sequence
  Description of Artificial Sequence: Synthetic peptide
  Seed: MTFGRLQGI (SSX2_HUMAN)
MMFGRLQGL

SEQ ID NO: 165812 - protein, 10 aa, Artificial Sequence
  Description of Artificial Sequence: Synthetic peptide
  Seed: AQIPEKIQKA (SSX2_HUMAN)
ALIPEKIQKW

SEQ ID NO: 165813 - protein, 9 aa, Artificial Sequence
  Description of Artificial Sequence: Synthetic peptide
  Seed: YMKRKYEAM (SSX2_HUMAN)
YTKRKYEAF

SEQ ID NO: 165814 - protein, 9 aa, Artificial Sequence
  Description of Artificial Sequence: Synthetic peptide
  Seed: GFKATLPPF (SSX2_HUMAN)
GMKATLPPY

SEQ ID NO: 165815 - protein, 9 aa, Artificial Sequence
  Description of Artificial Sequence: Synthetic peptide
  Seed: AFDDIAKYF (SSX2_HUMAN)
AVDDIAKYW

SEQ ID NO: 165816 - protein, 9 aa, Artificial Sequence
  Description of Artificial Sequence: Synthetic peptide
  Seed: TTSEKIHER (SSX2_HUMAN)
TYSEKIHEL

SEQ ID NO: 165817 - protein, 10 aa, Artificial Sequence
  Description of Artificial Sequence: Synthetic peptide
  Seed: YEAMTKLGFK (SSX2_HUMAN)
YFAMTKLGFK

SEQ ID NO: 165818 - protein, 11 aa, Artificial Sequence
  Description of Artificial Sequence: Synthetic peptide
  Seed: RGEHAWTHRLR (SSX2_HUMAN)
RYEHAWTHRLR

SEQ ID NO: 165819 - protein, 8 aa, Artificial Sequence
  Description of Artificial Sequence: Synthetic peptide
  Seed: YMKRKYEA (SSX2_HUMAN)
YTKRKYEL

SEQ ID NO: 165820 - protein, 9 aa, Artificial Sequence
  Description of Artificial Sequence: Synthetic peptide
  Seed: RLQGISPKI (SSX2_HUMAN)
RIQGISPKM

SEQ ID NO: 165821 - protein, 10 aa, Artificial Sequence
  Description of Artificial Sequence: Synthetic peptide
  Seed: RKQLVIYEEI (SSX2_HUMAN)
RRQLVIYEEV

SEQ ID NO: 165822 - protein, 10 aa, Artificial Sequence
  Description of Artificial Sequence: Synthetic peptide
  Seed: YEAMTKLGFK (SSX2_HUMAN)
YDAMTKLGFR

SEQ ID NO: 165823 - protein, 9 aa, Artificial Sequence
  Description of Artificial Sequence: Synthetic peptide
  Seed: YMKRKYEAM (SSX2_HUMAN)
YCKRKYEAL

SEQ ID NO: 165824 - protein, 9 aa, Artificial Sequence
  Description of Artificial Sequence: Synthetic peptide
  Seed: TKLGFKATL (SSX2_HUMAN)
TKLGFKATF

SEQ ID NO: 165825 - protein, 10 aa, Artificial Sequence
  Description of Artificial Sequence: Synthetic peptide
  Seed: KYEAMTKLGF (SSX2_HUMAN)
KREAMTKLGW

SEQ ID NO: 165826 - protein, 9 aa, Artificial Sequence
  Description of Artificial Sequence: Synthetic peptide
  Seed: RKYEAMTKL (SSX2_HUMAN)
RRYEAMTKY

SEQ ID NO: 165827 - protein, 9 aa, Artificial Sequence
  Description of Artificial Sequence: Synthetic peptide
  Seed: ISPKIMPKK (SSX2_HUMAN)
IVPKIMPKK

SEQ ID NO: 165828 - protein, 10 aa, Artificial Sequence
  Description of Artificial Sequence: Synthetic peptide
  Seed: MKRKYEAMTK (SSX2_HUMAN)
MQRKYEAMTK

SEQ ID NO: 165829 - protein, 10 aa, Artificial Sequence
  Description of Artificial Sequence: Synthetic peptide
  Seed: KASEKIFYVY (SSX2_HUMAN)
KFSEKIFYVW

SEQ ID NO: 165830 - protein, 9 aa, Artificial Sequence
  Description of Artificial Sequence: Synthetic peptide
  Seed: MTFGRLQGI (SSX2_HUMAN)
MYFGRLQGY

SEQ ID NO: 165831 - protein, 10 aa, Artificial Sequence
  Description of Artificial Sequence: Synthetic peptide
  Seed: YVYMKRKYEA (SSX2_HUMAN)
YVYMKRKYEL

SEQ ID NO: 165832 - protein, 9 aa, Artificial Sequence
  Description of Artificial Sequence: Synthetic peptide
  Seed: CPPGKPTTS (SSX2_HUMAN)
CPPGKPTTA

SEQ ID NO: 165833 - protein, 9 aa, Artificial Sequence
  Description of Artificial Sequence: Synthetic peptide
  Seed: MTFGRLQGI (SSX2_HUMAN)
MLFGRLQGS

SEQ ID NO: 165834 - protein, 9 aa, Artificial Sequence
  Description of Artificial Sequence: Synthetic peptide
  Seed: VGAQIPEKI (SSX2_HUMAN)
VQAQIPEKF

SEQ ID NO: 165835 - protein, 10 aa, Artificial Sequence
  Description of Artificial Sequence: Synthetic peptide
  Seed: VYMKRKYEAM (SSX2_HUMAN)
VLMKRKYEAL

SEQ ID NO: 165836 - protein, 9 aa, Artificial Sequence
  Description of Artificial Sequence: Synthetic peptide
  Seed: RLQGISPKI (SSX2_HUMAN)
RTQGISPKY

SEQ ID NO: 165837 - protein, 9 aa, Artificial Sequence
  Description of Artificial Sequence: Synthetic peptide
  Seed: KASEKIFYV (SSX2_HUMAN)
KQSEKIFYC

SEQ ID NO: 165838 - protein, 9 aa, Artificial Sequence
  Description of Artificial Sequence: Synthetic peptide
  Seed: MTFGRLQGI (SSX2_HUMAN)
MQFGRLQGL

SEQ ID NO: 165839 - protein, 8 aa, Artificial Sequence
  Description of Artificial Sequence: Synthetic peptide
  Seed: FDDIAKYF (SSX2_HUMAN)
FNDIAKYL

SEQ ID NO: 165840 - protein, 9 aa, Artificial Sequence
  Description of Artificial Sequence: Synthetic peptide
  Seed: YMKRKYEAM (SSX2_HUMAN)
YPKRKYEAC

SEQ ID NO: 165841 - protein, 9 aa, Artificial Sequence
  Description of Artificial Sequence: Synthetic peptide
  Seed: KASEKIFYV (SSX2_HUMAN)
KMSEKIFYA

SEQ ID NO: 165842 - protein, 9 aa, Artificial Sequence
  Description of Artificial Sequence: Synthetic peptide
  Seed: YMKRKYEAM (SSX2_HUMAN)
YRKRKYEAL

SEQ ID NO: 165843 - protein, 9 aa, Artificial Sequence
  Description of Artificial Sequence: Synthetic peptide
  Seed: RKYEAMTKL (SSX2_HUMAN)
RYYEAMTKF

SEQ ID NO: 165844 - protein, 9 aa, Artificial Sequence
  Description of Artificial Sequence: Synthetic peptide
  Seed: KASEKIFYV (SSX2_HUMAN)
KVSEKIFYV

SEQ ID NO: 165845 - protein, 9 aa, Artificial Sequence
  Description of Artificial Sequence: Synthetic peptide
  Seed: ASEKIFYVY (SSX2_HUMAN)
ALEKIFYVY

SEQ ID NO: 165846 - protein, 9 aa, Artificial Sequence
  Description of Artificial Sequence: Synthetic peptide
  Seed: DDIAKYFSK (SSX2_HUMAN)
DVIAKYFSR

SEQ ID NO: 165847 - protein, 11 aa, Artificial Sequence
  Description of Artificial Sequence: Synthetic peptide
  Seed: RGEHAWTHRLR (SSX2_HUMAN)
RFEHAWTHRLR

SEQ ID NO: 165848 - protein, 8 aa, Artificial Sequence
  Description of Artificial Sequence: Synthetic peptide
  Seed: FDDIAKYF (SSX2_HUMAN)
FTDIAKYF

SEQ ID NO: 165849 - protein, 9 aa, Artificial Sequence
  Description of Artificial Sequence: Synthetic peptide
  Seed: VGAQIPEKI (SSX2_HUMAN)
VLAQIPEKI

SEQ ID NO: 165850 - protein, 10 aa, Artificial Sequence
  Description of Artificial Sequence: Synthetic peptide
  Seed: ATLPPFMCNK (SSX2_HUMAN)
AMLPPFMCNK

SEQ ID NO: 165851 - protein, 9 aa, Artificial Sequence
  Description of Artificial Sequence: Synthetic peptide
  Seed: RLRERKQLV (SSX2_HUMAN)
RARERKQLY

SEQ ID NO: 165852 - protein, 9 aa, Artificial Sequence
  Description of Artificial Sequence: Synthetic peptide
  Seed: FARRPTVGA (SSX2_HUMAN)
FARRPTVGI

SEQ ID NO: 165853 - protein, 9 aa, Artificial Sequence
  Description of Artificial Sequence: Synthetic peptide
  Seed: GFKATLPPF (SSX2_HUMAN)
GWKATLPPF

SEQ ID NO: 165854 - protein, 9 aa, Artificial Sequence
  Description of Artificial Sequence: Synthetic peptide
  Seed: MTFGRLQGI (SSX2_HUMAN)
MAFGRLQGW

SEQ ID NO: 165855 - protein, 9 aa, Artificial Sequence
  Description of Artificial Sequence: Synthetic peptide
  Seed: KASEKIFYV (SSX2_HUMAN)
KGSEKIFYM

SEQ ID NO: 165856 - protein, 9 aa, Artificial Sequence
  Description of Artificial Sequence: Synthetic peptide
  Seed: RLRERKQLV (SSX2_HUMAN)
RVRERKQLY

SEQ ID NO: 165857 - protein, 9 aa, Artificial Sequence
  Description of Artificial Sequence: Synthetic peptide
  Seed: YEAMTKLGF (SSX2_HUMAN)
YKAMTKLGM

SEQ ID NO: 165858 - protein, 9 aa, Artificial Sequence
  Description of Artificial Sequence: Synthetic peptide
  Seed: YEAMTKLGF (SSX2_HUMAN)
YQAMTKLGY

SEQ ID NO: 165859 - protein, 9 aa, Artificial Sequence
  Description of Artificial Sequence: Synthetic peptide
  Seed: TTSEKIHER (SSX2_HUMAN)
TQSEKIHER

SEQ ID NO: 165860 - protein, 9 aa, Artificial Sequence
  Description of Artificial Sequence: Synthetic peptide
  Seed: RKYEAMTKL (SSX2_HUMAN)
RLYEAMTKM

SEQ ID NO: 165861 - protein, 9 aa, Artificial Sequence
  Description of Artificial Sequence: Synthetic peptide
  Seed: KQLVIYEEI (SSX2_HUMAN)
KSLVIYEEY

SEQ ID NO: 165862 - protein, 9 aa, Artificial Sequence
  Description of Artificial Sequence: Synthetic peptide
  Seed: RLRERKQLV (SSX2_HUMAN)
RTRERKQLM

SEQ ID NO: 165863 - protein, 9 aa, Artificial Sequence
  Description of Artificial Sequence: Synthetic peptide
  Seed: YMKRKYEAM (SSX2_HUMAN)
YFKRKYEAI

SEQ ID NO: 165864 - protein, 8 aa, Artificial Sequence
  Description of Artificial Sequence: Synthetic peptide
  Seed: KIFYVYMK (SSX2_HUMAN)
KMFYVYMK

SEQ ID NO: 165865 - protein, 9 aa, Artificial Sequence
  Description of Artificial Sequence: Synthetic peptide
  Seed: TTSEKIHER (SSX2_HUMAN)
TNSEKIHEM

SEQ ID NO: 165866 - protein, 9 aa, Artificial Sequence
  Description of Artificial Sequence: Synthetic peptide
  Seed: TKLGFKATL (SSX2_HUMAN)
TYLGFKATY

SEQ ID NO: 165867 - protein, 9 aa, Artificial Sequence
  Description of Artificial Sequence: Synthetic peptide
  Seed: KIHERSGPK (SSX2_HUMAN)
KTHERSGPY

SEQ ID NO: 165868 - protein, 9 aa, Artificial Sequence
  Description of Artificial Sequence: Synthetic peptide
  Seed: KASEKIFYV (SSX2_HUMAN)
KVSEKIFYY

SEQ ID NO: 165869 - protein, 9 aa, Artificial Sequence
  Description of Artificial Sequence: Synthetic peptide
  Seed: AQIPEKIQK (SSX2_HUMAN)
AEIPEKIQY

SEQ ID NO: 165870 - protein, 9 aa, Artificial Sequence
  Description of Artificial Sequence: Synthetic peptide
  Seed: KASEKIFYV (SSX2_HUMAN)
KYSEKIFYF

SEQ ID NO: 165871 - protein, 10 aa, Artificial Sequence
  Description of Artificial Sequence: Synthetic peptide
  Seed: MTKLGFKATL (SSX2_HUMAN)
MHKLGFKATF

SEQ ID NO: 165872 - protein, 9 aa, Artificial Sequence
  Description of Artificial Sequence: Synthetic peptide
  Seed: NDSEEVPEA (SSX2_HUMAN)
NESEEVPEF

SEQ ID NO: 165873 - protein, 9 aa, Artificial Sequence
  Description of Artificial Sequence: Synthetic peptide
  Seed: KQLVIYEEI (SSX2_HUMAN)
KLLVIYEEF

SEQ ID NO: 165874 - protein, 9 aa, Artificial Sequence
  Description of Artificial Sequence: Synthetic peptide
  Seed: KRKYEAMTK (SSX2_HUMAN)
KAKYEAMTI

SEQ ID NO: 165875 - protein, 10 aa, Artificial Sequence
  Description of Artificial Sequence: Synthetic peptide
  Seed: AQIPEKIQKA (SSX2_HUMAN)
ALIPEKIQKA

SEQ ID NO: 165876 - protein, 8 aa, Artificial Sequence
  Description of Artificial Sequence: Synthetic peptide
  Seed: NQVERPQM (SSX2_HUMAN)
NQVERPQI

SEQ ID NO: 165877 - protein, 9 aa, Artificial Sequence
  Description of Artificial Sequence: Synthetic peptide
  Seed: VGAQIPEKI (SSX2_HUMAN)
VMAQIPEKF

SEQ ID NO: 165878 - protein, 9 aa, Artificial Sequence
  Description of Artificial Sequence: Synthetic peptide
  Seed: RLRERKQLV (SSX2_HUMAN)
RARERKQLA

SEQ ID NO: 165879 - protein, 9 aa, Artificial Sequence
  Description of Artificial Sequence: Synthetic peptide
  Seed: AKYFSKEEW (SSX2_HUMAN)
AQYFSKEEI

SEQ ID NO: 165880 - protein, 10 aa, Artificial Sequence
  Description of Artificial Sequence: Synthetic peptide
  Seed: AFARRPTVGA (SSX2_HUMAN)
ACARRPTVGK

SEQ ID NO: 165881 - protein, 9 aa, Artificial Sequence
  Description of Artificial Sequence: Synthetic peptide
  Seed: AQIPEKIQK (SSX2_HUMAN)
AYIPEKIQY

SEQ ID NO: 165882 - protein, 10 aa, Artificial Sequence
  Description of Artificial Sequence: Synthetic peptide
  Seed: VYMKRKYEAM (SSX2_HUMAN)
VPMKRKYEAV

SEQ ID NO: 165883 - protein, 10 aa, Artificial Sequence
  Description of Artificial Sequence: Synthetic peptide
  Seed: AEEGNDSEEV (SSX2_HUMAN)
AEEGNDSEEF

SEQ ID NO: 165884 - protein, 10 aa, Artificial Sequence
  Description of Artificial Sequence: Synthetic peptide
  Seed: LGFKATLPPF (SSX2_HUMAN)
LKFKATLPPL

SEQ ID NO: 165885 - protein, 9 aa, Artificial Sequence
  Description of Artificial Sequence: Synthetic peptide
  Seed: QVERPQMTF (SSX2_HUMAN)
QTERPQMTF

SEQ ID NO: 165886 - protein, 9 aa, Artificial Sequence
  Description of Artificial Sequence: Synthetic peptide
  Seed: KASEKIFYV (SSX2_HUMAN)
KLSEKIFYR

SEQ ID NO: 165887 - protein, 8 aa, Artificial Sequence
  Description of Artificial Sequence: Synthetic peptide
  Seed: AFDDIAKY (SSX2_HUMAN)
ALDDIAKL

SEQ ID NO: 165888 - protein, 10 aa, Artificial Sequence
  Description of Artificial Sequence: Synthetic peptide
  Seed: MKASEKIFYV (SSX2_HUMAN)
MTASEKIFYI

SEQ ID NO: 165889 - protein, 11 aa, Artificial Sequence
  Description of Artificial Sequence: Synthetic peptide
  Seed: RKYEAMTKLGF (SSX2_HUMAN)
RKYEAMTKLGY

SEQ ID NO: 165890 - protein, 11 aa, Artificial Sequence
  Description of Artificial Sequence: Synthetic peptide
  Seed: AQIPEKIQKAF (SSX2_HUMAN)
ARIPEKIQKAF

SEQ ID NO: 165891 - protein, 9 aa, Artificial Sequence
  Description of Artificial Sequence: Synthetic peptide
  Seed: VGAQIPEKI (SSX2_HUMAN)
VRAQIPEKI

SEQ ID NO: 165892 - protein, 9 aa, Artificial Sequence
  Description of Artificial Sequence: Synthetic peptide
  Seed: GFKATLPPF (SSX2_HUMAN)
GHKATLPPY

SEQ ID NO: 165893 - protein, 9 aa, Artificial Sequence
  Description of Artificial Sequence: Synthetic peptide
  Seed: KQLVIYEEI (SSX2_HUMAN)
KQLVIYEEM

SEQ ID NO: 165894 - protein, 9 aa, Artificial Sequence
  Description of Artificial Sequence: Synthetic peptide
  Seed: KRKYEAMTK (SSX2_HUMAN)
KVKYEAMTK

SEQ ID NO: 165895 - protein, 9 aa, Artificial Sequence
  Description of Artificial Sequence: Synthetic peptide
  Seed: KQLVIYEEI (SSX2_HUMAN)
KRLVIYEEY

SEQ ID NO: 165896 - protein, 9 aa, Artificial Sequence
  Description of Artificial Sequence: Synthetic peptide
  Seed: KIHERSGPK (SSX2_HUMAN)
KQHERSGPR

SEQ ID NO: 165897 - protein, 9 aa, Artificial Sequence
  Description of Artificial Sequence: Synthetic peptide
  Seed: YMKRKYEAM (SSX2_HUMAN)
YKKRKYEAM

SEQ ID NO: 165898 - protein, 9 aa, Artificial Sequence
  Description of Artificial Sequence: Synthetic peptide
  Seed: DAFARRPTV (SSX2_HUMAN)
DLFARRPTI

SEQ ID NO: 165899 - protein, 9 aa, Artificial Sequence
  Description of Artificial Sequence: Synthetic peptide
  Seed: KAFDDIAKY (SSX2_HUMAN)
KHFDDIAKY

SEQ ID NO: 165900 - protein, 9 aa, Artificial Sequence
  Description of Artificial Sequence: Synthetic peptide
  Seed: KASEKIFYV (SSX2_HUMAN)
KGSEKIFYK

SEQ ID NO: 165901 - protein, 9 aa, Artificial Sequence
  Description of Artificial Sequence: Synthetic peptide
  Seed: MTFGRLQGI (SSX2_HUMAN)
MIFGRLQGL

SEQ ID NO: 165902 - protein, 9 aa, Artificial Sequence
  Description of Artificial Sequence: Synthetic peptide
  Seed: KAFDDIAKY (SSX2_HUMAN)
KFFDDIAKR

SEQ ID NO: 165903 - protein, 11 aa, Artificial Sequence
  Description of Artificial Sequence: Synthetic peptide
  Seed: RGEHAWTHRLR (SSX2_HUMAN)
RTEHAWTHRLR

SEQ ID NO: 165904 - protein, 9 aa, Artificial Sequence
  Description of Artificial Sequence: Synthetic peptide
  Seed: MKASEKIFY (SSX2_HUMAN)
MIASEKIFY

SEQ ID NO: 165905 - protein, 9 aa, Artificial Sequence
  Description of Artificial Sequence: Synthetic peptide
  Seed: YFSKEEWEK (SSX2_HUMAN)
YASKEEWEL

SEQ ID NO: 165906 - protein, 11 aa, Artificial Sequence
  Description of Artificial Sequence: Synthetic peptide
  Seed: AQIPEKIQKAF (SSX2_HUMAN)
ALIPEKIQKAY

SEQ ID NO: 165907 - protein, 9 aa, Artificial Sequence
  Description of Artificial Sequence: Synthetic peptide
  Seed: RLQGISPKI (SSX2_HUMAN)
RQQGISPKV

SEQ ID NO: 165908 - protein, 9 aa, Artificial Sequence
  Description of Artificial Sequence: Synthetic peptide
  Seed: KQLVIYEEI (SSX2_HUMAN)
KLLVIYEEM

SEQ ID NO: 165909 - protein, 10 aa, Artificial Sequence
  Description of Artificial Sequence: Synthetic peptide
  Seed: MTKLGFKATL (SSX2_HUMAN)
MVKLGFKATK

SEQ ID NO: 165910 - protein, 9 aa, Artificial Sequence
  Description of Artificial Sequence: Synthetic peptide
  Seed: RPQMTFGRL (SSX2_HUMAN)
RPQMTFGRF

SEQ ID NO: 165911 - protein, 10 aa, Artificial Sequence
  Description of Artificial Sequence: Synthetic peptide
  Seed: AQIPEKIQKA (SSX2_HUMAN)
AMIPEKIQKW

SEQ ID NO: 165912 - protein, 9 aa, Artificial Sequence
  Description of Artificial Sequence: Synthetic peptide
  Seed: MTFGRLQGI (SSX2_HUMAN)
MLFGRLQGI

SEQ ID NO: 165913 - protein, 9 aa, Artificial Sequence
  Description of Artificial Sequence: Synthetic peptide
  Seed: TTSEKIHER (SSX2_HUMAN)
TQSEKIHEF

SEQ ID NO: 165914 - protein, 9 aa, Artificial Sequence
  Description of Artificial Sequence: Synthetic peptide
  Seed: RKYEAMTKL (SSX2_HUMAN)
RQYEAMTKA

SEQ ID NO: 165915 - protein, 8 aa, Artificial Sequence
  Description of Artificial Sequence: Synthetic peptide
  Seed: AFDDIAKY (SSX2_HUMAN)
AYDDIAKF

SEQ ID NO: 165916 - protein, 9 aa, Artificial Sequence
  Description of Artificial Sequence: Synthetic peptide
  Seed: FKATLPPFM (SSX2_HUMAN)
FRATLPPFM

SEQ ID NO: 165917 - protein, 9 aa, Artificial Sequence
  Description of Artificial Sequence: Synthetic peptide
  Seed: DAFARRPTV (SSX2_HUMAN)
DMFARRPTM

SEQ ID NO: 165918 - protein, 9 aa, Artificial Sequence
  Description of Artificial Sequence: Synthetic peptide
  Seed: IFYVYMKRK (SSX2_HUMAN)
ISYVYMKRR

SEQ ID NO: 165919 - protein, 9 aa, Artificial Sequence
  Description of Artificial Sequence: Synthetic peptide
  Seed: RLQGISPKI (SSX2_HUMAN)
RFQGISPKY

SEQ ID NO: 165920 - protein, 9 aa, Artificial Sequence
  Description of Artificial Sequence: Synthetic peptide
  Seed: AMTKLGFKA (SSX2_HUMAN)
AMTKLGFKL

SEQ ID NO: 165921 - protein, 10 aa, Artificial Sequence
  Description of Artificial Sequence: Synthetic peptide
  Seed: EKIFYVYMKR (SSX2_HUMAN)
EDIFYVYMKK

SEQ ID NO: 165922 - protein, 9 aa, Artificial Sequence
  Description of Artificial Sequence: Synthetic peptide
  Seed: QIPEKIQKA (SSX2_HUMAN)
QLPEKIQKV

SEQ ID NO: 165923 - protein, 9 aa, Artificial Sequence
  Description of Artificial Sequence: Synthetic peptide
  Seed: RLQGISPKI (SSX2_HUMAN)
RSQGISPKF

SEQ ID NO: 165924 - protein, 9 aa, Artificial Sequence
  Description of Artificial Sequence: Synthetic peptide
  Seed: RGEHAWTHR (SSX2_HUMAN)
RSEHAWTHR

SEQ ID NO: 165925 - protein, 10 aa, Artificial Sequence
  Description of Artificial Sequence: Synthetic peptide
  Seed: KIFYVYMKRK (SSX2_HUMAN)
KMFYVYMKRR

SEQ ID NO: 165926 - protein, 9 aa, Artificial Sequence
  Description of Artificial Sequence: Synthetic peptide
  Seed: AQIPEKIQK (SSX2_HUMAN)
ASIPEKIQK

SEQ ID NO: 165927 - protein, 9 aa, Artificial Sequence
  Description of Artificial Sequence: Synthetic peptide
  Seed: TTSEKIHER (SSX2_HUMAN)
TTSEKIHEV

SEQ ID NO: 165928 - protein, 10 aa, Artificial Sequence
  Description of Artificial Sequence: Synthetic peptide
  Seed: MNGDDAFARR (SSX2_HUMAN)
MTGDDAFARK

SEQ ID NO: 165929 - protein, 9 aa, Artificial Sequence
  Description of Artificial Sequence: Synthetic peptide
  Seed: VGAQIPEKI (SSX2_HUMAN)
VIAQIPEKM

SEQ ID NO: 165930 - protein, 10 aa, Artificial Sequence
  Description of Artificial Sequence: Synthetic peptide
  Seed: KAFDDIAKYF (SSX2_HUMAN)
KMFDDIAKYR

SEQ ID NO: 165931 - protein, 10 aa, Artificial Sequence
  Description of Artificial Sequence: Synthetic peptide
  Seed: EKIFYVYMKR (SSX2_HUMAN)
EEIFYVYMKK

SEQ ID NO: 165932 - protein, 11 aa, Artificial Sequence
  Description of Artificial Sequence: Synthetic peptide
  Seed: KMKASEKIFYV (SSX2_HUMAN)
KLKASEKIFYI

SEQ ID NO: 165933 - protein, 10 aa, Artificial Sequence
  Description of Artificial Sequence: Synthetic peptide
  Seed: MKASEKIFYV (SSX2_HUMAN)
MYASEKIFYI

SEQ ID NO: 165934 - protein, 9 aa, Artificial Sequence
  Description of Artificial Sequence: Synthetic peptide
  Seed: TTSEKIHER (SSX2_HUMAN)
TFSEKIHEL

SEQ ID NO: 165935 - protein, 9 aa, Artificial Sequence
  Description of Artificial Sequence: Synthetic peptide
  Seed: RLQGISPKI (SSX2_HUMAN)
RMQGISPKW

SEQ ID NO: 165936 - protein, 10 aa, Artificial Sequence
  Description of Artificial Sequence: Synthetic peptide
  Seed: KMKASEKIFY (SSX2_HUMAN)
KAKASEKIFV

SEQ ID NO: 165937 - protein, 9 aa, Artificial Sequence
  Description of Artificial Sequence: Synthetic peptide
  Seed: RKYEAMTKL (SSX2_HUMAN)
REYEAMTKF

SEQ ID NO: 165938 - protein, 9 aa, Artificial Sequence
  Description of Artificial Sequence: Synthetic peptide
  Seed: DAFARRPTV (SSX2_HUMAN)
DPFARRPTA

SEQ ID NO: 165939 - protein, 9 aa, Artificial Sequence
  Description of Artificial Sequence: Synthetic peptide
  Seed: RLQGISPKI (SSX2_HUMAN)
RTQGISPKV

SEQ ID NO: 165940 - protein, 10 aa, Artificial Sequence
  Description of Artificial Sequence: Synthetic peptide
  Seed: KYFSKEEWEK (SSX2_HUMAN)
KYFSKEEWER

SEQ ID NO: 165941 - protein, 9 aa, Artificial Sequence
  Description of Artificial Sequence: Synthetic peptide
  Seed: AFDDIAKYF (SSX2_HUMAN)
AADDIAKYW

SEQ ID NO: 165942 - protein, 10 aa, Artificial Sequence
  Description of Artificial Sequence: Synthetic peptide
  Seed: AQIPEKIQKA (SSX2_HUMAN)
ALIPEKIQKI

SEQ ID NO: 165943 - protein, 9 aa, Artificial Sequence
  Description of Artificial Sequence: Synthetic peptide
  Seed: KAFDDIAKY (SSX2_HUMAN)
KYFDDIAKL

SEQ ID NO: 165944 - protein, 9 aa, Artificial Sequence
  Description of Artificial Sequence: Synthetic peptide
  Seed: MTFGRLQGI (SSX2_HUMAN)
MTFGRLQGR

SEQ ID NO: 165945 - protein, 9 aa, Artificial Sequence
  Description of Artificial Sequence: Synthetic peptide
  Seed: QIPEKIQKA (SSX2_HUMAN)
QQPEKIQKI

SEQ ID NO: 165946 - protein, 8 aa, Artificial Sequence
  Description of Artificial Sequence: Synthetic peptide
  Seed: AFDDIAKY (SSX2_HUMAN)
AADDIAKV

SEQ ID NO: 165947 - protein, 9 aa, Artificial Sequence
  Description of Artificial Sequence: Synthetic peptide
  Seed: SEEVPEASG (SSX2_HUMAN)
SEEVPEASC

SEQ ID NO: 165948 - protein, 10 aa, Artificial Sequence
  Description of Artificial Sequence: Synthetic peptide
  Seed: KASEKIFYVY (SSX2_HUMAN)
KASEKIFYVF

SEQ ID NO: 165949 - protein, 9 aa, Artificial Sequence
  Description of Artificial Sequence: Synthetic peptide
  Seed: MTKLGFKAT (SSX2_HUMAN)
MMKLGFKAK

SEQ ID NO: 165950 - protein, 9 aa, Artificial Sequence
  Description of Artificial Sequence: Synthetic peptide
  Seed: FSKEEWEKM (SSX2_HUMAN)
FRKEEWEKL

SEQ ID NO: 165951 - protein, 8 aa, Artificial Sequence
  Description of Artificial Sequence: Synthetic peptide
  Seed: AFDDIAKY (SSX2_HUMAN)
AWDDIAKF

SEQ ID NO: 165952 - protein, 10 aa, Artificial Sequence
  Description of Artificial Sequence: Synthetic peptide
  Seed: LGFKATLPPF (SSX2_HUMAN)
LIFKATLPPY

SEQ ID NO: 165953 - protein, 10 aa, Artificial Sequence
  Description of Artificial Sequence: Synthetic peptide
  Seed: KAFDDIAKYF (SSX2_HUMAN)
KLFDDIAKYM

SEQ ID NO: 165954 - protein, 9 aa, Artificial Sequence
  Description of Artificial Sequence: Synthetic peptide
  Seed: VGAQIPEKI (SSX2_HUMAN)
VMAQIPEKW

SEQ ID NO: 165955 - protein, 9 aa, Artificial Sequence
  Description of Artificial Sequence: Synthetic peptide
  Seed: SEKIFYVYM (SSX2_HUMAN)
SQKIFYVYF

SEQ ID NO: 165956 - protein, 9 aa, Artificial Sequence
  Description of Artificial Sequence: Synthetic peptide
  Seed: RKYEAMTKL (SSX2_HUMAN)
RVYEAMTKI

SEQ ID NO: 165957 - protein, 9 aa, Artificial Sequence
  Description of Artificial Sequence: Synthetic peptide
  Seed: YMKRKYEAM (SSX2_HUMAN)
YAKRKYEAC

SEQ ID NO: 165958 - protein, 9 aa, Artificial Sequence
  Description of Artificial Sequence: Synthetic peptide
  Seed: RKYEAMTKL (SSX2_HUMAN)
RQYEAMTKH

SEQ ID NO: 165959 - protein, 10 aa, Artificial Sequence
  Description of Artificial Sequence: Synthetic peptide
  Seed: ATLPPFMCNK (SSX2_HUMAN)
AILPPFMCNR

SEQ ID NO: 165960 - protein, 10 aa, Artificial Sequence
  Description of Artificial Sequence: Synthetic peptide
  Seed: MTKLGFKATL (SSX2_HUMAN)
MAKLGFKATW

SEQ ID NO: 165961 - protein, 9 aa, Artificial Sequence
  Description of Artificial Sequence: Synthetic peptide
  Seed: WTHRLRERK (SSX2_HUMAN)
WMHRLRERR

SEQ ID NO: 165962 - protein, 10 aa, Artificial Sequence
  Description of Artificial Sequence: Synthetic peptide
  Seed: KAFDDIAKYF (SSX2_HUMAN)
KNFDDIAKYW

SEQ ID NO: 165963 - protein, 10 aa, Artificial Sequence
  Description of Artificial Sequence: Synthetic peptide
  Seed: KMKASEKIFY (SSX2_HUMAN)
KTKASEKIFI

SEQ ID NO: 165964 - protein, 9 aa, Artificial Sequence
  Description of Artificial Sequence: Synthetic peptide
  Seed: RKYEAMTKL (SSX2_HUMAN)
RDYEAMTKV

SEQ ID NO: 165965 - protein, 9 aa, Artificial Sequence
  Description of Artificial Sequence: Synthetic peptide
  Seed: RKYEAMTKL (SSX2_HUMAN)
RQYEAMTKI

SEQ ID NO: 165966 - protein, 10 aa, Artificial Sequence
  Description of Artificial Sequence: Synthetic peptide
  Seed: DGKELCPPGK (SSX2_HUMAN)
DFKELCPPGR

SEQ ID NO: 165967 - protein, 9 aa, Artificial Sequence
  Description of Artificial Sequence: Synthetic peptide
  Seed: YEAMTKLGF (SSX2_HUMAN)
YQAMTKLGF

SEQ ID NO: 165968 - protein, 9 aa, Artificial Sequence
  Description of Artificial Sequence: Synthetic peptide
  Seed: RLRERKQLV (SSX2_HUMAN)
RMRERKQLS

SEQ ID NO: 165969 - protein, 9 aa, Artificial Sequence
  Description of Artificial Sequence: Synthetic peptide
  Seed: SPKIMPKKP (SSX2_HUMAN)
SPKIMPKKV

SEQ ID NO: 165970 - protein, 9 aa, Artificial Sequence
  Description of Artificial Sequence: Synthetic peptide
  Seed: MTKLGFKAT (SSX2_HUMAN)
MIKLGFKAK

SEQ ID NO: 165971 - protein, 11 aa, Artificial Sequence
  Description of Artificial Sequence: Synthetic peptide
  Seed: MKASEKIFYVY (SSX2_HUMAN)
MQASEKIFYVM

SEQ ID NO: 165972 - protein, 10 aa, Artificial Sequence
  Description of Artificial Sequence: Synthetic peptide
  Seed: GRLQGISPKI (SSX2_HUMAN)
GLLQGISPKL

SEQ ID NO: 165973 - protein, 9 aa, Artificial Sequence
  Description of Artificial Sequence: Synthetic peptide
  Seed: YEAMTKLGF (SSX2_HUMAN)
YQAMTKLGI

SEQ ID NO: 165974 - protein, 9 aa, Artificial Sequence
  Description of Artificial Sequence: Synthetic peptide
  Seed: MTFGRLQGI (SSX2_HUMAN)
MLFGRLQGM

SEQ ID NO: 165975 - protein, 10 aa, Artificial Sequence
  Description of Artificial Sequence: Synthetic peptide
  Seed: AFARRPTVGA (SSX2_HUMAN)
APARRPTVGK

SEQ ID NO: 165976 - protein, 10 aa, Artificial Sequence
  Description of Artificial Sequence: Synthetic peptide
  Seed: QMTFGRLQGI (SSX2_HUMAN)
QRTFGRLQGV

SEQ ID NO: 165977 - protein, 10 aa, Artificial Sequence
  Description of Artificial Sequence: Synthetic peptide
  Seed: KAFDDIAKYF (SSX2_HUMAN)
KSFDDIAKYM

SEQ ID NO: 165978 - protein, 11 aa, Artificial Sequence
  Description of Artificial Sequence: Synthetic peptide
  Seed: YVYMKRKYEAM (SSX2_HUMAN)
YRYMKRKYEAL

SEQ ID NO: 165979 - protein, 8 aa, Artificial Sequence
  Description of Artificial Sequence: Synthetic peptide
  Seed: FDDIAKYF (SSX2_HUMAN)
FFDIAKYV

SEQ ID NO: 165980 - protein, 10 aa, Artificial Sequence
  Description of Artificial Sequence: Synthetic peptide
  Seed: RLRERKQLVI (SSX2_HUMAN)
RTRERKQLVL

SEQ ID NO: 165981 - protein, 9 aa, Artificial Sequence
  Description of Artificial Sequence: Synthetic peptide
  Seed: KASEKIFYV (SSX2_HUMAN)
KLSEKIFYC

SEQ ID NO: 165982 - protein, 9 aa, Artificial Sequence
  Description of Artificial Sequence: Synthetic peptide
  Seed: YMKRKYEAM (SSX2_HUMAN)
YPKRKYEAM

SEQ ID NO: 165983 - protein, 9 aa, Artificial Sequence
  Description of Artificial Sequence: Synthetic peptide
  Seed: MNGDDAFAR (SSX2_HUMAN)
MMGDDAFAR

SEQ ID NO: 165984 - protein, 10 aa, Artificial Sequence
  Description of Artificial Sequence: Synthetic peptide
  Seed: AQIPEKIQKA (SSX2_HUMAN)
AVIPEKIQKY

SEQ ID NO: 165985 - protein, 9 aa, Artificial Sequence
  Description of Artificial Sequence: Synthetic peptide
  Seed: EVPEASGPQ (SSX2_HUMAN)
EMPEASGPR

SEQ ID NO: 165986 - protein, 9 aa, Artificial Sequence
  Description of Artificial Sequence: Synthetic peptide
  Seed: GISPKIMPK (SSX2_HUMAN)
GSSPKIMPK

SEQ ID NO: 165987 - protein, 10 aa, Artificial Sequence
  Description of Artificial Sequence: Synthetic peptide
  Seed: MTKLGFKATL (SSX2_HUMAN)
MGKLGFKATF

SEQ ID NO: 165988 - protein, 9 aa, Artificial Sequence
  Description of Artificial Sequence: Synthetic peptide
  Seed: FARRPTVGA (SSX2_HUMAN)
FSRRPTVGK

SEQ ID NO: 165989 - protein, 10 aa, Artificial Sequence
  Description of Artificial Sequence: Synthetic peptide
  Seed: KMKASEKIFY (SSX2_HUMAN)
KAKASEKIFA

SEQ ID NO: 165990 - protein, 10 aa, Artificial Sequence
  Description of Artificial Sequence: Synthetic peptide
  Seed: MKASEKIFYV (SSX2_HUMAN)
MMASEKIFYC

SEQ ID NO: 165991 - protein, 9 aa, Homo sapiens
  Native (SSX2_HUMAN)
NDSEEVPEA

SEQ ID NO: 165992 - protein, 9 aa, Homo sapiens
  Native (SSX2_HUMAN)
LQGISPKIM

SEQ ID NO: 165993 - protein, 9 aa, Homo sapiens
  Native (SSX2_HUMAN)
NGDDAFARR

SEQ ID NO: 165994 - protein, 10 aa, Homo sapiens
  Native (SSX2_HUMAN)
ERPQMTFGRL

SEQ ID NO: 165995 - protein, 10 aa, Homo sapiens
  Native (SSX2_HUMAN)
FMCNKRAEDF

SEQ ID NO: 165996 - protein, 9 aa, Homo sapiens
  Native (SSX2_HUMAN)
RPTVGAQIP

SEQ ID NO: 165997 - protein, 8 aa, Homo sapiens
  Native (SSX2_HUMAN)
YMKRKYEA

SEQ ID NO: 165998 - protein, 11 aa, Homo sapiens
  Native (SSX2_HUMAN)
NRGNQVERPQM

SEQ ID NO: 165999 - protein, 8 aa, Homo sapiens
  Native (SSX2_HUMAN)
YVYMKRKY

SEQ ID NO: 166000 - protein, 9 aa, Homo sapiens
  Native (SSX2_HUMAN)
EEWEKMKAS

SEQ ID NO: 166001 - protein, 9 aa, Homo sapiens
  Native (SSX2_HUMAN)
YFSKEEWEK

SEQ ID NO: 166002 - protein, 11 aa, Homo sapiens
  Native (SSX2_HUMAN)
WEKMKASEKIF

SEQ ID NO: 166003 - protein, 9 aa, Homo sapiens
  Native (SSX2_HUMAN)
AKYFSKEEW

SEQ ID NO: 166004 - protein, 11 aa, Homo sapiens
  Native (SSX2_HUMAN)
ASGPQNDGKEL

SEQ ID NO: 166005 - protein, 10 aa, Homo sapiens
  Native (SSX2_HUMAN)
KEEWEKMKAS

SEQ ID NO: 166006 - protein, 11 aa, Homo sapiens
  Native (SSX2_HUMAN)
MKASEKIFYVY

SEQ ID NO: 166007 - protein, 10 aa, Homo sapiens
  Native (SSX2_HUMAN)
QMTFGRLQGI

SEQ ID NO: 166008 - protein, 9 aa, Homo sapiens
  Native (SSX2_HUMAN)
HERSGPKRG

SEQ ID NO: 166009 - protein, 10 aa, Homo sapiens
  Native (SSX2_HUMAN)
MTKLGFKATL

SEQ ID NO: 166010 - protein, 10 aa, Homo sapiens
  Native (SSX2_HUMAN)
YVYMKRKYEA

SEQ ID NO: 166011 - protein, 11 aa, Homo sapiens
  Native (SSX2_HUMAN)
HRLRERKQLVI

SEQ ID NO: 166012 - protein, 9 aa, Homo sapiens
  Native (SSX2_HUMAN)
QIPEKIQKA

SEQ ID NO: 166013 - protein, 11 aa, Homo sapiens
  Native (SSX2_HUMAN)
EKMKASEKIFY

SEQ ID NO: 166014 - protein, 10 aa, Homo sapiens
  Native (SSX2_HUMAN)
EEGNDSEEVP

SEQ ID NO: 166015 - protein, 9 aa, Homo sapiens
  Native (SSX2_HUMAN)
SEKIFYVYM

SEQ ID NO: 166016 - protein, 11 aa, Homo sapiens
  Native (SSX2_HUMAN)
KELCPPGKPTT

SEQ ID NO: 166017 - protein, 10 aa, Homo sapiens
  Native (SSX2_HUMAN)
RLRERKQLVI

SEQ ID NO: 166018 - protein, 10 aa, Homo sapiens
  Native (SSX2_HUMAN)
RPQMTFGRLQ

SEQ ID NO: 166019 - protein, 8 aa, Homo sapiens
  Native (SSX2_HUMAN)
ERKQLVIY

SEQ ID NO: 166020 - protein, 8 aa, Homo sapiens
  Native (SSX2_HUMAN)
KIFYVYMK

SEQ ID NO: 166021 - protein, 11 aa, Homo sapiens
  Native (SSX2_HUMAN)
KASEKIFYVYM

SEQ ID NO: 166022 - protein, 10 aa, Homo sapiens
  Native (SSX2_HUMAN)
HRLRERKQLV

SEQ ID NO: 166023 - protein, 10 aa, Homo sapiens
  Native (SSX2_HUMAN)
KYFSKEEWEK

SEQ ID NO: 166024 - protein, 9 aa, Homo sapiens
  Native (SSX2_HUMAN)
QVERPQMTF

SEQ ID NO: 166025 - protein, 11 aa, Homo sapiens
  Native (SSX2_HUMAN)
YMKRKYEAMTK

SEQ ID NO: 166026 - protein, 10 aa, Homo sapiens
  Native (SSX2_HUMAN)
YEAMTKLGFK

SEQ ID NO: 166027 - protein, 11 aa, Homo sapiens
  Native (SSX2_HUMAN)
ERSGPKRGEHA

SEQ ID NO: 166028 - protein, 10 aa, Homo sapiens
  Native (SSX2_HUMAN)
MKRKYEAMTK

SEQ ID NO: 166029 - protein, 11 aa, Homo sapiens
  Native (SSX2_HUMAN)
RGEHAWTHRLR

SEQ ID NO: 166030 - protein, 10 aa, Homo sapiens
  Native (SSX2_HUMAN)
EKIFYVYMKR

SEQ ID NO: 166031 - protein, 9 aa, Homo sapiens
  Native (SSX2_HUMAN)
SEEVPEASG

SEQ ID NO: 166032 - protein, 10 aa, Homo sapiens
  Native (SSX2_HUMAN)
RGEHAWTHRL

SEQ ID NO: 166033 - protein, 11 aa, Homo sapiens
  Native (SSX2_HUMAN)
IQKAFDDIAKY

SEQ ID NO: 166034 - protein, 9 aa, Homo sapiens
  Native (SSX2_HUMAN)
AQIPEKIQK

SEQ ID NO: 166035 - protein, 10 aa, Homo sapiens
  Native (SSX2_HUMAN)
TLPPFMCNKR

SEQ ID NO: 166036 - protein, 9 aa, Homo sapiens
  Native (SSX2_HUMAN)
NDLDNDPNR

SEQ ID NO: 166037 - protein, 9 aa, Homo sapiens
  Native (SSX2_HUMAN)
GFKATLPPF

SEQ ID NO: 166038 - protein, 11 aa, Homo sapiens
  Native (SSX2_HUMAN)
QGNDLDNDPNR

SEQ ID NO: 166039 - protein, 8 aa, Homo sapiens
  Native (SSX2_HUMAN)
VGAQIPEK

SEQ ID NO: 166040 - protein, 10 aa, Homo sapiens
  Native (SSX2_HUMAN)
FGRLQGISPK

SEQ ID NO: 166041 - protein, 9 aa, Homo sapiens
  Native (SSX2_HUMAN)
EEVPEASGP

SEQ ID NO: 166042 - protein, 8 aa, Homo sapiens
  Native (SSX2_HUMAN)
IPEKIQKA

SEQ ID NO: 166043 - protein, 9 aa, Homo sapiens
  Native (SSX2_HUMAN)
NQVERPQMT

SEQ ID NO: 166044 - protein, 10 aa, Homo sapiens
  Native (SSX2_HUMAN)
ASEKIFYVYM

SEQ ID NO: 166045 - protein, 10 aa, Homo sapiens
  Native (SSX2_HUMAN)
RAEDFQGNDL

SEQ ID NO: 166046 - protein, 10 aa, Homo sapiens
  Native (SSX2_HUMAN)
GISPKIMPKK

SEQ ID NO: 166047 - protein, 10 aa, Homo sapiens
  Native (SSX2_HUMAN)
RLQGISPKIM

SEQ ID NO: 166048 - protein, 9 aa, Homo sapiens
  Native (SSX2_HUMAN)
CPPGKPTTS

SEQ ID NO: 166049 - protein, 10 aa, Homo sapiens
  Native (SSX2_HUMAN)
QKAFDDIAKY

SEQ ID NO: 166050 - protein, 10 aa, Homo sapiens
  Native (SSX2_HUMAN)
VYMKRKYEAM

SEQ ID NO: 166051 - protein, 10 aa, Homo sapiens
  Native (SSX2_HUMAN)
PTTSEKIHER

SEQ ID NO: 166052 - protein, 9 aa, Homo sapiens
  Native (SSX2_HUMAN)
EHAWTHRLR

SEQ ID NO: 166053 - protein, 10 aa, Homo sapiens
  Native (SSX2_HUMAN)
EASGPQNDGK

SEQ ID NO: 166054 - protein, 11 aa, Homo sapiens
  Native (SSX2_HUMAN)
FARRPTVGAQI

SEQ ID NO: 166055 - protein, 9 aa, Homo sapiens
  Native (SSX2_HUMAN)
MPKKPAEEG

SEQ ID NO: 166056 - protein, 8 aa, Homo sapiens
  Native (SSX2_HUMAN)
SEKIFYVY

SEQ ID NO: 166057 - protein, 10 aa, Homo sapiens
  Native (SSX2_HUMAN)
ARRPTVGAQI

SEQ ID NO: 166058 - protein, 9 aa, Homo sapiens
  Native (SSX2_HUMAN)
VGAQIPEKI

SEQ ID NO: 166059 - protein, 11 aa, Homo sapiens
  Native (SSX2_HUMAN)
VERPQMTFGRL

SEQ ID NO: 166060 - protein, 8 aa, Homo sapiens
  Native (SSX2_HUMAN)
QLVIYEEI

SEQ ID NO: 166061 - protein, 10 aa, Homo sapiens
  Native (SSX2_HUMAN)
KASEKIFYVY

SEQ ID NO: 166062 - protein, 9 aa, Homo sapiens
  Native (SSX2_HUMAN)
AEDFQGNDL

SEQ ID NO: 166063 - protein, 10 aa, Homo sapiens
  Native (SSX2_HUMAN)
MKASEKIFYV

SEQ ID NO: 166064 - protein, 11 aa, Homo sapiens
  Native (SSX2_HUMAN)
SEKIFYVYMKR

SEQ ID NO: 166065 - protein, 9 aa, Homo sapiens
  Native (SSX2_HUMAN)
GPQNDGKEL

SEQ ID NO: 166066 - protein, 11 aa, Homo sapiens
  Native (SSX2_HUMAN)
YVYMKRKYEAM

SEQ ID NO: 166067 - protein, 8 aa, Homo sapiens
  Native (SSX2_HUMAN)
KYEAMTKL

SEQ ID NO: 166068 - protein, 8 aa, Homo sapiens
  Native (SSX2_HUMAN)
IFYVYMKR

SEQ ID NO: 166069 - protein, 9 aa, Homo sapiens
  Native (SSX2_HUMAN)
SPKIMPKKP

SEQ ID NO: 166070 - protein, 8 aa, Homo sapiens
  Native (SSX2_HUMAN)
EHAWTHRL

SEQ ID NO: 166071 - protein, 8 aa, Homo sapiens
  Native (SSX2_HUMAN)
AFDDIAKY

SEQ ID NO: 166072 - protein, 10 aa, Homo sapiens
  Native (SSX2_HUMAN)
AWTHRLRERK

SEQ ID NO: 166073 - protein, 8 aa, Homo sapiens
  Native (SSX2_HUMAN)
LQGISPKI

SEQ ID NO: 166074 - protein, 11 aa, Homo sapiens
  Native (SSX2_HUMAN)
KATLPPFMCNK

SEQ ID NO: 166075 - protein, 9 aa, Homo sapiens
  Native (SSX2_HUMAN)
EEGNDSEEV

SEQ ID NO: 166076 - protein, 11 aa, Homo sapiens
  Native (SSX2_HUMAN)
KLGFKATLPPF

SEQ ID NO: 166077 - protein, 8 aa, Homo sapiens
  Native (SSX2_HUMAN)
AFARRPTV

SEQ ID NO: 166078 - protein, 9 aa, Homo sapiens
  Native (SSX2_HUMAN)
EVPEASGPQ

SEQ ID NO: 166079 - protein, 9 aa, Homo sapiens
  Native (SSX2_HUMAN)
SEKIHERSG

SEQ ID NO: 166080 - protein, 9 aa, Homo sapiens
  Native (SSX2_HUMAN)
WTHRLRERK

SEQ ID NO: 166081 - protein, 8 aa, Homo sapiens
  Native (SSX2_HUMAN)
FSKEEWEK

SEQ ID NO: 166082 - protein, 11 aa, Homo sapiens
  Native (SSX2_HUMAN)
ARRPTVGAQIP

SEQ ID NO: 166083 - protein, 11 aa, Homo sapiens
  Native (SSX2_HUMAN)
KRGEHAWTHRL

SEQ ID NO: 166084 - protein, 9 aa, Homo sapiens
  Native (SSX2_HUMAN)
DDIAKYFSK

SEQ ID NO: 166085 - protein, 8 aa, Homo sapiens
  Native (SSX2_HUMAN)
KAFDDIAK

SEQ ID NO: 166086 - protein, 9 aa, Homo sapiens
  Native (SSX2_HUMAN)
RLRERKQLV

SEQ ID NO: 166087 - protein, 9 aa, Homo sapiens
  Native (SSX2_HUMAN)
KELCPPGKP

SEQ ID NO: 166088 - protein, 9 aa, Homo sapiens
  Native (SSX2_HUMAN)
MNGDDAFAR

SEQ ID NO: 166089 - protein, 8 aa, Homo sapiens
  Native (SSX2_HUMAN)
RLRERKQL

SEQ ID NO: 166090 - protein, 9 aa, Homo sapiens
  Native (SSX2_HUMAN)
ARRPTVGAQ

SEQ ID NO: 166091 - protein, 9 aa, Homo sapiens
  Native (SSX2_HUMAN)
GPKRGEHAW

SEQ ID NO: 166092 - protein, 8 aa, Homo sapiens
  Native (SSX2_HUMAN)
QIPEKIQK

SEQ ID NO: 166093 - protein, 8 aa, Homo sapiens
  Native (SSX2_HUMAN)
RPTVGAQI

SEQ ID NO: 166094 - protein, 8 aa, Homo sapiens
  Native (SSX2_HUMAN)
GPKRGEHA

SEQ ID NO: 166095 - protein, 10 aa, Homo sapiens
  Native (SSX2_HUMAN)
MNGDDAFARR

SEQ ID NO: 166096 - protein, 11 aa, Homo sapiens
  Native (SSX2_HUMAN)
KMKASEKIFYV

SEQ ID NO: 166097 - protein, 10 aa, Homo sapiens
  Native (SSX2_HUMAN)
KMKASEKIFY

SEQ ID NO: 166098 - protein, 9 aa, Homo sapiens
  Native (SSX2_HUMAN)
AFDDIAKYF

SEQ ID NO: 166099 - protein, 10 aa, Homo sapiens
  Native (SSX2_HUMAN)
QIPEKIQKAF

SEQ ID NO: 166100 - protein, 9 aa, Homo sapiens
  Native (SSX2_HUMAN)
HRLRERKQL

SEQ ID NO: 166101 - protein, 9 aa, Homo sapiens
  Native (SSX2_HUMAN)
KATLPPFMC

SEQ ID NO: 166102 - protein, 8 aa, Homo sapiens
  Native (SSX2_HUMAN)
KYFSKEEW

SEQ ID NO: 166103 - protein, 10 aa, Homo sapiens
  Native (SSX2_HUMAN)
KAFDDIAKYF

SEQ ID NO: 166104 - protein, 11 aa, Homo sapiens
  Native (SSX2_HUMAN)
KIFYVYMKRKY

SEQ ID NO: 166105 - protein, 9 aa, Homo sapiens
  Native (SSX2_HUMAN)
KRKYEAMTK

SEQ ID NO: 166106 - protein, 11 aa, Homo sapiens
  Native (SSX2_HUMAN)
RLRERKQLVIY

SEQ ID NO: 166107 - protein, 8 aa, Homo sapiens
  Native (SSX2_HUMAN)
RLQGISPK

SEQ ID NO: 166108 - protein, 11 aa, Homo sapiens
  Native (SSX2_HUMAN)
ATLPPFMCNKR

SEQ ID NO: 166109 - protein, 11 aa, Homo sapiens
  Native (SSX2_HUMAN)
LDNDPNRGNQV

SEQ ID NO: 166110 - protein, 8 aa, Homo sapiens
  Native (SSX2_HUMAN)
TSEKIHER

SEQ ID NO: 166111 - protein, 8 aa, Homo sapiens
  Native (SSX2_HUMAN)
DIAKYFSK

SEQ ID NO: 166112 - protein, 10 aa, Homo sapiens
  Native (SSX2_HUMAN)
IQKAFDDIAK

SEQ ID NO: 166113 - protein, 11 aa, Homo sapiens
  Native (SSX2_HUMAN)
KYFSKEEWEKM

SEQ ID NO: 166114 - protein, 11 aa, Homo sapiens
  Native (SSX2_HUMAN)
EKIFYVYMKRK

SEQ ID NO: 166115 - protein, 8 aa, Homo sapiens
  Native (SSX2_HUMAN)
DPNRGNQV

SEQ ID NO: 166116 - protein, 10 aa, Homo sapiens
  Native (SSX2_HUMAN)
KYEAMTKLGF

SEQ ID NO: 166117 - protein, 11 aa, Homo sapiens
  Native (SSX2_HUMAN)
QGISPKIMPKK

SEQ ID NO: 166118 - protein, 10 aa, Homo sapiens
  Native (SSX2_HUMAN)
SPKIMPKKPA

SEQ ID NO: 166119 - protein, 11 aa, Homo sapiens
  Native (SSX2_HUMAN)
VGAQIPEKIQK

SEQ ID NO: 166120 - protein, 9 aa, Homo sapiens
  Native (SSX2_HUMAN)
NDPNRGNQV

SEQ ID NO: 166121 - protein, 8 aa, Homo sapiens
  Native (SSX2_HUMAN)
KATLPPFM

SEQ ID NO: 166122 - protein, 9 aa, Homo sapiens
  Native (SSX2_HUMAN)
MTKLGFKAT

SEQ ID NO: 166123 - protein, 10 aa, Homo sapiens
  Native (SSX2_HUMAN)
SEEVPEASGP

SEQ ID NO: 166124 - protein, 9 aa, Homo sapiens
  Native (SSX2_HUMAN)
RGEHAWTHR

SEQ ID NO: 166125 - protein, 10 aa, Homo sapiens
  Native (SSX2_HUMAN)
DGKELCPPGK

SEQ ID NO: 166126 - protein, 10 aa, Homo sapiens
  Native (SSX2_HUMAN)
QGISPKIMPK

SEQ ID NO: 166127 - protein, 10 aa, Homo sapiens
  Native (SSX2_HUMAN)
KIFYVYMKRK

SEQ ID NO: 166128 - protein, 10 aa, Homo sapiens
  Native (SSX2_HUMAN)
AFARRPTVGA

SEQ ID NO: 166129 - protein, 11 aa, Homo sapiens
  Native (SSX2_HUMAN)
RKYEAMTKLGF

SEQ ID NO: 166130 - protein, 10 aa, Homo sapiens
  Native (SSX2_HUMAN)
KRGEHAWTHR

SEQ ID NO: 166131 - protein, 9 aa, Homo sapiens
  Native (SSX2_HUMAN)
VYMKRKYEA

SEQ ID NO: 166132 - protein, 10 aa, Homo sapiens
  Native (SSX2_HUMAN)
KELCPPGKPT

SEQ ID NO: 166133 - protein, 9 aa, Homo sapiens
  Native (SSX2_HUMAN)
RRPTVGAQI

SEQ ID NO: 166134 - protein, 10 aa, Homo sapiens
  Native (SSX2_HUMAN)
SGPKRGEHAW

SEQ ID NO: 166135 - protein, 11 aa, Homo sapiens
  Native (SSX2_HUMAN)
LQGISPKIMPK

SEQ ID NO: 166136 - protein, 8 aa, Homo sapiens
  Native (SSX2_HUMAN)
NQVERPQM

SEQ ID NO: 166137 - protein, 10 aa, Homo sapiens
  Native (SSX2_HUMAN)
SEKIHERSGP

SEQ ID NO: 166138 - protein, 8 aa, Homo sapiens
  Native (SSX2_HUMAN)
IQKAFDDI

SEQ ID NO: 166139 - protein, 8 aa, Homo sapiens
  Native (SSX2_HUMAN)
KASEKIFY

SEQ ID NO: 166140 - protein, 11 aa, Homo sapiens
  Native (SSX2_HUMAN)
AEEGNDSEEVP

SEQ ID NO: 166141 - protein, 9 aa, Homo sapiens
  Native (SSX2_HUMAN)
FARRPTVGA

SEQ ID NO: 166142 - protein, 11 aa, Homo sapiens
  Native (SSX2_HUMAN)
FGRLQGISPKI

SEQ ID NO: 166143 - protein, 9 aa, Homo sapiens
  Native (SSX2_HUMAN)
KIQKAFDDI

SEQ ID NO: 166144 - protein, 9 aa, Homo sapiens
  Native (SSX2_HUMAN)
IQKAFDDIA

SEQ ID NO: 166145 - protein, 10 aa, Homo sapiens
  Native (SSX2_HUMAN)
LGFKATLPPF

SEQ ID NO: 166146 - protein, 11 aa, Homo sapiens
  Native (SSX2_HUMAN)
KRAEDFQGNDL

SEQ ID NO: 166147 - protein, 10 aa, Homo sapiens
  Native (SSX2_HUMAN)
RKQLVIYEEI

SEQ ID NO: 166148 - protein, 10 aa, Homo sapiens
  Native (SSX2_HUMAN)
FSKEEWEKMK

SEQ ID NO: 166149 - protein, 8 aa, Homo sapiens
  Native (SSX2_HUMAN)
GAQIPEKI

SEQ ID NO: 166150 - protein, 9 aa, Homo sapiens
  Native (SSX2_HUMAN)
IFYVYMKRK

SEQ ID NO: 166151 - protein, 9 aa, Homo sapiens
  Native (SSX2_HUMAN)
EKMKASEKI

SEQ ID NO: 166152 - protein, 8 aa, Homo sapiens
  Native (SSX2_HUMAN)
MKRKYEAM

SEQ ID NO: 166153 - protein, 8 aa, Homo sapiens
  Native (SSX2_HUMAN)
EDFQGNDL

SEQ ID NO: 166154 - protein, 9 aa, Homo sapiens
  Native (SSX2_HUMAN)
RSGPKRGEH

SEQ ID NO: 166155 - protein, 9 aa, Homo sapiens
  Native (SSX2_HUMAN)
ASGPQNDGK

SEQ ID NO: 166156 - protein, 11 aa, Homo sapiens
  Native (SSX2_HUMAN)
AMTKLGFKATL

SEQ ID NO: 166157 - protein, 8 aa, Homo sapiens
  Native (SSX2_HUMAN)
MKASEKIF

SEQ ID NO: 166158 - protein, 8 aa, Homo sapiens
  Native (SSX2_HUMAN)
FDDIAKYF

SEQ ID NO: 166159 - protein, 9 aa, Homo sapiens
  Native (SSX2_HUMAN)
AWTHRLRER

SEQ ID NO: 166160 - protein, 9 aa, Homo sapiens
  Native (SSX2_HUMAN)
MKASEKIFY

SEQ ID NO: 166161 - protein, 8 aa, Homo sapiens
  Native (SSX2_HUMAN)
VERPQMTF

SEQ ID NO: 166162 - protein, 11 aa, Homo sapiens
  Native (SSX2_HUMAN)
ASEKIFYVYMK

SEQ ID NO: 166163 - protein, 8 aa, Homo sapiens
  Native (SSX2_HUMAN)
SEEVPEAS

SEQ ID NO: 166164 - protein, 10 aa, Homo sapiens
  Native (SSX2_HUMAN)
PTVGAQIPEK

SEQ ID NO: 166165 - protein, 8 aa, Homo sapiens
  Native (SSX2_HUMAN)
ISPKIMPK

SEQ ID NO: 166166 - protein, 9 aa, Homo sapiens
  Native (SSX2_HUMAN)
MCNKRAEDF

SEQ ID NO: 166167 - protein, 9 aa, Homo sapiens
  Native (SSX2_HUMAN)
VERPQMTFG

SEQ ID NO: 166168 - protein, 8 aa, Homo sapiens
  Native (SSX2_HUMAN)
EEWEKMKA

SEQ ID NO: 166169 - protein, 8 aa, Homo sapiens
  Native (SSX2_HUMAN)
NGDDAFAR

SEQ ID NO: 166170 - protein, 10 aa, Homo sapiens
  Native (SSX2_HUMAN)
AQIPEKIQKA

SEQ ID NO: 166171 - protein, 11 aa, Homo sapiens
  Native (SSX2_HUMAN)
YEAMTKLGFKA

SEQ ID NO: 166172 - protein, 10 aa, Homo sapiens
  Native (SSX2_HUMAN)
GRLQGISPKI

SEQ ID NO: 166173 - protein, 10 aa, Homo sapiens
  Native (SSX2_HUMAN)
GAQIPEKIQK

SEQ ID NO: 166174 - protein, 10 aa, Homo sapiens
  Native (SSX2_HUMAN)
LPPFMCNKRA

SEQ ID NO: 166175 - protein, 10 aa, Homo sapiens
  Native (SSX2_HUMAN)
KIHERSGPKR

SEQ ID NO: 166176 - protein, 9 aa, Homo sapiens
  Native (SSX2_HUMAN)
ASEKIFYVY

SEQ ID NO: 166177 - protein, 9 aa, Homo sapiens
  Native (SSX2_HUMAN)
LRERKQLVI

SEQ ID NO: 166178 - protein, 11 aa, Homo sapiens
  Native (SSX2_HUMAN)
KPTTSEKIHER

SEQ ID NO: 166179 - protein, 11 aa, Homo sapiens
  Native (SSX2_HUMAN)
KYEAMTKLGFK

SEQ ID NO: 166180 - protein, 10 aa, Homo sapiens
  Native (SSX2_HUMAN)
WEKMKASEKI

SEQ ID NO: 166181 - protein, 10 aa, Homo sapiens
  Native (SSX2_HUMAN)
MTFGRLQGIS

SEQ ID NO: 166182 - protein, 10 aa, Homo sapiens
  Native (SSX2_HUMAN)
YMKRKYEAMT

SEQ ID NO: 166183 - protein, 9 aa, Homo sapiens
  Native (SSX2_HUMAN)
LPPFMCNKR

SEQ ID NO: 166184 - protein, 11 aa, Homo sapiens
  Native (SSX2_HUMAN)
AQIPEKIQKAF

SEQ ID NO: 166185 - protein, 11 aa, Homo sapiens
  Native (SSX2_HUMAN)
QVERPQMTFGR

SEQ ID NO: 166186 - protein, 10 aa, Homo sapiens
  Native (SSX2_HUMAN)
YFSKEEWEKM

SEQ ID NO: 166187 - protein, 8 aa, Homo sapiens
  Native (SSX2_HUMAN)
HAWTHRLR

SEQ ID NO: 166188 - protein, 9 aa, Homo sapiens
  Native (SSX2_HUMAN)
KRGEHAWTH

SEQ ID NO: 166189 - protein, 10 aa, Homo sapiens
  Native (SSX2_HUMAN)
SGPQNDGKEL

SEQ ID NO: 166190 - protein, 9 aa, Homo sapiens
  Native (SSX2_HUMAN)
TKLGFKATL

SEQ ID NO: 166191 - protein, 10 aa, Homo sapiens
  Native (SSX2_HUMAN)
LRERKQLVIY

SEQ ID NO: 166192 - protein, 9 aa, Homo sapiens
  Native (SSX2_HUMAN)
GRLQGISPK

SEQ ID NO: 166193 - protein, 11 aa, Homo sapiens
  Native (SSX2_HUMAN)
GRLQGISPKIM

SEQ ID NO: 166194 - protein, 10 aa, Homo sapiens
  Native (SSX2_HUMAN)
IFYVYMKRKY

SEQ ID NO: 166195 - protein, 8 aa, Homo sapiens
  Native (SSX2_HUMAN)
RERKQLVI

SEQ ID NO: 166196 - protein, 9 aa, Homo sapiens
  Native (SSX2_HUMAN)
ERPQMTFGR

SEQ ID NO: 166197 - protein, 9 aa, Homo sapiens
  Native (SSX2_HUMAN)
ISPKIMPKK

SEQ ID NO: 166198 - protein, 9 aa, Homo sapiens
  Native (SSX2_HUMAN)
FKATLPPFM

SEQ ID NO: 166199 - protein, 11 aa, Homo sapiens
  Native (SSX2_HUMAN)
KIQKAFDDIAK

SEQ ID NO: 166200 - protein, 11 aa, Homo sapiens
  Native (SSX2_HUMAN)
AFDDIAKYFSK

SEQ ID NO: 166201 - protein, 9 aa, Artificial Sequence
  Description of Artificial Sequence: Synthetic peptide
  Seed: AEDFQGNDL (SSX2_HUMAN)
  misc_feature (2)..(2): Xaa can be Glu, Ala, Ser, Thr, Val, Ile, Tyr, Leu, Gly, Gln, Phe, Met, Asn, Trp, Cys, Pro, Arg, Asp, His, or Lys
  misc_feature (9)..(9): Xaa can be Leu, Phe, Met, Val, Ile, Tyr, Trp, Cys, Ala, Thr, Ser, Gly, or Pro
AXDFQGNDX

SEQ ID NO: 166202 - protein, 10 aa, Artificial Sequence
  Description of Artificial Sequence: Synthetic peptide
  Seed: AEEGNDSEEV (SSX2_HUMAN)
  misc_feature (2)..(2): Xaa can be Glu, Gln, Asp, Asn, Leu, Ser, Lys, His, Met, Thr, Arg, Val, Ile, or Ala
  misc_feature (10)..(10): Xaa can be Trp, Ile, Leu, Phe, Met, Tyr, Val, Ala, Cys, Thr, Glu, Gly, Arg, His, Gln, Pro, Lys, or Se r
AXEGNDSEEX

SEQ ID NO: 166203 - protein, 11 aa, Artificial Sequence
  Description of Artificial Sequence: Synthetic peptide
  Seed: AEEGNDSEEVP (SSX2_HUMAN)
  misc_feature (2)..(2): Xaa can be Glu, Gln, or Asp
  misc_feature (11)..(11): Xaa can be Cys, Leu, Ala, Met, Ile, Val, Phe, Asn, His, Gly, Glu, Arg, Tyr, Ser, Thr, Pro, Gln, Lys, or Trp
AXEGNDSEEVX

SEQ ID NO: 166204 - protein, 8 aa, Artificial Sequence
  Description of Artificial Sequence: Synthetic peptide
  Seed: AFARRPTV (SSX2_HUMAN)
  misc_feature (2)..(2): Xaa can be Phe, Tyr, or Trp
  misc_feature (8)..(8): Xaa can be Met, Tyr, Leu, Phe, Val, or Ile
AXARRPTX

SEQ ID NO: 166205 - protein, 10 aa, Artificial Sequence
  Description of Artificial Sequence: Synthetic peptide
  Seed: AFARRPTVGA (SSX2_HUMAN)
  misc_feature (2)..(2): Xaa can be Thr, Ser, Tyr, Val, Phe, Met, Trp, Gln, Arg, Lys, Ile, Leu, Gly, Ala, Cys, His, Asn, Pro, Glu, or Asp
  misc_feature (10)..(10): Xaa can be Leu, Lys, Tyr, Ile, Ala, Val, Arg, Met, Ser, Gly, Thr, Cys, Pro, or Phe
AXARRPTVGX

SEQ ID NO: 166206 - protein, 8 aa, Artificial Sequence
  Description of Artificial Sequence: Synthetic peptide
  Seed: AFDDIAKY (SSX2_HUMAN)
  misc_feature (2)..(2): Xaa can be Ala, Phe, Tyr, Thr, Ser, Ile, Val, Leu, Gln, Gly, Asn, Cys, Asp, Met, Trp, Arg, Pro, Glu, His, or Lys
  misc_feature (8)..(8): Xaa can be Leu, Phe, Met, Tyr, Ile, Val, Lys, Arg, His, Trp, Ala, Cys, or Thr
AXDDIAKX

SEQ ID NO: 166207 - protein, 9 aa, Artificial Sequence
  Description of Artificial Sequence: Synthetic peptide
  Seed: AFDDIAKYF (SSX2_HUMAN)
  misc_feature (2)..(2): Xaa can be Ala, Tyr, Phe, Thr, Ser, Val, Leu, Ile, Met, Cys, Gln, Gly, Arg, Trp, Asn, Glu, Pro, His, Asp, or Lys
  misc_feature (9)..(9): Xaa can be Trp, Lys, Met, Val, Tyr, Ile, Leu, Phe, Cys, Arg, Ala, Thr, His, Gln, Ser, Pro, Gly, Glu, or Asn
AXDDIAKYX

SEQ ID NO: 166208 - protein, 11 aa, Artificial Sequence
  Description of Artificial Sequence: Synthetic peptide
  Seed: AFDDIAKYFSK (SSX2_HUMAN)
  misc_feature (2)..(2): Xaa can be Thr, Ser, Ala, Met, Val, Ile, Gly, Phe, Leu, Cys, Tyr, Gln, Asn, Trp, Asp, Glu, Pro, or Ly s
  misc_feature (11)..(11): Xaa can be Tyr, Lys, Arg, Phe, His, Met, Leu, Trp, Gln, Ile, Val, Glu, Thr, or Asn
AXDDIAKYFSX

SEQ ID NO: 166209 - protein, 9 aa, Artificial Sequence
  Description of Artificial Sequence: Synthetic peptide
  Seed: AKYFSKEEW (SSX2_HUMAN)
  misc_feature (2)..(2): Xaa can be Glu, Gln, Lys, Ile, Leu, Met, Ala, Asp, Asn, Ser, Thr, Arg, His, Val, Gly, Pro, Tyr, Phe, Cys, or Trp
  misc_feature (9)..(9): Xaa can be Tyr, Phe, Trp, Leu, Ile, Met, Val, His, Cys, Ala, Thr, Arg, Lys, or Gln
AXYFSKEEX

SEQ ID NO: 166210 - protein, 9 aa, Artificial Sequence
  Description of Artificial Sequence: Synthetic peptide
  Seed: AMTKLGFKA (SSX2_HUMAN)
  misc_feature (2)..(2): Xaa can be Gln, Met, Leu, Val, Ile, Glu, Thr, Ser, Ala, Gly, or Asn
  misc_feature (9)..(9): Xaa can be Val, Ile, Leu, Met, Ala, Phe, Thr, Cys, or Trp
AXTKLGFKX

SEQ ID NO: 166211 - protein, 11 aa, Artificial Sequence
  Description of Artificial Sequence: Synthetic peptide
  Seed: AMTKLGFKATL (SSX2_HUMAN)
  misc_feature (2)..(2): Xaa can be Leu, Met, or Ile
  misc_feature (11)..(11): Xaa can be Val, Ile, or Leu
AXTKLGFKATX

SEQ ID NO: 166212 - protein, 9 aa, Artificial Sequence
  Description of Artificial Sequence: Synthetic peptide
  Seed: AQIPEKIQK (SSX2_HUMAN)
  misc_feature (2)..(2): Xaa can be Arg, Ala, Gln, Glu, Tyr, Thr, Ser, Val, Lys, Ile, Leu, Gly, Met, His, Asn, Phe, Asp, Cys, Trp, or Pro
  misc_feature (9)..(9): Xaa can be Met, Phe, Tyr, Lys, Arg, Leu, Ile, Val, His, Trp, Ala, Gln, Cys, Thr, Ser, Gly, Asn, Glu, or Pro
AXIPEKIQX

SEQ ID NO: 166213 - protein, 10 aa, Artificial Sequence
  Description of Artificial Sequence: Synthetic peptide
  Seed: AQIPEKIQKA (SSX2_HUMAN)
  misc_feature (2)..(2): Xaa can be Glu, Gln, His, Asp, Arg, Met, Ile, Val, Leu, Ser, Lys, Ala, Thr, Gly, Asn, Phe, Tyr, Pro, Trp, or Cys
  misc_feature (10)..(10): Xaa can be Tyr, Phe, Leu, Val, Met, Trp, Ile, Ala, Thr, Cys, Pro, Gly, His, Lys, Ser, Arg, Glu, Gln, Asp, or Asn
AXIPEKIQKX

SEQ ID NO: 166214 - protein, 11 aa, Artificial Sequence
  Description of Artificial Sequence: Synthetic peptide
  Seed: AQIPEKIQKAF (SSX2_HUMAN)
  misc_feature (2)..(2): Xaa can be Arg, Glu, Gln, Ala, Ile, Asp, Leu, Met, Thr, Lys, Ser, Val, Gly, His, Phe, Tyr, Asn, Cys, Pro, or Trp
  misc_feature (11)..(11): Xaa can be Tyr, Phe, Leu, Trp, Met, Ile, His, Val, Lys, Ala, Arg, Cys, Gln, Gly, Ser, Pro, Thr, Asn, or Glu
AXIPEKIQKAX

SEQ ID NO: 166215 - protein, 9 aa, Artificial Sequence
  Description of Artificial Sequence: Synthetic peptide
  Seed: ARRPTVGAQ (SSX2_HUMAN)
  misc_feature (2)..(2): Xaa can be Arg, Gln, or Gly
  misc_feature (9)..(9): Xaa can be Leu, Arg, Phe, Lys, Tyr, Ile, Ala, Gln, Cys, Val, His, Met, or Trp
AXRPTVGAX

SEQ ID NO: 166216 - protein, 10 aa, Artificial Sequence
  Description of Artificial Sequence: Synthetic peptide
  Seed: ARRPTVGAQI (SSX2_HUMAN)
  misc_feature (2)..(2): Xaa can be Arg, Gln, His, Tyr, Glu, Lys, Gly, Ala, Ser, Phe, Met, Trp, Val, Pro, Asn, Thr, Ile, Leu, or Asp
  misc_feature (10)..(10): Xaa can be Leu, Phe, Tyr, Met, Ile, Lys, Val, Trp, Arg, Pro, Ser, Cys, Gln, Ala, His, Thr, Asn, Glu, or Gly
AXRPTVGAQX

SEQ ID NO: 166217 - protein, 11 aa, Artificial Sequence
  Description of Artificial Sequence: Synthetic peptide
  Seed: ARRPTVGAQIP (SSX2_HUMAN)
  misc_feature (2)..(2): Xaa can be Arg, Gln, His, or Lys
  misc_feature (11)..(11): Xaa can be Leu, Phe, Met, Lys, His, Cys, Gly, Glu, Ala, Tyr, Trp, Thr, Asn, Ile, Val, Arg, Gln, or Pr o
AXRPTVGAQIX

SEQ ID NO: 166218 - protein, 9 aa, Artificial Sequence
  Description of Artificial Sequence: Synthetic peptide
  Seed: ASEKIFYVY (SSX2_HUMAN)
  misc_feature (2)..(2): Xaa can be Ser, Thr, Ala, Gln, Val, Met, Ile, Gly, Lys, Leu, Asn, Arg, Phe, His, Trp, Pro, Asp, Glu, Cys, or Tyr
  misc_feature (9)..(9): Xaa can be Tyr, Phe, Trp, Met, Lys, Leu, Ile, His, Val, or Arg
AXEKIFYVX

SEQ ID NO: 166219 - protein, 10 aa, Artificial Sequence
  Description of Artificial Sequence: Synthetic peptide
  Seed: ASEKIFYVYM (SSX2_HUMAN)
  misc_feature (2)..(2): Xaa can be Ser, Thr, Glu, Ala, Val, Met, Tyr, Phe, Leu, Gly, Gln, Asn, Ile, Cys, His, Lys, Asp, Arg, Trp, or Pro
  misc_feature (10)..(10): Xaa can be Leu, Met, Ile, Lys, Ala, Val, Ser, Phe, or Arg
AXEKIFYVYX

SEQ ID NO: 166220 - protein, 11 aa, Artificial Sequence
  Description of Artificial Sequence: Synthetic peptide
  Seed: ASEKIFYVYMK (SSX2_HUMAN)
  misc_feature (2)..(2): Xaa can be Gln, Met, Ser, Val, Ala, Ile, or Thr
  misc_feature (11)..(11): Xaa can be , or Lys
AXEKIFYVYMX

SEQ ID NO: 166221 - protein, 9 aa, Artificial Sequence
  Description of Artificial Sequence: Synthetic peptide
  Seed: ASGPQNDGK (SSX2_HUMAN)
  misc_feature (2)..(2): Xaa can be Ser, Thr, Ala, Met, Leu, Asp, Ile, Val, Asn, Gly, Phe, Glu, Gln, Pro, Cys, or Tyr
  misc_feature (9)..(9): Xaa can be Lys, Arg, Tyr, Met, Phe, or Leu
AXGPQNDGX

SEQ ID NO: 166222 - protein, 11 aa, Artificial Sequence
  Description of Artificial Sequence: Synthetic peptide
  Seed: ASGPQNDGKEL (SSX2_HUMAN)
  misc_feature (2)..(2): Xaa can be Ala, Met, Ile, Gln, Thr, Leu, Ser, Val, Gly, Glu, Arg, Asn, Phe, Cys, His, Asp, Tyr, Pro, Lys, or Trp
  misc_feature (11)..(11): Xaa can be Trp, Leu, Phe, Met, Arg, Lys, Tyr, Ile, His, Val, Cys, or Ala
AXGPQNDGKEX

SEQ ID NO: 166223 - protein, 10 aa, Artificial Sequence
  Description of Artificial Sequence: Synthetic peptide
  Seed: ATLPPFMCNK (SSX2_HUMAN)
  misc_feature (2)..(2): Xaa can be Thr, Met, Val, Leu, Ile, Ser, Trp, Ala, Gln, Pro, His, Arg, Lys, Phe, Gly, Asn, Glu, Asp, Cys, or Tyr
  misc_feature (10)..(10): Xaa can be Lys, Arg, Tyr, Leu, Val, Phe, His, Met, Ala, or Ile
AXLPPFMCNX

SEQ ID NO: 166224 - protein, 11 aa, Artificial Sequence
  Description of Artificial Sequence: Synthetic peptide
  Seed: ATLPPFMCNKR (SSX2_HUMAN)
  misc_feature (2)..(2): Xaa can be Thr, Val, Met, Leu, Ile, Ser, Asp, Tyr, Ala, Gly, Asn, Gln, Phe, Trp, Glu, Arg, Lys, or Cy s
  misc_feature (11)..(11): Xaa can be Arg, Lys, Tyr, Met, Leu, Cys, Gln, Pro, Glu, Ala, His, Ser, Ile, Asp, Thr, Asn, Gly, Val, Trp, or Phe
AXLPPFMCNKX

SEQ ID NO: 166225 - protein, 9 aa, Artificial Sequence
  Description of Artificial Sequence: Synthetic peptide
  Seed: AWTHRLRER (SSX2_HUMAN)
  misc_feature (2)..(2): Xaa can be Phe, Val, Met, Gln, Thr, Tyr, Asn, Ala, Leu, Gly, Ile, Ser, or Trp
  misc_feature (9)..(9): Xaa can be Arg, or Lys
AXTHRLREX

SEQ ID NO: 166226 - protein, 10 aa, Artificial Sequence
  Description of Artificial Sequence: Synthetic peptide
  Seed: AWTHRLRERK (SSX2_HUMAN)
  misc_feature (2)..(2): Xaa can be Tyr, Lys, Trp, Arg, Cys, Ala, Thr, Pro, Ile, Phe, Asn, Leu, Glu, Gly, Met, Ser, Gln, Val, His, or Asp
  misc_feature (10)..(10): Xaa can be , or Lys
AXTHRLRERX

SEQ ID NO: 166227 - protein, 9 aa, Artificial Sequence
  Description of Artificial Sequence: Synthetic peptide
  Seed: CPPGKPTTS (SSX2_HUMAN)
  misc_feature (2)..(2): Xaa can be Pro, Ala, Val, Met, Ile, Ser, Gly, Phe, Leu, Thr, Gln, Cys, Tyr, Trp, Asp, or Glu
  misc_feature (9)..(9): Xaa can be Leu, Met, Ala, Val, Phe, Ile, Cys, Thr, Pro, Arg, Trp, Glu, Gly, Ser, Gln, Tyr, or Lys
CXPGKPTTX

SEQ ID NO: 166228 - protein, 9 aa, Artificial Sequence
  Description of Artificial Sequence: Synthetic peptide
  Seed: DAFARRPTV (SSX2_HUMAN)
  misc_feature (2)..(2): Xaa can be Gln, Pro, Ala, Arg, His, Leu, Ile, Thr, Ser, Met, Val, Gly, Glu, Asp, Asn, Phe, Lys, Cys, Tyr, or Trp
  misc_feature (9)..(9): Xaa can be Ile, Leu, Met, Val, Phe, Tyr, Cys, Ala, Arg, Lys, Trp, Thr, His, Pro, Gly, or Ser
DXFARRPTX

SEQ ID NO: 166229 - protein, 9 aa, Artificial Sequence
  Description of Artificial Sequence: Synthetic peptide
  Seed: DDIAKYFSK (SSX2_HUMAN)
  misc_feature (2)..(2): Xaa can be Thr, Val, Ile, Ala, Ser, Leu, Met, Phe, Tyr, Pro, Asp, Trp, Cys, Glu, Asn, Gln, His, Gly, Lys, or Arg
  misc_feature (9)..(9): Xaa can be Arg, Lys, His, Tyr, Met, Leu, Phe, Val, Gln, or Ile
DXIAKYFSX

SEQ ID NO: 166230 - protein, 10 aa, Artificial Sequence
  Description of Artificial Sequence: Synthetic peptide
  Seed: DGKELCPPGK (SSX2_HUMAN)
  misc_feature (2)..(2): Xaa can be Val, Thr, Ile, Met, Cys, Gln, Ala, Ser, Phe, Asn, Tyr, Trp, Gly, Leu, Glu, His, or Lys
  misc_feature (10)..(10): Xaa can be Arg, Lys, Tyr, Leu, Met, or Phe
DXKELCPPGX

SEQ ID NO: 166231 - protein, 8 aa, Artificial Sequence
  Description of Artificial Sequence: Synthetic peptide
  Seed: DIAKYFSK (SSX2_HUMAN)
  misc_feature (2)..(2): Xaa can be Gln, Met, Ser, Leu, Val, Ile, Thr, Ala, or Gly
  misc_feature (8)..(8): Xaa can be Lys, or Arg
DXAKYFSX

SEQ ID NO: 166232 - protein, 8 aa, Artificial Sequence
  Description of Artificial Sequence: Synthetic peptide
  Seed: DPNRGNQV (SSX2_HUMAN)
  misc_feature (2)..(2): Xaa can be Ala, or Pro
  misc_feature (8)..(8): Xaa can be Val, Ile, or Leu
DXNRGNQX

SEQ ID NO: 166233 - protein, 9 aa, Artificial Sequence
  Description of Artificial Sequence: Synthetic peptide
  Seed: EAMTKLGFK (SSX2_HUMAN)
  misc_feature (2)..(2): Xaa can be Ile, Thr, Val, Ala, Ser, Met, Leu, Tyr, Cys, Pro, His, Asn, Trp, Glu, Gly, Phe, Asp, Gln, Lys, or Arg
  misc_feature (9)..(9): Xaa can be Arg, Lys, His, Phe, Met, Tyr, Leu, Ile, Val, Gln, or Ala
EXMTKLGFX

SEQ ID NO: 166234 - protein, 10 aa, Artificial Sequence
  Description of Artificial Sequence: Synthetic peptide
  Seed: EASGPQNDGK (SSX2_HUMAN)
  misc_feature (2)..(2): Xaa can be Thr, Val, Ile, Ala, Phe, Met, Gly, Ser, Asn, Leu, Gln, Trp, Tyr, Cys, Pro, or Glu
  misc_feature (10)..(10): Xaa can be Arg, Lys, Tyr, Leu, Phe, Met, or His
EXSGPQNDGX

SEQ ID NO: 166235 - protein, 8 aa, Artificial Sequence
  Description of Artificial Sequence: Synthetic peptide
  Seed: EDFQGNDL (SSX2_HUMAN)
  misc_feature (2)..(2): Xaa can be Glu, Asp, or Gln
  misc_feature (8)..(8): Xaa can be Leu, Phe, Val, Met, Ala, Pro, Ile, Thr, Cys, or Ser
EXFQGNDX

SEQ ID NO: 166236 - protein, 9 aa, Artificial Sequence
  Description of Artificial Sequence: Synthetic peptide
  Seed: EEGNDSEEV (SSX2_HUMAN)
  misc_feature (2)..(2): Xaa can be Glu, Gln, or Asp
  misc_feature (9)..(9): Xaa can be Val, Trp, Leu, Tyr, Phe, Met, Ala, Ile, His, Pro, Thr, Ser, or Cys
EXGNDSEEX

SEQ ID NO: 166237 - protein, 10 aa, Artificial Sequence
  Description of Artificial Sequence: Synthetic peptide
  Seed: EEGNDSEEVP (SSX2_HUMAN)
  misc_feature (2)..(2): Xaa can be , or Glu
  misc_feature (10)..(10): Xaa can be Ala, Pro, Tyr, Leu, Val, Met, Ile, Cys, Phe, Thr, or Ser
EXGNDSEEVX

SEQ ID NO: 166238 - protein, 9 aa, Artificial Sequence
  Description of Artificial Sequence: Synthetic peptide
  Seed: EEVPEASGP (SSX2_HUMAN)
  misc_feature (2)..(2): Xaa can be Glu, Asp, or Gln
  misc_feature (9)..(9): Xaa can be Ile, Ala, Leu, Pro, Phe, Met, Cys, Val, Thr, Gly, Ser, Tyr, or Trp
EXVPEASGX

SEQ ID NO: 166239 - protein, 8 aa, Artificial Sequence
  Description of Artificial Sequence: Synthetic peptide
  Seed: EEWEKMKA (SSX2_HUMAN)
  misc_feature (2)..(2): Xaa can be Glu, Asp, or Gln
  misc_feature (8)..(8): Xaa can be Met, Ile, Leu, Tyr, Val, Phe, Ala, Pro, Ser, Cys, Trp, His, Arg, Lys, Thr, Gln, or Gly
EXWEKMKX

SEQ ID NO: 166240 - protein, 9 aa, Artificial Sequence
  Description of Artificial Sequence: Synthetic peptide
  Seed: EEWEKMKAS (SSX2_HUMAN)
  misc_feature (2)..(2): Xaa can be Glu, Gln, Asp, Asn, Ala, Val, or Ser
  misc_feature (9)..(9): Xaa can be Leu, Thr, Ala, Met, Val, Cys, Phe, Ile, Pro, Tyr, Ser, Trp, Gly, Glu, Asn, Asp, Gln, Lys, Arg, or His
EXWEKMKAX

SEQ ID NO: 166241 - protein, 8 aa, Artificial Sequence
  Description of Artificial Sequence: Synthetic peptide
  Seed: EHAWTHRL (SSX2_HUMAN)
  misc_feature (2)..(2): Xaa can be His, Arg, or Gln
  misc_feature (8)..(8): Xaa can be Leu, Ile, Ala, Met, Val, Thr, or Phe
EXAWTHRX

SEQ ID NO: 166242 - protein, 9 aa, Artificial Sequence
  Description of Artificial Sequence: Synthetic peptide
  Seed: EHAWTHRLR (SSX2_HUMAN)
  misc_feature (2)..(2): Xaa can be Ala, Met, Tyr, Gln, Trp, Phe, Leu, Thr, Val, Asn, Ile, Gly, Ser, Arg, Glu, Pro, Lys, Cys, Asp, or His
  misc_feature (9)..(9): Xaa can be Arg, or Lys
EXAWTHRLX

SEQ ID NO: 166243 - protein, 10 aa, Artificial Sequence
  Description of Artificial Sequence: Synthetic peptide
  Seed: EKIFYVYMKR (SSX2_HUMAN)
  misc_feature (2)..(2): Xaa can be Thr, Ala, Ser, Val, Ile, His, Lys, Asn, Phe, Pro, Leu, Glu, Cys, Met, Asp, Tyr, Arg, Gln, Trp, or Gly
  misc_feature (10)..(10): Xaa can be Lys, Tyr, Arg, Gly, Ile, Gln, Leu, Val, Ala, Asp, Cys, His, Asn, Trp, Ser, Phe, Glu, Met, Pro, or Thr
EXIFYVYMKX

SEQ ID NO: 166244 - protein, 11 aa, Artificial Sequence
  Description of Artificial Sequence: Synthetic peptide
  Seed: EKIFYVYMKRK (SSX2_HUMAN)
  misc_feature (2)..(2): Xaa can be Lys, or Arg
  misc_feature (11)..(11): Xaa can be , or Lys
EXIFYVYMKRX

SEQ ID NO: 166245 - protein, 9 aa, Artificial Sequence
  Description of Artificial Sequence: Synthetic peptide
  Seed: EKMKASEKI (SSX2_HUMAN)
  misc_feature (2)..(2): Xaa can be His, Gln, Arg, Glu, Lys, Asn, or Tyr
  misc_feature (9)..(9): Xaa can be Leu, Ile, Phe, Val, Trp, Met, Thr, Cys, Tyr, or Ala
EXMKASEKX

SEQ ID NO: 166246 - protein, 11 aa, Artificial Sequence
  Description of Artificial Sequence: Synthetic peptide
  Seed: EKMKASEKIFY (SSX2_HUMAN)
  misc_feature (2)..(2): Xaa can be Met, Lys, or Arg
  misc_feature (11)..(11): Xaa can be , or Tyr
EXMKASEKIFX

SEQ ID NO: 166247 - protein, 8 aa, Artificial Sequence
  Description of Artificial Sequence: Synthetic peptide
  Seed: ERKQLVIY (SSX2_HUMAN)
  misc_feature (2)..(2): Xaa can be Gln, or Arg
  misc_feature (8)..(8): Xaa can be Tyr, or Phe
EXKQLVIX

SEQ ID NO: 166248 - protein, 9 aa, Artificial Sequence
  Description of Artificial Sequence: Synthetic peptide
  Seed: ERPQMTFGR (SSX2_HUMAN)
  misc_feature (2)..(2): Xaa can be Arg, Tyr, Ser, Phe, Val, Met, Trp, Ala, Leu, Ile, Thr, Lys, Asn, His, Asp, Pro, Glu, Gly, Cys, or Gln
  misc_feature (9)..(9): Xaa can be Arg, Lys, Leu, Phe, Met, or Tyr
EXPQMTFGX

SEQ ID NO: 166249 - protein, 10 aa, Artificial Sequence
  Description of Artificial Sequence: Synthetic peptide
  Seed: ERPQMTFGRL (SSX2_HUMAN)
  misc_feature (2)..(2): Xaa can be Arg, Tyr, Ser, Lys, or Met
  misc_feature (10)..(10): Xaa can be Leu, Phe, Met, or Tyr
EXPQMTFGRX

SEQ ID NO: 166250 - protein, 11 aa, Artificial Sequence
  Description of Artificial Sequence: Synthetic peptide
  Seed: ERSGPKRGEHA (SSX2_HUMAN)
  misc_feature (2)..(2): Xaa can be , or Arg
  misc_feature (11)..(11): Xaa can be Leu, or Ala
EXSGPKRGEHX

SEQ ID NO: 166251 - protein, 9 aa, Artificial Sequence
  Description of Artificial Sequence: Synthetic peptide
  Seed: EVPEASGPQ (SSX2_HUMAN)
  misc_feature (2)..(2): Xaa can be Thr, Val, Ala, Ile, Ser, Leu, Met, Glu, Pro, Gln, Asp, Gly, Phe, Asn, Cys, Trp, Lys, or Ty r
  misc_feature (9)..(9): Xaa can be Arg, Lys, Met, Tyr, Leu, Phe, His, Val, Ile, Ala, or Gln
EXPEASGPX

SEQ ID NO: 166252 - protein, 9 aa, Artificial Sequence
  Description of Artificial Sequence: Synthetic peptide
  Seed: FARRPTVGA (SSX2_HUMAN)
  misc_feature (2)..(2): Xaa can be Pro, Ala, Ser, Thr, Val, Met, Ile, Leu, Gln, Gly, Tyr, Asn, Phe, Cys, Glu, Asp, Trp, His, or Lys
  misc_feature (9)..(9): Xaa can be Tyr, Phe, Lys, Leu, Met, Ala, Val, His, Ile, Arg, Trp, Cys, Ser, Gly, Thr, Pro, Gln, Glu, Asp, or Asn
FXRRPTVGX

SEQ ID NO: 166253 - protein, 11 aa, Artificial Sequence
  Description of Artificial Sequence: Synthetic peptide
  Seed: FARRPTVGAQI (SSX2_HUMAN)
  misc_feature (2)..(2): Xaa can be Ala, Ser, Val, Ile, Thr, Gly, Met, Cys, Leu, Gln, Pro, or Glu
  misc_feature (11)..(11): Xaa can be Tyr, Phe, Leu, Met, His, Trp, Cys, Ile, Val, or Ala
FXRRPTVGAQX

SEQ ID NO: 166254 - protein, 8 aa, Artificial Sequence
  Description of Artificial Sequence: Synthetic peptide
  Seed: FDDIAKYF (SSX2_HUMAN)
  misc_feature (2)..(2): Xaa can be Ser, Ala, Thr, Ile, Phe, Val, Tyr, Leu, Trp, Gly, Met, His, Asn, Cys, Gln, Glu, Arg, Asp, Pro, or Lys
  misc_feature (8)..(8): Xaa can be Ile, Leu, Met, Phe, Val, Tyr, Cys, Trp, Ala, or Thr
FXDIAKYX

SEQ ID NO: 166255 - protein, 10 aa, Artificial Sequence
  Description of Artificial Sequence: Synthetic peptide
  Seed: FGRLQGISPK (SSX2_HUMAN)
  misc_feature (2)..(2): Xaa can be Ser, Thr, Arg, Leu, His, Ala, Glu, Asp, Phe, Ile, Trp, Asn, Cys, Met, Tyr, Gly, Gln, Val, Lys, or Pro
  misc_feature (10)..(10): Xaa can be Met, Ile, Val, Leu, Tyr, Lys, Phe, Arg, Ala, or Trp
FXRLQGISPX

SEQ ID NO: 166256 - protein, 11 aa, Artificial Sequence
  Description of Artificial Sequence: Synthetic peptide
  Seed: FGRLQGISPKI (SSX2_HUMAN)
  misc_feature (2)..(2): Xaa can be Phe, Val, Ser, His, Met, Gln, Ile, Glu, Asp, Gly, Thr, Leu, Asn, Arg, Ala, Tyr, Pro, Trp, Cys, or Lys
  misc_feature (11)..(11): Xaa can be Leu, Val, Ile, Ala, or Met
FXRLQGISPKX

SEQ ID NO: 166257 - protein, 8 aa, Artificial Sequence
  Description of Artificial Sequence: Synthetic peptide
  Seed: FKATLPPF (SSX2_HUMAN)
  misc_feature (2)..(2): Xaa can be Gln, Met, Lys, Glu, His, Ser, Ile, Tyr, Thr, Leu, Asn, Val, Phe, Arg, or Ala
  misc_feature (8)..(8): Xaa can be Tyr, Phe, Met, Leu, Trp, or Ile
FXATLPPX

SEQ ID NO: 166258 - protein, 9 aa, Artificial Sequence
  Description of Artificial Sequence: Synthetic peptide
  Seed: FKATLPPFM (SSX2_HUMAN)
  misc_feature (2)..(2): Xaa can be Arg, Gln, Met, Tyr, Val, Phe, Ser, Lys, Gly, Thr, His, Ala, Ile, Asn, Glu, Leu, Trp, Pro, Asp, or Cys
  misc_feature (9)..(9): Xaa can be Leu, Met, Tyr, Phe, Ile, Val, Trp, His, Ala, Cys, Lys, or Arg
FXATLPPFX

SEQ ID NO: 166259 - protein, 10 aa, Artificial Sequence
  Description of Artificial Sequence: Synthetic peptide
  Seed: FMCNKRAEDF (SSX2_HUMAN)
  misc_feature (2)..(2): Xaa can be Ala, Ser, Gln, Val, Thr, Leu, Met, Ile, Glu, Gly, or Pro
  misc_feature (10)..(10): Xaa can be Tyr, Phe, Met, or Leu
FXCNKRAEDX

SEQ ID NO: 166260 - protein, 8 aa, Artificial Sequence
  Description of Artificial Sequence: Synthetic peptide
  Seed: FSKEEWEK (SSX2_HUMAN)
  misc_feature (2)..(2): Xaa can be Ala, Thr, Ser, Val, Gly, Ile, Gln, Glu, Asp, Leu, or Asn
  misc_feature (8)..(8): Xaa can be Lys, Tyr, Arg, Leu, Met, Phe, Ile, Val, or Trp
FXKEEWEX

SEQ ID NO: 166261 - protein, 9 aa, Artificial Sequence
  Description of Artificial Sequence: Synthetic peptide
  Seed: FSKEEWEKM (SSX2_HUMAN)
  misc_feature (2)..(2): Xaa can be Ala, Arg, Val, Ser, Thr, Gly, Leu, Asn, Ile, Gln, Glu, Met, Asp, Tyr, Phe, His, Trp, Lys, Pro, or Cys
  misc_feature (9)..(9): Xaa can be Leu, Tyr, Met, Phe, Trp, Ile, Val, Lys, His, Arg, Ala, Cys, Gln, Ser, or Thr
FXKEEWEKX

SEQ ID NO: 166262 - protein, 10 aa, Artificial Sequence
  Description of Artificial Sequence: Synthetic peptide
  Seed: FSKEEWEKMK (SSX2_HUMAN)
  misc_feature (2)..(2): Xaa can be Thr, Val, Ser, Ile, Ala, Met, Leu, Gln, or Asp
  misc_feature (10)..(10): Xaa can be Tyr, Lys, or Arg
FXKEEWEKMX

SEQ ID NO: 166263 - protein, 9 aa, Artificial Sequence
  Description of Artificial Sequence: Synthetic peptide
  Seed: FYVYMKRKY (SSX2_HUMAN)
  misc_feature (2)..(2): Xaa can be Arg, Tyr, Phe, Trp, Gln, His, Met, Ile, Gly, Lys, Ala, Thr, Ser, Glu, Asp, Leu, Asn, or Va l
  misc_feature (9)..(9): Xaa can be Tyr, Phe, Met, Leu, Val, Ile, or Trp
FXVYMKRKX

SEQ ID NO: 166264 - protein, 8 aa, Artificial Sequence
  Description of Artificial Sequence: Synthetic peptide
  Seed: GAQIPEKI (SSX2_HUMAN)
  misc_feature (2)..(2): Xaa can be Ala, Ser, Thr, Ile, or Val
  misc_feature (8)..(8): Xaa can be Lys, Leu, Tyr, Phe, Met, Ile, or Val
GXQIPEKX

SEQ ID NO: 166265 - protein, 10 aa, Artificial Sequence
  Description of Artificial Sequence: Synthetic peptide
  Seed: GAQIPEKIQK (SSX2_HUMAN)
  misc_feature (2)..(2): Xaa can be Ala, Met, Thr, Gln, Ile, Leu, Ser, Val, Gly, Cys, Asn, Asp, or Glu
  misc_feature (10)..(10): Xaa can be Tyr, Lys, Arg, Leu, Met, or Phe
GXQIPEKIQX

SEQ ID NO: 166266 - protein, 9 aa, Artificial Sequence
  Description of Artificial Sequence: Synthetic peptide
  Seed: GEHAWTHRL (SSX2_HUMAN)
  misc_feature (2)..(2): Xaa can be Glu, Gln, Asp, His, Leu, Ala, Met, Ile, Val, Thr, Arg, Ser, Lys, Asn, Gly, Tyr, Pro, or Ph e
  misc_feature (9)..(9): Xaa can be Tyr, Leu, Phe, Val, Trp, Ile, Met, Cys, Ala, His, Pro, Thr, Gly, Lys, Arg, Ser, or Asp
GXHAWTHRX

SEQ ID NO: 166267 - protein, 9 aa, Artificial Sequence
  Description of Artificial Sequence: Synthetic peptide
  Seed: GFKATLPPF (SSX2_HUMAN)
  misc_feature (2)..(2): Xaa can be Arg, Gln, Met, Leu, Tyr, Ala, Phe, Val, Trp, Ile, Lys, His, Ser, Glu, Thr, Gly, Asn, Pro, Cys, or Asp
  misc_feature (9)..(9): Xaa can be Tyr, Phe, Met, Leu, Trp, Ile, His, Val, Ala, Lys, or Arg
GXKATLPPX

SEQ ID NO: 166268 - protein, 9 aa, Artificial Sequence
  Description of Artificial Sequence: Synthetic peptide
  Seed: GISPKIMPK (SSX2_HUMAN)
  misc_feature (2)..(2): Xaa can be Thr, Ala, Ser, Val, Met, Leu, Ile, Cys, Gly, Phe, Pro, Gln, Asn, Tyr, Asp, Trp, His, Glu, Lys, or Arg
  misc_feature (9)..(9): Xaa can be Arg, Lys, Tyr, Leu, Phe, Met, Val, Ile, His, Ala, Trp, Cys, Gly, Ser, or Thr
GXSPKIMPX

SEQ ID NO: 166269 - protein, 10 aa, Artificial Sequence
  Description of Artificial Sequence: Synthetic peptide
  Seed: GISPKIMPKK (SSX2_HUMAN)
  misc_feature (2)..(2): Xaa can be Ser, Met, Val, Leu, Thr, Ile, Ala, Gly, Trp, Gln, Asn, Tyr, or Phe
  misc_feature (10)..(10): Xaa can be Arg, Lys, Leu, Tyr, Val, Phe, Gln, His, Cys, Thr, Met, Ala, Trp, Ile, Asp, Pro, Glu, Ser, Asn, or Gly
GXSPKIMPKX

SEQ ID NO: 166270 - protein, 8 aa, Artificial Sequence
  Description of Artificial Sequence: Synthetic peptide
  Seed: GPKRGEHA (SSX2_HUMAN)
  misc_feature (2)..(2): Xaa can be , or Pro
  misc_feature (8)..(8): Xaa can be , or Ala
GXKRGEHX

SEQ ID NO: 166271 - protein, 9 aa, Artificial Sequence
  Description of Artificial Sequence: Synthetic peptide
  Seed: GPKRGEHAW (SSX2_HUMAN)
  misc_feature (2)..(2): Xaa can be Pro, Ala, Thr, Ser, Val, Ile, Met, Gln, Gly, Leu, Asp, Phe, Asn, or Cys
  misc_feature (9)..(9): Xaa can be Trp, Leu, Met, Phe, Tyr, Ile, Val, Ala, Ser, Thr, Pro, or Cys
GXKRGEHAX

SEQ ID NO: 166272 - protein, 9 aa, Artificial Sequence
  Description of Artificial Sequence: Synthetic peptide
  Seed: GPQNDGKEL (SSX2_HUMAN)
  misc_feature (2)..(2): Xaa can be , or Pro
  misc_feature (9)..(9): Xaa can be Phe, Leu, Val, Ala, Ile, or Met
GXQNDGKEX

SEQ ID NO: 166273 - protein, 9 aa, Artificial Sequence
  Description of Artificial Sequence: Synthetic peptide
  Seed: GRLQGISPK (SSX2_HUMAN)
  misc_feature (2)..(2): Xaa can be Arg, Gln, Lys, Ala, Tyr, His, Phe, or Gly
  misc_feature (9)..(9): Xaa can be Met, Leu, Phe, Tyr, Lys, Arg, Ile, Val, Thr, Gln, Ala, Pro, Trp, Cys, Gly, Ser, His, Asn, or Glu
GXLQGISPX

SEQ ID NO: 166274 - protein, 10 aa, Artificial Sequence
  Description of Artificial Sequence: Synthetic peptide
  Seed: GRLQGISPKI (SSX2_HUMAN)
  misc_feature (2)..(2): Xaa can be Arg, Gln, Lys, His, Tyr, Leu, Met, Phe, Trp, Ala, Ser, Glu, Thr, Ile, Asp, Pro, Asn, Val, Gly, or Cys
  misc_feature (10)..(10): Xaa can be Ile, Leu, Val, Met, Ala, Tyr, Phe, Arg, Lys, Trp, Thr, Ser, His, Glu, Pro, Gln, Asn, Cys, or Gly
GXLQGISPKX

SEQ ID NO: 166275 - protein, 11 aa, Artificial Sequence
  Description of Artificial Sequence: Synthetic peptide
  Seed: GRLQGISPKIM (SSX2_HUMAN)
  misc_feature (2)..(2): Xaa can be Arg, or Gln
  misc_feature (11)..(11): Xaa can be Lys, Tyr, Phe, Leu, Gly, Pro, Ser, Ile, Cys, Thr, Val, His, Ala, Asn, Arg, Met, Trp, Gln, or Glu
GXLQGISPKIX

SEQ ID NO: 166276 - protein, 8 aa, Artificial Sequence
  Description of Artificial Sequence: Synthetic peptide
  Seed: HAWTHRLR (SSX2_HUMAN)
  misc_feature (2)..(2): Xaa can be Val, Trp, Tyr, Phe, Met, Leu, Ile, Gln, Ser, Thr, Gly, or Ala
  misc_feature (8)..(8): Xaa can be Arg, or Lys
HXWTHRLX

SEQ ID NO: 166277 - protein, 10 aa, Artificial Sequence
  Description of Artificial Sequence: Synthetic peptide
  Seed: HAWTHRLRER (SSX2_HUMAN)
  misc_feature (2)..(2): Xaa can be Ile, Thr, Val, Ala, Asn, Gln, Trp, Gly, Tyr, Ser, Leu, Phe, Met, Cys, Pro, His, or Arg
  misc_feature (10)..(10): Xaa can be Arg, Lys, or Tyr
HXWTHRLREX

SEQ ID NO: 166278 - protein, 9 aa, Artificial Sequence
  Description of Artificial Sequence: Synthetic peptide
  Seed: HERSGPKRG (SSX2_HUMAN)
  misc_feature (2)..(2): Xaa can be Glu, or Asp
  misc_feature (9)..(9): Xaa can be Pro, Leu, Ala, Ile, Val, Cys, Met, Phe, Ser, Gly, or Thr
HXRSGPKRX

SEQ ID NO: 166279 - protein, 9 aa, Artificial Sequence
  Description of Artificial Sequence: Synthetic peptide
  Seed: HRLRERKQL (SSX2_HUMAN)
  misc_feature (2)..(2): Xaa can be Arg, His, Gln, Ala, Glu, Phe, Gly, Tyr, Ser, Asn, Met, Leu, Ile, Val, Lys, Thr, Asp, Trp, Pro, or Cys
  misc_feature (9)..(9): Xaa can be Leu, Ile, Phe, Lys, Tyr, Met, Val, Trp, Ala, Arg, Cys, Gln, His, or Pro
HXLRERKQX

SEQ ID NO: 166280 - protein, 10 aa, Artificial Sequence
  Description of Artificial Sequence: Synthetic peptide
  Seed: HRLRERKQLV (SSX2_HUMAN)
  misc_feature (2)..(2): Xaa can be Arg, Gln, Ile, Met, Thr, or Leu
  misc_feature (10)..(10): Xaa can be Leu, Lys, Phe, Tyr, Met, Arg, Trp, Ile, Cys, Ala, His, or Val
HXLRERKQLX

SEQ ID NO: 166281 - protein, 11 aa, Artificial Sequence
  Description of Artificial Sequence: Synthetic peptide
  Seed: HRLRERKQLVI (SSX2_HUMAN)
  misc_feature (2)..(2): Xaa can be Arg, Gln, Glu, Gly, or Asn
  misc_feature (11)..(11): Xaa can be Lys, Leu, Tyr, Phe, Arg, Gln, Met, Cys, Val, Trp, Ile, Ala, or His
HXLRERKQLVX

SEQ ID NO: 166282 - protein, 10 aa, Artificial Sequence
  Description of Artificial Sequence: Synthetic peptide
  Seed: IAKYFSKEEW (SSX2_HUMAN)
  misc_feature (2)..(2): Xaa can be Thr, Ser, Ala, Gly, Asn, Pro, Val, Cys, Ile, Gln, Met, Asp, or Leu
  misc_feature (10)..(10): Xaa can be Trp, Tyr, Phe, or Met
IXKYFSKEEX

SEQ ID NO: 166283 - protein, 8 aa, Artificial Sequence
  Description of Artificial Sequence: Synthetic peptide
  Seed: IFYVYMKR (SSX2_HUMAN)
  misc_feature (2)..(2): Xaa can be Val, Ile, Trp, Ser, Thr, Phe, Met, Gln, Tyr, or Leu
  misc_feature (8)..(8): Xaa can be , or Arg
IXYVYMKX

SEQ ID NO: 166284 - protein, 9 aa, Artificial Sequence
  Description of Artificial Sequence: Synthetic peptide
  Seed: IFYVYMKRK (SSX2_HUMAN)
  misc_feature (2)..(2): Xaa can be Gly, Thr, Ala, Phe, Gln, Tyr, Val, Ser, Leu, Asn, Ile, Trp, or Met
  misc_feature (9)..(9): Xaa can be Arg, or Lys
IXYVYMKRX

SEQ ID NO: 166285 - protein, 10 aa, Artificial Sequence
  Description of Artificial Sequence: Synthetic peptide
  Seed: IFYVYMKRKY (SSX2_HUMAN)
  misc_feature (2)..(2): Xaa can be Tyr, Phe, Trp, Thr, Ser, Val, Leu, Gln, Ala, or Met
  misc_feature (10)..(10): Xaa can be Tyr, Met, Phe, or Leu
IXYVYMKRKX

SEQ ID NO: 166286 - protein, 8 aa, Artificial Sequence
  Description of Artificial Sequence: Synthetic peptide
  Seed: IPEKIQKA (SSX2_HUMAN)
  misc_feature (2)..(2): Xaa can be , or Pro
  misc_feature (8)..(8): Xaa can be Phe, Ala, Met, Ile, Val, or Leu
IXEKIQKX

SEQ ID NO: 166287 - protein, 9 aa, Artificial Sequence
  Description of Artificial Sequence: Synthetic peptide
  Seed: IPEKIQKAF (SSX2_HUMAN)
  misc_feature (2)..(2): Xaa can be Pro, Ala, Val, Glu, Gln, Phe, Ile, Ser, Trp, Met, Leu, Tyr, Gly, Thr, His, Asp, Asn, Lys, Arg, or Cys
  misc_feature (9)..(9): Xaa can be Tyr, Phe, Met, Leu, Trp, Ile, Ala, Val, Ser, Thr, Pro, Gly, His, or Cys
IXEKIQKAX

SEQ ID NO: 166288 - protein, 8 aa, Artificial Sequence
  Description of Artificial Sequence: Synthetic peptide
  Seed: IQKAFDDI (SSX2_HUMAN)
  misc_feature (2)..(2): Xaa can be , or Gln
  misc_feature (8)..(8): Xaa can be Ile, Val, or Leu
IXKAFDDX

SEQ ID NO: 166289 - protein, 9 aa, Artificial Sequence
  Description of Artificial Sequence: Synthetic peptide
  Seed: IQKAFDDIA (SSX2_HUMAN)
  misc_feature (2)..(2): Xaa can be His, Arg, or Gln
  misc_feature (9)..(9): Xaa can be Ala, Val, Cys, Ile, Leu, Thr, or Met
IXKAFDDIX

SEQ ID NO: 166290 - protein, 10 aa, Artificial Sequence
  Description of Artificial Sequence: Synthetic peptide
  Seed: IQKAFDDIAK (SSX2_HUMAN)
  misc_feature (2)..(2): Xaa can be Ala, Thr, Val, Ser, Ile, Met, Leu, Gln, Gly, Glu, Cys, Asp, Asn, Phe, or Pro
  misc_feature (10)..(10): Xaa can be Lys, Arg, Tyr, Phe, Met, Leu, His, Ile, or Val
IXKAFDDIAX

SEQ ID NO: 166291 - protein, 11 aa, Artificial Sequence
  Description of Artificial Sequence: Synthetic peptide
  Seed: IQKAFDDIAKY (SSX2_HUMAN)
  misc_feature (2)..(2): Xaa can be Val, Ala, Ser, Ile, Gln, Thr, Met, Asp, Gly, Leu, Asn, Cys, Pro, His, Lys, Trp, Phe, Arg, Glu, or Tyr
  misc_feature (11)..(11): Xaa can be Tyr, Phe, Trp, Met, Lys, Leu, or His
IXKAFDDIAKX

SEQ ID NO: 166292 - protein, 8 aa, Artificial Sequence
  Description of Artificial Sequence: Synthetic peptide
  Seed: ISPKIMPK (SSX2_HUMAN)
  misc_feature (2)..(2): Xaa can be Ser, Ala, Thr, Gly, Val, Ile, Leu, Cys, Asn, Met, Tyr, Gln, or Phe
  misc_feature (8)..(8): Xaa can be Leu, Lys, Arg, Met, Phe, Tyr, Ile, or Val
IXPKIMPX

SEQ ID NO: 166293 - protein, 9 aa, Artificial Sequence
  Description of Artificial Sequence: Synthetic peptide
  Seed: ISPKIMPKK (SSX2_HUMAN)
  misc_feature (2)..(2): Xaa can be Met, Thr, Ala, Leu, Val, Ile, Ser, Gln, Phe, Gly, Tyr, Pro, Asn, Cys, Trp, or Asp
  misc_feature (9)..(9): Xaa can be Lys, Arg, Leu, Met, Ile, Val, Tyr, Phe, His, or Ala
IXPKIMPKX

SEQ ID NO: 166294 - protein, 8 aa, Artificial Sequence
  Description of Artificial Sequence: Synthetic peptide
  Seed: KAFDDIAK (SSX2_HUMAN)
  misc_feature (2)..(2): Xaa can be Ala, Ser, Thr, Val, Ile, Gln, Met, Asn, Cys, Leu, Asp, Gly, or Glu
  misc_feature (8)..(8): Xaa can be Lys, Arg, Tyr, Leu, Phe, Met, His, Ile, or Val
KXFDDIAX

SEQ ID NO: 166295 - protein, 9 aa, Artificial Sequence
  Description of Artificial Sequence: Synthetic peptide
  Seed: KAFDDIAKY (SSX2_HUMAN)
  misc_feature (2)..(2): Xaa can be Ala, Arg, Leu, Met, Thr, Gln, Ile, Val, Ser, Tyr, Phe, Pro, Glu, Gly, Asp, Asn, Lys, Trp, His, or Cys
  misc_feature (9)..(9): Xaa can be Phe, Tyr, Arg, His, Val, Met, Ile, Leu, Trp, Lys, Ala, Cys, Thr, Gln, Ser, Glu, Gly, Asn, or Pro
KXFDDIAKX

SEQ ID NO: 166296 - protein, 10 aa, Artificial Sequence
  Description of Artificial Sequence: Synthetic peptide
  Seed: KAFDDIAKYF (SSX2_HUMAN)
  misc_feature (2)..(2): Xaa can be Gln, Met, Arg, Ala, Thr, Ser, Leu, Ile, Val, Glu, Tyr, Phe, His, Gly, Trp, Asn, Lys, Cys, Asp, or Pro
  misc_feature (10)..(10): Xaa can be Ile, Leu, Tyr, Met, Trp, Phe, Val, Arg, Lys, His, Cys, Ala, Gln, Thr, Gly, Ser, Asn, Glu, Asp, or Pro
KXFDDIAKYX

SEQ ID NO: 166297 - protein, 8 aa, Artificial Sequence
  Description of Artificial Sequence: Synthetic peptide
  Seed: KASEKIFY (SSX2_HUMAN)
  misc_feature (2)..(2): Xaa can be Ala, Thr, Ser, Val, Ile, Phe, Gln, Leu, Tyr, Asp, or Met
  misc_feature (8)..(8): Xaa can be Tyr, Leu, Met, Phe, Ile, Val, or Lys
KXSEKIFX

SEQ ID NO: 166298 - protein, 9 aa, Artificial Sequence
  Description of Artificial Sequence: Synthetic peptide
  Seed: KASEKIFYV (SSX2_HUMAN)
  misc_feature (2)..(2): Xaa can be Leu, Met, Thr, Ile, Val, Gln, Ser, Ala, Arg, Tyr, Gly, Trp, Phe, Asn, Cys, Glu, Pro, His, Lys, or Asp
  misc_feature (9)..(9): Xaa can be Val, Tyr, Phe, Lys, Trp, Ile, Leu, Arg, Met, Ala, His, Cys, Thr, Gly, Ser, Gln, Pro, Asp, Asn, or Glu
KXSEKIFYX

SEQ ID NO: 166299 - protein, 10 aa, Artificial Sequence
  Description of Artificial Sequence: Synthetic peptide
  Seed: KASEKIFYVY (SSX2_HUMAN)
  misc_feature (2)..(2): Xaa can be Thr, Ser, Ala, Gln, Tyr, Val, Trp, Met, Leu, Lys, Ile, Glu, His, Gly, Cys, Pro, Arg, Phe, Asn, or Asp
  misc_feature (10)..(10): Xaa can be Trp, Phe, Tyr, Met, Leu, Ile, Gly, Val, Asn, Cys, or His
KXSEKIFYVX

SEQ ID NO: 166300 - protein, 11 aa, Artificial Sequence
  Description of Artificial Sequence: Synthetic peptide
  Seed: KASEKIFYVYM (SSX2_HUMAN)
  misc_feature (2)..(2): Xaa can be , or Ala
  misc_feature (11)..(11): Xaa can be Leu, Met, Tyr, or Phe
KXSEKIFYVYX

SEQ ID NO: 166301 - protein, 8 aa, Artificial Sequence
  Description of Artificial Sequence: Synthetic peptide
  Seed: KATLPPFM (SSX2_HUMAN)
  misc_feature (2)..(2): Xaa can be Ala, Ser, Thr, or Val
  misc_feature (8)..(8): Xaa can be Leu, Phe, Ile, Tyr, Met, or Val
KXTLPPFX

SEQ ID NO: 166302 - protein, 9 aa, Artificial Sequence
  Description of Artificial Sequence: Synthetic peptide
  Seed: KATLPPFMC (SSX2_HUMAN)
  misc_feature (2)..(2): Xaa can be Thr, Ser, Ala, Gly, Val, Met, Ile, Cys, Asn, Gln, Leu, Pro, Asp, Tyr, Glu, Phe, or Trp
  misc_feature (9)..(9): Xaa can be Trp, Phe, Ile, Leu, Met, Val, Tyr, or Cys
KXTLPPFMX

SEQ ID NO: 166303 - protein, 11 aa, Artificial Sequence
  Description of Artificial Sequence: Synthetic peptide
  Seed: KATLPPFMCNK (SSX2_HUMAN)
  misc_feature (2)..(2): Xaa can be Asn, Val, Ser, Gln, Gly, Ala, Cys, Tyr, Asp, Thr, Glu, Trp, Pro, His, Arg, Ile, Leu, Met, Lys, or Phe
  misc_feature (11)..(11): Xaa can be Lys, or Arg
KXTLPPFMCNX

SEQ ID NO: 166304 - protein, 9 aa, Artificial Sequence
  Description of Artificial Sequence: Synthetic peptide
  Seed: KEEWEKMKA (SSX2_HUMAN)
  misc_feature (2)..(2): Xaa can be Glu, Asp, or Gln
  misc_feature (9)..(9): Xaa can be Leu, Met, Phe, Ile, Val, Ala, Tyr, Gly, Ser, Thr, Pro, Cys, or Trp
KXEWEKMKX

SEQ ID NO: 166305 - protein, 10 aa, Artificial Sequence
  Description of Artificial Sequence: Synthetic peptide
  Seed: KEEWEKMKAS (SSX2_HUMAN)
  misc_feature (2)..(2): Xaa can be Glu, or Asp
  misc_feature (10)..(10): Xaa can be Ala, Val, Phe, Pro, Leu, Thr, Gly, Met, Ile, Ser, or Cys
KXEWEKMKAX

SEQ ID NO: 166306 - protein, 9 aa, Artificial Sequence
  Description of Artificial Sequence: Synthetic peptide
  Seed: KELCPPGKP (SSX2_HUMAN)
  misc_feature (2)..(2): Xaa can be Glu, Asp, or Gln
  misc_feature (9)..(9): Xaa can be Leu, Ile, Met, Phe, Ala, Val, Thr, Ser, Cys, Gly, or Pro
KXLCPPGKX

SEQ ID NO: 166307 - protein, 10 aa, Artificial Sequence
  Description of Artificial Sequence: Synthetic peptide
  Seed: KELCPPGKPT (SSX2_HUMAN)
  misc_feature (2)..(2): Xaa can be Glu, or Asp
  misc_feature (10)..(10): Xaa can be Met, Val, Ala, Leu, Cys, Ser, Tyr, Phe, Pro, Thr, Trp, Gly, or Ile
KXLCPPGKPX

SEQ ID NO: 166308 - protein, 11 aa, Artificial Sequence
  Description of Artificial Sequence: Synthetic peptide
  Seed: KELCPPGKPTT (SSX2_HUMAN)
  misc_feature (2)..(2): Xaa can be Glu, Asp, or Gln
  misc_feature (11)..(11): Xaa can be Leu, Cys, Ala, Ile, Met, Val, Phe, Lys, Thr, Tyr, Trp, Pro, Gly, Asp, Ser, Glu, or Gln
KXLCPPGKPTX

SEQ ID NO: 166309 - protein, 8 aa, Artificial Sequence
  Description of Artificial Sequence: Synthetic peptide
  Seed: KIFYVYMK (SSX2_HUMAN)
  misc_feature (2)..(2): Xaa can be Leu, Phe, Val, Met, Thr, Ser, Ile, Ala, Trp, Tyr, Gln, Arg, Asn, Lys, Cys, His, or Gly
  misc_feature (8)..(8): Xaa can be Arg, or Lys
KXFYVYMX

SEQ ID NO: 166310 - protein, 9 aa, Artificial Sequence
  Description of Artificial Sequence: Synthetic peptide
  Seed: KIFYVYMKR (SSX2_HUMAN)
  misc_feature (2)..(2): Xaa can be Thr, Ser, Val, Ala, Met, Gln, Tyr, Ile, Trp, Phe, Leu, Gly, Asn, Arg, Lys, Glu, Asp, His, Pro, or Cys
  misc_feature (9)..(9): Xaa can be Arg, Lys, Tyr, Ala, Val, Leu, Ile, Met, His, Gly, Ser, Phe, Thr, Asn, Pro, Gln, Cys, or Gl u
KXFYVYMKX

SEQ ID NO: 166311 - protein, 10 aa, Artificial Sequence
  Description of Artificial Sequence: Synthetic peptide
  Seed: KIFYVYMKRK (SSX2_HUMAN)
  misc_feature (2)..(2): Xaa can be Thr, Ala, Met, Gln, Phe, Ser, Val, Trp, Ile, Gly, Leu, Tyr, Asp, Glu, Arg, Asn, Cys, His, Lys, or Pro
  misc_feature (10)..(10): Xaa can be Lys, Arg, Gln, Met, Tyr, Ala, Gly, Val, Trp, Phe, Asn, Cys, His, Glu, Ile, Thr, Leu, Asp, Pro, or Ser
KXFYVYMKRX

SEQ ID NO: 166312 - protein, 11 aa, Artificial Sequence
  Description of Artificial Sequence: Synthetic peptide
  Seed: KIFYVYMKRKY (SSX2_HUMAN)
  misc_feature (2)..(2): Xaa can be Gln, Met, Gly, Thr, Ser, Val, Trp, Ala, Tyr, Ile, or Leu
  misc_feature (11)..(11): Xaa can be , or Tyr
KXFYVYMKRKX

SEQ ID NO: 166313 - protein, 9 aa, Artificial Sequence
  Description of Artificial Sequence: Synthetic peptide
  Seed: KIHERSGPK (SSX2_HUMAN)
  misc_feature (2)..(2): Xaa can be Ser, Thr, Val, Met, Ile, Tyr, Leu, Ala, Phe, Trp, Gln, Gly, Asn, Asp, Pro, Cys, Lys, or Hi s
  misc_feature (9)..(9): Xaa can be Lys, Arg, Val, Ala, Ile, Tyr, Met, Leu, Gly, Ser, His, Phe, Pro, Gln, Cys, Thr, Asn, or Gl u
KXHERSGPX

SEQ ID NO: 166314 - protein, 10 aa, Artificial Sequence
  Description of Artificial Sequence: Synthetic peptide
  Seed: KIHERSGPKR (SSX2_HUMAN)
  misc_feature (2)..(2): Xaa can be Thr, Val, Met, Ile, Leu, Phe, Ser, Tyr, Gln, Trp, Gly, Ala, or Asn
  misc_feature (10)..(10): Xaa can be Arg, Lys, Tyr, Leu, Met, or Phe
KXHERSGPKX

SEQ ID NO: 166315 - protein, 9 aa, Artificial Sequence
  Description of Artificial Sequence: Synthetic peptide
  Seed: KIQKAFDDI (SSX2_HUMAN)
  misc_feature (2)..(2): Xaa can be Leu, Gln, Met, Ile, Val, Ala, Thr, Ser, or Glu
  misc_feature (9)..(9): Xaa can be Trp, Leu, Phe, Val, Ile, Met, Ala, or Tyr
KXQKAFDDX

SEQ ID NO: 166316 - protein, 11 aa, Artificial Sequence
  Description of Artificial Sequence: Synthetic peptide
  Seed: KIQKAFDDIAK (SSX2_HUMAN)
  misc_feature (2)..(2): Xaa can be Thr, Ala, Val, Leu, Ile, Met, Ser, Gln, Phe, Trp, Asp, Tyr, Gly, Cys, or Asn
  misc_feature (11)..(11): Xaa can be Lys, Arg, Tyr, His, or Phe
KXQKAFDDIAX

SEQ ID NO: 166317 - protein, 11 aa, Artificial Sequence
  Description of Artificial Sequence: Synthetic peptide
  Seed: KLGFKATLPPF (SSX2_HUMAN)
  misc_feature (2)..(2): Xaa can be Tyr, Trp, Met, Gln, Ala, Phe, Ser, Thr, Ile, Val, Leu, Cys, Asn, Glu, Pro, Arg, His, Asp, Gly, or Lys
  misc_feature (11)..(11): Xaa can be Phe, Tyr, Trp, Met, Leu, or Ile
KXGFKATLPPX

SEQ ID NO: 166318 - protein, 9 aa, Artificial Sequence
  Description of Artificial Sequence: Synthetic peptide
  Seed: KMKASEKIF (SSX2_HUMAN)
  misc_feature (2)..(2): Xaa can be Ala, Gln, Ser, Thr, Met, Val, Leu, Ile, Lys, Gly, Glu, Cys, Asn, Pro, Phe, Asp, His, Arg, Tyr, or Trp
  misc_feature (9)..(9): Xaa can be Tyr, Phe, Trp, Met, Leu, Ile, Val, His, or Ala
KXKASEKIX

SEQ ID NO: 166319 - protein, 10 aa, Artificial Sequence
  Description of Artificial Sequence: Synthetic peptide
  Seed: KMKASEKIFY (SSX2_HUMAN)
  misc_feature (2)..(2): Xaa can be Thr, Val, Ser, Met, Ile, Ala, Tyr, Phe, Leu, Gln, Trp, Gly, Asn, His, Cys, Glu, Lys, Arg, or Asp
  misc_feature (10)..(10): Xaa can be Tyr, Phe, Lys, Val, Ala, Ile, Leu, Met, Arg, Ser, Gly, Trp, Thr, Cys, Pro, Gln, Glu, His, or Asn
KXKASEKIFX

SEQ ID NO: 166320 - protein, 11 aa, Artificial Sequence
  Description of Artificial Sequence: Synthetic peptide
  Seed: KMKASEKIFYV (SSX2_HUMAN)
  misc_feature (2)..(2): Xaa can be Thr, Met, Ser, Val, Leu, Ile, Tyr, Ala, Phe, Gln, Trp, Gly, His, Asn, Cys, Lys, Asp, Arg, Pro, or Glu
  misc_feature (11)..(11): Xaa can be Val, Lys, Ala, Ile, Leu, Met, Ser, Thr, Gly, Tyr, Arg, Cys, Phe, or Pro
KXKASEKIFYX

SEQ ID NO: 166321 - protein, 11 aa, Artificial Sequence
  Description of Artificial Sequence: Synthetic peptide
  Seed: KPTTSEKIHER (SSX2_HUMAN)
  misc_feature (2)..(2): Xaa can be Met, Ser, Trp, Gly, Tyr, Thr, Asn, Glu, Lys, Ala, Gln, Asp, Leu, His, Val, Phe, Cys, Pro, Arg, or Ile
  misc_feature (11)..(11): Xaa can be Arg, or Lys
KXTTSEKIHEX

SEQ ID NO: 166322 - protein, 9 aa, Artificial Sequence
  Description of Artificial Sequence: Synthetic peptide
  Seed: KQLVIYEEI (SSX2_HUMAN)
  misc_feature (2)..(2): Xaa can be Glu, Gln, Arg, Met, Asp, His, Leu, Val, Ile, Thr, Asn, Ala, Ser, Gly, Lys, Tyr, Phe, Pro, Cys, or Trp
  misc_feature (9)..(9): Xaa can be Tyr, Leu, Phe, Val, Trp, Met, Ile, Ala, Thr, Cys, His, Lys, Pro, Arg, Ser, Asn, Gly, Gln, Asp, or Glu
KXLVIYEEX

SEQ ID NO: 166323 - protein, 11 aa, Artificial Sequence
  Description of Artificial Sequence: Synthetic peptide
  Seed: KRAEDFQGNDL (SSX2_HUMAN)
  misc_feature (2)..(2): Xaa can be Arg, His, Gln, Tyr, Gly, Ala, or Phe
  misc_feature (11)..(11): Xaa can be Leu, Phe, Met, Ile, Trp, Tyr, Lys, Val, Ala, His, Cys, or Arg
KXAEDFQGNDX

SEQ ID NO: 166324 - protein, 9 aa, Artificial Sequence
  Description of Artificial Sequence: Synthetic peptide
  Seed: KRGEHAWTH (SSX2_HUMAN)
  misc_feature (2)..(2): Xaa can be Arg, Gln, Tyr, Lys, Ala, Phe, His, Met, Trp, Glu, Asn, Leu, Ile, Ser, Thr, Val, Pro, or Gl y
  misc_feature (9)..(9): Xaa can be Phe, Met, Leu, Tyr, Ile, Val, Lys, Trp, Arg, His, Gln, Glu, Asn, Cys, Ala, or Thr
KXGEHAWTX

SEQ ID NO: 166325 - protein, 10 aa, Artificial Sequence
  Description of Artificial Sequence: Synthetic peptide
  Seed: KRGEHAWTHR (SSX2_HUMAN)
  misc_feature (2)..(2): Xaa can be Arg, Trp, Ser, Met, Phe, Thr, Val, Leu, Tyr, Ala, Gln, Ile, His, Asn, Lys, Pro, Gly, Cys, or Glu
  misc_feature (10)..(10): Xaa can be Arg, Lys, Met, His, Ile, Trp, Tyr, Leu, Val, or Phe
KXGEHAWTHX

SEQ ID NO: 166326 - protein, 11 aa, Artificial Sequence
  Description of Artificial Sequence: Synthetic peptide
  Seed: KRGEHAWTHRL (SSX2_HUMAN)
  misc_feature (2)..(2): Xaa can be Arg, Tyr, Gln, or His
  misc_feature (11)..(11): Xaa can be Phe, Leu, His, Val, Ile, Tyr, Lys, Gln, Met, Arg, or Trp
KXGEHAWTHRX

SEQ ID NO: 166327 - protein, 9 aa, Artificial Sequence
  Description of Artificial Sequence: Synthetic peptide
  Seed: KRKYEAMTK (SSX2_HUMAN)
  misc_feature (2)..(2): Xaa can be Ser, Val, Thr, Met, Tyr, Arg, Ala, Ile, Phe, Gln, Gly, Leu, Trp, Asn, Lys, His, Glu, or Cy s
  misc_feature (9)..(9): Xaa can be Lys, Leu, Met, Phe, Tyr, Ala, Ile, Val, Arg, Ser, Gly, Thr, Cys, Gln, His, Pro, Asn, Glu, or Trp
KXKYEAMTX

SEQ ID NO: 166328 - protein, 10 aa, Artificial Sequence
  Description of Artificial Sequence: Synthetic peptide
  Seed: KRKYEAMTKL (SSX2_HUMAN)
  misc_feature (2)..(2): Xaa can be Arg, or Gln
  misc_feature (10)..(10): Xaa can be Leu, His, Lys, Met, Phe, Ala, Trp, Tyr, Arg, Ile, Gln, or Val
KXKYEAMTKX

SEQ ID NO: 166329 - protein, 8 aa, Artificial Sequence
  Description of Artificial Sequence: Synthetic peptide
  Seed: KYEAMTKL (SSX2_HUMAN)
  misc_feature (2)..(2): Xaa can be Tyr, Arg, Phe, Glu, Ala, Gln, or His
  misc_feature (8)..(8): Xaa can be Leu, Met, Phe, or Tyr
KXEAMTKX

SEQ ID NO: 166330 - protein, 10 aa, Artificial Sequence
  Description of Artificial Sequence: Synthetic peptide
  Seed: KYEAMTKLGF (SSX2_HUMAN)
  misc_feature (2)..(2): Xaa can be Arg, Tyr, Gln, Asn, His, Thr, Cys, Asp, Leu, Pro, Met, Ala, Phe, Lys, Ile, Val, Glu, Ser, Trp, or Gly
  misc_feature (10)..(10): Xaa can be Val, Tyr, Ile, Met, Phe, Leu, or Trp
KXEAMTKLGX

SEQ ID NO: 166331 - protein, 11 aa, Artificial Sequence
  Description of Artificial Sequence: Synthetic peptide
  Seed: KYEAMTKLGFK (SSX2_HUMAN)
  misc_feature (2)..(2): Xaa can be Thr, Leu, Ser, Met, Val, Cys, Ala, Pro, Trp, Asp, Arg, Tyr, Asn, Gln, Ile, His, Glu, Gly, Lys, or Phe
  misc_feature (11)..(11): Xaa can be Lys, Arg, Ala, Tyr, Ile, or Val
KXEAMTKLGFX

SEQ ID NO: 166332 - protein, 8 aa, Artificial Sequence
  Description of Artificial Sequence: Synthetic peptide
  Seed: KYFSKEEW (SSX2_HUMAN)
  misc_feature (2)..(2): Xaa can be Tyr, Trp, or Phe
  misc_feature (8)..(8): Xaa can be Phe, Trp, Ile, or Leu
KXFSKEEX

SEQ ID NO: 166333 - protein, 10 aa, Artificial Sequence
  Description of Artificial Sequence: Synthetic peptide
  Seed: KYFSKEEWEK (SSX2_HUMAN)
  misc_feature (2)..(2): Xaa can be Met, Leu, Ile, Thr, Val, Tyr, Gln, Trp, Phe, Ser, Ala, Gly, Glu, Asn, Lys, Arg, Asp, His, Cys, or Pro
  misc_feature (10)..(10): Xaa can be Arg, Tyr, Lys, Phe, Trp, Met, Leu, Val, Ile, or His
KXFSKEEWEX

SEQ ID NO: 166334 - protein, 11 aa, Artificial Sequence
  Description of Artificial Sequence: Synthetic peptide
  Seed: KYFSKEEWEKM (SSX2_HUMAN)
  misc_feature (2)..(2): Xaa can be Tyr, Arg, Trp, Phe, His, Gln, or Met
  misc_feature (11)..(11): Xaa can be Phe, Tyr, Leu, Met, Ile, Trp, His, or Val
KXFSKEEWEKX

SEQ ID NO: 166335 - protein, 11 aa, Artificial Sequence
  Description of Artificial Sequence: Synthetic peptide
  Seed: LDNDPNRGNQV (SSX2_HUMAN)
  misc_feature (2)..(2): Xaa can be Glu, Asp, or Gln
  misc_feature (11)..(11): Xaa can be Leu, Cys, Met, Phe, Ile, Val, Trp, Ala, Ser, Thr, Pro, Gly, or Tyr
LXNDPNRGNQX

SEQ ID NO: 166336 - protein, 10 aa, Artificial Sequence
  Description of Artificial Sequence: Synthetic peptide
  Seed: LGFKATLPPF (SSX2_HUMAN)
  misc_feature (2)..(2): Xaa can be Gln, Met, Lys, Ser, Val, His, Thr, Leu, Glu, Ala, Ile, Arg, Gly, Asn, Tyr, Phe, Cys, Pro, Asp, or Trp
  misc_feature (10)..(10): Xaa can be Tyr, Phe, Met, Trp, Leu, Ile, His, Val, Ala, Gly, Ser, Cys, or Thr
LXFKATLPPX

SEQ ID NO: 166337 - protein, 9 aa, Artificial Sequence
  Description of Artificial Sequence: Synthetic peptide
  Seed: LPPFMCNKR (SSX2_HUMAN)
  misc_feature (2)..(2): Xaa can be Asn, Val, Phe, Gln, Tyr, Trp, Thr, Leu, Gly, Ile, Ala, Met, Ser, or Pro
  misc_feature (9)..(9): Xaa can be , or Arg
LXPFMCNKX

SEQ ID NO: 166338 - protein, 10 aa, Artificial Sequence
  Description of Artificial Sequence: Synthetic peptide
  Seed: LPPFMCNKRA (SSX2_HUMAN)
  misc_feature (2)..(2): Xaa can be Gln, Ala, Val, Asp, Leu, His, Thr, Asn, Trp, Met, Lys, Pro, Ser, Tyr, Ile, Phe, Arg, Glu, Cys, or Gly
  misc_feature (10)..(10): Xaa can be , or Ala
LXPFMCNKRX

SEQ ID NO: 166339 - protein, 8 aa, Artificial Sequence
  Description of Artificial Sequence: Synthetic peptide
  Seed: LQGISPKI (SSX2_HUMAN)
  misc_feature (2)..(2): Xaa can be Gln, Val, Met, Glu, Ala, Gly, Ser, Pro, Asn, Leu, or Ile
  misc_feature (8)..(8): Xaa can be Val, Ile, Leu, Met, or Phe
LXGISPKX

SEQ ID NO: 166340 - protein, 9 aa, Artificial Sequence
  Description of Artificial Sequence: Synthetic peptide
  Seed: LQGISPKIM (SSX2_HUMAN)
  misc_feature (2)..(2): Xaa can be Ala, Gln, Ser, Met, Val, Arg, Tyr, Glu, Leu, Phe, Thr, Ile, His, Gly, Lys, Pro, Asn, Trp, Asp, or Cys
  misc_feature (9)..(9): Xaa can be Tyr, Leu, Phe, Met, Val, Ile, His, Trp, or Ala
LXGISPKIX

SEQ ID NO: 166341 - protein, 11 aa, Artificial Sequence
  Description of Artificial Sequence: Synthetic peptide
  Seed: LQGISPKIMPK (SSX2_HUMAN)
  misc_feature (2)..(2): Xaa can be Val, Asp, Thr, Gly, His, Met, Glu, Tyr, Ser, Ala, Leu, Trp, Arg, Phe, Ile, Gln, Asn, Pro, Lys, or Cys
  misc_feature (11)..(11): Xaa can be , or Lys
LXGISPKIMPX

SEQ ID NO: 166342 - protein, 9 aa, Artificial Sequence
  Description of Artificial Sequence: Synthetic peptide
  Seed: LRERKQLVI (SSX2_HUMAN)
  misc_feature (2)..(2): Xaa can be Arg, Gln, Gly, Ser, Asn, Tyr, Leu, Phe, Ala, Met, Ile, Thr, Glu, His, Trp, Val, Asp, Pro, Cys, or Lys
  misc_feature (9)..(9): Xaa can be Ile, Leu, Met, Phe, Val, Lys, Tyr, Arg, Trp, or His
LXERKQLVX

SEQ ID NO: 166343 - protein, 10 aa, Artificial Sequence
  Description of Artificial Sequence: Synthetic peptide
  Seed: LRERKQLVIY (SSX2_HUMAN)
  misc_feature (2)..(2): Xaa can be Arg, Leu, Met, Gln, Ala, Ile, Val, Thr, Ser, Gly, or Asn
  misc_feature (10)..(10): Xaa can be Leu, Phe, Lys, Tyr, or Arg
LXERKQLVIX

SEQ ID NO: 166344 - protein, 9 aa, Artificial Sequence
  Description of Artificial Sequence: Synthetic peptide
  Seed: MCNKRAEDF (SSX2_HUMAN)
  misc_feature (2)..(2): Xaa can be Ser, Thr, Ala, Val, Gln, Met, Phe, Cys, Ile, Tyr, Gly, Leu, Asn, or Trp
  misc_feature (9)..(9): Xaa can be Tyr, Phe, Met, Leu, Ile, Val, or Trp
MXNKRAEDX

SEQ ID NO: 166345 - protein, 8 aa, Artificial Sequence
  Description of Artificial Sequence: Synthetic peptide
  Seed: MKASEKIF (SSX2_HUMAN)
  misc_feature (2)..(2): Xaa can be Gln, Lys, or Met
  misc_feature (8)..(8): Xaa can be Tyr, Phe, or Met
MXASEKIX

SEQ ID NO: 166346 - protein, 9 aa, Artificial Sequence
  Description of Artificial Sequence: Synthetic peptide
  Seed: MKASEKIFY (SSX2_HUMAN)
  misc_feature (2)..(2): Xaa can be Gln, Met, Lys, Leu, Val, Ala, Ile, Glu, Arg, Ser, Pro, His, Asn, Phe, Tyr, Asp, Gly, Trp, Thr, or Cys
  misc_feature (9)..(9): Xaa can be Tyr, Phe, Met, Leu, Ile, Trp, His, or Val
MXASEKIFX

SEQ ID NO: 166347 - protein, 10 aa, Artificial Sequence
  Description of Artificial Sequence: Synthetic peptide
  Seed: MKASEKIFYV (SSX2_HUMAN)
  misc_feature (2)..(2): Xaa can be Met, Leu, Gln, Ile, Thr, Val, Ala, Ser, Phe, His, Glu, Pro, Lys, Gly, Arg, Trp, Asp, Cys, Tyr, or Asn
  misc_feature (10)..(10): Xaa can be Ile, Val, Met, Ala, Phe, Tyr, Leu, Thr, Ser, Cys, Gly, Glu, Pro, or Arg
MXASEKIFYX

SEQ ID NO: 166348 - protein, 11 aa, Artificial Sequence
  Description of Artificial Sequence: Synthetic peptide
  Seed: MKASEKIFYVY (SSX2_HUMAN)
  misc_feature (2)..(2): Xaa can be Gln, Lys, Met, His, Arg, Ser, Glu, Leu, Ala, Asn, Ile, Tyr, Gly, Val, or Thr
  misc_feature (11)..(11): Xaa can be Tyr, Phe, Met, Leu, His, Trp, or Ile
MXASEKIFYVX

SEQ ID NO: 166349 - protein, 8 aa, Artificial Sequence
  Description of Artificial Sequence: Synthetic peptide
  Seed: MKRKYEAM (SSX2_HUMAN)
  misc_feature (2)..(2): Xaa can be Met, Leu, Gln, Ala, Lys, Ile, Pro, Arg, Val, Phe, Ser, His, Asn, Gly, Tyr, Trp, Thr, Glu, or Cys
  misc_feature (8)..(8): Xaa can be Leu, Met, Ile, Val, Phe, Tyr, Ala, Cys, or Trp
MXRKYEAX

SEQ ID NO: 166350 - protein, 10 aa, Artificial Sequence
  Description of Artificial Sequence: Synthetic peptide
  Seed: MKRKYEAMTK (SSX2_HUMAN)
  misc_feature (2)..(2): Xaa can be Thr, Ser, Val, Tyr, Met, Ala, Gln, Trp, Ile, Phe, Gly, Asn, His, Arg, Lys, Leu, or Cys
  misc_feature (10)..(10): Xaa can be Lys, Ala, Val, Ile, Arg, Met, Tyr, Leu, Ser, Gly, Thr, Pro, or Phe
MXRKYEAMTX

SEQ ID NO: 166351 - protein, 9 aa, Artificial Sequence
  Description of Artificial Sequence: Synthetic peptide
  Seed: MNGDDAFAR (SSX2_HUMAN)
  misc_feature (2)..(2): Xaa can be Ala, Ser, Met, Thr, Leu, Ile, Val, Gly, Cys, Asn, Trp, Glu, Phe, Tyr, Asp, Gln, Pro, or Hi s
  misc_feature (9)..(9): Xaa can be Arg, Lys, Tyr, Leu, Met, Phe, Val, Ile, His, or Ala
MXGDDAFAX

SEQ ID NO: 166352 - protein, 10 aa, Artificial Sequence
  Description of Artificial Sequence: Synthetic peptide
  Seed: MNGDDAFARR (SSX2_HUMAN)
  misc_feature (2)..(2): Xaa can be Met, Leu, Ala, Thr, Val, Ser, Ile, Gln, Glu, Tyr, Asp, Phe, Gly, Asn, Trp, His, or Pro
  misc_feature (10)..(10): Xaa can be Arg, Lys, Met, Leu, Tyr, Phe, Ile, or Val
MXGDDAFARX

SEQ ID NO: 166353 - protein, 9 aa, Artificial Sequence
  Description of Artificial Sequence: Synthetic peptide
  Seed: MPKKPAEEG (SSX2_HUMAN)
  misc_feature (2)..(2): Xaa can be Pro, Ala, Val, Met, Ile, Ser, Leu, Gly, Thr, Gln, Glu, Cys, Asp, Phe, Asn, or Tyr
  misc_feature (9)..(9): Xaa can be Leu, Met, Phe, Tyr, Ala, Ile, Val, Cys, Thr, Pro, Ser, Trp, Gln, Glu, Gly, His, Asp, Asn, Arg, or Lys
MXKKPAEEX

SEQ ID NO: 166354 - protein, 9 aa, Artificial Sequence
  Description of Artificial Sequence: Synthetic peptide
  Seed: MTFGRLQGI (SSX2_HUMAN)
  misc_feature (2)..(2): Xaa can be Arg, Thr, Met, Leu, Gln, Val, Ile, Ala, Ser, Pro, Asn, Gly, Tyr, Glu, Phe, Cys, Asp, Lys, Trp, or His
  misc_feature (9)..(9): Xaa can be Tyr, Val, Leu, Trp, Met, Phe, Lys, Ile, Arg, Ala, His, Cys, Thr, Ser, Pro, Gly, Gln, Glu, or Asn
MXFGRLQGX

SEQ ID NO: 166355 - protein, 10 aa, Artificial Sequence
  Description of Artificial Sequence: Synthetic peptide
  Seed: MTFGRLQGIS (SSX2_HUMAN)
  misc_feature (2)..(2): Xaa can be Thr, Val, Ser, Ala, Ile, Leu, Met, or Asn
  misc_feature (10)..(10): Xaa can be Val, Ile, Leu, Ala, Met, Tyr, Cys, Gly, Phe, Pro, Ser, Thr, or Arg
MXFGRLQGIX

SEQ ID NO: 166356 - protein, 9 aa, Artificial Sequence
  Description of Artificial Sequence: Synthetic peptide
  Seed: MTKLGFKAT (SSX2_HUMAN)
  misc_feature (2)..(2): Xaa can be Thr, Ser, Val, Met, Ala, Ile, Gly, Gln, Phe, Trp, Tyr, Cys, Leu, Lys, Arg, Asn, or His
  misc_feature (9)..(9): Xaa can be Lys, Ala, Val, Ile, Ser, Met, Gly, Leu, Pro, Tyr, Arg, Thr, Phe, Cys, Asn, or His
MXKLGFKAX

SEQ ID NO: 166357 - protein, 10 aa, Artificial Sequence
  Description of Artificial Sequence: Synthetic peptide
  Seed: MTKLGFKATL (SSX2_HUMAN)
  misc_feature (2)..(2): Xaa can be Thr, Ser, Gln, Met, Leu, Val, Ala, Pro, Arg, Ile, Tyr, Gly, Asn, Phe, His, Glu, Asp, Cys, Trp, or Lys
  misc_feature (10)..(10): Xaa can be Tyr, Phe, Leu, Met, Lys, Trp, Ile, Ala, Val, Arg, Ser, His, or Gly
MXKLGFKATX

SEQ ID NO: 166358 - protein, 9 aa, Artificial Sequence
  Description of Artificial Sequence: Synthetic peptide
  Seed: NDLDNDPNR (SSX2_HUMAN)
  misc_feature (2)..(2): Xaa can be Ala, Thr, Val, Ser, Ile, Gly, Phe, Gln, Asp, Met, Asn, Leu, Cys, Tyr, Glu, or Pro
  misc_feature (9)..(9): Xaa can be Lys, Arg, Met, Leu, Ile, Val, Tyr, or Phe
NXLDNDPNX

SEQ ID NO: 166359 - protein, 9 aa, Artificial Sequence
  Description of Artificial Sequence: Synthetic peptide
  Seed: NDPNRGNQV (SSX2_HUMAN)
  misc_feature (2)..(2): Xaa can be Glu, Tyr, Arg, Ala, Gln, Phe, Ser, Val, Met, Leu, Asp, Ile, Thr, Trp, Pro, Lys, His, Asn, Gly, or Cys
  misc_feature (9)..(9): Xaa can be Phe, Ile, Met, Val, Leu, Cys, Ala, Tyr, Thr, Pro, Trp, or Ser
NXPNRGNQX

SEQ ID NO: 166360 - protein, 9 aa, Artificial Sequence
  Description of Artificial Sequence: Synthetic peptide
  Seed: NDSEEVPEA (SSX2_HUMAN)
  misc_feature (2)..(2): Xaa can be Glu, Asp, Gln, Val, Ile, Ala, Ser, Asn, Gly, Thr, Leu, or Met
  misc_feature (9)..(9): Xaa can be Leu, Phe, Met, Ile, Trp, Cys, Val, Tyr, Thr, Pro, Ala, Arg, Lys, Gly, Asn, Glu, Gln, Ser, or Asp
NXSEEVPEX

SEQ ID NO: 166361 - protein, 8 aa, Artificial Sequence
  Description of Artificial Sequence: Synthetic peptide
  Seed: NGDDAFAR (SSX2_HUMAN)
  misc_feature (2)..(2): Xaa can be Ala, Thr, Val, Ser, Met, Ile, Gly, Leu, Phe, or Gln
  misc_feature (8)..(8): Xaa can be Lys, Arg, Leu, Met, or Phe
NXDDAFAX

SEQ ID NO: 166362 - protein, 9 aa, Artificial Sequence
  Description of Artificial Sequence: Synthetic peptide
  Seed: NGDDAFARR (SSX2_HUMAN)
  misc_feature (2)..(2): Xaa can be Thr, Ser, Val, Ile, Leu, Ala, Gly, Met, Tyr, Trp, Phe, Gln, Cys, Arg, Asn, Pro, His, Glu, Asp, or Lys
  misc_feature (9)..(9): Xaa can be Tyr, Lys, Arg, Leu, Met, Phe, Ile, Val, Trp, His, Gln, or Ala
NXDDAFARX

SEQ ID NO: 166363 - protein, 8 aa, Artificial Sequence
  Description of Artificial Sequence: Synthetic peptide
  Seed: NQVERPQM (SSX2_HUMAN)
  misc_feature (2)..(2): Xaa can be His, Gln, Arg, Glu, Tyr, Asn, Ala, Phe, Lys, Met, Ser, Pro, Val, Thr, Gly, Ile, Leu, Asp, or Trp
  misc_feature (8)..(8): Xaa can be Leu, Ile, Val, Met, Phe, Tyr, Ala, Cys, Thr, Ser, Pro, or Gly
NXVERPQX

SEQ ID NO: 166364 - protein, 9 aa, Artificial Sequence
  Description of Artificial Sequence: Synthetic peptide
  Seed: NQVERPQMT (SSX2_HUMAN)
  misc_feature (2)..(2): Xaa can be His, Arg, Gln, Glu, Lys, Pro, Asn, or Ala
  misc_feature (9)..(9): Xaa can be Ala, Leu, Val, Ile, Met, Pro, Cys, Thr, Ser, Phe, or Gly
NXVERPQMX

SEQ ID NO: 166365 - protein, 10 aa, Artificial Sequence
  Description of Artificial Sequence: Synthetic peptide
  Seed: NQVERPQMTF (SSX2_HUMAN)
  misc_feature (2)..(2): Xaa can be Glu, Arg, His, Gln, Met, Ala, Asp, Leu, Tyr, Phe, Ser, Val, Thr, Pro, Lys, Trp, Ile, Asn, Cys, or Gly
  misc_feature (10)..(10): Xaa can be Tyr, Phe, Met, Leu, Ile, Trp, Val, His, Cys, or Lys
NXVERPQMTX

SEQ ID NO: 166366 - protein, 11 aa, Artificial Sequence
  Description of Artificial Sequence: Synthetic peptide
  Seed: NRGNQVERPQM (SSX2_HUMAN)
  misc_feature (2)..(2): Xaa can be Arg, or Gly
  misc_feature (11)..(11): Xaa can be Lys, Tyr, Met, Ile, Leu, Arg, Phe, or Trp
NXGNQVERPQX

SEQ ID NO: 166367 - protein, 10 aa, Artificial Sequence
  Description of Artificial Sequence: Synthetic peptide
  Seed: PTTSEKIHER (SSX2_HUMAN)
  misc_feature (2)..(2): Xaa can be Phe, Glu, Met, Tyr, His, Val, Asp, Asn, Ser, Trp, or Thr
  misc_feature (10)..(10): Xaa can be Arg, or Lys
PXTSEKIHEX

SEQ ID NO: 166368 - protein, 10 aa, Artificial Sequence
  Description of Artificial Sequence: Synthetic peptide
  Seed: PTVGAQIPEK (SSX2_HUMAN)
  misc_feature (2)..(2): Xaa can be Val, Thr, Ala, Ile, Met, or Ser
  misc_feature (10)..(10): Xaa can be Lys, or Arg
PXVGAQIPEX

SEQ ID NO: 166369 - protein, 10 aa, Artificial Sequence
  Description of Artificial Sequence: Synthetic peptide
  Seed: QGISPKIMPK (SSX2_HUMAN)
  misc_feature (2)..(2): Xaa can be Thr, Val, Ile, Leu, Ala, Met, Ser, Phe, Pro, Cys, Gln, Arg, Asp, Glu, Lys, Trp, Tyr, His, Asn, or Gly
  misc_feature (10)..(10): Xaa can be Arg, Lys, Tyr, His, Gln, Phe, Leu, or Met
QXISPKIMPX

SEQ ID NO: 166370 - protein, 11 aa, Artificial Sequence
  Description of Artificial Sequence: Synthetic peptide
  Seed: QGISPKIMPKK (SSX2_HUMAN)
  misc_feature (2)..(2): Xaa can be Thr, Met, Leu, Ser, Val, Ala, Ile, Gly, or Gln
  misc_feature (11)..(11): Xaa can be Lys, Arg, His, or Tyr
QXISPKIMPKX

SEQ ID NO: 166371 - protein, 11 aa, Artificial Sequence
  Description of Artificial Sequence: Synthetic peptide
  Seed: QGNDLDNDPNR (SSX2_HUMAN)
  misc_feature (2)..(2): Xaa can be Ala, Val, Thr, Ser, Met, Ile, Leu, Gly, Gln, Asp, Cys, Phe, Tyr, Asn, Trp, Glu, His, Arg, or Pro
  misc_feature (11)..(11): Xaa can be Lys, Arg, Tyr, Phe, Leu, His, Met, or Trp
QXNDLDNDPNX

SEQ ID NO: 166372 - protein, 8 aa, Artificial Sequence
  Description of Artificial Sequence: Synthetic peptide
  Seed: QIPEKIQK (SSX2_HUMAN)
  misc_feature (2)..(2): Xaa can be Ala, Thr, Ser, Val, Ile, Gly, Phe, Met, or Leu
  misc_feature (8)..(8): Xaa can be Leu, Lys, Tyr, Met, Phe, Val, Ile, Arg, or Trp
QXPEKIQX

SEQ ID NO: 166373 - protein, 9 aa, Artificial Sequence
  Description of Artificial Sequence: Synthetic peptide
  Seed: QIPEKIQKA (SSX2_HUMAN)
  misc_feature (2)..(2): Xaa can be Ala, Val, Thr, Met, Ile, Leu, Ser, Gln, Gly, Pro, Phe, Asn, Cys, Tyr, Trp, Glu, Asp, Lys, His, or Arg
  misc_feature (9)..(9): Xaa can be Leu, Met, Arg, Val, Ile, Phe, Lys, Tyr, Ala, Cys, His, Thr, Gln, or Trp
QXPEKIQKX

SEQ ID NO: 166374 - protein, 10 aa, Artificial Sequence
  Description of Artificial Sequence: Synthetic peptide
  Seed: QIPEKIQKAF (SSX2_HUMAN)
  misc_feature (2)..(2): Xaa can be Met, Leu, Ala, Ile, Val, Gln, Thr, Ser, Gly, Glu, Phe, Tyr, Cys, Pro, or Asn
  misc_feature (10)..(10): Xaa can be Tyr, Leu, Phe, Met, or Ile
QXPEKIQKAX

SEQ ID NO: 166375 - protein, 10 aa, Artificial Sequence
  Description of Artificial Sequence: Synthetic peptide
  Seed: QKAFDDIAKY (SSX2_HUMAN)
  misc_feature (2)..(2): Xaa can be Pro, Met, Ala, Gln, Lys, Arg, Tyr, Glu, Leu, Ile, Ser, Trp, Cys, Val, Gly, His, Thr, Asp, Asn, or Phe
  misc_feature (10)..(10): Xaa can be Tyr, Phe, or Met
QXAFDDIAKX

SEQ ID NO: 166376 - protein, 8 aa, Artificial Sequence
  Description of Artificial Sequence: Synthetic peptide
  Seed: QLVIYEEI (SSX2_HUMAN)
  misc_feature (2)..(2): Xaa can be Gln, Gly, Met, Ala, Ser, Glu, Asn, or Leu
  misc_feature (8)..(8): Xaa can be Ile, Val, Leu, Met, or Phe
QXVIYEEX

SEQ ID NO: 166377 - protein, 10 aa, Artificial Sequence
  Description of Artificial Sequence: Synthetic peptide
  Seed: QMTFGRLQGI (SSX2_HUMAN)
  misc_feature (2)..(2): Xaa can be Leu, Met, Gln, Phe, Tyr, Glu, Ile, Val, Asp, Gly, Cys, Lys, Thr, Asn, Ser, Trp, His, Pro, Arg, or Ala
  misc_feature (10)..(10): Xaa can be Val, Ile, Leu, Ala, Thr, or Met
QXTFGRLQGX

SEQ ID NO: 166378 - protein, 9 aa, Artificial Sequence
  Description of Artificial Sequence: Synthetic peptide
  Seed: QVERPQMTF (SSX2_HUMAN)
  misc_feature (2)..(2): Xaa can be Thr, Ala, Ser, Leu, Gln, Val, Ile, Met, Pro, Glu, Asn, Gly, Tyr, Phe, Cys, Arg, Asp, Lys, Trp, or His
  misc_feature (9)..(9): Xaa can be Tyr, Trp, Phe, Met, Leu, Ile, Lys, Val, His, or Arg
QXERPQMTX

SEQ ID NO: 166379 - protein, 11 aa, Artificial Sequence
  Description of Artificial Sequence: Synthetic peptide
  Seed: QVERPQMTFGR (SSX2_HUMAN)
  misc_feature (2)..(2): Xaa can be Tyr, Thr, or Val
  misc_feature (11)..(11): Xaa can be , or Arg
QXERPQMTFGX

SEQ ID NO: 166380 - protein, 10 aa, Artificial Sequence
  Description of Artificial Sequence: Synthetic peptide
  Seed: RAEDFQGNDL (SSX2_HUMAN)
  misc_feature (2)..(2): Xaa can be Ala, Thr, Ser, Val, Met, Leu, Phe, Tyr, Ile, Arg, Gly, Gln, Glu, Trp, Cys, His, Asn, Asp, Lys, or Pro
  misc_feature (10)..(10): Xaa can be Leu, Met, Phe, Lys, Tyr, Arg, Ile, Val, Trp, or His
RXEDFQGNDX

SEQ ID NO: 166381 - protein, 8 aa, Artificial Sequence
  Description of Artificial Sequence: Synthetic peptide
  Seed: RERKQLVI (SSX2_HUMAN)
  misc_feature (2)..(2): Xaa can be Glu, Asp, Gln, His, or Ala
  misc_feature (8)..(8): Xaa can be Leu, Val, Ile, Met, Phe, Cys, Ala, Pro, Thr, or Tyr
RXRKQLVX

SEQ ID NO: 166382 - protein, 9 aa, Artificial Sequence
  Description of Artificial Sequence: Synthetic peptide
  Seed: RERKQLVIY (SSX2_HUMAN)
  misc_feature (2)..(2): Xaa can be Arg, Glu, Asp, Gln, Ala, Met, Val, Ile, Ser, Thr, Leu, Lys, Gly, His, Asn, Tyr, Phe, Cys, Trp, or Pro
  misc_feature (9)..(9): Xaa can be Tyr, Leu, Phe, Ile, Met, Lys, Val, Arg, Trp, His, Ala, Cys, Gly, Thr, Pro, Ser, Gln, Glu, Asn, or Asp
RXRKQLVIX

SEQ ID NO: 166383 - protein, 9 aa, Artificial Sequence
  Description of Artificial Sequence: Synthetic peptide
  Seed: RGEHAWTHR (SSX2_HUMAN)
  misc_feature (2)..(2): Xaa can be Phe, Trp, Val, Ala, Tyr, Met, Thr, Gly, Ile, Gln, Leu, Ser, Asn, Pro, or Cys
  misc_feature (9)..(9): Xaa can be Arg, or Lys
RXEHAWTHX

SEQ ID NO: 166384 - protein, 10 aa, Artificial Sequence
  Description of Artificial Sequence: Synthetic peptide
  Seed: RGEHAWTHRL (SSX2_HUMAN)
  misc_feature (2)..(2): Xaa can be Ile, Gly, Gln, Met, Glu, Trp, Ser, Pro, Leu, Lys, Asp, Arg, Val, Cys, Asn, Phe, His, Tyr, Ala, or Thr
  misc_feature (10)..(10): Xaa can be Phe, Leu, Ile, Val, or Met
RXEHAWTHRX

SEQ ID NO: 166385 - protein, 11 aa, Artificial Sequence
  Description of Artificial Sequence: Synthetic peptide
  Seed: RGEHAWTHRLR (SSX2_HUMAN)
  misc_feature (2)..(2): Xaa can be Thr, Trp, Gln, Phe, Met, Tyr, Ile, Ser, Val, Leu, Asn, Ala, Cys, or Gly
  misc_feature (11)..(11): Xaa can be Arg, or Lys
RXEHAWTHRLX

SEQ ID NO: 166386 - protein, 10 aa, Artificial Sequence
  Description of Artificial Sequence: Synthetic peptide
  Seed: RKQLVIYEEI (SSX2_HUMAN)
  misc_feature (2)..(2): Xaa can be Arg, Gln, Lys, Tyr, His, Asp, Val, Glu, Ile, Thr, Leu, Trp, Ser, Gly, Phe, Cys, Ala, Asn, Pro, or Met
  misc_feature (10)..(10): Xaa can be Leu, Ile, Phe, Val, Met, Cys, Thr, Ala, or Ser
RXQLVIYEEX

SEQ ID NO: 166387 - protein, 9 aa, Artificial Sequence
  Description of Artificial Sequence: Synthetic peptide
  Seed: RKYEAMTKL (SSX2_HUMAN)
  misc_feature (2)..(2): Xaa can be Arg, Gln, Met, Glu, His, Leu, Ala, Lys, Ser, Ile, Val, Thr, Asp, Tyr, Asn, Gly, Cys, Pro, Phe, or Trp
  misc_feature (9)..(9): Xaa can be Ile, Met, Tyr, Phe, Leu, Val, Trp, Ala, Cys, His, Arg, Lys, Thr, Gly, Ser, Gln, Pro, Asn, Asp, or Glu
RXYEAMTKX

SEQ ID NO: 166388 - protein, 11 aa, Artificial Sequence
  Description of Artificial Sequence: Synthetic peptide
  Seed: RKYEAMTKLGF (SSX2_HUMAN)
  misc_feature (2)..(2): Xaa can be Arg, Gln, Lys, Tyr, His, Glu, Trp, Met, Phe, Ala, Thr, Ser, Leu, Asn, Gly, Ile, or Val
  misc_feature (11)..(11): Xaa can be Phe, Tyr, Met, Trp, Leu, Lys, Ile, Arg, Val, His, Thr, Gln, Pro, Asn, Gly, Cys, Ser, Glu, Asp, or Ala
RXYEAMTKLGX

SEQ ID NO: 166389 - protein, 8 aa, Artificial Sequence
  Description of Artificial Sequence: Synthetic peptide
  Seed: RLQGISPK (SSX2_HUMAN)
  misc_feature (2)..(2): Xaa can be Leu, or Met
  misc_feature (8)..(8): Xaa can be , or Lys
RXQGISPX

SEQ ID NO: 166390 - protein, 9 aa, Artificial Sequence
  Description of Artificial Sequence: Synthetic peptide
  Seed: RLQGISPKI (SSX2_HUMAN)
  misc_feature (2)..(2): Xaa can be Arg, Gln, Leu, Met, Thr, Ala, Ser, Ile, Val, Tyr, Glu, Asn, Cys, Trp, Phe, Lys, Gly, His, Asp, or Pro
  misc_feature (9)..(9): Xaa can be Tyr, Leu, Trp, Phe, Val, Met, Arg, Lys, Ile, Ala, His, Cys, Thr, Gly, Pro, Ser, Gln, Asn, or Glu
RXQGISPKX

SEQ ID NO: 166391 - protein, 10 aa, Artificial Sequence
  Description of Artificial Sequence: Synthetic peptide
  Seed: RLQGISPKIM (SSX2_HUMAN)
  misc_feature (2)..(2): Xaa can be Gln, Met, Val, Ile, Glu, Leu, His, Lys, Ser, Ala, Thr, Trp, Gly, Asn, Tyr, Asp, Arg, Pro, Cys, or Phe
  misc_feature (10)..(10): Xaa can be Phe, Tyr, Trp, Met, Leu, Ile, Val, Thr, Cys, Ala, or His
RXQGISPKIX

SEQ ID NO: 166392 - protein, 8 aa, Artificial Sequence
  Description of Artificial Sequence: Synthetic peptide
  Seed: RLRERKQL (SSX2_HUMAN)
  misc_feature (2)..(2): Xaa can be Pro, Met, Leu, Ser, Ile, Gly, Val, Gln, or Ala
  misc_feature (8)..(8): Xaa can be Leu, Met, Phe, Ile, or Val
RXRERKQX

SEQ ID NO: 166393 - protein, 9 aa, Artificial Sequence
  Description of Artificial Sequence: Synthetic peptide
  Seed: RLRERKQLV (SSX2_HUMAN)
  misc_feature (2)..(2): Xaa can be Thr, Val, Ser, Met, Tyr, Ala, Leu, Phe, Ile, Gln, Trp, Gly, Asn, Pro, Asp, Glu, Arg, His, Cys, or Lys
  misc_feature (9)..(9): Xaa can be Leu, Met, Tyr, Lys, Ile, Phe, Val, Trp, Ala, Arg, Ser, Cys, Thr, Gln, Gly, Pro, Asn, His, Glu, or Asp
RXRERKQLX

SEQ ID NO: 166394 - protein, 10 aa, Artificial Sequence
  Description of Artificial Sequence: Synthetic peptide
  Seed: RLRERKQLVI (SSX2_HUMAN)
  misc_feature (2)..(2): Xaa can be Thr, Val, Tyr, Ser, Phe, Met, Ile, Ala, Trp, Leu, Gln, Pro, Gly, Asn, Cys, or His
  misc_feature (10)..(10): Xaa can be Lys, Val, Ala, Leu, Met, Ile, Tyr, Ser, Phe, Arg, Gly, Thr, Cys, Pro, Gln, Asn, Glu, His, or Asp
RXRERKQLVX

SEQ ID NO: 166395 - protein, 11 aa, Artificial Sequence
  Description of Artificial Sequence: Synthetic peptide
  Seed: RLRERKQLVIY (SSX2_HUMAN)
  misc_feature (2)..(2): Xaa can be Met, Gln, Leu, Thr, Val, Ile, Ser, Tyr, Ala, Phe, or Trp
  misc_feature (11)..(11): Xaa can be Tyr, Phe, or Met
RXRERKQLVIX

SEQ ID NO: 166396 - protein, 9 aa, Artificial Sequence
  Description of Artificial Sequence: Synthetic peptide
  Seed: RPQMTFGRL (SSX2_HUMAN)
  misc_feature (2)..(2): Xaa can be Pro, Ala, Val, or Ile
  misc_feature (9)..(9): Xaa can be Leu, Met, Val, Tyr, Trp, Phe, Ser, Cys, Ile, Ala, Thr, Gly, or Pro
RXQMTFGRX

SEQ ID NO: 166397 - protein, 10 aa, Artificial Sequence
  Description of Artificial Sequence: Synthetic peptide
  Seed: RPQMTFGRLQ (SSX2_HUMAN)
  misc_feature (2)..(2): Xaa can be , or Pro
  misc_feature (10)..(10): Xaa can be His, Leu, Ser, Asp, Cys, Ile, Gln, Trp, Val, Tyr, Lys, Glu, Asn, Thr, Phe, Gly, Met, Ala, Pro, or Arg
RXQMTFGRLX

SEQ ID NO: 166398 - protein, 8 aa, Artificial Sequence
  Description of Artificial Sequence: Synthetic peptide
  Seed: RPTVGAQI (SSX2_HUMAN)
  misc_feature (2)..(2): Xaa can be , or Pro
  misc_feature (8)..(8): Xaa can be Met, Phe, Ala, Cys, Leu, Thr, Val, Ile, or Pro
RXTVGAQX

SEQ ID NO: 166399 - protein, 9 aa, Artificial Sequence
  Description of Artificial Sequence: Synthetic peptide
  Seed: RPTVGAQIP (SSX2_HUMAN)
  misc_feature (2)..(2): Xaa can be Pro, or Ala
  misc_feature (9)..(9): Xaa can be Ala, Leu, Cys, Ser, Pro, Trp, Tyr, Thr, Ile, Met, Val, Gly, or Phe
RXTVGAQIX

SEQ ID NO: 166400 - protein, 9 aa, Artificial Sequence
  Description of Artificial Sequence: Synthetic peptide
  Seed: RRPTVGAQI (SSX2_HUMAN)
  misc_feature (2)..(2): Xaa can be Arg, Gln, Ala, Tyr, His, Gly, Phe, Lys, Ser, Asn, Ile, Val, Thr, Met, Cys, Pro, Trp, Glu, Leu, or Asp
  misc_feature (9)..(9): Xaa can be Phe, Leu, Met, Ile, Val, Tyr, Cys, Lys, Trp, Arg, Ala, His, Gly, Gln, Thr, Pro, or Ser
RXPTVGAQX

SEQ ID NO: 166401 - protein, 9 aa, Artificial Sequence
  Description of Artificial Sequence: Synthetic peptide
  Seed: RSGPKRGEH (SSX2_HUMAN)
  misc_feature (2)..(2): Xaa can be Ala, Ser, Val, Thr, Met, Ile, Gln, Leu, Gly, Glu, Asn, Cys, or Asp
  misc_feature (9)..(9): Xaa can be Tyr, Phe, Met, Leu, Ile, His, Val, or Ala
RXGPKRGEX

SEQ ID NO: 166402 - protein, 11 aa, Artificial Sequence
  Description of Artificial Sequence: Synthetic peptide
  Seed: RSGPKRGEHAW (SSX2_HUMAN)
  misc_feature (2)..(2): Xaa can be Thr, Ala, Ser, Val, Met, Leu, Gln, Ile, Cys, Gly, Glu, Tyr, Asn, Trp, Asp, Pro, or Phe
  misc_feature (11)..(11): Xaa can be Trp, Phe, Tyr, Leu, Met, Ile, or Val
RXGPKRGEHAX

SEQ ID NO: 166403 - protein, 8 aa, Artificial Sequence
  Description of Artificial Sequence: Synthetic peptide
  Seed: SEEVPEAS (SSX2_HUMAN)
  misc_feature (2)..(2): Xaa can be Glu, or Asp
  misc_feature (8)..(8): Xaa can be Leu, Ile, Val, Ala, Cys, Gly, Met, Thr, Ser, Phe, Pro, or Tyr
SXEVPEAX

SEQ ID NO: 166404 - protein, 9 aa, Artificial Sequence
  Description of Artificial Sequence: Synthetic peptide
  Seed: SEEVPEASG (SSX2_HUMAN)
  misc_feature (2)..(2): Xaa can be Glu, Asp, Gln, or Ala
  misc_feature (9)..(9): Xaa can be Leu, Ala, Met, Phe, Ile, Val, Pro, Cys, Thr, Tyr, Gly, Asn, Glu, Gln, Trp, Lys, Ser, Arg, or Asp
SXEVPEASX

SEQ ID NO: 166405 - protein, 10 aa, Artificial Sequence
  Description of Artificial Sequence: Synthetic peptide
  Seed: SEEVPEASGP (SSX2_HUMAN)
  misc_feature (2)..(2): Xaa can be Glu, Gln, or Asp
  misc_feature (10)..(10): Xaa can be Leu, Ala, Cys, Val, Thr, Gly, Met, Phe, Ser, Trp, Tyr, Pro, or Ile
SXEVPEASGX

SEQ ID NO: 166406 - protein, 8 aa, Artificial Sequence
  Description of Artificial Sequence: Synthetic peptide
  Seed: SEKIFYVY (SSX2_HUMAN)
  misc_feature (2)..(2): Xaa can be Glu, Asp, Gln, Lys, Ser, Arg, Met, Ala, His, Leu, Asn, Gly, Val, Pro, or Ile
  misc_feature (8)..(8): Xaa can be Tyr, Phe, Leu, Trp, Met, Ile, Val, Ala, His, Pro, Cys, or Thr
SXKIFYVX

SEQ ID NO: 166407 - protein, 9 aa, Artificial Sequence
  Description of Artificial Sequence: Synthetic peptide
  Seed: SEKIFYVYM (SSX2_HUMAN)
  misc_feature (2)..(2): Xaa can be Glu, Asp, Gln, Arg, Ala, Ser, Lys, His, Leu, Met, Asn, or Gly
  misc_feature (9)..(9): Xaa can be Tyr, Phe, Leu, Met, Ile, Val, Trp, Cys, Ala, Pro, Gly, Ser, His, or Thr
SXKIFYVYX

SEQ ID NO: 166408 - protein, 11 aa, Artificial Sequence
  Description of Artificial Sequence: Synthetic peptide
  Seed: SEKIFYVYMKR (SSX2_HUMAN)
  misc_feature (2)..(2): Xaa can be Ile, Pro, Asp, Arg, Met, Ala, Lys, Gly, Tyr, Phe, Asn, Leu, Trp, Gln, Val, Glu, His, Ser, Cys, or Thr
  misc_feature (11)..(11): Xaa can be Lys, or Arg
SXKIFYVYMKX

SEQ ID NO: 166409 - protein, 9 aa, Artificial Sequence
  Description of Artificial Sequence: Synthetic peptide
  Seed: SEKIHERSG (SSX2_HUMAN)
  misc_feature (2)..(2): Xaa can be Glu, Asp, or Gln
  misc_feature (9)..(9): Xaa can be Met, Val, Ala, Cys, Leu, Ile, Phe, Pro, Tyr, Trp, Asp, Thr, Glu, Gly, Ser, or Gln
SXKIHERSX

SEQ ID NO: 166410 - protein, 10 aa, Artificial Sequence
  Description of Artificial Sequence: Synthetic peptide
  Seed: SEKIHERSGP (SSX2_HUMAN)
  misc_feature (2)..(2): Xaa can be , or Glu
  misc_feature (10)..(10): Xaa can be Met, Ala, Leu, Cys, Val, Ile, or Pro
SXKIHERSGX

SEQ ID NO: 166411 - protein, 10 aa, Artificial Sequence
  Description of Artificial Sequence: Synthetic peptide
  Seed: SGPKRGEHAW (SSX2_HUMAN)
  misc_feature (2)..(2): Xaa can be Thr, Ser, Ala, Leu, Gly, Ile, Phe, Cys, Gln, Glu, Met, Asn, Asp, Val, or Pro
  misc_feature (10)..(10): Xaa can be Trp, Phe, or Tyr
SXPKRGEHAX

SEQ ID NO: 166412 - protein, 10 aa, Artificial Sequence
  Description of Artificial Sequence: Synthetic peptide
  Seed: SGPQNDGKEL (SSX2_HUMAN)
  misc_feature (2)..(2): Xaa can be Gly, Ala, Leu, Arg, Ile, Val, Met, Tyr, Thr, Gln, Phe, Ser, Glu, Asn, Trp, Cys, Lys, Asp, Pro, or His
  misc_feature (10)..(10): Xaa can be Met, Leu, Lys, Phe, Tyr, Arg, Ile, Val, Trp, Glu, His, Gln, Asn, or Cys
SXPQNDGKEX

SEQ ID NO: 166413 - protein, 9 aa, Artificial Sequence
  Description of Artificial Sequence: Synthetic peptide
  Seed: SPKIMPKKP (SSX2_HUMAN)
  misc_feature (2)..(2): Xaa can be Pro, Ala, Val, or Ile
  misc_feature (9)..(9): Xaa can be Leu, Met, Ile, Ala, Trp, Tyr, Phe, Gly, Ser, Cys, Val, Pro, or Thr
SXKIMPKKX

SEQ ID NO: 166414 - protein, 10 aa, Artificial Sequence
  Description of Artificial Sequence: Synthetic peptide
  Seed: SPKIMPKKPA (SSX2_HUMAN)
  misc_feature (2)..(2): Xaa can be , or Pro
  misc_feature (10)..(10): Xaa can be Cys, Val, Ile, Phe, Ala, Thr, Met, Leu, Ser, Tyr, or Pro
SXKIMPKKPX

SEQ ID NO: 166415 - protein, 9 aa, Artificial Sequence
  Description of Artificial Sequence: Synthetic peptide
  Seed: TKLGFKATL (SSX2_HUMAN)
  misc_feature (2)..(2): Xaa can be Arg, Gln, His, Glu, Ala, Asn, Met, Lys, Tyr, Pro, Ser, Phe, Gly, Asp, Thr, Ile, Leu, Trp, Val, or Cys
  misc_feature (9)..(9): Xaa can be Leu, Met, Tyr, Phe, Ile, Val, Ala, Trp, His, Cys, Pro, Thr, Lys, Arg, Gly, or Ser
TXLGFKATX

SEQ ID NO: 166416 - protein, 9 aa, Artificial Sequence
  Description of Artificial Sequence: Synthetic peptide
  Seed: TLPPFMCNK (SSX2_HUMAN)
  misc_feature (2)..(2): Xaa can be Met, Ile, Ala, Leu, Val, Thr, Ser, Gln, Gly, Asp, Glu, Trp, Phe, Pro, Tyr, Asn, or Cys
  misc_feature (9)..(9): Xaa can be Arg, Lys, Tyr, Leu, Met, Ile, His, Phe, Val, or Ala
TXPPFMCNX

SEQ ID NO: 166417 - protein, 10 aa, Artificial Sequence
  Description of Artificial Sequence: Synthetic peptide
  Seed: TLPPFMCNKR (SSX2_HUMAN)
  misc_feature (2)..(2): Xaa can be Val, Thr, Leu, Met, Ala, Ile, Ser, Tyr, Pro, Gly, Phe, Trp, Gln, Asn, Cys, Glu, Asp, or Hi s
  misc_feature (10)..(10): Xaa can be Arg, Lys, Tyr, Leu, Phe, Met, or His
TXPPFMCNKX

SEQ ID NO: 166418 - protein, 8 aa, Artificial Sequence
  Description of Artificial Sequence: Synthetic peptide
  Seed: TSEKIHER (SSX2_HUMAN)
  misc_feature (2)..(2): Xaa can be Ser, Ala, Thr, Phe, Val, Ile, Gly, Leu, Met, Trp, Tyr, Asn, Cys, Gln, Asp, or Glu
  misc_feature (8)..(8): Xaa can be Tyr, Leu, Phe, Lys, Met, Arg, Ile, Val, His, or Trp
TXEKIHEX

SEQ ID NO: 166419 - protein, 9 aa, Artificial Sequence
  Description of Artificial Sequence: Synthetic peptide
  Seed: TTSEKIHER (SSX2_HUMAN)
  misc_feature (2)..(2): Xaa can be Ala, Met, Thr, Val, Leu, Ser, Arg, Ile, Tyr, Phe, Gln, Gly, Asn, Glu, Trp, Pro, Cys, Lys, His, or Asp
  misc_feature (9)..(9): Xaa can be Phe, Arg, Leu, Met, Tyr, Lys, Ile, Val, Trp, His, Cys, Ala, Thr, Gln, Pro, or Ser
TXSEKIHEX

SEQ ID NO: 166420 - protein, 9 aa, Artificial Sequence
  Description of Artificial Sequence: Synthetic peptide
  Seed: TVGAQIPEK (SSX2_HUMAN)
  misc_feature (2)..(2): Xaa can be Ala, Ser, Thr, Ile, Leu, Val, Gly, Met, Gln, Tyr, Phe, Asn, Cys, Pro, Glu, Trp, or Asp
  misc_feature (9)..(9): Xaa can be Tyr, Arg, Lys, Met, Phe, Leu, His, Ile, Val, Trp, or Ala
TXGAQIPEX

SEQ ID NO: 166421 - protein, 8 aa, Artificial Sequence
  Description of Artificial Sequence: Synthetic peptide
  Seed: VERPQMTF (SSX2_HUMAN)
  misc_feature (2)..(2): Xaa can be Glu, Asp, Gln, Met, Ile, Leu, Ser, Arg, Val, Lys, Ala, Thr, Pro, Phe, Gly, Asn, or His
  misc_feature (8)..(8): Xaa can be Tyr, Phe, Met, Leu, Val, Trp, Ile, Pro, Ala, Cys, or Thr
VXRPQMTX

SEQ ID NO: 166422 - protein, 9 aa, Artificial Sequence
  Description of Artificial Sequence: Synthetic peptide
  Seed: VERPQMTFG (SSX2_HUMAN)
  misc_feature (2)..(2): Xaa can be Glu, or Asp
  misc_feature (9)..(9): Xaa can be Val, Ala, Phe, Leu, Cys, Pro, Ser, Gly, Met, Ile, or Thr
VXRPQMTFX

SEQ ID NO: 166423 - protein, 11 aa, Artificial Sequence
  Description of Artificial Sequence: Synthetic peptide
  Seed: VERPQMTFGRL (SSX2_HUMAN)
  misc_feature (2)..(2): Xaa can be , or Glu
  misc_feature (11)..(11): Xaa can be , or Leu
VXRPQMTFGRX

SEQ ID NO: 166424 - protein, 8 aa, Artificial Sequence
  Description of Artificial Sequence: Synthetic peptide
  Seed: VGAQIPEK (SSX2_HUMAN)
  misc_feature (2)..(2): Xaa can be Ala, Val, Thr, Ile, Gly, Ser, Met, Phe, Leu, Cys, Gln, Asn, Tyr, Asp, Glu, or Pro
  misc_feature (8)..(8): Xaa can be Lys, Leu, Arg, Phe, Met, Tyr, Val, Ile, or Trp
VXAQIPEX

SEQ ID NO: 166425 - protein, 9 aa, Artificial Sequence
  Description of Artificial Sequence: Synthetic peptide
  Seed: VGAQIPEKI (SSX2_HUMAN)
  misc_feature (2)..(2): Xaa can be Ala, Gln, Pro, Met, Arg, Leu, Ser, Thr, Ile, Gly, Glu, Asn, Cys, Tyr, Val, Phe, Asp, His, Trp, or Lys
  misc_feature (9)..(9): Xaa can be Phe, Leu, Met, Trp, Ile, Val, Lys, Tyr, Arg, Cys, Ala, Thr, or His
VXAQIPEKX

SEQ ID NO: 166426 - protein, 11 aa, Artificial Sequence
  Description of Artificial Sequence: Synthetic peptide
  Seed: VGAQIPEKIQK (SSX2_HUMAN)
  misc_feature (2)..(2): Xaa can be Ala, Thr, Ser, Val, Asn, Gly, Leu, Met, Asp, Ile, Gln, Glu, Cys, or Phe
  misc_feature (11)..(11): Xaa can be Lys, Tyr, Arg, Leu, Phe, Met, His, Val, Trp, or Ile
VXAQIPEKIQX

SEQ ID NO: 166427 - protein, 9 aa, Artificial Sequence
  Description of Artificial Sequence: Synthetic peptide
  Seed: VYMKRKYEA (SSX2_HUMAN)
  misc_feature (2)..(2): Xaa can be Tyr, Phe, Met, Trp, Ala, Arg, or His
  misc_feature (9)..(9): Xaa can be Met, Tyr, Leu, Phe, Trp, Ile, Val, or Ala
VXMKRKYEX

SEQ ID NO: 166428 - protein, 10 aa, Artificial Sequence
  Description of Artificial Sequence: Synthetic peptide
  Seed: VYMKRKYEAM (SSX2_HUMAN)
  misc_feature (2)..(2): Xaa can be Met, Tyr, Phe, Leu, Trp, Pro, Ala, Lys, Gly, Arg, Ser, Thr, Val, Asp, Ile, His, Glu, Gln, Asn, or Cys
  misc_feature (10)..(10): Xaa can be Leu, Phe, Met, Val, Ile, Ala, Cys, Trp, Tyr, or Thr
VXMKRKYEAX

SEQ ID NO: 166429 - protein, 10 aa, Artificial Sequence
  Description of Artificial Sequence: Synthetic peptide
  Seed: WEKMKASEKI (SSX2_HUMAN)
  misc_feature (2)..(2): Xaa can be , or Glu
  misc_feature (10)..(10): Xaa can be Pro, Ile, Cys, Leu, Val, Ala, Phe, or Met
WXKMKASEKX

SEQ ID NO: 166430 - protein, 11 aa, Artificial Sequence
  Description of Artificial Sequence: Synthetic peptide
  Seed: WEKMKASEKIF (SSX2_HUMAN)
  misc_feature (2)..(2): Xaa can be , or Glu
  misc_feature (11)..(11): Xaa can be Tyr, Trp, or Phe
WXKMKASEKIX

SEQ ID NO: 166431 - protein, 9 aa, Artificial Sequence
  Description of Artificial Sequence: Synthetic peptide
  Seed: WTHRLRERK (SSX2_HUMAN)
  misc_feature (2)..(2): Xaa can be Thr, Leu, Val, Ile, Met, Ser, Phe, Ala, Tyr, Gly, Gln, or Trp
  misc_feature (9)..(9): Xaa can be Arg, Lys, or Tyr
WXHRLRERX

SEQ ID NO: 166432 - protein, 9 aa, Artificial Sequence
  Description of Artificial Sequence: Synthetic peptide
  Seed: YEAMTKLGF (SSX2_HUMAN)
  misc_feature (2)..(2): Xaa can be Glu, Asp, Gln, Met, Lys, His, Leu, Ser, Ile, Ala, Val, Arg, Thr, Pro, Phe, Tyr, Asn, Cys, Trp, or Gly
  misc_feature (9)..(9): Xaa can be Tyr, Phe, Met, Leu, Trp, Ile, Val, His, Ala, Cys, Ser, Pro, Lys, Gly, or Thr
YXAMTKLGX

SEQ ID NO: 166433 - protein, 10 aa, Artificial Sequence
  Description of Artificial Sequence: Synthetic peptide
  Seed: YEAMTKLGFK (SSX2_HUMAN)
  misc_feature (2)..(2): Xaa can be Val, Thr, Ala, Ser, Phe, Met, Ile, Pro, Leu, Arg, His, Tyr, Asn, Glu, Cys, Gly, Asp, Lys, Trp, or Gln
  misc_feature (10)..(10): Xaa can be Lys, Arg, Tyr, or His
YXAMTKLGFX

SEQ ID NO: 166434 - protein, 11 aa, Artificial Sequence
  Description of Artificial Sequence: Synthetic peptide
  Seed: YEAMTKLGFKA (SSX2_HUMAN)
  misc_feature (2)..(2): Xaa can be , or Glu
  misc_feature (11)..(11): Xaa can be Ala, Val, Cys, Leu, Met, or Ile
YXAMTKLGFKX

SEQ ID NO: 166435 - protein, 9 aa, Artificial Sequence
  Description of Artificial Sequence: Synthetic peptide
  Seed: YFSKEEWEK (SSX2_HUMAN)
  misc_feature (2)..(2): Xaa can be Ala, Thr, Ser, Val, Leu, Met, Ile, Tyr, Phe, Asn, Gly, Gln, Cys, Asp, Glu, Trp, or Pro
  misc_feature (9)..(9): Xaa can be Tyr, Arg, Lys, Met, Phe, Leu, His, Ile, Val, or Trp
YXSKEEWEX

SEQ ID NO: 166436 - protein, 10 aa, Artificial Sequence
  Description of Artificial Sequence: Synthetic peptide
  Seed: YFSKEEWEKM (SSX2_HUMAN)
  misc_feature (2)..(2): Xaa can be Tyr, Phe, or Trp
  misc_feature (10)..(10): Xaa can be Tyr, Phe, Met, or Leu
YXSKEEWEKX

SEQ ID NO: 166437 - protein, 8 aa, Artificial Sequence
  Description of Artificial Sequence: Synthetic peptide
  Seed: YMKRKYEA (SSX2_HUMAN)
  misc_feature (2)..(2): Xaa can be Met, Pro, Leu, Val, Ile, Ala, Gln, Thr, Ser, Cys, Gly, Asn, Asp, Arg, Phe, Glu, Lys, Trp, His, or Tyr
  misc_feature (8)..(8): Xaa can be Leu, Met, Ile, Val, Phe, Ala, Cys, Thr, Ser, Gly, Pro, Trp, or Tyr
YXKRKYEX

SEQ ID NO: 166438 - protein, 9 aa, Artificial Sequence
  Description of Artificial Sequence: Synthetic peptide
  Seed: YMKRKYEAM (SSX2_HUMAN)
  misc_feature (2)..(2): Xaa can be Met, Leu, Pro, Ile, Ala, Val, Gln, Ser, Thr, Phe, Arg, Tyr, Gly, Asn, Lys, Cys, Trp, Glu, His, or Asp
  misc_feature (9)..(9): Xaa can be Phe, Leu, Tyr, Val, Ile, Met, Ala, Cys, Thr, Trp, Gly, His, Ser, Glu, Pro, Gln, Asn, Asp, or Arg
YXKRKYEAX

SEQ ID NO: 166439 - protein, 10 aa, Artificial Sequence
  Description of Artificial Sequence: Synthetic peptide
  Seed: YMKRKYEAMT (SSX2_HUMAN)
  misc_feature (2)..(2): Xaa can be Phe, Pro, Ile, Leu, Val, Gln, Met, Ala, Asn, Thr, Gly, Ser, Arg, Trp, Cys, Lys, or Tyr
  misc_feature (10)..(10): Xaa can be Leu, Met, Phe, Val, Ile, Ala, His, Tyr, Thr, Pro, Gly, Trp, Lys, Asp, Gln, Arg, Glu, Asn, Cys, or Ser
YXKRKYEAMX

SEQ ID NO: 166440 - protein, 11 aa, Artificial Sequence
  Description of Artificial Sequence: Synthetic peptide
  Seed: YMKRKYEAMTK (SSX2_HUMAN)
  misc_feature (2)..(2): Xaa can be Met, Leu, Pro, Val, Ile, Ala, Gln, Thr, Asn, Arg, Phe, Ser, Gly, Lys, Cys, or Trp
  misc_feature (11)..(11): Xaa can be Leu, Met, Val, Ile, Phe, Ala, Thr, Cys, Gly, Trp, Ser, Lys, His, Tyr, Arg, Asn, Glu, Asp, Pro, or Gln
YXKRKYEAMTX

SEQ ID NO: 166441 - protein, 8 aa, Artificial Sequence
  Description of Artificial Sequence: Synthetic peptide
  Seed: YVYMKRKY (SSX2_HUMAN)
  misc_feature (2)..(2): Xaa can be Ala, Ser, Thr, Gln, Val, Gly, Ile, Met, Leu, Phe, Glu, or Asn
  misc_feature (8)..(8): Xaa can be Tyr, Leu, Phe, Met, Trp, Val, or Ile
YXYMKRKX

SEQ ID NO: 166442 - protein, 10 aa, Artificial Sequence
  Description of Artificial Sequence: Synthetic peptide
  Seed: YVYMKRKYEA (SSX2_HUMAN)
  misc_feature (2)..(2): Xaa can be Met, Pro, Leu, Ala, Ile, Val, Asn, Gln, Ser, Gly, Phe, Thr, Arg, Trp, Cys, Lys, Tyr, Glu, His, or Asp
  misc_feature (10)..(10): Xaa can be Leu, Met, Phe, Val, Ile, Ala, Cys, Thr, Gly, Ser, or Trp
YXYMKRKYEX

SEQ ID NO: 166443 - protein, 11 aa, Artificial Sequence
  Description of Artificial Sequence: Synthetic peptide
  Seed: YVYMKRKYEAM (SSX2_HUMAN)
  misc_feature (2)..(2): Xaa can be Pro, Met, Ile, Tyr, Val, Gln, Gly, Asp, Leu, Arg, Thr, Glu, Ser, Lys, Asn, Phe, Ala, His, Trp, or Cys
  misc_feature (11)..(11): Xaa can be Ala, Leu, Phe, Val, Ile, Met, Cys, or Thr
YXYMKRKYEAX

SEQ ID NO: 166444 - protein, 9 aa, Artificial Sequence
  Description of Artificial Sequence: Synthetic peptide
  Seed: AVFDEWLRR (TYRP1_HUMAN)
ATFDEWLRK

SEQ ID NO: 166445 - protein, 9 aa, Artificial Sequence
  Description of Artificial Sequence: Synthetic peptide
  Seed: ASYLIRARR (TYRP1_HUMAN)
ATYLIRARK

SEQ ID NO: 166446 - protein, 9 aa, Artificial Sequence
  Description of Artificial Sequence: Synthetic peptide
  Seed: FSHEGPAFL (TYRP1_HUMAN)
FAHEGPAFL

SEQ ID NO: 166447 - protein, 9 aa, Artificial Sequence
  Description of Artificial Sequence: Synthetic peptide
  Seed: FVWTHYYSV (TYRP1_HUMAN)
FAWTHYYSV

SEQ ID NO: 166448 - protein, 9 aa, Artificial Sequence
  Description of Artificial Sequence: Synthetic peptide
  Seed: FVWTHYYSV (TYRP1_HUMAN)
FMWTHYYSV

SEQ ID NO: 166449 - protein, 9 aa, Artificial Sequence
  Description of Artificial Sequence: Synthetic peptide
  Seed: FSHEGPAFL (TYRP1_HUMAN)
FRHEGPAFF

SEQ ID NO: 166450 - protein, 9 aa, Artificial Sequence
  Description of Artificial Sequence: Synthetic peptide
  Seed: FSHEGPAFL (TYRP1_HUMAN)
FRHEGPAFL

SEQ ID NO: 166451 - protein, 9 aa, Artificial Sequence
  Description of Artificial Sequence: Synthetic peptide
  Seed: FSHEGPAFL (TYRP1_HUMAN)
FRHEGPAFV

SEQ ID NO: 166452 - protein, 9 aa, Artificial Sequence
  Description of Artificial Sequence: Synthetic peptide
  Seed: FTDAVFDEW (TYRP1_HUMAN)
FSDAVFDEY

SEQ ID NO: 166453 - protein, 9 aa, Artificial Sequence
  Description of Artificial Sequence: Synthetic peptide
  Seed: FVWTHYYSV (TYRP1_HUMAN)
FSWTHYYSV

SEQ ID NO: 166454 - protein, 9 aa, Artificial Sequence
  Description of Artificial Sequence: Synthetic peptide
  Seed: FTDAVFDEW (TYRP1_HUMAN)
FTDAVFDEF

SEQ ID NO: 166455 - protein, 9 aa, Artificial Sequence
  Description of Artificial Sequence: Synthetic peptide
  Seed: ISIYNYFVW (TYRP1_HUMAN)
IAIYNYFVW

SEQ ID NO: 166456 - protein, 9 aa, Artificial Sequence
  Description of Artificial Sequence: Synthetic peptide
  Seed: KYDPAVRSL (TYRP1_HUMAN)
KADPAVRSL

SEQ ID NO: 166457 - protein, 9 aa, Artificial Sequence
  Description of Artificial Sequence: Synthetic peptide
  Seed: KYDPAVRSL (TYRP1_HUMAN)
KADPAVRSM

SEQ ID NO: 166458 - protein, 9 aa, Artificial Sequence
  Description of Artificial Sequence: Synthetic peptide
  Seed: KYDPAVRSL (TYRP1_HUMAN)
KFDPAVRSL

SEQ ID NO: 166459 - protein, 9 aa, Artificial Sequence
  Description of Artificial Sequence: Synthetic peptide
  Seed: KYDPAVRSL (TYRP1_HUMAN)
KFDPAVRSM

SEQ ID NO: 166460 - protein, 9 aa, Artificial Sequence
  Description of Artificial Sequence: Synthetic peptide
  Seed: KYDPAVRSL (TYRP1_HUMAN)
KVDPAVRSL

SEQ ID NO: 166461 - protein, 9 aa, Artificial Sequence
  Description of Artificial Sequence: Synthetic peptide
  Seed: KYDPAVRSL (TYRP1_HUMAN)
KYDPAVRSF

SEQ ID NO: 166462 - protein, 10 aa, Artificial Sequence
  Description of Artificial Sequence: Synthetic peptide
  Seed: LTWHRYHLLR (TYRP1_HUMAN)
LMWHRYHLLK

SEQ ID NO: 166463 - protein, 10 aa, Artificial Sequence
  Description of Artificial Sequence: Synthetic peptide
  Seed: LTWHRYHLLR (TYRP1_HUMAN)
LTWHRYHLLK

SEQ ID NO: 166464 - protein, 9 aa, Artificial Sequence
  Description of Artificial Sequence: Synthetic peptide
  Seed: MSAPKLLSL (TYRP1_HUMAN)
MAAPKLLSL

SEQ ID NO: 166465 - protein, 9 aa, Artificial Sequence
  Description of Artificial Sequence: Synthetic peptide
  Seed: MSAPKLLSL (TYRP1_HUMAN)
MAAPKLLSV

SEQ ID NO: 166466 - protein, 9 aa, Artificial Sequence
  Description of Artificial Sequence: Synthetic peptide
  Seed: MLQEPSFSL (TYRP1_HUMAN)
MMQEPSFSL

SEQ ID NO: 166467 - protein, 9 aa, Artificial Sequence
  Description of Artificial Sequence: Synthetic peptide
  Seed: MAKRTTHPL (TYRP1_HUMAN)
MPKRTTHPL

SEQ ID NO: 166468 - protein, 9 aa, Artificial Sequence
  Description of Artificial Sequence: Synthetic peptide
  Seed: MAKRTTHPL (TYRP1_HUMAN)
MPKRTTHPM

SEQ ID NO: 166469 - protein, 9 aa, Artificial Sequence
  Description of Artificial Sequence: Synthetic peptide
  Seed: MSAPKLLSL (TYRP1_HUMAN)
MQAPKLLSM

SEQ ID NO: 166470 - protein, 9 aa, Artificial Sequence
  Description of Artificial Sequence: Synthetic peptide
  Seed: NADISTFPL (TYRP1_HUMAN)
NADISTFPF

SEQ ID NO: 166471 - protein, 9 aa, Artificial Sequence
  Description of Artificial Sequence: Synthetic peptide
  Seed: NADISTFPL (TYRP1_HUMAN)
NADISTFPM

SEQ ID NO: 166472 - protein, 9 aa, Artificial Sequence
  Description of Artificial Sequence: Synthetic peptide
  Seed: NYFVWTHYY (TYRP1_HUMAN)
NYFVWTHYF

SEQ ID NO: 166473 - protein, 9 aa, Artificial Sequence
  Description of Artificial Sequence: Synthetic peptide
  Seed: NYFVWTHYY (TYRP1_HUMAN)
NYFVWTHYL

SEQ ID NO: 166474 - protein, 9 aa, Artificial Sequence
  Description of Artificial Sequence: Synthetic peptide
  Seed: NYFVWTHYY (TYRP1_HUMAN)
NYFVWTHYM

SEQ ID NO: 166475 - protein, 9 aa, Artificial Sequence
  Description of Artificial Sequence: Synthetic peptide
  Seed: QQARAQFPR (TYRP1_HUMAN)
QTARAQFPR

SEQ ID NO: 166476 - protein, 9 aa, Artificial Sequence
  Description of Artificial Sequence: Synthetic peptide
  Seed: RQYNMVPFW (TYRP1_HUMAN)
RMYNMVPFF

SEQ ID NO: 166477 - protein, 9 aa, Artificial Sequence
  Description of Artificial Sequence: Synthetic peptide
  Seed: RQYNMVPFW (TYRP1_HUMAN)
RTYNMVPFF

SEQ ID NO: 166478 - protein, 10 aa, Artificial Sequence
  Description of Artificial Sequence: Synthetic peptide
  Seed: TAPDNLGYTY (TYRP1_HUMAN)
TTPDNLGYTY

SEQ ID NO: 166479 - protein, 9 aa, Artificial Sequence
  Description of Artificial Sequence: Synthetic peptide
  Seed: YSNSTNSFR (TYRP1_HUMAN)
YTNSTNSFR

SEQ ID NO: 166480 - protein, 10 aa, Artificial Sequence
  Description of Artificial Sequence: Synthetic peptide
  Seed: YNYFVWTHYY (TYRP1_HUMAN)
YTYFVWTHYY

SEQ ID NO: 166481 - protein, 9 aa, Homo sapiens
  Native (TYRP1_HUMAN)
ALIFGTASY

SEQ ID NO: 166482 - protein, 9 aa, Homo sapiens
  Native (TYRP1_HUMAN)
APIGHNRQY

SEQ ID NO: 166483 - protein, 9 aa, Homo sapiens
  Native (TYRP1_HUMAN)
AVFDEWLRR

SEQ ID NO: 166484 - protein, 9 aa, Homo sapiens
  Native (TYRP1_HUMAN)
AVVGALLLV

SEQ ID NO: 166485 - protein, 9 aa, Homo sapiens
  Native (TYRP1_HUMAN)
DSRPHSPQY

SEQ ID NO: 166486 - protein, 9 aa, Homo sapiens
  Native (TYRP1_HUMAN)
ENAPIGHNR

SEQ ID NO: 166487 - protein, 9 aa, Homo sapiens
  Native (TYRP1_HUMAN)
FENISIYNY

SEQ ID NO: 166488 - protein, 10 aa, Homo sapiens
  Native (TYRP1_HUMAN)
FPRQCATVEA

SEQ ID NO: 166489 - protein, 9 aa, Homo sapiens
  Native (TYRP1_HUMAN)
FSHEGPAFL

SEQ ID NO: 166490 - protein, 9 aa, Homo sapiens
  Native (TYRP1_HUMAN)
FSVPEIIAI

SEQ ID NO: 166491 - protein, 9 aa, Homo sapiens
  Native (TYRP1_HUMAN)
FVWTHYYSV

SEQ ID NO: 166492 - protein, 9 aa, Homo sapiens
  Native (TYRP1_HUMAN)
FYSNSTNSF

SEQ ID NO: 166493 - protein, 9 aa, Homo sapiens
  Native (TYRP1_HUMAN)
GLFDTPPFY

SEQ ID NO: 166494 - protein, 9 aa, Homo sapiens
  Native (TYRP1_HUMAN)
HYYSVKKTF

SEQ ID NO: 166495 - protein, 9 aa, Homo sapiens
  Native (TYRP1_HUMAN)
IAIAVVGAL

SEQ ID NO: 166496 - protein, 9 aa, Homo sapiens
  Native (TYRP1_HUMAN)
IFGTASYLI

SEQ ID NO: 166497 - protein, 9 aa, Homo sapiens
  Native (TYRP1_HUMAN)
ISIYNYFVW

SEQ ID NO: 166498 - protein, 10 aa, Homo sapiens
  Native (TYRP1_HUMAN)
ISPNSVFSQW

SEQ ID NO: 166499 - protein, 10 aa, Homo sapiens
  Native (TYRP1_HUMAN)
KLLSLGCIFF

SEQ ID NO: 166500 - protein, 9 aa, Homo sapiens
  Native (TYRP1_HUMAN)
KRTTHPLFV

SEQ ID NO: 166501 - protein, 11 aa, Homo sapiens
  Native (TYRP1_HUMAN)
KTFLGVGQESF

SEQ ID NO: 166502 - protein, 9 aa, Homo sapiens
  Native (TYRP1_HUMAN)
KYDPAVRSL

SEQ ID NO: 166503 - protein, 8 aa, Homo sapiens
  Native (TYRP1_HUMAN)
LTDQYQCY

SEQ ID NO: 166504 - protein, 9 aa, Homo sapiens
  Native (TYRP1_HUMAN)
MAKRTTHPL

SEQ ID NO: 166505 - protein, 9 aa, Homo sapiens
  Native (TYRP1_HUMAN)
MSAPKLLSL

SEQ ID NO: 166506 - protein, 9 aa, Homo sapiens
  Native (TYRP1_HUMAN)
NMVPFWPPV

SEQ ID NO: 166507 - protein, 9 aa, Homo sapiens
  Native (TYRP1_HUMAN)
NVARPMVQR

SEQ ID NO: 166508 - protein, 9 aa, Homo sapiens
  Native (TYRP1_HUMAN)
QEMLQEPSF

SEQ ID NO: 166509 - protein, 10 aa, Homo sapiens
  Native (TYRP1_HUMAN)
QEPSFSLPYW

SEQ ID NO: 166510 - protein, 9 aa, Homo sapiens
  Native (TYRP1_HUMAN)
RARRSMDEA

SEQ ID NO: 166511 - protein, 9 aa, Homo sapiens
  Native (TYRP1_HUMAN)
REFSVPEII

SEQ ID NO: 166512 - protein, 9 aa, Homo sapiens
  Native (TYRP1_HUMAN)
RQCATVEAL

SEQ ID NO: 166513 - protein, 9 aa, Homo sapiens
  Native (TYRP1_HUMAN)
RQYNMVPFW

SEQ ID NO: 166514 - protein, 9 aa, Homo sapiens
  Native (TYRP1_HUMAN)
RRNLLDLSK

SEQ ID NO: 166515 - protein, 10 aa, Homo sapiens
  Native (TYRP1_HUMAN)
RRYNADISTF

SEQ ID NO: 166516 - protein, 10 aa, Homo sapiens
  Native (TYRP1_HUMAN)
RTTHPLFVIA

SEQ ID NO: 166517 - protein, 9 aa, Homo sapiens
  Native (TYRP1_HUMAN)
RYNADISTF

SEQ ID NO: 166518 - protein, 9 aa, Homo sapiens
  Native (TYRP1_HUMAN)
SMDEANQPL

SEQ ID NO: 166519 - protein, 9 aa, Homo sapiens
  Native (TYRP1_HUMAN)
SPNDPIFVL

SEQ ID NO: 166520 - protein, 9 aa, Homo sapiens
  Native (TYRP1_HUMAN)
SPNSVFSQW

SEQ ID NO: 166521 - protein, 9 aa, Homo sapiens
  Native (TYRP1_HUMAN)
SRSNFDSTL

SEQ ID NO: 166522 - protein, 9 aa, Homo sapiens
  Native (TYRP1_HUMAN)
SVPEIIAIA

SEQ ID NO: 166523 - protein, 10 aa, Homo sapiens
  Native (TYRP1_HUMAN)
THLSPNDPIF

SEQ ID NO: 166524 - protein, 9 aa, Homo sapiens
  Native (TYRP1_HUMAN)
TLISPNSVF

SEQ ID NO: 166525 - protein, 10 aa, Homo sapiens
  Native (TYRP1_HUMAN)
VALIFGTASY

SEQ ID NO: 166526 - protein, 9 aa, Homo sapiens
  Native (TYRP1_HUMAN)
VLIVRRNLL

SEQ ID NO: 166527 - protein, 11 aa, Homo sapiens
  Native (TYRP1_HUMAN)
VTAPDNLGYTY

SEQ ID NO: 166528 - protein, 9 aa, Homo sapiens
  Native (TYRP1_HUMAN)
WTHYYSVKK

SEQ ID NO: 166529 - protein, 8 aa, Homo sapiens
  Native (TYRP1_HUMAN)
YAEEYEKL

SEQ ID NO: 166530 - protein, 10 aa, Homo sapiens
  Native (TYRP1_HUMAN)
YNYFVWTHYY

SEQ ID NO: 166531 - protein, 10 aa, Homo sapiens
  Native (TYRP1_HUMAN)
YTYEIQWPSR

SEQ ID NO: 166532 - protein, 9 aa, Artificial Sequence
  Description of Artificial Sequence: Synthetic peptide
  Seed: SMDEANQPL (TYRP1_HUMAN)
SNDEANQPI

SEQ ID NO: 166533 - protein, 9 aa, Artificial Sequence
  Description of Artificial Sequence: Synthetic peptide
  Seed: NFDSTLISP (TYRP1_HUMAN)
NYDSTLISV

SEQ ID NO: 166534 - protein, 10 aa, Artificial Sequence
  Description of Artificial Sequence: Synthetic peptide
  Seed: THLSPNDPIF (TYRP1_HUMAN)
TQLSPNDPIF

SEQ ID NO: 166535 - protein, 9 aa, Artificial Sequence
  Description of Artificial Sequence: Synthetic peptide
  Seed: NADISTFPL (TYRP1_HUMAN)
NSDISTFPF

SEQ ID NO: 166536 - protein, 9 aa, Artificial Sequence
  Description of Artificial Sequence: Synthetic peptide
  Seed: GPDGNTPQF (TYRP1_HUMAN)
GVDGNTPQF

SEQ ID NO: 166537 - protein, 9 aa, Artificial Sequence
  Description of Artificial Sequence: Synthetic peptide
  Seed: GPIRRNPAG (TYRP1_HUMAN)
GPIRRNPAF

SEQ ID NO: 166538 - protein, 9 aa, Artificial Sequence
  Description of Artificial Sequence: Synthetic peptide
  Seed: FGTASYLIR (TYRP1_HUMAN)
FSTASYLIR

SEQ ID NO: 166539 - protein, 11 aa, Artificial Sequence
  Description of Artificial Sequence: Synthetic peptide
  Seed: YNYFVWTHYYS (TYRP1_HUMAN)
YMYFVWTHYYC

SEQ ID NO: 166540 - protein, 9 aa, Artificial Sequence
  Description of Artificial Sequence: Synthetic peptide
  Seed: FENISIYNY (TYRP1_HUMAN)
FMNISIYNF

SEQ ID NO: 166541 - protein, 9 aa, Artificial Sequence
  Description of Artificial Sequence: Synthetic peptide
  Seed: FPRQCATVE (TYRP1_HUMAN)
FPRQCATVV

SEQ ID NO: 166542 - protein, 10 aa, Artificial Sequence
  Description of Artificial Sequence: Synthetic peptide
  Seed: NLAHLFLNGT (TYRP1_HUMAN)
NLAHLFLNGV

SEQ ID NO: 166543 - protein, 9 aa, Artificial Sequence
  Description of Artificial Sequence: Synthetic peptide
  Seed: LLTDQYQCY (TYRP1_HUMAN)
LATDQYQCY

SEQ ID NO: 166544 - protein, 9 aa, Artificial Sequence
  Description of Artificial Sequence: Synthetic peptide
  Seed: SLPYWNFAT (TYRP1_HUMAN)
SLPYWNFAI

SEQ ID NO: 166545 - protein, 10 aa, Artificial Sequence
  Description of Artificial Sequence: Synthetic peptide
  Seed: FVLLHTFTDA (TYRP1_HUMAN)
FLLLHTFTDL

SEQ ID NO: 166546 - protein, 9 aa, Artificial Sequence
  Description of Artificial Sequence: Synthetic peptide
  Seed: SIYNYFVWT (TYRP1_HUMAN)
SIYNYFVWV

SEQ ID NO: 166547 - protein, 9 aa, Artificial Sequence
  Description of Artificial Sequence: Synthetic peptide
  Seed: YNYFVWTHY (TYRP1_HUMAN)
YWYFVWTHY

SEQ ID NO: 166548 - protein, 9 aa, Artificial Sequence
  Description of Artificial Sequence: Synthetic peptide
  Seed: VGLFDTPPF (TYRP1_HUMAN)
VRLFDTPPF

SEQ ID NO: 166549 - protein, 9 aa, Artificial Sequence
  Description of Artificial Sequence: Synthetic peptide
  Seed: AQFPRQCAT (TYRP1_HUMAN)
AHFPRQCAA

SEQ ID NO: 166550 - protein, 9 aa, Artificial Sequence
  Description of Artificial Sequence: Synthetic peptide
  Seed: AACDQRVLI (TYRP1_HUMAN)
AQCDQRVLM

SEQ ID NO: 166551 - protein, 9 aa, Artificial Sequence
  Description of Artificial Sequence: Synthetic peptide
  Seed: RYNADISTF (TYRP1_HUMAN)
RQNADISTW

SEQ ID NO: 166552 - protein, 9 aa, Artificial Sequence
  Description of Artificial Sequence: Synthetic peptide
  Seed: MAKRTTHPL (TYRP1_HUMAN)
MHKRTTHPM

SEQ ID NO: 166553 - protein, 11 aa, Artificial Sequence
  Description of Artificial Sequence: Synthetic peptide
  Seed: REFSVPEIIAI (TYRP1_HUMAN)
REFSVPEIIAS

SEQ ID NO: 166554 - protein, 9 aa, Artificial Sequence
  Description of Artificial Sequence: Synthetic peptide
  Seed: VDFSHEGPA (TYRP1_HUMAN)
VEFSHEGPV

SEQ ID NO: 166555 - protein, 9 aa, Artificial Sequence
  Description of Artificial Sequence: Synthetic peptide
  Seed: LFQQARAQF (TYRP1_HUMAN)
LFQQARAQM

SEQ ID NO: 166556 - protein, 9 aa, Artificial Sequence
  Description of Artificial Sequence: Synthetic peptide
  Seed: VCDICTDDL (TYRP1_HUMAN)
VSDICTDDL

SEQ ID NO: 166557 - protein, 10 aa, Artificial Sequence
  Description of Artificial Sequence: Synthetic peptide
  Seed: ALIFGTASYL (TYRP1_HUMAN)
AMIFGTASYF

SEQ ID NO: 166558 - protein, 9 aa, Artificial Sequence
  Description of Artificial Sequence: Synthetic peptide
  Seed: RYNADISTF (TYRP1_HUMAN)
RANADISTF

SEQ ID NO: 166559 - protein, 9 aa, Artificial Sequence
  Description of Artificial Sequence: Synthetic peptide
  Seed: VARPMVQRL (TYRP1_HUMAN)
VARPMVQRW

SEQ ID NO: 166560 - protein, 10 aa, Artificial Sequence
  Description of Artificial Sequence: Synthetic peptide
  Seed: EFSVPEIIAI (TYRP1_HUMAN)
ELSVPEIIAV

SEQ ID NO: 166561 - protein, 10 aa, Artificial Sequence
  Description of Artificial Sequence: Synthetic peptide
  Seed: YNYFVWTHYY (TYRP1_HUMAN)
YYYFVWTHYV

SEQ ID NO: 166562 - protein, 10 aa, Artificial Sequence
  Description of Artificial Sequence: Synthetic peptide
  Seed: NSFRNTVEGY (TYRP1_HUMAN)
NPFRNTVEGF

SEQ ID NO: 166563 - protein, 9 aa, Artificial Sequence
  Description of Artificial Sequence: Synthetic peptide
  Seed: LSKEEKNHF (TYRP1_HUMAN)
LSKEEKNHY

SEQ ID NO: 166564 - protein, 10 aa, Artificial Sequence
  Description of Artificial Sequence: Synthetic peptide
  Seed: YNADISTFPL (TYRP1_HUMAN)
YVADISTFPY

SEQ ID NO: 166565 - protein, 9 aa, Artificial Sequence
  Description of Artificial Sequence: Synthetic peptide
  Seed: LIFGTASYL (TYRP1_HUMAN)
LVFGTASYM

SEQ ID NO: 166566 - protein, 10 aa, Artificial Sequence
  Description of Artificial Sequence: Synthetic peptide
  Seed: FWPPVTNTEM (TYRP1_HUMAN)
FSPPVTNTEY

SEQ ID NO: 166567 - protein, 10 aa, Artificial Sequence
  Description of Artificial Sequence: Synthetic peptide
  Seed: FYSNSTNSFR (TYRP1_HUMAN)
FMSNSTNSFR

SEQ ID NO: 166568 - protein, 9 aa, Artificial Sequence
  Description of Artificial Sequence: Synthetic peptide
  Seed: ISIYNYFVW (TYRP1_HUMAN)
IWIYNYFVW

SEQ ID NO: 166569 - protein, 11 aa, Artificial Sequence
  Description of Artificial Sequence: Synthetic peptide
  Seed: LVALIFGTASY (TYRP1_HUMAN)
LTALIFGTASF

SEQ ID NO: 166570 - protein, 10 aa, Artificial Sequence
  Description of Artificial Sequence: Synthetic peptide
  Seed: RRYNADISTF (TYRP1_HUMAN)
RYYNADISTM

SEQ ID NO: 166571 - protein, 9 aa, Artificial Sequence
  Description of Artificial Sequence: Synthetic peptide
  Seed: RSLHNLAHL (TYRP1_HUMAN)
RILHNLAHY

SEQ ID NO: 166572 - protein, 10 aa, Artificial Sequence
  Description of Artificial Sequence: Synthetic peptide
  Seed: YFVWTHYYSV (TYRP1_HUMAN)
YMVWTHYYSM

SEQ ID NO: 166573 - protein, 10 aa, Artificial Sequence
  Description of Artificial Sequence: Synthetic peptide
  Seed: ALIFGTASYL (TYRP1_HUMAN)
ATIFGTASYR

SEQ ID NO: 166574 - protein, 9 aa, Artificial Sequence
  Description of Artificial Sequence: Synthetic peptide
  Seed: TNTEMFVTA (TYRP1_HUMAN)
THTEMFVTV

SEQ ID NO: 166575 - protein, 9 aa, Artificial Sequence
  Description of Artificial Sequence: Synthetic peptide
  Seed: LFQQARAQF (TYRP1_HUMAN)
LWQQARAQF

SEQ ID NO: 166576 - protein, 11 aa, Artificial Sequence
  Description of Artificial Sequence: Synthetic peptide
  Seed: HTFTDAVFDEW (TYRP1_HUMAN)
HQFTDAVFDEW

SEQ ID NO: 166577 - protein, 10 aa, Artificial Sequence
  Description of Artificial Sequence: Synthetic peptide
  Seed: WPPVTNTEMF (TYRP1_HUMAN)
WLPVTNTEMY

SEQ ID NO: 166578 - protein, 9 aa, Artificial Sequence
  Description of Artificial Sequence: Synthetic peptide
  Seed: SMDEANQPL (TYRP1_HUMAN)
SSDEANQPI

SEQ ID NO: 166579 - protein, 10 aa, Artificial Sequence
  Description of Artificial Sequence: Synthetic peptide
  Seed: MVPFWPPVTN (TYRP1_HUMAN)
MSPFWPPVTF

SEQ ID NO: 166580 - protein, 9 aa, Artificial Sequence
  Description of Artificial Sequence: Synthetic peptide
  Seed: FTDAVFDEW (TYRP1_HUMAN)
FYDAVFDEI

SEQ ID NO: 166581 - protein, 9 aa, Artificial Sequence
  Description of Artificial Sequence: Synthetic peptide
  Seed: APIGHNRQY (TYRP1_HUMAN)
AYIGHNRQY

SEQ ID NO: 166582 - protein, 9 aa, Artificial Sequence
  Description of Artificial Sequence: Synthetic peptide
  Seed: HEGPAFLTW (TYRP1_HUMAN)
HIGPAFLTW

SEQ ID NO: 166583 - protein, 8 aa, Artificial Sequence
  Description of Artificial Sequence: Synthetic peptide
  Seed: YSDPTGKY (TYRP1_HUMAN)
YVDPTGKF

SEQ ID NO: 166584 - protein, 9 aa, Artificial Sequence
  Description of Artificial Sequence: Synthetic peptide
  Seed: ISIYNYFVW (TYRP1_HUMAN)
IQIYNYFVW

SEQ ID NO: 166585 - protein, 9 aa, Artificial Sequence
  Description of Artificial Sequence: Synthetic peptide
  Seed: KYDPAVRSL (TYRP1_HUMAN)
KCDPAVRSM

SEQ ID NO: 166586 - protein, 9 aa, Artificial Sequence
  Description of Artificial Sequence: Synthetic peptide
  Seed: MSAPKLLSL (TYRP1_HUMAN)
MPAPKLLSL

SEQ ID NO: 166587 - protein, 9 aa, Artificial Sequence
  Description of Artificial Sequence: Synthetic peptide
  Seed: STNSFRNTV (TYRP1_HUMAN)
SMNSFRNTF

SEQ ID NO: 166588 - protein, 10 aa, Artificial Sequence
  Description of Artificial Sequence: Synthetic peptide
  Seed: SMDEANQPLL (TYRP1_HUMAN)
SQDEANQPLF

SEQ ID NO: 166589 - protein, 9 aa, Artificial Sequence
  Description of Artificial Sequence: Synthetic peptide
  Seed: FPLENAPIG (TYRP1_HUMAN)
FPLENAPII

SEQ ID NO: 166590 - protein, 10 aa, Artificial Sequence
  Description of Artificial Sequence: Synthetic peptide
  Seed: EIIAIAVVGA (TYRP1_HUMAN)
ETIAIAVVGA

SEQ ID NO: 166591 - protein, 9 aa, Artificial Sequence
  Description of Artificial Sequence: Synthetic peptide
  Seed: RQYNMVPFW (TYRP1_HUMAN)
RMYNMVPFV

SEQ ID NO: 166592 - protein, 9 aa, Artificial Sequence
  Description of Artificial Sequence: Synthetic peptide
  Seed: NADISTFPL (TYRP1_HUMAN)
NMDISTFPL

SEQ ID NO: 166593 - protein, 9 aa, Artificial Sequence
  Description of Artificial Sequence: Synthetic peptide
  Seed: RSNFDSTLI (TYRP1_HUMAN)
RTNFDSTLY

SEQ ID NO: 166594 - protein, 10 aa, Artificial Sequence
  Description of Artificial Sequence: Synthetic peptide
  Seed: VGLFDTPPFY (TYRP1_HUMAN)
VDLFDTPPFK

SEQ ID NO: 166595 - protein, 9 aa, Artificial Sequence
  Description of Artificial Sequence: Synthetic peptide
  Seed: ARAQFPRQC (TYRP1_HUMAN)
ARAQFPRQF

SEQ ID NO: 166596 - protein, 9 aa, Artificial Sequence
  Description of Artificial Sequence: Synthetic peptide
  Seed: RGRCEAVTA (TYRP1_HUMAN)
RPRCEAVTA

SEQ ID NO: 166597 - protein, 9 aa, Artificial Sequence
  Description of Artificial Sequence: Synthetic peptide
  Seed: FLGVGQESF (TYRP1_HUMAN)
FMGVGQESM

SEQ ID NO: 166598 - protein, 10 aa, Artificial Sequence
  Description of Artificial Sequence: Synthetic peptide
  Seed: VGLFDTPPFY (TYRP1_HUMAN)
VNLFDTPPFK

SEQ ID NO: 166599 - protein, 10 aa, Artificial Sequence
  Description of Artificial Sequence: Synthetic peptide
  Seed: KLLSLGCIFF (TYRP1_HUMAN)
KLLSLGCIFY

SEQ ID NO: 166600 - protein, 9 aa, Artificial Sequence
  Description of Artificial Sequence: Synthetic peptide
  Seed: ENISIYNYF (TYRP1_HUMAN)
EQISIYNYY

SEQ ID NO: 166601 - protein, 8 aa, Artificial Sequence
  Description of Artificial Sequence: Synthetic peptide
  Seed: YYSVKKTF (TYRP1_HUMAN)
YSSVKKTF

SEQ ID NO: 166602 - protein, 10 aa, Artificial Sequence
  Description of Artificial Sequence: Synthetic peptide
  Seed: EMLQEPSFSL (TYRP1_HUMAN)
EYLQEPSFSA

SEQ ID NO: 166603 - protein, 9 aa, Artificial Sequence
  Description of Artificial Sequence: Synthetic peptide
  Seed: IAVVGALLL (TYRP1_HUMAN)
ITVVGALLL

SEQ ID NO: 166604 - protein, 10 aa, Artificial Sequence
  Description of Artificial Sequence: Synthetic peptide
  Seed: RSLHNLAHLF (TYRP1_HUMAN)
RVLHNLAHLF

SEQ ID NO: 166605 - protein, 11 aa, Artificial Sequence
  Description of Artificial Sequence: Synthetic peptide
  Seed: REVWPLRFFNR (TYRP1_HUMAN)
RQVWPLRFFNK

SEQ ID NO: 166606 - protein, 9 aa, Artificial Sequence
  Description of Artificial Sequence: Synthetic peptide
  Seed: FLTWHRYHL (TYRP1_HUMAN)
FATWHRYHM

SEQ ID NO: 166607 - protein, 9 aa, Artificial Sequence
  Description of Artificial Sequence: Synthetic peptide
  Seed: MSAPKLLSL (TYRP1_HUMAN)
MVAPKLLST

SEQ ID NO: 166608 - protein, 9 aa, Artificial Sequence
  Description of Artificial Sequence: Synthetic peptide
  Seed: ALIFGTASY (TYRP1_HUMAN)
AFIFGTASI

SEQ ID NO: 166609 - protein, 10 aa, Artificial Sequence
  Description of Artificial Sequence: Synthetic peptide
  Seed: NSVFSQWRVV (TYRP1_HUMAN)
NTVFSQWRVV

SEQ ID NO: 166610 - protein, 9 aa, Artificial Sequence
  Description of Artificial Sequence: Synthetic peptide
  Seed: HPLFVIATR (TYRP1_HUMAN)
HSLFVIATK

SEQ ID NO: 166611 - protein, 10 aa, Artificial Sequence
  Description of Artificial Sequence: Synthetic peptide
  Seed: RRYNADISTF (TYRP1_HUMAN)
RAYNADISTF

SEQ ID NO: 166612 - protein, 9 aa, Artificial Sequence
  Description of Artificial Sequence: Synthetic peptide
  Seed: REVWPLRFF (TYRP1_HUMAN)
RQVWPLRFM

SEQ ID NO: 166613 - protein, 8 aa, Artificial Sequence
  Description of Artificial Sequence: Synthetic peptide
  Seed: HTFTDAVF (TYRP1_HUMAN)
HQFTDAVY

SEQ ID NO: 166614 - protein, 9 aa, Artificial Sequence
  Description of Artificial Sequence: Synthetic peptide
  Seed: RQCATVEAL (TYRP1_HUMAN)
RICATVEAY

SEQ ID NO: 166615 - protein, 9 aa, Artificial Sequence
  Description of Artificial Sequence: Synthetic peptide
  Seed: RFFNRTCHC (TYRP1_HUMAN)
RWFNRTCHM

SEQ ID NO: 166616 - protein, 10 aa, Artificial Sequence
  Description of Artificial Sequence: Synthetic peptide
  Seed: YNADISTFPL (TYRP1_HUMAN)
YMADISTFPT

SEQ ID NO: 166617 - protein, 9 aa, Artificial Sequence
  Description of Artificial Sequence: Synthetic peptide
  Seed: YLIRARRSM (TYRP1_HUMAN)
YPIRARRSA

SEQ ID NO: 166618 - protein, 9 aa, Artificial Sequence
  Description of Artificial Sequence: Synthetic peptide
  Seed: TPQFENISI (TYRP1_HUMAN)
TAQFENISW

SEQ ID NO: 166619 - protein, 10 aa, Artificial Sequence
  Description of Artificial Sequence: Synthetic peptide
  Seed: LSPNDPIFVL (TYRP1_HUMAN)
LMPNDPIFVF

SEQ ID NO: 166620 - protein, 11 aa, Artificial Sequence
  Description of Artificial Sequence: Synthetic peptide
  Seed: KTFLGVGQESF (TYRP1_HUMAN)
KTFLGVGQESY

SEQ ID NO: 166621 - protein, 10 aa, Artificial Sequence
  Description of Artificial Sequence: Synthetic peptide
  Seed: SVKKTFLGVG (TYRP1_HUMAN)
SYKKTFLGVK

SEQ ID NO: 166622 - protein, 9 aa, Artificial Sequence
  Description of Artificial Sequence: Synthetic peptide
  Seed: VGALLLVAL (TYRP1_HUMAN)
VAALLLVAM

SEQ ID NO: 166623 - protein, 10 aa, Artificial Sequence
  Description of Artificial Sequence: Synthetic peptide
  Seed: GLFDTPPFYS (TYRP1_HUMAN)
GLFDTPPFYM

SEQ ID NO: 166624 - protein, 10 aa, Artificial Sequence
  Description of Artificial Sequence: Synthetic peptide
  Seed: MVPFWPPVTN (TYRP1_HUMAN)
MIPFWPPVTL

SEQ ID NO: 166625 - protein, 9 aa, Artificial Sequence
  Description of Artificial Sequence: Synthetic peptide
  Seed: FTDAVFDEW (TYRP1_HUMAN)
FWDAVFDEL

SEQ ID NO: 166626 - protein, 9 aa, Artificial Sequence
  Description of Artificial Sequence: Synthetic peptide
  Seed: LQNPNQSVV (TYRP1_HUMAN)
LSNPNQSVM

SEQ ID NO: 166627 - protein, 9 aa, Artificial Sequence
  Description of Artificial Sequence: Synthetic peptide
  Seed: GPAFLTWHR (TYRP1_HUMAN)
GTAFLTWHR

SEQ ID NO: 166628 - protein, 10 aa, Artificial Sequence
  Description of Artificial Sequence: Synthetic peptide
  Seed: LIFGTASYLI (TYRP1_HUMAN)
LKFGTASYLF

SEQ ID NO: 166629 - protein, 9 aa, Artificial Sequence
  Description of Artificial Sequence: Synthetic peptide
  Seed: RQYNMVPFW (TYRP1_HUMAN)
RKYNMVPFY

SEQ ID NO: 166630 - protein, 10 aa, Artificial Sequence
  Description of Artificial Sequence: Synthetic peptide
  Seed: KRTTHPLFVI (TYRP1_HUMAN)
KNTTHPLFVY

SEQ ID NO: 166631 - protein, 9 aa, Artificial Sequence
  Description of Artificial Sequence: Synthetic peptide
  Seed: WPPVTNTEM (TYRP1_HUMAN)
WPPVTNTEF

SEQ ID NO: 166632 - protein, 8 aa, Artificial Sequence
  Description of Artificial Sequence: Synthetic peptide
  Seed: YYSVKKTF (TYRP1_HUMAN)
YTSVKKTL

SEQ ID NO: 166633 - protein, 9 aa, Artificial Sequence
  Description of Artificial Sequence: Synthetic peptide
  Seed: ACDQRVLIV (TYRP1_HUMAN)
AFDQRVLII

SEQ ID NO: 166634 - protein, 9 aa, Artificial Sequence
  Description of Artificial Sequence: Synthetic peptide
  Seed: ACDQRVLIV (TYRP1_HUMAN)
AFDQRVLIL

SEQ ID NO: 166635 - protein, 9 aa, Artificial Sequence
  Description of Artificial Sequence: Synthetic peptide
  Seed: RTTHPLFVI (TYRP1_HUMAN)
RVTHPLFVL

SEQ ID NO: 166636 - protein, 9 aa, Artificial Sequence
  Description of Artificial Sequence: Synthetic peptide
  Seed: RGRCEAVTA (TYRP1_HUMAN)
RSRCEAVTI

SEQ ID NO: 166637 - protein, 8 aa, Artificial Sequence
  Description of Artificial Sequence: Synthetic peptide
  Seed: IFFPLLLF (TYRP1_HUMAN)
IWFPLLLF

SEQ ID NO: 166638 - protein, 10 aa, Artificial Sequence
  Description of Artificial Sequence: Synthetic peptide
  Seed: LSLGCIFFPL (TYRP1_HUMAN)
LILGCIFFPA

SEQ ID NO: 166639 - protein, 10 aa, Artificial Sequence
  Description of Artificial Sequence: Synthetic peptide
  Seed: FGTASYLIRA (TYRP1_HUMAN)
FLTASYLIRT

SEQ ID NO: 166640 - protein, 10 aa, Artificial Sequence
  Description of Artificial Sequence: Synthetic peptide
  Seed: AVFDEWLRRY (TYRP1_HUMAN)
AFFDEWLRRY

SEQ ID NO: 166641 - protein, 10 aa, Artificial Sequence
  Description of Artificial Sequence: Synthetic peptide
  Seed: FSLPYWNFAT (TYRP1_HUMAN)
FMLPYWNFAV

SEQ ID NO: 166642 - protein, 9 aa, Artificial Sequence
  Description of Artificial Sequence: Synthetic peptide
  Seed: NVARPMVQR (TYRP1_HUMAN)
NLARPMVQR

SEQ ID NO: 166643 - protein, 9 aa, Artificial Sequence
  Description of Artificial Sequence: Synthetic peptide
  Seed: HRYHLLRLE (TYRP1_HUMAN)
HRYHLLRLR

SEQ ID NO: 166644 - protein, 9 aa, Artificial Sequence
  Description of Artificial Sequence: Synthetic peptide
  Seed: VGQESFGEV (TYRP1_HUMAN)
VAQESFGEL

SEQ ID NO: 166645 - protein, 9 aa, Artificial Sequence
  Description of Artificial Sequence: Synthetic peptide
  Seed: LTWHRYHLL (TYRP1_HUMAN)
LIWHRYHLL

SEQ ID NO: 166646 - protein, 9 aa, Artificial Sequence
  Description of Artificial Sequence: Synthetic peptide
  Seed: VPEIIAIAV (TYRP1_HUMAN)
VPEIIAIAW

SEQ ID NO: 166647 - protein, 9 aa, Artificial Sequence
  Description of Artificial Sequence: Synthetic peptide
  Seed: LIFGTASYL (TYRP1_HUMAN)
LCFGTASYW

SEQ ID NO: 166648 - protein, 11 aa, Artificial Sequence
  Description of Artificial Sequence: Synthetic peptide
  Seed: LISPNSVFSQW (TYRP1_HUMAN)
LVSPNSVFSQW

SEQ ID NO: 166649 - protein, 9 aa, Artificial Sequence
  Description of Artificial Sequence: Synthetic peptide
  Seed: ACDQRVLIV (TYRP1_HUMAN)
AVDQRVLIM

SEQ ID NO: 166650 - protein, 9 aa, Artificial Sequence
  Description of Artificial Sequence: Synthetic peptide
  Seed: IAVVGALLL (TYRP1_HUMAN)
ILVVGALLV

SEQ ID NO: 166651 - protein, 9 aa, Artificial Sequence
  Description of Artificial Sequence: Synthetic peptide
  Seed: TTHPLFVIA (TYRP1_HUMAN)
TMHPLFVIV

SEQ ID NO: 166652 - protein, 10 aa, Artificial Sequence
  Description of Artificial Sequence: Synthetic peptide
  Seed: NYFVWTHYYS (TYRP1_HUMAN)
NQFVWTHYYY

SEQ ID NO: 166653 - protein, 9 aa, Artificial Sequence
  Description of Artificial Sequence: Synthetic peptide
  Seed: RTTHPLFVI (TYRP1_HUMAN)
RTTHPLFVK

SEQ ID NO: 166654 - protein, 9 aa, Artificial Sequence
  Description of Artificial Sequence: Synthetic peptide
  Seed: MSAPKLLSL (TYRP1_HUMAN)
MAAPKLLSA

SEQ ID NO: 166655 - protein, 9 aa, Artificial Sequence
  Description of Artificial Sequence: Synthetic peptide
  Seed: STNSFRNTV (TYRP1_HUMAN)
SINSFRNTV

SEQ ID NO: 166656 - protein, 11 aa, Artificial Sequence
  Description of Artificial Sequence: Synthetic peptide
  Seed: YQCYAEEYEKL (TYRP1_HUMAN)
YACYAEEYEKF

SEQ ID NO: 166657 - protein, 9 aa, Artificial Sequence
  Description of Artificial Sequence: Synthetic peptide
  Seed: VRSLHNLAH (TYRP1_HUMAN)
VRSLHNLAY

SEQ ID NO: 166658 - protein, 9 aa, Artificial Sequence
  Description of Artificial Sequence: Synthetic peptide
  Seed: AIAVVGALL (TYRP1_HUMAN)
ALAVVGALY

SEQ ID NO: 166659 - protein, 10 aa, Artificial Sequence
  Description of Artificial Sequence: Synthetic peptide
  Seed: ALIFGTASYL (TYRP1_HUMAN)
AVIFGTASYV

SEQ ID NO: 166660 - protein, 9 aa, Artificial Sequence
  Description of Artificial Sequence: Synthetic peptide
  Seed: LSPNDPIFV (TYRP1_HUMAN)
LSPNDPIFL

SEQ ID NO: 166661 - protein, 10 aa, Artificial Sequence
  Description of Artificial Sequence: Synthetic peptide
  Seed: RSMDEANQPL (TYRP1_HUMAN)
RNMDEANQPY

SEQ ID NO: 166662 - protein, 9 aa, Artificial Sequence
  Description of Artificial Sequence: Synthetic peptide
  Seed: SFSLPYWNF (TYRP1_HUMAN)
SFSLPYWNI

SEQ ID NO: 166663 - protein, 9 aa, Artificial Sequence
  Description of Artificial Sequence: Synthetic peptide
  Seed: RYNADISTF (TYRP1_HUMAN)
RFNADISTY

SEQ ID NO: 166664 - protein, 9 aa, Artificial Sequence
  Description of Artificial Sequence: Synthetic peptide
  Seed: VARPMVQRL (TYRP1_HUMAN)
VFRPMVQRY

SEQ ID NO: 166665 - protein, 11 aa, Artificial Sequence
  Description of Artificial Sequence: Synthetic peptide
  Seed: QEMLQEPSFSL (TYRP1_HUMAN)
QKMLQEPSFSV

SEQ ID NO: 166666 - protein, 9 aa, Artificial Sequence
  Description of Artificial Sequence: Synthetic peptide
  Seed: TAPDNLGYT (TYRP1_HUMAN)
TAPDNLGYV

SEQ ID NO: 166667 - protein, 9 aa, Artificial Sequence
  Description of Artificial Sequence: Synthetic peptide
  Seed: RQYNMVPFW (TYRP1_HUMAN)
RIYNMVPFY

SEQ ID NO: 166668 - protein, 10 aa, Artificial Sequence
  Description of Artificial Sequence: Synthetic peptide
  Seed: YNYFVWTHYY (TYRP1_HUMAN)
YFYFVWTHYA

SEQ ID NO: 166669 - protein, 10 aa, Artificial Sequence
  Description of Artificial Sequence: Synthetic peptide
  Seed: LSLGCIFFPL (TYRP1_HUMAN)
LGLGCIFFPL

SEQ ID NO: 166670 - protein, 10 aa, Artificial Sequence
  Description of Artificial Sequence: Synthetic peptide
  Seed: YNYFVWTHYY (TYRP1_HUMAN)
YLYFVWTHYL

SEQ ID NO: 166671 - protein, 11 aa, Artificial Sequence
  Description of Artificial Sequence: Synthetic peptide
  Seed: SLEDYDTLGTL (TYRP1_HUMAN)
SMEDYDTLGTA

SEQ ID NO: 166672 - protein, 10 aa, Artificial Sequence
  Description of Artificial Sequence: Synthetic peptide
  Seed: KLLSLGCIFF (TYRP1_HUMAN)
KVLSLGCIFW

SEQ ID NO: 166673 - protein, 10 aa, Artificial Sequence
  Description of Artificial Sequence: Synthetic peptide
  Seed: SHEGPAFLTW (TYRP1_HUMAN)
SEEGPAFLTF

SEQ ID NO: 166674 - protein, 9 aa, Artificial Sequence
  Description of Artificial Sequence: Synthetic peptide
  Seed: DDREVWPLR (TYRP1_HUMAN)
DVREVWPLK

SEQ ID NO: 166675 - protein, 9 aa, Artificial Sequence
  Description of Artificial Sequence: Synthetic peptide
  Seed: SPNSVFSQW (TYRP1_HUMAN)
SPNSVFSQY

SEQ ID NO: 166676 - protein, 9 aa, Artificial Sequence
  Description of Artificial Sequence: Synthetic peptide
  Seed: IGHNRQYNM (TYRP1_HUMAN)
IAHNRQYNV

SEQ ID NO: 166677 - protein, 9 aa, Artificial Sequence
  Description of Artificial Sequence: Synthetic peptide
  Seed: IAIAVVGAL (TYRP1_HUMAN)
IQIAVVGAV

SEQ ID NO: 166678 - protein, 9 aa, Artificial Sequence
  Description of Artificial Sequence: Synthetic peptide
  Seed: ENAPIGHNR (TYRP1_HUMAN)
EIAPIGHNF

SEQ ID NO: 166679 - protein, 9 aa, Artificial Sequence
  Description of Artificial Sequence: Synthetic peptide
  Seed: FSLPYWNFA (TYRP1_HUMAN)
FTLPYWNFV

SEQ ID NO: 166680 - protein, 10 aa, Artificial Sequence
  Description of Artificial Sequence: Synthetic peptide
  Seed: RSMDEANQPL (TYRP1_HUMAN)
RAMDEANQPI

SEQ ID NO: 166681 - protein, 9 aa, Artificial Sequence
  Description of Artificial Sequence: Synthetic peptide
  Seed: FLGVGQESF (TYRP1_HUMAN)
FMGVGQESA

SEQ ID NO: 166682 - protein, 10 aa, Artificial Sequence
  Description of Artificial Sequence: Synthetic peptide
  Seed: TASYLIRARR (TYRP1_HUMAN)
TTSYLIRARR

SEQ ID NO: 166683 - protein, 10 aa, Artificial Sequence
  Description of Artificial Sequence: Synthetic peptide
  Seed: TFLGVGQESF (TYRP1_HUMAN)
TYLGVGQESW

SEQ ID NO: 166684 - protein, 9 aa, Artificial Sequence
  Description of Artificial Sequence: Synthetic peptide
  Seed: VFDEWLRRY (TYRP1_HUMAN)
VQDEWLRRV

SEQ ID NO: 166685 - protein, 9 aa, Artificial Sequence
  Description of Artificial Sequence: Synthetic peptide
  Seed: RQCATVEAL (TYRP1_HUMAN)
RRCATVEAV

SEQ ID NO: 166686 - protein, 10 aa, Artificial Sequence
  Description of Artificial Sequence: Synthetic peptide
  Seed: ANQPLLTDQY (TYRP1_HUMAN)
AMQPLLTDQY

SEQ ID NO: 166687 - protein, 9 aa, Artificial Sequence
  Description of Artificial Sequence: Synthetic peptide
  Seed: LTWHRYHLL (TYRP1_HUMAN)
LSWHRYHLF

SEQ ID NO: 166688 - protein, 11 aa, Artificial Sequence
  Description of Artificial Sequence: Synthetic peptide
  Seed: YFVWTHYYSVK (TYRP1_HUMAN)
YAVWTHYYSVR

SEQ ID NO: 166689 - protein, 9 aa, Artificial Sequence
  Description of Artificial Sequence: Synthetic peptide
  Seed: FSVPEIIAI (TYRP1_HUMAN)
FPVPEIIAA

SEQ ID NO: 166690 - protein, 9 aa, Artificial Sequence
  Description of Artificial Sequence: Synthetic peptide
  Seed: FPLLLFQQA (TYRP1_HUMAN)
FPLLLFQQS

SEQ ID NO: 166691 - protein, 11 aa, Artificial Sequence
  Description of Artificial Sequence: Synthetic peptide
  Seed: NYFVWTHYYSV (TYRP1_HUMAN)
NMFVWTHYYSI

SEQ ID NO: 166692 - protein, 9 aa, Artificial Sequence
  Description of Artificial Sequence: Synthetic peptide
  Seed: KLQNPNQSV (TYRP1_HUMAN)
KAQNPNQSF

SEQ ID NO: 166693 - protein, 9 aa, Artificial Sequence
  Description of Artificial Sequence: Synthetic peptide
  Seed: MLQEPSFSL (TYRP1_HUMAN)
MMQEPSFSF

SEQ ID NO: 166694 - protein, 9 aa, Artificial Sequence
  Description of Artificial Sequence: Synthetic peptide
  Seed: LTWHRYHLL (TYRP1_HUMAN)
LAWHRYHLK

SEQ ID NO: 166695 - protein, 10 aa, Artificial Sequence
  Description of Artificial Sequence: Synthetic peptide
  Seed: FGTASYLIRA (TYRP1_HUMAN)
FLTASYLIRL

SEQ ID NO: 166696 - protein, 10 aa, Artificial Sequence
  Description of Artificial Sequence: Synthetic peptide
  Seed: YNADISTFPL (TYRP1_HUMAN)
YHADISTFPI

SEQ ID NO: 166697 - protein, 8 aa, Artificial Sequence
  Description of Artificial Sequence: Synthetic peptide
  Seed: YDPAVRSL (TYRP1_HUMAN)
YAPAVRSL

SEQ ID NO: 166698 - protein, 9 aa, Artificial Sequence
  Description of Artificial Sequence: Synthetic peptide
  Seed: KLLSLGCIF (TYRP1_HUMAN)
KTLSLGCIM

SEQ ID NO: 166699 - protein, 11 aa, Artificial Sequence
  Description of Artificial Sequence: Synthetic peptide
  Seed: VRSLHNLAHLF (TYRP1_HUMAN)
VYSLHNLAHLW

SEQ ID NO: 166700 - protein, 9 aa, Artificial Sequence
  Description of Artificial Sequence: Synthetic peptide
  Seed: MSAPKLLSL (TYRP1_HUMAN)
MSAPKLLSM

SEQ ID NO: 166701 - protein, 9 aa, Artificial Sequence
  Description of Artificial Sequence: Synthetic peptide
  Seed: FSVPEIIAI (TYRP1_HUMAN)
FTVPEIIAV

SEQ ID NO: 166702 - protein, 11 aa, Artificial Sequence
  Description of Artificial Sequence: Synthetic peptide
  Seed: REVWPLRFFNR (TYRP1_HUMAN)
RWVWPLRFFNK

SEQ ID NO: 166703 - protein, 9 aa, Artificial Sequence
  Description of Artificial Sequence: Synthetic peptide
  Seed: LFDTPPFYS (TYRP1_HUMAN)
LMDTPPFYM

SEQ ID NO: 166704 - protein, 9 aa, Artificial Sequence
  Description of Artificial Sequence: Synthetic peptide
  Seed: TTHPLFVIA (TYRP1_HUMAN)
TSHPLFVIL

SEQ ID NO: 166705 - protein, 9 aa, Artificial Sequence
  Description of Artificial Sequence: Synthetic peptide
  Seed: VTAPDNLGY (TYRP1_HUMAN)
VSAPDNLGR

SEQ ID NO: 166706 - protein, 10 aa, Artificial Sequence
  Description of Artificial Sequence: Synthetic peptide
  Seed: RLEKDMQEML (TYRP1_HUMAN)
RMEKDMQEMF

SEQ ID NO: 166707 - protein, 9 aa, Artificial Sequence
  Description of Artificial Sequence: Synthetic peptide
  Seed: SVFSQWRVV (TYRP1_HUMAN)
SLFSQWRVA

SEQ ID NO: 166708 - protein, 9 aa, Artificial Sequence
  Description of Artificial Sequence: Synthetic peptide
  Seed: FSHEGPAFL (TYRP1_HUMAN)
FCHEGPAFM

SEQ ID NO: 166709 - protein, 9 aa, Artificial Sequence
  Description of Artificial Sequence: Synthetic peptide
  Seed: MLQEPSFSL (TYRP1_HUMAN)
MEQEPSFSY

SEQ ID NO: 166710 - protein, 9 aa, Artificial Sequence
  Description of Artificial Sequence: Synthetic peptide
  Seed: STEDGPIRR (TYRP1_HUMAN)
SIEDGPIRY

SEQ ID NO: 166711 - protein, 9 aa, Artificial Sequence
  Description of Artificial Sequence: Synthetic peptide
  Seed: ARAQFPRQC (TYRP1_HUMAN)
AHAQFPRQA

SEQ ID NO: 166712 - protein, 10 aa, Artificial Sequence
  Description of Artificial Sequence: Synthetic peptide
  Seed: RSLHNLAHLF (TYRP1_HUMAN)
RWLHNLAHLM

SEQ ID NO: 166713 - protein, 10 aa, Artificial Sequence
  Description of Artificial Sequence: Synthetic peptide
  Seed: IYNYFVWTHY (TYRP1_HUMAN)
IFNYFVWTHY

SEQ ID NO: 166714 - protein, 11 aa, Artificial Sequence
  Description of Artificial Sequence: Synthetic peptide
  Seed: FSHEGPAFLTW (TYRP1_HUMAN)
FAHEGPAFLTH

SEQ ID NO: 166715 - protein, 9 aa, Artificial Sequence
  Description of Artificial Sequence: Synthetic peptide
  Seed: YLIRARRSM (TYRP1_HUMAN)
YPIRARRSY

SEQ ID NO: 166716 - protein, 9 aa, Artificial Sequence
  Description of Artificial Sequence: Synthetic peptide
  Seed: TTHPLFVIA (TYRP1_HUMAN)
TAHPLFVII

SEQ ID NO: 166717 - protein, 10 aa, Artificial Sequence
  Description of Artificial Sequence: Synthetic peptide
  Seed: RRYNADISTF (TYRP1_HUMAN)
RMYNADISTY

SEQ ID NO: 166718 - protein, 11 aa, Artificial Sequence
  Description of Artificial Sequence: Synthetic peptide
  Seed: REFSVPEIIAI (TYRP1_HUMAN)
REFSVPEIIAL

SEQ ID NO: 166719 - protein, 8 aa, Artificial Sequence
  Description of Artificial Sequence: Synthetic peptide
  Seed: YFVWTHYY (TYRP1_HUMAN)
YTVWTHYY

SEQ ID NO: 166720 - protein, 9 aa, Artificial Sequence
  Description of Artificial Sequence: Synthetic peptide
  Seed: AKRTTHPLF (TYRP1_HUMAN)
AQRTTHPLY

SEQ ID NO: 166721 - protein, 9 aa, Artificial Sequence
  Description of Artificial Sequence: Synthetic peptide
  Seed: RGRCEAVTA (TYRP1_HUMAN)
RQRCEAVTK

SEQ ID NO: 166722 - protein, 9 aa, Artificial Sequence
  Description of Artificial Sequence: Synthetic peptide
  Seed: HLSPNDPIF (TYRP1_HUMAN)
HMSPNDPII

SEQ ID NO: 166723 - protein, 9 aa, Artificial Sequence
  Description of Artificial Sequence: Synthetic peptide
  Seed: TLISPNSVF (TYRP1_HUMAN)
TQISPNSVY

SEQ ID NO: 166724 - protein, 9 aa, Artificial Sequence
  Description of Artificial Sequence: Synthetic peptide
  Seed: QEMLQEPSF (TYRP1_HUMAN)
QEMLQEPSM

SEQ ID NO: 166725 - protein, 9 aa, Artificial Sequence
  Description of Artificial Sequence: Synthetic peptide
  Seed: LQNPNQSVV (TYRP1_HUMAN)
LANPNQSVH

SEQ ID NO: 166726 - protein, 11 aa, Artificial Sequence
  Description of Artificial Sequence: Synthetic peptide
  Seed: NYFVWTHYYSV (TYRP1_HUMAN)
NMFVWTHYYSL

SEQ ID NO: 166727 - protein, 9 aa, Artificial Sequence
  Description of Artificial Sequence: Synthetic peptide
  Seed: RVLIVRRNL (TYRP1_HUMAN)
RVLIVRRNV

SEQ ID NO: 166728 - protein, 9 aa, Artificial Sequence
  Description of Artificial Sequence: Synthetic peptide
  Seed: STLISPNSV (TYRP1_HUMAN)
SALISPNSY

SEQ ID NO: 166729 - protein, 9 aa, Artificial Sequence
  Description of Artificial Sequence: Synthetic peptide
  Seed: NADISTFPL (TYRP1_HUMAN)
NSDISTFPM

SEQ ID NO: 166730 - protein, 9 aa, Artificial Sequence
  Description of Artificial Sequence: Synthetic peptide
  Seed: HYYSVKKTF (TYRP1_HUMAN)
HQYSVKKTF

SEQ ID NO: 166731 - protein, 9 aa, Artificial Sequence
  Description of Artificial Sequence: Synthetic peptide
  Seed: GLFDTPPFY (TYRP1_HUMAN)
GAFDTPPFL

SEQ ID NO: 166732 - protein, 8 aa, Artificial Sequence
  Description of Artificial Sequence: Synthetic peptide
  Seed: LIFGTASY (TYRP1_HUMAN)
LLFGTASY

SEQ ID NO: 166733 - protein, 11 aa, Artificial Sequence
  Description of Artificial Sequence: Synthetic peptide
  Seed: KTFLGVGQESF (TYRP1_HUMAN)
KAFLGVGQESY

SEQ ID NO: 166734 - protein, 9 aa, Artificial Sequence
  Description of Artificial Sequence: Synthetic peptide
  Seed: RRYNADIST (TYRP1_HUMAN)
RYYNADISL

SEQ ID NO: 166735 - protein, 9 aa, Artificial Sequence
  Description of Artificial Sequence: Synthetic peptide
  Seed: RYHLLRLEK (TYRP1_HUMAN)
RVHLLRLEK

SEQ ID NO: 166736 - protein, 8 aa, Artificial Sequence
  Description of Artificial Sequence: Synthetic peptide
  Seed: YSNSTNSF (TYRP1_HUMAN)
YYNSTNSF

SEQ ID NO: 166737 - protein, 9 aa, Artificial Sequence
  Description of Artificial Sequence: Synthetic peptide
  Seed: QRLPEPQDV (TYRP1_HUMAN)
QHLPEPQDV

SEQ ID NO: 166738 - protein, 10 aa, Artificial Sequence
  Description of Artificial Sequence: Synthetic peptide
  Seed: AQFPRQCATV (TYRP1_HUMAN)
AKFPRQCATF

SEQ ID NO: 166739 - protein, 10 aa, Artificial Sequence
  Description of Artificial Sequence: Synthetic peptide
  Seed: STLISPNSVF (TYRP1_HUMAN)
SQLISPNSVM

SEQ ID NO: 166740 - protein, 9 aa, Artificial Sequence
  Description of Artificial Sequence: Synthetic peptide
  Seed: ALIFGTASY (TYRP1_HUMAN)
AIIFGTASR

SEQ ID NO: 166741 - protein, 10 aa, Artificial Sequence
  Description of Artificial Sequence: Synthetic peptide
  Seed: STLISPNSVF (TYRP1_HUMAN)
SRLISPNSVY

SEQ ID NO: 166742 - protein, 9 aa, Artificial Sequence
  Description of Artificial Sequence: Synthetic peptide
  Seed: FYSNSTNSF (TYRP1_HUMAN)
FQSNSTNSF

SEQ ID NO: 166743 - protein, 10 aa, Artificial Sequence
  Description of Artificial Sequence: Synthetic peptide
  Seed: NYFVWTHYYS (TYRP1_HUMAN)
NAFVWTHYYY

SEQ ID NO: 166744 - protein, 10 aa, Artificial Sequence
  Description of Artificial Sequence: Synthetic peptide
  Seed: YNYFVWTHYY (TYRP1_HUMAN)
YYYFVWTHYH

SEQ ID NO: 166745 - protein, 9 aa, Artificial Sequence
  Description of Artificial Sequence: Synthetic peptide
  Seed: RYNADISTF (TYRP1_HUMAN)
RANADISTM

SEQ ID NO: 166746 - protein, 9 aa, Artificial Sequence
  Description of Artificial Sequence: Synthetic peptide
  Seed: RYHLLRLEK (TYRP1_HUMAN)
RAHLLRLER

SEQ ID NO: 166747 - protein, 10 aa, Artificial Sequence
  Description of Artificial Sequence: Synthetic peptide
  Seed: MSAPKLLSLG (TYRP1_HUMAN)
MHAPKLLSLW

SEQ ID NO: 166748 - protein, 9 aa, Artificial Sequence
  Description of Artificial Sequence: Synthetic peptide
  Seed: RARRSMDEA (TYRP1_HUMAN)
RTRRSMDEY

SEQ ID NO: 166749 - protein, 9 aa, Artificial Sequence
  Description of Artificial Sequence: Synthetic peptide
  Seed: IAVVGALLL (TYRP1_HUMAN)
IIVVGALLW

SEQ ID NO: 166750 - protein, 10 aa, Artificial Sequence
  Description of Artificial Sequence: Synthetic peptide
  Seed: HSPQYPHDGR (TYRP1_HUMAN)
HVPQYPHDGR

SEQ ID NO: 166751 - protein, 10 aa, Artificial Sequence
  Description of Artificial Sequence: Synthetic peptide
  Seed: LSPNDPIFVL (TYRP1_HUMAN)
LVPNDPIFVY

SEQ ID NO: 166752 - protein, 8 aa, Artificial Sequence
  Description of Artificial Sequence: Synthetic peptide
  Seed: ACDQRVLI (TYRP1_HUMAN)
AVDQRVLI

SEQ ID NO: 166753 - protein, 9 aa, Artificial Sequence
  Description of Artificial Sequence: Synthetic peptide
  Seed: FSVPEIIAI (TYRP1_HUMAN)
FLVPEIIAS

SEQ ID NO: 166754 - protein, 9 aa, Artificial Sequence
  Description of Artificial Sequence: Synthetic peptide
  Seed: NMVPFWPPV (TYRP1_HUMAN)
NFVPFWPPL

SEQ ID NO: 166755 - protein, 9 aa, Artificial Sequence
  Description of Artificial Sequence: Synthetic peptide
  Seed: MLQEPSFSL (TYRP1_HUMAN)
MLQEPSFSA

SEQ ID NO: 166756 - protein, 9 aa, Artificial Sequence
  Description of Artificial Sequence: Synthetic peptide
  Seed: AQFPRQCAT (TYRP1_HUMAN)
AVFPRQCAF

SEQ ID NO: 166757 - protein, 9 aa, Artificial Sequence
  Description of Artificial Sequence: Synthetic peptide
  Seed: TEMFVTAPD (TYRP1_HUMAN)
TEMFVTAPS

SEQ ID NO: 166758 - protein, 11 aa, Artificial Sequence
  Description of Artificial Sequence: Synthetic peptide
  Seed: YFVWTHYYSVK (TYRP1_HUMAN)
YVVWTHYYSVK

SEQ ID NO: 166759 - protein, 9 aa, Artificial Sequence
  Description of Artificial Sequence: Synthetic peptide
  Seed: DDREVWPLR (TYRP1_HUMAN)
DLREVWPLR

SEQ ID NO: 166760 - protein, 9 aa, Artificial Sequence
  Description of Artificial Sequence: Synthetic peptide
  Seed: GCIFFPLLL (TYRP1_HUMAN)
GTIFFPLLL

SEQ ID NO: 166761 - protein, 11 aa, Artificial Sequence
  Description of Artificial Sequence: Synthetic peptide
  Seed: REVWPLRFFNR (TYRP1_HUMAN)
RLVWPLRFFNR

SEQ ID NO: 166762 - protein, 9 aa, Artificial Sequence
  Description of Artificial Sequence: Synthetic peptide
  Seed: RTCHCNGNF (TYRP1_HUMAN)
RTCHCNGNY

SEQ ID NO: 166763 - protein, 9 aa, Artificial Sequence
  Description of Artificial Sequence: Synthetic peptide
  Seed: FYSNSTNSF (TYRP1_HUMAN)
FYSNSTNSA

SEQ ID NO: 166764 - protein, 9 aa, Artificial Sequence
  Description of Artificial Sequence: Synthetic peptide
  Seed: YTYEIQWPS (TYRP1_HUMAN)
YTYEIQWPF

SEQ ID NO: 166765 - protein, 10 aa, Artificial Sequence
  Description of Artificial Sequence: Synthetic peptide
  Seed: IAIAVVGALL (TYRP1_HUMAN)
IIIAVVGALV

SEQ ID NO: 166766 - protein, 10 aa, Artificial Sequence
  Description of Artificial Sequence: Synthetic peptide
  Seed: EIIAIAVVGA (TYRP1_HUMAN)
EVIAIAVVGM

SEQ ID NO: 166767 - protein, 9 aa, Artificial Sequence
  Description of Artificial Sequence: Synthetic peptide
  Seed: LLVALIFGT (TYRP1_HUMAN)
LMVALIFGV

SEQ ID NO: 166768 - protein, 10 aa, Artificial Sequence
  Description of Artificial Sequence: Synthetic peptide
  Seed: NYFVWTHYYS (TYRP1_HUMAN)
NRFVWTHYYY

SEQ ID NO: 166769 - protein, 10 aa, Artificial Sequence
  Description of Artificial Sequence: Synthetic peptide
  Seed: TPQFENISIY (TYRP1_HUMAN)
TGQFENISIF

SEQ ID NO: 166770 - protein, 9 aa, Artificial Sequence
  Description of Artificial Sequence: Synthetic peptide
  Seed: TADSRPHSP (TYRP1_HUMAN)
TNDSRPHSV

SEQ ID NO: 166771 - protein, 11 aa, Artificial Sequence
  Description of Artificial Sequence: Synthetic peptide
  Seed: VRSLHNLAHLF (TYRP1_HUMAN)
VQSLHNLAHLY

SEQ ID NO: 166772 - protein, 10 aa, Artificial Sequence
  Description of Artificial Sequence: Synthetic peptide
  Seed: WPPVTNTEMF (TYRP1_HUMAN)
WFPVTNTEMW

SEQ ID NO: 166773 - protein, 10 aa, Artificial Sequence
  Description of Artificial Sequence: Synthetic peptide
  Seed: QCYAEEYEKL (TYRP1_HUMAN)
QSYAEEYEKF

SEQ ID NO: 166774 - protein, 9 aa, Artificial Sequence
  Description of Artificial Sequence: Synthetic peptide
  Seed: FENISIYNY (TYRP1_HUMAN)
FENISIYNL

SEQ ID NO: 166775 - protein, 9 aa, Artificial Sequence
  Description of Artificial Sequence: Synthetic peptide
  Seed: APIGHNRQY (TYRP1_HUMAN)
AVIGHNRQF

SEQ ID NO: 166776 - protein, 10 aa, Artificial Sequence
  Description of Artificial Sequence: Synthetic peptide
  Seed: LGPDGNTPQF (TYRP1_HUMAN)
LHPDGNTPQY

SEQ ID NO: 166777 - protein, 9 aa, Artificial Sequence
  Description of Artificial Sequence: Synthetic peptide
  Seed: VARPMVQRL (TYRP1_HUMAN)
VARPMVQRM

SEQ ID NO: 166778 - protein, 9 aa, Artificial Sequence
  Description of Artificial Sequence: Synthetic peptide
  Seed: FLGVGQESF (TYRP1_HUMAN)
FPGVGQESY

SEQ ID NO: 166779 - protein, 9 aa, Artificial Sequence
  Description of Artificial Sequence: Synthetic peptide
  Seed: VFDEWLRRY (TYRP1_HUMAN)
VFDEWLRRF

SEQ ID NO: 166780 - protein, 9 aa, Artificial Sequence
  Description of Artificial Sequence: Synthetic peptide
  Seed: MAKRTTHPL (TYRP1_HUMAN)
MLKRTTHPY

SEQ ID NO: 166781 - protein, 9 aa, Artificial Sequence
  Description of Artificial Sequence: Synthetic peptide
  Seed: RTTHPLFVI (TYRP1_HUMAN)
RMTHPLFVV

SEQ ID NO: 166782 - protein, 10 aa, Artificial Sequence
  Description of Artificial Sequence: Synthetic peptide
  Seed: YNMVPFWPPV (TYRP1_HUMAN)
YAMVPFWPPT

SEQ ID NO: 166783 - protein, 10 aa, Artificial Sequence
  Description of Artificial Sequence: Synthetic peptide
  Seed: FVWTHYYSVK (TYRP1_HUMAN)
FVWTHYYSVL

SEQ ID NO: 166784 - protein, 9 aa, Artificial Sequence
  Description of Artificial Sequence: Synthetic peptide
  Seed: GYSDPTGKY (TYRP1_HUMAN)
GYSDPTGKF

SEQ ID NO: 166785 - protein, 9 aa, Artificial Sequence
  Description of Artificial Sequence: Synthetic peptide
  Seed: FVWTHYYSV (TYRP1_HUMAN)
FIWTHYYSL

SEQ ID NO: 166786 - protein, 9 aa, Artificial Sequence
  Description of Artificial Sequence: Synthetic peptide
  Seed: VARPMVQRL (TYRP1_HUMAN)
VIRPMVQRF

SEQ ID NO: 166787 - protein, 10 aa, Artificial Sequence
  Description of Artificial Sequence: Synthetic peptide
  Seed: RSMDEANQPL (TYRP1_HUMAN)
RSMDEANQPI

SEQ ID NO: 166788 - protein, 10 aa, Artificial Sequence
  Description of Artificial Sequence: Synthetic peptide
  Seed: AVRSLHNLAH (TYRP1_HUMAN)
ATRSLHNLAK

SEQ ID NO: 166789 - protein, 9 aa, Artificial Sequence
  Description of Artificial Sequence: Synthetic peptide
  Seed: FPRQCATVE (TYRP1_HUMAN)
FPRQCATVI

SEQ ID NO: 166790 - protein, 10 aa, Artificial Sequence
  Description of Artificial Sequence: Synthetic peptide
  Seed: IQWPSREFSV (TYRP1_HUMAN)
IMWPSREFSV

SEQ ID NO: 166791 - protein, 9 aa, Artificial Sequence
  Description of Artificial Sequence: Synthetic peptide
  Seed: RPMVQRLPE (TYRP1_HUMAN)
RPMVQRLPC

SEQ ID NO: 166792 - protein, 10 aa, Artificial Sequence
  Description of Artificial Sequence: Synthetic peptide
  Seed: LLLVALIFGT (TYRP1_HUMAN)
LNLVALIFGL

SEQ ID NO: 166793 - protein, 9 aa, Artificial Sequence
  Description of Artificial Sequence: Synthetic peptide
  Seed: YLIRARRSM (TYRP1_HUMAN)
YWIRARRSI

SEQ ID NO: 166794 - protein, 9 aa, Artificial Sequence
  Description of Artificial Sequence: Synthetic peptide
  Seed: FSHEGPAFL (TYRP1_HUMAN)
FLHEGPAFC

SEQ ID NO: 166795 - protein, 8 aa, Artificial Sequence
  Description of Artificial Sequence: Synthetic peptide
  Seed: RQYNMVPF (TYRP1_HUMAN)
RMYNMVPL

SEQ ID NO: 166796 - protein, 10 aa, Artificial Sequence
  Description of Artificial Sequence: Synthetic peptide
  Seed: EFSVPEIIAI (TYRP1_HUMAN)
ETSVPEIIAI

SEQ ID NO: 166797 - protein, 10 aa, Artificial Sequence
  Description of Artificial Sequence: Synthetic peptide
  Seed: LSLGCIFFPL (TYRP1_HUMAN)
LELGCIFFPV

SEQ ID NO: 166798 - protein, 10 aa, Artificial Sequence
  Description of Artificial Sequence: Synthetic peptide
  Seed: YNMVPFWPPV (TYRP1_HUMAN)
YQMVPFWPPC

SEQ ID NO: 166799 - protein, 10 aa, Artificial Sequence
  Description of Artificial Sequence: Synthetic peptide
  Seed: LPYWNFATGK (TYRP1_HUMAN)
LWYWNFATGR

SEQ ID NO: 166800 - protein, 11 aa, Artificial Sequence
  Description of Artificial Sequence: Synthetic peptide
  Seed: RRYNADISTFP (TYRP1_HUMAN)
RYYNADISTFG

SEQ ID NO: 166801 - protein, 9 aa, Artificial Sequence
  Description of Artificial Sequence: Synthetic peptide
  Seed: IGHNRQYNM (TYRP1_HUMAN)
IAHNRQYNF

SEQ ID NO: 166802 - protein, 9 aa, Artificial Sequence
  Description of Artificial Sequence: Synthetic peptide
  Seed: NYFVWTHYY (TYRP1_HUMAN)
NYFVWTHYW

SEQ ID NO: 166803 - protein, 9 aa, Artificial Sequence
  Description of Artificial Sequence: Synthetic peptide
  Seed: MLQEPSFSL (TYRP1_HUMAN)
MPQEPSFSF

SEQ ID NO: 166804 - protein, 9 aa, Artificial Sequence
  Description of Artificial Sequence: Synthetic peptide
  Seed: VTAPDNLGY (TYRP1_HUMAN)
VSAPDNLGF

SEQ ID NO: 166805 - protein, 10 aa, Artificial Sequence
  Description of Artificial Sequence: Synthetic peptide
  Seed: MQEMLQEPSF (TYRP1_HUMAN)
MLEMLQEPSY

SEQ ID NO: 166806 - protein, 9 aa, Artificial Sequence
  Description of Artificial Sequence: Synthetic peptide
  Seed: MLQEPSFSL (TYRP1_HUMAN)
MIQEPSFSL

SEQ ID NO: 166807 - protein, 8 aa, Artificial Sequence
  Description of Artificial Sequence: Synthetic peptide
  Seed: RPMVQRLP (TYRP1_HUMAN)
RPMVQRLM

SEQ ID NO: 166808 - protein, 9 aa, Artificial Sequence
  Description of Artificial Sequence: Synthetic peptide
  Seed: FVWTHYYSV (TYRP1_HUMAN)
FVWTHYYSY

SEQ ID NO: 166809 - protein, 9 aa, Artificial Sequence
  Description of Artificial Sequence: Synthetic peptide
  Seed: NMVPFWPPV (TYRP1_HUMAN)
NAVPFWPPI

SEQ ID NO: 166810 - protein, 9 aa, Artificial Sequence
  Description of Artificial Sequence: Synthetic peptide
  Seed: YNYFVWTHY (TYRP1_HUMAN)
YLYFVWTHY

SEQ ID NO: 166811 - protein, 9 aa, Artificial Sequence
  Description of Artificial Sequence: Synthetic peptide
  Seed: MDEANQPLL (TYRP1_HUMAN)
MEEANQPLP

SEQ ID NO: 166812 - protein, 9 aa, Artificial Sequence
  Description of Artificial Sequence: Synthetic peptide
  Seed: LTWHRYHLL (TYRP1_HUMAN)
LAWHRYHLF

SEQ ID NO: 166813 - protein, 9 aa, Artificial Sequence
  Description of Artificial Sequence: Synthetic peptide
  Seed: FPLENAPIG (TYRP1_HUMAN)
FMLENAPIF

SEQ ID NO: 166814 - protein, 9 aa, Artificial Sequence
  Description of Artificial Sequence: Synthetic peptide
  Seed: RPMVQRLPE (TYRP1_HUMAN)
RVMVQRLPI

SEQ ID NO: 166815 - protein, 10 aa, Artificial Sequence
  Description of Artificial Sequence: Synthetic peptide
  Seed: RRYNADISTF (TYRP1_HUMAN)
RYYNADISTL

SEQ ID NO: 166816 - protein, 9 aa, Artificial Sequence
  Description of Artificial Sequence: Synthetic peptide
  Seed: YSNSTNSFR (TYRP1_HUMAN)
YMNSTNSFR

SEQ ID NO: 166817 - protein, 10 aa, Artificial Sequence
  Description of Artificial Sequence: Synthetic peptide
  Seed: FVLLHTFTDA (TYRP1_HUMAN)
FELLHTFTDV

SEQ ID NO: 166818 - protein, 10 aa, Artificial Sequence
  Description of Artificial Sequence: Synthetic peptide
  Seed: YNADISTFPL (TYRP1_HUMAN)
YNADISTFPI

SEQ ID NO: 166819 - protein, 9 aa, Artificial Sequence
  Description of Artificial Sequence: Synthetic peptide
  Seed: MSAPKLLSL (TYRP1_HUMAN)
MSAPKLLSI

SEQ ID NO: 166820 - protein, 11 aa, Artificial Sequence
  Description of Artificial Sequence: Synthetic peptide
  Seed: QEMLQEPSFSL (TYRP1_HUMAN)
QWMLQEPSFSV

SEQ ID NO: 166821 - protein, 9 aa, Artificial Sequence
  Description of Artificial Sequence: Synthetic peptide
  Seed: KLQNPNQSV (TYRP1_HUMAN)
KIQNPNQSY

SEQ ID NO: 166822 - protein, 9 aa, Artificial Sequence
  Description of Artificial Sequence: Synthetic peptide
  Seed: STNSFRNTV (TYRP1_HUMAN)
SINSFRNTW

SEQ ID NO: 166823 - protein, 10 aa, Artificial Sequence
  Description of Artificial Sequence: Synthetic peptide
  Seed: YNADISTFPL (TYRP1_HUMAN)
YTADISTFPF

SEQ ID NO: 166824 - protein, 9 aa, Artificial Sequence
  Description of Artificial Sequence: Synthetic peptide
  Seed: LQNPNQSVV (TYRP1_HUMAN)
LQNPNQSVY

SEQ ID NO: 166825 - protein, 10 aa, Artificial Sequence
  Description of Artificial Sequence: Synthetic peptide
  Seed: ATVEALRSGM (TYRP1_HUMAN)
ASVEALRSGW

SEQ ID NO: 166826 - protein, 9 aa, Artificial Sequence
  Description of Artificial Sequence: Synthetic peptide
  Seed: HPLFVIATR (TYRP1_HUMAN)
HPLFVIATV

SEQ ID NO: 166827 - protein, 11 aa, Artificial Sequence
  Description of Artificial Sequence: Synthetic peptide
  Seed: FVWTHYYSVKK (TYRP1_HUMAN)
FTWTHYYSVKR

SEQ ID NO: 166828 - protein, 9 aa, Artificial Sequence
  Description of Artificial Sequence: Synthetic peptide
  Seed: MSAPKLLSL (TYRP1_HUMAN)
MMAPKLLSA

SEQ ID NO: 166829 - protein, 10 aa, Artificial Sequence
  Description of Artificial Sequence: Synthetic peptide
  Seed: RRYNADISTF (TYRP1_HUMAN)
REYNADISTL

SEQ ID NO: 166830 - protein, 10 aa, Artificial Sequence
  Description of Artificial Sequence: Synthetic peptide
  Seed: MVPFWPPVTN (TYRP1_HUMAN)
MNPFWPPVTY

SEQ ID NO: 166831 - protein, 11 aa, Artificial Sequence
  Description of Artificial Sequence: Synthetic peptide
  Seed: RRYNADISTFP (TYRP1_HUMAN)
RWYNADISTFT

SEQ ID NO: 166832 - protein, 10 aa, Artificial Sequence
  Description of Artificial Sequence: Synthetic peptide
  Seed: YFVWTHYYSV (TYRP1_HUMAN)
YRVWTHYYSV

SEQ ID NO: 166833 - protein, 9 aa, Artificial Sequence
  Description of Artificial Sequence: Synthetic peptide
  Seed: VGLFDTPPF (TYRP1_HUMAN)
VTLFDTPPI

SEQ ID NO: 166834 - protein, 10 aa, Artificial Sequence
  Description of Artificial Sequence: Synthetic peptide
  Seed: LPYWNFATGK (TYRP1_HUMAN)
LTYWNFATGK

SEQ ID NO: 166835 - protein, 11 aa, Artificial Sequence
  Description of Artificial Sequence: Synthetic peptide
  Seed: TVEGYSDPTGK (TYRP1_HUMAN)
TVEGYSDPTGY

SEQ ID NO: 166836 - protein, 9 aa, Artificial Sequence
  Description of Artificial Sequence: Synthetic peptide
  Seed: MLQEPSFSL (TYRP1_HUMAN)
MVQEPSFSF

SEQ ID NO: 166837 - protein, 9 aa, Artificial Sequence
  Description of Artificial Sequence: Synthetic peptide
  Seed: GPDGNTPQF (TYRP1_HUMAN)
GTDGNTPQF

SEQ ID NO: 166838 - protein, 9 aa, Artificial Sequence
  Description of Artificial Sequence: Synthetic peptide
  Seed: RRYNADIST (TYRP1_HUMAN)
RRYNADISY

SEQ ID NO: 166839 - protein, 9 aa, Artificial Sequence
  Description of Artificial Sequence: Synthetic peptide
  Seed: SPNSVFSQW (TYRP1_HUMAN)
SANSVFSQY

SEQ ID NO: 166840 - protein, 9 aa, Artificial Sequence
  Description of Artificial Sequence: Synthetic peptide
  Seed: RDDREVWPL (TYRP1_HUMAN)
REDREVWPL

SEQ ID NO: 166841 - protein, 9 aa, Artificial Sequence
  Description of Artificial Sequence: Synthetic peptide
  Seed: SFRNTVEGY (TYRP1_HUMAN)
SARNTVEGL

SEQ ID NO: 166842 - protein, 10 aa, Artificial Sequence
  Description of Artificial Sequence: Synthetic peptide
  Seed: KLLSLGCIFF (TYRP1_HUMAN)
KSLSLGCIFY

SEQ ID NO: 166843 - protein, 9 aa, Artificial Sequence
  Description of Artificial Sequence: Synthetic peptide
  Seed: KLQNPNQSV (TYRP1_HUMAN)
KSQNPNQSF

SEQ ID NO: 166844 - protein, 11 aa, Artificial Sequence
  Description of Artificial Sequence: Synthetic peptide
  Seed: LRRYNADISTF (TYRP1_HUMAN)
LQRYNADISTF

SEQ ID NO: 166845 - protein, 9 aa, Artificial Sequence
  Description of Artificial Sequence: Synthetic peptide
  Seed: LHTFTDAVF (TYRP1_HUMAN)
LHTFTDAVL

SEQ ID NO: 166846 - protein, 9 aa, Artificial Sequence
  Description of Artificial Sequence: Synthetic peptide
  Seed: FSVPEIIAI (TYRP1_HUMAN)
FSVPEIIAH

SEQ ID NO: 166847 - protein, 9 aa, Artificial Sequence
  Description of Artificial Sequence: Synthetic peptide
  Seed: KLLSLGCIF (TYRP1_HUMAN)
KALSLGCIM

SEQ ID NO: 166848 - protein, 9 aa, Artificial Sequence
  Description of Artificial Sequence: Synthetic peptide
  Seed: GCIFFPLLL (TYRP1_HUMAN)
GAIFFPLLL

SEQ ID NO: 166849 - protein, 9 aa, Artificial Sequence
  Description of Artificial Sequence: Synthetic peptide
  Seed: SLGCIFFPL (TYRP1_HUMAN)
SMGCIFFPK

SEQ ID NO: 166850 - protein, 9 aa, Artificial Sequence
  Description of Artificial Sequence: Synthetic peptide
  Seed: KYDPAVRSL (TYRP1_HUMAN)
KIDPAVRSV

SEQ ID NO: 166851 - protein, 9 aa, Artificial Sequence
  Description of Artificial Sequence: Synthetic peptide
  Seed: SRSNFDSTL (TYRP1_HUMAN)
SASNFDSTY

SEQ ID NO: 166852 - protein, 8 aa, Artificial Sequence
  Description of Artificial Sequence: Synthetic peptide
  Seed: YSNSTNSF (TYRP1_HUMAN)
YMNSTNSM

SEQ ID NO: 166853 - protein, 9 aa, Artificial Sequence
  Description of Artificial Sequence: Synthetic peptide
  Seed: VGLFDTPPF (TYRP1_HUMAN)
VALFDTPPW

SEQ ID NO: 166854 - protein, 9 aa, Artificial Sequence
  Description of Artificial Sequence: Synthetic peptide
  Seed: RQYNMVPFW (TYRP1_HUMAN)
RWYNMVPFY

SEQ ID NO: 166855 - protein, 9 aa, Artificial Sequence
  Description of Artificial Sequence: Synthetic peptide
  Seed: IVRRNLLDL (TYRP1_HUMAN)
ITRRNLLDK

SEQ ID NO: 166856 - protein, 10 aa, Artificial Sequence
  Description of Artificial Sequence: Synthetic peptide
  Seed: VLLHTFTDAV (TYRP1_HUMAN)
VPLHTFTDAV

SEQ ID NO: 166857 - protein, 10 aa, Artificial Sequence
  Description of Artificial Sequence: Synthetic peptide
  Seed: GKYDPAVRSL (TYRP1_HUMAN)
GRYDPAVRSY

SEQ ID NO: 166858 - protein, 9 aa, Artificial Sequence
  Description of Artificial Sequence: Synthetic peptide
  Seed: ACDQRVLIV (TYRP1_HUMAN)
AVDQRVLIF

SEQ ID NO: 166859 - protein, 11 aa, Artificial Sequence
  Description of Artificial Sequence: Synthetic peptide
  Seed: FLNGTGGQTHL (TYRP1_HUMAN)
FQNGTGGQTHY

SEQ ID NO: 166860 - protein, 8 aa, Artificial Sequence
  Description of Artificial Sequence: Synthetic peptide
  Seed: IQWPSREF (TYRP1_HUMAN)
IAWPSREL

SEQ ID NO: 166861 - protein, 9 aa, Artificial Sequence
  Description of Artificial Sequence: Synthetic peptide
  Seed: SPNSVFSQW (TYRP1_HUMAN)
SQNSVFSQF

SEQ ID NO: 166862 - protein, 9 aa, Artificial Sequence
  Description of Artificial Sequence: Synthetic peptide
  Seed: FSVPEIIAI (TYRP1_HUMAN)
FTVPEIIAA

SEQ ID NO: 166863 - protein, 10 aa, Artificial Sequence
  Description of Artificial Sequence: Synthetic peptide
  Seed: LQEPSFSLPY (TYRP1_HUMAN)
LTEPSFSLPY

SEQ ID NO: 166864 - protein, 10 aa, Artificial Sequence
  Description of Artificial Sequence: Synthetic peptide
  Seed: LLLVALIFGT (TYRP1_HUMAN)
LMLVALIFGL

SEQ ID NO: 166865 - protein, 10 aa, Artificial Sequence
  Description of Artificial Sequence: Synthetic peptide
  Seed: LENAPIGHNR (TYRP1_HUMAN)
LANAPIGHNM

SEQ ID NO: 166866 - protein, 10 aa, Artificial Sequence
  Description of Artificial Sequence: Synthetic peptide
  Seed: FPRQCATVEA (TYRP1_HUMAN)
FPRQCATVEM

SEQ ID NO: 166867 - protein, 9 aa, Artificial Sequence
  Description of Artificial Sequence: Synthetic peptide
  Seed: TADSRPHSP (TYRP1_HUMAN)
TVDSRPHSI

SEQ ID NO: 166868 - protein, 9 aa, Artificial Sequence
  Description of Artificial Sequence: Synthetic peptide
  Seed: FVWTHYYSV (TYRP1_HUMAN)
FRWTHYYSV

SEQ ID NO: 166869 - protein, 9 aa, Artificial Sequence
  Description of Artificial Sequence: Synthetic peptide
  Seed: KYDPAVRSL (TYRP1_HUMAN)
KSDPAVRSI

SEQ ID NO: 166870 - protein, 9 aa, Artificial Sequence
  Description of Artificial Sequence: Synthetic peptide
  Seed: TTHPLFVIA (TYRP1_HUMAN)
TIHPLFVIV

SEQ ID NO: 166871 - protein, 9 aa, Artificial Sequence
  Description of Artificial Sequence: Synthetic peptide
  Seed: NHFVRALDM (TYRP1_HUMAN)
NRFVRALDM

SEQ ID NO: 166872 - protein, 10 aa, Artificial Sequence
  Description of Artificial Sequence: Synthetic peptide
  Seed: MQEMLQEPSF (TYRP1_HUMAN)
MQEMLQEPSW

SEQ ID NO: 166873 - protein, 10 aa, Artificial Sequence
  Description of Artificial Sequence: Synthetic peptide
  Seed: LQEPSFSLPY (TYRP1_HUMAN)
LKEPSFSLPF

SEQ ID NO: 166874 - protein, 9 aa, Artificial Sequence
  Description of Artificial Sequence: Synthetic peptide
  Seed: DAVFDEWLR (TYRP1_HUMAN)
DYVFDEWLR

SEQ ID NO: 166875 - protein, 9 aa, Artificial Sequence
  Description of Artificial Sequence: Synthetic peptide
  Seed: RYHLLRLEK (TYRP1_HUMAN)
RMHLLRLEY

SEQ ID NO: 166876 - protein, 11 aa, Artificial Sequence
  Description of Artificial Sequence: Synthetic peptide
  Seed: RSMDEANQPLL (TYRP1_HUMAN)
RMMDEANQPLW

SEQ ID NO: 166877 - protein, 9 aa, Artificial Sequence
  Description of Artificial Sequence: Synthetic peptide
  Seed: DLMGSRSNF (TYRP1_HUMAN)
DTMGSRSNY

SEQ ID NO: 166878 - protein, 9 aa, Artificial Sequence
  Description of Artificial Sequence: Synthetic peptide
  Seed: IAVVGALLL (TYRP1_HUMAN)
IQVVGALLF

SEQ ID NO: 166879 - protein, 10 aa, Artificial Sequence
  Description of Artificial Sequence: Synthetic peptide
  Seed: KLLSLGCIFF (TYRP1_HUMAN)
KSLSLGCIFF

SEQ ID NO: 166880 - protein, 9 aa, Artificial Sequence
  Description of Artificial Sequence: Synthetic peptide
  Seed: KEEKNHFVR (TYRP1_HUMAN)
KEEKNHFVL

SEQ ID NO: 166881 - protein, 9 aa, Artificial Sequence
  Description of Artificial Sequence: Synthetic peptide
  Seed: CIFFPLLLF (TYRP1_HUMAN)
CVFFPLLLY

SEQ ID NO: 166882 - protein, 9 aa, Artificial Sequence
  Description of Artificial Sequence: Synthetic peptide
  Seed: KYDPAVRSL (TYRP1_HUMAN)
KYDPAVRSW

SEQ ID NO: 166883 - protein, 11 aa, Artificial Sequence
  Description of Artificial Sequence: Synthetic peptide
  Seed: MFVTAPDNLGY (TYRP1_HUMAN)
MPVTAPDNLGF

SEQ ID NO: 166884 - protein, 10 aa, Artificial Sequence
  Description of Artificial Sequence: Synthetic peptide
  Seed: STFPLENAPI (TYRP1_HUMAN)
SLFPLENAPM

SEQ ID NO: 166885 - protein, 10 aa, Artificial Sequence
  Description of Artificial Sequence: Synthetic peptide
  Seed: FFPLLLFQQA (TYRP1_HUMAN)
FNPLLLFQQA

SEQ ID NO: 166886 - protein, 10 aa, Artificial Sequence
  Description of Artificial Sequence: Synthetic peptide
  Seed: FVTAPDNLGY (TYRP1_HUMAN)
FTTAPDNLGR

SEQ ID NO: 166887 - protein, 9 aa, Artificial Sequence
  Description of Artificial Sequence: Synthetic peptide
  Seed: RAQFPRQCA (TYRP1_HUMAN)
RTQFPRQCV

SEQ ID NO: 166888 - protein, 9 aa, Artificial Sequence
  Description of Artificial Sequence: Synthetic peptide
  Seed: REFSVPEII (TYRP1_HUMAN)
RQFSVPEIY

SEQ ID NO: 166889 - protein, 11 aa, Artificial Sequence
  Description of Artificial Sequence: Synthetic peptide
  Seed: YNMVPFWPPVT (TYRP1_HUMAN)
YLMVPFWPPVC

SEQ ID NO: 166890 - protein, 9 aa, Artificial Sequence
  Description of Artificial Sequence: Synthetic peptide
  Seed: VPFWPPVTN (TYRP1_HUMAN)
VAFWPPVTA

SEQ ID NO: 166891 - protein, 9 aa, Artificial Sequence
  Description of Artificial Sequence: Synthetic peptide
  Seed: YTYEIQWPS (TYRP1_HUMAN)
YIYEIQWPM

SEQ ID NO: 166892 - protein, 11 aa, Artificial Sequence
  Description of Artificial Sequence: Synthetic peptide
  Seed: RLPEPQDVAQC (TYRP1_HUMAN)
RQPEPQDVAQM

SEQ ID NO: 166893 - protein, 9 aa, Artificial Sequence
  Description of Artificial Sequence: Synthetic peptide
  Seed: HEGPAFLTW (TYRP1_HUMAN)
HQGPAFLTF

SEQ ID NO: 166894 - protein, 8 aa, Artificial Sequence
  Description of Artificial Sequence: Synthetic peptide
  Seed: YSNSTNSF (TYRP1_HUMAN)
YQNSTNSF

SEQ ID NO: 166895 - protein, 10 aa, Artificial Sequence
  Description of Artificial Sequence: Synthetic peptide
  Seed: ATVEALRSGM (TYRP1_HUMAN)
ATVEALRSGW

SEQ ID NO: 166896 - protein, 10 aa, Artificial Sequence
  Description of Artificial Sequence: Synthetic peptide
  Seed: YNYFVWTHYY (TYRP1_HUMAN)
YLYFVWTHYR

SEQ ID NO: 166897 - protein, 9 aa, Artificial Sequence
  Description of Artificial Sequence: Synthetic peptide
  Seed: REVWPLRFF (TYRP1_HUMAN)
RMVWPLRFF

SEQ ID NO: 166898 - protein, 9 aa, Artificial Sequence
  Description of Artificial Sequence: Synthetic peptide
  Seed: DYDTLGTLC (TYRP1_HUMAN)
DYDTLGTLV

SEQ ID NO: 166899 - protein, 9 aa, Artificial Sequence
  Description of Artificial Sequence: Synthetic peptide
  Seed: SIYNYFVWT (TYRP1_HUMAN)
SVYNYFVWM

SEQ ID NO: 166900 - protein, 9 aa, Artificial Sequence
  Description of Artificial Sequence: Synthetic peptide
  Seed: YLIRARRSM (TYRP1_HUMAN)
YHIRARRSM

SEQ ID NO: 166901 - protein, 10 aa, Artificial Sequence
  Description of Artificial Sequence: Synthetic peptide
  Seed: FYSNSTNSFR (TYRP1_HUMAN)
FLSNSTNSFR

SEQ ID NO: 166902 - protein, 11 aa, Artificial Sequence
  Description of Artificial Sequence: Synthetic peptide
  Seed: IYNYFVWTHYY (TYRP1_HUMAN)
IYNYFVWTHYW

SEQ ID NO: 166903 - protein, 11 aa, Artificial Sequence
  Description of Artificial Sequence: Synthetic peptide
  Seed: REFSVPEIIAI (TYRP1_HUMAN)
RHFSVPEIIAF

SEQ ID NO: 166904 - protein, 9 aa, Artificial Sequence
  Description of Artificial Sequence: Synthetic peptide
  Seed: FVWTHYYSV (TYRP1_HUMAN)
FTWTHYYSK

SEQ ID NO: 166905 - protein, 9 aa, Artificial Sequence
  Description of Artificial Sequence: Synthetic peptide
  Seed: FLGVGQESF (TYRP1_HUMAN)
FVGVGQESF

SEQ ID NO: 166906 - protein, 11 aa, Artificial Sequence
  Description of Artificial Sequence: Synthetic peptide
  Seed: YNMVPFWPPVT (TYRP1_HUMAN)
YVMVPFWPPVL

SEQ ID NO: 166907 - protein, 9 aa, Artificial Sequence
  Description of Artificial Sequence: Synthetic peptide
  Seed: IAIAVVGAL (TYRP1_HUMAN)
IIIAVVGAL

SEQ ID NO: 166908 - protein, 9 aa, Artificial Sequence
  Description of Artificial Sequence: Synthetic peptide
  Seed: SPQYPHDGR (TYRP1_HUMAN)
SSQYPHDGR

SEQ ID NO: 166909 - protein, 9 aa, Artificial Sequence
  Description of Artificial Sequence: Synthetic peptide
  Seed: RQYNMVPFW (TYRP1_HUMAN)
RAYNMVPFY

SEQ ID NO: 166910 - protein, 10 aa, Artificial Sequence
  Description of Artificial Sequence: Synthetic peptide
  Seed: MQEMLQEPSF (TYRP1_HUMAN)
MMEMLQEPSY

SEQ ID NO: 166911 - protein, 10 aa, Artificial Sequence
  Description of Artificial Sequence: Synthetic peptide
  Seed: EIIAIAVVGA (TYRP1_HUMAN)
EKIAIAVVGI

SEQ ID NO: 166912 - protein, 10 aa, Artificial Sequence
  Description of Artificial Sequence: Synthetic peptide
  Seed: FSLPYWNFAT (TYRP1_HUMAN)
FKLPYWNFAA

SEQ ID NO: 166913 - protein, 9 aa, Artificial Sequence
  Description of Artificial Sequence: Synthetic peptide
  Seed: SPNSVFSQW (TYRP1_HUMAN)
SVNSVFSQF

SEQ ID NO: 166914 - protein, 9 aa, Artificial Sequence
  Description of Artificial Sequence: Synthetic peptide
  Seed: TWHRYHLLR (TYRP1_HUMAN)
TYHRYHLLK

SEQ ID NO: 166915 - protein, 8 aa, Artificial Sequence
  Description of Artificial Sequence: Synthetic peptide
  Seed: REFSVPEI (TYRP1_HUMAN)
RAFSVPEV

SEQ ID NO: 166916 - protein, 9 aa, Artificial Sequence
  Description of Artificial Sequence: Synthetic peptide
  Seed: KYDPAVRSL (TYRP1_HUMAN)
KVDPAVRSC

SEQ ID NO: 166917 - protein, 10 aa, Artificial Sequence
  Description of Artificial Sequence: Synthetic peptide
  Seed: EIIAIAVVGA (TYRP1_HUMAN)
EMIAIAVVGI

SEQ ID NO: 166918 - protein, 10 aa, Artificial Sequence
  Description of Artificial Sequence: Synthetic peptide
  Seed: SQWRVVCDSL (TYRP1_HUMAN)
SRWRVVCDSI

SEQ ID NO: 166919 - protein, 9 aa, Artificial Sequence
  Description of Artificial Sequence: Synthetic peptide
  Seed: DSRPHSPQY (TYRP1_HUMAN)
DLRPHSPQR

SEQ ID NO: 166920 - protein, 9 aa, Artificial Sequence
  Description of Artificial Sequence: Synthetic peptide
  Seed: VARPMVQRL (TYRP1_HUMAN)
VVRPMVQRY

SEQ ID NO: 166921 - protein, 10 aa, Artificial Sequence
  Description of Artificial Sequence: Synthetic peptide
  Seed: LIFGTASYLI (TYRP1_HUMAN)
LQFGTASYLV

SEQ ID NO: 166922 - protein, 9 aa, Artificial Sequence
  Description of Artificial Sequence: Synthetic peptide
  Seed: ISIYNYFVW (TYRP1_HUMAN)
ICIYNYFVW

SEQ ID NO: 166923 - protein, 10 aa, Artificial Sequence
  Description of Artificial Sequence: Synthetic peptide
  Seed: THYYSVKKTF (TYRP1_HUMAN)
TFYYSVKKTM

SEQ ID NO: 166924 - protein, 10 aa, Artificial Sequence
  Description of Artificial Sequence: Synthetic peptide
  Seed: RRYNADISTF (TYRP1_HUMAN)
RCYNADISTL

SEQ ID NO: 166925 - protein, 9 aa, Artificial Sequence
  Description of Artificial Sequence: Synthetic peptide
  Seed: NADISTFPL (TYRP1_HUMAN)
NQDISTFPL

SEQ ID NO: 166926 - protein, 9 aa, Artificial Sequence
  Description of Artificial Sequence: Synthetic peptide
  Seed: AFLTWHRYH (TYRP1_HUMAN)
ANLTWHRYR

SEQ ID NO: 166927 - protein, 9 aa, Artificial Sequence
  Description of Artificial Sequence: Synthetic peptide
  Seed: SLHNLAHLF (TYRP1_HUMAN)
SYHNLAHLI

SEQ ID NO: 166928 - protein, 9 aa, Artificial Sequence
  Description of Artificial Sequence: Synthetic peptide
  Seed: MSAPKLLSL (TYRP1_HUMAN)
MHAPKLLSI

SEQ ID NO: 166929 - protein, 10 aa, Artificial Sequence
  Description of Artificial Sequence: Synthetic peptide
  Seed: NMVPFWPPVT (TYRP1_HUMAN)
NLVPFWPPVV

SEQ ID NO: 166930 - protein, 9 aa, Artificial Sequence
  Description of Artificial Sequence: Synthetic peptide
  Seed: MAKRTTHPL (TYRP1_HUMAN)
MFKRTTHPY

SEQ ID NO: 166931 - protein, 11 aa, Artificial Sequence
  Description of Artificial Sequence: Synthetic peptide
  Seed: IYNYFVWTHYY (TYRP1_HUMAN)
IENYFVWTHYL

SEQ ID NO: 166932 - protein, 9 aa, Artificial Sequence
  Description of Artificial Sequence: Synthetic peptide
  Seed: RSNFDSTLI (TYRP1_HUMAN)
RVNFDSTLW

SEQ ID NO: 166933 - protein, 9 aa, Artificial Sequence
  Description of Artificial Sequence: Synthetic peptide
  Seed: RFFNRTCHC (TYRP1_HUMAN)
RYFNRTCHM

SEQ ID NO: 166934 - protein, 9 aa, Artificial Sequence
  Description of Artificial Sequence: Synthetic peptide
  Seed: LQNPNQSVV (TYRP1_HUMAN)
LFNPNQSVY

SEQ ID NO: 166935 - protein, 11 aa, Artificial Sequence
  Description of Artificial Sequence: Synthetic peptide
  Seed: RSMDEANQPLL (TYRP1_HUMAN)
RFMDEANQPLY

SEQ ID NO: 166936 - protein, 11 aa, Artificial Sequence
  Description of Artificial Sequence: Synthetic peptide
  Seed: LRRYNADISTF (TYRP1_HUMAN)
LKRYNADISTF

SEQ ID NO: 166937 - protein, 10 aa, Artificial Sequence
  Description of Artificial Sequence: Synthetic peptide
  Seed: MVPFWPPVTN (TYRP1_HUMAN)
MKPFWPPVTF

SEQ ID NO: 166938 - protein, 9 aa, Artificial Sequence
  Description of Artificial Sequence: Synthetic peptide
  Seed: RSLHNLAHL (TYRP1_HUMAN)
RVLHNLAHM

SEQ ID NO: 166939 - protein, 9 aa, Artificial Sequence
  Description of Artificial Sequence: Synthetic peptide
  Seed: MLQEPSFSL (TYRP1_HUMAN)
MQQEPSFSF

SEQ ID NO: 166940 - protein, 9 aa, Artificial Sequence
  Description of Artificial Sequence: Synthetic peptide
  Seed: KYDPAVRSL (TYRP1_HUMAN)
KADPAVRSF

SEQ ID NO: 166941 - protein, 11 aa, Artificial Sequence
  Description of Artificial Sequence: Synthetic peptide
  Seed: VTAPDNLGYTY (TYRP1_HUMAN)
VQAPDNLGYTF

SEQ ID NO: 166942 - protein, 8 aa, Artificial Sequence
  Description of Artificial Sequence: Synthetic peptide
  Seed: RQYNMVPF (TYRP1_HUMAN)
RKYNMVPF

SEQ ID NO: 166943 - protein, 9 aa, Artificial Sequence
  Description of Artificial Sequence: Synthetic peptide
  Seed: VARPMVQRL (TYRP1_HUMAN)
VIRPMVQRY

SEQ ID NO: 166944 - protein, 8 aa, Artificial Sequence
  Description of Artificial Sequence: Synthetic peptide
  Seed: FSHEGPAF (TYRP1_HUMAN)
FQHEGPAF

SEQ ID NO: 166945 - protein, 9 aa, Artificial Sequence
  Description of Artificial Sequence: Synthetic peptide
  Seed: FSHEGPAFL (TYRP1_HUMAN)
FMHEGPAFG

SEQ ID NO: 166946 - protein, 11 aa, Artificial Sequence
  Description of Artificial Sequence: Synthetic peptide
  Seed: FSHEGPAFLTW (TYRP1_HUMAN)
FAHEGPAFLTF

SEQ ID NO: 166947 - protein, 9 aa, Artificial Sequence
  Description of Artificial Sequence: Synthetic peptide
  Seed: AFLTWHRYH (TYRP1_HUMAN)
ALLTWHRYR

SEQ ID NO: 166948 - protein, 10 aa, Artificial Sequence
  Description of Artificial Sequence: Synthetic peptide
  Seed: NYFVWTHYYS (TYRP1_HUMAN)
NMFVWTHYYM

SEQ ID NO: 166949 - protein, 10 aa, Artificial Sequence
  Description of Artificial Sequence: Synthetic peptide
  Seed: ENISIYNYFV (TYRP1_HUMAN)
EWISIYNYFV

SEQ ID NO: 166950 - protein, 9 aa, Artificial Sequence
  Description of Artificial Sequence: Synthetic peptide
  Seed: WPSREFSVP (TYRP1_HUMAN)
WPSREFSVA

SEQ ID NO: 166951 - protein, 9 aa, Artificial Sequence
  Description of Artificial Sequence: Synthetic peptide
  Seed: VFDEWLRRY (TYRP1_HUMAN)
VYDEWLRRV

SEQ ID NO: 166952 - protein, 9 aa, Artificial Sequence
  Description of Artificial Sequence: Synthetic peptide
  Seed: FSHEGPAFL (TYRP1_HUMAN)
FMHEGPAFM

SEQ ID NO: 166953 - protein, 9 aa, Artificial Sequence
  Description of Artificial Sequence: Synthetic peptide
  Seed: SLHNLAHLF (TYRP1_HUMAN)
SAHNLAHLL

SEQ ID NO: 166954 - protein, 11 aa, Artificial Sequence
  Description of Artificial Sequence: Synthetic peptide
  Seed: LEVGLFDTPPF (TYRP1_HUMAN)
LQVGLFDTPPM

SEQ ID NO: 166955 - protein, 9 aa, Artificial Sequence
  Description of Artificial Sequence: Synthetic peptide
  Seed: RSLHNLAHL (TYRP1_HUMAN)
RILHNLAHK

SEQ ID NO: 166956 - protein, 9 aa, Artificial Sequence
  Description of Artificial Sequence: Synthetic peptide
  Seed: ISIYNYFVW (TYRP1_HUMAN)
IFIYNYFVW

SEQ ID NO: 166957 - protein, 10 aa, Artificial Sequence
  Description of Artificial Sequence: Synthetic peptide
  Seed: WPPVTNTEMF (TYRP1_HUMAN)
WFPVTNTEMY

SEQ ID NO: 166958 - protein, 8 aa, Artificial Sequence
  Description of Artificial Sequence: Synthetic peptide
  Seed: FSHEGPAF (TYRP1_HUMAN)
FVHEGPAL

SEQ ID NO: 166959 - protein, 8 aa, Artificial Sequence
  Description of Artificial Sequence: Synthetic peptide
  Seed: FPRQCATV (TYRP1_HUMAN)
FPRQCATL

SEQ ID NO: 166960 - protein, 9 aa, Artificial Sequence
  Description of Artificial Sequence: Synthetic peptide
  Seed: MAKRTTHPL (TYRP1_HUMAN)
MHKRTTHPY

SEQ ID NO: 166961 - protein, 9 aa, Artificial Sequence
  Description of Artificial Sequence: Synthetic peptide
  Seed: MAKRTTHPL (TYRP1_HUMAN)
MPKRTTHPA

SEQ ID NO: 166962 - protein, 10 aa, Artificial Sequence
  Description of Artificial Sequence: Synthetic peptide
  Seed: MAKRTTHPLF (TYRP1_HUMAN)
MAKRTTHPLW

SEQ ID NO: 166963 - protein, 9 aa, Artificial Sequence
  Description of Artificial Sequence: Synthetic peptide
  Seed: YSNSTNSFR (TYRP1_HUMAN)
YSNSTNSFK

SEQ ID NO: 166964 - protein, 9 aa, Artificial Sequence
  Description of Artificial Sequence: Synthetic peptide
  Seed: LGYTYEIQW (TYRP1_HUMAN)
LTYTYEIQL

SEQ ID NO: 166965 - protein, 10 aa, Artificial Sequence
  Description of Artificial Sequence: Synthetic peptide
  Seed: RYNADISTFP (TYRP1_HUMAN)
RYNADISTFW

SEQ ID NO: 166966 - protein, 11 aa, Artificial Sequence
  Description of Artificial Sequence: Synthetic peptide
  Seed: YNMVPFWPPVT (TYRP1_HUMAN)
YLMVPFWPPVW

SEQ ID NO: 166967 - protein, 8 aa, Artificial Sequence
  Description of Artificial Sequence: Synthetic peptide
  Seed: DEANQPLL (TYRP1_HUMAN)
DEANQPLY

SEQ ID NO: 166968 - protein, 10 aa, Artificial Sequence
  Description of Artificial Sequence: Synthetic peptide
  Seed: RSLHNLAHLF (TYRP1_HUMAN)
RELHNLAHLY

SEQ ID NO: 166969 - protein, 10 aa, Artificial Sequence
  Description of Artificial Sequence: Synthetic peptide
  Seed: STFPLENAPI (TYRP1_HUMAN)
SAFPLENAPV

SEQ ID NO: 166970 - protein, 9 aa, Artificial Sequence
  Description of Artificial Sequence: Synthetic peptide
  Seed: SRSNFDSTL (TYRP1_HUMAN)
SKSNFDSTY

SEQ ID NO: 166971 - protein, 9 aa, Artificial Sequence
  Description of Artificial Sequence: Synthetic peptide
  Seed: MAKRTTHPL (TYRP1_HUMAN)
MRKRTTHPM

SEQ ID NO: 166972 - protein, 9 aa, Artificial Sequence
  Description of Artificial Sequence: Synthetic peptide
  Seed: RRYNADIST (TYRP1_HUMAN)
RRYNADISL

SEQ ID NO: 166973 - protein, 10 aa, Artificial Sequence
  Description of Artificial Sequence: Synthetic peptide
  Seed: YNMVPFWPPV (TYRP1_HUMAN)
YGMVPFWPPI

SEQ ID NO: 166974 - protein, 9 aa, Artificial Sequence
  Description of Artificial Sequence: Synthetic peptide
  Seed: ALIFGTASY (TYRP1_HUMAN)
ALIFGTASW

SEQ ID NO: 166975 - protein, 9 aa, Artificial Sequence
  Description of Artificial Sequence: Synthetic peptide
  Seed: KYDPAVRSL (TYRP1_HUMAN)
KRDPAVRSM

SEQ ID NO: 166976 - protein, 9 aa, Artificial Sequence
  Description of Artificial Sequence: Synthetic peptide
  Seed: IYNYFVWTH (TYRP1_HUMAN)
IWNYFVWTR

SEQ ID NO: 166977 - protein, 11 aa, Artificial Sequence
  Description of Artificial Sequence: Synthetic peptide
  Seed: YNMVPFWPPVT (TYRP1_HUMAN)
YQMVPFWPPVV

SEQ ID NO: 166978 - protein, 9 aa, Artificial Sequence
  Description of Artificial Sequence: Synthetic peptide
  Seed: NYFVWTHYY (TYRP1_HUMAN)
NAFVWTHYR

SEQ ID NO: 166979 - protein, 10 aa, Artificial Sequence
  Description of Artificial Sequence: Synthetic peptide
  Seed: FVWTHYYSVK (TYRP1_HUMAN)
FQWTHYYSVR

SEQ ID NO: 166980 - protein, 9 aa, Artificial Sequence
  Description of Artificial Sequence: Synthetic peptide
  Seed: NFDSTLISP (TYRP1_HUMAN)
NWDSTLISL

SEQ ID NO: 166981 - protein, 9 aa, Artificial Sequence
  Description of Artificial Sequence: Synthetic peptide
  Seed: LSKEEKNHF (TYRP1_HUMAN)
LAKEEKNHW

SEQ ID NO: 166982 - protein, 10 aa, Artificial Sequence
  Description of Artificial Sequence: Synthetic peptide
  Seed: NYFVWTHYYS (TYRP1_HUMAN)
NYFVWTHYYM

SEQ ID NO: 166983 - protein, 9 aa, Artificial Sequence
  Description of Artificial Sequence: Synthetic peptide
  Seed: FTDAVFDEW (TYRP1_HUMAN)
FPDAVFDEI

SEQ ID NO: 166984 - protein, 10 aa, Artificial Sequence
  Description of Artificial Sequence: Synthetic peptide
  Seed: HYYSVKKTFL (TYRP1_HUMAN)
HRYSVKKTFY

SEQ ID NO: 166985 - protein, 9 aa, Artificial Sequence
  Description of Artificial Sequence: Synthetic peptide
  Seed: LVALIFGTA (TYRP1_HUMAN)
LMALIFGTV

SEQ ID NO: 166986 - protein, 9 aa, Artificial Sequence
  Description of Artificial Sequence: Synthetic peptide
  Seed: RYHLLRLEK (TYRP1_HUMAN)
RTHLLRLEG

SEQ ID NO: 166987 - protein, 10 aa, Artificial Sequence
  Description of Artificial Sequence: Synthetic peptide
  Seed: QFENISIYNY (TYRP1_HUMAN)
QTENISIYNY

SEQ ID NO: 166988 - protein, 10 aa, Artificial Sequence
  Description of Artificial Sequence: Synthetic peptide
  Seed: REFSVPEIIA (TYRP1_HUMAN)
REFSVPEIIS

SEQ ID NO: 166989 - protein, 9 aa, Artificial Sequence
  Description of Artificial Sequence: Synthetic peptide
  Seed: RTTHPLFVI (TYRP1_HUMAN)
RFTHPLFVY

SEQ ID NO: 166990 - protein, 10 aa, Artificial Sequence
  Description of Artificial Sequence: Synthetic peptide
  Seed: RTCHCNGNFS (TYRP1_HUMAN)
RSCHCNGNFK

SEQ ID NO: 166991 - protein, 10 aa, Artificial Sequence
  Description of Artificial Sequence: Synthetic peptide
  Seed: FLTWHRYHLL (TYRP1_HUMAN)
FLTWHRYHLA

SEQ ID NO: 166992 - protein, 9 aa, Artificial Sequence
  Description of Artificial Sequence: Synthetic peptide
  Seed: RQYNMVPFW (TYRP1_HUMAN)
RWYNMVPFW

SEQ ID NO: 166993 - protein, 9 aa, Artificial Sequence
  Description of Artificial Sequence: Synthetic peptide
  Seed: FSVPEIIAI (TYRP1_HUMAN)
FMVPEIIAL

SEQ ID NO: 166994 - protein, 10 aa, Artificial Sequence
  Description of Artificial Sequence: Synthetic peptide
  Seed: MSAPKLLSLG (TYRP1_HUMAN)
MDAPKLLSLW

SEQ ID NO: 166995 - protein, 8 aa, Artificial Sequence
  Description of Artificial Sequence: Synthetic peptide
  Seed: ADISTFPL (TYRP1_HUMAN)
AEISTFPA

SEQ ID NO: 166996 - protein, 9 aa, Artificial Sequence
  Description of Artificial Sequence: Synthetic peptide
  Seed: MAKRTTHPL (TYRP1_HUMAN)
MSKRTTHPR

SEQ ID NO: 166997 - protein, 9 aa, Artificial Sequence
  Description of Artificial Sequence: Synthetic peptide
  Seed: YTYEIQWPS (TYRP1_HUMAN)
YIYEIQWPY

SEQ ID NO: 166998 - protein, 9 aa, Artificial Sequence
  Description of Artificial Sequence: Synthetic peptide
  Seed: DNLGYTYEI (TYRP1_HUMAN)
DTLGYTYEI

SEQ ID NO: 166999 - protein, 11 aa, Artificial Sequence
  Description of Artificial Sequence: Synthetic peptide
  Seed: HLSPNDPIFVL (TYRP1_HUMAN)
HRSPNDPIFVF

SEQ ID NO: 167000 - protein, 9 aa, Artificial Sequence
  Description of Artificial Sequence: Synthetic peptide
  Seed: RSLHNLAHL (TYRP1_HUMAN)
RELHNLAHY

SEQ ID NO: 167001 - protein, 9 aa, Artificial Sequence
  Description of Artificial Sequence: Synthetic peptide
  Seed: RQCATVEAL (TYRP1_HUMAN)
RGCATVEAY

SEQ ID NO: 167002 - protein, 10 aa, Artificial Sequence
  Description of Artificial Sequence: Synthetic peptide
  Seed: RRYNADISTF (TYRP1_HUMAN)
RRYNADISTR

SEQ ID NO: 167003 - protein, 8 aa, Artificial Sequence
  Description of Artificial Sequence: Synthetic peptide
  Seed: TEDGPIRR (TYRP1_HUMAN)
TSDGPIRY

SEQ ID NO: 167004 - protein, 10 aa, Artificial Sequence
  Description of Artificial Sequence: Synthetic peptide
  Seed: EMLQEPSFSL (TYRP1_HUMAN)
EKLQEPSFSL

SEQ ID NO: 167005 - protein, 9 aa, Artificial Sequence
  Description of Artificial Sequence: Synthetic peptide
  Seed: RGRCEAVTA (TYRP1_HUMAN)
RVRCEAVTV

SEQ ID NO: 167006 - protein, 10 aa, Artificial Sequence
  Description of Artificial Sequence: Synthetic peptide
  Seed: HLSPNDPIFV (TYRP1_HUMAN)
HVSPNDPIFV

SEQ ID NO: 167007 - protein, 9 aa, Artificial Sequence
  Description of Artificial Sequence: Synthetic peptide
  Seed: DAVFDEWLR (TYRP1_HUMAN)
DTVFDEWLK

SEQ ID NO: 167008 - protein, 9 aa, Artificial Sequence
  Description of Artificial Sequence: Synthetic peptide
  Seed: MAKRTTHPL (TYRP1_HUMAN)
MQKRTTHPW

SEQ ID NO: 167009 - protein, 9 aa, Artificial Sequence
  Description of Artificial Sequence: Synthetic peptide
  Seed: NADISTFPL (TYRP1_HUMAN)
NPDISTFPV

SEQ ID NO: 167010 - protein, 10 aa, Artificial Sequence
  Description of Artificial Sequence: Synthetic peptide
  Seed: YFVWTHYYSV (TYRP1_HUMAN)
YFVWTHYYSL

SEQ ID NO: 167011 - protein, 9 aa, Artificial Sequence
  Description of Artificial Sequence: Synthetic peptide
  Seed: RSLHNLAHL (TYRP1_HUMAN)
RVLHNLAHW

SEQ ID NO: 167012 - protein, 9 aa, Artificial Sequence
  Description of Artificial Sequence: Synthetic peptide
  Seed: HEGPAFLTW (TYRP1_HUMAN)
HIGPAFLTL

SEQ ID NO: 167013 - protein, 10 aa, Artificial Sequence
  Description of Artificial Sequence: Synthetic peptide
  Seed: LGPDGNTPQF (TYRP1_HUMAN)
LLPDGNTPQF

SEQ ID NO: 167014 - protein, 10 aa, Artificial Sequence
  Description of Artificial Sequence: Synthetic peptide
  Seed: FVTAPDNLGY (TYRP1_HUMAN)
FRTAPDNLGF

SEQ ID NO: 167015 - protein, 9 aa, Artificial Sequence
  Description of Artificial Sequence: Synthetic peptide
  Seed: AVVGALLLV (TYRP1_HUMAN)
ASVGALLLR

SEQ ID NO: 167016 - protein, 10 aa, Artificial Sequence
  Description of Artificial Sequence: Synthetic peptide
  Seed: FLNGTGGQTH (TYRP1_HUMAN)
FVNGTGGQTF

SEQ ID NO: 167017 - protein, 9 aa, Artificial Sequence
  Description of Artificial Sequence: Synthetic peptide
  Seed: NMVPFWPPV (TYRP1_HUMAN)
NMVPFWPPK

SEQ ID NO: 167018 - protein, 11 aa, Artificial Sequence
  Description of Artificial Sequence: Synthetic peptide
  Seed: FWPPVTNTEMF (TYRP1_HUMAN)
FYPPVTNTEMY

SEQ ID NO: 167019 - protein, 10 aa, Artificial Sequence
  Description of Artificial Sequence: Synthetic peptide
  Seed: YNADISTFPL (TYRP1_HUMAN)
YVADISTFPA

SEQ ID NO: 167020 - protein, 9 aa, Artificial Sequence
  Description of Artificial Sequence: Synthetic peptide
  Seed: AVVGALLLV (TYRP1_HUMAN)
AMVGALLLR

SEQ ID NO: 167021 - protein, 9 aa, Artificial Sequence
  Description of Artificial Sequence: Synthetic peptide
  Seed: NMVPFWPPV (TYRP1_HUMAN)
NMVPFWPPR

SEQ ID NO: 167022 - protein, 9 aa, Artificial Sequence
  Description of Artificial Sequence: Synthetic peptide
  Seed: LIFGTASYL (TYRP1_HUMAN)
LFFGTASYL

SEQ ID NO: 167023 - protein, 9 aa, Artificial Sequence
  Description of Artificial Sequence: Synthetic peptide
  Seed: MCCPDLSPV (TYRP1_HUMAN)
MICPDLSPM

SEQ ID NO: 167024 - protein, 9 aa, Artificial Sequence
  Description of Artificial Sequence: Synthetic peptide
  Seed: LTWHRYHLL (TYRP1_HUMAN)
LPWHRYHLM

SEQ ID NO: 167025 - protein, 10 aa, Artificial Sequence
  Description of Artificial Sequence: Synthetic peptide
  Seed: RSMDEANQPL (TYRP1_HUMAN)
RCMDEANQPY

SEQ ID NO: 167026 - protein, 9 aa, Artificial Sequence
  Description of Artificial Sequence: Synthetic peptide
  Seed: SVKKTFLGV (TYRP1_HUMAN)
SNKKTFLGK

SEQ ID NO: 167027 - protein, 9 aa, Artificial Sequence
  Description of Artificial Sequence: Synthetic peptide
  Seed: FTDAVFDEW (TYRP1_HUMAN)
FNDAVFDEV

SEQ ID NO: 167028 - protein, 10 aa, Artificial Sequence
  Description of Artificial Sequence: Synthetic peptide
  Seed: LQEPSFSLPY (TYRP1_HUMAN)
LVEPSFSLPY

SEQ ID NO: 167029 - protein, 10 aa, Artificial Sequence
  Description of Artificial Sequence: Synthetic peptide
  Seed: RVLIVRRNLL (TYRP1_HUMAN)
RALIVRRNLK

SEQ ID NO: 167030 - protein, 9 aa, Artificial Sequence
  Description of Artificial Sequence: Synthetic peptide
  Seed: RSLHNLAHL (TYRP1_HUMAN)
RILHNLAHR

SEQ ID NO: 167031 - protein, 11 aa, Artificial Sequence
  Description of Artificial Sequence: Synthetic peptide
  Seed: VTAPDNLGYTY (TYRP1_HUMAN)
VTAPDNLGYTK

SEQ ID NO: 167032 - protein, 10 aa, Artificial Sequence
  Description of Artificial Sequence: Synthetic peptide
  Seed: EMLQEPSFSL (TYRP1_HUMAN)
EYLQEPSFSI

SEQ ID NO: 167033 - protein, 10 aa, Artificial Sequence
  Description of Artificial Sequence: Synthetic peptide
  Seed: FVLLHTFTDA (TYRP1_HUMAN)
FWLLHTFTDL

SEQ ID NO: 167034 - protein, 10 aa, Artificial Sequence
  Description of Artificial Sequence: Synthetic peptide
  Seed: TDAVFDEWLR (TYRP1_HUMAN)
TMAVFDEWLK

SEQ ID NO: 167035 - protein, 9 aa, Artificial Sequence
  Description of Artificial Sequence: Synthetic peptide
  Seed: APDNLGYTY (TYRP1_HUMAN)
AMDNLGYTF

SEQ ID NO: 167036 - protein, 11 aa, Artificial Sequence
  Description of Artificial Sequence: Synthetic peptide
  Seed: HTFTDAVFDEW (TYRP1_HUMAN)
HVFTDAVFDEW

SEQ ID NO: 167037 - protein, 11 aa, Artificial Sequence
  Description of Artificial Sequence: Synthetic peptide
  Seed: FVLLHTFTDAV (TYRP1_HUMAN)
FMLLHTFTDAA

SEQ ID NO: 167038 - protein, 10 aa, Artificial Sequence
  Description of Artificial Sequence: Synthetic peptide
  Seed: KRTTHPLFVI (TYRP1_HUMAN)
KNTTHPLFVF

SEQ ID NO: 167039 - protein, 10 aa, Artificial Sequence
  Description of Artificial Sequence: Synthetic peptide
  Seed: TPQFENISIY (TYRP1_HUMAN)
TMQFENISIM

SEQ ID NO: 167040 - protein, 10 aa, Artificial Sequence
  Description of Artificial Sequence: Synthetic peptide
  Seed: QFENISIYNY (TYRP1_HUMAN)
QAENISIYNW

SEQ ID NO: 167041 - protein, 9 aa, Artificial Sequence
  Description of Artificial Sequence: Synthetic peptide
  Seed: SVPEIIAIA (TYRP1_HUMAN)
SLPEIIAIL

SEQ ID NO: 167042 - protein, 10 aa, Artificial Sequence
  Description of Artificial Sequence: Synthetic peptide
  Seed: HRYHLLRLEK (TYRP1_HUMAN)
HWYHLLRLER

SEQ ID NO: 167043 - protein, 10 aa, Artificial Sequence
  Description of Artificial Sequence: Synthetic peptide
  Seed: FVTAPDNLGY (TYRP1_HUMAN)
FSTAPDNLGW

SEQ ID NO: 167044 - protein, 9 aa, Artificial Sequence
  Description of Artificial Sequence: Synthetic peptide
  Seed: DDREVWPLR (TYRP1_HUMAN)
DNREVWPLR

SEQ ID NO: 167045 - protein, 9 aa, Artificial Sequence
  Description of Artificial Sequence: Synthetic peptide
  Seed: LLHTFTDAV (TYRP1_HUMAN)
LMHTFTDAM

SEQ ID NO: 167046 - protein, 9 aa, Artificial Sequence
  Description of Artificial Sequence: Synthetic peptide
  Seed: FSVPEIIAI (TYRP1_HUMAN)
FWVPEIIAF

SEQ ID NO: 167047 - protein, 9 aa, Artificial Sequence
  Description of Artificial Sequence: Synthetic peptide
  Seed: NGTGGQTHL (TYRP1_HUMAN)
NATGGQTHY

SEQ ID NO: 167048 - protein, 9 aa, Artificial Sequence
  Description of Artificial Sequence: Synthetic peptide
  Seed: SGHNCGTCR (TYRP1_HUMAN)
SAHNCGTCY

SEQ ID NO: 167049 - protein, 9 aa, Artificial Sequence
  Description of Artificial Sequence: Synthetic peptide
  Seed: ACDQRVLIV (TYRP1_HUMAN)
AGDQRVLIM

SEQ ID NO: 167050 - protein, 10 aa, Artificial Sequence
  Description of Artificial Sequence: Synthetic peptide
  Seed: NSFRNTVEGY (TYRP1_HUMAN)
NVFRNTVEGR

SEQ ID NO: 167051 - protein, 9 aa, Artificial Sequence
  Description of Artificial Sequence: Synthetic peptide
  Seed: MAKRTTHPL (TYRP1_HUMAN)
MPKRTTHPF

SEQ ID NO: 167052 - protein, 9 aa, Artificial Sequence
  Description of Artificial Sequence: Synthetic peptide
  Seed: SVKKTFLGV (TYRP1_HUMAN)
SVKKTFLGR

SEQ ID NO: 167053 - protein, 10 aa, Artificial Sequence
  Description of Artificial Sequence: Synthetic peptide
  Seed: RSLHNLAHLF (TYRP1_HUMAN)
RTLHNLAHLL

SEQ ID NO: 167054 - protein, 9 aa, Artificial Sequence
  Description of Artificial Sequence: Synthetic peptide
  Seed: RPGWRGAAC (TYRP1_HUMAN)
RPGWRGAAT

SEQ ID NO: 167055 - protein, 9 aa, Artificial Sequence
  Description of Artificial Sequence: Synthetic peptide
  Seed: LTWHRYHLL (TYRP1_HUMAN)
LMWHRYHLK

SEQ ID NO: 167056 - protein, 9 aa, Artificial Sequence
  Description of Artificial Sequence: Synthetic peptide
  Seed: VGQESFGEV (TYRP1_HUMAN)
VFQESFGEL

SEQ ID NO: 167057 - protein, 10 aa, Artificial Sequence
  Description of Artificial Sequence: Synthetic peptide
  Seed: FWPPVTNTEM (TYRP1_HUMAN)
FIPPVTNTEI

SEQ ID NO: 167058 - protein, 10 aa, Artificial Sequence
  Description of Artificial Sequence: Synthetic peptide
  Seed: SREFSVPEII (TYRP1_HUMAN)
SCEFSVPEIL

SEQ ID NO: 167059 - protein, 9 aa, Artificial Sequence
  Description of Artificial Sequence: Synthetic peptide
  Seed: SFSLPYWNF (TYRP1_HUMAN)
SASLPYWNY

SEQ ID NO: 167060 - protein, 10 aa, Artificial Sequence
  Description of Artificial Sequence: Synthetic peptide
  Seed: FWPPVTNTEM (TYRP1_HUMAN)
FLPPVTNTEY

SEQ ID NO: 167061 - protein, 10 aa, Artificial Sequence
  Description of Artificial Sequence: Synthetic peptide
  Seed: GVGQESFGEV (TYRP1_HUMAN)
GMGQESFGEV

SEQ ID NO: 167062 - protein, 10 aa, Artificial Sequence
  Description of Artificial Sequence: Synthetic peptide
  Seed: FSLPYWNFAT (TYRP1_HUMAN)
FMLPYWNFAS

SEQ ID NO: 167063 - protein, 10 aa, Artificial Sequence
  Description of Artificial Sequence: Synthetic peptide
  Seed: ALIFGTASYL (TYRP1_HUMAN)
AQIFGTASYS

SEQ ID NO: 167064 - protein, 9 aa, Artificial Sequence
  Description of Artificial Sequence: Synthetic peptide
  Seed: IFGTASYLI (TYRP1_HUMAN)
IFGTASYLW

SEQ ID NO: 167065 - protein, 10 aa, Artificial Sequence
  Description of Artificial Sequence: Synthetic peptide
  Seed: RYNADISTFP (TYRP1_HUMAN)
RWNADISTFL

SEQ ID NO: 167066 - protein, 9 aa, Artificial Sequence
  Description of Artificial Sequence: Synthetic peptide
  Seed: NYFVWTHYY (TYRP1_HUMAN)
NVFVWTHYF

SEQ ID NO: 167067 - protein, 10 aa, Artificial Sequence
  Description of Artificial Sequence: Synthetic peptide
  Seed: FSLPYWNFAT (TYRP1_HUMAN)
FWLPYWNFAV

SEQ ID NO: 167068 - protein, 9 aa, Artificial Sequence
  Description of Artificial Sequence: Synthetic peptide
  Seed: SLGCIFFPL (TYRP1_HUMAN)
SLGCIFFPI

SEQ ID NO: 167069 - protein, 10 aa, Artificial Sequence
  Description of Artificial Sequence: Synthetic peptide
  Seed: TPQFENISIY (TYRP1_HUMAN)
TLQFENISIM

SEQ ID NO: 167070 - protein, 9 aa, Artificial Sequence
  Description of Artificial Sequence: Synthetic peptide
  Seed: SMDEANQPL (TYRP1_HUMAN)
SQDEANQPL

SEQ ID NO: 167071 - protein, 9 aa, Artificial Sequence
  Description of Artificial Sequence: Synthetic peptide
  Seed: ALIFGTASY (TYRP1_HUMAN)
AAIFGTASR

SEQ ID NO: 167072 - protein, 9 aa, Artificial Sequence
  Description of Artificial Sequence: Synthetic peptide
  Seed: FYSNSTNSF (TYRP1_HUMAN)
FVSNSTNSV

SEQ ID NO: 167073 - protein, 10 aa, Artificial Sequence
  Description of Artificial Sequence: Synthetic peptide
  Seed: FSLPYWNFAT (TYRP1_HUMAN)
FGLPYWNFAA

SEQ ID NO: 167074 - protein, 8 aa, Artificial Sequence
  Description of Artificial Sequence: Synthetic peptide
  Seed: RQYNMVPF (TYRP1_HUMAN)
RMYNMVPF

SEQ ID NO: 167075 - protein, 10 aa, Artificial Sequence
  Description of Artificial Sequence: Synthetic peptide
  Seed: WPPVTNTEMF (TYRP1_HUMAN)
WAPVTNTEMY

SEQ ID NO: 167076 - protein, 11 aa, Artificial Sequence
  Description of Artificial Sequence: Synthetic peptide
  Seed: YFVWTHYYSVK (TYRP1_HUMAN)
YVVWTHYYSVR

SEQ ID NO: 167077 - protein, 10 aa, Artificial Sequence
  Description of Artificial Sequence: Synthetic peptide
  Seed: YNADISTFPL (TYRP1_HUMAN)
YSADISTFPI

SEQ ID NO: 167078 - protein, 11 aa, Artificial Sequence
  Description of Artificial Sequence: Synthetic peptide
  Seed: IYNYFVWTHYY (TYRP1_HUMAN)
ILNYFVWTHYL

SEQ ID NO: 167079 - protein, 8 aa, Artificial Sequence
  Description of Artificial Sequence: Synthetic peptide
  Seed: YFVWTHYY (TYRP1_HUMAN)
YMVWTHYY

SEQ ID NO: 167080 - protein, 9 aa, Artificial Sequence
  Description of Artificial Sequence: Synthetic peptide
  Seed: KYDPAVRSL (TYRP1_HUMAN)
KADPAVRSW

SEQ ID NO: 167081 - protein, 10 aa, Artificial Sequence
  Description of Artificial Sequence: Synthetic peptide
  Seed: EMLQEPSFSL (TYRP1_HUMAN)
ESLQEPSFSV

SEQ ID NO: 167082 - protein, 10 aa, Artificial Sequence
  Description of Artificial Sequence: Synthetic peptide
  Seed: RLEKDMQEML (TYRP1_HUMAN)
RQEKDMQEML

SEQ ID NO: 167083 - protein, 10 aa, Artificial Sequence
  Description of Artificial Sequence: Synthetic peptide
  Seed: RRNPAGNVAR (TYRP1_HUMAN)
RRNPAGNVAL

SEQ ID NO: 167084 - protein, 9 aa, Artificial Sequence
  Description of Artificial Sequence: Synthetic peptide
  Seed: FYSNSTNSF (TYRP1_HUMAN)
FLSNSTNSL

SEQ ID NO: 167085 - protein, 10 aa, Artificial Sequence
  Description of Artificial Sequence: Synthetic peptide
  Seed: FQQARAQFPR (TYRP1_HUMAN)
FIQARAQFPK

SEQ ID NO: 167086 - protein, 9 aa, Artificial Sequence
  Description of Artificial Sequence: Synthetic peptide
  Seed: FLNGTGGQT (TYRP1_HUMAN)
FVNGTGGQL

SEQ ID NO: 167087 - protein, 9 aa, Artificial Sequence
  Description of Artificial Sequence: Synthetic peptide
  Seed: ALIFGTASY (TYRP1_HUMAN)
AMIFGTASI

SEQ ID NO: 167088 - protein, 10 aa, Artificial Sequence
  Description of Artificial Sequence: Synthetic peptide
  Seed: HRYHLLRLEK (TYRP1_HUMAN)
HIYHLLRLER

SEQ ID NO: 167089 - protein, 10 aa, Artificial Sequence
  Description of Artificial Sequence: Synthetic peptide
  Seed: VLLHTFTDAV (TYRP1_HUMAN)
VQLHTFTDAV

SEQ ID NO: 167090 - protein, 9 aa, Artificial Sequence
  Description of Artificial Sequence: Synthetic peptide
  Seed: YNYFVWTHY (TYRP1_HUMAN)
YHYFVWTHY

SEQ ID NO: 167091 - protein, 9 aa, Artificial Sequence
  Description of Artificial Sequence: Synthetic peptide
  Seed: NYFVWTHYY (TYRP1_HUMAN)
NLFVWTHYV

SEQ ID NO: 167092 - protein, 9 aa, Artificial Sequence
  Description of Artificial Sequence: Synthetic peptide
  Seed: VFDEWLRRY (TYRP1_HUMAN)
VIDEWLRRF

SEQ ID NO: 167093 - protein, 9 aa, Artificial Sequence
  Description of Artificial Sequence: Synthetic peptide
  Seed: STNSFRNTV (TYRP1_HUMAN)
SGNSFRNTK

SEQ ID NO: 167094 - protein, 9 aa, Artificial Sequence
  Description of Artificial Sequence: Synthetic peptide
  Seed: RGRCEAVTA (TYRP1_HUMAN)
RMRCEAVTY

SEQ ID NO: 167095 - protein, 11 aa, Artificial Sequence
  Description of Artificial Sequence: Synthetic peptide
  Seed: YNYFVWTHYYS (TYRP1_HUMAN)
YMYFVWTHYYI

SEQ ID NO: 167096 - protein, 9 aa, Artificial Sequence
  Description of Artificial Sequence: Synthetic peptide
  Seed: RSLHNLAHL (TYRP1_HUMAN)
RRLHNLAHY

SEQ ID NO: 167097 - protein, 9 aa, Artificial Sequence
  Description of Artificial Sequence: Synthetic peptide
  Seed: RPGWRGAAC (TYRP1_HUMAN)
RAGWRGAAL

SEQ ID NO: 167098 - protein, 9 aa, Artificial Sequence
  Description of Artificial Sequence: Synthetic peptide
  Seed: SGRGRCEAV (TYRP1_HUMAN)
SIRGRCEAL

SEQ ID NO: 167099 - protein, 9 aa, Artificial Sequence
  Description of Artificial Sequence: Synthetic peptide
  Seed: LLHTFTDAV (TYRP1_HUMAN)
LLHTFTDAI

SEQ ID NO: 167100 - protein, 10 aa, Artificial Sequence
  Description of Artificial Sequence: Synthetic peptide
  Seed: FVWTHYYSVK (TYRP1_HUMAN)
FMWTHYYSVR

SEQ ID NO: 167101 - protein, 9 aa, Artificial Sequence
  Description of Artificial Sequence: Synthetic peptide
  Seed: RGRCEAVTA (TYRP1_HUMAN)
RSRCEAVTY

SEQ ID NO: 167102 - protein, 9 aa, Artificial Sequence
  Description of Artificial Sequence: Synthetic peptide
  Seed: RSLHNLAHL (TYRP1_HUMAN)
RILHNLAHL

SEQ ID NO: 167103 - protein, 10 aa, Artificial Sequence
  Description of Artificial Sequence: Synthetic peptide
  Seed: YNYFVWTHYY (TYRP1_HUMAN)
YQYFVWTHYV

SEQ ID NO: 167104 - protein, 10 aa, Artificial Sequence
  Description of Artificial Sequence: Synthetic peptide
  Seed: YNYFVWTHYY (TYRP1_HUMAN)
YSYFVWTHYV

SEQ ID NO: 167105 - protein, 9 aa, Artificial Sequence
  Description of Artificial Sequence: Synthetic peptide
  Seed: SLGCIFFPL (TYRP1_HUMAN)
STGCIFFPK

SEQ ID NO: 167106 - protein, 9 aa, Artificial Sequence
  Description of Artificial Sequence: Synthetic peptide
  Seed: ENAPIGHNR (TYRP1_HUMAN)
EFAPIGHNK

SEQ ID NO: 167107 - protein, 9 aa, Artificial Sequence
  Description of Artificial Sequence: Synthetic peptide
  Seed: FSHEGPAFL (TYRP1_HUMAN)
FIHEGPAFK

SEQ ID NO: 167108 - protein, 9 aa, Artificial Sequence
  Description of Artificial Sequence: Synthetic peptide
  Seed: VLIVRRNLL (TYRP1_HUMAN)
VAIVRRNLY

SEQ ID NO: 167109 - protein, 11 aa, Artificial Sequence
  Description of Artificial Sequence: Synthetic peptide
  Seed: YQCYAEEYEKL (TYRP1_HUMAN)
YLCYAEEYEKF

SEQ ID NO: 167110 - protein, 9 aa, Artificial Sequence
  Description of Artificial Sequence: Synthetic peptide
  Seed: FYSNSTNSF (TYRP1_HUMAN)
FPSNSTNSH

SEQ ID NO: 167111 - protein, 9 aa, Artificial Sequence
  Description of Artificial Sequence: Synthetic peptide
  Seed: SLHNLAHLF (TYRP1_HUMAN)
SFHNLAHLI

SEQ ID NO: 167112 - protein, 9 aa, Artificial Sequence
  Description of Artificial Sequence: Synthetic peptide
  Seed: SLHNLAHLF (TYRP1_HUMAN)
SSHNLAHLF

SEQ ID NO: 167113 - protein, 10 aa, Artificial Sequence
  Description of Artificial Sequence: Synthetic peptide
  Seed: SHEGPAFLTW (TYRP1_HUMAN)
SKEGPAFLTW

SEQ ID NO: 167114 - protein, 10 aa, Artificial Sequence
  Description of Artificial Sequence: Synthetic peptide
  Seed: EEKNHFVRAL (TYRP1_HUMAN)
EEKNHFVRAF

SEQ ID NO: 167115 - protein, 10 aa, Artificial Sequence
  Description of Artificial Sequence: Synthetic peptide
  Seed: NISIYNYFVW (TYRP1_HUMAN)
NMSIYNYFVW

SEQ ID NO: 167116 - protein, 10 aa, Artificial Sequence
  Description of Artificial Sequence: Synthetic peptide
  Seed: AQFPRQCATV (TYRP1_HUMAN)
AEFPRQCATY

SEQ ID NO: 167117 - protein, 9 aa, Artificial Sequence
  Description of Artificial Sequence: Synthetic peptide
  Seed: PNDPIFVLL (TYRP1_HUMAN)
PSDPIFVLM

SEQ ID NO: 167118 - protein, 9 aa, Artificial Sequence
  Description of Artificial Sequence: Synthetic peptide
  Seed: ENAPIGHNR (TYRP1_HUMAN)
ELAPIGHNR

SEQ ID NO: 167119 - protein, 10 aa, Artificial Sequence
  Description of Artificial Sequence: Synthetic peptide
  Seed: LGPDGNTPQF (TYRP1_HUMAN)
LNPDGNTPQW

SEQ ID NO: 167120 - protein, 10 aa, Artificial Sequence
  Description of Artificial Sequence: Synthetic peptide
  Seed: TFLGVGQESF (TYRP1_HUMAN)
TYLGVGQESM

SEQ ID NO: 167121 - protein, 11 aa, Artificial Sequence
  Description of Artificial Sequence: Synthetic peptide
  Seed: FPLLLFQQARA (TYRP1_HUMAN)
FHLLLFQQARV

SEQ ID NO: 167122 - protein, 11 aa, Artificial Sequence
  Description of Artificial Sequence: Synthetic peptide
  Seed: AGNVARPMVQR (TYRP1_HUMAN)
AHNVARPMVQK

SEQ ID NO: 167123 - protein, 9 aa, Artificial Sequence
  Description of Artificial Sequence: Synthetic peptide
  Seed: VFDEWLRRY (TYRP1_HUMAN)
VFDEWLRRI

SEQ ID NO: 167124 - protein, 10 aa, Artificial Sequence
  Description of Artificial Sequence: Synthetic peptide
  Seed: MSAPKLLSLG (TYRP1_HUMAN)
MMAPKLLSLW

SEQ ID NO: 167125 - protein, 9 aa, Artificial Sequence
  Description of Artificial Sequence: Synthetic peptide
  Seed: FSVPEIIAI (TYRP1_HUMAN)
FGVPEIIAW

SEQ ID NO: 167126 - protein, 9 aa, Artificial Sequence
  Description of Artificial Sequence: Synthetic peptide
  Seed: AQFPRQCAT (TYRP1_HUMAN)
AEFPRQCAF

SEQ ID NO: 167127 - protein, 10 aa, Artificial Sequence
  Description of Artificial Sequence: Synthetic peptide
  Seed: IAIAVVGALL (TYRP1_HUMAN)
IMIAVVGALA

SEQ ID NO: 167128 - protein, 9 aa, Artificial Sequence
  Description of Artificial Sequence: Synthetic peptide
  Seed: YTYEIQWPS (TYRP1_HUMAN)
YQYEIQWPT

SEQ ID NO: 167129 - protein, 10 aa, Artificial Sequence
  Description of Artificial Sequence: Synthetic peptide
  Seed: FVLLHTFTDA (TYRP1_HUMAN)
FALLHTFTDI

SEQ ID NO: 167130 - protein, 10 aa, Artificial Sequence
  Description of Artificial Sequence: Synthetic peptide
  Seed: VDFSHEGPAF (TYRP1_HUMAN)
VAFSHEGPAH

SEQ ID NO: 167131 - protein, 9 aa, Artificial Sequence
  Description of Artificial Sequence: Synthetic peptide
  Seed: SVPEIIAIA (TYRP1_HUMAN)
SMPEIIAIM

SEQ ID NO: 167132 - protein, 9 aa, Artificial Sequence
  Description of Artificial Sequence: Synthetic peptide
  Seed: SVKKTFLGV (TYRP1_HUMAN)
STKKTFLGT

SEQ ID NO: 167133 - protein, 9 aa, Artificial Sequence
  Description of Artificial Sequence: Synthetic peptide
  Seed: GYSDPTGKY (TYRP1_HUMAN)
GFSDPTGKY

SEQ ID NO: 167134 - protein, 10 aa, Artificial Sequence
  Description of Artificial Sequence: Synthetic peptide
  Seed: YNYFVWTHYY (TYRP1_HUMAN)
YEYFVWTHYY

SEQ ID NO: 167135 - protein, 10 aa, Artificial Sequence
  Description of Artificial Sequence: Synthetic peptide
  Seed: SMDEANQPLL (TYRP1_HUMAN)
SYDEANQPLL

SEQ ID NO: 167136 - protein, 9 aa, Artificial Sequence
  Description of Artificial Sequence: Synthetic peptide
  Seed: MLQEPSFSL (TYRP1_HUMAN)
MVQEPSFSW

SEQ ID NO: 167137 - protein, 9 aa, Artificial Sequence
  Description of Artificial Sequence: Synthetic peptide
  Seed: SVFSQWRVV (TYRP1_HUMAN)
SLFSQWRVF

SEQ ID NO: 167138 - protein, 9 aa, Artificial Sequence
  Description of Artificial Sequence: Synthetic peptide
  Seed: IAIAVVGAL (TYRP1_HUMAN)
ISIAVVGAI

SEQ ID NO: 167139 - protein, 11 aa, Artificial Sequence
  Description of Artificial Sequence: Synthetic peptide
  Seed: RLPEPQDVAQC (TYRP1_HUMAN)
RIPEPQDVAQL

SEQ ID NO: 167140 - protein, 9 aa, Artificial Sequence
  Description of Artificial Sequence: Synthetic peptide
  Seed: SVPEIIAIA (TYRP1_HUMAN)
SIPEIIAIM

SEQ ID NO: 167141 - protein, 11 aa, Artificial Sequence
  Description of Artificial Sequence: Synthetic peptide
  Seed: HLSPNDPIFVL (TYRP1_HUMAN)
HVSPNDPIFVY

SEQ ID NO: 167142 - protein, 9 aa, Artificial Sequence
  Description of Artificial Sequence: Synthetic peptide
  Seed: MCCPDLSPV (TYRP1_HUMAN)
MMCPDLSPM

SEQ ID NO: 167143 - protein, 10 aa, Artificial Sequence
  Description of Artificial Sequence: Synthetic peptide
  Seed: SPVSGPGTDR (TYRP1_HUMAN)
SAVSGPGTDL

SEQ ID NO: 167144 - protein, 9 aa, Artificial Sequence
  Description of Artificial Sequence: Synthetic peptide
  Seed: RFFNRTCHC (TYRP1_HUMAN)
RFFNRTCHM

SEQ ID NO: 167145 - protein, 9 aa, Artificial Sequence
  Description of Artificial Sequence: Synthetic peptide
  Seed: IYNYFVWTH (TYRP1_HUMAN)
IVNYFVWTR

SEQ ID NO: 167146 - protein, 9 aa, Artificial Sequence
  Description of Artificial Sequence: Synthetic peptide
  Seed: MCCPDLSPV (TYRP1_HUMAN)
MLCPDLSPV

SEQ ID NO: 167147 - protein, 9 aa, Artificial Sequence
  Description of Artificial Sequence: Synthetic peptide
  Seed: IAVVGALLL (TYRP1_HUMAN)
IMVVGALLW

SEQ ID NO: 167148 - protein, 9 aa, Artificial Sequence
  Description of Artificial Sequence: Synthetic peptide
  Seed: RQCATVEAL (TYRP1_HUMAN)
RHCATVEAF

SEQ ID NO: 167149 - protein, 9 aa, Artificial Sequence
  Description of Artificial Sequence: Synthetic peptide
  Seed: SRSNFDSTL (TYRP1_HUMAN)
SQSNFDSTW

SEQ ID NO: 167150 - protein, 9 aa, Artificial Sequence
  Description of Artificial Sequence: Synthetic peptide
  Seed: VGLFDTPPF (TYRP1_HUMAN)
VKLFDTPPF

SEQ ID NO: 167151 - protein, 9 aa, Artificial Sequence
  Description of Artificial Sequence: Synthetic peptide
  Seed: FSLPYWNFA (TYRP1_HUMAN)
FLLPYWNFC

SEQ ID NO: 167152 - protein, 10 aa, Artificial Sequence
  Description of Artificial Sequence: Synthetic peptide
  Seed: FGTASYLIRA (TYRP1_HUMAN)
FPTASYLIRV

SEQ ID NO: 167153 - protein, 11 aa, Artificial Sequence
  Description of Artificial Sequence: Synthetic peptide
  Seed: HEGPAFLTWHR (TYRP1_HUMAN)
HAGPAFLTWHR

SEQ ID NO: 167154 - protein, 9 aa, Artificial Sequence
  Description of Artificial Sequence: Synthetic peptide
  Seed: FTDAVFDEW (TYRP1_HUMAN)
FPDAVFDEM

SEQ ID NO: 167155 - protein, 10 aa, Artificial Sequence
  Description of Artificial Sequence: Synthetic peptide
  Seed: TASYLIRARR (TYRP1_HUMAN)
TGSYLIRARR

SEQ ID NO: 167156 - protein, 9 aa, Artificial Sequence
  Description of Artificial Sequence: Synthetic peptide
  Seed: DYDTLGTLC (TYRP1_HUMAN)
DYDTLGTLF

SEQ ID NO: 167157 - protein, 9 aa, Artificial Sequence
  Description of Artificial Sequence: Synthetic peptide
  Seed: EEYEKLQNP (TYRP1_HUMAN)
EEYEKLQNV

SEQ ID NO: 167158 - protein, 10 aa, Artificial Sequence
  Description of Artificial Sequence: Synthetic peptide
  Seed: RSLHNLAHLF (TYRP1_HUMAN)
RWLHNLAHLY

SEQ ID NO: 167159 - protein, 11 aa, Artificial Sequence
  Description of Artificial Sequence: Synthetic peptide
  Seed: VTAPDNLGYTY (TYRP1_HUMAN)
VAAPDNLGYTW

SEQ ID NO: 167160 - protein, 9 aa, Artificial Sequence
  Description of Artificial Sequence: Synthetic peptide
  Seed: AVVGALLLV (TYRP1_HUMAN)
ALVGALLLR

SEQ ID NO: 167161 - protein, 10 aa, Artificial Sequence
  Description of Artificial Sequence: Synthetic peptide
  Seed: SMDEANQPLL (TYRP1_HUMAN)
SIDEANQPLY

SEQ ID NO: 167162 - protein, 9 aa, Artificial Sequence
  Description of Artificial Sequence: Synthetic peptide
  Seed: FGTASYLIR (TYRP1_HUMAN)
FVTASYLIR

SEQ ID NO: 167163 - protein, 9 aa, Artificial Sequence
  Description of Artificial Sequence: Synthetic peptide
  Seed: AVVGALLLV (TYRP1_HUMAN)
AVVGALLLL

SEQ ID NO: 167164 - protein, 9 aa, Artificial Sequence
  Description of Artificial Sequence: Synthetic peptide
  Seed: FYSNSTNSF (TYRP1_HUMAN)
FMSNSTNSV

SEQ ID NO: 167165 - protein, 10 aa, Artificial Sequence
  Description of Artificial Sequence: Synthetic peptide
  Seed: TWHRYHLLRL (TYRP1_HUMAN)
TYHRYHLLRF

SEQ ID NO: 167166 - protein, 9 aa, Artificial Sequence
  Description of Artificial Sequence: Synthetic peptide
  Seed: IIAIAVVGA (TYRP1_HUMAN)
IVAIAVVGV

SEQ ID NO: 167167 - protein, 11 aa, Artificial Sequence
  Description of Artificial Sequence: Synthetic peptide
  Seed: RRYNADISTFP (TYRP1_HUMAN)
RVYNADISTFF

SEQ ID NO: 167168 - protein, 10 aa, Artificial Sequence
  Description of Artificial Sequence: Synthetic peptide
  Seed: ALIFGTASYL (TYRP1_HUMAN)
AMIFGTASYT

SEQ ID NO: 167169 - protein, 10 aa, Artificial Sequence
  Description of Artificial Sequence: Synthetic peptide
  Seed: AQFPRQCATV (TYRP1_HUMAN)
ALFPRQCATY

SEQ ID NO: 167170 - protein, 11 aa, Artificial Sequence
  Description of Artificial Sequence: Synthetic peptide
  Seed: REFSVPEIIAI (TYRP1_HUMAN)
RRFSVPEIIAF

SEQ ID NO: 167171 - protein, 9 aa, Artificial Sequence
  Description of Artificial Sequence: Synthetic peptide
  Seed: TAPDNLGYT (TYRP1_HUMAN)
TVPDNLGYF

SEQ ID NO: 167172 - protein, 10 aa, Artificial Sequence
  Description of Artificial Sequence: Synthetic peptide
  Seed: LGPDGNTPQF (TYRP1_HUMAN)
LVPDGNTPQW

SEQ ID NO: 167173 - protein, 11 aa, Artificial Sequence
  Description of Artificial Sequence: Synthetic peptide
  Seed: REVWPLRFFNR (TYRP1_HUMAN)
RVVWPLRFFNK

SEQ ID NO: 167174 - protein, 9 aa, Artificial Sequence
  Description of Artificial Sequence: Synthetic peptide
  Seed: MLQEPSFSL (TYRP1_HUMAN)
MAQEPSFSH

SEQ ID NO: 167175 - protein, 10 aa, Artificial Sequence
  Description of Artificial Sequence: Synthetic peptide
  Seed: SIYNYFVWTH (TYRP1_HUMAN)
SQYNYFVWTR

SEQ ID NO: 167176 - protein, 9 aa, Artificial Sequence
  Description of Artificial Sequence: Synthetic peptide
  Seed: CIFFPLLLF (TYRP1_HUMAN)
CGFFPLLLW

SEQ ID NO: 167177 - protein, 10 aa, Artificial Sequence
  Description of Artificial Sequence: Synthetic peptide
  Seed: FSLPYWNFAT (TYRP1_HUMAN)
FALPYWNFAI

SEQ ID NO: 167178 - protein, 9 aa, Artificial Sequence
  Description of Artificial Sequence: Synthetic peptide
  Seed: MLQEPSFSL (TYRP1_HUMAN)
MMQEPSFSA

SEQ ID NO: 167179 - protein, 9 aa, Artificial Sequence
  Description of Artificial Sequence: Synthetic peptide
  Seed: NMVPFWPPV (TYRP1_HUMAN)
NAVPFWPPV

SEQ ID NO: 167180 - protein, 10 aa, Artificial Sequence
  Description of Artificial Sequence: Synthetic peptide
  Seed: TASYLIRARR (TYRP1_HUMAN)
TLSYLIRARR

SEQ ID NO: 167181 - protein, 10 aa, Artificial Sequence
  Description of Artificial Sequence: Synthetic peptide
  Seed: YNMVPFWPPV (TYRP1_HUMAN)
YGMVPFWPPM

SEQ ID NO: 167182 - protein, 9 aa, Artificial Sequence
  Description of Artificial Sequence: Synthetic peptide
  Seed: KRTTHPLFV (TYRP1_HUMAN)
KRTTHPLFI

SEQ ID NO: 167183 - protein, 10 aa, Artificial Sequence
  Description of Artificial Sequence: Synthetic peptide
  Seed: LIFGTASYLI (TYRP1_HUMAN)
LMFGTASYLT

SEQ ID NO: 167184 - protein, 10 aa, Artificial Sequence
  Description of Artificial Sequence: Synthetic peptide
  Seed: TFTDAVFDEW (TYRP1_HUMAN)
TSTDAVFDEW

SEQ ID NO: 167185 - protein, 9 aa, Artificial Sequence
  Description of Artificial Sequence: Synthetic peptide
  Seed: TTHPLFVIA (TYRP1_HUMAN)
TAHPLFVIY

SEQ ID NO: 167186 - protein, 9 aa, Artificial Sequence
  Description of Artificial Sequence: Synthetic peptide
  Seed: AQFPRQCAT (TYRP1_HUMAN)
AMFPRQCAL

SEQ ID NO: 167187 - protein, 9 aa, Artificial Sequence
  Description of Artificial Sequence: Synthetic peptide
  Seed: NRQYNMVPF (TYRP1_HUMAN)
NHQYNMVPY

SEQ ID NO: 167188 - protein, 9 aa, Artificial Sequence
  Description of Artificial Sequence: Synthetic peptide
  Seed: FVWTHYYSV (TYRP1_HUMAN)
FPWTHYYSS

SEQ ID NO: 167189 - protein, 10 aa, Artificial Sequence
  Description of Artificial Sequence: Synthetic peptide
  Seed: SPVSGPGTDR (TYRP1_HUMAN)
SPVSGPGTDA

SEQ ID NO: 167190 - protein, 10 aa, Artificial Sequence
  Description of Artificial Sequence: Synthetic peptide
  Seed: FVTAPDNLGY (TYRP1_HUMAN)
FHTAPDNLGW

SEQ ID NO: 167191 - protein, 9 aa, Artificial Sequence
  Description of Artificial Sequence: Synthetic peptide
  Seed: VTAPDNLGY (TYRP1_HUMAN)
VLAPDNLGW

SEQ ID NO: 167192 - protein, 10 aa, Artificial Sequence
  Description of Artificial Sequence: Synthetic peptide
  Seed: TFTDAVFDEW (TYRP1_HUMAN)
TATDAVFDEW

SEQ ID NO: 167193 - protein, 9 aa, Artificial Sequence
  Description of Artificial Sequence: Synthetic peptide
  Seed: EGYSDPTGK (TYRP1_HUMAN)
EIYSDPTGR

SEQ ID NO: 167194 - protein, 10 aa, Artificial Sequence
  Description of Artificial Sequence: Synthetic peptide
  Seed: RSLHNLAHLF (TYRP1_HUMAN)
RALHNLAHLM

SEQ ID NO: 167195 - protein, 11 aa, Artificial Sequence
  Description of Artificial Sequence: Synthetic peptide
  Seed: YNMVPFWPPVT (TYRP1_HUMAN)
YIMVPFWPPVE

SEQ ID NO: 167196 - protein, 9 aa, Artificial Sequence
  Description of Artificial Sequence: Synthetic peptide
  Seed: AVFDEWLRR (TYRP1_HUMAN)
AIFDEWLRK

SEQ ID NO: 167197 - protein, 9 aa, Artificial Sequence
  Description of Artificial Sequence: Synthetic peptide
  Seed: HYYSVKKTF (TYRP1_HUMAN)
HHYSVKKTY

SEQ ID NO: 167198 - protein, 9 aa, Artificial Sequence
  Description of Artificial Sequence: Synthetic peptide
  Seed: IAVVGALLL (TYRP1_HUMAN)
INVVGALLW

SEQ ID NO: 167199 - protein, 11 aa, Artificial Sequence
  Description of Artificial Sequence: Synthetic peptide
  Seed: RRYNADISTFP (TYRP1_HUMAN)
RWYNADISTFP

SEQ ID NO: 167200 - protein, 10 aa, Artificial Sequence
  Description of Artificial Sequence: Synthetic peptide
  Seed: STLISPNSVF (TYRP1_HUMAN)
SCLISPNSVY

SEQ ID NO: 167201 - protein, 9 aa, Artificial Sequence
  Description of Artificial Sequence: Synthetic peptide
  Seed: LVALIFGTA (TYRP1_HUMAN)
LQALIFGTL

SEQ ID NO: 167202 - protein, 9 aa, Artificial Sequence
  Description of Artificial Sequence: Synthetic peptide
  Seed: LTDQYQCYA (TYRP1_HUMAN)
LQDQYQCYY

SEQ ID NO: 167203 - protein, 9 aa, Artificial Sequence
  Description of Artificial Sequence: Synthetic peptide
  Seed: TWHRYHLLR (TYRP1_HUMAN)
TQHRYHLLR

SEQ ID NO: 167204 - protein, 11 aa, Artificial Sequence
  Description of Artificial Sequence: Synthetic peptide
  Seed: IAIAVVGALLL (TYRP1_HUMAN)
ISIAVVGALLF

SEQ ID NO: 167205 - protein, 9 aa, Artificial Sequence
  Description of Artificial Sequence: Synthetic peptide
  Seed: FVWTHYYSV (TYRP1_HUMAN)
FQWTHYYSS

SEQ ID NO: 167206 - protein, 9 aa, Artificial Sequence
  Description of Artificial Sequence: Synthetic peptide
  Seed: NADISTFPL (TYRP1_HUMAN)
NIDISTFPL

SEQ ID NO: 167207 - protein, 9 aa, Artificial Sequence
  Description of Artificial Sequence: Synthetic peptide
  Seed: QDVAQCLEV (TYRP1_HUMAN)
QEVAQCLEA

SEQ ID NO: 167208 - protein, 9 aa, Artificial Sequence
  Description of Artificial Sequence: Synthetic peptide
  Seed: LHNLAHLFL (TYRP1_HUMAN)
LQNLAHLFM

SEQ ID NO: 167209 - protein, 10 aa, Artificial Sequence
  Description of Artificial Sequence: Synthetic peptide
  Seed: RYNADISTFP (TYRP1_HUMAN)
RYNADISTFG

SEQ ID NO: 167210 - protein, 11 aa, Artificial Sequence
  Description of Artificial Sequence: Synthetic peptide
  Seed: HLSPNDPIFVL (TYRP1_HUMAN)
HQSPNDPIFVI

SEQ ID NO: 167211 - protein, 10 aa, Artificial Sequence
  Description of Artificial Sequence: Synthetic peptide
  Seed: MQEMLQEPSF (TYRP1_HUMAN)
MDEMLQEPSW

SEQ ID NO: 167212 - protein, 9 aa, Artificial Sequence
  Description of Artificial Sequence: Synthetic peptide
  Seed: RYNADISTF (TYRP1_HUMAN)
RQNADISTF

SEQ ID NO: 167213 - protein, 9 aa, Artificial Sequence
  Description of Artificial Sequence: Synthetic peptide
  Seed: APIGHNRQY (TYRP1_HUMAN)
AMIGHNRQY

SEQ ID NO: 167214 - protein, 10 aa, Artificial Sequence
  Description of Artificial Sequence: Synthetic peptide
  Seed: GLFDTPPFYS (TYRP1_HUMAN)
GVFDTPPFYL

SEQ ID NO: 167215 - protein, 9 aa, Artificial Sequence
  Description of Artificial Sequence: Synthetic peptide
  Seed: KYDPAVRSL (TYRP1_HUMAN)
KMDPAVRSV

SEQ ID NO: 167216 - protein, 10 aa, Artificial Sequence
  Description of Artificial Sequence: Synthetic peptide
  Seed: PSFSLPYWNF (TYRP1_HUMAN)
PYFSLPYWNF

SEQ ID NO: 167217 - protein, 9 aa, Artificial Sequence
  Description of Artificial Sequence: Synthetic peptide
  Seed: AVRSLHNLA (TYRP1_HUMAN)
AYRSLHNLA

SEQ ID NO: 167218 - protein, 10 aa, Artificial Sequence
  Description of Artificial Sequence: Synthetic peptide
  Seed: STFPLENAPI (TYRP1_HUMAN)
SQFPLENAPV

SEQ ID NO: 167219 - protein, 10 aa, Artificial Sequence
  Description of Artificial Sequence: Synthetic peptide
  Seed: TPQFENISIY (TYRP1_HUMAN)
TIQFENISIF

SEQ ID NO: 167220 - protein, 10 aa, Artificial Sequence
  Description of Artificial Sequence: Synthetic peptide
  Seed: YNYFVWTHYY (TYRP1_HUMAN)
YIYFVWTHYR

SEQ ID NO: 167221 - protein, 9 aa, Artificial Sequence
  Description of Artificial Sequence: Synthetic peptide
  Seed: MSAPKLLSL (TYRP1_HUMAN)
MGAPKLLSK

SEQ ID NO: 167222 - protein, 9 aa, Artificial Sequence
  Description of Artificial Sequence: Synthetic peptide
  Seed: YYSVKKTFL (TYRP1_HUMAN)
YTSVKKTFL

SEQ ID NO: 167223 - protein, 10 aa, Artificial Sequence
  Description of Artificial Sequence: Synthetic peptide
  Seed: KRTTHPLFVI (TYRP1_HUMAN)
KWTTHPLFVW

SEQ ID NO: 167224 - protein, 10 aa, Artificial Sequence
  Description of Artificial Sequence: Synthetic peptide
  Seed: KRTTHPLFVI (TYRP1_HUMAN)
KATTHPLFVM

SEQ ID NO: 167225 - protein, 9 aa, Artificial Sequence
  Description of Artificial Sequence: Synthetic peptide
  Seed: LQNPNQSVV (TYRP1_HUMAN)
LMNPNQSVW

SEQ ID NO: 167226 - protein, 9 aa, Artificial Sequence
  Description of Artificial Sequence: Synthetic peptide
  Seed: LIFGTASYL (TYRP1_HUMAN)
LKFGTASYI

SEQ ID NO: 167227 - protein, 9 aa, Artificial Sequence
  Description of Artificial Sequence: Synthetic peptide
  Seed: KRTTHPLFV (TYRP1_HUMAN)
KATTHPLFL

SEQ ID NO: 167228 - protein, 10 aa, Artificial Sequence
  Description of Artificial Sequence: Synthetic peptide
  Seed: EIIAIAVVGA (TYRP1_HUMAN)
EHIAIAVVGV

SEQ ID NO: 167229 - protein, 10 aa, Artificial Sequence
  Description of Artificial Sequence: Synthetic peptide
  Seed: FTDAVFDEWL (TYRP1_HUMAN)
FVDAVFDEWL

SEQ ID NO: 167230 - protein, 10 aa, Artificial Sequence
  Description of Artificial Sequence: Synthetic peptide
  Seed: LSLGCIFFPL (TYRP1_HUMAN)
LMLGCIFFPT

SEQ ID NO: 167231 - protein, 11 aa, Artificial Sequence
  Description of Artificial Sequence: Synthetic peptide
  Seed: QEMLQEPSFSL (TYRP1_HUMAN)
QWMLQEPSFSI

SEQ ID NO: 167232 - protein, 10 aa, Artificial Sequence
  Description of Artificial Sequence: Synthetic peptide
  Seed: THYYSVKKTF (TYRP1_HUMAN)
TVYYSVKKTF

SEQ ID NO: 167233 - protein, 9 aa, Artificial Sequence
  Description of Artificial Sequence: Synthetic peptide
  Seed: TEMFVTAPD (TYRP1_HUMAN)
TEMFVTAPH

SEQ ID NO: 167234 - protein, 9 aa, Artificial Sequence
  Description of Artificial Sequence: Synthetic peptide
  Seed: RYNADISTF (TYRP1_HUMAN)
RFNADISTF

SEQ ID NO: 167235 - protein, 10 aa, Artificial Sequence
  Description of Artificial Sequence: Synthetic peptide
  Seed: IAVVGALLLV (TYRP1_HUMAN)
IFVVGALLLV

SEQ ID NO: 167236 - protein, 10 aa, Artificial Sequence
  Description of Artificial Sequence: Synthetic peptide
  Seed: SHEGPAFLTW (TYRP1_HUMAN)
SFEGPAFLTW

SEQ ID NO: 167237 - protein, 10 aa, Artificial Sequence
  Description of Artificial Sequence: Synthetic peptide
  Seed: SIYNYFVWTH (TYRP1_HUMAN)
SEYNYFVWTR

SEQ ID NO: 167238 - protein, 10 aa, Artificial Sequence
  Description of Artificial Sequence: Synthetic peptide
  Seed: HNRQYNMVPF (TYRP1_HUMAN)
HERQYNMVPY

SEQ ID NO: 167239 - protein, 9 aa, Artificial Sequence
  Description of Artificial Sequence: Synthetic peptide
  Seed: YSNSTNSFR (TYRP1_HUMAN)
YMNSTNSFK

SEQ ID NO: 167240 - protein, 10 aa, Artificial Sequence
  Description of Artificial Sequence: Synthetic peptide
  Seed: SMDEANQPLL (TYRP1_HUMAN)
SSDEANQPLM

SEQ ID NO: 167241 - protein, 9 aa, Artificial Sequence
  Description of Artificial Sequence: Synthetic peptide
  Seed: RQYNMVPFW (TYRP1_HUMAN)
RGYNMVPFY

SEQ ID NO: 167242 - protein, 9 aa, Artificial Sequence
  Description of Artificial Sequence: Synthetic peptide
  Seed: WPPVTNTEM (TYRP1_HUMAN)
WAPVTNTEL

SEQ ID NO: 167243 - protein, 11 aa, Artificial Sequence
  Description of Artificial Sequence: Synthetic peptide
  Seed: DICTDDLMGSR (TYRP1_HUMAN)
DTCTDDLMGSR

SEQ ID NO: 167244 - protein, 9 aa, Artificial Sequence
  Description of Artificial Sequence: Synthetic peptide
  Seed: SPNDPIFVL (TYRP1_HUMAN)
STNDPIFVV

SEQ ID NO: 167245 - protein, 9 aa, Artificial Sequence
  Description of Artificial Sequence: Synthetic peptide
  Seed: KLLSLGCIF (TYRP1_HUMAN)
KLLSLGCIY

SEQ ID NO: 167246 - protein, 9 aa, Artificial Sequence
  Description of Artificial Sequence: Synthetic peptide
  Seed: GTASYLIRA (TYRP1_HUMAN)
GAASYLIRL

SEQ ID NO: 167247 - protein, 8 aa, Artificial Sequence
  Description of Artificial Sequence: Synthetic peptide
  Seed: IFGTASYL (TYRP1_HUMAN)
IYGTASYL

SEQ ID NO: 167248 - protein, 11 aa, Artificial Sequence
  Description of Artificial Sequence: Synthetic peptide
  Seed: VTAPDNLGYTY (TYRP1_HUMAN)
VAAPDNLGYTY

SEQ ID NO: 167249 - protein, 9 aa, Artificial Sequence
  Description of Artificial Sequence: Synthetic peptide
  Seed: AVFDEWLRR (TYRP1_HUMAN)
ASFDEWLRR

SEQ ID NO: 167250 - protein, 9 aa, Artificial Sequence
  Description of Artificial Sequence: Synthetic peptide
  Seed: RSLHNLAHL (TYRP1_HUMAN)
RGLHNLAHY

SEQ ID NO: 167251 - protein, 10 aa, Artificial Sequence
  Description of Artificial Sequence: Synthetic peptide
  Seed: NMVPFWPPVT (TYRP1_HUMAN)
NMVPFWPPVV

SEQ ID NO: 167252 - protein, 9 aa, Artificial Sequence
  Description of Artificial Sequence: Synthetic peptide
  Seed: MLQEPSFSL (TYRP1_HUMAN)
MIQEPSFSR

SEQ ID NO: 167253 - protein, 9 aa, Artificial Sequence
  Description of Artificial Sequence: Synthetic peptide
  Seed: LHTFTDAVF (TYRP1_HUMAN)
LETFTDAVF

SEQ ID NO: 167254 - protein, 9 aa, Artificial Sequence
  Description of Artificial Sequence: Synthetic peptide
  Seed: FLGVGQESF (TYRP1_HUMAN)
FQGVGQESL

SEQ ID NO: 167255 - protein, 10 aa, Artificial Sequence
  Description of Artificial Sequence: Synthetic peptide
  Seed: KYDPAVRSLH (TYRP1_HUMAN)
KTDPAVRSLY

SEQ ID NO: 167256 - protein, 10 aa, Artificial Sequence
  Description of Artificial Sequence: Synthetic peptide
  Seed: ENISIYNYFV (TYRP1_HUMAN)
ETISIYNYFT

SEQ ID NO: 167257 - protein, 10 aa, Artificial Sequence
  Description of Artificial Sequence: Synthetic peptide
  Seed: YNADISTFPL (TYRP1_HUMAN)
YYADISTFPY

SEQ ID NO: 167258 - protein, 10 aa, Artificial Sequence
  Description of Artificial Sequence: Synthetic peptide
  Seed: KLLSLGCIFF (TYRP1_HUMAN)
KILSLGCIFV

SEQ ID NO: 167259 - protein, 9 aa, Artificial Sequence
  Description of Artificial Sequence: Synthetic peptide
  Seed: YNYFVWTHY (TYRP1_HUMAN)
YRYFVWTHY

SEQ ID NO: 167260 - protein, 10 aa, Artificial Sequence
  Description of Artificial Sequence: Synthetic peptide
  Seed: MVPFWPPVTN (TYRP1_HUMAN)
MNPFWPPVTF

SEQ ID NO: 167261 - protein, 10 aa, Artificial Sequence
  Description of Artificial Sequence: Synthetic peptide
  Seed: LSPNDPIFVL (TYRP1_HUMAN)
LRPNDPIFVM

SEQ ID NO: 167262 - protein, 10 aa, Artificial Sequence
  Description of Artificial Sequence: Synthetic peptide
  Seed: NVARPMVQRL (TYRP1_HUMAN)
NVARPMVQRV

SEQ ID NO: 167263 - protein, 9 aa, Artificial Sequence
  Description of Artificial Sequence: Synthetic peptide
  Seed: NYFVWTHYY (TYRP1_HUMAN)
NLFVWTHYW

SEQ ID NO: 167264 - protein, 10 aa, Artificial Sequence
  Description of Artificial Sequence: Synthetic peptide
  Seed: REFSVPEIIA (TYRP1_HUMAN)
RQFSVPEIIL

SEQ ID NO: 167265 - protein, 9 aa, Artificial Sequence
  Description of Artificial Sequence: Synthetic peptide
  Seed: FYSNSTNSF (TYRP1_HUMAN)
FASNSTNSV

SEQ ID NO: 167266 - protein, 10 aa, Artificial Sequence
  Description of Artificial Sequence: Synthetic peptide
  Seed: KYDPAVRSLH (TYRP1_HUMAN)
KSDPAVRSLY

SEQ ID NO: 167267 - protein, 9 aa, Artificial Sequence
  Description of Artificial Sequence: Synthetic peptide
  Seed: FTDAVFDEW (TYRP1_HUMAN)
FPDAVFDEL

SEQ ID NO: 167268 - protein, 9 aa, Artificial Sequence
  Description of Artificial Sequence: Synthetic peptide
  Seed: EDYDTLGTL (TYRP1_HUMAN)
EEYDTLGTI

SEQ ID NO: 167269 - protein, 9 aa, Artificial Sequence
  Description of Artificial Sequence: Synthetic peptide
  Seed: RGRCEAVTA (TYRP1_HUMAN)
RIRCEAVTV

SEQ ID NO: 167270 - protein, 10 aa, Artificial Sequence
  Description of Artificial Sequence: Synthetic peptide
  Seed: AIAVVGALLL (TYRP1_HUMAN)
ALAVVGALLV

SEQ ID NO: 167271 - protein, 9 aa, Artificial Sequence
  Description of Artificial Sequence: Synthetic peptide
  Seed: ENAPIGHNR (TYRP1_HUMAN)
EVAPIGHNF

SEQ ID NO: 167272 - protein, 9 aa, Artificial Sequence
  Description of Artificial Sequence: Synthetic peptide
  Seed: QRLPEPQDV (TYRP1_HUMAN)
QHLPEPQDL

SEQ ID NO: 167273 - protein, 9 aa, Artificial Sequence
  Description of Artificial Sequence: Synthetic peptide
  Seed: YNYFVWTHY (TYRP1_HUMAN)
YKYFVWTHL

SEQ ID NO: 167274 - protein, 9 aa, Artificial Sequence
  Description of Artificial Sequence: Synthetic peptide
  Seed: FSVPEIIAI (TYRP1_HUMAN)
FWVPEIIAL

SEQ ID NO: 167275 - protein, 9 aa, Artificial Sequence
  Description of Artificial Sequence: Synthetic peptide
  Seed: NADISTFPL (TYRP1_HUMAN)
NVDISTFPF

SEQ ID NO: 167276 - protein, 9 aa, Artificial Sequence
  Description of Artificial Sequence: Synthetic peptide
  Seed: RYNADISTF (TYRP1_HUMAN)
RYNADISTI

SEQ ID NO: 167277 - protein, 10 aa, Artificial Sequence
  Description of Artificial Sequence: Synthetic peptide
  Seed: FWPPVTNTEM (TYRP1_HUMAN)
FNPPVTNTEM

SEQ ID NO: 167278 - protein, 8 aa, Artificial Sequence
  Description of Artificial Sequence: Synthetic peptide
  Seed: YSDPTGKY (TYRP1_HUMAN)
YLDPTGKV

SEQ ID NO: 167279 - protein, 10 aa, Artificial Sequence
  Description of Artificial Sequence: Synthetic peptide
  Seed: YNMVPFWPPV (TYRP1_HUMAN)
YKMVPFWPPV

SEQ ID NO: 167280 - protein, 10 aa, Artificial Sequence
  Description of Artificial Sequence: Synthetic peptide
  Seed: RSMDEANQPL (TYRP1_HUMAN)
RYMDEANQPY

SEQ ID NO: 167281 - protein, 9 aa, Artificial Sequence
  Description of Artificial Sequence: Synthetic peptide
  Seed: KYDPAVRSL (TYRP1_HUMAN)
KCDPAVRSF

SEQ ID NO: 167282 - protein, 9 aa, Artificial Sequence
  Description of Artificial Sequence: Synthetic peptide
  Seed: YLIRARRSM (TYRP1_HUMAN)
YSIRARRSY

SEQ ID NO: 167283 - protein, 9 aa, Artificial Sequence
  Description of Artificial Sequence: Synthetic peptide
  Seed: RVLIVRRNL (TYRP1_HUMAN)
RTLIVRRNM

SEQ ID NO: 167284 - protein, 9 aa, Artificial Sequence
  Description of Artificial Sequence: Synthetic peptide
  Seed: SVFSQWRVV (TYRP1_HUMAN)
SMFSQWRVI

SEQ ID NO: 167285 - protein, 9 aa, Artificial Sequence
  Description of Artificial Sequence: Synthetic peptide
  Seed: MSAPKLLSL (TYRP1_HUMAN)
MDAPKLLSM

SEQ ID NO: 167286 - protein, 10 aa, Artificial Sequence
  Description of Artificial Sequence: Synthetic peptide
  Seed: KLLSLGCIFF (TYRP1_HUMAN)
KMLSLGCIFM

SEQ ID NO: 167287 - protein, 9 aa, Artificial Sequence
  Description of Artificial Sequence: Synthetic peptide
  Seed: KYDPAVRSL (TYRP1_HUMAN)
KTDPAVRSY

SEQ ID NO: 167288 - protein, 9 aa, Artificial Sequence
  Description of Artificial Sequence: Synthetic peptide
  Seed: AVVGALLLV (TYRP1_HUMAN)
AAVGALLLM

SEQ ID NO: 167289 - protein, 9 aa, Artificial Sequence
  Description of Artificial Sequence: Synthetic peptide
  Seed: FPRQCATVE (TYRP1_HUMAN)
FPRQCATVS

SEQ ID NO: 167290 - protein, 10 aa, Artificial Sequence
  Description of Artificial Sequence: Synthetic peptide
  Seed: TASYLIRARR (TYRP1_HUMAN)
TMSYLIRARR

SEQ ID NO: 167291 - protein, 11 aa, Artificial Sequence
  Description of Artificial Sequence: Synthetic peptide
  Seed: RLPEPQDVAQC (TYRP1_HUMAN)
RQPEPQDVAQL

SEQ ID NO: 167292 - protein, 10 aa, Artificial Sequence
  Description of Artificial Sequence: Synthetic peptide
  Seed: YEIQWPSREF (TYRP1_HUMAN)
YIIQWPSREF

SEQ ID NO: 167293 - protein, 8 aa, Artificial Sequence
  Description of Artificial Sequence: Synthetic peptide
  Seed: REVWPLRF (TYRP1_HUMAN)
REVWPLRL

SEQ ID NO: 167294 - protein, 9 aa, Artificial Sequence
  Description of Artificial Sequence: Synthetic peptide
  Seed: SVKKTFLGV (TYRP1_HUMAN)
SSKKTFLGK

SEQ ID NO: 167295 - protein, 9 aa, Artificial Sequence
  Description of Artificial Sequence: Synthetic peptide
  Seed: CIFFPLLLF (TYRP1_HUMAN)
CQFFPLLLL

SEQ ID NO: 167296 - protein, 9 aa, Artificial Sequence
  Description of Artificial Sequence: Synthetic peptide
  Seed: HEGPAFLTW (TYRP1_HUMAN)
HSGPAFLTM

SEQ ID NO: 167297 - protein, 9 aa, Artificial Sequence
  Description of Artificial Sequence: Synthetic peptide
  Seed: HLSPNDPIF (TYRP1_HUMAN)
HHSPNDPII

SEQ ID NO: 167298 - protein, 9 aa, Artificial Sequence
  Description of Artificial Sequence: Synthetic peptide
  Seed: CIFFPLLLF (TYRP1_HUMAN)
CKFFPLLLM

SEQ ID NO: 167299 - protein, 9 aa, Artificial Sequence
  Description of Artificial Sequence: Synthetic peptide
  Seed: VARPMVQRL (TYRP1_HUMAN)
VFRPMVQRF

SEQ ID NO: 167300 - protein, 9 aa, Artificial Sequence
  Description of Artificial Sequence: Synthetic peptide
  Seed: FTDAVFDEW (TYRP1_HUMAN)
FVDAVFDEI

SEQ ID NO: 167301 - protein, 10 aa, Artificial Sequence
  Description of Artificial Sequence: Synthetic peptide
  Seed: SMDEANQPLL (TYRP1_HUMAN)
SGDEANQPLM

SEQ ID NO: 167302 - protein, 9 aa, Artificial Sequence
  Description of Artificial Sequence: Synthetic peptide
  Seed: IAVVGALLL (TYRP1_HUMAN)
IHVVGALLF

SEQ ID NO: 167303 - protein, 10 aa, Artificial Sequence
  Description of Artificial Sequence: Synthetic peptide
  Seed: RSLHNLAHLF (TYRP1_HUMAN)
RALHNLAHLW

SEQ ID NO: 167304 - protein, 9 aa, Artificial Sequence
  Description of Artificial Sequence: Synthetic peptide
  Seed: RQCATVEAL (TYRP1_HUMAN)
RSCATVEAY

SEQ ID NO: 167305 - protein, 11 aa, Artificial Sequence
  Description of Artificial Sequence: Synthetic peptide
  Seed: FLNGTGGQTHL (TYRP1_HUMAN)
FVNGTGGQTHL

SEQ ID NO: 167306 - protein, 10 aa, Artificial Sequence
  Description of Artificial Sequence: Synthetic peptide
  Seed: FVLLHTFTDA (TYRP1_HUMAN)
FKLLHTFTDL

SEQ ID NO: 167307 - protein, 9 aa, Artificial Sequence
  Description of Artificial Sequence: Synthetic peptide
  Seed: RTTHPLFVI (TYRP1_HUMAN)
RMTHPLFVY

SEQ ID NO: 167308 - protein, 10 aa, Artificial Sequence
  Description of Artificial Sequence: Synthetic peptide
  Seed: ASYLIRARRS (TYRP1_HUMAN)
AYYLIRARRR

SEQ ID NO: 167309 - protein, 9 aa, Artificial Sequence
  Description of Artificial Sequence: Synthetic peptide
  Seed: SVFSQWRVV (TYRP1_HUMAN)
STFSQWRVY

SEQ ID NO: 167310 - protein, 10 aa, Artificial Sequence
  Description of Artificial Sequence: Synthetic peptide
  Seed: AVFDEWLRRY (TYRP1_HUMAN)
ACFDEWLRRW

SEQ ID NO: 167311 - protein, 9 aa, Artificial Sequence
  Description of Artificial Sequence: Synthetic peptide
  Seed: TTHPLFVIA (TYRP1_HUMAN)
TPHPLFVIS

SEQ ID NO: 167312 - protein, 11 aa, Artificial Sequence
  Description of Artificial Sequence: Synthetic peptide
  Seed: VRSLHNLAHLF (TYRP1_HUMAN)
VASLHNLAHLW

SEQ ID NO: 167313 - protein, 9 aa, Artificial Sequence
  Description of Artificial Sequence: Synthetic peptide
  Seed: RPHSPQYPH (TYRP1_HUMAN)
RPHSPQYPL

SEQ ID NO: 167314 - protein, 9 aa, Artificial Sequence
  Description of Artificial Sequence: Synthetic peptide
  Seed: LHNLAHLFL (TYRP1_HUMAN)
LHNLAHLFF

SEQ ID NO: 167315 - protein, 10 aa, Artificial Sequence
  Description of Artificial Sequence: Synthetic peptide
  Seed: FLNGTGGQTH (TYRP1_HUMAN)
FLNGTGGQTM

SEQ ID NO: 167316 - protein, 9 aa, Artificial Sequence
  Description of Artificial Sequence: Synthetic peptide
  Seed: STEDGPIRR (TYRP1_HUMAN)
SMEDGPIRY

SEQ ID NO: 167317 - protein, 9 aa, Artificial Sequence
  Description of Artificial Sequence: Synthetic peptide
  Seed: FSHEGPAFL (TYRP1_HUMAN)
FQHEGPAFW

SEQ ID NO: 167318 - protein, 9 aa, Artificial Sequence
  Description of Artificial Sequence: Synthetic peptide
  Seed: RSLHNLAHL (TYRP1_HUMAN)
RKLHNLAHF

SEQ ID NO: 167319 - protein, 9 aa, Artificial Sequence
  Description of Artificial Sequence: Synthetic peptide
  Seed: AQFPRQCAT (TYRP1_HUMAN)
AMFPRQCAI

SEQ ID NO: 167320 - protein, 9 aa, Artificial Sequence
  Description of Artificial Sequence: Synthetic peptide
  Seed: ALIFGTASY (TYRP1_HUMAN)
AAIFGTASF

SEQ ID NO: 167321 - protein, 10 aa, Artificial Sequence
  Description of Artificial Sequence: Synthetic peptide
  Seed: ADSRPHSPQY (TYRP1_HUMAN)
ALSRPHSPQV

SEQ ID NO: 167322 - protein, 9 aa, Artificial Sequence
  Description of Artificial Sequence: Synthetic peptide
  Seed: AACDQRVLI (TYRP1_HUMAN)
ALCDQRVLW

SEQ ID NO: 167323 - protein, 9 aa, Artificial Sequence
  Description of Artificial Sequence: Synthetic peptide
  Seed: RTTHPLFVI (TYRP1_HUMAN)
RLTHPLFVY

SEQ ID NO: 167324 - protein, 9 aa, Artificial Sequence
  Description of Artificial Sequence: Synthetic peptide
  Seed: SPNDPIFVL (TYRP1_HUMAN)
SHNDPIFVF

SEQ ID NO: 167325 - protein, 10 aa, Artificial Sequence
  Description of Artificial Sequence: Synthetic peptide
  Seed: RQCATVEALR (TYRP1_HUMAN)
RMCATVEALK

SEQ ID NO: 167326 - protein, 9 aa, Artificial Sequence
  Description of Artificial Sequence: Synthetic peptide
  Seed: SLHNLAHLF (TYRP1_HUMAN)
SMHNLAHLA

SEQ ID NO: 167327 - protein, 10 aa, Artificial Sequence
  Description of Artificial Sequence: Synthetic peptide
  Seed: YEIQWPSREF (TYRP1_HUMAN)
YTIQWPSREY

SEQ ID NO: 167328 - protein, 11 aa, Artificial Sequence
  Description of Artificial Sequence: Synthetic peptide
  Seed: EILGPDGNTPQ (TYRP1_HUMAN)
ESLGPDGNTPR

SEQ ID NO: 167329 - protein, 9 aa, Artificial Sequence
  Description of Artificial Sequence: Synthetic peptide
  Seed: LLHTFTDAV (TYRP1_HUMAN)
LMHTFTDAI

SEQ ID NO: 167330 - protein, 8 aa, Artificial Sequence
  Description of Artificial Sequence: Synthetic peptide
  Seed: YDPAVRSL (TYRP1_HUMAN)
YIPAVRSL

SEQ ID NO: 167331 - protein, 10 aa, Artificial Sequence
  Description of Artificial Sequence: Synthetic peptide
  Seed: FYSNSTNSFR (TYRP1_HUMAN)
FWSNSTNSFF

SEQ ID NO: 167332 - protein, 10 aa, Artificial Sequence
  Description of Artificial Sequence: Synthetic peptide
  Seed: YEIQWPSREF (TYRP1_HUMAN)
YQIQWPSREL

SEQ ID NO: 167333 - protein, 9 aa, Artificial Sequence
  Description of Artificial Sequence: Synthetic peptide
  Seed: SVPEIIAIA (TYRP1_HUMAN)
SSPEIIAIM

SEQ ID NO: 167334 - protein, 9 aa, Artificial Sequence
  Description of Artificial Sequence: Synthetic peptide
  Seed: NFDSTLISP (TYRP1_HUMAN)
NSDSTLISL

SEQ ID NO: 167335 - protein, 10 aa, Artificial Sequence
  Description of Artificial Sequence: Synthetic peptide
  Seed: TAPDNLGYTY (TYRP1_HUMAN)
TTPDNLGYTF

SEQ ID NO: 167336 - protein, 10 aa, Artificial Sequence
  Description of Artificial Sequence: Synthetic peptide
  Seed: YNMVPFWPPV (TYRP1_HUMAN)
YIMVPFWPPM

SEQ ID NO: 167337 - protein, 10 aa, Artificial Sequence
  Description of Artificial Sequence: Synthetic peptide
  Seed: MQEMLQEPSF (TYRP1_HUMAN)
MEEMLQEPSL

SEQ ID NO: 167338 - protein, 9 aa, Artificial Sequence
  Description of Artificial Sequence: Synthetic peptide
  Seed: AIAVVGALL (TYRP1_HUMAN)
AAAVVGALY

SEQ ID NO: 167339 - protein, 11 aa, Artificial Sequence
  Description of Artificial Sequence: Synthetic peptide
  Seed: VRSLHNLAHLF (TYRP1_HUMAN)
VHSLHNLAHLW

SEQ ID NO: 167340 - protein, 11 aa, Artificial Sequence
  Description of Artificial Sequence: Synthetic peptide
  Seed: FPLLLFQQARA (TYRP1_HUMAN)
FALLLFQQARV

SEQ ID NO: 167341 - protein, 9 aa, Artificial Sequence
  Description of Artificial Sequence: Synthetic peptide
  Seed: FYSNSTNSF (TYRP1_HUMAN)
FESNSTNSF

SEQ ID NO: 167342 - protein, 9 aa, Artificial Sequence
  Description of Artificial Sequence: Synthetic peptide
  Seed: LHNLAHLFL (TYRP1_HUMAN)
LQNLAHLFY

SEQ ID NO: 167343 - protein, 9 aa, Artificial Sequence
  Description of Artificial Sequence: Synthetic peptide
  Seed: ACDQRVLIV (TYRP1_HUMAN)
AFDQRVLIF

SEQ ID NO: 167344 - protein, 10 aa, Artificial Sequence
  Description of Artificial Sequence: Synthetic peptide
  Seed: EDYDTLGTLC (TYRP1_HUMAN)
EEYDTLGTLV

SEQ ID NO: 167345 - protein, 9 aa, Artificial Sequence
  Description of Artificial Sequence: Synthetic peptide
  Seed: RYHLLRLEK (TYRP1_HUMAN)
RLHLLRLEK

SEQ ID NO: 167346 - protein, 9 aa, Artificial Sequence
  Description of Artificial Sequence: Synthetic peptide
  Seed: EIQWPSREF (TYRP1_HUMAN)
EVQWPSREF

SEQ ID NO: 167347 - protein, 9 aa, Artificial Sequence
  Description of Artificial Sequence: Synthetic peptide
  Seed: SFSLPYWNF (TYRP1_HUMAN)
SLSLPYWNY

SEQ ID NO: 167348 - protein, 10 aa, Artificial Sequence
  Description of Artificial Sequence: Synthetic peptide
  Seed: RQCATVEALR (TYRP1_HUMAN)
RICATVEALR

SEQ ID NO: 167349 - protein, 9 aa, Artificial Sequence
  Description of Artificial Sequence: Synthetic peptide
  Seed: EEYEKLQNP (TYRP1_HUMAN)
EDYEKLQNF

SEQ ID NO: 167350 - protein, 9 aa, Artificial Sequence
  Description of Artificial Sequence: Synthetic peptide
  Seed: TTHPLFVIA (TYRP1_HUMAN)
TGHPLFVIY

SEQ ID NO: 167351 - protein, 10 aa, Artificial Sequence
  Description of Artificial Sequence: Synthetic peptide
  Seed: IQWPSREFSV (TYRP1_HUMAN)
ILWPSREFSM

SEQ ID NO: 167352 - protein, 10 aa, Artificial Sequence
  Description of Artificial Sequence: Synthetic peptide
  Seed: ALIFGTASYL (TYRP1_HUMAN)
ARIFGTASYY

SEQ ID NO: 167353 - protein, 8 aa, Artificial Sequence
  Description of Artificial Sequence: Synthetic peptide
  Seed: YDPAVRSL (TYRP1_HUMAN)
YQPAVRSV

SEQ ID NO: 167354 - protein, 9 aa, Artificial Sequence
  Description of Artificial Sequence: Synthetic peptide
  Seed: SLHNLAHLF (TYRP1_HUMAN)
STHNLAHLW

SEQ ID NO: 167355 - protein, 9 aa, Artificial Sequence
  Description of Artificial Sequence: Synthetic peptide
  Seed: LHNLAHLFL (TYRP1_HUMAN)
LMNLAHLFM

SEQ ID NO: 167356 - protein, 9 aa, Artificial Sequence
  Description of Artificial Sequence: Synthetic peptide
  Seed: HEGPAFLTW (TYRP1_HUMAN)
HTGPAFLTY

SEQ ID NO: 167357 - protein, 9 aa, Artificial Sequence
  Description of Artificial Sequence: Synthetic peptide
  Seed: FPLLLFQQA (TYRP1_HUMAN)
FPLLLFQQM

SEQ ID NO: 167358 - protein, 10 aa, Artificial Sequence
  Description of Artificial Sequence: Synthetic peptide
  Seed: FVLLHTFTDA (TYRP1_HUMAN)
FPLLHTFTDL

SEQ ID NO: 167359 - protein, 10 aa, Artificial Sequence
  Description of Artificial Sequence: Synthetic peptide
  Seed: LGPDGNTPQF (TYRP1_HUMAN)
LQPDGNTPQY

SEQ ID NO: 167360 - protein, 9 aa, Artificial Sequence
  Description of Artificial Sequence: Synthetic peptide
  Seed: YTYEIQWPS (TYRP1_HUMAN)
YTYEIQWPH

SEQ ID NO: 167361 - protein, 9 aa, Artificial Sequence
  Description of Artificial Sequence: Synthetic peptide
  Seed: MLQEPSFSL (TYRP1_HUMAN)
MPQEPSFSV

SEQ ID NO: 167362 - protein, 9 aa, Artificial Sequence
  Description of Artificial Sequence: Synthetic peptide
  Seed: MLQEPSFSL (TYRP1_HUMAN)
MRQEPSFSY

SEQ ID NO: 167363 - protein, 9 aa, Artificial Sequence
  Description of Artificial Sequence: Synthetic peptide
  Seed: HLSPNDPIF (TYRP1_HUMAN)
HPSPNDPIY

SEQ ID NO: 167364 - protein, 9 aa, Artificial Sequence
  Description of Artificial Sequence: Synthetic peptide
  Seed: NADISTFPL (TYRP1_HUMAN)
NVDISTFPI

SEQ ID NO: 167365 - protein, 9 aa, Artificial Sequence
  Description of Artificial Sequence: Synthetic peptide
  Seed: FSHEGPAFL (TYRP1_HUMAN)
FAHEGPAFR

SEQ ID NO: 167366 - protein, 9 aa, Artificial Sequence
  Description of Artificial Sequence: Synthetic peptide
  Seed: MSAPKLLSL (TYRP1_HUMAN)
MGAPKLLSI

SEQ ID NO: 167367 - protein, 9 aa, Artificial Sequence
  Description of Artificial Sequence: Synthetic peptide
  Seed: IYNYFVWTH (TYRP1_HUMAN)
IINYFVWTK

SEQ ID NO: 167368 - protein, 9 aa, Artificial Sequence
  Description of Artificial Sequence: Synthetic peptide
  Seed: MCCPDLSPV (TYRP1_HUMAN)
MACPDLSPA

SEQ ID NO: 167369 - protein, 9 aa, Artificial Sequence
  Description of Artificial Sequence: Synthetic peptide
  Seed: FSVPEIIAI (TYRP1_HUMAN)
FQVPEIIAV

SEQ ID NO: 167370 - protein, 9 aa, Artificial Sequence
  Description of Artificial Sequence: Synthetic peptide
  Seed: AVFDEWLRR (TYRP1_HUMAN)
ATFDEWLRF

SEQ ID NO: 167371 - protein, 10 aa, Artificial Sequence
  Description of Artificial Sequence: Synthetic peptide
  Seed: NLAHLFLNGT (TYRP1_HUMAN)
NMAHLFLNGA

SEQ ID NO: 167372 - protein, 10 aa, Artificial Sequence
  Description of Artificial Sequence: Synthetic peptide
  Seed: IAVVGALLLV (TYRP1_HUMAN)
IVVVGALLLV

SEQ ID NO: 167373 - protein, 10 aa, Artificial Sequence
  Description of Artificial Sequence: Synthetic peptide
  Seed: GLFDTPPFYS (TYRP1_HUMAN)
GVFDTPPFYV

SEQ ID NO: 167374 - protein, 9 aa, Artificial Sequence
  Description of Artificial Sequence: Synthetic peptide
  Seed: IAIAVVGAL (TYRP1_HUMAN)
IPIAVVGAA

SEQ ID NO: 167375 - protein, 9 aa, Artificial Sequence
  Description of Artificial Sequence: Synthetic peptide
  Seed: LSPNDPIFV (TYRP1_HUMAN)
LLPNDPIFV

SEQ ID NO: 167376 - protein, 8 aa, Artificial Sequence
  Description of Artificial Sequence: Synthetic peptide
  Seed: RPGWRGAA (TYRP1_HUMAN)
RPGWRGAL

SEQ ID NO: 167377 - protein, 10 aa, Artificial Sequence
  Description of Artificial Sequence: Synthetic peptide
  Seed: TDAVFDEWLR (TYRP1_HUMAN)
TNAVFDEWLR

SEQ ID NO: 167378 - protein, 9 aa, Artificial Sequence
  Description of Artificial Sequence: Synthetic peptide
  Seed: FSHEGPAFL (TYRP1_HUMAN)
FNHEGPAFV

SEQ ID NO: 167379 - protein, 10 aa, Artificial Sequence
  Description of Artificial Sequence: Synthetic peptide
  Seed: FVWTHYYSVK (TYRP1_HUMAN)
FLWTHYYSVE

SEQ ID NO: 167380 - protein, 9 aa, Artificial Sequence
  Description of Artificial Sequence: Synthetic peptide
  Seed: FLNGTGGQT (TYRP1_HUMAN)
FMNGTGGQL

SEQ ID NO: 167381 - protein, 10 aa, Artificial Sequence
  Description of Artificial Sequence: Synthetic peptide
  Seed: HPLFVIATRR (TYRP1_HUMAN)
HALFVIATRR

SEQ ID NO: 167382 - protein, 9 aa, Artificial Sequence
  Description of Artificial Sequence: Synthetic peptide
  Seed: MLQEPSFSL (TYRP1_HUMAN)
MSQEPSFSF

SEQ ID NO: 167383 - protein, 10 aa, Artificial Sequence
  Description of Artificial Sequence: Synthetic peptide
  Seed: EGYSDPTGKY (TYRP1_HUMAN)
EVYSDPTGKK

SEQ ID NO: 167384 - protein, 10 aa, Artificial Sequence
  Description of Artificial Sequence: Synthetic peptide
  Seed: LTWHRYHLLR (TYRP1_HUMAN)
LSWHRYHLLK

SEQ ID NO: 167385 - protein, 10 aa, Artificial Sequence
  Description of Artificial Sequence: Synthetic peptide
  Seed: ALIFGTASYL (TYRP1_HUMAN)
AFIFGTASYV

SEQ ID NO: 167386 - protein, 9 aa, Artificial Sequence
  Description of Artificial Sequence: Synthetic peptide
  Seed: FYSNSTNSF (TYRP1_HUMAN)
FVSNSTNSM

SEQ ID NO: 167387 - protein, 9 aa, Artificial Sequence
  Description of Artificial Sequence: Synthetic peptide
  Seed: AKRTTHPLF (TYRP1_HUMAN)
AIRTTHPLF

SEQ ID NO: 167388 - protein, 10 aa, Artificial Sequence
  Description of Artificial Sequence: Synthetic peptide
  Seed: FWPPVTNTEM (TYRP1_HUMAN)
FGPPVTNTEI

SEQ ID NO: 167389 - protein, 9 aa, Artificial Sequence
  Description of Artificial Sequence: Synthetic peptide
  Seed: TLISPNSVF (TYRP1_HUMAN)
TAISPNSVL

SEQ ID NO: 167390 - protein, 9 aa, Artificial Sequence
  Description of Artificial Sequence: Synthetic peptide
  Seed: LLVALIFGT (TYRP1_HUMAN)
LAVALIFGV

SEQ ID NO: 167391 - protein, 10 aa, Artificial Sequence
  Description of Artificial Sequence: Synthetic peptide
  Seed: NYFVWTHYYS (TYRP1_HUMAN)
NFFVWTHYYK

SEQ ID NO: 167392 - protein, 10 aa, Artificial Sequence
  Description of Artificial Sequence: Synthetic peptide
  Seed: FVRALDMAKR (TYRP1_HUMAN)
FFRALDMAKR

SEQ ID NO: 167393 - protein, 9 aa, Artificial Sequence
  Description of Artificial Sequence: Synthetic peptide
  Seed: AVRSLHNLA (TYRP1_HUMAN)
AARSLHNLV

SEQ ID NO: 167394 - protein, 10 aa, Artificial Sequence
  Description of Artificial Sequence: Synthetic peptide
  Seed: YNADISTFPL (TYRP1_HUMAN)
YLADISTFPL

SEQ ID NO: 167395 - protein, 9 aa, Artificial Sequence
  Description of Artificial Sequence: Synthetic peptide
  Seed: RQYNMVPFW (TYRP1_HUMAN)
RIYNMVPFF

SEQ ID NO: 167396 - protein, 10 aa, Artificial Sequence
  Description of Artificial Sequence: Synthetic peptide
  Seed: HYYSVKKTFL (TYRP1_HUMAN)
HRYSVKKTFL

SEQ ID NO: 167397 - protein, 9 aa, Artificial Sequence
  Description of Artificial Sequence: Synthetic peptide
  Seed: KYDPAVRSL (TYRP1_HUMAN)
KIDPAVRSL

SEQ ID NO: 167398 - protein, 9 aa, Artificial Sequence
  Description of Artificial Sequence: Synthetic peptide
  Seed: NYFVWTHYY (TYRP1_HUMAN)
NLFVWTHYF

SEQ ID NO: 167399 - protein, 9 aa, Artificial Sequence
  Description of Artificial Sequence: Synthetic peptide
  Seed: FYSNSTNSF (TYRP1_HUMAN)
FISNSTNSM

SEQ ID NO: 167400 - protein, 10 aa, Artificial Sequence
  Description of Artificial Sequence: Synthetic peptide
  Seed: YNYFVWTHYY (TYRP1_HUMAN)
YWYFVWTHYW

SEQ ID NO: 167401 - protein, 9 aa, Artificial Sequence
  Description of Artificial Sequence: Synthetic peptide
  Seed: DSLEDYDTL (TYRP1_HUMAN)
DALEDYDTI

SEQ ID NO: 167402 - protein, 9 aa, Artificial Sequence
  Description of Artificial Sequence: Synthetic peptide
  Seed: WHRYHLLRL (TYRP1_HUMAN)
WMRYHLLRF

SEQ ID NO: 167403 - protein, 9 aa, Artificial Sequence
  Description of Artificial Sequence: Synthetic peptide
  Seed: RGRCEAVTA (TYRP1_HUMAN)
RTRCEAVTT

SEQ ID NO: 167404 - protein, 9 aa, Artificial Sequence
  Description of Artificial Sequence: Synthetic peptide
  Seed: MAKRTTHPL (TYRP1_HUMAN)
MAKRTTHPV

SEQ ID NO: 167405 - protein, 9 aa, Artificial Sequence
  Description of Artificial Sequence: Synthetic peptide
  Seed: LTDQYQCYA (TYRP1_HUMAN)
LADQYQCYY

SEQ ID NO: 167406 - protein, 9 aa, Artificial Sequence
  Description of Artificial Sequence: Synthetic peptide
  Seed: AFLTWHRYH (TYRP1_HUMAN)
ASLTWHRYR

SEQ ID NO: 167407 - protein, 10 aa, Artificial Sequence
  Description of Artificial Sequence: Synthetic peptide
  Seed: RSMDEANQPL (TYRP1_HUMAN)
RVMDEANQPI

SEQ ID NO: 167408 - protein, 10 aa, Artificial Sequence
  Description of Artificial Sequence: Synthetic peptide
  Seed: LIFGTASYLI (TYRP1_HUMAN)
LQFGTASYLI

SEQ ID NO: 167409 - protein, 9 aa, Artificial Sequence
  Description of Artificial Sequence: Synthetic peptide
  Seed: SVPEIIAIA (TYRP1_HUMAN)
SSPEIIAIV

SEQ ID NO: 167410 - protein, 10 aa, Artificial Sequence
  Description of Artificial Sequence: Synthetic peptide
  Seed: IYNYFVWTHY (TYRP1_HUMAN)
IYNYFVWTHI

SEQ ID NO: 167411 - protein, 9 aa, Artificial Sequence
  Description of Artificial Sequence: Synthetic peptide
  Seed: YSNSTNSFR (TYRP1_HUMAN)
YQNSTNSFR

SEQ ID NO: 167412 - protein, 10 aa, Artificial Sequence
  Description of Artificial Sequence: Synthetic peptide
  Seed: FFPLLLFQQA (TYRP1_HUMAN)
FSPLLLFQQA

SEQ ID NO: 167413 - protein, 10 aa, Artificial Sequence
  Description of Artificial Sequence: Synthetic peptide
  Seed: FVTAPDNLGY (TYRP1_HUMAN)
FYTAPDNLGW

SEQ ID NO: 167414 - protein, 9 aa, Artificial Sequence
  Description of Artificial Sequence: Synthetic peptide
  Seed: ISIYNYFVW (TYRP1_HUMAN)
ITIYNYFVL

SEQ ID NO: 167415 - protein, 10 aa, Artificial Sequence
  Description of Artificial Sequence: Synthetic peptide
  Seed: YNYFVWTHYY (TYRP1_HUMAN)
YWYFVWTHYL

SEQ ID NO: 167416 - protein, 9 aa, Artificial Sequence
  Description of Artificial Sequence: Synthetic peptide
  Seed: ALLLVALIF (TYRP1_HUMAN)
ATLLVALIW

SEQ ID NO: 167417 - protein, 9 aa, Artificial Sequence
  Description of Artificial Sequence: Synthetic peptide
  Seed: WPPVTNTEM (TYRP1_HUMAN)
WGPVTNTEL

SEQ ID NO: 167418 - protein, 9 aa, Artificial Sequence
  Description of Artificial Sequence: Synthetic peptide
  Seed: SLHNLAHLF (TYRP1_HUMAN)
STHNLAHLI

SEQ ID NO: 167419 - protein, 11 aa, Artificial Sequence
  Description of Artificial Sequence: Synthetic peptide
  Seed: HEGPAFLTWHR (TYRP1_HUMAN)
HVGPAFLTWHR

SEQ ID NO: 167420 - protein, 9 aa, Artificial Sequence
  Description of Artificial Sequence: Synthetic peptide
  Seed: SLGCIFFPL (TYRP1_HUMAN)
SSGCIFFPV

SEQ ID NO: 167421 - protein, 11 aa, Artificial Sequence
  Description of Artificial Sequence: Synthetic peptide
  Seed: YNMVPFWPPVT (TYRP1_HUMAN)
YMMVPFWPPVM

SEQ ID NO: 167422 - protein, 10 aa, Artificial Sequence
  Description of Artificial Sequence: Synthetic peptide
  Seed: YTYEIQWPSR (TYRP1_HUMAN)
YSYEIQWPSR

SEQ ID NO: 167423 - protein, 10 aa, Artificial Sequence
  Description of Artificial Sequence: Synthetic peptide
  Seed: FWPPVTNTEM (TYRP1_HUMAN)
FVPPVTNTEI

SEQ ID NO: 167424 - protein, 9 aa, Artificial Sequence
  Description of Artificial Sequence: Synthetic peptide
  Seed: FLNGTGGQT (TYRP1_HUMAN)
FINGTGGQI

SEQ ID NO: 167425 - protein, 10 aa, Artificial Sequence
  Description of Artificial Sequence: Synthetic peptide
  Seed: TFTDAVFDEW (TYRP1_HUMAN)
TYTDAVFDEW

SEQ ID NO: 167426 - protein, 9 aa, Artificial Sequence
  Description of Artificial Sequence: Synthetic peptide
  Seed: FYSNSTNSF (TYRP1_HUMAN)
FWSNSTNSI

SEQ ID NO: 167427 - protein, 9 aa, Artificial Sequence
  Description of Artificial Sequence: Synthetic peptide
  Seed: TLISPNSVF (TYRP1_HUMAN)
TFISPNSVI

SEQ ID NO: 167428 - protein, 9 aa, Artificial Sequence
  Description of Artificial Sequence: Synthetic peptide
  Seed: IAVVGALLL (TYRP1_HUMAN)
IYVVGALLM

SEQ ID NO: 167429 - protein, 10 aa, Artificial Sequence
  Description of Artificial Sequence: Synthetic peptide
  Seed: SMDEANQPLL (TYRP1_HUMAN)
STDEANQPLW

SEQ ID NO: 167430 - protein, 10 aa, Artificial Sequence
  Description of Artificial Sequence: Synthetic peptide
  Seed: LGPDGNTPQF (TYRP1_HUMAN)
LEPDGNTPQY

SEQ ID NO: 167431 - protein, 11 aa, Artificial Sequence
  Description of Artificial Sequence: Synthetic peptide
  Seed: REFSVPEIIAI (TYRP1_HUMAN)
REFSVPEIIAF

SEQ ID NO: 167432 - protein, 9 aa, Artificial Sequence
  Description of Artificial Sequence: Synthetic peptide
  Seed: SMDEANQPL (TYRP1_HUMAN)
SCDEANQPI

SEQ ID NO: 167433 - protein, 9 aa, Artificial Sequence
  Description of Artificial Sequence: Synthetic peptide
  Seed: DSRPHSPQY (TYRP1_HUMAN)
DVRPHSPQK

SEQ ID NO: 167434 - protein, 9 aa, Artificial Sequence
  Description of Artificial Sequence: Synthetic peptide
  Seed: LQNPNQSVV (TYRP1_HUMAN)
LLNPNQSVY

SEQ ID NO: 167435 - protein, 10 aa, Artificial Sequence
  Description of Artificial Sequence: Synthetic peptide
  Seed: PAVRSLHNLA (TYRP1_HUMAN)
PRVRSLHNLK

SEQ ID NO: 167436 - protein, 9 aa, Artificial Sequence
  Description of Artificial Sequence: Synthetic peptide
  Seed: TADSRPHSP (TYRP1_HUMAN)
TCDSRPHSM

SEQ ID NO: 167437 - protein, 9 aa, Artificial Sequence
  Description of Artificial Sequence: Synthetic peptide
  Seed: RTTHPLFVI (TYRP1_HUMAN)
RQTHPLFVF

SEQ ID NO: 167438 - protein, 9 aa, Artificial Sequence
  Description of Artificial Sequence: Synthetic peptide
  Seed: RPMVQRLPE (TYRP1_HUMAN)
RVMVQRLPL

SEQ ID NO: 167439 - protein, 10 aa, Artificial Sequence
  Description of Artificial Sequence: Synthetic peptide
  Seed: YNYFVWTHYY (TYRP1_HUMAN)
YFYFVWTHYK

SEQ ID NO: 167440 - protein, 10 aa, Artificial Sequence
  Description of Artificial Sequence: Synthetic peptide
  Seed: ENISIYNYFV (TYRP1_HUMAN)
EIISIYNYFL

SEQ ID NO: 167441 - protein, 9 aa, Artificial Sequence
  Description of Artificial Sequence: Synthetic peptide
  Seed: ENISIYNYF (TYRP1_HUMAN)
EVISIYNYF

SEQ ID NO: 167442 - protein, 9 aa, Artificial Sequence
  Description of Artificial Sequence: Synthetic peptide
  Seed: KYDPAVRSL (TYRP1_HUMAN)
KSDPAVRSF

SEQ ID NO: 167443 - protein, 10 aa, Artificial Sequence
  Description of Artificial Sequence: Synthetic peptide
  Seed: IAVVGALLLV (TYRP1_HUMAN)
IHVVGALLLV

SEQ ID NO: 167444 - protein, 9 aa, Artificial Sequence
  Description of Artificial Sequence: Synthetic peptide
  Seed: ALLLVALIF (TYRP1_HUMAN)
AMLLVALIY

SEQ ID NO: 167445 - protein, 9 aa, Artificial Sequence
  Description of Artificial Sequence: Synthetic peptide
  Seed: FSHEGPAFL (TYRP1_HUMAN)
FIHEGPAFL

SEQ ID NO: 167446 - protein, 10 aa, Artificial Sequence
  Description of Artificial Sequence: Synthetic peptide
  Seed: WPPVTNTEMF (TYRP1_HUMAN)
WQPVTNTEMW

SEQ ID NO: 167447 - protein, 9 aa, Artificial Sequence
  Description of Artificial Sequence: Synthetic peptide
  Seed: WHRYHLLRL (TYRP1_HUMAN)
WARYHLLRY

SEQ ID NO: 167448 - protein, 9 aa, Artificial Sequence
  Description of Artificial Sequence: Synthetic peptide
  Seed: KLLSLGCIF (TYRP1_HUMAN)
KMLSLGCIF

SEQ ID NO: 167449 - protein, 9 aa, Artificial Sequence
  Description of Artificial Sequence: Synthetic peptide
  Seed: RVLIVRRNL (TYRP1_HUMAN)
RILIVRRNK

SEQ ID NO: 167450 - protein, 10 aa, Artificial Sequence
  Description of Artificial Sequence: Synthetic peptide
  Seed: FGTASYLIRA (TYRP1_HUMAN)
FKTASYLIRI

SEQ ID NO: 167451 - protein, 9 aa, Artificial Sequence
  Description of Artificial Sequence: Synthetic peptide
  Seed: LIFGTASYL (TYRP1_HUMAN)
LGFGTASYF

SEQ ID NO: 167452 - protein, 11 aa, Artificial Sequence
  Description of Artificial Sequence: Synthetic peptide
  Seed: YNYFVWTHYYS (TYRP1_HUMAN)
YMYFVWTHYYF

SEQ ID NO: 167453 - protein, 9 aa, Artificial Sequence
  Description of Artificial Sequence: Synthetic peptide
  Seed: TGKYDPAVR (TYRP1_HUMAN)
TTKYDPAVR

SEQ ID NO: 167454 - protein, 9 aa, Artificial Sequence
  Description of Artificial Sequence: Synthetic peptide
  Seed: DNLGYTYEI (TYRP1_HUMAN)
DSLGYTYEL

SEQ ID NO: 167455 - protein, 10 aa, Artificial Sequence
  Description of Artificial Sequence: Synthetic peptide
  Seed: AVFDEWLRRY (TYRP1_HUMAN)
AIFDEWLRRF

SEQ ID NO: 167456 - protein, 10 aa, Artificial Sequence
  Description of Artificial Sequence: Synthetic peptide
  Seed: ISPNSVFSQW (TYRP1_HUMAN)
INPNSVFSQW

SEQ ID NO: 167457 - protein, 10 aa, Artificial Sequence
  Description of Artificial Sequence: Synthetic peptide
  Seed: SQWRVVCDSL (TYRP1_HUMAN)
SMWRVVCDSY

SEQ ID NO: 167458 - protein, 9 aa, Artificial Sequence
  Description of Artificial Sequence: Synthetic peptide
  Seed: SVPEIIAIA (TYRP1_HUMAN)
SVPEIIAIL

SEQ ID NO: 167459 - protein, 9 aa, Artificial Sequence
  Description of Artificial Sequence: Synthetic peptide
  Seed: KYDPAVRSL (TYRP1_HUMAN)
KMDPAVRSR

SEQ ID NO: 167460 - protein, 9 aa, Artificial Sequence
  Description of Artificial Sequence: Synthetic peptide
  Seed: ALIFGTASY (TYRP1_HUMAN)
ATIFGTASY

SEQ ID NO: 167461 - protein, 9 aa, Artificial Sequence
  Description of Artificial Sequence: Synthetic peptide
  Seed: FSHEGPAFL (TYRP1_HUMAN)
FQHEGPAFL

SEQ ID NO: 167462 - protein, 9 aa, Artificial Sequence
  Description of Artificial Sequence: Synthetic peptide
  Seed: KYDPAVRSL (TYRP1_HUMAN)
KWDPAVRSW

SEQ ID NO: 167463 - protein, 9 aa, Artificial Sequence
  Description of Artificial Sequence: Synthetic peptide
  Seed: HYYSVKKTF (TYRP1_HUMAN)
HIYSVKKTM

SEQ ID NO: 167464 - protein, 8 aa, Artificial Sequence
  Description of Artificial Sequence: Synthetic peptide
  Seed: IFFPLLLF (TYRP1_HUMAN)
IFFPLLLY

SEQ ID NO: 167465 - protein, 9 aa, Artificial Sequence
  Description of Artificial Sequence: Synthetic peptide
  Seed: RGRCEAVTA (TYRP1_HUMAN)
RIRCEAVTI

SEQ ID NO: 167466 - protein, 9 aa, Artificial Sequence
  Description of Artificial Sequence: Synthetic peptide
  Seed: SPNDPIFVL (TYRP1_HUMAN)
SSNDPIFVY

SEQ ID NO: 167467 - protein, 9 aa, Artificial Sequence
  Description of Artificial Sequence: Synthetic peptide
  Seed: DYDTLGTLC (TYRP1_HUMAN)
DFDTLGTLM

SEQ ID NO: 167468 - protein, 9 aa, Artificial Sequence
  Description of Artificial Sequence: Synthetic peptide
  Seed: LTDQYQCYA (TYRP1_HUMAN)
LMDQYQCYL

SEQ ID NO: 167469 - protein, 10 aa, Artificial Sequence
  Description of Artificial Sequence: Synthetic peptide
  Seed: ALIFGTASYL (TYRP1_HUMAN)
AIIFGTASYF

SEQ ID NO: 167470 - protein, 9 aa, Artificial Sequence
  Description of Artificial Sequence: Synthetic peptide
  Seed: RYNADISTF (TYRP1_HUMAN)
RWNADISTL

SEQ ID NO: 167471 - protein, 10 aa, Artificial Sequence
  Description of Artificial Sequence: Synthetic peptide
  Seed: DQYQCYAEEY (TYRP1_HUMAN)
DEYQCYAEEM

SEQ ID NO: 167472 - protein, 9 aa, Artificial Sequence
  Description of Artificial Sequence: Synthetic peptide
  Seed: LHNLAHLFL (TYRP1_HUMAN)
LSNLAHLFY

SEQ ID NO: 167473 - protein, 9 aa, Artificial Sequence
  Description of Artificial Sequence: Synthetic peptide
  Seed: NYFVWTHYY (TYRP1_HUMAN)
NSFVWTHYK

SEQ ID NO: 167474 - protein, 9 aa, Artificial Sequence
  Description of Artificial Sequence: Synthetic peptide
  Seed: FTDAVFDEW (TYRP1_HUMAN)
FLDAVFDEY

SEQ ID NO: 167475 - protein, 9 aa, Artificial Sequence
  Description of Artificial Sequence: Synthetic peptide
  Seed: GPDGNTPQF (TYRP1_HUMAN)
GFDGNTPQF

SEQ ID NO: 167476 - protein, 9 aa, Artificial Sequence
  Description of Artificial Sequence: Synthetic peptide
  Seed: MCCPDLSPV (TYRP1_HUMAN)
MSCPDLSPA

SEQ ID NO: 167477 - protein, 9 aa, Artificial Sequence
  Description of Artificial Sequence: Synthetic peptide
  Seed: RDDREVWPL (TYRP1_HUMAN)
REDREVWPM

SEQ ID NO: 167478 - protein, 10 aa, Artificial Sequence
  Description of Artificial Sequence: Synthetic peptide
  Seed: YEIQWPSREF (TYRP1_HUMAN)
YVIQWPSREY

SEQ ID NO: 167479 - protein, 9 aa, Artificial Sequence
  Description of Artificial Sequence: Synthetic peptide
  Seed: TPPFYSNST (TYRP1_HUMAN)
TPPFYSNSA

SEQ ID NO: 167480 - protein, 10 aa, Artificial Sequence
  Description of Artificial Sequence: Synthetic peptide
  Seed: SHEGPAFLTW (TYRP1_HUMAN)
SCEGPAFLTW

SEQ ID NO: 167481 - protein, 9 aa, Artificial Sequence
  Description of Artificial Sequence: Synthetic peptide
  Seed: TADSRPHSP (TYRP1_HUMAN)
TDDSRPHSL

SEQ ID NO: 167482 - protein, 8 aa, Artificial Sequence
  Description of Artificial Sequence: Synthetic peptide
  Seed: YSDPTGKY (TYRP1_HUMAN)
YSDPTGKV

SEQ ID NO: 167483 - protein, 8 aa, Artificial Sequence
  Description of Artificial Sequence: Synthetic peptide
  Seed: YSNSTNSF (TYRP1_HUMAN)
YSNSTNSM

SEQ ID NO: 167484 - protein, 9 aa, Artificial Sequence
  Description of Artificial Sequence: Synthetic peptide
  Seed: RQCATVEAL (TYRP1_HUMAN)
RHCATVEAM

SEQ ID NO: 167485 - protein, 10 aa, Artificial Sequence
  Description of Artificial Sequence: Synthetic peptide
  Seed: VGLFDTPPFY (TYRP1_HUMAN)
VMLFDTPPFY

SEQ ID NO: 167486 - protein, 9 aa, Artificial Sequence
  Description of Artificial Sequence: Synthetic peptide
  Seed: WPPVTNTEM (TYRP1_HUMAN)
WAPVTNTEY

SEQ ID NO: 167487 - protein, 9 aa, Artificial Sequence
  Description of Artificial Sequence: Synthetic peptide
  Seed: SLHNLAHLF (TYRP1_HUMAN)
SRHNLAHLI

SEQ ID NO: 167488 - protein, 10 aa, Artificial Sequence
  Description of Artificial Sequence: Synthetic peptide
  Seed: RRYNADISTF (TYRP1_HUMAN)
RRYNADISTY

SEQ ID NO: 167489 - protein, 11 aa, Artificial Sequence
  Description of Artificial Sequence: Synthetic peptide
  Seed: DICTDDLMGSR (TYRP1_HUMAN)
DVCTDDLMGSR

SEQ ID NO: 167490 - protein, 9 aa, Artificial Sequence
  Description of Artificial Sequence: Synthetic peptide
  Seed: LFQQARAQF (TYRP1_HUMAN)
LHQQARAQY

SEQ ID NO: 167491 - protein, 9 aa, Artificial Sequence
  Description of Artificial Sequence: Synthetic peptide
  Seed: RQYNMVPFW (TYRP1_HUMAN)
RQYNMVPFA

SEQ ID NO: 167492 - protein, 10 aa, Artificial Sequence
  Description of Artificial Sequence: Synthetic peptide
  Seed: FTDAVFDEWL (TYRP1_HUMAN)
FLDAVFDEWL

SEQ ID NO: 167493 - protein, 9 aa, Artificial Sequence
  Description of Artificial Sequence: Synthetic peptide
  Seed: KYDPAVRSL (TYRP1_HUMAN)
KLDPAVRSV

SEQ ID NO: 167494 - protein, 9 aa, Artificial Sequence
  Description of Artificial Sequence: Synthetic peptide
  Seed: RSNFDSTLI (TYRP1_HUMAN)
RCNFDSTLW

SEQ ID NO: 167495 - protein, 9 aa, Artificial Sequence
  Description of Artificial Sequence: Synthetic peptide
  Seed: RSLHNLAHL (TYRP1_HUMAN)
RKLHNLAHY

SEQ ID NO: 167496 - protein, 9 aa, Artificial Sequence
  Description of Artificial Sequence: Synthetic peptide
  Seed: VARPMVQRL (TYRP1_HUMAN)
VFRPMVQRM

SEQ ID NO: 167497 - protein, 9 aa, Artificial Sequence
  Description of Artificial Sequence: Synthetic peptide
  Seed: VFDEWLRRY (TYRP1_HUMAN)
VIDEWLRRI

SEQ ID NO: 167498 - protein, 9 aa, Artificial Sequence
  Description of Artificial Sequence: Synthetic peptide
  Seed: IAVVGALLL (TYRP1_HUMAN)
IPVVGALLI

SEQ ID NO: 167499 - protein, 11 aa, Artificial Sequence
  Description of Artificial Sequence: Synthetic peptide
  Seed: FVLLHTFTDAV (TYRP1_HUMAN)
FELLHTFTDAV

SEQ ID NO: 167500 - protein, 11 aa, Artificial Sequence
  Description of Artificial Sequence: Synthetic peptide
  Seed: RRYNADISTFP (TYRP1_HUMAN)
RWYNADISTFY

SEQ ID NO: 167501 - protein, 9 aa, Artificial Sequence
  Description of Artificial Sequence: Synthetic peptide
  Seed: NRQYNMVPF (TYRP1_HUMAN)
NHQYNMVPI

SEQ ID NO: 167502 - protein, 10 aa, Artificial Sequence
  Description of Artificial Sequence: Synthetic peptide
  Seed: TDAVFDEWLR (TYRP1_HUMAN)
TFAVFDEWLR

SEQ ID NO: 167503 - protein, 10 aa, Artificial Sequence
  Description of Artificial Sequence: Synthetic peptide
  Seed: FFPLLLFQQA (TYRP1_HUMAN)
FQPLLLFQQA

SEQ ID NO: 167504 - protein, 9 aa, Artificial Sequence
  Description of Artificial Sequence: Synthetic peptide
  Seed: DSRPHSPQY (TYRP1_HUMAN)
DARPHSPQW

SEQ ID NO: 167505 - protein, 10 aa, Artificial Sequence
  Description of Artificial Sequence: Synthetic peptide
  Seed: FSLPYWNFAT (TYRP1_HUMAN)
FQLPYWNFAM

SEQ ID NO: 167506 - protein, 9 aa, Artificial Sequence
  Description of Artificial Sequence: Synthetic peptide
  Seed: HYYSVKKTF (TYRP1_HUMAN)
HYYSVKKTI

SEQ ID NO: 167507 - protein, 11 aa, Artificial Sequence
  Description of Artificial Sequence: Synthetic peptide
  Seed: REVWPLRFFNR (TYRP1_HUMAN)
RKVWPLRFFNR

SEQ ID NO: 167508 - protein, 9 aa, Artificial Sequence
  Description of Artificial Sequence: Synthetic peptide
  Seed: MSAPKLLSL (TYRP1_HUMAN)
MPAPKLLSV

SEQ ID NO: 167509 - protein, 10 aa, Artificial Sequence
  Description of Artificial Sequence: Synthetic peptide
  Seed: YNADISTFPL (TYRP1_HUMAN)
YCADISTFPL

SEQ ID NO: 167510 - protein, 11 aa, Artificial Sequence
  Description of Artificial Sequence: Synthetic peptide
  Seed: REVWPLRFFNR (TYRP1_HUMAN)
RRVWPLRFFNK

SEQ ID NO: 167511 - protein, 9 aa, Artificial Sequence
  Description of Artificial Sequence: Synthetic peptide
  Seed: LQNPNQSVV (TYRP1_HUMAN)
LANPNQSVM

SEQ ID NO: 167512 - protein, 10 aa, Artificial Sequence
  Description of Artificial Sequence: Synthetic peptide
  Seed: KRTTHPLFVI (TYRP1_HUMAN)
KATTHPLFVF

SEQ ID NO: 167513 - protein, 9 aa, Artificial Sequence
  Description of Artificial Sequence: Synthetic peptide
  Seed: STNSFRNTV (TYRP1_HUMAN)
SLNSFRNTY

SEQ ID NO: 167514 - protein, 10 aa, Artificial Sequence
  Description of Artificial Sequence: Synthetic peptide
  Seed: FLNGTGGQTH (TYRP1_HUMAN)
FPNGTGGQTY

SEQ ID NO: 167515 - protein, 11 aa, Artificial Sequence
  Description of Artificial Sequence: Synthetic peptide
  Seed: FWPPVTNTEMF (TYRP1_HUMAN)
FFPPVTNTEMY

SEQ ID NO: 167516 - protein, 9 aa, Artificial Sequence
  Description of Artificial Sequence: Synthetic peptide
  Seed: SLHNLAHLF (TYRP1_HUMAN)
SMHNLAHLL

SEQ ID NO: 167517 - protein, 10 aa, Artificial Sequence
  Description of Artificial Sequence: Synthetic peptide
  Seed: AVVGALLLVA (TYRP1_HUMAN)
AMVGALLLVL

SEQ ID NO: 167518 - protein, 9 aa, Artificial Sequence
  Description of Artificial Sequence: Synthetic peptide
  Seed: RLEKDMQEM (TYRP1_HUMAN)
RLEKDMQEI

SEQ ID NO: 167519 - protein, 9 aa, Artificial Sequence
  Description of Artificial Sequence: Synthetic peptide
  Seed: SPNSVFSQW (TYRP1_HUMAN)
SVNSVFSQW

SEQ ID NO: 167520 - protein, 9 aa, Artificial Sequence
  Description of Artificial Sequence: Synthetic peptide
  Seed: YLIRARRSM (TYRP1_HUMAN)
YLIRARRSV

SEQ ID NO: 167521 - protein, 10 aa, Artificial Sequence
  Description of Artificial Sequence: Synthetic peptide
  Seed: YNYFVWTHYY (TYRP1_HUMAN)
YRYFVWTHYV

SEQ ID NO: 167522 - protein, 10 aa, Artificial Sequence
  Description of Artificial Sequence: Synthetic peptide
  Seed: YNYFVWTHYY (TYRP1_HUMAN)
YFYFVWTHYR

SEQ ID NO: 167523 - protein, 10 aa, Artificial Sequence
  Description of Artificial Sequence: Synthetic peptide
  Seed: YNYFVWTHYY (TYRP1_HUMAN)
YYYFVWTHYW

SEQ ID NO: 167524 - protein, 10 aa, Artificial Sequence
  Description of Artificial Sequence: Synthetic peptide
  Seed: RRYNADISTF (TYRP1_HUMAN)
RNYNADISTW

SEQ ID NO: 167525 - protein, 10 aa, Artificial Sequence
  Description of Artificial Sequence: Synthetic peptide
  Seed: RSLHNLAHLF (TYRP1_HUMAN)
RPLHNLAHLY

SEQ ID NO: 167526 - protein, 9 aa, Artificial Sequence
  Description of Artificial Sequence: Synthetic peptide
  Seed: MSAPKLLSL (TYRP1_HUMAN)
MQAPKLLSI

SEQ ID NO: 167527 - protein, 10 aa, Artificial Sequence
  Description of Artificial Sequence: Synthetic peptide
  Seed: FVLLHTFTDA (TYRP1_HUMAN)
FCLLHTFTDV

SEQ ID NO: 167528 - protein, 9 aa, Artificial Sequence
  Description of Artificial Sequence: Synthetic peptide
  Seed: RTTHPLFVI (TYRP1_HUMAN)
RLTHPLFVK

SEQ ID NO: 167529 - protein, 8 aa, Artificial Sequence
  Description of Artificial Sequence: Synthetic peptide
  Seed: YSDPTGKY (TYRP1_HUMAN)
YMDPTGKL

SEQ ID NO: 167530 - protein, 9 aa, Artificial Sequence
  Description of Artificial Sequence: Synthetic peptide
  Seed: RYNADISTF (TYRP1_HUMAN)
RYNADISTY

SEQ ID NO: 167531 - protein, 9 aa, Artificial Sequence
  Description of Artificial Sequence: Synthetic peptide
  Seed: TADSRPHSP (TYRP1_HUMAN)
TMDSRPHSV

SEQ ID NO: 167532 - protein, 11 aa, Artificial Sequence
  Description of Artificial Sequence: Synthetic peptide
  Seed: RRYNADISTFP (TYRP1_HUMAN)
RRYNADISTFW

SEQ ID NO: 167533 - protein, 11 aa, Artificial Sequence
  Description of Artificial Sequence: Synthetic peptide
  Seed: YQCYAEEYEKL (TYRP1_HUMAN)
YECYAEEYEKF

SEQ ID NO: 167534 - protein, 9 aa, Artificial Sequence
  Description of Artificial Sequence: Synthetic peptide
  Seed: LLTDQYQCY (TYRP1_HUMAN)
LTTDQYQCY

SEQ ID NO: 167535 - protein, 10 aa, Artificial Sequence
  Description of Artificial Sequence: Synthetic peptide
  Seed: FVLLHTFTDA (TYRP1_HUMAN)
FQLLHTFTDL

SEQ ID NO: 167536 - protein, 9 aa, Artificial Sequence
  Description of Artificial Sequence: Synthetic peptide
  Seed: FSHEGPAFL (TYRP1_HUMAN)
FWHEGPAFL

SEQ ID NO: 167537 - protein, 11 aa, Artificial Sequence
  Description of Artificial Sequence: Synthetic peptide
  Seed: RRSMDEANQPL (TYRP1_HUMAN)
RRSMDEANQPV

SEQ ID NO: 167538 - protein, 11 aa, Artificial Sequence
  Description of Artificial Sequence: Synthetic peptide
  Seed: VTAPDNLGYTY (TYRP1_HUMAN)
VSAPDNLGYTM

SEQ ID NO: 167539 - protein, 10 aa, Artificial Sequence
  Description of Artificial Sequence: Synthetic peptide
  Seed: IAIAVVGALL (TYRP1_HUMAN)
ITIAVVGALM

SEQ ID NO: 167540 - protein, 9 aa, Artificial Sequence
  Description of Artificial Sequence: Synthetic peptide
  Seed: RFFNRTCHC (TYRP1_HUMAN)
RSFNRTCHI

SEQ ID NO: 167541 - protein, 9 aa, Artificial Sequence
  Description of Artificial Sequence: Synthetic peptide
  Seed: LTDQYQCYA (TYRP1_HUMAN)
LQDQYQCYL

SEQ ID NO: 167542 - protein, 10 aa, Artificial Sequence
  Description of Artificial Sequence: Synthetic peptide
  Seed: MVPFWPPVTN (TYRP1_HUMAN)
MNPFWPPVTM

SEQ ID NO: 167543 - protein, 10 aa, Artificial Sequence
  Description of Artificial Sequence: Synthetic peptide
  Seed: MVPFWPPVTN (TYRP1_HUMAN)
MMPFWPPVTM

SEQ ID NO: 167544 - protein, 10 aa, Artificial Sequence
  Description of Artificial Sequence: Synthetic peptide
  Seed: VLLHTFTDAV (TYRP1_HUMAN)
VYLHTFTDAV

SEQ ID NO: 167545 - protein, 9 aa, Artificial Sequence
  Description of Artificial Sequence: Synthetic peptide
  Seed: NRQYNMVPF (TYRP1_HUMAN)
NHQYNMVPV

SEQ ID NO: 167546 - protein, 9 aa, Artificial Sequence
  Description of Artificial Sequence: Synthetic peptide
  Seed: LLDLSKEEK (TYRP1_HUMAN)
LMDLSKEEY

SEQ ID NO: 167547 - protein, 9 aa, Artificial Sequence
  Description of Artificial Sequence: Synthetic peptide
  Seed: FSHEGPAFL (TYRP1_HUMAN)
FLHEGPAFV

SEQ ID NO: 167548 - protein, 10 aa, Artificial Sequence
  Description of Artificial Sequence: Synthetic peptide
  Seed: MAKRTTHPLF (TYRP1_HUMAN)
MKKRTTHPLF

SEQ ID NO: 167549 - protein, 10 aa, Artificial Sequence
  Description of Artificial Sequence: Synthetic peptide
  Seed: VALIFGTASY (TYRP1_HUMAN)
VSLIFGTASM

SEQ ID NO: 167550 - protein, 9 aa, Artificial Sequence
  Description of Artificial Sequence: Synthetic peptide
  Seed: CIFFPLLLF (TYRP1_HUMAN)
CHFFPLLLF

SEQ ID NO: 167551 - protein, 9 aa, Artificial Sequence
  Description of Artificial Sequence: Synthetic peptide
  Seed: FPLENAPIG (TYRP1_HUMAN)
FALENAPIF

SEQ ID NO: 167552 - protein, 10 aa, Artificial Sequence
  Description of Artificial Sequence: Synthetic peptide
  Seed: LSPNDPIFVL (TYRP1_HUMAN)
LEPNDPIFVY

SEQ ID NO: 167553 - protein, 10 aa, Artificial Sequence
  Description of Artificial Sequence: Synthetic peptide
  Seed: LLLVALIFGT (TYRP1_HUMAN)
LMLVALIFGA

SEQ ID NO: 167554 - protein, 9 aa, Artificial Sequence
  Description of Artificial Sequence: Synthetic peptide
  Seed: MAKRTTHPL (TYRP1_HUMAN)
MAKRTTHPM

SEQ ID NO: 167555 - protein, 9 aa, Artificial Sequence
  Description of Artificial Sequence: Synthetic peptide
  Seed: WTHYYSVKK (TYRP1_HUMAN)
WMHYYSVKR

SEQ ID NO: 167556 - protein, 11 aa, Artificial Sequence
  Description of Artificial Sequence: Synthetic peptide
  Seed: MLQEPSFSLPY (TYRP1_HUMAN)
MYQEPSFSLPY

SEQ ID NO: 167557 - protein, 10 aa, Artificial Sequence
  Description of Artificial Sequence: Synthetic peptide
  Seed: RSLHNLAHLF (TYRP1_HUMAN)
RSLHNLAHLY

SEQ ID NO: 167558 - protein, 10 aa, Artificial Sequence
  Description of Artificial Sequence: Synthetic peptide
  Seed: LLHTFTDAVF (TYRP1_HUMAN)
LMHTFTDAVI

SEQ ID NO: 167559 - protein, 11 aa, Artificial Sequence
  Description of Artificial Sequence: Synthetic peptide
  Seed: FVLLHTFTDAV (TYRP1_HUMAN)
FMLLHTFTDAI

SEQ ID NO: 167560 - protein, 11 aa, Artificial Sequence
  Description of Artificial Sequence: Synthetic peptide
  Seed: FPRQCATVEAL (TYRP1_HUMAN)
FPRQCATVEAI

SEQ ID NO: 167561 - protein, 10 aa, Artificial Sequence
  Description of Artificial Sequence: Synthetic peptide
  Seed: MSAPKLLSLG (TYRP1_HUMAN)
MKAPKLLSLW

SEQ ID NO: 167562 - protein, 9 aa, Artificial Sequence
  Description of Artificial Sequence: Synthetic peptide
  Seed: GALLLVALI (TYRP1_HUMAN)
GMLLLVALV

SEQ ID NO: 167563 - protein, 9 aa, Artificial Sequence
  Description of Artificial Sequence: Synthetic peptide
  Seed: REFSVPEII (TYRP1_HUMAN)
RHFSVPEIM

SEQ ID NO: 167564 - protein, 9 aa, Artificial Sequence
  Description of Artificial Sequence: Synthetic peptide
  Seed: FLGVGQESF (TYRP1_HUMAN)
FYGVGQESF

SEQ ID NO: 167565 - protein, 10 aa, Artificial Sequence
  Description of Artificial Sequence: Synthetic peptide
  Seed: YTYEIQWPSR (TYRP1_HUMAN)
YLYEIQWPSR

SEQ ID NO: 167566 - protein, 10 aa, Artificial Sequence
  Description of Artificial Sequence: Synthetic peptide
  Seed: LLLVALIFGT (TYRP1_HUMAN)
LALVALIFGL

SEQ ID NO: 167567 - protein, 9 aa, Artificial Sequence
  Description of Artificial Sequence: Synthetic peptide
  Seed: SVPEIIAIA (TYRP1_HUMAN)
SLPEIIAIF

SEQ ID NO: 167568 - protein, 11 aa, Artificial Sequence
  Description of Artificial Sequence: Synthetic peptide
  Seed: MFVTAPDNLGY (TYRP1_HUMAN)
MIVTAPDNLGF

SEQ ID NO: 167569 - protein, 9 aa, Artificial Sequence
  Description of Artificial Sequence: Synthetic peptide
  Seed: KYDPAVRSL (TYRP1_HUMAN)
KWDPAVRSY

SEQ ID NO: 167570 - protein, 11 aa, Artificial Sequence
  Description of Artificial Sequence: Synthetic peptide
  Seed: FPLLLFQQARA (TYRP1_HUMAN)
FKLLLFQQARV

SEQ ID NO: 167571 - protein, 10 aa, Artificial Sequence
  Description of Artificial Sequence: Synthetic peptide
  Seed: NYFVWTHYYS (TYRP1_HUMAN)
NFFVWTHYYF

SEQ ID NO: 167572 - protein, 9 aa, Artificial Sequence
  Description of Artificial Sequence: Synthetic peptide
  Seed: MSAPKLLSL (TYRP1_HUMAN)
MIAPKLLSV

SEQ ID NO: 167573 - protein, 11 aa, Artificial Sequence
  Description of Artificial Sequence: Synthetic peptide
  Seed: LISPNSVFSQW (TYRP1_HUMAN)
LQSPNSVFSQF

SEQ ID NO: 167574 - protein, 10 aa, Artificial Sequence
  Description of Artificial Sequence: Synthetic peptide
  Seed: ADSRPHSPQY (TYRP1_HUMAN)
AESRPHSPQA

SEQ ID NO: 167575 - protein, 9 aa, Artificial Sequence
  Description of Artificial Sequence: Synthetic peptide
  Seed: LTDQYQCYA (TYRP1_HUMAN)
LTDQYQCYI

SEQ ID NO: 167576 - protein, 9 aa, Artificial Sequence
  Description of Artificial Sequence: Synthetic peptide
  Seed: VGLFDTPPF (TYRP1_HUMAN)
VELFDTPPF

SEQ ID NO: 167577 - protein, 9 aa, Artificial Sequence
  Description of Artificial Sequence: Synthetic peptide
  Seed: LTWHRYHLL (TYRP1_HUMAN)
LSWHRYHLI

SEQ ID NO: 167578 - protein, 10 aa, Artificial Sequence
  Description of Artificial Sequence: Synthetic peptide
  Seed: QCYAEEYEKL (TYRP1_HUMAN)
QDYAEEYEKF

SEQ ID NO: 167579 - protein, 10 aa, Artificial Sequence
  Description of Artificial Sequence: Synthetic peptide
  Seed: TAPDNLGYTY (TYRP1_HUMAN)
TPPDNLGYTY

SEQ ID NO: 167580 - protein, 9 aa, Artificial Sequence
  Description of Artificial Sequence: Synthetic peptide
  Seed: APDNLGYTY (TYRP1_HUMAN)
APDNLGYTF

SEQ ID NO: 167581 - protein, 10 aa, Artificial Sequence
  Description of Artificial Sequence: Synthetic peptide
  Seed: RRYNADISTF (TYRP1_HUMAN)
RMYNADISTI

SEQ ID NO: 167582 - protein, 10 aa, Artificial Sequence
  Description of Artificial Sequence: Synthetic peptide
  Seed: ENISIYNYFV (TYRP1_HUMAN)
EAISIYNYFA

SEQ ID NO: 167583 - protein, 11 aa, Artificial Sequence
  Description of Artificial Sequence: Synthetic peptide
  Seed: YSDPTGKYDPA (TYRP1_HUMAN)
YADPTGKYDPF

SEQ ID NO: 167584 - protein, 9 aa, Artificial Sequence
  Description of Artificial Sequence: Synthetic peptide
  Seed: ALIFGTASY (TYRP1_HUMAN)
AAIFGTASI

SEQ ID NO: 167585 - protein, 9 aa, Artificial Sequence
  Description of Artificial Sequence: Synthetic peptide
  Seed: TFPLENAPI (TYRP1_HUMAN)
TVPLENAPL

SEQ ID NO: 167586 - protein, 10 aa, Artificial Sequence
  Description of Artificial Sequence: Synthetic peptide
  Seed: YNYFVWTHYY (TYRP1_HUMAN)
YVYFVWTHYK

SEQ ID NO: 167587 - protein, 11 aa, Artificial Sequence
  Description of Artificial Sequence: Synthetic peptide
  Seed: LTWHRYHLLRL (TYRP1_HUMAN)
LSWHRYHLLRF

SEQ ID NO: 167588 - protein, 9 aa, Artificial Sequence
  Description of Artificial Sequence: Synthetic peptide
  Seed: RYHLLRLEK (TYRP1_HUMAN)
RTHLLRLEL

SEQ ID NO: 167589 - protein, 10 aa, Artificial Sequence
  Description of Artificial Sequence: Synthetic peptide
  Seed: SIYNYFVWTH (TYRP1_HUMAN)
SSYNYFVWTR

SEQ ID NO: 167590 - protein, 9 aa, Artificial Sequence
  Description of Artificial Sequence: Synthetic peptide
  Seed: FSHEGPAFL (TYRP1_HUMAN)
FVHEGPAFV

SEQ ID NO: 167591 - protein, 10 aa, Artificial Sequence
  Description of Artificial Sequence: Synthetic peptide
  Seed: MLQEPSFSLP (TYRP1_HUMAN)
MLQEPSFSLK

SEQ ID NO: 167592 - protein, 9 aa, Artificial Sequence
  Description of Artificial Sequence: Synthetic peptide
  Seed: QEPSFSLPY (TYRP1_HUMAN)
QVPSFSLPY

SEQ ID NO: 167593 - protein, 8 aa, Artificial Sequence
  Description of Artificial Sequence: Synthetic peptide
  Seed: SVPEIIAI (TYRP1_HUMAN)
SSPEIIAL

SEQ ID NO: 167594 - protein, 9 aa, Artificial Sequence
  Description of Artificial Sequence: Synthetic peptide
  Seed: VCDICTDDL (TYRP1_HUMAN)
VADICTDDF

SEQ ID NO: 167595 - protein, 9 aa, Artificial Sequence
  Description of Artificial Sequence: Synthetic peptide
  Seed: RSNFDSTLI (TYRP1_HUMAN)
RQNFDSTLI

SEQ ID NO: 167596 - protein, 8 aa, Artificial Sequence
  Description of Artificial Sequence: Synthetic peptide
  Seed: YSDPTGKY (TYRP1_HUMAN)
YQDPTGKI

SEQ ID NO: 167597 - protein, 10 aa, Artificial Sequence
  Description of Artificial Sequence: Synthetic peptide
  Seed: TPQFENISIY (TYRP1_HUMAN)
TQQFENISIY

SEQ ID NO: 167598 - protein, 9 aa, Artificial Sequence
  Description of Artificial Sequence: Synthetic peptide
  Seed: LTWHRYHLL (TYRP1_HUMAN)
LLWHRYHLW

SEQ ID NO: 167599 - protein, 10 aa, Artificial Sequence
  Description of Artificial Sequence: Synthetic peptide
  Seed: RSLHNLAHLF (TYRP1_HUMAN)
RYLHNLAHLY

SEQ ID NO: 167600 - protein, 9 aa, Artificial Sequence
  Description of Artificial Sequence: Synthetic peptide
  Seed: MSAPKLLSL (TYRP1_HUMAN)
MHAPKLLSV

SEQ ID NO: 167601 - protein, 9 aa, Artificial Sequence
  Description of Artificial Sequence: Synthetic peptide
  Seed: VPFWPPVTN (TYRP1_HUMAN)
VPFWPPVTF

SEQ ID NO: 167602 - protein, 11 aa, Artificial Sequence
  Description of Artificial Sequence: Synthetic peptide
  Seed: FWPPVTNTEMF (TYRP1_HUMAN)
FHPPVTNTEMW

SEQ ID NO: 167603 - protein, 9 aa, Artificial Sequence
  Description of Artificial Sequence: Synthetic peptide
  Seed: NADISTFPL (TYRP1_HUMAN)
NVDISTFPY

SEQ ID NO: 167604 - protein, 9 aa, Artificial Sequence
  Description of Artificial Sequence: Synthetic peptide
  Seed: NADISTFPL (TYRP1_HUMAN)
NKDISTFPM

SEQ ID NO: 167605 - protein, 9 aa, Artificial Sequence
  Description of Artificial Sequence: Synthetic peptide
  Seed: WHRYHLLRL (TYRP1_HUMAN)
WHRYHLLRF

SEQ ID NO: 167606 - protein, 10 aa, Artificial Sequence
  Description of Artificial Sequence: Synthetic peptide
  Seed: YNADISTFPL (TYRP1_HUMAN)
YDADISTFPM

SEQ ID NO: 167607 - protein, 9 aa, Artificial Sequence
  Description of Artificial Sequence: Synthetic peptide
  Seed: AVVGALLLV (TYRP1_HUMAN)
ASVGALLLW

SEQ ID NO: 167608 - protein, 11 aa, Artificial Sequence
  Description of Artificial Sequence: Synthetic peptide
  Seed: YNYFVWTHYYS (TYRP1_HUMAN)
YTYFVWTHYYM

SEQ ID NO: 167609 - protein, 9 aa, Artificial Sequence
  Description of Artificial Sequence: Synthetic peptide
  Seed: ACDQRVLIV (TYRP1_HUMAN)
ATDQRVLIV

SEQ ID NO: 167610 - protein, 9 aa, Artificial Sequence
  Description of Artificial Sequence: Synthetic peptide
  Seed: REFSVPEII (TYRP1_HUMAN)
RGFSVPEIY

SEQ ID NO: 167611 - protein, 11 aa, Artificial Sequence
  Description of Artificial Sequence: Synthetic peptide
  Seed: LIFGTASYLIR (TYRP1_HUMAN)
LVFGTASYLIR

SEQ ID NO: 167612 - protein, 9 aa, Artificial Sequence
  Description of Artificial Sequence: Synthetic peptide
  Seed: LFQQARAQF (TYRP1_HUMAN)
LMQQARAQF

SEQ ID NO: 167613 - protein, 10 aa, Artificial Sequence
  Description of Artificial Sequence: Synthetic peptide
  Seed: YNYFVWTHYY (TYRP1_HUMAN)
YNYFVWTHYV

SEQ ID NO: 167614 - protein, 9 aa, Artificial Sequence
  Description of Artificial Sequence: Synthetic peptide
  Seed: ALLLVALIF (TYRP1_HUMAN)
ATLLVALIF

SEQ ID NO: 167615 - protein, 11 aa, Artificial Sequence
  Description of Artificial Sequence: Synthetic peptide
  Seed: LRRYNADISTF (TYRP1_HUMAN)
LQRYNADISTY

SEQ ID NO: 167616 - protein, 11 aa, Artificial Sequence
  Description of Artificial Sequence: Synthetic peptide
  Seed: SIYNYFVWTHY (TYRP1_HUMAN)
SKYNYFVWTHY

SEQ ID NO: 167617 - protein, 9 aa, Artificial Sequence
  Description of Artificial Sequence: Synthetic peptide
  Seed: FVWTHYYSV (TYRP1_HUMAN)
FIWTHYYST

SEQ ID NO: 167618 - protein, 10 aa, Artificial Sequence
  Description of Artificial Sequence: Synthetic peptide
  Seed: STFPLENAPI (TYRP1_HUMAN)
SSFPLENAPW

SEQ ID NO: 167619 - protein, 9 aa, Artificial Sequence
  Description of Artificial Sequence: Synthetic peptide
  Seed: ALIFGTASY (TYRP1_HUMAN)
AQIFGTASH

SEQ ID NO: 167620 - protein, 9 aa, Artificial Sequence
  Description of Artificial Sequence: Synthetic peptide
  Seed: SIYNYFVWT (TYRP1_HUMAN)
SLYNYFVWM

SEQ ID NO: 167621 - protein, 9 aa, Artificial Sequence
  Description of Artificial Sequence: Synthetic peptide
  Seed: HYYSVKKTF (TYRP1_HUMAN)
HRYSVKKTV

SEQ ID NO: 167622 - protein, 9 aa, Artificial Sequence
  Description of Artificial Sequence: Synthetic peptide
  Seed: ACDQRVLIV (TYRP1_HUMAN)
AADQRVLIM

SEQ ID NO: 167623 - protein, 10 aa, Artificial Sequence
  Description of Artificial Sequence: Synthetic peptide
  Seed: MQEMLQEPSF (TYRP1_HUMAN)
MEEMLQEPSW

SEQ ID NO: 167624 - protein, 10 aa, Artificial Sequence
  Description of Artificial Sequence: Synthetic peptide
  Seed: CDQRVLIVRR (TYRP1_HUMAN)
CFQRVLIVRR

SEQ ID NO: 167625 - protein, 11 aa, Artificial Sequence
  Description of Artificial Sequence: Synthetic peptide
  Seed: MFVTAPDNLGY (TYRP1_HUMAN)
MTVTAPDNLGW

SEQ ID NO: 167626 - protein, 9 aa, Artificial Sequence
  Description of Artificial Sequence: Synthetic peptide
  Seed: VLLHTFTDA (TYRP1_HUMAN)
VLLHTFTDL

SEQ ID NO: 167627 - protein, 9 aa, Artificial Sequence
  Description of Artificial Sequence: Synthetic peptide
  Seed: REFSVPEII (TYRP1_HUMAN)
REFSVPEIT

SEQ ID NO: 167628 - protein, 9 aa, Artificial Sequence
  Description of Artificial Sequence: Synthetic peptide
  Seed: TWHRYHLLR (TYRP1_HUMAN)
TSHRYHLLR

SEQ ID NO: 167629 - protein, 9 aa, Artificial Sequence
  Description of Artificial Sequence: Synthetic peptide
  Seed: AVRSLHNLA (TYRP1_HUMAN)
ALRSLHNLA

SEQ ID NO: 167630 - protein, 9 aa, Artificial Sequence
  Description of Artificial Sequence: Synthetic peptide
  Seed: LVALIFGTA (TYRP1_HUMAN)
LTALIFGTV

SEQ ID NO: 167631 - protein, 10 aa, Artificial Sequence
  Description of Artificial Sequence: Synthetic peptide
  Seed: FTDAVFDEWL (TYRP1_HUMAN)
FLDAVFDEWY

SEQ ID NO: 167632 - protein, 8 aa, Artificial Sequence
  Description of Artificial Sequence: Synthetic peptide
  Seed: YSDPTGKY (TYRP1_HUMAN)
YIDPTGKM

SEQ ID NO: 167633 - protein, 9 aa, Artificial Sequence
  Description of Artificial Sequence: Synthetic peptide
  Seed: IAIAVVGAL (TYRP1_HUMAN)
IQIAVVGAY

SEQ ID NO: 167634 - protein, 9 aa, Artificial Sequence
  Description of Artificial Sequence: Synthetic peptide
  Seed: RYHLLRLEK (TYRP1_HUMAN)
RTHLLRLEI

SEQ ID NO: 167635 - protein, 10 aa, Artificial Sequence
  Description of Artificial Sequence: Synthetic peptide
  Seed: ALIFGTASYL (TYRP1_HUMAN)
ASIFGTASYY

SEQ ID NO: 167636 - protein, 10 aa, Artificial Sequence
  Description of Artificial Sequence: Synthetic peptide
  Seed: LIFGTASYLI (TYRP1_HUMAN)
LLFGTASYLC

SEQ ID NO: 167637 - protein, 10 aa, Artificial Sequence
  Description of Artificial Sequence: Synthetic peptide
  Seed: EGPAFLTWHR (TYRP1_HUMAN)
EYPAFLTWHR

SEQ ID NO: 167638 - protein, 9 aa, Artificial Sequence
  Description of Artificial Sequence: Synthetic peptide
  Seed: WTHYYSVKK (TYRP1_HUMAN)
WVHYYSVKR

SEQ ID NO: 167639 - protein, 9 aa, Artificial Sequence
  Description of Artificial Sequence: Synthetic peptide
  Seed: QEMLQEPSF (TYRP1_HUMAN)
QEMLQEPSA

SEQ ID NO: 167640 - protein, 9 aa, Artificial Sequence
  Description of Artificial Sequence: Synthetic peptide
  Seed: YNYFVWTHY (TYRP1_HUMAN)
YTYFVWTHR

SEQ ID NO: 167641 - protein, 11 aa, Artificial Sequence
  Description of Artificial Sequence: Synthetic peptide
  Seed: MLQEPSFSLPY (TYRP1_HUMAN)
MMQEPSFSLPY

SEQ ID NO: 167642 - protein, 9 aa, Artificial Sequence
  Description of Artificial Sequence: Synthetic peptide
  Seed: REFSVPEII (TYRP1_HUMAN)
RRFSVPEIM

SEQ ID NO: 167643 - protein, 9 aa, Artificial Sequence
  Description of Artificial Sequence: Synthetic peptide
  Seed: AHLFLNGTG (TYRP1_HUMAN)
AHLFLNGTA

SEQ ID NO: 167644 - protein, 10 aa, Artificial Sequence
  Description of Artificial Sequence: Synthetic peptide
  Seed: RSMDEANQPL (TYRP1_HUMAN)
RFMDEANQPY

SEQ ID NO: 167645 - protein, 9 aa, Artificial Sequence
  Description of Artificial Sequence: Synthetic peptide
  Seed: VPEIIAIAV (TYRP1_HUMAN)
VPEIIAIAM

SEQ ID NO: 167646 - protein, 9 aa, Artificial Sequence
  Description of Artificial Sequence: Synthetic peptide
  Seed: AVRSLHNLA (TYRP1_HUMAN)
ASRSLHNLT

SEQ ID NO: 167647 - protein, 9 aa, Artificial Sequence
  Description of Artificial Sequence: Synthetic peptide
  Seed: REFSVPEII (TYRP1_HUMAN)
RDFSVPEII

SEQ ID NO: 167648 - protein, 9 aa, Artificial Sequence
  Description of Artificial Sequence: Synthetic peptide
  Seed: LSKEEKNHF (TYRP1_HUMAN)
LPKEEKNHY

SEQ ID NO: 167649 - protein, 8 aa, Artificial Sequence
  Description of Artificial Sequence: Synthetic peptide
  Seed: FSHEGPAF (TYRP1_HUMAN)
FTHEGPAV

SEQ ID NO: 167650 - protein, 9 aa, Artificial Sequence
  Description of Artificial Sequence: Synthetic peptide
  Seed: AIAVVGALL (TYRP1_HUMAN)
AIAVVGALF

SEQ ID NO: 167651 - protein, 10 aa, Artificial Sequence
  Description of Artificial Sequence: Synthetic peptide
  Seed: ADSRPHSPQY (TYRP1_HUMAN)
AHSRPHSPQA

SEQ ID NO: 167652 - protein, 9 aa, Artificial Sequence
  Description of Artificial Sequence: Synthetic peptide
  Seed: LIFGTASYL (TYRP1_HUMAN)
LWFGTASYF

SEQ ID NO: 167653 - protein, 9 aa, Artificial Sequence
  Description of Artificial Sequence: Synthetic peptide
  Seed: DSRPHSPQY (TYRP1_HUMAN)
DIRPHSPQY

SEQ ID NO: 167654 - protein, 11 aa, Artificial Sequence
  Description of Artificial Sequence: Synthetic peptide
  Seed: FSVPEIIAIAV (TYRP1_HUMAN)
FMVPEIIAIAV

SEQ ID NO: 167655 - protein, 10 aa, Artificial Sequence
  Description of Artificial Sequence: Synthetic peptide
  Seed: LSLGCIFFPL (TYRP1_HUMAN)
LILGCIFFPL

SEQ ID NO: 167656 - protein, 9 aa, Artificial Sequence
  Description of Artificial Sequence: Synthetic peptide
  Seed: SRSNFDSTL (TYRP1_HUMAN)
SMSNFDSTL

SEQ ID NO: 167657 - protein, 10 aa, Artificial Sequence
  Description of Artificial Sequence: Synthetic peptide
  Seed: YEIQWPSREF (TYRP1_HUMAN)
YKIQWPSREF

SEQ ID NO: 167658 - protein, 9 aa, Artificial Sequence
  Description of Artificial Sequence: Synthetic peptide
  Seed: MSAPKLLSL (TYRP1_HUMAN)
MMAPKLLSY

SEQ ID NO: 167659 - protein, 9 aa, Artificial Sequence
  Description of Artificial Sequence: Synthetic peptide
  Seed: NYFVWTHYY (TYRP1_HUMAN)
NRFVWTHYY

SEQ ID NO: 167660 - protein, 11 aa, Artificial Sequence
  Description of Artificial Sequence: Synthetic peptide
  Seed: AGNVARPMVQR (TYRP1_HUMAN)
AANVARPMVQK

SEQ ID NO: 167661 - protein, 9 aa, Artificial Sequence
  Description of Artificial Sequence: Synthetic peptide
  Seed: AQFPRQCAT (TYRP1_HUMAN)
ARFPRQCAM

SEQ ID NO: 167662 - protein, 9 aa, Artificial Sequence
  Description of Artificial Sequence: Synthetic peptide
  Seed: DLMGSRSNF (TYRP1_HUMAN)
DVMGSRSNK

SEQ ID NO: 167663 - protein, 9 aa, Artificial Sequence
  Description of Artificial Sequence: Synthetic peptide
  Seed: HEGPAFLTW (TYRP1_HUMAN)
HMGPAFLTW

SEQ ID NO: 167664 - protein, 10 aa, Artificial Sequence
  Description of Artificial Sequence: Synthetic peptide
  Seed: LGPDGNTPQF (TYRP1_HUMAN)
LGPDGNTPQL

SEQ ID NO: 167665 - protein, 9 aa, Artificial Sequence
  Description of Artificial Sequence: Synthetic peptide
  Seed: MLQEPSFSL (TYRP1_HUMAN)
MGQEPSFSF

SEQ ID NO: 167666 - protein, 10 aa, Artificial Sequence
  Description of Artificial Sequence: Synthetic peptide
  Seed: RSMDEANQPL (TYRP1_HUMAN)
RRMDEANQPY

SEQ ID NO: 167667 - protein, 11 aa, Artificial Sequence
  Description of Artificial Sequence: Synthetic peptide
  Seed: YNMVPFWPPVT (TYRP1_HUMAN)
YLMVPFWPPVD

SEQ ID NO: 167668 - protein, 9 aa, Artificial Sequence
  Description of Artificial Sequence: Synthetic peptide
  Seed: VTAPDNLGY (TYRP1_HUMAN)
VLAPDNLGF

SEQ ID NO: 167669 - protein, 10 aa, Artificial Sequence
  Description of Artificial Sequence: Synthetic peptide
  Seed: YNYFVWTHYY (TYRP1_HUMAN)
YKYFVWTHYR

SEQ ID NO: 167670 - protein, 10 aa, Artificial Sequence
  Description of Artificial Sequence: Synthetic peptide
  Seed: FENISIYNYF (TYRP1_HUMAN)
FENISIYNYL

SEQ ID NO: 167671 - protein, 9 aa, Artificial Sequence
  Description of Artificial Sequence: Synthetic peptide
  Seed: GEVDFSHEG (TYRP1_HUMAN)
GQVDFSHEW

SEQ ID NO: 167672 - protein, 9 aa, Artificial Sequence
  Description of Artificial Sequence: Synthetic peptide
  Seed: LVALIFGTA (TYRP1_HUMAN)
LVALIFGTI

SEQ ID NO: 167673 - protein, 9 aa, Artificial Sequence
  Description of Artificial Sequence: Synthetic peptide
  Seed: FTDAVFDEW (TYRP1_HUMAN)
FVDAVFDEM

SEQ ID NO: 167674 - protein, 9 aa, Artificial Sequence
  Description of Artificial Sequence: Synthetic peptide
  Seed: ALIFGTASY (TYRP1_HUMAN)
AHIFGTASM

SEQ ID NO: 167675 - protein, 10 aa, Artificial Sequence
  Description of Artificial Sequence: Synthetic peptide
  Seed: YNYFVWTHYY (TYRP1_HUMAN)
YRYFVWTHYF

SEQ ID NO: 167676 - protein, 11 aa, Artificial Sequence
  Description of Artificial Sequence: Synthetic peptide
  Seed: YSDPTGKYDPA (TYRP1_HUMAN)
YVDPTGKYDPI

SEQ ID NO: 167677 - protein, 9 aa, Artificial Sequence
  Description of Artificial Sequence: Synthetic peptide
  Seed: GTASYLIRA (TYRP1_HUMAN)
GQASYLIRM

SEQ ID NO: 167678 - protein, 10 aa, Artificial Sequence
  Description of Artificial Sequence: Synthetic peptide
  Seed: FSVPEIIAIA (TYRP1_HUMAN)
FSVPEIIAIV

SEQ ID NO: 167679 - protein, 10 aa, Artificial Sequence
  Description of Artificial Sequence: Synthetic peptide
  Seed: TDAVFDEWLR (TYRP1_HUMAN)
TPAVFDEWLR

SEQ ID NO: 167680 - protein, 9 aa, Artificial Sequence
  Description of Artificial Sequence: Synthetic peptide
  Seed: CIFFPLLLF (TYRP1_HUMAN)
CLFFPLLLY

SEQ ID NO: 167681 - protein, 10 aa, Artificial Sequence
  Description of Artificial Sequence: Synthetic peptide
  Seed: IAIAVVGALL (TYRP1_HUMAN)
ISIAVVGALL

SEQ ID NO: 167682 - protein, 9 aa, Artificial Sequence
  Description of Artificial Sequence: Synthetic peptide
  Seed: LSKEEKNHF (TYRP1_HUMAN)
LTKEEKNHF

SEQ ID NO: 167683 - protein, 9 aa, Artificial Sequence
  Description of Artificial Sequence: Synthetic peptide
  Seed: MSAPKLLSL (TYRP1_HUMAN)
MPAPKLLSY

SEQ ID NO: 167684 - protein, 9 aa, Artificial Sequence
  Description of Artificial Sequence: Synthetic peptide
  Seed: MSAPKLLSL (TYRP1_HUMAN)
MMAPKLLSK

SEQ ID NO: 167685 - protein, 8 aa, Artificial Sequence
  Description of Artificial Sequence: Synthetic peptide
  Seed: FSHEGPAF (TYRP1_HUMAN)
FYHEGPAL

SEQ ID NO: 167686 - protein, 10 aa, Artificial Sequence
  Description of Artificial Sequence: Synthetic peptide
  Seed: FTDAVFDEWL (TYRP1_HUMAN)
FMDAVFDEWM

SEQ ID NO: 167687 - protein, 9 aa, Artificial Sequence
  Description of Artificial Sequence: Synthetic peptide
  Seed: FSLPYWNFA (TYRP1_HUMAN)
FMLPYWNFT

SEQ ID NO: 167688 - protein, 9 aa, Artificial Sequence
  Description of Artificial Sequence: Synthetic peptide
  Seed: LFDTPPFYS (TYRP1_HUMAN)
LWDTPPFYV

SEQ ID NO: 167689 - protein, 9 aa, Artificial Sequence
  Description of Artificial Sequence: Synthetic peptide
  Seed: SLHNLAHLF (TYRP1_HUMAN)
SYHNLAHLL

SEQ ID NO: 167690 - protein, 9 aa, Artificial Sequence
  Description of Artificial Sequence: Synthetic peptide
  Seed: FTDAVFDEW (TYRP1_HUMAN)
FLDAVFDEF

SEQ ID NO: 167691 - protein, 9 aa, Artificial Sequence
  Description of Artificial Sequence: Synthetic peptide
  Seed: LLHTFTDAV (TYRP1_HUMAN)
LVHTFTDAV

SEQ ID NO: 167692 - protein, 10 aa, Artificial Sequence
  Description of Artificial Sequence: Synthetic peptide
  Seed: LSPNDPIFVL (TYRP1_HUMAN)
LEPNDPIFVM

SEQ ID NO: 167693 - protein, 10 aa, Artificial Sequence
  Description of Artificial Sequence: Synthetic peptide
  Seed: TAPDNLGYTY (TYRP1_HUMAN)
TIPDNLGYTW

SEQ ID NO: 167694 - protein, 10 aa, Artificial Sequence
  Description of Artificial Sequence: Synthetic peptide
  Seed: FVWTHYYSVK (TYRP1_HUMAN)
FLWTHYYSVC

SEQ ID NO: 167695 - protein, 10 aa, Artificial Sequence
  Description of Artificial Sequence: Synthetic peptide
  Seed: RRYNADISTF (TYRP1_HUMAN)
RQYNADISTL

SEQ ID NO: 167696 - protein, 8 aa, Artificial Sequence
  Description of Artificial Sequence: Synthetic peptide
  Seed: YFVWTHYY (TYRP1_HUMAN)
YVVWTHYY

SEQ ID NO: 167697 - protein, 9 aa, Artificial Sequence
  Description of Artificial Sequence: Synthetic peptide
  Seed: YLIRARRSM (TYRP1_HUMAN)
YRIRARRSY

SEQ ID NO: 167698 - protein, 9 aa, Artificial Sequence
  Description of Artificial Sequence: Synthetic peptide
  Seed: LFDTPPFYS (TYRP1_HUMAN)
LWDTPPFYI

SEQ ID NO: 167699 - protein, 10 aa, Artificial Sequence
  Description of Artificial Sequence: Synthetic peptide
  Seed: NISIYNYFVW (TYRP1_HUMAN)
NRSIYNYFVW

SEQ ID NO: 167700 - protein, 9 aa, Artificial Sequence
  Description of Artificial Sequence: Synthetic peptide
  Seed: SFRNTVEGY (TYRP1_HUMAN)
SVRNTVEGY

SEQ ID NO: 167701 - protein, 9 aa, Artificial Sequence
  Description of Artificial Sequence: Synthetic peptide
  Seed: RQCATVEAL (TYRP1_HUMAN)
RQCATVEAI

SEQ ID NO: 167702 - protein, 11 aa, Artificial Sequence
  Description of Artificial Sequence: Synthetic peptide
  Seed: MFVTAPDNLGY (TYRP1_HUMAN)
MLVTAPDNLGF

SEQ ID NO: 167703 - protein, 10 aa, Artificial Sequence
  Description of Artificial Sequence: Synthetic peptide
  Seed: RRYNADISTF (TYRP1_HUMAN)
RWYNADISTI

SEQ ID NO: 167704 - protein, 9 aa, Artificial Sequence
  Description of Artificial Sequence: Synthetic peptide
  Seed: MLQEPSFSL (TYRP1_HUMAN)
MYQEPSFSL

SEQ ID NO: 167705 - protein, 9 aa, Artificial Sequence
  Description of Artificial Sequence: Synthetic peptide
  Seed: TLISPNSVF (TYRP1_HUMAN)
TQISPNSVI

SEQ ID NO: 167706 - protein, 8 aa, Artificial Sequence
  Description of Artificial Sequence: Synthetic peptide
  Seed: LFDTPPFY (TYRP1_HUMAN)
LYDTPPFV

SEQ ID NO: 167707 - protein, 9 aa, Artificial Sequence
  Description of Artificial Sequence: Synthetic peptide
  Seed: IYNYFVWTH (TYRP1_HUMAN)
IWNYFVWTK

SEQ ID NO: 167708 - protein, 9 aa, Artificial Sequence
  Description of Artificial Sequence: Synthetic peptide
  Seed: ALIFGTASY (TYRP1_HUMAN)
AWIFGTASF

SEQ ID NO: 167709 - protein, 9 aa, Artificial Sequence
  Description of Artificial Sequence: Synthetic peptide
  Seed: ALIFGTASY (TYRP1_HUMAN)
AYIFGTASV

SEQ ID NO: 167710 - protein, 8 aa, Artificial Sequence
  Description of Artificial Sequence: Synthetic peptide
  Seed: TEDGPIRR (TYRP1_HUMAN)
TTDGPIRY

SEQ ID NO: 167711 - protein, 8 aa, Artificial Sequence
  Description of Artificial Sequence: Synthetic peptide
  Seed: FPLENAPI (TYRP1_HUMAN)
FPLENAPM

SEQ ID NO: 167712 - protein, 10 aa, Artificial Sequence
  Description of Artificial Sequence: Synthetic peptide
  Seed: NVARPMVQRL (TYRP1_HUMAN)
NAARPMVQRR

SEQ ID NO: 167713 - protein, 9 aa, Artificial Sequence
  Description of Artificial Sequence: Synthetic peptide
  Seed: LSKEEKNHF (TYRP1_HUMAN)
LAKEEKNHF

SEQ ID NO: 167714 - protein, 9 aa, Artificial Sequence
  Description of Artificial Sequence: Synthetic peptide
  Seed: LIFGTASYL (TYRP1_HUMAN)
LVFGTASYY

SEQ ID NO: 167715 - protein, 9 aa, Artificial Sequence
  Description of Artificial Sequence: Synthetic peptide
  Seed: FSHEGPAFL (TYRP1_HUMAN)
FYHEGPAFW

SEQ ID NO: 167716 - protein, 10 aa, Artificial Sequence
  Description of Artificial Sequence: Synthetic peptide
  Seed: HNRQYNMVPF (TYRP1_HUMAN)
HLRQYNMVPF

SEQ ID NO: 167717 - protein, 10 aa, Artificial Sequence
  Description of Artificial Sequence: Synthetic peptide
  Seed: YSVKKTFLGV (TYRP1_HUMAN)
YLVKKTFLGL

SEQ ID NO: 167718 - protein, 10 aa, Artificial Sequence
  Description of Artificial Sequence: Synthetic peptide
  Seed: EIIAIAVVGA (TYRP1_HUMAN)
EIIAIAVVGI

SEQ ID NO: 167719 - protein, 10 aa, Artificial Sequence
  Description of Artificial Sequence: Synthetic peptide
  Seed: MLQEPSFSLP (TYRP1_HUMAN)
MMQEPSFSLP

SEQ ID NO: 167720 - protein, 10 aa, Artificial Sequence
  Description of Artificial Sequence: Synthetic peptide
  Seed: SREFSVPEII (TYRP1_HUMAN)
SVEFSVPEIL

SEQ ID NO: 167721 - protein, 10 aa, Artificial Sequence
  Description of Artificial Sequence: Synthetic peptide
  Seed: TPQFENISIY (TYRP1_HUMAN)
TKQFENISIM

SEQ ID NO: 167722 - protein, 10 aa, Artificial Sequence
  Description of Artificial Sequence: Synthetic peptide
  Seed: SPNDPIFVLL (TYRP1_HUMAN)
SANDPIFVLW

SEQ ID NO: 167723 - protein, 9 aa, Artificial Sequence
  Description of Artificial Sequence: Synthetic peptide
  Seed: LQNPNQSVV (TYRP1_HUMAN)
LVNPNQSVM

SEQ ID NO: 167724 - protein, 9 aa, Artificial Sequence
  Description of Artificial Sequence: Synthetic peptide
  Seed: FYSNSTNSF (TYRP1_HUMAN)
FYSNSTNSM

SEQ ID NO: 167725 - protein, 10 aa, Artificial Sequence
  Description of Artificial Sequence: Synthetic peptide
  Seed: YFVWTHYYSV (TYRP1_HUMAN)
YMVWTHYYSL

SEQ ID NO: 167726 - protein, 9 aa, Artificial Sequence
  Description of Artificial Sequence: Synthetic peptide
  Seed: SPNDPIFVL (TYRP1_HUMAN)
SVNDPIFVF

SEQ ID NO: 167727 - protein, 8 aa, Artificial Sequence
  Description of Artificial Sequence: Synthetic peptide
  Seed: YSDPTGKY (TYRP1_HUMAN)
YQDPTGKM

SEQ ID NO: 167728 - protein, 9 aa, Artificial Sequence
  Description of Artificial Sequence: Synthetic peptide
  Seed: TAPDNLGYT (TYRP1_HUMAN)
TIPDNLGYM

SEQ ID NO: 167729 - protein, 10 aa, Artificial Sequence
  Description of Artificial Sequence: Synthetic peptide
  Seed: RRYNADISTF (TYRP1_HUMAN)
RAYNADISTM

SEQ ID NO: 167730 - protein, 10 aa, Artificial Sequence
  Description of Artificial Sequence: Synthetic peptide
  Seed: ENISIYNYFV (TYRP1_HUMAN)
EIISIYNYFA

SEQ ID NO: 167731 - protein, 10 aa, Artificial Sequence
  Description of Artificial Sequence: Synthetic peptide
  Seed: GEVDFSHEGP (TYRP1_HUMAN)
GEVDFSHEGI

SEQ ID NO: 167732 - protein, 10 aa, Artificial Sequence
  Description of Artificial Sequence: Synthetic peptide
  Seed: AVVGALLLVA (TYRP1_HUMAN)
AQVGALLLVA

SEQ ID NO: 167733 - protein, 9 aa, Artificial Sequence
  Description of Artificial Sequence: Synthetic peptide
  Seed: AVRSLHNLA (TYRP1_HUMAN)
ATRSLHNLQ

SEQ ID NO: 167734 - protein, 10 aa, Artificial Sequence
  Description of Artificial Sequence: Synthetic peptide
  Seed: MAKRTTHPLF (TYRP1_HUMAN)
MMKRTTHPLL

SEQ ID NO: 167735 - protein, 10 aa, Artificial Sequence
  Description of Artificial Sequence: Synthetic peptide
  Seed: YNYFVWTHYY (TYRP1_HUMAN)
YTYFVWTHYF

SEQ ID NO: 167736 - protein, 9 aa, Artificial Sequence
  Description of Artificial Sequence: Synthetic peptide
  Seed: FSLPYWNFA (TYRP1_HUMAN)
FSLPYWNFF

SEQ ID NO: 167737 - protein, 10 aa, Artificial Sequence
  Description of Artificial Sequence: Synthetic peptide
  Seed: FVWTHYYSVK (TYRP1_HUMAN)
FLWTHYYSVN

SEQ ID NO: 167738 - protein, 10 aa, Artificial Sequence
  Description of Artificial Sequence: Synthetic peptide
  Seed: MLQEPSFSLP (TYRP1_HUMAN)
MLQEPSFSLR

SEQ ID NO: 167739 - protein, 10 aa, Artificial Sequence
  Description of Artificial Sequence: Synthetic peptide
  Seed: RRYNADISTF (TYRP1_HUMAN)
RQYNADISTM

SEQ ID NO: 167740 - protein, 9 aa, Artificial Sequence
  Description of Artificial Sequence: Synthetic peptide
  Seed: FLTWHRYHL (TYRP1_HUMAN)
FITWHRYHI

SEQ ID NO: 167741 - protein, 9 aa, Artificial Sequence
  Description of Artificial Sequence: Synthetic peptide
  Seed: EDYDTLGTL (TYRP1_HUMAN)
EQYDTLGTI

SEQ ID NO: 167742 - protein, 9 aa, Artificial Sequence
  Description of Artificial Sequence: Synthetic peptide
  Seed: SVPEIIAIA (TYRP1_HUMAN)
SGPEIIAIY

SEQ ID NO: 167743 - protein, 9 aa, Artificial Sequence
  Description of Artificial Sequence: Synthetic peptide
  Seed: FSLPYWNFA (TYRP1_HUMAN)
FLLPYWNFI

SEQ ID NO: 167744 - protein, 10 aa, Artificial Sequence
  Description of Artificial Sequence: Synthetic peptide
  Seed: RSMDEANQPL (TYRP1_HUMAN)
RQMDEANQPV

SEQ ID NO: 167745 - protein, 10 aa, Artificial Sequence
  Description of Artificial Sequence: Synthetic peptide
  Seed: HNRQYNMVPF (TYRP1_HUMAN)
HQRQYNMVPM

SEQ ID NO: 167746 - protein, 9 aa, Artificial Sequence
  Description of Artificial Sequence: Synthetic peptide
  Seed: DYDTLGTLC (TYRP1_HUMAN)
DWDTLGTLM

SEQ ID NO: 167747 - protein, 10 aa, Artificial Sequence
  Description of Artificial Sequence: Synthetic peptide
  Seed: IYNYFVWTHY (TYRP1_HUMAN)
IYNYFVWTHL

SEQ ID NO: 167748 - protein, 11 aa, Artificial Sequence
  Description of Artificial Sequence: Synthetic peptide
  Seed: FLNGTGGQTHL (TYRP1_HUMAN)
FTNGTGGQTHL

SEQ ID NO: 167749 - protein, 9 aa, Artificial Sequence
  Description of Artificial Sequence: Synthetic peptide
  Seed: TLISPNSVF (TYRP1_HUMAN)
TWISPNSVF

SEQ ID NO: 167750 - protein, 10 aa, Artificial Sequence
  Description of Artificial Sequence: Synthetic peptide
  Seed: YNMVPFWPPV (TYRP1_HUMAN)
YCMVPFWPPM

SEQ ID NO: 167751 - protein, 10 aa, Artificial Sequence
  Description of Artificial Sequence: Synthetic peptide
  Seed: FWPPVTNTEM (TYRP1_HUMAN)
FAPPVTNTEY

SEQ ID NO: 167752 - protein, 9 aa, Artificial Sequence
  Description of Artificial Sequence: Synthetic peptide
  Seed: ALIFGTASY (TYRP1_HUMAN)
AMIFGTASL

SEQ ID NO: 167753 - protein, 8 aa, Artificial Sequence
  Description of Artificial Sequence: Synthetic peptide
  Seed: LFDTPPFY (TYRP1_HUMAN)
LYDTPPFM

SEQ ID NO: 167754 - protein, 9 aa, Artificial Sequence
  Description of Artificial Sequence: Synthetic peptide
  Seed: RFFNRTCHC (TYRP1_HUMAN)
RVFNRTCHV

SEQ ID NO: 167755 - protein, 9 aa, Artificial Sequence
  Description of Artificial Sequence: Synthetic peptide
  Seed: RQYNMVPFW (TYRP1_HUMAN)
RMYNMVPFW

SEQ ID NO: 167756 - protein, 9 aa, Artificial Sequence
  Description of Artificial Sequence: Synthetic peptide
  Seed: SHEGPAFLT (TYRP1_HUMAN)
SHEGPAFLV

SEQ ID NO: 167757 - protein, 10 aa, Artificial Sequence
  Description of Artificial Sequence: Synthetic peptide
  Seed: FYSNSTNSFR (TYRP1_HUMAN)
FYSNSTNSFY

SEQ ID NO: 167758 - protein, 9 aa, Artificial Sequence
  Description of Artificial Sequence: Synthetic peptide
  Seed: FSVPEIIAI (TYRP1_HUMAN)
FLVPEIIAA

SEQ ID NO: 167759 - protein, 10 aa, Artificial Sequence
  Description of Artificial Sequence: Synthetic peptide
  Seed: SVPEIIAIAV (TYRP1_HUMAN)
STPEIIAIAI

SEQ ID NO: 167760 - protein, 11 aa, Artificial Sequence
  Description of Artificial Sequence: Synthetic peptide
  Seed: EEILGPDGNTP (TYRP1_HUMAN)
EEILGPDGNTA

SEQ ID NO: 167761 - protein, 9 aa, Artificial Sequence
  Description of Artificial Sequence: Synthetic peptide
  Seed: MCCPDLSPV (TYRP1_HUMAN)
MLCPDLSPL

SEQ ID NO: 167762 - protein, 10 aa, Artificial Sequence
  Description of Artificial Sequence: Synthetic peptide
  Seed: FTDAVFDEWL (TYRP1_HUMAN)
FMDAVFDEWA

SEQ ID NO: 167763 - protein, 9 aa, Artificial Sequence
  Description of Artificial Sequence: Synthetic peptide
  Seed: NHFVRALDM (TYRP1_HUMAN)
NHFVRALDL

SEQ ID NO: 167764 - protein, 9 aa, Artificial Sequence
  Description of Artificial Sequence: Synthetic peptide
  Seed: YSNSTNSFR (TYRP1_HUMAN)
YANSTNSFK

SEQ ID NO: 167765 - protein, 9 aa, Artificial Sequence
  Description of Artificial Sequence: Synthetic peptide
  Seed: RSLHNLAHL (TYRP1_HUMAN)
RTLHNLAHI

SEQ ID NO: 167766 - protein, 9 aa, Artificial Sequence
  Description of Artificial Sequence: Synthetic peptide
  Seed: AFLTWHRYH (TYRP1_HUMAN)
AWLTWHRYR

SEQ ID NO: 167767 - protein, 9 aa, Artificial Sequence
  Description of Artificial Sequence: Synthetic peptide
  Seed: ALLLVALIF (TYRP1_HUMAN)
ASLLVALIW

SEQ ID NO: 167768 - protein, 10 aa, Artificial Sequence
  Description of Artificial Sequence: Synthetic peptide
  Seed: GKYDPAVRSL (TYRP1_HUMAN)
GEYDPAVRSF

SEQ ID NO: 167769 - protein, 9 aa, Artificial Sequence
  Description of Artificial Sequence: Synthetic peptide
  Seed: LIFGTASYL (TYRP1_HUMAN)
LVFGTASYV

SEQ ID NO: 167770 - protein, 9 aa, Artificial Sequence
  Description of Artificial Sequence: Synthetic peptide
  Seed: RQCATVEAL (TYRP1_HUMAN)
RMCATVEAW

SEQ ID NO: 167771 - protein, 9 aa, Artificial Sequence
  Description of Artificial Sequence: Synthetic peptide
  Seed: IATRRSEEI (TYRP1_HUMAN)
IATRRSEEL

SEQ ID NO: 167772 - protein, 9 aa, Artificial Sequence
  Description of Artificial Sequence: Synthetic peptide
  Seed: SPNDPIFVL (TYRP1_HUMAN)
SPNDPIFVW

SEQ ID NO: 167773 - protein, 11 aa, Artificial Sequence
  Description of Artificial Sequence: Synthetic peptide
  Seed: LVALIFGTASY (TYRP1_HUMAN)
LSALIFGTASY

SEQ ID NO: 167774 - protein, 9 aa, Artificial Sequence
  Description of Artificial Sequence: Synthetic peptide
  Seed: RYHLLRLEK (TYRP1_HUMAN)
RSHLLRLEL

SEQ ID NO: 167775 - protein, 11 aa, Artificial Sequence
  Description of Artificial Sequence: Synthetic peptide
  Seed: ILGPDGNTPQF (TYRP1_HUMAN)
ISGPDGNTPQW

SEQ ID NO: 167776 - protein, 9 aa, Artificial Sequence
  Description of Artificial Sequence: Synthetic peptide
  Seed: RARRSMDEA (TYRP1_HUMAN)
RMRRSMDEM

SEQ ID NO: 167777 - protein, 10 aa, Artificial Sequence
  Description of Artificial Sequence: Synthetic peptide
  Seed: SMDEANQPLL (TYRP1_HUMAN)
SADEANQPLV

SEQ ID NO: 167778 - protein, 9 aa, Artificial Sequence
  Description of Artificial Sequence: Synthetic peptide
  Seed: RGRCEAVTA (TYRP1_HUMAN)
RMRCEAVTR

SEQ ID NO: 167779 - protein, 9 aa, Artificial Sequence
  Description of Artificial Sequence: Synthetic peptide
  Seed: HLSPNDPIF (TYRP1_HUMAN)
HSSPNDPIL

SEQ ID NO: 167780 - protein, 10 aa, Artificial Sequence
  Description of Artificial Sequence: Synthetic peptide
  Seed: QCYAEEYEKL (TYRP1_HUMAN)
QRYAEEYEKF

SEQ ID NO: 167781 - protein, 9 aa, Artificial Sequence
  Description of Artificial Sequence: Synthetic peptide
  Seed: RSLHNLAHL (TYRP1_HUMAN)
RVLHNLAHK

SEQ ID NO: 167782 - protein, 11 aa, Artificial Sequence
  Description of Artificial Sequence: Synthetic peptide
  Seed: RSMDEANQPLL (TYRP1_HUMAN)
RGMDEANQPLW

SEQ ID NO: 167783 - protein, 9 aa, Artificial Sequence
  Description of Artificial Sequence: Synthetic peptide
  Seed: YYSVKKTFL (TYRP1_HUMAN)
YFSVKKTFF

SEQ ID NO: 167784 - protein, 9 aa, Artificial Sequence
  Description of Artificial Sequence: Synthetic peptide
  Seed: AVVGALLLV (TYRP1_HUMAN)
AMVGALLLK

SEQ ID NO: 167785 - protein, 9 aa, Artificial Sequence
  Description of Artificial Sequence: Synthetic peptide
  Seed: FSHEGPAFL (TYRP1_HUMAN)
FLHEGPAFG

SEQ ID NO: 167786 - protein, 10 aa, Artificial Sequence
  Description of Artificial Sequence: Synthetic peptide
  Seed: ENISIYNYFV (TYRP1_HUMAN)
ESISIYNYFV

SEQ ID NO: 167787 - protein, 11 aa, Artificial Sequence
  Description of Artificial Sequence: Synthetic peptide
  Seed: IYNYFVWTHYY (TYRP1_HUMAN)
ITNYFVWTHYY

SEQ ID NO: 167788 - protein, 10 aa, Artificial Sequence
  Description of Artificial Sequence: Synthetic peptide
  Seed: FSVPEIIAIA (TYRP1_HUMAN)
FHVPEIIAIV

SEQ ID NO: 167789 - protein, 9 aa, Artificial Sequence
  Description of Artificial Sequence: Synthetic peptide
  Seed: HEGPAFLTW (TYRP1_HUMAN)
HQGPAFLTY

SEQ ID NO: 167790 - protein, 9 aa, Artificial Sequence
  Description of Artificial Sequence: Synthetic peptide
  Seed: SVFSQWRVV (TYRP1_HUMAN)
SLFSQWRVK

SEQ ID NO: 167791 - protein, 10 aa, Artificial Sequence
  Description of Artificial Sequence: Synthetic peptide
  Seed: FYSNSTNSFR (TYRP1_HUMAN)
FASNSTNSFK

SEQ ID NO: 167792 - protein, 9 aa, Artificial Sequence
  Description of Artificial Sequence: Synthetic peptide
  Seed: AVVGALLLV (TYRP1_HUMAN)
AQVGALLLM

SEQ ID NO: 167793 - protein, 9 aa, Artificial Sequence
  Description of Artificial Sequence: Synthetic peptide
  Seed: RARRSMDEA (TYRP1_HUMAN)
RYRRSMDEK

SEQ ID NO: 167794 - protein, 9 aa, Artificial Sequence
  Description of Artificial Sequence: Synthetic peptide
  Seed: MSAPKLLSL (TYRP1_HUMAN)
MTAPKLLSY

SEQ ID NO: 167795 - protein, 9 aa, Artificial Sequence
  Description of Artificial Sequence: Synthetic peptide
  Seed: SIYNYFVWT (TYRP1_HUMAN)
SQYNYFVWT

SEQ ID NO: 167796 - protein, 10 aa, Artificial Sequence
  Description of Artificial Sequence: Synthetic peptide
  Seed: AVFDEWLRRY (TYRP1_HUMAN)
AWFDEWLRRY

SEQ ID NO: 167797 - protein, 9 aa, Artificial Sequence
  Description of Artificial Sequence: Synthetic peptide
  Seed: IAVVGALLL (TYRP1_HUMAN)
ILVVGALLL

SEQ ID NO: 167798 - protein, 9 aa, Artificial Sequence
  Description of Artificial Sequence: Synthetic peptide
  Seed: KYDPAVRSL (TYRP1_HUMAN)
KADPAVRSV

SEQ ID NO: 167799 - protein, 9 aa, Artificial Sequence
  Description of Artificial Sequence: Synthetic peptide
  Seed: FPLENAPIG (TYRP1_HUMAN)
FILENAPIM

SEQ ID NO: 167800 - protein, 9 aa, Artificial Sequence
  Description of Artificial Sequence: Synthetic peptide
  Seed: NISIYNYFV (TYRP1_HUMAN)
NISIYNYFI

SEQ ID NO: 167801 - protein, 9 aa, Artificial Sequence
  Description of Artificial Sequence: Synthetic peptide
  Seed: FSHEGPAFL (TYRP1_HUMAN)
FQHEGPAFH

SEQ ID NO: 167802 - protein, 9 aa, Artificial Sequence
  Description of Artificial Sequence: Synthetic peptide
  Seed: SVKKTFLGV (TYRP1_HUMAN)
SVKKTFLGG

SEQ ID NO: 167803 - protein, 9 aa, Artificial Sequence
  Description of Artificial Sequence: Synthetic peptide
  Seed: MAKRTTHPL (TYRP1_HUMAN)
MPKRTTHPS

SEQ ID NO: 167804 - protein, 11 aa, Artificial Sequence
  Description of Artificial Sequence: Synthetic peptide
  Seed: YNYFVWTHYYS (TYRP1_HUMAN)
YFYFVWTHYYP

SEQ ID NO: 167805 - protein, 9 aa, Artificial Sequence
  Description of Artificial Sequence: Synthetic peptide
  Seed: NADISTFPL (TYRP1_HUMAN)
NGDISTFPL

SEQ ID NO: 167806 - protein, 10 aa, Artificial Sequence
  Description of Artificial Sequence: Synthetic peptide
  Seed: IAIAVVGALL (TYRP1_HUMAN)
IVIAVVGALV

SEQ ID NO: 167807 - protein, 9 aa, Artificial Sequence
  Description of Artificial Sequence: Synthetic peptide
  Seed: LFQQARAQF (TYRP1_HUMAN)
LKQQARAQY

SEQ ID NO: 167808 - protein, 9 aa, Artificial Sequence
  Description of Artificial Sequence: Synthetic peptide
  Seed: AQFPRQCAT (TYRP1_HUMAN)
ALFPRQCAM

SEQ ID NO: 167809 - protein, 10 aa, Artificial Sequence
  Description of Artificial Sequence: Synthetic peptide
  Seed: LLTDQYQCYA (TYRP1_HUMAN)
LMTDQYQCYI

SEQ ID NO: 167810 - protein, 9 aa, Artificial Sequence
  Description of Artificial Sequence: Synthetic peptide
  Seed: ENAPIGHNR (TYRP1_HUMAN)
EAAPIGHNY

SEQ ID NO: 167811 - protein, 11 aa, Artificial Sequence
  Description of Artificial Sequence: Synthetic peptide
  Seed: QEMLQEPSFSL (TYRP1_HUMAN)
QKMLQEPSFSI

SEQ ID NO: 167812 - protein, 10 aa, Artificial Sequence
  Description of Artificial Sequence: Synthetic peptide
  Seed: FLNGTGGQTH (TYRP1_HUMAN)
FGNGTGGQTM

SEQ ID NO: 167813 - protein, 10 aa, Artificial Sequence
  Description of Artificial Sequence: Synthetic peptide
  Seed: SPNDPIFVLL (TYRP1_HUMAN)
STNDPIFVLM

SEQ ID NO: 167814 - protein, 9 aa, Artificial Sequence
  Description of Artificial Sequence: Synthetic peptide
  Seed: YNYFVWTHY (TYRP1_HUMAN)
YVYFVWTHK

SEQ ID NO: 167815 - protein, 10 aa, Artificial Sequence
  Description of Artificial Sequence: Synthetic peptide
  Seed: IAIAVVGALL (TYRP1_HUMAN)
ISIAVVGALW

SEQ ID NO: 167816 - protein, 10 aa, Artificial Sequence
  Description of Artificial Sequence: Synthetic peptide
  Seed: ADSRPHSPQY (TYRP1_HUMAN)
ADSRPHSPQA

SEQ ID NO: 167817 - protein, 10 aa, Artificial Sequence
  Description of Artificial Sequence: Synthetic peptide
  Seed: HNRQYNMVPF (TYRP1_HUMAN)
HERQYNMVPF

SEQ ID NO: 167818 - protein, 9 aa, Artificial Sequence
  Description of Artificial Sequence: Synthetic peptide
  Seed: RARRSMDEA (TYRP1_HUMAN)
RIRRSMDEA

SEQ ID NO: 167819 - protein, 9 aa, Artificial Sequence
  Description of Artificial Sequence: Synthetic peptide
  Seed: FLGVGQESF (TYRP1_HUMAN)
FAGVGQESV

SEQ ID NO: 167820 - protein, 9 aa, Artificial Sequence
  Description of Artificial Sequence: Synthetic peptide
  Seed: YTYEIQWPS (TYRP1_HUMAN)
YQYEIQWPI

SEQ ID NO: 167821 - protein, 9 aa, Artificial Sequence
  Description of Artificial Sequence: Synthetic peptide
  Seed: FVWTHYYSV (TYRP1_HUMAN)
FLWTHYYSY

SEQ ID NO: 167822 - protein, 9 aa, Artificial Sequence
  Description of Artificial Sequence: Synthetic peptide
  Seed: HYYSVKKTF (TYRP1_HUMAN)
HFYSVKKTL

SEQ ID NO: 167823 - protein, 9 aa, Artificial Sequence
  Description of Artificial Sequence: Synthetic peptide
  Seed: RYHLLRLEK (TYRP1_HUMAN)
RSHLLRLER

SEQ ID NO: 167824 - protein, 10 aa, Artificial Sequence
  Description of Artificial Sequence: Synthetic peptide
  Seed: FGTASYLIRA (TYRP1_HUMAN)
FYTASYLIRV

SEQ ID NO: 167825 - protein, 9 aa, Artificial Sequence
  Description of Artificial Sequence: Synthetic peptide
  Seed: SPNDPIFVL (TYRP1_HUMAN)
SQNDPIFVM

SEQ ID NO: 167826 - protein, 10 aa, Artificial Sequence
  Description of Artificial Sequence: Synthetic peptide
  Seed: FSVPEIIAIA (TYRP1_HUMAN)
FIVPEIIAII

SEQ ID NO: 167827 - protein, 11 aa, Artificial Sequence
  Description of Artificial Sequence: Synthetic peptide
  Seed: REFSVPEIIAI (TYRP1_HUMAN)
REFSVPEIIAC

SEQ ID NO: 167828 - protein, 10 aa, Artificial Sequence
  Description of Artificial Sequence: Synthetic peptide
  Seed: LIFGTASYLI (TYRP1_HUMAN)
LVFGTASYLI

SEQ ID NO: 167829 - protein, 9 aa, Artificial Sequence
  Description of Artificial Sequence: Synthetic peptide
  Seed: AVFDEWLRR (TYRP1_HUMAN)
AIFDEWLRR

SEQ ID NO: 167830 - protein, 9 aa, Artificial Sequence
  Description of Artificial Sequence: Synthetic peptide
  Seed: PNDPIFVLL (TYRP1_HUMAN)
PMDPIFVLL

SEQ ID NO: 167831 - protein, 10 aa, Artificial Sequence
  Description of Artificial Sequence: Synthetic peptide
  Seed: FSLPYWNFAT (TYRP1_HUMAN)
FALPYWNFAL

SEQ ID NO: 167832 - protein, 10 aa, Artificial Sequence
  Description of Artificial Sequence: Synthetic peptide
  Seed: FYSNSTNSFR (TYRP1_HUMAN)
FVSNSTNSFR

SEQ ID NO: 167833 - protein, 9 aa, Artificial Sequence
  Description of Artificial Sequence: Synthetic peptide
  Seed: SPNDPIFVL (TYRP1_HUMAN)
SSNDPIFVI

SEQ ID NO: 167834 - protein, 10 aa, Artificial Sequence
  Description of Artificial Sequence: Synthetic peptide
  Seed: YFVWTHYYSV (TYRP1_HUMAN)
YPVWTHYYSI

SEQ ID NO: 167835 - protein, 9 aa, Artificial Sequence
  Description of Artificial Sequence: Synthetic peptide
  Seed: ALIFGTASY (TYRP1_HUMAN)
AAIFGTASL

SEQ ID NO: 167836 - protein, 10 aa, Artificial Sequence
  Description of Artificial Sequence: Synthetic peptide
  Seed: MAKRTTHPLF (TYRP1_HUMAN)
MGKRTTHPLW

SEQ ID NO: 167837 - protein, 9 aa, Artificial Sequence
  Description of Artificial Sequence: Synthetic peptide
  Seed: RQYNMVPFW (TYRP1_HUMAN)
RGYNMVPFW

SEQ ID NO: 167838 - protein, 10 aa, Artificial Sequence
  Description of Artificial Sequence: Synthetic peptide
  Seed: YNYFVWTHYY (TYRP1_HUMAN)
YTYFVWTHYL

SEQ ID NO: 167839 - protein, 9 aa, Artificial Sequence
  Description of Artificial Sequence: Synthetic peptide
  Seed: RLEKDMQEM (TYRP1_HUMAN)
RQEKDMQEV

SEQ ID NO: 167840 - protein, 9 aa, Artificial Sequence
  Description of Artificial Sequence: Synthetic peptide
  Seed: HYYSVKKTF (TYRP1_HUMAN)
HYYSVKKTL

SEQ ID NO: 167841 - protein, 9 aa, Artificial Sequence
  Description of Artificial Sequence: Synthetic peptide
  Seed: ACDQRVLIV (TYRP1_HUMAN)
AIDQRVLIM

SEQ ID NO: 167842 - protein, 8 aa, Artificial Sequence
  Description of Artificial Sequence: Synthetic peptide
  Seed: LIFGTASY (TYRP1_HUMAN)
LKFGTASF

SEQ ID NO: 167843 - protein, 9 aa, Artificial Sequence
  Description of Artificial Sequence: Synthetic peptide
  Seed: AVFDEWLRR (TYRP1_HUMAN)
AWFDEWLRR

SEQ ID NO: 167844 - protein, 9 aa, Artificial Sequence
  Description of Artificial Sequence: Synthetic peptide
  Seed: FSLPYWNFA (TYRP1_HUMAN)
FTLPYWNFF

SEQ ID NO: 167845 - protein, 9 aa, Artificial Sequence
  Description of Artificial Sequence: Synthetic peptide
  Seed: VDFSHEGPA (TYRP1_HUMAN)
VEFSHEGPL

SEQ ID NO: 167846 - protein, 11 aa, Artificial Sequence
  Description of Artificial Sequence: Synthetic peptide
  Seed: LVALIFGTASY (TYRP1_HUMAN)
LAALIFGTASY

SEQ ID NO: 167847 - protein, 9 aa, Artificial Sequence
  Description of Artificial Sequence: Synthetic peptide
  Seed: LPYWNFATG (TYRP1_HUMAN)
LAYWNFATF

SEQ ID NO: 167848 - protein, 9 aa, Artificial Sequence
  Description of Artificial Sequence: Synthetic peptide
  Seed: RQYNMVPFW (TYRP1_HUMAN)
RWYNMVPFM

SEQ ID NO: 167849 - protein, 9 aa, Artificial Sequence
  Description of Artificial Sequence: Synthetic peptide
  Seed: EEYEKLQNP (TYRP1_HUMAN)
EDYEKLQNL

SEQ ID NO: 167850 - protein, 9 aa, Artificial Sequence
  Description of Artificial Sequence: Synthetic peptide
  Seed: RLEKDMQEM (TYRP1_HUMAN)
RQEKDMQEM

SEQ ID NO: 167851 - protein, 10 aa, Artificial Sequence
  Description of Artificial Sequence: Synthetic peptide
  Seed: DAVFDEWLRR (TYRP1_HUMAN)
DQVFDEWLRR

SEQ ID NO: 167852 - protein, 8 aa, Artificial Sequence
  Description of Artificial Sequence: Synthetic peptide
  Seed: TEDGPIRR (TYRP1_HUMAN)
TVDGPIRY

SEQ ID NO: 167853 - protein, 11 aa, Artificial Sequence
  Description of Artificial Sequence: Synthetic peptide
  Seed: RSLHNLAHLFL (TYRP1_HUMAN)
RSLHNLAHLFY

SEQ ID NO: 167854 - protein, 8 aa, Artificial Sequence
  Description of Artificial Sequence: Synthetic peptide
  Seed: VPFWPPVT (TYRP1_HUMAN)
VPFWPPVA

SEQ ID NO: 167855 - protein, 9 aa, Artificial Sequence
  Description of Artificial Sequence: Synthetic peptide
  Seed: YTYEIQWPS (TYRP1_HUMAN)
YIYEIQWPE

SEQ ID NO: 167856 - protein, 9 aa, Artificial Sequence
  Description of Artificial Sequence: Synthetic peptide
  Seed: VTAPDNLGY (TYRP1_HUMAN)
VSAPDNLGM

SEQ ID NO: 167857 - protein, 9 aa, Artificial Sequence
  Description of Artificial Sequence: Synthetic peptide
  Seed: SLHNLAHLF (TYRP1_HUMAN)
SRHNLAHLL

SEQ ID NO: 167858 - protein, 11 aa, Artificial Sequence
  Description of Artificial Sequence: Synthetic peptide
  Seed: HLSPNDPIFVL (TYRP1_HUMAN)
HMSPNDPIFVY

SEQ ID NO: 167859 - protein, 9 aa, Artificial Sequence
  Description of Artificial Sequence: Synthetic peptide
  Seed: FSLPYWNFA (TYRP1_HUMAN)
FALPYWNFF

SEQ ID NO: 167860 - protein, 9 aa, Artificial Sequence
  Description of Artificial Sequence: Synthetic peptide
  Seed: TLISPNSVF (TYRP1_HUMAN)
TQISPNSVF

SEQ ID NO: 167861 - protein, 10 aa, Artificial Sequence
  Description of Artificial Sequence: Synthetic peptide
  Seed: TAPDNLGYTY (TYRP1_HUMAN)
TLPDNLGYTF

SEQ ID NO: 167862 - protein, 10 aa, Artificial Sequence
  Description of Artificial Sequence: Synthetic peptide
  Seed: IFGTASYLIR (TYRP1_HUMAN)
IMGTASYLIR

SEQ ID NO: 167863 - protein, 9 aa, Artificial Sequence
  Description of Artificial Sequence: Synthetic peptide
  Seed: RPMVQRLPE (TYRP1_HUMAN)
RPMVQRLPW

SEQ ID NO: 167864 - protein, 10 aa, Artificial Sequence
  Description of Artificial Sequence: Synthetic peptide
  Seed: NVARPMVQRL (TYRP1_HUMAN)
NIARPMVQRR

SEQ ID NO: 167865 - protein, 9 aa, Artificial Sequence
  Description of Artificial Sequence: Synthetic peptide
  Seed: YNYFVWTHY (TYRP1_HUMAN)
YPYFVWTHY

SEQ ID NO: 167866 - protein, 10 aa, Artificial Sequence
  Description of Artificial Sequence: Synthetic peptide
  Seed: IYNYFVWTHY (TYRP1_HUMAN)
IWNYFVWTHL

SEQ ID NO: 167867 - protein, 9 aa, Artificial Sequence
  Description of Artificial Sequence: Synthetic peptide
  Seed: GPDGNTPQF (TYRP1_HUMAN)
GFDGNTPQV

SEQ ID NO: 167868 - protein, 9 aa, Artificial Sequence
  Description of Artificial Sequence: Synthetic peptide
  Seed: LTWHRYHLL (TYRP1_HUMAN)
LAWHRYHLW

SEQ ID NO: 167869 - protein, 9 aa, Artificial Sequence
  Description of Artificial Sequence: Synthetic peptide
  Seed: RFFNRTCHC (TYRP1_HUMAN)
RSFNRTCHS

SEQ ID NO: 167870 - protein, 8 aa, Artificial Sequence
  Description of Artificial Sequence: Synthetic peptide
  Seed: YDPAVRSL (TYRP1_HUMAN)
YAPAVRSI

SEQ ID NO: 167871 - protein, 9 aa, Artificial Sequence
  Description of Artificial Sequence: Synthetic peptide
  Seed: NYFVWTHYY (TYRP1_HUMAN)
NWFVWTHYW

SEQ ID NO: 167872 - protein, 10 aa, Artificial Sequence
  Description of Artificial Sequence: Synthetic peptide
  Seed: EIIAIAVVGA (TYRP1_HUMAN)
ESIAIAVVGL

SEQ ID NO: 167873 - protein, 8 aa, Artificial Sequence
  Description of Artificial Sequence: Synthetic peptide
  Seed: FSHEGPAF (TYRP1_HUMAN)
FVHEGPAY

SEQ ID NO: 167874 - protein, 10 aa, Artificial Sequence
  Description of Artificial Sequence: Synthetic peptide
  Seed: LLLVALIFGT (TYRP1_HUMAN)
LFLVALIFGV

SEQ ID NO: 167875 - protein, 8 aa, Artificial Sequence
  Description of Artificial Sequence: Synthetic peptide
  Seed: IAVVGALL (TYRP1_HUMAN)
IQVVGALV

SEQ ID NO: 167876 - protein, 10 aa, Artificial Sequence
  Description of Artificial Sequence: Synthetic peptide
  Seed: YNMVPFWPPV (TYRP1_HUMAN)
YDMVPFWPPI

SEQ ID NO: 167877 - protein, 8 aa, Artificial Sequence
  Description of Artificial Sequence: Synthetic peptide
  Seed: IFFPLLLF (TYRP1_HUMAN)
IMFPLLLY

SEQ ID NO: 167878 - protein, 9 aa, Artificial Sequence
  Description of Artificial Sequence: Synthetic peptide
  Seed: ALIFGTASY (TYRP1_HUMAN)
ATIFGTASF

SEQ ID NO: 167879 - protein, 9 aa, Artificial Sequence
  Description of Artificial Sequence: Synthetic peptide
  Seed: HYYSVKKTF (TYRP1_HUMAN)
HRYSVKKTY

SEQ ID NO: 167880 - protein, 9 aa, Artificial Sequence
  Description of Artificial Sequence: Synthetic peptide
  Seed: RQYNMVPFW (TYRP1_HUMAN)
RRYNMVPFA

SEQ ID NO: 167881 - protein, 10 aa, Artificial Sequence
  Description of Artificial Sequence: Synthetic peptide
  Seed: SLHNLAHLFL (TYRP1_HUMAN)
SLHNLAHLFI

SEQ ID NO: 167882 - protein, 10 aa, Artificial Sequence
  Description of Artificial Sequence: Synthetic peptide
  Seed: AVFDEWLRRY (TYRP1_HUMAN)
ATFDEWLRRF

SEQ ID NO: 167883 - protein, 9 aa, Artificial Sequence
  Description of Artificial Sequence: Synthetic peptide
  Seed: YTYEIQWPS (TYRP1_HUMAN)
YVYEIQWPY

SEQ ID NO: 167884 - protein, 10 aa, Artificial Sequence
  Description of Artificial Sequence: Synthetic peptide
  Seed: RSMDEANQPL (TYRP1_HUMAN)
RVMDEANQPW

SEQ ID NO: 167885 - protein, 11 aa, Artificial Sequence
  Description of Artificial Sequence: Synthetic peptide
  Seed: MAKRTTHPLFV (TYRP1_HUMAN)
MQKRTTHPLFK

SEQ ID NO: 167886 - protein, 11 aa, Artificial Sequence
  Description of Artificial Sequence: Synthetic peptide
  Seed: FWPPVTNTEMF (TYRP1_HUMAN)
FYPPVTNTEMM

SEQ ID NO: 167887 - protein, 9 aa, Artificial Sequence
  Description of Artificial Sequence: Synthetic peptide
  Seed: APDNLGYTY (TYRP1_HUMAN)
AIDNLGYTY

SEQ ID NO: 167888 - protein, 9 aa, Artificial Sequence
  Description of Artificial Sequence: Synthetic peptide
  Seed: RYHLLRLEK (TYRP1_HUMAN)
RVHLLRLER

SEQ ID NO: 167889 - protein, 10 aa, Artificial Sequence
  Description of Artificial Sequence: Synthetic peptide
  Seed: YFVWTHYYSV (TYRP1_HUMAN)
YPVWTHYYSL

SEQ ID NO: 167890 - protein, 9 aa, Artificial Sequence
  Description of Artificial Sequence: Synthetic peptide
  Seed: SPNDPIFVL (TYRP1_HUMAN)
SVNDPIFVY

SEQ ID NO: 167891 - protein, 9 aa, Artificial Sequence
  Description of Artificial Sequence: Synthetic peptide
  Seed: ENAPIGHNR (TYRP1_HUMAN)
EMAPIGHNK

SEQ ID NO: 167892 - protein, 11 aa, Artificial Sequence
  Description of Artificial Sequence: Synthetic peptide
  Seed: VRSLHNLAHLF (TYRP1_HUMAN)
VISLHNLAHLW

SEQ ID NO: 167893 - protein, 11 aa, Artificial Sequence
  Description of Artificial Sequence: Synthetic peptide
  Seed: YNYFVWTHYYS (TYRP1_HUMAN)
YFYFVWTHYYM

SEQ ID NO: 167894 - protein, 9 aa, Artificial Sequence
  Description of Artificial Sequence: Synthetic peptide
  Seed: SRSNFDSTL (TYRP1_HUMAN)
SYSNFDSTF

SEQ ID NO: 167895 - protein, 9 aa, Artificial Sequence
  Description of Artificial Sequence: Synthetic peptide
  Seed: GLFDTPPFY (TYRP1_HUMAN)
GTFDTPPFI

SEQ ID NO: 167896 - protein, 9 aa, Artificial Sequence
  Description of Artificial Sequence: Synthetic peptide
  Seed: VCDICTDDL (TYRP1_HUMAN)
VVDICTDDF

SEQ ID NO: 167897 - protein, 9 aa, Artificial Sequence
  Description of Artificial Sequence: Synthetic peptide
  Seed: FLTWHRYHL (TYRP1_HUMAN)
FSTWHRYHI

SEQ ID NO: 167898 - protein, 9 aa, Artificial Sequence
  Description of Artificial Sequence: Synthetic peptide
  Seed: MDEANQPLL (TYRP1_HUMAN)
MSEANQPLM

SEQ ID NO: 167899 - protein, 10 aa, Artificial Sequence
  Description of Artificial Sequence: Synthetic peptide
  Seed: SVPEIIAIAV (TYRP1_HUMAN)
SIPEIIAIAV

SEQ ID NO: 167900 - protein, 9 aa, Artificial Sequence
  Description of Artificial Sequence: Synthetic peptide
  Seed: IAVVGALLL (TYRP1_HUMAN)
IAVVGALLF

SEQ ID NO: 167901 - protein, 10 aa, Artificial Sequence
  Description of Artificial Sequence: Synthetic peptide
  Seed: TAPDNLGYTY (TYRP1_HUMAN)
TAPDNLGYTF

SEQ ID NO: 167902 - protein, 11 aa, Artificial Sequence
  Description of Artificial Sequence: Synthetic peptide
  Seed: TTHPLFVIATR (TYRP1_HUMAN)
TTHPLFVIATK

SEQ ID NO: 167903 - protein, 9 aa, Artificial Sequence
  Description of Artificial Sequence: Synthetic peptide
  Seed: AQFPRQCAT (TYRP1_HUMAN)
AMFPRQCAY

SEQ ID NO: 167904 - protein, 10 aa, Artificial Sequence
  Description of Artificial Sequence: Synthetic peptide
  Seed: FYSNSTNSFR (TYRP1_HUMAN)
FRSNSTNSFK

SEQ ID NO: 167905 - protein, 9 aa, Artificial Sequence
  Description of Artificial Sequence: Synthetic peptide
  Seed: GPDGNTPQF (TYRP1_HUMAN)
GTDGNTPQV

SEQ ID NO: 167906 - protein, 9 aa, Artificial Sequence
  Description of Artificial Sequence: Synthetic peptide
  Seed: VFDEWLRRY (TYRP1_HUMAN)
VGDEWLRRI

SEQ ID NO: 167907 - protein, 10 aa, Artificial Sequence
  Description of Artificial Sequence: Synthetic peptide
  Seed: LIFGTASYLI (TYRP1_HUMAN)
LLFGTASYLA

SEQ ID NO: 167908 - protein, 11 aa, Artificial Sequence
  Description of Artificial Sequence: Synthetic peptide
  Seed: REFSVPEIIAI (TYRP1_HUMAN)
RQFSVPEIIAV

SEQ ID NO: 167909 - protein, 11 aa, Artificial Sequence
  Description of Artificial Sequence: Synthetic peptide
  Seed: EILGPDGNTPQ (TYRP1_HUMAN)
EVLGPDGNTPK

SEQ ID NO: 167910 - protein, 10 aa, Artificial Sequence
  Description of Artificial Sequence: Synthetic peptide
  Seed: WPPVTNTEMF (TYRP1_HUMAN)
WWPVTNTEMY

SEQ ID NO: 167911 - protein, 10 aa, Artificial Sequence
  Description of Artificial Sequence: Synthetic peptide
  Seed: EVWPLRFFNR (TYRP1_HUMAN)
ELWPLRFFNR

SEQ ID NO: 167912 - protein, 10 aa, Artificial Sequence
  Description of Artificial Sequence: Synthetic peptide
  Seed: LSPNDPIFVL (TYRP1_HUMAN)
LDPNDPIFVF

SEQ ID NO: 167913 - protein, 9 aa, Artificial Sequence
  Description of Artificial Sequence: Synthetic peptide
  Seed: VFDEWLRRY (TYRP1_HUMAN)
VIDEWLRRV

SEQ ID NO: 167914 - protein, 9 aa, Artificial Sequence
  Description of Artificial Sequence: Synthetic peptide
  Seed: MSAPKLLSL (TYRP1_HUMAN)
MKAPKLLSM

SEQ ID NO: 167915 - protein, 10 aa, Artificial Sequence
  Description of Artificial Sequence: Synthetic peptide
  Seed: MLQEPSFSLP (TYRP1_HUMAN)
MLQEPSFSLI

SEQ ID NO: 167916 - protein, 10 aa, Artificial Sequence
  Description of Artificial Sequence: Synthetic peptide
  Seed: NLAHLFLNGT (TYRP1_HUMAN)
NLAHLFLNGA

SEQ ID NO: 167917 - protein, 10 aa, Artificial Sequence
  Description of Artificial Sequence: Synthetic peptide
  Seed: ADSRPHSPQY (TYRP1_HUMAN)
AWSRPHSPQA

SEQ ID NO: 167918 - protein, 9 aa, Artificial Sequence
  Description of Artificial Sequence: Synthetic peptide
  Seed: ALLLVALIF (TYRP1_HUMAN)
AQLLVALIM

SEQ ID NO: 167919 - protein, 9 aa, Artificial Sequence
  Description of Artificial Sequence: Synthetic peptide
  Seed: RVLIVRRNL (TYRP1_HUMAN)
RSLIVRRNV

SEQ ID NO: 167920 - protein, 10 aa, Artificial Sequence
  Description of Artificial Sequence: Synthetic peptide
  Seed: STLISPNSVF (TYRP1_HUMAN)
SALISPNSVF

SEQ ID NO: 167921 - protein, 9 aa, Artificial Sequence
  Description of Artificial Sequence: Synthetic peptide
  Seed: LIFGTASYL (TYRP1_HUMAN)
LSFGTASYV

SEQ ID NO: 167922 - protein, 10 aa, Artificial Sequence
  Description of Artificial Sequence: Synthetic peptide
  Seed: NMVPFWPPVT (TYRP1_HUMAN)
NMVPFWPPVI

SEQ ID NO: 167923 - protein, 8 aa, Artificial Sequence
  Description of Artificial Sequence: Synthetic peptide
  Seed: SAPKLLSL (TYRP1_HUMAN)
SQPKLLSV

SEQ ID NO: 167924 - protein, 9 aa, Artificial Sequence
  Description of Artificial Sequence: Synthetic peptide
  Seed: ALIFGTASY (TYRP1_HUMAN)
AMIFGTASY

SEQ ID NO: 167925 - protein, 9 aa, Artificial Sequence
  Description of Artificial Sequence: Synthetic peptide
  Seed: NISIYNYFV (TYRP1_HUMAN)
NVSIYNYFA

SEQ ID NO: 167926 - protein, 11 aa, Artificial Sequence
  Description of Artificial Sequence: Synthetic peptide
  Seed: TEMFVTAPDNL (TYRP1_HUMAN)
TEMFVTAPDNW

SEQ ID NO: 167927 - protein, 10 aa, Artificial Sequence
  Description of Artificial Sequence: Synthetic peptide
  Seed: AFLTWHRYHL (TYRP1_HUMAN)
ALLTWHRYHA

SEQ ID NO: 167928 - protein, 9 aa, Artificial Sequence
  Description of Artificial Sequence: Synthetic peptide
  Seed: STLISPNSV (TYRP1_HUMAN)
SALISPNSW

SEQ ID NO: 167929 - protein, 10 aa, Artificial Sequence
  Description of Artificial Sequence: Synthetic peptide
  Seed: GNVARPMVQR (TYRP1_HUMAN)
GPVARPMVQK

SEQ ID NO: 167930 - protein, 9 aa, Artificial Sequence
  Description of Artificial Sequence: Synthetic peptide
  Seed: SLHNLAHLF (TYRP1_HUMAN)
SGHNLAHLW

SEQ ID NO: 167931 - protein, 9 aa, Artificial Sequence
  Description of Artificial Sequence: Synthetic peptide
  Seed: AVFDEWLRR (TYRP1_HUMAN)
AYFDEWLRY

SEQ ID NO: 167932 - protein, 10 aa, Artificial Sequence
  Description of Artificial Sequence: Synthetic peptide
  Seed: YNYFVWTHYY (TYRP1_HUMAN)
YGYFVWTHYL

SEQ ID NO: 167933 - protein, 10 aa, Artificial Sequence
  Description of Artificial Sequence: Synthetic peptide
  Seed: FLTWHRYHLL (TYRP1_HUMAN)
FETWHRYHLV

SEQ ID NO: 167934 - protein, 9 aa, Artificial Sequence
  Description of Artificial Sequence: Synthetic peptide
  Seed: MLQEPSFSL (TYRP1_HUMAN)
MPQEPSFSL

SEQ ID NO: 167935 - protein, 9 aa, Artificial Sequence
  Description of Artificial Sequence: Synthetic peptide
  Seed: LTWHRYHLL (TYRP1_HUMAN)
LTWHRYHLF

SEQ ID NO: 167936 - protein, 9 aa, Artificial Sequence
  Description of Artificial Sequence: Synthetic peptide
  Seed: ALIFGTASY (TYRP1_HUMAN)
AGIFGTASF

SEQ ID NO: 167937 - protein, 10 aa, Artificial Sequence
  Description of Artificial Sequence: Synthetic peptide
  Seed: HRYHLLRLEK (TYRP1_HUMAN)
HFYHLLRLEK

SEQ ID NO: 167938 - protein, 9 aa, Artificial Sequence
  Description of Artificial Sequence: Synthetic peptide
  Seed: MLQEPSFSL (TYRP1_HUMAN)
MLQEPSFSV

SEQ ID NO: 167939 - protein, 11 aa, Artificial Sequence
  Description of Artificial Sequence: Synthetic peptide
  Seed: SIYNYFVWTHY (TYRP1_HUMAN)
SKYNYFVWTHF

SEQ ID NO: 167940 - protein, 10 aa, Artificial Sequence
  Description of Artificial Sequence: Synthetic peptide
  Seed: TAPDNLGYTY (TYRP1_HUMAN)
TVPDNLGYTL

SEQ ID NO: 167941 - protein, 8 aa, Artificial Sequence
  Description of Artificial Sequence: Synthetic peptide
  Seed: FSHEGPAF (TYRP1_HUMAN)
FFHEGPAY

SEQ ID NO: 167942 - protein, 9 aa, Artificial Sequence
  Description of Artificial Sequence: Synthetic peptide
  Seed: NSVFSQWRV (TYRP1_HUMAN)
NIVFSQWRV

SEQ ID NO: 167943 - protein, 9 aa, Artificial Sequence
  Description of Artificial Sequence: Synthetic peptide
  Seed: MSAPKLLSL (TYRP1_HUMAN)
MNAPKLLSI

SEQ ID NO: 167944 - protein, 10 aa, Artificial Sequence
  Description of Artificial Sequence: Synthetic peptide
  Seed: VGLFDTPPFY (TYRP1_HUMAN)
VQLFDTPPFM

SEQ ID NO: 167945 - protein, 10 aa, Artificial Sequence
  Description of Artificial Sequence: Synthetic peptide
  Seed: SPNSVFSQWR (TYRP1_HUMAN)
SMNSVFSQWK

SEQ ID NO: 167946 - protein, 10 aa, Artificial Sequence
  Description of Artificial Sequence: Synthetic peptide
  Seed: NLAHLFLNGT (TYRP1_HUMAN)
NMAHLFLNGI

SEQ ID NO: 167947 - protein, 11 aa, Artificial Sequence
  Description of Artificial Sequence: Synthetic peptide
  Seed: KTFLGVGQESF (TYRP1_HUMAN)
KMFLGVGQESF

SEQ ID NO: 167948 - protein, 9 aa, Artificial Sequence
  Description of Artificial Sequence: Synthetic peptide
  Seed: STLISPNSV (TYRP1_HUMAN)
SMLISPNSA

SEQ ID NO: 167949 - protein, 9 aa, Artificial Sequence
  Description of Artificial Sequence: Synthetic peptide
  Seed: AACDQRVLI (TYRP1_HUMAN)
AQCDQRVLW

SEQ ID NO: 167950 - protein, 8 aa, Artificial Sequence
  Description of Artificial Sequence: Synthetic peptide
  Seed: IFVLLHTF (TYRP1_HUMAN)
IYVLLHTF

SEQ ID NO: 167951 - protein, 10 aa, Artificial Sequence
  Description of Artificial Sequence: Synthetic peptide
  Seed: LGPDGNTPQF (TYRP1_HUMAN)
LLPDGNTPQL

SEQ ID NO: 167952 - protein, 10 aa, Artificial Sequence
  Description of Artificial Sequence: Synthetic peptide
  Seed: EVWPLRFFNR (TYRP1_HUMAN)
EIWPLRFFNR

SEQ ID NO: 167953 - protein, 10 aa, Artificial Sequence
  Description of Artificial Sequence: Synthetic peptide
  Seed: RSMDEANQPL (TYRP1_HUMAN)
RCMDEANQPI

SEQ ID NO: 167954 - protein, 9 aa, Artificial Sequence
  Description of Artificial Sequence: Synthetic peptide
  Seed: DSRPHSPQY (TYRP1_HUMAN)
DARPHSPQR

SEQ ID NO: 167955 - protein, 9 aa, Artificial Sequence
  Description of Artificial Sequence: Synthetic peptide
  Seed: FPLENAPIG (TYRP1_HUMAN)
FPLENAPIF

SEQ ID NO: 167956 - protein, 9 aa, Artificial Sequence
  Description of Artificial Sequence: Synthetic peptide
  Seed: QEMLQEPSF (TYRP1_HUMAN)
QMMLQEPSM

SEQ ID NO: 167957 - protein, 10 aa, Artificial Sequence
  Description of Artificial Sequence: Synthetic peptide
  Seed: VALIFGTASY (TYRP1_HUMAN)
VHLIFGTASF

SEQ ID NO: 167958 - protein, 9 aa, Artificial Sequence
  Description of Artificial Sequence: Synthetic peptide
  Seed: GPDGNTPQF (TYRP1_HUMAN)
GMDGNTPQV

SEQ ID NO: 167959 - protein, 9 aa, Artificial Sequence
  Description of Artificial Sequence: Synthetic peptide
  Seed: YTYEIQWPS (TYRP1_HUMAN)
YLYEIQWPE

SEQ ID NO: 167960 - protein, 8 aa, Artificial Sequence
  Description of Artificial Sequence: Synthetic peptide
  Seed: RQYNMVPF (TYRP1_HUMAN)
REYNMVPL

SEQ ID NO: 167961 - protein, 10 aa, Artificial Sequence
  Description of Artificial Sequence: Synthetic peptide
  Seed: FVWTHYYSVK (TYRP1_HUMAN)
FIWTHYYSVA

SEQ ID NO: 167962 - protein, 9 aa, Artificial Sequence
  Description of Artificial Sequence: Synthetic peptide
  Seed: SRSNFDSTL (TYRP1_HUMAN)
SMSNFDSTF

SEQ ID NO: 167963 - protein, 9 aa, Artificial Sequence
  Description of Artificial Sequence: Synthetic peptide
  Seed: KLQNPNQSV (TYRP1_HUMAN)
KIQNPNQSL

SEQ ID NO: 167964 - protein, 8 aa, Artificial Sequence
  Description of Artificial Sequence: Synthetic peptide
  Seed: YNADISTF (TYRP1_HUMAN)
YAADISTM

SEQ ID NO: 167965 - protein, 9 aa, Artificial Sequence
  Description of Artificial Sequence: Synthetic peptide
  Seed: KYDPAVRSL (TYRP1_HUMAN)
KWDPAVRSI

SEQ ID NO: 167966 - protein, 9 aa, Artificial Sequence
  Description of Artificial Sequence: Synthetic peptide
  Seed: LSKEEKNHF (TYRP1_HUMAN)
LTKEEKNHW

SEQ ID NO: 167967 - protein, 10 aa, Artificial Sequence
  Description of Artificial Sequence: Synthetic peptide
  Seed: TAPDNLGYTY (TYRP1_HUMAN)
TYPDNLGYTM

SEQ ID NO: 167968 - protein, 10 aa, Artificial Sequence
  Description of Artificial Sequence: Synthetic peptide
  Seed: NTVEGYSDPT (TYRP1_HUMAN)
NVVEGYSDPV

SEQ ID NO: 167969 - protein, 9 aa, Artificial Sequence
  Description of Artificial Sequence: Synthetic peptide
  Seed: RGRCEAVTA (TYRP1_HUMAN)
RSRCEAVTV

SEQ ID NO: 167970 - protein, 9 aa, Artificial Sequence
  Description of Artificial Sequence: Synthetic peptide
  Seed: SMDEANQPL (TYRP1_HUMAN)
SPDEANQPF

SEQ ID NO: 167971 - protein, 9 aa, Artificial Sequence
  Description of Artificial Sequence: Synthetic peptide
  Seed: KLQNPNQSV (TYRP1_HUMAN)
KMQNPNQSW

SEQ ID NO: 167972 - protein, 10 aa, Artificial Sequence
  Description of Artificial Sequence: Synthetic peptide
  Seed: FVLLHTFTDA (TYRP1_HUMAN)
FGLLHTFTDL

SEQ ID NO: 167973 - protein, 8 aa, Artificial Sequence
  Description of Artificial Sequence: Synthetic peptide
  Seed: GLFDTPPF (TYRP1_HUMAN)
GQFDTPPF

SEQ ID NO: 167974 - protein, 9 aa, Artificial Sequence
  Description of Artificial Sequence: Synthetic peptide
  Seed: MSAPKLLSL (TYRP1_HUMAN)
MPAPKLLSG

SEQ ID NO: 167975 - protein, 9 aa, Artificial Sequence
  Description of Artificial Sequence: Synthetic peptide
  Seed: REVWPLRFF (TYRP1_HUMAN)
REVWPLRFL

SEQ ID NO: 167976 - protein, 9 aa, Artificial Sequence
  Description of Artificial Sequence: Synthetic peptide
  Seed: RGRCEAVTA (TYRP1_HUMAN)
RLRCEAVTA

SEQ ID NO: 167977 - protein, 10 aa, Artificial Sequence
  Description of Artificial Sequence: Synthetic peptide
  Seed: RRYNADISTF (TYRP1_HUMAN)
RQYNADISTV

SEQ ID NO: 167978 - protein, 11 aa, Artificial Sequence
  Description of Artificial Sequence: Synthetic peptide
  Seed: RSLHNLAHLFL (TYRP1_HUMAN)
RTLHNLAHLFW

SEQ ID NO: 167979 - protein, 9 aa, Artificial Sequence
  Description of Artificial Sequence: Synthetic peptide
  Seed: APIGHNRQY (TYRP1_HUMAN)
ASIGHNRQF

SEQ ID NO: 167980 - protein, 9 aa, Artificial Sequence
  Description of Artificial Sequence: Synthetic peptide
  Seed: QDVAQCLEV (TYRP1_HUMAN)
QEVAQCLEP

SEQ ID NO: 167981 - protein, 10 aa, Artificial Sequence
  Description of Artificial Sequence: Synthetic peptide
  Seed: FYSNSTNSFR (TYRP1_HUMAN)
FISNSTNSFK

SEQ ID NO: 167982 - protein, 9 aa, Artificial Sequence
  Description of Artificial Sequence: Synthetic peptide
  Seed: HLSPNDPIF (TYRP1_HUMAN)
HRSPNDPIL

SEQ ID NO: 167983 - protein, 10 aa, Artificial Sequence
  Description of Artificial Sequence: Synthetic peptide
  Seed: SPVSGPGTDR (TYRP1_HUMAN)
STVSGPGTDK

SEQ ID NO: 167984 - protein, 10 aa, Artificial Sequence
  Description of Artificial Sequence: Synthetic peptide
  Seed: AVFDEWLRRY (TYRP1_HUMAN)
ANFDEWLRRW

SEQ ID NO: 167985 - protein, 9 aa, Artificial Sequence
  Description of Artificial Sequence: Synthetic peptide
  Seed: GTASYLIRA (TYRP1_HUMAN)
GMASYLIRM

SEQ ID NO: 167986 - protein, 9 aa, Artificial Sequence
  Description of Artificial Sequence: Synthetic peptide
  Seed: MSAPKLLSL (TYRP1_HUMAN)
MQAPKLLSA

SEQ ID NO: 167987 - protein, 9 aa, Artificial Sequence
  Description of Artificial Sequence: Synthetic peptide
  Seed: VGLFDTPPF (TYRP1_HUMAN)
VTLFDTPPM

SEQ ID NO: 167988 - protein, 10 aa, Artificial Sequence
  Description of Artificial Sequence: Synthetic peptide
  Seed: FVLLHTFTDA (TYRP1_HUMAN)
FFLLHTFTDV

SEQ ID NO: 167989 - protein, 9 aa, Artificial Sequence
  Description of Artificial Sequence: Synthetic peptide
  Seed: HEGPAFLTW (TYRP1_HUMAN)
HMGPAFLTI

SEQ ID NO: 167990 - protein, 9 aa, Artificial Sequence
  Description of Artificial Sequence: Synthetic peptide
  Seed: SLGCIFFPL (TYRP1_HUMAN)
SMGCIFFPF

SEQ ID NO: 167991 - protein, 10 aa, Artificial Sequence
  Description of Artificial Sequence: Synthetic peptide
  Seed: HLSPNDPIFV (TYRP1_HUMAN)
HMSPNDPIFA

SEQ ID NO: 167992 - protein, 10 aa, Artificial Sequence
  Description of Artificial Sequence: Synthetic peptide
  Seed: YNYFVWTHYY (TYRP1_HUMAN)
YQYFVWTHYC

SEQ ID NO: 167993 - protein, 9 aa, Artificial Sequence
  Description of Artificial Sequence: Synthetic peptide
  Seed: MAKRTTHPL (TYRP1_HUMAN)
MPKRTTHPI

SEQ ID NO: 167994 - protein, 9 aa, Artificial Sequence
  Description of Artificial Sequence: Synthetic peptide
  Seed: RVLIVRRNL (TYRP1_HUMAN)
RILIVRRNA

SEQ ID NO: 167995 - protein, 9 aa, Artificial Sequence
  Description of Artificial Sequence: Synthetic peptide
  Seed: TLISPNSVF (TYRP1_HUMAN)
THISPNSVM

SEQ ID NO: 167996 - protein, 9 aa, Artificial Sequence
  Description of Artificial Sequence: Synthetic peptide
  Seed: FVWTHYYSV (TYRP1_HUMAN)
FGWTHYYSM

SEQ ID NO: 167997 - protein, 9 aa, Artificial Sequence
  Description of Artificial Sequence: Synthetic peptide
  Seed: EEYEKLQNP (TYRP1_HUMAN)
EDYEKLQNM

SEQ ID NO: 167998 - protein, 9 aa, Artificial Sequence
  Description of Artificial Sequence: Synthetic peptide
  Seed: GTASYLIRA (TYRP1_HUMAN)
GLASYLIRA

SEQ ID NO: 167999 - protein, 9 aa, Artificial Sequence
  Description of Artificial Sequence: Synthetic peptide
  Seed: RFFNRTCHC (TYRP1_HUMAN)
RSFNRTCHL

SEQ ID NO: 168000 - protein, 9 aa, Artificial Sequence
  Description of Artificial Sequence: Synthetic peptide
  Seed: RYHLLRLEK (TYRP1_HUMAN)
RTHLLRLEY

SEQ ID NO: 168001 - protein, 9 aa, Artificial Sequence
  Description of Artificial Sequence: Synthetic peptide
  Seed: LTWHRYHLL (TYRP1_HUMAN)
LMWHRYHLR

SEQ ID NO: 168002 - protein, 9 aa, Artificial Sequence
  Description of Artificial Sequence: Synthetic peptide
  Seed: TEMFVTAPD (TYRP1_HUMAN)
TEMFVTAPV

SEQ ID NO: 168003 - protein, 9 aa, Artificial Sequence
  Description of Artificial Sequence: Synthetic peptide
  Seed: KLQNPNQSV (TYRP1_HUMAN)
KTQNPNQSW

SEQ ID NO: 168004 - protein, 11 aa, Artificial Sequence
  Description of Artificial Sequence: Synthetic peptide
  Seed: FWPPVTNTEMF (TYRP1_HUMAN)
FVPPVTNTEMW

SEQ ID NO: 168005 - protein, 9 aa, Artificial Sequence
  Description of Artificial Sequence: Synthetic peptide
  Seed: LIFGTASYL (TYRP1_HUMAN)
LSFGTASYY

SEQ ID NO: 168006 - protein, 10 aa, Artificial Sequence
  Description of Artificial Sequence: Synthetic peptide
  Seed: QCYAEEYEKL (TYRP1_HUMAN)
QVYAEEYEKF

SEQ ID NO: 168007 - protein, 9 aa, Artificial Sequence
  Description of Artificial Sequence: Synthetic peptide
  Seed: SMDEANQPL (TYRP1_HUMAN)
SSDEANQPM

SEQ ID NO: 168008 - protein, 9 aa, Artificial Sequence
  Description of Artificial Sequence: Synthetic peptide
  Seed: LQNPNQSVV (TYRP1_HUMAN)
LQNPNQSVF

SEQ ID NO: 168009 - protein, 9 aa, Artificial Sequence
  Description of Artificial Sequence: Synthetic peptide
  Seed: YLIRARRSM (TYRP1_HUMAN)
YIIRARRSF

SEQ ID NO: 168010 - protein, 9 aa, Artificial Sequence
  Description of Artificial Sequence: Synthetic peptide
  Seed: ISIYNYFVW (TYRP1_HUMAN)
IGIYNYFVW

SEQ ID NO: 168011 - protein, 11 aa, Artificial Sequence
  Description of Artificial Sequence: Synthetic peptide
  Seed: REVWPLRFFNR (TYRP1_HUMAN)
RRVWPLRFFNR

SEQ ID NO: 168012 - protein, 10 aa, Artificial Sequence
  Description of Artificial Sequence: Synthetic peptide
  Seed: YTYEIQWPSR (TYRP1_HUMAN)
YWYEIQWPSK

SEQ ID NO: 168013 - protein, 10 aa, Artificial Sequence
  Description of Artificial Sequence: Synthetic peptide
  Seed: LGPDGNTPQF (TYRP1_HUMAN)
LLPDGNTPQY

SEQ ID NO: 168014 - protein, 9 aa, Artificial Sequence
  Description of Artificial Sequence: Synthetic peptide
  Seed: TGKYDPAVR (TYRP1_HUMAN)
TAKYDPAVL

SEQ ID NO: 168015 - protein, 11 aa, Artificial Sequence
  Description of Artificial Sequence: Synthetic peptide
  Seed: YSDPTGKYDPA (TYRP1_HUMAN)
YLDPTGKYDPM

SEQ ID NO: 168016 - protein, 10 aa, Artificial Sequence
  Description of Artificial Sequence: Synthetic peptide
  Seed: THPLFVIATR (TYRP1_HUMAN)
TVPLFVIATR

SEQ ID NO: 168017 - protein, 10 aa, Artificial Sequence
  Description of Artificial Sequence: Synthetic peptide
  Seed: FGTASYLIRA (TYRP1_HUMAN)
FVTASYLIRA

SEQ ID NO: 168018 - protein, 10 aa, Artificial Sequence
  Description of Artificial Sequence: Synthetic peptide
  Seed: LSLGCIFFPL (TYRP1_HUMAN)
LRLGCIFFPL

SEQ ID NO: 168019 - protein, 11 aa, Artificial Sequence
  Description of Artificial Sequence: Synthetic peptide
  Seed: YNMVPFWPPVT (TYRP1_HUMAN)
YLMVPFWPPVF

SEQ ID NO: 168020 - protein, 10 aa, Artificial Sequence
  Description of Artificial Sequence: Synthetic peptide
  Seed: TDAVFDEWLR (TYRP1_HUMAN)
TAAVFDEWLR

SEQ ID NO: 168021 - protein, 9 aa, Artificial Sequence
  Description of Artificial Sequence: Synthetic peptide
  Seed: FYSNSTNSF (TYRP1_HUMAN)
FESNSTNSM

SEQ ID NO: 168022 - protein, 9 aa, Artificial Sequence
  Description of Artificial Sequence: Synthetic peptide
  Seed: LIFGTASYL (TYRP1_HUMAN)
LVFGTASYI

SEQ ID NO: 168023 - protein, 9 aa, Artificial Sequence
  Description of Artificial Sequence: Synthetic peptide
  Seed: PIFVLLHTF (TYRP1_HUMAN)
PFFVLLHTF

SEQ ID NO: 168024 - protein, 9 aa, Artificial Sequence
  Description of Artificial Sequence: Synthetic peptide
  Seed: FSHEGPAFL (TYRP1_HUMAN)
FSHEGPAFY

SEQ ID NO: 168025 - protein, 9 aa, Artificial Sequence
  Description of Artificial Sequence: Synthetic peptide
  Seed: FTDAVFDEW (TYRP1_HUMAN)
FYDAVFDEV

SEQ ID NO: 168026 - protein, 10 aa, Artificial Sequence
  Description of Artificial Sequence: Synthetic peptide
  Seed: MVPFWPPVTN (TYRP1_HUMAN)
MVPFWPPVTY

SEQ ID NO: 168027 - protein, 9 aa, Artificial Sequence
  Description of Artificial Sequence: Synthetic peptide
  Seed: TAPDNLGYT (TYRP1_HUMAN)
TAPDNLGYI

SEQ ID NO: 168028 - protein, 9 aa, Artificial Sequence
  Description of Artificial Sequence: Synthetic peptide
  Seed: LLVALIFGT (TYRP1_HUMAN)
LIVALIFGA

SEQ ID NO: 168029 - protein, 10 aa, Artificial Sequence
  Description of Artificial Sequence: Synthetic peptide
  Seed: LLFQQARAQF (TYRP1_HUMAN)
LHFQQARAQY

SEQ ID NO: 168030 - protein, 9 aa, Artificial Sequence
  Description of Artificial Sequence: Synthetic peptide
  Seed: LHNLAHLFL (TYRP1_HUMAN)
LRNLAHLFY

SEQ ID NO: 168031 - protein, 10 aa, Artificial Sequence
  Description of Artificial Sequence: Synthetic peptide
  Seed: WPPVTNTEMF (TYRP1_HUMAN)
WVPVTNTEMW

SEQ ID NO: 168032 - protein, 9 aa, Artificial Sequence
  Description of Artificial Sequence: Synthetic peptide
  Seed: FENISIYNY (TYRP1_HUMAN)
FFNISIYNY

SEQ ID NO: 168033 - protein, 9 aa, Artificial Sequence
  Description of Artificial Sequence: Synthetic peptide
  Seed: FTDAVFDEW (TYRP1_HUMAN)
FYDAVFDEF

SEQ ID NO: 168034 - protein, 9 aa, Artificial Sequence
  Description of Artificial Sequence: Synthetic peptide
  Seed: SGHNCGTCR (TYRP1_HUMAN)
STHNCGTCY

SEQ ID NO: 168035 - protein, 9 aa, Artificial Sequence
  Description of Artificial Sequence: Synthetic peptide
  Seed: SVFSQWRVV (TYRP1_HUMAN)
STFSQWRVA

SEQ ID NO: 168036 - protein, 9 aa, Artificial Sequence
  Description of Artificial Sequence: Synthetic peptide
  Seed: YYSVKKTFL (TYRP1_HUMAN)
YFSVKKTFL

SEQ ID NO: 168037 - protein, 9 aa, Artificial Sequence
  Description of Artificial Sequence: Synthetic peptide
  Seed: SMDEANQPL (TYRP1_HUMAN)
STDEANQPI

SEQ ID NO: 168038 - protein, 10 aa, Artificial Sequence
  Description of Artificial Sequence: Synthetic peptide
  Seed: RSMDEANQPL (TYRP1_HUMAN)
RMMDEANQPM

SEQ ID NO: 168039 - protein, 9 aa, Artificial Sequence
  Description of Artificial Sequence: Synthetic peptide
  Seed: APIGHNRQY (TYRP1_HUMAN)
AVIGHNRQY

SEQ ID NO: 168040 - protein, 10 aa, Artificial Sequence
  Description of Artificial Sequence: Synthetic peptide
  Seed: MVPFWPPVTN (TYRP1_HUMAN)
MLPFWPPVTL

SEQ ID NO: 168041 - protein, 9 aa, Artificial Sequence
  Description of Artificial Sequence: Synthetic peptide
  Seed: RSLHNLAHL (TYRP1_HUMAN)
RVLHNLAHI

SEQ ID NO: 168042 - protein, 9 aa, Artificial Sequence
  Description of Artificial Sequence: Synthetic peptide
  Seed: NISIYNYFV (TYRP1_HUMAN)
NVSIYNYFL

SEQ ID NO: 168043 - protein, 9 aa, Artificial Sequence
  Description of Artificial Sequence: Synthetic peptide
  Seed: ALIFGTASY (TYRP1_HUMAN)
AVIFGTASR

SEQ ID NO: 168044 - protein, 10 aa, Artificial Sequence
  Description of Artificial Sequence: Synthetic peptide
  Seed: RSMDEANQPL (TYRP1_HUMAN)
RIMDEANQPF

SEQ ID NO: 168045 - protein, 9 aa, Artificial Sequence
  Description of Artificial Sequence: Synthetic peptide
  Seed: DQRVLIVRR (TYRP1_HUMAN)
DGRVLIVRR

SEQ ID NO: 168046 - protein, 10 aa, Artificial Sequence
  Description of Artificial Sequence: Synthetic peptide
  Seed: VGLFDTPPFY (TYRP1_HUMAN)
VILFDTPPFY

SEQ ID NO: 168047 - protein, 8 aa, Artificial Sequence
  Description of Artificial Sequence: Synthetic peptide
  Seed: FSHEGPAF (TYRP1_HUMAN)
FFHEGPAF

SEQ ID NO: 168048 - protein, 9 aa, Artificial Sequence
  Description of Artificial Sequence: Synthetic peptide
  Seed: GLFDTPPFY (TYRP1_HUMAN)
GVFDTPPFV

SEQ ID NO: 168049 - protein, 11 aa, Artificial Sequence
  Description of Artificial Sequence: Synthetic peptide
  Seed: MFVTAPDNLGY (TYRP1_HUMAN)
MMVTAPDNLGY

SEQ ID NO: 168050 - protein, 9 aa, Artificial Sequence
  Description of Artificial Sequence: Synthetic peptide
  Seed: YTYEIQWPS (TYRP1_HUMAN)
YTYEIQWPM

SEQ ID NO: 168051 - protein, 9 aa, Artificial Sequence
  Description of Artificial Sequence: Synthetic peptide
  Seed: RRYNADIST (TYRP1_HUMAN)
RRYNADISK

SEQ ID NO: 168052 - protein, 9 aa, Artificial Sequence
  Description of Artificial Sequence: Synthetic peptide
  Seed: FSHEGPAFL (TYRP1_HUMAN)
FRHEGPAFM

SEQ ID NO: 168053 - protein, 10 aa, Artificial Sequence
  Description of Artificial Sequence: Synthetic peptide
  Seed: ADSRPHSPQY (TYRP1_HUMAN)
ATSRPHSPQK

SEQ ID NO: 168054 - protein, 9 aa, Artificial Sequence
  Description of Artificial Sequence: Synthetic peptide
  Seed: ALIFGTASY (TYRP1_HUMAN)
ALIFGTASM

SEQ ID NO: 168055 - protein, 10 aa, Artificial Sequence
  Description of Artificial Sequence: Synthetic peptide
  Seed: YFVWTHYYSV (TYRP1_HUMAN)
YFVWTHYYSM

SEQ ID NO: 168056 - protein, 9 aa, Artificial Sequence
  Description of Artificial Sequence: Synthetic peptide
  Seed: MFVTAPDNL (TYRP1_HUMAN)
MWVTAPDNF

SEQ ID NO: 168057 - protein, 10 aa, Artificial Sequence
  Description of Artificial Sequence: Synthetic peptide
  Seed: LIFGTASYLI (TYRP1_HUMAN)
LTFGTASYLI

SEQ ID NO: 168058 - protein, 11 aa, Artificial Sequence
  Description of Artificial Sequence: Synthetic peptide
  Seed: REVWPLRFFNR (TYRP1_HUMAN)
RTVWPLRFFNR

SEQ ID NO: 168059 - protein, 9 aa, Artificial Sequence
  Description of Artificial Sequence: Synthetic peptide
  Seed: RTTHPLFVI (TYRP1_HUMAN)
RSTHPLFVL

SEQ ID NO: 168060 - protein, 9 aa, Artificial Sequence
  Description of Artificial Sequence: Synthetic peptide
  Seed: YTYEIQWPS (TYRP1_HUMAN)
YKYEIQWPI

SEQ ID NO: 168061 - protein, 10 aa, Artificial Sequence
  Description of Artificial Sequence: Synthetic peptide
  Seed: AVFDEWLRRY (TYRP1_HUMAN)
AQFDEWLRRF

SEQ ID NO: 168062 - protein, 10 aa, Artificial Sequence
  Description of Artificial Sequence: Synthetic peptide
  Seed: FVRALDMAKR (TYRP1_HUMAN)
FTRALDMAKR

SEQ ID NO: 168063 - protein, 9 aa, Artificial Sequence
  Description of Artificial Sequence: Synthetic peptide
  Seed: FLGVGQESF (TYRP1_HUMAN)
FRGVGQESF

SEQ ID NO: 168064 - protein, 9 aa, Artificial Sequence
  Description of Artificial Sequence: Synthetic peptide
  Seed: LTDQYQCYA (TYRP1_HUMAN)
LMDQYQCYY

SEQ ID NO: 168065 - protein, 11 aa, Artificial Sequence
  Description of Artificial Sequence: Synthetic peptide
  Seed: LRRYNADISTF (TYRP1_HUMAN)
LDRYNADISTF

SEQ ID NO: 168066 - protein, 9 aa, Artificial Sequence
  Description of Artificial Sequence: Synthetic peptide
  Seed: IAIAVVGAL (TYRP1_HUMAN)
ISIAVVGAR

SEQ ID NO: 168067 - protein, 10 aa, Artificial Sequence
  Description of Artificial Sequence: Synthetic peptide
  Seed: AIAVVGALLL (TYRP1_HUMAN)
ALAVVGALLL

SEQ ID NO: 168068 - protein, 11 aa, Artificial Sequence
  Description of Artificial Sequence: Synthetic peptide
  Seed: VALIFGTASYL (TYRP1_HUMAN)
VMLIFGTASYV

SEQ ID NO: 168069 - protein, 9 aa, Artificial Sequence
  Description of Artificial Sequence: Synthetic peptide
  Seed: MAKRTTHPL (TYRP1_HUMAN)
MQKRTTHPI

SEQ ID NO: 168070 - protein, 9 aa, Artificial Sequence
  Description of Artificial Sequence: Synthetic peptide
  Seed: TTHPLFVIA (TYRP1_HUMAN)
TPHPLFVIL

SEQ ID NO: 168071 - protein, 9 aa, Artificial Sequence
  Description of Artificial Sequence: Synthetic peptide
  Seed: RVLIVRRNL (TYRP1_HUMAN)
RSLIVRRNY

SEQ ID NO: 168072 - protein, 9 aa, Artificial Sequence
  Description of Artificial Sequence: Synthetic peptide
  Seed: SRSNFDSTL (TYRP1_HUMAN)
SHSNFDSTW

SEQ ID NO: 168073 - protein, 10 aa, Artificial Sequence
  Description of Artificial Sequence: Synthetic peptide
  Seed: LLLVALIFGT (TYRP1_HUMAN)
LGLVALIFGV

SEQ ID NO: 168074 - protein, 10 aa, Artificial Sequence
  Description of Artificial Sequence: Synthetic peptide
  Seed: NPAGNVARPM (TYRP1_HUMAN)
NPAGNVARPL

SEQ ID NO: 168075 - protein, 9 aa, Artificial Sequence
  Description of Artificial Sequence: Synthetic peptide
  Seed: TLISPNSVF (TYRP1_HUMAN)
TMISPNSVM

SEQ ID NO: 168076 - protein, 9 aa, Artificial Sequence
  Description of Artificial Sequence: Synthetic peptide
  Seed: LEKDMQEML (TYRP1_HUMAN)
LEKDMQEMY

SEQ ID NO: 168077 - protein, 9 aa, Artificial Sequence
  Description of Artificial Sequence: Synthetic peptide
  Seed: GLFDTPPFY (TYRP1_HUMAN)
GIFDTPPFA

SEQ ID NO: 168078 - protein, 9 aa, Artificial Sequence
  Description of Artificial Sequence: Synthetic peptide
  Seed: MAKRTTHPL (TYRP1_HUMAN)
MTKRTTHPL

SEQ ID NO: 168079 - protein, 9 aa, Artificial Sequence
  Description of Artificial Sequence: Synthetic peptide
  Seed: REFSVPEII (TYRP1_HUMAN)
RMFSVPEIM

SEQ ID NO: 168080 - protein, 10 aa, Artificial Sequence
  Description of Artificial Sequence: Synthetic peptide
  Seed: LSLGCIFFPL (TYRP1_HUMAN)
LLLGCIFFPL

SEQ ID NO: 168081 - protein, 10 aa, Artificial Sequence
  Description of Artificial Sequence: Synthetic peptide
  Seed: KRTTHPLFVI (TYRP1_HUMAN)
KCTTHPLFVW

SEQ ID NO: 168082 - protein, 9 aa, Artificial Sequence
  Description of Artificial Sequence: Synthetic peptide
  Seed: YLIRARRSM (TYRP1_HUMAN)
YHIRARRSF

SEQ ID NO: 168083 - protein, 9 aa, Artificial Sequence
  Description of Artificial Sequence: Synthetic peptide
  Seed: RRNPAGNVA (TYRP1_HUMAN)
RRNPAGNVF

SEQ ID NO: 168084 - protein, 9 aa, Artificial Sequence
  Description of Artificial Sequence: Synthetic peptide
  Seed: KLLSLGCIF (TYRP1_HUMAN)
KELSLGCIY

SEQ ID NO: 168085 - protein, 9 aa, Artificial Sequence
  Description of Artificial Sequence: Synthetic peptide
  Seed: YTYEIQWPS (TYRP1_HUMAN)
YAYEIQWPL

SEQ ID NO: 168086 - protein, 9 aa, Artificial Sequence
  Description of Artificial Sequence: Synthetic peptide
  Seed: RLPEPQDVA (TYRP1_HUMAN)
RQPEPQDVL

SEQ ID NO: 168087 - protein, 10 aa, Artificial Sequence
  Description of Artificial Sequence: Synthetic peptide
  Seed: LSLGCIFFPL (TYRP1_HUMAN)
LELGCIFFPI

SEQ ID NO: 168088 - protein, 9 aa, Artificial Sequence
  Description of Artificial Sequence: Synthetic peptide
  Seed: RYNADISTF (TYRP1_HUMAN)
RKNADISTL

SEQ ID NO: 168089 - protein, 9 aa, Artificial Sequence
  Description of Artificial Sequence: Synthetic peptide
  Seed: HLSPNDPIF (TYRP1_HUMAN)
HYSPNDPIM

SEQ ID NO: 168090 - protein, 9 aa, Artificial Sequence
  Description of Artificial Sequence: Synthetic peptide
  Seed: SLGCIFFPL (TYRP1_HUMAN)
SAGCIFFPV

SEQ ID NO: 168091 - protein, 10 aa, Artificial Sequence
  Description of Artificial Sequence: Synthetic peptide
  Seed: SMDEANQPLL (TYRP1_HUMAN)
SLDEANQPLM

SEQ ID NO: 168092 - protein, 11 aa, Artificial Sequence
  Description of Artificial Sequence: Synthetic peptide
  Seed: YNMVPFWPPVT (TYRP1_HUMAN)
YLMVPFWPPVH

SEQ ID NO: 168093 - protein, 9 aa, Artificial Sequence
  Description of Artificial Sequence: Synthetic peptide
  Seed: VGALLLVAL (TYRP1_HUMAN)
VMALLLVAV

SEQ ID NO: 168094 - protein, 10 aa, Artificial Sequence
  Description of Artificial Sequence: Synthetic peptide
  Seed: FLTWHRYHLL (TYRP1_HUMAN)
FMTWHRYHLL

SEQ ID NO: 168095 - protein, 9 aa, Artificial Sequence
  Description of Artificial Sequence: Synthetic peptide
  Seed: YTYEIQWPS (TYRP1_HUMAN)
YMYEIQWPA

SEQ ID NO: 168096 - protein, 9 aa, Artificial Sequence
  Description of Artificial Sequence: Synthetic peptide
  Seed: RPMVQRLPE (TYRP1_HUMAN)
RAMVQRLPV

SEQ ID NO: 168097 - protein, 9 aa, Artificial Sequence
  Description of Artificial Sequence: Synthetic peptide
  Seed: FSHEGPAFL (TYRP1_HUMAN)
FTHEGPAFF

SEQ ID NO: 168098 - protein, 10 aa, Artificial Sequence
  Description of Artificial Sequence: Synthetic peptide
  Seed: YNYFVWTHYY (TYRP1_HUMAN)
YAYFVWTHYK

SEQ ID NO: 168099 - protein, 9 aa, Artificial Sequence
  Description of Artificial Sequence: Synthetic peptide
  Seed: SLPYWNFAT (TYRP1_HUMAN)
SLPYWNFAM

SEQ ID NO: 168100 - protein, 10 aa, Artificial Sequence
  Description of Artificial Sequence: Synthetic peptide
  Seed: FWPPVTNTEM (TYRP1_HUMAN)
FTPPVTNTEY

SEQ ID NO: 168101 - protein, 9 aa, Artificial Sequence
  Description of Artificial Sequence: Synthetic peptide
  Seed: LFDTPPFYS (TYRP1_HUMAN)
LYDTPPFYV

SEQ ID NO: 168102 - protein, 10 aa, Artificial Sequence
  Description of Artificial Sequence: Synthetic peptide
  Seed: GNVARPMVQR (TYRP1_HUMAN)
GEVARPMVQR

SEQ ID NO: 168103 - protein, 9 aa, Artificial Sequence
  Description of Artificial Sequence: Synthetic peptide
  Seed: HEGPAFLTW (TYRP1_HUMAN)
HAGPAFLTW

SEQ ID NO: 168104 - protein, 9 aa, Artificial Sequence
  Description of Artificial Sequence: Synthetic peptide
  Seed: VCDICTDDL (TYRP1_HUMAN)
VYDICTDDI

SEQ ID NO: 168105 - protein, 10 aa, Artificial Sequence
  Description of Artificial Sequence: Synthetic peptide
  Seed: MVPFWPPVTN (TYRP1_HUMAN)
MEPFWPPVTM

SEQ ID NO: 168106 - protein, 10 aa, Artificial Sequence
  Description of Artificial Sequence: Synthetic peptide
  Seed: FVTAPDNLGY (TYRP1_HUMAN)
FCTAPDNLGW

SEQ ID NO: 168107 - protein, 10 aa, Artificial Sequence
  Description of Artificial Sequence: Synthetic peptide
  Seed: YNYFVWTHYY (TYRP1_HUMAN)
YEYFVWTHYK

SEQ ID NO: 168108 - protein, 11 aa, Artificial Sequence
  Description of Artificial Sequence: Synthetic peptide
  Seed: HLSPNDPIFVL (TYRP1_HUMAN)
HQSPNDPIFVF

SEQ ID NO: 168109 - protein, 9 aa, Artificial Sequence
  Description of Artificial Sequence: Synthetic peptide
  Seed: VFDEWLRRY (TYRP1_HUMAN)
VWDEWLRRL

SEQ ID NO: 168110 - protein, 11 aa, Artificial Sequence
  Description of Artificial Sequence: Synthetic peptide
  Seed: REVWPLRFFNR (TYRP1_HUMAN)
RVVWPLRFFNR

SEQ ID NO: 168111 - protein, 9 aa, Artificial Sequence
  Description of Artificial Sequence: Synthetic peptide
  Seed: RQYNMVPFW (TYRP1_HUMAN)
RLYNMVPFI

SEQ ID NO: 168112 - protein, 10 aa, Artificial Sequence
  Description of Artificial Sequence: Synthetic peptide
  Seed: FSLPYWNFAT (TYRP1_HUMAN)
FQLPYWNFAA

SEQ ID NO: 168113 - protein, 9 aa, Artificial Sequence
  Description of Artificial Sequence: Synthetic peptide
  Seed: MAKRTTHPL (TYRP1_HUMAN)
MGKRTTHPF

SEQ ID NO: 168114 - protein, 11 aa, Artificial Sequence
  Description of Artificial Sequence: Synthetic peptide
  Seed: LVALIFGTASY (TYRP1_HUMAN)
LGALIFGTASY

SEQ ID NO: 168115 - protein, 9 aa, Artificial Sequence
  Description of Artificial Sequence: Synthetic peptide
  Seed: MSAPKLLSL (TYRP1_HUMAN)
MLAPKLLSW

SEQ ID NO: 168116 - protein, 9 aa, Artificial Sequence
  Description of Artificial Sequence: Synthetic peptide
  Seed: KRTTHPLFV (TYRP1_HUMAN)
KRTTHPLFL

SEQ ID NO: 168117 - protein, 9 aa, Artificial Sequence
  Description of Artificial Sequence: Synthetic peptide
  Seed: KLQNPNQSV (TYRP1_HUMAN)
KTQNPNQSY

SEQ ID NO: 168118 - protein, 9 aa, Artificial Sequence
  Description of Artificial Sequence: Synthetic peptide
  Seed: LEKDMQEML (TYRP1_HUMAN)
LQKDMQEMI

SEQ ID NO: 168119 - protein, 9 aa, Artificial Sequence
  Description of Artificial Sequence: Synthetic peptide
  Seed: TNTEMFVTA (TYRP1_HUMAN)
TQTEMFVTA

SEQ ID NO: 168120 - protein, 11 aa, Artificial Sequence
  Description of Artificial Sequence: Synthetic peptide
  Seed: FVLLHTFTDAV (TYRP1_HUMAN)
FVLLHTFTDAL

SEQ ID NO: 168121 - protein, 10 aa, Artificial Sequence
  Description of Artificial Sequence: Synthetic peptide
  Seed: SIYNYFVWTH (TYRP1_HUMAN)
SRYNYFVWTK

SEQ ID NO: 168122 - protein, 9 aa, Artificial Sequence
  Description of Artificial Sequence: Synthetic peptide
  Seed: FSHEGPAFL (TYRP1_HUMAN)
FLHEGPAFL

SEQ ID NO: 168123 - protein, 9 aa, Artificial Sequence
  Description of Artificial Sequence: Synthetic peptide
  Seed: KRTTHPLFV (TYRP1_HUMAN)
KQTTHPLFL

SEQ ID NO: 168124 - protein, 10 aa, Artificial Sequence
  Description of Artificial Sequence: Synthetic peptide
  Seed: FTDAVFDEWL (TYRP1_HUMAN)
FIDAVFDEWL

SEQ ID NO: 168125 - protein, 8 aa, Artificial Sequence
  Description of Artificial Sequence: Synthetic peptide
  Seed: YAEEYEKL (TYRP1_HUMAN)
YTEEYEKL

SEQ ID NO: 168126 - protein, 10 aa, Artificial Sequence
  Description of Artificial Sequence: Synthetic peptide
  Seed: RRYNADISTF (TYRP1_HUMAN)
RFYNADISTM

SEQ ID NO: 168127 - protein, 10 aa, Artificial Sequence
  Description of Artificial Sequence: Synthetic peptide
  Seed: RRYNADISTF (TYRP1_HUMAN)
RTYNADISTY

SEQ ID NO: 168128 - protein, 11 aa, Artificial Sequence
  Description of Artificial Sequence: Synthetic peptide
  Seed: IYNYFVWTHYY (TYRP1_HUMAN)
IYNYFVWTHYL

SEQ ID NO: 168129 - protein, 11 aa, Artificial Sequence
  Description of Artificial Sequence: Synthetic peptide
  Seed: SIYNYFVWTHY (TYRP1_HUMAN)
SMYNYFVWTHF

SEQ ID NO: 168130 - protein, 9 aa, Artificial Sequence
  Description of Artificial Sequence: Synthetic peptide
  Seed: ISIYNYFVW (TYRP1_HUMAN)
IMIYNYFVF

SEQ ID NO: 168131 - protein, 9 aa, Artificial Sequence
  Description of Artificial Sequence: Synthetic peptide
  Seed: YNYFVWTHY (TYRP1_HUMAN)
YNYFVWTHF

SEQ ID NO: 168132 - protein, 9 aa, Artificial Sequence
  Description of Artificial Sequence: Synthetic peptide
  Seed: LPYWNFATG (TYRP1_HUMAN)
LLYWNFATY

SEQ ID NO: 168133 - protein, 8 aa, Artificial Sequence
  Description of Artificial Sequence: Synthetic peptide
  Seed: LIRARRSM (TYRP1_HUMAN)
LMRARRSV

SEQ ID NO: 168134 - protein, 11 aa, Artificial Sequence
  Description of Artificial Sequence: Synthetic peptide
  Seed: LVALIFGTASY (TYRP1_HUMAN)
LMALIFGTASY

SEQ ID NO: 168135 - protein, 9 aa, Artificial Sequence
  Description of Artificial Sequence: Synthetic peptide
  Seed: RARRSMDEA (TYRP1_HUMAN)
RSRRSMDEL

SEQ ID NO: 168136 - protein, 10 aa, Artificial Sequence
  Description of Artificial Sequence: Synthetic peptide
  Seed: EVWPLRFFNR (TYRP1_HUMAN)
EAWPLRFFNK

SEQ ID NO: 168137 - protein, 10 aa, Artificial Sequence
  Description of Artificial Sequence: Synthetic peptide
  Seed: YNADISTFPL (TYRP1_HUMAN)
YFADISTFPV

SEQ ID NO: 168138 - protein, 9 aa, Artificial Sequence
  Description of Artificial Sequence: Synthetic peptide
  Seed: NADISTFPL (TYRP1_HUMAN)
NYDISTFPL

SEQ ID NO: 168139 - protein, 10 aa, Artificial Sequence
  Description of Artificial Sequence: Synthetic peptide
  Seed: FVTAPDNLGY (TYRP1_HUMAN)
FVTAPDNLGK

SEQ ID NO: 168140 - protein, 9 aa, Artificial Sequence
  Description of Artificial Sequence: Synthetic peptide
  Seed: SPNDPIFVL (TYRP1_HUMAN)
SYNDPIFVF

SEQ ID NO: 168141 - protein, 10 aa, Artificial Sequence
  Description of Artificial Sequence: Synthetic peptide
  Seed: FVLLHTFTDA (TYRP1_HUMAN)
FMLLHTFTDT

SEQ ID NO: 168142 - protein, 11 aa, Artificial Sequence
  Description of Artificial Sequence: Synthetic peptide
  Seed: RRYNADISTFP (TYRP1_HUMAN)
RWYNADISTFV

SEQ ID NO: 168143 - protein, 9 aa, Artificial Sequence
  Description of Artificial Sequence: Synthetic peptide
  Seed: VTAPDNLGY (TYRP1_HUMAN)
VMAPDNLGR

SEQ ID NO: 168144 - protein, 9 aa, Artificial Sequence
  Description of Artificial Sequence: Synthetic peptide
  Seed: ENAPIGHNR (TYRP1_HUMAN)
ENAPIGHNK

SEQ ID NO: 168145 - protein, 10 aa, Artificial Sequence
  Description of Artificial Sequence: Synthetic peptide
  Seed: DAVFDEWLRR (TYRP1_HUMAN)
DMVFDEWLRR

SEQ ID NO: 168146 - protein, 9 aa, Artificial Sequence
  Description of Artificial Sequence: Synthetic peptide
  Seed: GLFDTPPFY (TYRP1_HUMAN)
GMFDTPPFV

SEQ ID NO: 168147 - protein, 9 aa, Artificial Sequence
  Description of Artificial Sequence: Synthetic peptide
  Seed: MCCPDLSPV (TYRP1_HUMAN)
MQCPDLSPI

SEQ ID NO: 168148 - protein, 9 aa, Artificial Sequence
  Description of Artificial Sequence: Synthetic peptide
  Seed: TWHRYHLLR (TYRP1_HUMAN)
TGHRYHLLR

SEQ ID NO: 168149 - protein, 9 aa, Artificial Sequence
  Description of Artificial Sequence: Synthetic peptide
  Seed: RARRSMDEA (TYRP1_HUMAN)
RVRRSMDEA

SEQ ID NO: 168150 - protein, 9 aa, Artificial Sequence
  Description of Artificial Sequence: Synthetic peptide
  Seed: FTDAVFDEW (TYRP1_HUMAN)
FMDAVFDEM

SEQ ID NO: 168151 - protein, 9 aa, Artificial Sequence
  Description of Artificial Sequence: Synthetic peptide
  Seed: APIGHNRQY (TYRP1_HUMAN)
ATIGHNRQV

SEQ ID NO: 168152 - protein, 9 aa, Artificial Sequence
  Description of Artificial Sequence: Synthetic peptide
  Seed: APIGHNRQY (TYRP1_HUMAN)
ARIGHNRQY

SEQ ID NO: 168153 - protein, 10 aa, Artificial Sequence
  Description of Artificial Sequence: Synthetic peptide
  Seed: FVWTHYYSVK (TYRP1_HUMAN)
FLWTHYYSVW

SEQ ID NO: 168154 - protein, 10 aa, Artificial Sequence
  Description of Artificial Sequence: Synthetic peptide
  Seed: KRTTHPLFVI (TYRP1_HUMAN)
KWTTHPLFVF

SEQ ID NO: 168155 - protein, 10 aa, Artificial Sequence
  Description of Artificial Sequence: Synthetic peptide
  Seed: REFSVPEIIA (TYRP1_HUMAN)
REFSVPEIIF

SEQ ID NO: 168156 - protein, 10 aa, Artificial Sequence
  Description of Artificial Sequence: Synthetic peptide
  Seed: YNMVPFWPPV (TYRP1_HUMAN)
YNMVPFWPPI

SEQ ID NO: 168157 - protein, 9 aa, Artificial Sequence
  Description of Artificial Sequence: Synthetic peptide
  Seed: FYSNSTNSF (TYRP1_HUMAN)
FVSNSTNSF

SEQ ID NO: 168158 - protein, 10 aa, Artificial Sequence
  Description of Artificial Sequence: Synthetic peptide
  Seed: QCYAEEYEKL (TYRP1_HUMAN)
QHYAEEYEKF

SEQ ID NO: 168159 - protein, 9 aa, Artificial Sequence
  Description of Artificial Sequence: Synthetic peptide
  Seed: LTWHRYHLL (TYRP1_HUMAN)
LSWHRYHLW

SEQ ID NO: 168160 - protein, 11 aa, Artificial Sequence
  Description of Artificial Sequence: Synthetic peptide
  Seed: FVLLHTFTDAV (TYRP1_HUMAN)
FMLLHTFTDAV

SEQ ID NO: 168161 - protein, 9 aa, Artificial Sequence
  Description of Artificial Sequence: Synthetic peptide
  Seed: RARRSMDEA (TYRP1_HUMAN)
RTRRSMDEK

SEQ ID NO: 168162 - protein, 9 aa, Artificial Sequence
  Description of Artificial Sequence: Synthetic peptide
  Seed: FLGVGQESF (TYRP1_HUMAN)
FAGVGQESF

SEQ ID NO: 168163 - protein, 9 aa, Artificial Sequence
  Description of Artificial Sequence: Synthetic peptide
  Seed: DYDTLGTLC (TYRP1_HUMAN)
DFDTLGTLI

SEQ ID NO: 168164 - protein, 9 aa, Artificial Sequence
  Description of Artificial Sequence: Synthetic peptide
  Seed: AVRSLHNLA (TYRP1_HUMAN)
AGRSLHNLK

SEQ ID NO: 168165 - protein, 10 aa, Artificial Sequence
  Description of Artificial Sequence: Synthetic peptide
  Seed: EIIAIAVVGA (TYRP1_HUMAN)
EAIAIAVVGA

SEQ ID NO: 168166 - protein, 9 aa, Artificial Sequence
  Description of Artificial Sequence: Synthetic peptide
  Seed: SPNDPIFVL (TYRP1_HUMAN)
SQNDPIFVF

SEQ ID NO: 168167 - protein, 9 aa, Artificial Sequence
  Description of Artificial Sequence: Synthetic peptide
  Seed: FSLPYWNFA (TYRP1_HUMAN)
FMLPYWNFC

SEQ ID NO: 168168 - protein, 9 aa, Artificial Sequence
  Description of Artificial Sequence: Synthetic peptide
  Seed: WTHYYSVKK (TYRP1_HUMAN)
WAHYYSVKR

SEQ ID NO: 168169 - protein, 9 aa, Artificial Sequence
  Description of Artificial Sequence: Synthetic peptide
  Seed: IAVVGALLL (TYRP1_HUMAN)
IPVVGALLW

SEQ ID NO: 168170 - protein, 9 aa, Artificial Sequence
  Description of Artificial Sequence: Synthetic peptide
  Seed: APDNLGYTY (TYRP1_HUMAN)
AVDNLGYTY

SEQ ID NO: 168171 - protein, 9 aa, Artificial Sequence
  Description of Artificial Sequence: Synthetic peptide
  Seed: HEGPAFLTW (TYRP1_HUMAN)
HAGPAFLTH

SEQ ID NO: 168172 - protein, 9 aa, Artificial Sequence
  Description of Artificial Sequence: Synthetic peptide
  Seed: VGLFDTPPF (TYRP1_HUMAN)
VLLFDTPPY

SEQ ID NO: 168173 - protein, 9 aa, Artificial Sequence
  Description of Artificial Sequence: Synthetic peptide
  Seed: HEGPAFLTW (TYRP1_HUMAN)
HIGPAFLTY

SEQ ID NO: 168174 - protein, 9 aa, Artificial Sequence
  Description of Artificial Sequence: Synthetic peptide
  Seed: FTDAVFDEW (TYRP1_HUMAN)
FTDAVFDEV

SEQ ID NO: 168175 - protein, 11 aa, Artificial Sequence
  Description of Artificial Sequence: Synthetic peptide
  Seed: VTAPDNLGYTY (TYRP1_HUMAN)
VYAPDNLGYTY

SEQ ID NO: 168176 - protein, 9 aa, Artificial Sequence
  Description of Artificial Sequence: Synthetic peptide
  Seed: STNSFRNTV (TYRP1_HUMAN)
SVNSFRNTK

SEQ ID NO: 168177 - protein, 9 aa, Artificial Sequence
  Description of Artificial Sequence: Synthetic peptide
  Seed: AQFPRQCAT (TYRP1_HUMAN)
AEFPRQCAS

SEQ ID NO: 168178 - protein, 9 aa, Artificial Sequence
  Description of Artificial Sequence: Synthetic peptide
  Seed: LIFGTASYL (TYRP1_HUMAN)
LWFGTASYL

SEQ ID NO: 168179 - protein, 10 aa, Artificial Sequence
  Description of Artificial Sequence: Synthetic peptide
  Seed: ADSRPHSPQY (TYRP1_HUMAN)
ATSRPHSPQV

SEQ ID NO: 168180 - protein, 9 aa, Artificial Sequence
  Description of Artificial Sequence: Synthetic peptide
  Seed: SFRNTVEGY (TYRP1_HUMAN)
SQRNTVEGF

SEQ ID NO: 168181 - protein, 10 aa, Artificial Sequence
  Description of Artificial Sequence: Synthetic peptide
  Seed: HRYHLLRLEK (TYRP1_HUMAN)
HSYHLLRLER

SEQ ID NO: 168182 - protein, 10 aa, Artificial Sequence
  Description of Artificial Sequence: Synthetic peptide
  Seed: NYFVWTHYYS (TYRP1_HUMAN)
NFFVWTHYYG

SEQ ID NO: 168183 - protein, 8 aa, Artificial Sequence
  Description of Artificial Sequence: Synthetic peptide
  Seed: SAPKLLSL (TYRP1_HUMAN)
SYPKLLSY

SEQ ID NO: 168184 - protein, 9 aa, Artificial Sequence
  Description of Artificial Sequence: Synthetic peptide
  Seed: AVRSLHNLA (TYRP1_HUMAN)
AIRSLHNLV

SEQ ID NO: 168185 - protein, 10 aa, Artificial Sequence
  Description of Artificial Sequence: Synthetic peptide
  Seed: TAPDNLGYTY (TYRP1_HUMAN)
TIPDNLGYTM

SEQ ID NO: 168186 - protein, 9 aa, Artificial Sequence
  Description of Artificial Sequence: Synthetic peptide
  Seed: FPRQCATVE (TYRP1_HUMAN)
FARQCATVY

SEQ ID NO: 168187 - protein, 9 aa, Artificial Sequence
  Description of Artificial Sequence: Synthetic peptide
  Seed: SRSNFDSTL (TYRP1_HUMAN)
SESNFDSTF

SEQ ID NO: 168188 - protein, 9 aa, Artificial Sequence
  Description of Artificial Sequence: Synthetic peptide
  Seed: SPQYPHDGR (TYRP1_HUMAN)
STQYPHDGR

SEQ ID NO: 168189 - protein, 10 aa, Artificial Sequence
  Description of Artificial Sequence: Synthetic peptide
  Seed: QFENISIYNY (TYRP1_HUMAN)
QKENISIYNW

SEQ ID NO: 168190 - protein, 10 aa, Artificial Sequence
  Description of Artificial Sequence: Synthetic peptide
  Seed: HPLFVIATRR (TYRP1_HUMAN)
HWLFVIATRR

SEQ ID NO: 168191 - protein, 10 aa, Artificial Sequence
  Description of Artificial Sequence: Synthetic peptide
  Seed: SIYNYFVWTH (TYRP1_HUMAN)
STYNYFVWTK

SEQ ID NO: 168192 - protein, 10 aa, Artificial Sequence
  Description of Artificial Sequence: Synthetic peptide
  Seed: REFSVPEIIA (TYRP1_HUMAN)
REFSVPEIIC

SEQ ID NO: 168193 - protein, 10 aa, Artificial Sequence
  Description of Artificial Sequence: Synthetic peptide
  Seed: GKYDPAVRSL (TYRP1_HUMAN)
GHYDPAVRSA

SEQ ID NO: 168194 - protein, 11 aa, Artificial Sequence
  Description of Artificial Sequence: Synthetic peptide
  Seed: RRSMDEANQPL (TYRP1_HUMAN)
RSSMDEANQPV

SEQ ID NO: 168195 - protein, 9 aa, Artificial Sequence
  Description of Artificial Sequence: Synthetic peptide
  Seed: RGRCEAVTA (TYRP1_HUMAN)
RVRCEAVTY

SEQ ID NO: 168196 - protein, 10 aa, Artificial Sequence
  Description of Artificial Sequence: Synthetic peptide
  Seed: EMLQEPSFSL (TYRP1_HUMAN)
EHLQEPSFSV

SEQ ID NO: 168197 - protein, 9 aa, Artificial Sequence
  Description of Artificial Sequence: Synthetic peptide
  Seed: NSVFSQWRV (TYRP1_HUMAN)
NQVFSQWRV

SEQ ID NO: 168198 - protein, 11 aa, Artificial Sequence
  Description of Artificial Sequence: Synthetic peptide
  Seed: VRSLHNLAHLF (TYRP1_HUMAN)
VSSLHNLAHLY

SEQ ID NO: 168199 - protein, 9 aa, Artificial Sequence
  Description of Artificial Sequence: Synthetic peptide
  Seed: LGYTYEIQW (TYRP1_HUMAN)
LAYTYEIQF

SEQ ID NO: 168200 - protein, 9 aa, Artificial Sequence
  Description of Artificial Sequence: Synthetic peptide
  Seed: NRQYNMVPF (TYRP1_HUMAN)
NRQYNMVPL

SEQ ID NO: 168201 - protein, 10 aa, Artificial Sequence
  Description of Artificial Sequence: Synthetic peptide
  Seed: DQYQCYAEEY (TYRP1_HUMAN)
DEYQCYAEEF

SEQ ID NO: 168202 - protein, 9 aa, Artificial Sequence
  Description of Artificial Sequence: Synthetic peptide
  Seed: SMDEANQPL (TYRP1_HUMAN)
SYDEANQPV

SEQ ID NO: 168203 - protein, 10 aa, Artificial Sequence
  Description of Artificial Sequence: Synthetic peptide
  Seed: FVWTHYYSVK (TYRP1_HUMAN)
FMWTHYYSVQ

SEQ ID NO: 168204 - protein, 9 aa, Artificial Sequence
  Description of Artificial Sequence: Synthetic peptide
  Seed: MAKRTTHPL (TYRP1_HUMAN)
MWKRTTHPM

SEQ ID NO: 168205 - protein, 10 aa, Artificial Sequence
  Description of Artificial Sequence: Synthetic peptide
  Seed: YSNSTNSFRN (TYRP1_HUMAN)
YANSTNSFRR

SEQ ID NO: 168206 - protein, 9 aa, Artificial Sequence
  Description of Artificial Sequence: Synthetic peptide
  Seed: YLIRARRSM (TYRP1_HUMAN)
YFIRARRSI

SEQ ID NO: 168207 - protein, 9 aa, Artificial Sequence
  Description of Artificial Sequence: Synthetic peptide
  Seed: SMDEANQPL (TYRP1_HUMAN)
SADEANQPV

SEQ ID NO: 168208 - protein, 10 aa, Artificial Sequence
  Description of Artificial Sequence: Synthetic peptide
  Seed: SPNSVFSQWR (TYRP1_HUMAN)
SANSVFSQWK

SEQ ID NO: 168209 - protein, 10 aa, Artificial Sequence
  Description of Artificial Sequence: Synthetic peptide
  Seed: YNYFVWTHYY (TYRP1_HUMAN)
YDYFVWTHYF

SEQ ID NO: 168210 - protein, 9 aa, Artificial Sequence
  Description of Artificial Sequence: Synthetic peptide
  Seed: SLHNLAHLF (TYRP1_HUMAN)
SLHNLAHLM

SEQ ID NO: 168211 - protein, 10 aa, Artificial Sequence
  Description of Artificial Sequence: Synthetic peptide
  Seed: LPYWNFATGK (TYRP1_HUMAN)
LVYWNFATGK

SEQ ID NO: 168212 - protein, 10 aa, Artificial Sequence
  Description of Artificial Sequence: Synthetic peptide
  Seed: FVLLHTFTDA (TYRP1_HUMAN)
FLLLHTFTDV

SEQ ID NO: 168213 - protein, 9 aa, Artificial Sequence
  Description of Artificial Sequence: Synthetic peptide
  Seed: AVRSLHNLA (TYRP1_HUMAN)
AFRSLHNLK

SEQ ID NO: 168214 - protein, 10 aa, Artificial Sequence
  Description of Artificial Sequence: Synthetic peptide
  Seed: EDYDTLGTLC (TYRP1_HUMAN)
EEYDTLGTLI

SEQ ID NO: 168215 - protein, 10 aa, Artificial Sequence
  Description of Artificial Sequence: Synthetic peptide
  Seed: LQEPSFSLPY (TYRP1_HUMAN)
LMEPSFSLPM

SEQ ID NO: 168216 - protein, 9 aa, Artificial Sequence
  Description of Artificial Sequence: Synthetic peptide
  Seed: VTAPDNLGY (TYRP1_HUMAN)
VIAPDNLGY

SEQ ID NO: 168217 - protein, 10 aa, Artificial Sequence
  Description of Artificial Sequence: Synthetic peptide
  Seed: VDFSHEGPAF (TYRP1_HUMAN)
VAFSHEGPAY

SEQ ID NO: 168218 - protein, 9 aa, Artificial Sequence
  Description of Artificial Sequence: Synthetic peptide
  Seed: AVFDEWLRR (TYRP1_HUMAN)
AMFDEWLRK

SEQ ID NO: 168219 - protein, 8 aa, Artificial Sequence
  Description of Artificial Sequence: Synthetic peptide
  Seed: FSHEGPAF (TYRP1_HUMAN)
FVHEGPAM

SEQ ID NO: 168220 - protein, 10 aa, Artificial Sequence
  Description of Artificial Sequence: Synthetic peptide
  Seed: LIFGTASYLI (TYRP1_HUMAN)
LMFGTASYLL

SEQ ID NO: 168221 - protein, 10 aa, Artificial Sequence
  Description of Artificial Sequence: Synthetic peptide
  Seed: LLHTFTDAVF (TYRP1_HUMAN)
LLHTFTDAVA

SEQ ID NO: 168222 - protein, 9 aa, Artificial Sequence
  Description of Artificial Sequence: Synthetic peptide
  Seed: NYFVWTHYY (TYRP1_HUMAN)
NAFVWTHYK

SEQ ID NO: 168223 - protein, 10 aa, Artificial Sequence
  Description of Artificial Sequence: Synthetic peptide
  Seed: YNADISTFPL (TYRP1_HUMAN)
YDADISTFPL

SEQ ID NO: 168224 - protein, 8 aa, Artificial Sequence
  Description of Artificial Sequence: Synthetic peptide
  Seed: IQWPSREF (TYRP1_HUMAN)
IQWPSREI

SEQ ID NO: 168225 - protein, 9 aa, Artificial Sequence
  Description of Artificial Sequence: Synthetic peptide
  Seed: VFDEWLRRY (TYRP1_HUMAN)
VTDEWLRRY

SEQ ID NO: 168226 - protein, 8 aa, Artificial Sequence
  Description of Artificial Sequence: Synthetic peptide
  Seed: YDPAVRSL (TYRP1_HUMAN)
YSPAVRSL

SEQ ID NO: 168227 - protein, 9 aa, Artificial Sequence
  Description of Artificial Sequence: Synthetic peptide
  Seed: HYYSVKKTF (TYRP1_HUMAN)
HHYSVKKTM

SEQ ID NO: 168228 - protein, 9 aa, Artificial Sequence
  Description of Artificial Sequence: Synthetic peptide
  Seed: FTDAVFDEW (TYRP1_HUMAN)
FNDAVFDEM

SEQ ID NO: 168229 - protein, 9 aa, Artificial Sequence
  Description of Artificial Sequence: Synthetic peptide
  Seed: KLQNPNQSV (TYRP1_HUMAN)
KSQNPNQSL

SEQ ID NO: 168230 - protein, 10 aa, Artificial Sequence
  Description of Artificial Sequence: Synthetic peptide
  Seed: YNADISTFPL (TYRP1_HUMAN)
YRADISTFPL

SEQ ID NO: 168231 - protein, 9 aa, Artificial Sequence
  Description of Artificial Sequence: Synthetic peptide
  Seed: VGALLLVAL (TYRP1_HUMAN)
VAALLLVAF

SEQ ID NO: 168232 - protein, 10 aa, Artificial Sequence
  Description of Artificial Sequence: Synthetic peptide
  Seed: YFVWTHYYSV (TYRP1_HUMAN)
YTVWTHYYSL

SEQ ID NO: 168233 - protein, 10 aa, Artificial Sequence
  Description of Artificial Sequence: Synthetic peptide
  Seed: HRYHLLRLEK (TYRP1_HUMAN)
HAYHLLRLER

SEQ ID NO: 168234 - protein, 10 aa, Artificial Sequence
  Description of Artificial Sequence: Synthetic peptide
  Seed: LLHTFTDAVF (TYRP1_HUMAN)
LMHTFTDAVM

SEQ ID NO: 168235 - protein, 9 aa, Artificial Sequence
  Description of Artificial Sequence: Synthetic peptide
  Seed: ISIYNYFVW (TYRP1_HUMAN)
IAIYNYFVF

SEQ ID NO: 168236 - protein, 10 aa, Artificial Sequence
  Description of Artificial Sequence: Synthetic peptide
  Seed: LSLGCIFFPL (TYRP1_HUMAN)
LSLGCIFFPF

SEQ ID NO: 168237 - protein, 8 aa, Artificial Sequence
  Description of Artificial Sequence: Synthetic peptide
  Seed: FSHEGPAF (TYRP1_HUMAN)
FSHEGPAY

SEQ ID NO: 168238 - protein, 9 aa, Artificial Sequence
  Description of Artificial Sequence: Synthetic peptide
  Seed: NYFVWTHYY (TYRP1_HUMAN)
NRFVWTHYF

SEQ ID NO: 168239 - protein, 8 aa, Artificial Sequence
  Description of Artificial Sequence: Synthetic peptide
  Seed: LIFGTASY (TYRP1_HUMAN)
LSFGTASY

SEQ ID NO: 168240 - protein, 9 aa, Artificial Sequence
  Description of Artificial Sequence: Synthetic peptide
  Seed: MSAPKLLSL (TYRP1_HUMAN)
MAAPKLLSC

SEQ ID NO: 168241 - protein, 9 aa, Artificial Sequence
  Description of Artificial Sequence: Synthetic peptide
  Seed: HLSPNDPIF (TYRP1_HUMAN)
HHSPNDPIM

SEQ ID NO: 168242 - protein, 8 aa, Artificial Sequence
  Description of Artificial Sequence: Synthetic peptide
  Seed: YFVWTHYY (TYRP1_HUMAN)
YLVWTHYY

SEQ ID NO: 168243 - protein, 9 aa, Artificial Sequence
  Description of Artificial Sequence: Synthetic peptide
  Seed: SMDEANQPL (TYRP1_HUMAN)
SLDEANQPF

SEQ ID NO: 168244 - protein, 9 aa, Artificial Sequence
  Description of Artificial Sequence: Synthetic peptide
  Seed: EEKNHFVRA (TYRP1_HUMAN)
EEKNHFVRW

SEQ ID NO: 168245 - protein, 9 aa, Artificial Sequence
  Description of Artificial Sequence: Synthetic peptide
  Seed: FTDAVFDEW (TYRP1_HUMAN)
FPDAVFDEF

SEQ ID NO: 168246 - protein, 11 aa, Artificial Sequence
  Description of Artificial Sequence: Synthetic peptide
  Seed: IYNYFVWTHYY (TYRP1_HUMAN)
IKNYFVWTHYF

SEQ ID NO: 168247 - protein, 11 aa, Artificial Sequence
  Description of Artificial Sequence: Synthetic peptide
  Seed: AGNVARPMVQR (TYRP1_HUMAN)
AMNVARPMVQK

SEQ ID NO: 168248 - protein, 10 aa, Artificial Sequence
  Description of Artificial Sequence: Synthetic peptide
  Seed: SPVSGPGTDR (TYRP1_HUMAN)
SYVSGPGTDR

SEQ ID NO: 168249 - protein, 9 aa, Artificial Sequence
  Description of Artificial Sequence: Synthetic peptide
  Seed: AACDQRVLI (TYRP1_HUMAN)
AACDQRVLY

SEQ ID NO: 168250 - protein, 9 aa, Artificial Sequence
  Description of Artificial Sequence: Synthetic peptide
  Seed: ARAQFPRQC (TYRP1_HUMAN)
AYAQFPRQY

SEQ ID NO: 168251 - protein, 10 aa, Artificial Sequence
  Description of Artificial Sequence: Synthetic peptide
  Seed: FYSNSTNSFR (TYRP1_HUMAN)
FQSNSTNSFK

SEQ ID NO: 168252 - protein, 10 aa, Artificial Sequence
  Description of Artificial Sequence: Synthetic peptide
  Seed: FSLPYWNFAT (TYRP1_HUMAN)
FHLPYWNFAV

SEQ ID NO: 168253 - protein, 10 aa, Artificial Sequence
  Description of Artificial Sequence: Synthetic peptide
  Seed: ALIFGTASYL (TYRP1_HUMAN)
AQIFGTASYN

SEQ ID NO: 168254 - protein, 9 aa, Artificial Sequence
  Description of Artificial Sequence: Synthetic peptide
  Seed: SRSNFDSTL (TYRP1_HUMAN)
SSSNFDSTF

SEQ ID NO: 168255 - protein, 9 aa, Artificial Sequence
  Description of Artificial Sequence: Synthetic peptide
  Seed: FSHEGPAFL (TYRP1_HUMAN)
FSHEGPAFF

SEQ ID NO: 168256 - protein, 10 aa, Artificial Sequence
  Description of Artificial Sequence: Synthetic peptide
  Seed: AVFDEWLRRY (TYRP1_HUMAN)
ASFDEWLRRF

SEQ ID NO: 168257 - protein, 9 aa, Artificial Sequence
  Description of Artificial Sequence: Synthetic peptide
  Seed: IAIAVVGAL (TYRP1_HUMAN)
IQIAVVGAF

SEQ ID NO: 168258 - protein, 9 aa, Artificial Sequence
  Description of Artificial Sequence: Synthetic peptide
  Seed: ALIFGTASY (TYRP1_HUMAN)
AKIFGTASM

SEQ ID NO: 168259 - protein, 10 aa, Artificial Sequence
  Description of Artificial Sequence: Synthetic peptide
  Seed: FGTASYLIRA (TYRP1_HUMAN)
FMTASYLIRM

SEQ ID NO: 168260 - protein, 10 aa, Artificial Sequence
  Description of Artificial Sequence: Synthetic peptide
  Seed: MQEMLQEPSF (TYRP1_HUMAN)
MSEMLQEPSW

SEQ ID NO: 168261 - protein, 9 aa, Artificial Sequence
  Description of Artificial Sequence: Synthetic peptide
  Seed: HYYSVKKTF (TYRP1_HUMAN)
HWYSVKKTY

SEQ ID NO: 168262 - protein, 9 aa, Artificial Sequence
  Description of Artificial Sequence: Synthetic peptide
  Seed: FSHEGPAFL (TYRP1_HUMAN)
FCHEGPAFY

SEQ ID NO: 168263 - protein, 10 aa, Artificial Sequence
  Description of Artificial Sequence: Synthetic peptide
  Seed: ALIFGTASYL (TYRP1_HUMAN)
ALIFGTASYI

SEQ ID NO: 168264 - protein, 10 aa, Artificial Sequence
  Description of Artificial Sequence: Synthetic peptide
  Seed: FWPPVTNTEM (TYRP1_HUMAN)
FYPPVTNTEV

SEQ ID NO: 168265 - protein, 10 aa, Artificial Sequence
  Description of Artificial Sequence: Synthetic peptide
  Seed: LSPNDPIFVL (TYRP1_HUMAN)
LKPNDPIFVW

SEQ ID NO: 168266 - protein, 10 aa, Artificial Sequence
  Description of Artificial Sequence: Synthetic peptide
  Seed: RRNPAGNVAR (TYRP1_HUMAN)
RRNPAGNVAY

SEQ ID NO: 168267 - protein, 10 aa, Artificial Sequence
  Description of Artificial Sequence: Synthetic peptide
  Seed: TASYLIRARR (TYRP1_HUMAN)
THSYLIRARR

SEQ ID NO: 168268 - protein, 9 aa, Artificial Sequence
  Description of Artificial Sequence: Synthetic peptide
  Seed: RQYNMVPFW (TYRP1_HUMAN)
RQYNMVPFY

SEQ ID NO: 168269 - protein, 9 aa, Artificial Sequence
  Description of Artificial Sequence: Synthetic peptide
  Seed: SPNDPIFVL (TYRP1_HUMAN)
SYNDPIFVM

SEQ ID NO: 168270 - protein, 10 aa, Artificial Sequence
  Description of Artificial Sequence: Synthetic peptide
  Seed: PFYSNSTNSF (TYRP1_HUMAN)
PYYSNSTNSL

SEQ ID NO: 168271 - protein, 10 aa, Artificial Sequence
  Description of Artificial Sequence: Synthetic peptide
  Seed: IYNYFVWTHY (TYRP1_HUMAN)
IFNYFVWTHF

SEQ ID NO: 168272 - protein, 10 aa, Artificial Sequence
  Description of Artificial Sequence: Synthetic peptide
  Seed: RSMDEANQPL (TYRP1_HUMAN)
RIMDEANQPW

SEQ ID NO: 168273 - protein, 10 aa, Artificial Sequence
  Description of Artificial Sequence: Synthetic peptide
  Seed: FSVPEIIAIA (TYRP1_HUMAN)
FLVPEIIAIL

SEQ ID NO: 168274 - protein, 10 aa, Artificial Sequence
  Description of Artificial Sequence: Synthetic peptide
  Seed: FVWTHYYSVK (TYRP1_HUMAN)
FIWTHYYSVD

SEQ ID NO: 168275 - protein, 9 aa, Artificial Sequence
  Description of Artificial Sequence: Synthetic peptide
  Seed: SVPEIIAIA (TYRP1_HUMAN)
SMPEIIAIF

SEQ ID NO: 168276 - protein, 10 aa, Artificial Sequence
  Description of Artificial Sequence: Synthetic peptide
  Seed: YNYFVWTHYY (TYRP1_HUMAN)
YHYFVWTHYY

SEQ ID NO: 168277 - protein, 9 aa, Artificial Sequence
  Description of Artificial Sequence: Synthetic peptide
  Seed: RQCATVEAL (TYRP1_HUMAN)
RVCATVEAY

SEQ ID NO: 168278 - protein, 9 aa, Artificial Sequence
  Description of Artificial Sequence: Synthetic peptide
  Seed: MCCPDLSPV (TYRP1_HUMAN)
MMCPDLSPI

SEQ ID NO: 168279 - protein, 9 aa, Artificial Sequence
  Description of Artificial Sequence: Synthetic peptide
  Seed: SIYNYFVWT (TYRP1_HUMAN)
SQYNYFVWM

SEQ ID NO: 168280 - protein, 9 aa, Artificial Sequence
  Description of Artificial Sequence: Synthetic peptide
  Seed: FSVPEIIAI (TYRP1_HUMAN)
FLVPEIIAI

SEQ ID NO: 168281 - protein, 9 aa, Artificial Sequence
  Description of Artificial Sequence: Synthetic peptide
  Seed: LEKDMQEML (TYRP1_HUMAN)
LEKDMQEMM

SEQ ID NO: 168282 - protein, 9 aa, Artificial Sequence
  Description of Artificial Sequence: Synthetic peptide
  Seed: FENISIYNY (TYRP1_HUMAN)
FENISIYNV

SEQ ID NO: 168283 - protein, 9 aa, Artificial Sequence
  Description of Artificial Sequence: Synthetic peptide
  Seed: LIFGTASYL (TYRP1_HUMAN)
LKFGTASYL

SEQ ID NO: 168284 - protein, 10 aa, Artificial Sequence
  Description of Artificial Sequence: Synthetic peptide
  Seed: ATVEALRSGM (TYRP1_HUMAN)
AQVEALRSGV

SEQ ID NO: 168285 - protein, 9 aa, Artificial Sequence
  Description of Artificial Sequence: Synthetic peptide
  Seed: FSVPEIIAI (TYRP1_HUMAN)
FYVPEIIAI

SEQ ID NO: 168286 - protein, 9 aa, Artificial Sequence
  Description of Artificial Sequence: Synthetic peptide
  Seed: GTASYLIRA (TYRP1_HUMAN)
GQASYLIRA

SEQ ID NO: 168287 - protein, 10 aa, Artificial Sequence
  Description of Artificial Sequence: Synthetic peptide
  Seed: FVTAPDNLGY (TYRP1_HUMAN)
FITAPDNLGW

SEQ ID NO: 168288 - protein, 9 aa, Artificial Sequence
  Description of Artificial Sequence: Synthetic peptide
  Seed: LFDTPPFYS (TYRP1_HUMAN)
LIDTPPFYL

SEQ ID NO: 168289 - protein, 9 aa, Artificial Sequence
  Description of Artificial Sequence: Synthetic peptide
  Seed: HLSPNDPIF (TYRP1_HUMAN)
HSSPNDPIW

SEQ ID NO: 168290 - protein, 11 aa, Artificial Sequence
  Description of Artificial Sequence: Synthetic peptide
  Seed: VTAPDNLGYTY (TYRP1_HUMAN)
VQAPDNLGYTY

SEQ ID NO: 168291 - protein, 11 aa, Artificial Sequence
  Description of Artificial Sequence: Synthetic peptide
  Seed: MLQEPSFSLPY (TYRP1_HUMAN)
MKQEPSFSLPF

SEQ ID NO: 168292 - protein, 10 aa, Artificial Sequence
  Description of Artificial Sequence: Synthetic peptide
  Seed: SMDEANQPLL (TYRP1_HUMAN)
SVDEANQPLI

SEQ ID NO: 168293 - protein, 10 aa, Artificial Sequence
  Description of Artificial Sequence: Synthetic peptide
  Seed: LLHTFTDAVF (TYRP1_HUMAN)
LAHTFTDAVF

SEQ ID NO: 168294 - protein, 9 aa, Artificial Sequence
  Description of Artificial Sequence: Synthetic peptide
  Seed: HRYHLLRLE (TYRP1_HUMAN)
HRYHLLRLM

SEQ ID NO: 168295 - protein, 10 aa, Artificial Sequence
  Description of Artificial Sequence: Synthetic peptide
  Seed: KRTTHPLFVI (TYRP1_HUMAN)
KVTTHPLFVY

SEQ ID NO: 168296 - protein, 10 aa, Artificial Sequence
  Description of Artificial Sequence: Synthetic peptide
  Seed: RPMVQRLPEP (TYRP1_HUMAN)
RPMVQRLPET

SEQ ID NO: 168297 - protein, 10 aa, Artificial Sequence
  Description of Artificial Sequence: Synthetic peptide
  Seed: FWPPVTNTEM (TYRP1_HUMAN)
FSPPVTNTEF

SEQ ID NO: 168298 - protein, 10 aa, Artificial Sequence
  Description of Artificial Sequence: Synthetic peptide
  Seed: YNMVPFWPPV (TYRP1_HUMAN)
YCMVPFWPPA

SEQ ID NO: 168299 - protein, 10 aa, Artificial Sequence
  Description of Artificial Sequence: Synthetic peptide
  Seed: LSLGCIFFPL (TYRP1_HUMAN)
LSLGCIFFPV

SEQ ID NO: 168300 - protein, 11 aa, Artificial Sequence
  Description of Artificial Sequence: Synthetic peptide
  Seed: VCDSLEDYDTL (TYRP1_HUMAN)
VIDSLEDYDTL

SEQ ID NO: 168301 - protein, 10 aa, Artificial Sequence
  Description of Artificial Sequence: Synthetic peptide
  Seed: QCYAEEYEKL (TYRP1_HUMAN)
QYYAEEYEKF

SEQ ID NO: 168302 - protein, 9 aa, Artificial Sequence
  Description of Artificial Sequence: Synthetic peptide
  Seed: YTYEIQWPS (TYRP1_HUMAN)
YGYEIQWPK

SEQ ID NO: 168303 - protein, 10 aa, Artificial Sequence
  Description of Artificial Sequence: Synthetic peptide
  Seed: TAPDNLGYTY (TYRP1_HUMAN)
TPPDNLGYTF

SEQ ID NO: 168304 - protein, 9 aa, Artificial Sequence
  Description of Artificial Sequence: Synthetic peptide
  Seed: AVRSLHNLA (TYRP1_HUMAN)
ATRSLHNLL

SEQ ID NO: 168305 - protein, 10 aa, Artificial Sequence
  Description of Artificial Sequence: Synthetic peptide
  Seed: RVLIVRRNLL (TYRP1_HUMAN)
RTLIVRRNLK

SEQ ID NO: 168306 - protein, 9 aa, Artificial Sequence
  Description of Artificial Sequence: Synthetic peptide
  Seed: FLGVGQESF (TYRP1_HUMAN)
FLGVGQESL

SEQ ID NO: 168307 - protein, 9 aa, Artificial Sequence
  Description of Artificial Sequence: Synthetic peptide
  Seed: ALIFGTASY (TYRP1_HUMAN)
AKIFGTASL

SEQ ID NO: 168308 - protein, 9 aa, Artificial Sequence
  Description of Artificial Sequence: Synthetic peptide
  Seed: TADSRPHSP (TYRP1_HUMAN)
TGDSRPHSL

SEQ ID NO: 168309 - protein, 10 aa, Artificial Sequence
  Description of Artificial Sequence: Synthetic peptide
  Seed: KLQNPNQSVV (TYRP1_HUMAN)
KQQNPNQSVL

SEQ ID NO: 168310 - protein, 11 aa, Artificial Sequence
  Description of Artificial Sequence: Synthetic peptide
  Seed: LVALIFGTASY (TYRP1_HUMAN)
LDALIFGTASY

SEQ ID NO: 168311 - protein, 9 aa, Artificial Sequence
  Description of Artificial Sequence: Synthetic peptide
  Seed: RTTHPLFVI (TYRP1_HUMAN)
RTTHPLFVL

SEQ ID NO: 168312 - protein, 9 aa, Artificial Sequence
  Description of Artificial Sequence: Synthetic peptide
  Seed: SLGCIFFPL (TYRP1_HUMAN)
SVGCIFFPR

SEQ ID NO: 168313 - protein, 9 aa, Artificial Sequence
  Description of Artificial Sequence: Synthetic peptide
  Seed: FPLENAPIG (TYRP1_HUMAN)
FALENAPII

SEQ ID NO: 168314 - protein, 11 aa, Artificial Sequence
  Description of Artificial Sequence: Synthetic peptide
  Seed: QEMLQEPSFSL (TYRP1_HUMAN)
QCMLQEPSFSV

SEQ ID NO: 168315 - protein, 9 aa, Artificial Sequence
  Description of Artificial Sequence: Synthetic peptide
  Seed: FPLENAPIG (TYRP1_HUMAN)
FGLENAPIY

SEQ ID NO: 168316 - protein, 10 aa, Artificial Sequence
  Description of Artificial Sequence: Synthetic peptide
  Seed: QFENISIYNY (TYRP1_HUMAN)
QRENISIYNW

SEQ ID NO: 168317 - protein, 9 aa, Artificial Sequence
  Description of Artificial Sequence: Synthetic peptide
  Seed: LGYTYEIQW (TYRP1_HUMAN)
LMYTYEIQF

SEQ ID NO: 168318 - protein, 9 aa, Artificial Sequence
  Description of Artificial Sequence: Synthetic peptide
  Seed: REVWPLRFF (TYRP1_HUMAN)
REVWPLRFA

SEQ ID NO: 168319 - protein, 8 aa, Artificial Sequence
  Description of Artificial Sequence: Synthetic peptide
  Seed: REFSVPEI (TYRP1_HUMAN)
RQFSVPEL

SEQ ID NO: 168320 - protein, 9 aa, Artificial Sequence
  Description of Artificial Sequence: Synthetic peptide
  Seed: VCDICTDDL (TYRP1_HUMAN)
VFDICTDDF

SEQ ID NO: 168321 - protein, 10 aa, Artificial Sequence
  Description of Artificial Sequence: Synthetic peptide
  Seed: RRYNADISTF (TYRP1_HUMAN)
RGYNADISTY

SEQ ID NO: 168322 - protein, 9 aa, Artificial Sequence
  Description of Artificial Sequence: Synthetic peptide
  Seed: APIGHNRQY (TYRP1_HUMAN)
ATIGHNRQM

SEQ ID NO: 168323 - protein, 10 aa, Artificial Sequence
  Description of Artificial Sequence: Synthetic peptide
  Seed: EGYSDPTGKY (TYRP1_HUMAN)
ESYSDPTGKK

SEQ ID NO: 168324 - protein, 9 aa, Artificial Sequence
  Description of Artificial Sequence: Synthetic peptide
  Seed: FSVPEIIAI (TYRP1_HUMAN)
FEVPEIIAF

SEQ ID NO: 168325 - protein, 10 aa, Artificial Sequence
  Description of Artificial Sequence: Synthetic peptide
  Seed: LSLGCIFFPL (TYRP1_HUMAN)
LVLGCIFFPA

SEQ ID NO: 168326 - protein, 10 aa, Artificial Sequence
  Description of Artificial Sequence: Synthetic peptide
  Seed: STLISPNSVF (TYRP1_HUMAN)
SSLISPNSVY

SEQ ID NO: 168327 - protein, 9 aa, Artificial Sequence
  Description of Artificial Sequence: Synthetic peptide
  Seed: YSNSTNSFR (TYRP1_HUMAN)
YTNSTNSFF

SEQ ID NO: 168328 - protein, 9 aa, Artificial Sequence
  Description of Artificial Sequence: Synthetic peptide
  Seed: GTASYLIRA (TYRP1_HUMAN)
GQASYLIRI

SEQ ID NO: 168329 - protein, 10 aa, Artificial Sequence
  Description of Artificial Sequence: Synthetic peptide
  Seed: HFVRALDMAK (TYRP1_HUMAN)
HTVRALDMAR

SEQ ID NO: 168330 - protein, 9 aa, Artificial Sequence
  Description of Artificial Sequence: Synthetic peptide
  Seed: RFFNRTCHC (TYRP1_HUMAN)
RYFNRTCHF

SEQ ID NO: 168331 - protein, 10 aa, Artificial Sequence
  Description of Artificial Sequence: Synthetic peptide
  Seed: FENISIYNYF (TYRP1_HUMAN)
FQNISIYNYM

SEQ ID NO: 168332 - protein, 11 aa, Artificial Sequence
  Description of Artificial Sequence: Synthetic peptide
  Seed: FENISIYNYFV (TYRP1_HUMAN)
FLNISIYNYFI

SEQ ID NO: 168333 - protein, 9 aa, Artificial Sequence
  Description of Artificial Sequence: Synthetic peptide
  Seed: FYSNSTNSF (TYRP1_HUMAN)
FQSNSTNSW

SEQ ID NO: 168334 - protein, 9 aa, Artificial Sequence
  Description of Artificial Sequence: Synthetic peptide
  Seed: NYFVWTHYY (TYRP1_HUMAN)
NMFVWTHYW

SEQ ID NO: 168335 - protein, 9 aa, Artificial Sequence
  Description of Artificial Sequence: Synthetic peptide
  Seed: LTWHRYHLL (TYRP1_HUMAN)
LVWHRYHLY

SEQ ID NO: 168336 - protein, 10 aa, Artificial Sequence
  Description of Artificial Sequence: Synthetic peptide
  Seed: RSMDEANQPL (TYRP1_HUMAN)
RKMDEANQPI

SEQ ID NO: 168337 - protein, 11 aa, Artificial Sequence
  Description of Artificial Sequence: Synthetic peptide
  Seed: KTFLGVGQESF (TYRP1_HUMAN)
KSFLGVGQESF

SEQ ID NO: 168338 - protein, 9 aa, Artificial Sequence
  Description of Artificial Sequence: Synthetic peptide
  Seed: GPDGNTPQF (TYRP1_HUMAN)
GADGNTPQL

SEQ ID NO: 168339 - protein, 9 aa, Artificial Sequence
  Description of Artificial Sequence: Synthetic peptide
  Seed: QYQCYAEEY (TYRP1_HUMAN)
QYQCYAEEM

SEQ ID NO: 168340 - protein, 10 aa, Artificial Sequence
  Description of Artificial Sequence: Synthetic peptide
  Seed: LLHTFTDAVF (TYRP1_HUMAN)
LEHTFTDAVF

SEQ ID NO: 168341 - protein, 10 aa, Artificial Sequence
  Description of Artificial Sequence: Synthetic peptide
  Seed: NYFVWTHYYS (TYRP1_HUMAN)
NFFVWTHYYN

SEQ ID NO: 168342 - protein, 10 aa, Artificial Sequence
  Description of Artificial Sequence: Synthetic peptide
  Seed: DAVFDEWLRR (TYRP1_HUMAN)
DFVFDEWLRR

SEQ ID NO: 168343 - protein, 10 aa, Artificial Sequence
  Description of Artificial Sequence: Synthetic peptide
  Seed: LPYWNFATGK (TYRP1_HUMAN)
LGYWNFATGR

SEQ ID NO: 168344 - protein, 10 aa, Artificial Sequence
  Description of Artificial Sequence: Synthetic peptide
  Seed: FVLLHTFTDA (TYRP1_HUMAN)
FILLHTFTDV

SEQ ID NO: 168345 - protein, 9 aa, Artificial Sequence
  Description of Artificial Sequence: Synthetic peptide
  Seed: PNDPIFVLL (TYRP1_HUMAN)
PVDPIFVLL

SEQ ID NO: 168346 - protein, 9 aa, Artificial Sequence
  Description of Artificial Sequence: Synthetic peptide
  Seed: RVLIVRRNL (TYRP1_HUMAN)
RYLIVRRNA

SEQ ID NO: 168347 - protein, 10 aa, Artificial Sequence
  Description of Artificial Sequence: Synthetic peptide
  Seed: ENISIYNYFV (TYRP1_HUMAN)
ESISIYNYFL

SEQ ID NO: 168348 - protein, 9 aa, Artificial Sequence
  Description of Artificial Sequence: Synthetic peptide
  Seed: KLLSLGCIF (TYRP1_HUMAN)
KQLSLGCIL

SEQ ID NO: 168349 - protein, 10 aa, Artificial Sequence
  Description of Artificial Sequence: Synthetic peptide
  Seed: AFLTWHRYHL (TYRP1_HUMAN)
ALLTWHRYHI

SEQ ID NO: 168350 - protein, 10 aa, Artificial Sequence
  Description of Artificial Sequence: Synthetic peptide
  Seed: MVPFWPPVTN (TYRP1_HUMAN)
MAPFWPPVTL

SEQ ID NO: 168351 - protein, 10 aa, Artificial Sequence
  Description of Artificial Sequence: Synthetic peptide
  Seed: SPNSVFSQWR (TYRP1_HUMAN)
SSNSVFSQWR

SEQ ID NO: 168352 - protein, 10 aa, Artificial Sequence
  Description of Artificial Sequence: Synthetic peptide
  Seed: HLSPNDPIFV (TYRP1_HUMAN)
HISPNDPIFV

SEQ ID NO: 168353 - protein, 9 aa, Artificial Sequence
  Description of Artificial Sequence: Synthetic peptide
  Seed: TWHRYHLLR (TYRP1_HUMAN)
TFHRYHLLK

SEQ ID NO: 168354 - protein, 9 aa, Artificial Sequence
  Description of Artificial Sequence: Synthetic peptide
  Seed: FSLPYWNFA (TYRP1_HUMAN)
FVLPYWNFM

SEQ ID NO: 168355 - protein, 9 aa, Artificial Sequence
  Description of Artificial Sequence: Synthetic peptide
  Seed: FLGVGQESF (TYRP1_HUMAN)
FTGVGQESY

SEQ ID NO: 168356 - protein, 10 aa, Artificial Sequence
  Description of Artificial Sequence: Synthetic peptide
  Seed: LIFGTASYLI (TYRP1_HUMAN)
LHFGTASYLF

SEQ ID NO: 168357 - protein, 9 aa, Artificial Sequence
  Description of Artificial Sequence: Synthetic peptide
  Seed: STNSFRNTV (TYRP1_HUMAN)
SANSFRNTV

SEQ ID NO: 168358 - protein, 10 aa, Artificial Sequence
  Description of Artificial Sequence: Synthetic peptide
  Seed: YFVWTHYYSV (TYRP1_HUMAN)
YLVWTHYYST

SEQ ID NO: 168359 - protein, 10 aa, Artificial Sequence
  Description of Artificial Sequence: Synthetic peptide
  Seed: MSAPKLLSLG (TYRP1_HUMAN)
MWAPKLLSLW

SEQ ID NO: 168360 - protein, 10 aa, Artificial Sequence
  Description of Artificial Sequence: Synthetic peptide
  Seed: WPPVTNTEMF (TYRP1_HUMAN)
WMPVTNTEMY

SEQ ID NO: 168361 - protein, 10 aa, Artificial Sequence
  Description of Artificial Sequence: Synthetic peptide
  Seed: MVPFWPPVTN (TYRP1_HUMAN)
MVPFWPPVTM

SEQ ID NO: 168362 - protein, 10 aa, Artificial Sequence
  Description of Artificial Sequence: Synthetic peptide
  Seed: VALIFGTASY (TYRP1_HUMAN)
VLLIFGTASY

SEQ ID NO: 168363 - protein, 9 aa, Artificial Sequence
  Description of Artificial Sequence: Synthetic peptide
  Seed: SVKKTFLGV (TYRP1_HUMAN)
SAKKTFLGL

SEQ ID NO: 168364 - protein, 10 aa, Artificial Sequence
  Description of Artificial Sequence: Synthetic peptide
  Seed: YNADISTFPL (TYRP1_HUMAN)
YMADISTFPY

SEQ ID NO: 168365 - protein, 9 aa, Artificial Sequence
  Description of Artificial Sequence: Synthetic peptide
  Seed: LLVALIFGT (TYRP1_HUMAN)
LQVALIFGM

SEQ ID NO: 168366 - protein, 9 aa, Artificial Sequence
  Description of Artificial Sequence: Synthetic peptide
  Seed: CIFFPLLLF (TYRP1_HUMAN)
CAFFPLLLW

SEQ ID NO: 168367 - protein, 11 aa, Artificial Sequence
  Description of Artificial Sequence: Synthetic peptide
  Seed: MSAPKLLSLGC (TYRP1_HUMAN)
MAAPKLLSLGW

SEQ ID NO: 168368 - protein, 8 aa, Artificial Sequence
  Description of Artificial Sequence: Synthetic peptide
  Seed: YSDPTGKY (TYRP1_HUMAN)
YQDPTGKF

SEQ ID NO: 168369 - protein, 9 aa, Artificial Sequence
  Description of Artificial Sequence: Synthetic peptide
  Seed: MCCPDLSPV (TYRP1_HUMAN)
MACPDLSPL

SEQ ID NO: 168370 - protein, 10 aa, Artificial Sequence
  Description of Artificial Sequence: Synthetic peptide
  Seed: NYFVWTHYYS (TYRP1_HUMAN)
NFFVWTHYYA

SEQ ID NO: 168371 - protein, 9 aa, Artificial Sequence
  Description of Artificial Sequence: Synthetic peptide
  Seed: WPPVTNTEM (TYRP1_HUMAN)
WPPVTNTEY

SEQ ID NO: 168372 - protein, 9 aa, Artificial Sequence
  Description of Artificial Sequence: Synthetic peptide
  Seed: FVWTHYYSV (TYRP1_HUMAN)
FLWTHYYSL

SEQ ID NO: 168373 - protein, 10 aa, Artificial Sequence
  Description of Artificial Sequence: Synthetic peptide
  Seed: YNMVPFWPPV (TYRP1_HUMAN)
YMMVPFWPPA

SEQ ID NO: 168374 - protein, 11 aa, Artificial Sequence
  Description of Artificial Sequence: Synthetic peptide
  Seed: FVLLHTFTDAV (TYRP1_HUMAN)
FILLHTFTDAL

SEQ ID NO: 168375 - protein, 9 aa, Artificial Sequence
  Description of Artificial Sequence: Synthetic peptide
  Seed: LLVALIFGT (TYRP1_HUMAN)
LVVALIFGI

SEQ ID NO: 168376 - protein, 10 aa, Artificial Sequence
  Description of Artificial Sequence: Synthetic peptide
  Seed: LPYWNFATGK (TYRP1_HUMAN)
LKYWNFATGR

SEQ ID NO: 168377 - protein, 10 aa, Artificial Sequence
  Description of Artificial Sequence: Synthetic peptide
  Seed: RQCATVEALR (TYRP1_HUMAN)
RTCATVEALR

SEQ ID NO: 168378 - protein, 10 aa, Artificial Sequence
  Description of Artificial Sequence: Synthetic peptide
  Seed: SMDEANQPLL (TYRP1_HUMAN)
SLDEANQPLL

SEQ ID NO: 168379 - protein, 11 aa, Artificial Sequence
  Description of Artificial Sequence: Synthetic peptide
  Seed: FPRQCATVEAL (TYRP1_HUMAN)
FPRQCATVEAA

SEQ ID NO: 168380 - protein, 11 aa, Artificial Sequence
  Description of Artificial Sequence: Synthetic peptide
  Seed: REVWPLRFFNR (TYRP1_HUMAN)
RMVWPLRFFNR

SEQ ID NO: 168381 - protein, 9 aa, Artificial Sequence
  Description of Artificial Sequence: Synthetic peptide
  Seed: SRSNFDSTL (TYRP1_HUMAN)
SMSNFDSTY

SEQ ID NO: 168382 - protein, 9 aa, Artificial Sequence
  Description of Artificial Sequence: Synthetic peptide
  Seed: VGLFDTPPF (TYRP1_HUMAN)
VILFDTPPW

SEQ ID NO: 168383 - protein, 10 aa, Artificial Sequence
  Description of Artificial Sequence: Synthetic peptide
  Seed: LIFGTASYLI (TYRP1_HUMAN)
LCFGTASYLF

SEQ ID NO: 168384 - protein, 10 aa, Artificial Sequence
  Description of Artificial Sequence: Synthetic peptide
  Seed: EGPAFLTWHR (TYRP1_HUMAN)
EVPAFLTWHR

SEQ ID NO: 168385 - protein, 10 aa, Artificial Sequence
  Description of Artificial Sequence: Synthetic peptide
  Seed: MAKRTTHPLF (TYRP1_HUMAN)
MLKRTTHPLF

SEQ ID NO: 168386 - protein, 10 aa, Artificial Sequence
  Description of Artificial Sequence: Synthetic peptide
  Seed: YNYFVWTHYY (TYRP1_HUMAN)
YRYFVWTHYW

SEQ ID NO: 168387 - protein, 9 aa, Artificial Sequence
  Description of Artificial Sequence: Synthetic peptide
  Seed: AQFPRQCAT (TYRP1_HUMAN)
ARFPRQCAY

SEQ ID NO: 168388 - protein, 10 aa, Artificial Sequence
  Description of Artificial Sequence: Synthetic peptide
  Seed: FWPPVTNTEM (TYRP1_HUMAN)
FMPPVTNTEM

SEQ ID NO: 168389 - protein, 9 aa, Artificial Sequence
  Description of Artificial Sequence: Synthetic peptide
  Seed: FTDAVFDEW (TYRP1_HUMAN)
FQDAVFDEM

SEQ ID NO: 168390 - protein, 9 aa, Artificial Sequence
  Description of Artificial Sequence: Synthetic peptide
  Seed: RGRCEAVTA (TYRP1_HUMAN)
RIRCEAVTK

SEQ ID NO: 168391 - protein, 9 aa, Artificial Sequence
  Description of Artificial Sequence: Synthetic peptide
  Seed: NADISTFPL (TYRP1_HUMAN)
NHDISTFPM

SEQ ID NO: 168392 - protein, 10 aa, Artificial Sequence
  Description of Artificial Sequence: Synthetic peptide
  Seed: FYSNSTNSFR (TYRP1_HUMAN)
FKSNSTNSFK

SEQ ID NO: 168393 - protein, 9 aa, Artificial Sequence
  Description of Artificial Sequence: Synthetic peptide
  Seed: STLISPNSV (TYRP1_HUMAN)
SLLISPNSL

SEQ ID NO: 168394 - protein, 9 aa, Artificial Sequence
  Description of Artificial Sequence: Synthetic peptide
  Seed: YNYFVWTHY (TYRP1_HUMAN)
YQYFVWTHR

SEQ ID NO: 168395 - protein, 9 aa, Artificial Sequence
  Description of Artificial Sequence: Synthetic peptide
  Seed: REFSVPEII (TYRP1_HUMAN)
RDFSVPEIA

SEQ ID NO: 168396 - protein, 10 aa, Artificial Sequence
  Description of Artificial Sequence: Synthetic peptide
  Seed: FLTWHRYHLL (TYRP1_HUMAN)
FTTWHRYHLV

SEQ ID NO: 168397 - protein, 10 aa, Artificial Sequence
  Description of Artificial Sequence: Synthetic peptide
  Seed: YNYFVWTHYY (TYRP1_HUMAN)
YYYFVWTHYL

SEQ ID NO: 168398 - protein, 10 aa, Artificial Sequence
  Description of Artificial Sequence: Synthetic peptide
  Seed: SIYNYFVWTH (TYRP1_HUMAN)
SQYNYFVWTK

SEQ ID NO: 168399 - protein, 9 aa, Artificial Sequence
  Description of Artificial Sequence: Synthetic peptide
  Seed: AVRSLHNLA (TYRP1_HUMAN)
ACRSLHNLK

SEQ ID NO: 168400 - protein, 10 aa, Artificial Sequence
  Description of Artificial Sequence: Synthetic peptide
  Seed: ADSRPHSPQY (TYRP1_HUMAN)
ATSRPHSPQL

SEQ ID NO: 168401 - protein, 10 aa, Artificial Sequence
  Description of Artificial Sequence: Synthetic peptide
  Seed: LLHTFTDAVF (TYRP1_HUMAN)
LVHTFTDAVF

SEQ ID NO: 168402 - protein, 9 aa, Artificial Sequence
  Description of Artificial Sequence: Synthetic peptide
  Seed: KLLSLGCIF (TYRP1_HUMAN)
KKLSLGCIM

SEQ ID NO: 168403 - protein, 10 aa, Artificial Sequence
  Description of Artificial Sequence: Synthetic peptide
  Seed: LLLVALIFGT (TYRP1_HUMAN)
LILVALIFGI

SEQ ID NO: 168404 - protein, 10 aa, Artificial Sequence
  Description of Artificial Sequence: Synthetic peptide
  Seed: VGLFDTPPFY (TYRP1_HUMAN)
VFLFDTPPFK

SEQ ID NO: 168405 - protein, 9 aa, Artificial Sequence
  Description of Artificial Sequence: Synthetic peptide
  Seed: AACDQRVLI (TYRP1_HUMAN)
ASCDQRVLW

SEQ ID NO: 168406 - protein, 10 aa, Artificial Sequence
  Description of Artificial Sequence: Synthetic peptide
  Seed: LSPNDPIFVL (TYRP1_HUMAN)
LMPNDPIFVM

SEQ ID NO: 168407 - protein, 10 aa, Artificial Sequence
  Description of Artificial Sequence: Synthetic peptide
  Seed: CDQRVLIVRR (TYRP1_HUMAN)
CYQRVLIVRR

SEQ ID NO: 168408 - protein, 11 aa, Artificial Sequence
  Description of Artificial Sequence: Synthetic peptide
  Seed: RSMDEANQPLL (TYRP1_HUMAN)
RTMDEANQPLM

SEQ ID NO: 168409 - protein, 10 aa, Artificial Sequence
  Description of Artificial Sequence: Synthetic peptide
  Seed: YNYFVWTHYY (TYRP1_HUMAN)
YFYFVWTHYW

SEQ ID NO: 168410 - protein, 9 aa, Artificial Sequence
  Description of Artificial Sequence: Synthetic peptide
  Seed: RQYNMVPFW (TYRP1_HUMAN)
RKYNMVPFM

SEQ ID NO: 168411 - protein, 9 aa, Artificial Sequence
  Description of Artificial Sequence: Synthetic peptide
  Seed: VGLFDTPPF (TYRP1_HUMAN)
VSLFDTPPW

SEQ ID NO: 168412 - protein, 9 aa, Artificial Sequence
  Description of Artificial Sequence: Synthetic peptide
  Seed: FSHEGPAFL (TYRP1_HUMAN)
FGHEGPAFL

SEQ ID NO: 168413 - protein, 11 aa, Artificial Sequence
  Description of Artificial Sequence: Synthetic peptide
  Seed: YNMVPFWPPVT (TYRP1_HUMAN)
YIMVPFWPPVF

SEQ ID NO: 168414 - protein, 10 aa, Artificial Sequence
  Description of Artificial Sequence: Synthetic peptide
  Seed: YNADISTFPL (TYRP1_HUMAN)
YMADISTFPI

SEQ ID NO: 168415 - protein, 9 aa, Artificial Sequence
  Description of Artificial Sequence: Synthetic peptide
  Seed: ARAQFPRQC (TYRP1_HUMAN)
ARAQFPRQI

SEQ ID NO: 168416 - protein, 9 aa, Artificial Sequence
  Description of Artificial Sequence: Synthetic peptide
  Seed: STNSFRNTV (TYRP1_HUMAN)
SINSFRNTF

SEQ ID NO: 168417 - protein, 9 aa, Artificial Sequence
  Description of Artificial Sequence: Synthetic peptide
  Seed: SMDEANQPL (TYRP1_HUMAN)
SNDEANQPL

SEQ ID NO: 168418 - protein, 11 aa, Artificial Sequence
  Description of Artificial Sequence: Synthetic peptide
  Seed: MLQEPSFSLPY (TYRP1_HUMAN)
MHQEPSFSLPF

SEQ ID NO: 168419 - protein, 9 aa, Artificial Sequence
  Description of Artificial Sequence: Synthetic peptide
  Seed: NISIYNYFV (TYRP1_HUMAN)
NLSIYNYFA

SEQ ID NO: 168420 - protein, 9 aa, Artificial Sequence
  Description of Artificial Sequence: Synthetic peptide
  Seed: HYYSVKKTF (TYRP1_HUMAN)
HAYSVKKTF

SEQ ID NO: 168421 - protein, 10 aa, Artificial Sequence
  Description of Artificial Sequence: Synthetic peptide
  Seed: LLLVALIFGT (TYRP1_HUMAN)
LILVALIFGL

SEQ ID NO: 168422 - protein, 9 aa, Artificial Sequence
  Description of Artificial Sequence: Synthetic peptide
  Seed: STLISPNSV (TYRP1_HUMAN)
STLISPNSW

SEQ ID NO: 168423 - protein, 9 aa, Artificial Sequence
  Description of Artificial Sequence: Synthetic peptide
  Seed: FLTWHRYHL (TYRP1_HUMAN)
FYTWHRYHI

SEQ ID NO: 168424 - protein, 11 aa, Artificial Sequence
  Description of Artificial Sequence: Synthetic peptide
  Seed: YNMVPFWPPVT (TYRP1_HUMAN)
YIMVPFWPPVK

SEQ ID NO: 168425 - protein, 9 aa, Artificial Sequence
  Description of Artificial Sequence: Synthetic peptide
  Seed: AVVGALLLV (TYRP1_HUMAN)
ATVGALLLV

SEQ ID NO: 168426 - protein, 9 aa, Artificial Sequence
  Description of Artificial Sequence: Synthetic peptide
  Seed: TADSRPHSP (TYRP1_HUMAN)
TSDSRPHSV

SEQ ID NO: 168427 - protein, 9 aa, Artificial Sequence
  Description of Artificial Sequence: Synthetic peptide
  Seed: SPNSVFSQW (TYRP1_HUMAN)
SSNSVFSQF

SEQ ID NO: 168428 - protein, 9 aa, Artificial Sequence
  Description of Artificial Sequence: Synthetic peptide
  Seed: TADSRPHSP (TYRP1_HUMAN)
TIDSRPHSF

SEQ ID NO: 168429 - protein, 9 aa, Artificial Sequence
  Description of Artificial Sequence: Synthetic peptide
  Seed: GPDGNTPQF (TYRP1_HUMAN)
GADGNTPQF

SEQ ID NO: 168430 - protein, 10 aa, Artificial Sequence
  Description of Artificial Sequence: Synthetic peptide
  Seed: HLSPNDPIFV (TYRP1_HUMAN)
HVSPNDPIFL

SEQ ID NO: 168431 - protein, 10 aa, Artificial Sequence
  Description of Artificial Sequence: Synthetic peptide
  Seed: TPQFENISIY (TYRP1_HUMAN)
TVQFENISIY

SEQ ID NO: 168432 - protein, 9 aa, Artificial Sequence
  Description of Artificial Sequence: Synthetic peptide
  Seed: HEGPAFLTW (TYRP1_HUMAN)
HLGPAFLTF

SEQ ID NO: 168433 - protein, 9 aa, Artificial Sequence
  Description of Artificial Sequence: Synthetic peptide
  Seed: HYYSVKKTF (TYRP1_HUMAN)
HMYSVKKTM

SEQ ID NO: 168434 - protein, 10 aa, Artificial Sequence
  Description of Artificial Sequence: Synthetic peptide
  Seed: FVWTHYYSVK (TYRP1_HUMAN)
FLWTHYYSVI

SEQ ID NO: 168435 - protein, 10 aa, Artificial Sequence
  Description of Artificial Sequence: Synthetic peptide
  Seed: EMLQEPSFSL (TYRP1_HUMAN)
EFLQEPSFSL

SEQ ID NO: 168436 - protein, 10 aa, Artificial Sequence
  Description of Artificial Sequence: Synthetic peptide
  Seed: ADSRPHSPQY (TYRP1_HUMAN)
AHSRPHSPQW

SEQ ID NO: 168437 - protein, 9 aa, Artificial Sequence
  Description of Artificial Sequence: Synthetic peptide
  Seed: RGRCEAVTA (TYRP1_HUMAN)
RYRCEAVTA

SEQ ID NO: 168438 - protein, 10 aa, Artificial Sequence
  Description of Artificial Sequence: Synthetic peptide
  Seed: FYSNSTNSFR (TYRP1_HUMAN)
FPSNSTNSFR

SEQ ID NO: 168439 - protein, 10 aa, Artificial Sequence
  Description of Artificial Sequence: Synthetic peptide
  Seed: LLLVALIFGT (TYRP1_HUMAN)
LQLVALIFGV

SEQ ID NO: 168440 - protein, 10 aa, Artificial Sequence
  Description of Artificial Sequence: Synthetic peptide
  Seed: MVPFWPPVTN (TYRP1_HUMAN)
MFPFWPPVTL

SEQ ID NO: 168441 - protein, 9 aa, Artificial Sequence
  Description of Artificial Sequence: Synthetic peptide
  Seed: SVKKTFLGV (TYRP1_HUMAN)
SSKKTFLGM

SEQ ID NO: 168442 - protein, 9 aa, Artificial Sequence
  Description of Artificial Sequence: Synthetic peptide
  Seed: YLIRARRSM (TYRP1_HUMAN)
YEIRARRSF

SEQ ID NO: 168443 - protein, 9 aa, Artificial Sequence
  Description of Artificial Sequence: Synthetic peptide
  Seed: SFRNTVEGY (TYRP1_HUMAN)
SFRNTVEGM

SEQ ID NO: 168444 - protein, 10 aa, Artificial Sequence
  Description of Artificial Sequence: Synthetic peptide
  Seed: TDAVFDEWLR (TYRP1_HUMAN)
TRAVFDEWLR

SEQ ID NO: 168445 - protein, 8 aa, Artificial Sequence
  Description of Artificial Sequence: Synthetic peptide
  Seed: ACDQRVLI (TYRP1_HUMAN)
AIDQRVLL

SEQ ID NO: 168446 - protein, 9 aa, Artificial Sequence
  Description of Artificial Sequence: Synthetic peptide
  Seed: LFQQARAQF (TYRP1_HUMAN)
LTQQARAQY

SEQ ID NO: 168447 - protein, 9 aa, Artificial Sequence
  Description of Artificial Sequence: Synthetic peptide
  Seed: PAFLTWHRY (TYRP1_HUMAN)
PFFLTWHRY

SEQ ID NO: 168448 - protein, 9 aa, Artificial Sequence
  Description of Artificial Sequence: Synthetic peptide
  Seed: YNYFVWTHY (TYRP1_HUMAN)
YAYFVWTHY

SEQ ID NO: 168449 - protein, 9 aa, Artificial Sequence
  Description of Artificial Sequence: Synthetic peptide
  Seed: LLVALIFGT (TYRP1_HUMAN)
LLVALIFGM

SEQ ID NO: 168450 - protein, 9 aa, Artificial Sequence
  Description of Artificial Sequence: Synthetic peptide
  Seed: SMDEANQPL (TYRP1_HUMAN)
SVDEANQPY

SEQ ID NO: 168451 - protein, 10 aa, Artificial Sequence
  Description of Artificial Sequence: Synthetic peptide
  Seed: MQEMLQEPSF (TYRP1_HUMAN)
MTEMLQEPSW

SEQ ID NO: 168452 - protein, 10 aa, Artificial Sequence
  Description of Artificial Sequence: Synthetic peptide
  Seed: SMDEANQPLL (TYRP1_HUMAN)
SYDEANQPLM

SEQ ID NO: 168453 - protein, 9 aa, Artificial Sequence
  Description of Artificial Sequence: Synthetic peptide
  Seed: LQNPNQSVV (TYRP1_HUMAN)
LRNPNQSVF

SEQ ID NO: 168454 - protein, 9 aa, Artificial Sequence
  Description of Artificial Sequence: Synthetic peptide
  Seed: FSHEGPAFL (TYRP1_HUMAN)
FFHEGPAFF

SEQ ID NO: 168455 - protein, 10 aa, Artificial Sequence
  Description of Artificial Sequence: Synthetic peptide
  Seed: EGPAFLTWHR (TYRP1_HUMAN)
EWPAFLTWHR

SEQ ID NO: 168456 - protein, 10 aa, Artificial Sequence
  Description of Artificial Sequence: Synthetic peptide
  Seed: FQQARAQFPR (TYRP1_HUMAN)
FNQARAQFPR

SEQ ID NO: 168457 - protein, 11 aa, Artificial Sequence
  Description of Artificial Sequence: Synthetic peptide
  Seed: LISPNSVFSQW (TYRP1_HUMAN)
LSSPNSVFSQW

SEQ ID NO: 168458 - protein, 9 aa, Artificial Sequence
  Description of Artificial Sequence: Synthetic peptide
  Seed: FVWTHYYSV (TYRP1_HUMAN)
FSWTHYYSR

SEQ ID NO: 168459 - protein, 9 aa, Artificial Sequence
  Description of Artificial Sequence: Synthetic peptide
  Seed: FSHEGPAFL (TYRP1_HUMAN)
FVHEGPAFH

SEQ ID NO: 168460 - protein, 10 aa, Artificial Sequence
  Description of Artificial Sequence: Synthetic peptide
  Seed: FLTWHRYHLL (TYRP1_HUMAN)
FMTWHRYHLT

SEQ ID NO: 168461 - protein, 11 aa, Artificial Sequence
  Description of Artificial Sequence: Synthetic peptide
  Seed: FPLLLFQQARA (TYRP1_HUMAN)
FILLLFQQARV

SEQ ID NO: 168462 - protein, 10 aa, Artificial Sequence
  Description of Artificial Sequence: Synthetic peptide
  Seed: LSLGCIFFPL (TYRP1_HUMAN)
LQLGCIFFPA

SEQ ID NO: 168463 - protein, 10 aa, Artificial Sequence
  Description of Artificial Sequence: Synthetic peptide
  Seed: YNYFVWTHYY (TYRP1_HUMAN)
YCYFVWTHYM

SEQ ID NO: 168464 - protein, 9 aa, Artificial Sequence
  Description of Artificial Sequence: Synthetic peptide
  Seed: SIYNYFVWT (TYRP1_HUMAN)
SVYNYFVWT

SEQ ID NO: 168465 - protein, 10 aa, Artificial Sequence
  Description of Artificial Sequence: Synthetic peptide
  Seed: RRYNADISTF (TYRP1_HUMAN)
RGYNADISTW

SEQ ID NO: 168466 - protein, 10 aa, Artificial Sequence
  Description of Artificial Sequence: Synthetic peptide
  Seed: YNYFVWTHYY (TYRP1_HUMAN)
YPYFVWTHYY

SEQ ID NO: 168467 - protein, 9 aa, Artificial Sequence
  Description of Artificial Sequence: Synthetic peptide
  Seed: FSHEGPAFL (TYRP1_HUMAN)
FPHEGPAFA

SEQ ID NO: 168468 - protein, 9 aa, Artificial Sequence
  Description of Artificial Sequence: Synthetic peptide
  Seed: MCCPDLSPV (TYRP1_HUMAN)
MICPDLSPT

SEQ ID NO: 168469 - protein, 9 aa, Artificial Sequence
  Description of Artificial Sequence: Synthetic peptide
  Seed: FSHEGPAFL (TYRP1_HUMAN)
FAHEGPAFM

SEQ ID NO: 168470 - protein, 9 aa, Artificial Sequence
  Description of Artificial Sequence: Synthetic peptide
  Seed: SRSNFDSTL (TYRP1_HUMAN)
SHSNFDSTY

SEQ ID NO: 168471 - protein, 10 aa, Artificial Sequence
  Description of Artificial Sequence: Synthetic peptide
  Seed: EIIAIAVVGA (TYRP1_HUMAN)
ETIAIAVVGM

SEQ ID NO: 168472 - protein, 9 aa, Artificial Sequence
  Description of Artificial Sequence: Synthetic peptide
  Seed: VCDICTDDL (TYRP1_HUMAN)
VADICTDDM

SEQ ID NO: 168473 - protein, 9 aa, Artificial Sequence
  Description of Artificial Sequence: Synthetic peptide
  Seed: SRSNFDSTL (TYRP1_HUMAN)
SHSNFDSTI

SEQ ID NO: 168474 - protein, 9 aa, Artificial Sequence
  Description of Artificial Sequence: Synthetic peptide
  Seed: FVWTHYYSV (TYRP1_HUMAN)
FIWTHYYSI

SEQ ID NO: 168475 - protein, 9 aa, Artificial Sequence
  Description of Artificial Sequence: Synthetic peptide
  Seed: LIFGTASYL (TYRP1_HUMAN)
LAFGTASYL

SEQ ID NO: 168476 - protein, 11 aa, Artificial Sequence
  Description of Artificial Sequence: Synthetic peptide
  Seed: RSMDEANQPLL (TYRP1_HUMAN)
RTMDEANQPLW

SEQ ID NO: 168477 - protein, 10 aa, Artificial Sequence
  Description of Artificial Sequence: Synthetic peptide
  Seed: AVVGALLLVA (TYRP1_HUMAN)
ALVGALLLVI

SEQ ID NO: 168478 - protein, 8 aa, Artificial Sequence
  Description of Artificial Sequence: Synthetic peptide
  Seed: TTHPLFVI (TYRP1_HUMAN)
TQHPLFVV

SEQ ID NO: 168479 - protein, 8 aa, Artificial Sequence
  Description of Artificial Sequence: Synthetic peptide
  Seed: YDPAVRSL (TYRP1_HUMAN)
YAPAVRSM

SEQ ID NO: 168480 - protein, 10 aa, Artificial Sequence
  Description of Artificial Sequence: Synthetic peptide
  Seed: RQCATVEALR (TYRP1_HUMAN)
RVCATVEALR

SEQ ID NO: 168481 - protein, 9 aa, Artificial Sequence
  Description of Artificial Sequence: Synthetic peptide
  Seed: YSNSTNSFR (TYRP1_HUMAN)
YANSTNSFM

SEQ ID NO: 168482 - protein, 9 aa, Artificial Sequence
  Description of Artificial Sequence: Synthetic peptide
  Seed: TTHPLFVIA (TYRP1_HUMAN)
TPHPLFVII

SEQ ID NO: 168483 - protein, 9 aa, Artificial Sequence
  Description of Artificial Sequence: Synthetic peptide
  Seed: FTDAVFDEW (TYRP1_HUMAN)
FFDAVFDEY

SEQ ID NO: 168484 - protein, 9 aa, Artificial Sequence
  Description of Artificial Sequence: Synthetic peptide
  Seed: LPYWNFATG (TYRP1_HUMAN)
LMYWNFATF

SEQ ID NO: 168485 - protein, 9 aa, Artificial Sequence
  Description of Artificial Sequence: Synthetic peptide
  Seed: YTYEIQWPS (TYRP1_HUMAN)
YRYEIQWPV

SEQ ID NO: 168486 - protein, 10 aa, Artificial Sequence
  Description of Artificial Sequence: Synthetic peptide
  Seed: SVPEIIAIAV (TYRP1_HUMAN)
STPEIIAIAV

SEQ ID NO: 168487 - protein, 9 aa, Artificial Sequence
  Description of Artificial Sequence: Synthetic peptide
  Seed: VFDEWLRRY (TYRP1_HUMAN)
VQDEWLRRM

SEQ ID NO: 168488 - protein, 9 aa, Artificial Sequence
  Description of Artificial Sequence: Synthetic peptide
  Seed: WPPVTNTEM (TYRP1_HUMAN)
WIPVTNTEL

SEQ ID NO: 168489 - protein, 10 aa, Artificial Sequence
  Description of Artificial Sequence: Synthetic peptide
  Seed: THPLFVIATR (TYRP1_HUMAN)
TVPLFVIATK

SEQ ID NO: 168490 - protein, 10 aa, Artificial Sequence
  Description of Artificial Sequence: Synthetic peptide
  Seed: LSLGCIFFPL (TYRP1_HUMAN)
LSLGCIFFPW

SEQ ID NO: 168491 - protein, 11 aa, Artificial Sequence
  Description of Artificial Sequence: Synthetic peptide
  Seed: KTFLGVGQESF (TYRP1_HUMAN)
KQFLGVGQESW

SEQ ID NO: 168492 - protein, 9 aa, Artificial Sequence
  Description of Artificial Sequence: Synthetic peptide
  Seed: MSAPKLLSL (TYRP1_HUMAN)
MDAPKLLSY

SEQ ID NO: 168493 - protein, 9 aa, Artificial Sequence
  Description of Artificial Sequence: Synthetic peptide
  Seed: QCATVEALR (TYRP1_HUMAN)
QWATVEALR

SEQ ID NO: 168494 - protein, 9 aa, Artificial Sequence
  Description of Artificial Sequence: Synthetic peptide
  Seed: RQCATVEAL (TYRP1_HUMAN)
RMCATVEAM

SEQ ID NO: 168495 - protein, 10 aa, Artificial Sequence
  Description of Artificial Sequence: Synthetic peptide
  Seed: HRYHLLRLEK (TYRP1_HUMAN)
HRYHLLRLEF

SEQ ID NO: 168496 - protein, 9 aa, Artificial Sequence
  Description of Artificial Sequence: Synthetic peptide
  Seed: RQYNMVPFW (TYRP1_HUMAN)
RSYNMVPFW

SEQ ID NO: 168497 - protein, 10 aa, Artificial Sequence
  Description of Artificial Sequence: Synthetic peptide
  Seed: MAKRTTHPLF (TYRP1_HUMAN)
MMKRTTHPLY

SEQ ID NO: 168498 - protein, 10 aa, Artificial Sequence
  Description of Artificial Sequence: Synthetic peptide
  Seed: MAKRTTHPLF (TYRP1_HUMAN)
MMKRTTHPLM

SEQ ID NO: 168499 - protein, 10 aa, Artificial Sequence
  Description of Artificial Sequence: Synthetic peptide
  Seed: ASYLIRARRS (TYRP1_HUMAN)
AAYLIRARRR

SEQ ID NO: 168500 - protein, 9 aa, Artificial Sequence
  Description of Artificial Sequence: Synthetic peptide
  Seed: RARRSMDEA (TYRP1_HUMAN)
RARRSMDEV

SEQ ID NO: 168501 - protein, 9 aa, Artificial Sequence
  Description of Artificial Sequence: Synthetic peptide
  Seed: IAVVGALLL (TYRP1_HUMAN)
IAVVGALLW

SEQ ID NO: 168502 - protein, 10 aa, Artificial Sequence
  Description of Artificial Sequence: Synthetic peptide
  Seed: FWPPVTNTEM (TYRP1_HUMAN)
FLPPVTNTEF

SEQ ID NO: 168503 - protein, 10 aa, Artificial Sequence
  Description of Artificial Sequence: Synthetic peptide
  Seed: SPNSVFSQWR (TYRP1_HUMAN)
SANSVFSQWR

SEQ ID NO: 168504 - protein, 9 aa, Artificial Sequence
  Description of Artificial Sequence: Synthetic peptide
  Seed: MSAPKLLSL (TYRP1_HUMAN)
MLAPKLLSS

SEQ ID NO: 168505 - protein, 10 aa, Artificial Sequence
  Description of Artificial Sequence: Synthetic peptide
  Seed: HFVRALDMAK (TYRP1_HUMAN)
HFVRALDMAR

SEQ ID NO: 168506 - protein, 9 aa, Artificial Sequence
  Description of Artificial Sequence: Synthetic peptide
  Seed: TTHPLFVIA (TYRP1_HUMAN)
TPHPLFVIP

SEQ ID NO: 168507 - protein, 10 aa, Artificial Sequence
  Description of Artificial Sequence: Synthetic peptide
  Seed: MVPFWPPVTN (TYRP1_HUMAN)
MLPFWPPVTF

SEQ ID NO: 168508 - protein, 11 aa, Artificial Sequence
  Description of Artificial Sequence: Synthetic peptide
  Seed: FPLLLFQQARA (TYRP1_HUMAN)
FDLLLFQQARV

SEQ ID NO: 168509 - protein, 10 aa, Artificial Sequence
  Description of Artificial Sequence: Synthetic peptide
  Seed: LLLVALIFGT (TYRP1_HUMAN)
LELVALIFGI

SEQ ID NO: 168510 - protein, 9 aa, Artificial Sequence
  Description of Artificial Sequence: Synthetic peptide
  Seed: VTAPDNLGY (TYRP1_HUMAN)
VLAPDNLGK

SEQ ID NO: 168511 - protein, 11 aa, Artificial Sequence
  Description of Artificial Sequence: Synthetic peptide
  Seed: RSMDEANQPLL (TYRP1_HUMAN)
RSMDEANQPLW

SEQ ID NO: 168512 - protein, 9 aa, Artificial Sequence
  Description of Artificial Sequence: Synthetic peptide
  Seed: KYDPAVRSL (TYRP1_HUMAN)
KDDPAVRSF

SEQ ID NO: 168513 - protein, 9 aa, Artificial Sequence
  Description of Artificial Sequence: Synthetic peptide
  Seed: FSHEGPAFL (TYRP1_HUMAN)
FLHEGPAFT

SEQ ID NO: 168514 - protein, 10 aa, Artificial Sequence
  Description of Artificial Sequence: Synthetic peptide
  Seed: IAIAVVGALL (TYRP1_HUMAN)
ISIAVVGALY

SEQ ID NO: 168515 - protein, 10 aa, Artificial Sequence
  Description of Artificial Sequence: Synthetic peptide
  Seed: LLFQQARAQF (TYRP1_HUMAN)
LYFQQARAQF

SEQ ID NO: 168516 - protein, 9 aa, Artificial Sequence
  Description of Artificial Sequence: Synthetic peptide
  Seed: MCCPDLSPV (TYRP1_HUMAN)
MVCPDLSPL

SEQ ID NO: 168517 - protein, 11 aa, Artificial Sequence
  Description of Artificial Sequence: Synthetic peptide
  Seed: YNMVPFWPPVT (TYRP1_HUMAN)
YQMVPFWPPVK

SEQ ID NO: 168518 - protein, 10 aa, Artificial Sequence
  Description of Artificial Sequence: Synthetic peptide
  Seed: HNRQYNMVPF (TYRP1_HUMAN)
HHRQYNMVPY

SEQ ID NO: 168519 - protein, 10 aa, Artificial Sequence
  Description of Artificial Sequence: Synthetic peptide
  Seed: RSMDEANQPL (TYRP1_HUMAN)
RYMDEANQPF

SEQ ID NO: 168520 - protein, 10 aa, Artificial Sequence
  Description of Artificial Sequence: Synthetic peptide
  Seed: FVTAPDNLGY (TYRP1_HUMAN)
FKTAPDNLGW

SEQ ID NO: 168521 - protein, 9 aa, Artificial Sequence
  Description of Artificial Sequence: Synthetic peptide
  Seed: FVWTHYYSV (TYRP1_HUMAN)
FMWTHYYSL

SEQ ID NO: 168522 - protein, 11 aa, Artificial Sequence
  Description of Artificial Sequence: Synthetic peptide
  Seed: FENISIYNYFV (TYRP1_HUMAN)
FQNISIYNYFV

SEQ ID NO: 168523 - protein, 10 aa, Artificial Sequence
  Description of Artificial Sequence: Synthetic peptide
  Seed: LSLGCIFFPL (TYRP1_HUMAN)
LALGCIFFPL

SEQ ID NO: 168524 - protein, 10 aa, Artificial Sequence
  Description of Artificial Sequence: Synthetic peptide
  Seed: LLHTFTDAVF (TYRP1_HUMAN)
LAHTFTDAVY

SEQ ID NO: 168525 - protein, 9 aa, Artificial Sequence
  Description of Artificial Sequence: Synthetic peptide
  Seed: RYNADISTF (TYRP1_HUMAN)
RVNADISTY

SEQ ID NO: 168526 - protein, 9 aa, Artificial Sequence
  Description of Artificial Sequence: Synthetic peptide
  Seed: TTHPLFVIA (TYRP1_HUMAN)
TVHPLFVIV

SEQ ID NO: 168527 - protein, 11 aa, Artificial Sequence
  Description of Artificial Sequence: Synthetic peptide
  Seed: RLPEPQDVAQC (TYRP1_HUMAN)
RMPEPQDVAQV

SEQ ID NO: 168528 - protein, 9 aa, Artificial Sequence
  Description of Artificial Sequence: Synthetic peptide
  Seed: DSLEDYDTL (TYRP1_HUMAN)
DTLEDYDTV

SEQ ID NO: 168529 - protein, 9 aa, Artificial Sequence
  Description of Artificial Sequence: Synthetic peptide
  Seed: YNYFVWTHY (TYRP1_HUMAN)
YKYFVWTHF

SEQ ID NO: 168530 - protein, 9 aa, Artificial Sequence
  Description of Artificial Sequence: Synthetic peptide
  Seed: SLHNLAHLF (TYRP1_HUMAN)
SIHNLAHLY

SEQ ID NO: 168531 - protein, 11 aa, Artificial Sequence
  Description of Artificial Sequence: Synthetic peptide
  Seed: YNYFVWTHYYS (TYRP1_HUMAN)
YFYFVWTHYYG

SEQ ID NO: 168532 - protein, 9 aa, Artificial Sequence
  Description of Artificial Sequence: Synthetic peptide
  Seed: NFDSTLISP (TYRP1_HUMAN)
NTDSTLISL

SEQ ID NO: 168533 - protein, 9 aa, Artificial Sequence
  Description of Artificial Sequence: Synthetic peptide
  Seed: ALIFGTASY (TYRP1_HUMAN)
ASIFGTASM

SEQ ID NO: 168534 - protein, 9 aa, Artificial Sequence
  Description of Artificial Sequence: Synthetic peptide
  Seed: LTWHRYHLL (TYRP1_HUMAN)
LMWHRYHLW

SEQ ID NO: 168535 - protein, 11 aa, Artificial Sequence
  Description of Artificial Sequence: Synthetic peptide
  Seed: HEGPAFLTWHR (TYRP1_HUMAN)
HSGPAFLTWHR

SEQ ID NO: 168536 - protein, 10 aa, Artificial Sequence
  Description of Artificial Sequence: Synthetic peptide
  Seed: RRYNADISTF (TYRP1_HUMAN)
RVYNADISTW

SEQ ID NO: 168537 - protein, 9 aa, Artificial Sequence
  Description of Artificial Sequence: Synthetic peptide
  Seed: QEPSFSLPY (TYRP1_HUMAN)
QTPSFSLPY

SEQ ID NO: 168538 - protein, 8 aa, Artificial Sequence
  Description of Artificial Sequence: Synthetic peptide
  Seed: YSNSTNSF (TYRP1_HUMAN)
YYNSTNSL

SEQ ID NO: 168539 - protein, 11 aa, Artificial Sequence
  Description of Artificial Sequence: Synthetic peptide
  Seed: RRYNADISTFP (TYRP1_HUMAN)
RWYNADISTFM

SEQ ID NO: 168540 - protein, 9 aa, Artificial Sequence
  Description of Artificial Sequence: Synthetic peptide
  Seed: MSAPKLLSL (TYRP1_HUMAN)
MVAPKLLSR

SEQ ID NO: 168541 - protein, 10 aa, Artificial Sequence
  Description of Artificial Sequence: Synthetic peptide
  Seed: YNADISTFPL (TYRP1_HUMAN)
YIADISTFPY

SEQ ID NO: 168542 - protein, 9 aa, Artificial Sequence
  Description of Artificial Sequence: Synthetic peptide
  Seed: RFFNRTCHC (TYRP1_HUMAN)
RIFNRTCHA

SEQ ID NO: 168543 - protein, 9 aa, Artificial Sequence
  Description of Artificial Sequence: Synthetic peptide
  Seed: LTWHRYHLL (TYRP1_HUMAN)
LTWHRYHLK

SEQ ID NO: 168544 - protein, 10 aa, Artificial Sequence
  Description of Artificial Sequence: Synthetic peptide
  Seed: LSPNDPIFVL (TYRP1_HUMAN)
LMPNDPIFVY

SEQ ID NO: 168545 - protein, 9 aa, Artificial Sequence
  Description of Artificial Sequence: Synthetic peptide
  Seed: SKEEKNHFV (TYRP1_HUMAN)
SYEEKNHFL

SEQ ID NO: 168546 - protein, 11 aa, Artificial Sequence
  Description of Artificial Sequence: Synthetic peptide
  Seed: SLPYWNFATGK (TYRP1_HUMAN)
STPYWNFATGK

SEQ ID NO: 168547 - protein, 10 aa, Artificial Sequence
  Description of Artificial Sequence: Synthetic peptide
  Seed: ADSRPHSPQY (TYRP1_HUMAN)
AVSRPHSPQV

SEQ ID NO: 168548 - protein, 9 aa, Artificial Sequence
  Description of Artificial Sequence: Synthetic peptide
  Seed: VPEIIAIAV (TYRP1_HUMAN)
VPEIIAIAI

SEQ ID NO: 168549 - protein, 9 aa, Artificial Sequence
  Description of Artificial Sequence: Synthetic peptide
  Seed: NYFVWTHYY (TYRP1_HUMAN)
NFFVWTHYI

SEQ ID NO: 168550 - protein, 9 aa, Artificial Sequence
  Description of Artificial Sequence: Synthetic peptide
  Seed: FSVPEIIAI (TYRP1_HUMAN)
FLVPEIIAF

SEQ ID NO: 168551 - protein, 10 aa, Artificial Sequence
  Description of Artificial Sequence: Synthetic peptide
  Seed: FFPLLLFQQA (TYRP1_HUMAN)
FKPLLLFQQA

SEQ ID NO: 168552 - protein, 9 aa, Artificial Sequence
  Description of Artificial Sequence: Synthetic peptide
  Seed: RFFNRTCHC (TYRP1_HUMAN)
RTFNRTCHK

SEQ ID NO: 168553 - protein, 11 aa, Artificial Sequence
  Description of Artificial Sequence: Synthetic peptide
  Seed: LRRYNADISTF (TYRP1_HUMAN)
LMRYNADISTY

SEQ ID NO: 168554 - protein, 10 aa, Artificial Sequence
  Description of Artificial Sequence: Synthetic peptide
  Seed: RRYNADISTF (TYRP1_HUMAN)
RFYNADISTY

SEQ ID NO: 168555 - protein, 9 aa, Artificial Sequence
  Description of Artificial Sequence: Synthetic peptide
  Seed: LLSLGCIFF (TYRP1_HUMAN)
LVSLGCIFY

SEQ ID NO: 168556 - protein, 9 aa, Artificial Sequence
  Description of Artificial Sequence: Synthetic peptide
  Seed: VARPMVQRL (TYRP1_HUMAN)
VGRPMVQRW

SEQ ID NO: 168557 - protein, 10 aa, Artificial Sequence
  Description of Artificial Sequence: Synthetic peptide
  Seed: RYNADISTFP (TYRP1_HUMAN)
RFNADISTFF

SEQ ID NO: 168558 - protein, 10 aa, Artificial Sequence
  Description of Artificial Sequence: Synthetic peptide
  Seed: LTWHRYHLLR (TYRP1_HUMAN)
LLWHRYHLLR

SEQ ID NO: 168559 - protein, 9 aa, Artificial Sequence
  Description of Artificial Sequence: Synthetic peptide
  Seed: FSVPEIIAI (TYRP1_HUMAN)
FTVPEIIAI

SEQ ID NO: 168560 - protein, 9 aa, Artificial Sequence
  Description of Artificial Sequence: Synthetic peptide
  Seed: MAKRTTHPL (TYRP1_HUMAN)
MIKRTTHPF

SEQ ID NO: 168561 - protein, 10 aa, Artificial Sequence
  Description of Artificial Sequence: Synthetic peptide
  Seed: FVLLHTFTDA (TYRP1_HUMAN)
FYLLHTFTDI

SEQ ID NO: 168562 - protein, 10 aa, Artificial Sequence
  Description of Artificial Sequence: Synthetic peptide
  Seed: IIAIAVVGAL (TYRP1_HUMAN)
IMAIAVVGAA

SEQ ID NO: 168563 - protein, 10 aa, Artificial Sequence
  Description of Artificial Sequence: Synthetic peptide
  Seed: PFYSNSTNSF (TYRP1_HUMAN)
PRYSNSTNSF

SEQ ID NO: 168564 - protein, 11 aa, Artificial Sequence
  Description of Artificial Sequence: Synthetic peptide
  Seed: FLNGTGGQTHL (TYRP1_HUMAN)
FQNGTGGQTHF

SEQ ID NO: 168565 - protein, 9 aa, Artificial Sequence
  Description of Artificial Sequence: Synthetic peptide
  Seed: LGCIFFPLL (TYRP1_HUMAN)
LSCIFFPLF

SEQ ID NO: 168566 - protein, 10 aa, Artificial Sequence
  Description of Artificial Sequence: Synthetic peptide
  Seed: SVPEIIAIAV (TYRP1_HUMAN)
SMPEIIAIAA

SEQ ID NO: 168567 - protein, 9 aa, Artificial Sequence
  Description of Artificial Sequence: Synthetic peptide
  Seed: FSHEGPAFL (TYRP1_HUMAN)
FLHEGPAFS

SEQ ID NO: 168568 - protein, 9 aa, Artificial Sequence
  Description of Artificial Sequence: Synthetic peptide
  Seed: LTDQYQCYA (TYRP1_HUMAN)
LADQYQCYM

SEQ ID NO: 168569 - protein, 9 aa, Artificial Sequence
  Description of Artificial Sequence: Synthetic peptide
  Seed: RSLHNLAHL (TYRP1_HUMAN)
RHLHNLAHY

SEQ ID NO: 168570 - protein, 9 aa, Artificial Sequence
  Description of Artificial Sequence: Synthetic peptide
  Seed: GPDGNTPQF (TYRP1_HUMAN)
GNDGNTPQM

SEQ ID NO: 168571 - protein, 9 aa, Artificial Sequence
  Description of Artificial Sequence: Synthetic peptide
  Seed: LSKEEKNHF (TYRP1_HUMAN)
LPKEEKNHF

SEQ ID NO: 168572 - protein, 9 aa, Artificial Sequence
  Description of Artificial Sequence: Synthetic peptide
  Seed: NMVPFWPPV (TYRP1_HUMAN)
NIVPFWPPR

SEQ ID NO: 168573 - protein, 10 aa, Artificial Sequence
  Description of Artificial Sequence: Synthetic peptide
  Seed: FWPPVTNTEM (TYRP1_HUMAN)
FCPPVTNTEL

SEQ ID NO: 168574 - protein, 11 aa, Artificial Sequence
  Description of Artificial Sequence: Synthetic peptide
  Seed: REFSVPEIIAI (TYRP1_HUMAN)
RQFSVPEIIAL

SEQ ID NO: 168575 - protein, 9 aa, Artificial Sequence
  Description of Artificial Sequence: Synthetic peptide
  Seed: MLQEPSFSL (TYRP1_HUMAN)
MNQEPSFSW

SEQ ID NO: 168576 - protein, 9 aa, Artificial Sequence
  Description of Artificial Sequence: Synthetic peptide
  Seed: VARPMVQRL (TYRP1_HUMAN)
VRRPMVQRL

SEQ ID NO: 168577 - protein, 9 aa, Artificial Sequence
  Description of Artificial Sequence: Synthetic peptide
  Seed: LIFGTASYL (TYRP1_HUMAN)
LFFGTASYV

SEQ ID NO: 168578 - protein, 9 aa, Artificial Sequence
  Description of Artificial Sequence: Synthetic peptide
  Seed: RYHLLRLEK (TYRP1_HUMAN)
RVHLLRLEL

SEQ ID NO: 168579 - protein, 9 aa, Artificial Sequence
  Description of Artificial Sequence: Synthetic peptide
  Seed: EEYEKLQNP (TYRP1_HUMAN)
EEYEKLQNA

SEQ ID NO: 168580 - protein, 9 aa, Artificial Sequence
  Description of Artificial Sequence: Synthetic peptide
  Seed: VGLFDTPPF (TYRP1_HUMAN)
VQLFDTPPL

SEQ ID NO: 168581 - protein, 10 aa, Artificial Sequence
  Description of Artificial Sequence: Synthetic peptide
  Seed: YNYFVWTHYY (TYRP1_HUMAN)
YNYFVWTHYK

SEQ ID NO: 168582 - protein, 10 aa, Artificial Sequence
  Description of Artificial Sequence: Synthetic peptide
  Seed: HPLFVIATRR (TYRP1_HUMAN)
HTLFVIATRP

SEQ ID NO: 168583 - protein, 9 aa, Artificial Sequence
  Description of Artificial Sequence: Synthetic peptide
  Seed: ISIYNYFVW (TYRP1_HUMAN)
IFIYNYFVL

SEQ ID NO: 168584 - protein, 9 aa, Artificial Sequence
  Description of Artificial Sequence: Synthetic peptide
  Seed: FTDAVFDEW (TYRP1_HUMAN)
FMDAVFDEL

SEQ ID NO: 168585 - protein, 9 aa, Artificial Sequence
  Description of Artificial Sequence: Synthetic peptide
  Seed: HYYSVKKTF (TYRP1_HUMAN)
HYYSVKKTM

SEQ ID NO: 168586 - protein, 9 aa, Artificial Sequence
  Description of Artificial Sequence: Synthetic peptide
  Seed: SMDEANQPL (TYRP1_HUMAN)
SHDEANQPM

SEQ ID NO: 168587 - protein, 10 aa, Artificial Sequence
  Description of Artificial Sequence: Synthetic peptide
  Seed: RSMDEANQPL (TYRP1_HUMAN)
REMDEANQPF

SEQ ID NO: 168588 - protein, 10 aa, Artificial Sequence
  Description of Artificial Sequence: Synthetic peptide
  Seed: HRYHLLRLEK (TYRP1_HUMAN)
HRYHLLRLEI

SEQ ID NO: 168589 - protein, 8 aa, Artificial Sequence
  Description of Artificial Sequence: Synthetic peptide
  Seed: FSHEGPAF (TYRP1_HUMAN)
FGHEGPAF

SEQ ID NO: 168590 - protein, 8 aa, Artificial Sequence
  Description of Artificial Sequence: Synthetic peptide
  Seed: FSHEGPAF (TYRP1_HUMAN)
FSHEGPAL

SEQ ID NO: 168591 - protein, 10 aa, Artificial Sequence
  Description of Artificial Sequence: Synthetic peptide
  Seed: EIIAIAVVGA (TYRP1_HUMAN)
EAIAIAVVGI

SEQ ID NO: 168592 - protein, 11 aa, Artificial Sequence
  Description of Artificial Sequence: Synthetic peptide
  Seed: IYNYFVWTHYY (TYRP1_HUMAN)
IMNYFVWTHYF

SEQ ID NO: 168593 - protein, 9 aa, Artificial Sequence
  Description of Artificial Sequence: Synthetic peptide
  Seed: RVLIVRRNL (TYRP1_HUMAN)
RTLIVRRNV

SEQ ID NO: 168594 - protein, 8 aa, Artificial Sequence
  Description of Artificial Sequence: Synthetic peptide
  Seed: FSHEGPAF (TYRP1_HUMAN)
FIHEGPAY

SEQ ID NO: 168595 - protein, 10 aa, Artificial Sequence
  Description of Artificial Sequence: Synthetic peptide
  Seed: TAPDNLGYTY (TYRP1_HUMAN)
TQPDNLGYTY

SEQ ID NO: 168596 - protein, 10 aa, Artificial Sequence
  Description of Artificial Sequence: Synthetic peptide
  Seed: SPNSVFSQWR (TYRP1_HUMAN)
SFNSVFSQWR

SEQ ID NO: 168597 - protein, 9 aa, Artificial Sequence
  Description of Artificial Sequence: Synthetic peptide
  Seed: VARPMVQRL (TYRP1_HUMAN)
VTRPMVQRF

SEQ ID NO: 168598 - protein, 10 aa, Artificial Sequence
  Description of Artificial Sequence: Synthetic peptide
  Seed: SVPEIIAIAV (TYRP1_HUMAN)
SVPEIIAIAL

SEQ ID NO: 168599 - protein, 9 aa, Artificial Sequence
  Description of Artificial Sequence: Synthetic peptide
  Seed: YLIRARRSM (TYRP1_HUMAN)
YVIRARRSY

SEQ ID NO: 168600 - protein, 9 aa, Artificial Sequence
  Description of Artificial Sequence: Synthetic peptide
  Seed: RYHLLRLEK (TYRP1_HUMAN)
RAHLLRLEA

SEQ ID NO: 168601 - protein, 8 aa, Artificial Sequence
  Description of Artificial Sequence: Synthetic peptide
  Seed: YNADISTF (TYRP1_HUMAN)
YAADISTF

SEQ ID NO: 168602 - protein, 9 aa, Artificial Sequence
  Description of Artificial Sequence: Synthetic peptide
  Seed: APDNLGYTY (TYRP1_HUMAN)
AFDNLGYTL

SEQ ID NO: 168603 - protein, 9 aa, Artificial Sequence
  Description of Artificial Sequence: Synthetic peptide
  Seed: VARPMVQRL (TYRP1_HUMAN)
VPRPMVQRI

SEQ ID NO: 168604 - protein, 9 aa, Artificial Sequence
  Description of Artificial Sequence: Synthetic peptide
  Seed: SVPEIIAIA (TYRP1_HUMAN)
SMPEIIAIT

SEQ ID NO: 168605 - protein, 10 aa, Artificial Sequence
  Description of Artificial Sequence: Synthetic peptide
  Seed: FWPPVTNTEM (TYRP1_HUMAN)
FYPPVTNTEI

SEQ ID NO: 168606 - protein, 9 aa, Artificial Sequence
  Description of Artificial Sequence: Synthetic peptide
  Seed: RGAACDQRV (TYRP1_HUMAN)
RQAACDQRL

SEQ ID NO: 168607 - protein, 9 aa, Artificial Sequence
  Description of Artificial Sequence: Synthetic peptide
  Seed: KYDPAVRSL (TYRP1_HUMAN)
KNDPAVRSW

SEQ ID NO: 168608 - protein, 9 aa, Artificial Sequence
  Description of Artificial Sequence: Synthetic peptide
  Seed: MLQEPSFSL (TYRP1_HUMAN)
MKQEPSFSM

SEQ ID NO: 168609 - protein, 8 aa, Artificial Sequence
  Description of Artificial Sequence: Synthetic peptide
  Seed: YSNSTNSF (TYRP1_HUMAN)
YYNSTNSY

SEQ ID NO: 168610 - protein, 11 aa, Artificial Sequence
  Description of Artificial Sequence: Synthetic peptide
  Seed: REFSVPEIIAI (TYRP1_HUMAN)
RQFSVPEIIAW

SEQ ID NO: 168611 - protein, 10 aa, Artificial Sequence
  Description of Artificial Sequence: Synthetic peptide
  Seed: DQYQCYAEEY (TYRP1_HUMAN)
DEYQCYAEEY

SEQ ID NO: 168612 - protein, 9 aa, Artificial Sequence
  Description of Artificial Sequence: Synthetic peptide
  Seed: APKLLSLGC (TYRP1_HUMAN)
APKLLSLGA

SEQ ID NO: 168613 - protein, 10 aa, Artificial Sequence
  Description of Artificial Sequence: Synthetic peptide
  Seed: HRYHLLRLEK (TYRP1_HUMAN)
HQYHLLRLER

SEQ ID NO: 168614 - protein, 9 aa, Artificial Sequence
  Description of Artificial Sequence: Synthetic peptide
  Seed: LHTFTDAVF (TYRP1_HUMAN)
LKTFTDAVY

SEQ ID NO: 168615 - protein, 8 aa, Artificial Sequence
  Description of Artificial Sequence: Synthetic peptide
  Seed: YSDPTGKY (TYRP1_HUMAN)
YLDPTGKL

SEQ ID NO: 168616 - protein, 9 aa, Artificial Sequence
  Description of Artificial Sequence: Synthetic peptide
  Seed: FSLPYWNFA (TYRP1_HUMAN)
FLLPYWNFV

SEQ ID NO: 168617 - protein, 9 aa, Artificial Sequence
  Description of Artificial Sequence: Synthetic peptide
  Seed: NVARPMVQR (TYRP1_HUMAN)
NSARPMVQR

SEQ ID NO: 168618 - protein, 10 aa, Artificial Sequence
  Description of Artificial Sequence: Synthetic peptide
  Seed: AVFDEWLRRY (TYRP1_HUMAN)
AAFDEWLRRY

SEQ ID NO: 168619 - protein, 9 aa, Artificial Sequence
  Description of Artificial Sequence: Synthetic peptide
  Seed: QQARAQFPR (TYRP1_HUMAN)
QNARAQFPR

SEQ ID NO: 168620 - protein, 10 aa, Artificial Sequence
  Description of Artificial Sequence: Synthetic peptide
  Seed: ADSRPHSPQY (TYRP1_HUMAN)
AMSRPHSPQK

SEQ ID NO: 168621 - protein, 9 aa, Artificial Sequence
  Description of Artificial Sequence: Synthetic peptide
  Seed: MAKRTTHPL (TYRP1_HUMAN)
MTKRTTHPM

SEQ ID NO: 168622 - protein, 10 aa, Artificial Sequence
  Description of Artificial Sequence: Synthetic peptide
  Seed: EVWPLRFFNR (TYRP1_HUMAN)
ETWPLRFFNK

SEQ ID NO: 168623 - protein, 10 aa, Artificial Sequence
  Description of Artificial Sequence: Synthetic peptide
  Seed: FWPPVTNTEM (TYRP1_HUMAN)
FMPPVTNTEV

SEQ ID NO: 168624 - protein, 9 aa, Artificial Sequence
  Description of Artificial Sequence: Synthetic peptide
  Seed: YTYEIQWPS (TYRP1_HUMAN)
YIYEIQWPA

SEQ ID NO: 168625 - protein, 11 aa, Artificial Sequence
  Description of Artificial Sequence: Synthetic peptide
  Seed: RSMDEANQPLL (TYRP1_HUMAN)
RVMDEANQPLF

SEQ ID NO: 168626 - protein, 9 aa, Artificial Sequence
  Description of Artificial Sequence: Synthetic peptide
  Seed: FLTWHRYHL (TYRP1_HUMAN)
FVTWHRYHF

SEQ ID NO: 168627 - protein, 9 aa, Artificial Sequence
  Description of Artificial Sequence: Synthetic peptide
  Seed: LIFGTASYL (TYRP1_HUMAN)
LTFGTASYM

SEQ ID NO: 168628 - protein, 10 aa, Artificial Sequence
  Description of Artificial Sequence: Synthetic peptide
  Seed: YFVWTHYYSV (TYRP1_HUMAN)
YWVWTHYYSW

SEQ ID NO: 168629 - protein, 10 aa, Artificial Sequence
  Description of Artificial Sequence: Synthetic peptide
  Seed: HPLFVIATRR (TYRP1_HUMAN)
HRLFVIATRR

SEQ ID NO: 168630 - protein, 9 aa, Artificial Sequence
  Description of Artificial Sequence: Synthetic peptide
  Seed: RYHLLRLEK (TYRP1_HUMAN)
RWHLLRLEK

SEQ ID NO: 168631 - protein, 9 aa, Artificial Sequence
  Description of Artificial Sequence: Synthetic peptide
  Seed: IAIAVVGAL (TYRP1_HUMAN)
IRIAVVGAY

SEQ ID NO: 168632 - protein, 10 aa, Artificial Sequence
  Description of Artificial Sequence: Synthetic peptide
  Seed: RRYNADISTF (TYRP1_HUMAN)
RRYNADISTM

SEQ ID NO: 168633 - protein, 10 aa, Artificial Sequence
  Description of Artificial Sequence: Synthetic peptide
  Seed: FPRQCATVEA (TYRP1_HUMAN)
FPRQCATVEF

SEQ ID NO: 168634 - protein, 9 aa, Artificial Sequence
  Description of Artificial Sequence: Synthetic peptide
  Seed: MLQEPSFSL (TYRP1_HUMAN)
MSQEPSFSL

SEQ ID NO: 168635 - protein, 10 aa, Artificial Sequence
  Description of Artificial Sequence: Synthetic peptide
  Seed: TPQFENISIY (TYRP1_HUMAN)
THQFENISIY

SEQ ID NO: 168636 - protein, 10 aa, Artificial Sequence
  Description of Artificial Sequence: Synthetic peptide
  Seed: MQEMLQEPSF (TYRP1_HUMAN)
MQEMLQEPSY

SEQ ID NO: 168637 - protein, 10 aa, Artificial Sequence
  Description of Artificial Sequence: Synthetic peptide
  Seed: LSLGCIFFPL (TYRP1_HUMAN)
LILGCIFFPI

SEQ ID NO: 168638 - protein, 10 aa, Artificial Sequence
  Description of Artificial Sequence: Synthetic peptide
  Seed: QCYAEEYEKL (TYRP1_HUMAN)
QLYAEEYEKF

SEQ ID NO: 168639 - protein, 10 aa, Artificial Sequence
  Description of Artificial Sequence: Synthetic peptide
  Seed: FWPPVTNTEM (TYRP1_HUMAN)
FTPPVTNTEM

SEQ ID NO: 168640 - protein, 10 aa, Artificial Sequence
  Description of Artificial Sequence: Synthetic peptide
  Seed: YNYFVWTHYY (TYRP1_HUMAN)
YCYFVWTHYL

SEQ ID NO: 168641 - protein, 9 aa, Artificial Sequence
  Description of Artificial Sequence: Synthetic peptide
  Seed: AQFPRQCAT (TYRP1_HUMAN)
AHFPRQCAM

SEQ ID NO: 168642 - protein, 9 aa, Artificial Sequence
  Description of Artificial Sequence: Synthetic peptide
  Seed: IYNYFVWTH (TYRP1_HUMAN)
ITNYFVWTK

SEQ ID NO: 168643 - protein, 9 aa, Artificial Sequence
  Description of Artificial Sequence: Synthetic peptide
  Seed: ARAQFPRQC (TYRP1_HUMAN)
AYAQFPRQF

SEQ ID NO: 168644 - protein, 11 aa, Artificial Sequence
  Description of Artificial Sequence: Synthetic peptide
  Seed: KTFLGVGQESF (TYRP1_HUMAN)
KQFLGVGQESM

SEQ ID NO: 168645 - protein, 8 aa, Artificial Sequence
  Description of Artificial Sequence: Synthetic peptide
  Seed: SAPKLLSL (TYRP1_HUMAN)
SSPKLLSL

SEQ ID NO: 168646 - protein, 9 aa, Artificial Sequence
  Description of Artificial Sequence: Synthetic peptide
  Seed: ENAPIGHNR (TYRP1_HUMAN)
ETAPIGHNY

SEQ ID NO: 168647 - protein, 10 aa, Artificial Sequence
  Description of Artificial Sequence: Synthetic peptide
  Seed: TAPDNLGYTY (TYRP1_HUMAN)
TLPDNLGYTL

SEQ ID NO: 168648 - protein, 10 aa, Artificial Sequence
  Description of Artificial Sequence: Synthetic peptide
  Seed: AQFPRQCATV (TYRP1_HUMAN)
AQFPRQCATY

SEQ ID NO: 168649 - protein, 9 aa, Artificial Sequence
  Description of Artificial Sequence: Synthetic peptide
  Seed: EEKNHFVRA (TYRP1_HUMAN)
EEKNHFVRV

SEQ ID NO: 168650 - protein, 9 aa, Artificial Sequence
  Description of Artificial Sequence: Synthetic peptide
  Seed: TFPLENAPI (TYRP1_HUMAN)
TYPLENAPY

SEQ ID NO: 168651 - protein, 10 aa, Artificial Sequence
  Description of Artificial Sequence: Synthetic peptide
  Seed: KLLSLGCIFF (TYRP1_HUMAN)
KMLSLGCIFV

SEQ ID NO: 168652 - protein, 9 aa, Artificial Sequence
  Description of Artificial Sequence: Synthetic peptide
  Seed: SGRGRCEAV (TYRP1_HUMAN)
SARGRCEAL

SEQ ID NO: 168653 - protein, 11 aa, Artificial Sequence
  Description of Artificial Sequence: Synthetic peptide
  Seed: YNYFVWTHYYS (TYRP1_HUMAN)
YIYFVWTHYYY

SEQ ID NO: 168654 - protein, 11 aa, Artificial Sequence
  Description of Artificial Sequence: Synthetic peptide
  Seed: MFVTAPDNLGY (TYRP1_HUMAN)
MAVTAPDNLGW

SEQ ID NO: 168655 - protein, 9 aa, Artificial Sequence
  Description of Artificial Sequence: Synthetic peptide
  Seed: QCATVEALR (TYRP1_HUMAN)
QTATVEALK

SEQ ID NO: 168656 - protein, 10 aa, Artificial Sequence
  Description of Artificial Sequence: Synthetic peptide
  Seed: DAVFDEWLRR (TYRP1_HUMAN)
DNVFDEWLRR

SEQ ID NO: 168657 - protein, 11 aa, Artificial Sequence
  Description of Artificial Sequence: Synthetic peptide
  Seed: QEMLQEPSFSL (TYRP1_HUMAN)
QEMLQEPSFSY

SEQ ID NO: 168658 - protein, 9 aa, Artificial Sequence
  Description of Artificial Sequence: Synthetic peptide
  Seed: CIFFPLLLF (TYRP1_HUMAN)
CHFFPLLLY

SEQ ID NO: 168659 - protein, 10 aa, Artificial Sequence
  Description of Artificial Sequence: Synthetic peptide
  Seed: FSVPEIIAIA (TYRP1_HUMAN)
FYVPEIIAIV

SEQ ID NO: 168660 - protein, 10 aa, Artificial Sequence
  Description of Artificial Sequence: Synthetic peptide
  Seed: LPYWNFATGK (TYRP1_HUMAN)
LMYWNFATGK

SEQ ID NO: 168661 - protein, 9 aa, Artificial Sequence
  Description of Artificial Sequence: Synthetic peptide
  Seed: IAVVGALLL (TYRP1_HUMAN)
ITVVGALLI

SEQ ID NO: 168662 - protein, 9 aa, Artificial Sequence
  Description of Artificial Sequence: Synthetic peptide
  Seed: MLQEPSFSL (TYRP1_HUMAN)
MQQEPSFSL

SEQ ID NO: 168663 - protein, 10 aa, Artificial Sequence
  Description of Artificial Sequence: Synthetic peptide
  Seed: YNYFVWTHYY (TYRP1_HUMAN)
YQYFVWTHYR

SEQ ID NO: 168664 - protein, 9 aa, Artificial Sequence
  Description of Artificial Sequence: Synthetic peptide
  Seed: RSNFDSTLI (TYRP1_HUMAN)
RQNFDSTLV

SEQ ID NO: 168665 - protein, 9 aa, Artificial Sequence
  Description of Artificial Sequence: Synthetic peptide
  Seed: NYFVWTHYY (TYRP1_HUMAN)
NQFVWTHYY

SEQ ID NO: 168666 - protein, 11 aa, Artificial Sequence
  Description of Artificial Sequence: Synthetic peptide
  Seed: EVWPLRFFNRT (TYRP1_HUMAN)
EYWPLRFFNRR

SEQ ID NO: 168667 - protein, 11 aa, Artificial Sequence
  Description of Artificial Sequence: Synthetic peptide
  Seed: MLQEPSFSLPY (TYRP1_HUMAN)
MLQEPSFSLPA

SEQ ID NO: 168668 - protein, 10 aa, Artificial Sequence
  Description of Artificial Sequence: Synthetic peptide
  Seed: THYYSVKKTF (TYRP1_HUMAN)
TGYYSVKKTF

SEQ ID NO: 168669 - protein, 10 aa, Artificial Sequence
  Description of Artificial Sequence: Synthetic peptide
  Seed: RTTHPLFVIA (TYRP1_HUMAN)
RVTHPLFVIA

SEQ ID NO: 168670 - protein, 10 aa, Artificial Sequence
  Description of Artificial Sequence: Synthetic peptide
  Seed: TAPDNLGYTY (TYRP1_HUMAN)
TVPDNLGYTM

SEQ ID NO: 168671 - protein, 9 aa, Artificial Sequence
  Description of Artificial Sequence: Synthetic peptide
  Seed: ISIYNYFVW (TYRP1_HUMAN)
IKIYNYFVM

SEQ ID NO: 168672 - protein, 9 aa, Artificial Sequence
  Description of Artificial Sequence: Synthetic peptide
  Seed: MDEANQPLL (TYRP1_HUMAN)
MVEANQPLL

SEQ ID NO: 168673 - protein, 10 aa, Artificial Sequence
  Description of Artificial Sequence: Synthetic peptide
  Seed: ADSRPHSPQY (TYRP1_HUMAN)
ADSRPHSPQV

SEQ ID NO: 168674 - protein, 10 aa, Artificial Sequence
  Description of Artificial Sequence: Synthetic peptide
  Seed: MAKRTTHPLF (TYRP1_HUMAN)
MVKRTTHPLW

SEQ ID NO: 168675 - protein, 10 aa, Artificial Sequence
  Description of Artificial Sequence: Synthetic peptide
  Seed: THYYSVKKTF (TYRP1_HUMAN)
TDYYSVKKTF

SEQ ID NO: 168676 - protein, 8 aa, Artificial Sequence
  Description of Artificial Sequence: Synthetic peptide
  Seed: LEKDMQEM (TYRP1_HUMAN)
LEKDMQEY

SEQ ID NO: 168677 - protein, 10 aa, Artificial Sequence
  Description of Artificial Sequence: Synthetic peptide
  Seed: FVTAPDNLGY (TYRP1_HUMAN)
FDTAPDNLGF

SEQ ID NO: 168678 - protein, 9 aa, Artificial Sequence
  Description of Artificial Sequence: Synthetic peptide
  Seed: SLHNLAHLF (TYRP1_HUMAN)
SVHNLAHLR

SEQ ID NO: 168679 - protein, 9 aa, Artificial Sequence
  Description of Artificial Sequence: Synthetic peptide
  Seed: AQFPRQCAT (TYRP1_HUMAN)
AEFPRQCAY

SEQ ID NO: 168680 - protein, 9 aa, Artificial Sequence
  Description of Artificial Sequence: Synthetic peptide
  Seed: RARRSMDEA (TYRP1_HUMAN)
RIRRSMDEM

SEQ ID NO: 168681 - protein, 9 aa, Artificial Sequence
  Description of Artificial Sequence: Synthetic peptide
  Seed: FLTWHRYHL (TYRP1_HUMAN)
FVTWHRYHI

SEQ ID NO: 168682 - protein, 9 aa, Artificial Sequence
  Description of Artificial Sequence: Synthetic peptide
  Seed: MAKRTTHPL (TYRP1_HUMAN)
MVKRTTHPG

SEQ ID NO: 168683 - protein, 11 aa, Artificial Sequence
  Description of Artificial Sequence: Synthetic peptide
  Seed: RRYNADISTFP (TYRP1_HUMAN)
RWYNADISTFL

SEQ ID NO: 168684 - protein, 10 aa, Artificial Sequence
  Description of Artificial Sequence: Synthetic peptide
  Seed: IAIAVVGALL (TYRP1_HUMAN)
IMIAVVGALL

SEQ ID NO: 168685 - protein, 9 aa, Artificial Sequence
  Description of Artificial Sequence: Synthetic peptide
  Seed: FVWTHYYSV (TYRP1_HUMAN)
FPWTHYYST

SEQ ID NO: 168686 - protein, 8 aa, Artificial Sequence
  Description of Artificial Sequence: Synthetic peptide
  Seed: YDPAVRSL (TYRP1_HUMAN)
YSPAVRSY

SEQ ID NO: 168687 - protein, 9 aa, Artificial Sequence
  Description of Artificial Sequence: Synthetic peptide
  Seed: VTAPDNLGY (TYRP1_HUMAN)
VAAPDNLGL

SEQ ID NO: 168688 - protein, 10 aa, Artificial Sequence
  Description of Artificial Sequence: Synthetic peptide
  Seed: EGYSDPTGKY (TYRP1_HUMAN)
ESYSDPTGKY

SEQ ID NO: 168689 - protein, 9 aa, Artificial Sequence
  Description of Artificial Sequence: Synthetic peptide
  Seed: FTDAVFDEW (TYRP1_HUMAN)
FSDAVFDEI

SEQ ID NO: 168690 - protein, 11 aa, Artificial Sequence
  Description of Artificial Sequence: Synthetic peptide
  Seed: YSDPTGKYDPA (TYRP1_HUMAN)
YSDPTGKYDPI

SEQ ID NO: 168691 - protein, 10 aa, Artificial Sequence
  Description of Artificial Sequence: Synthetic peptide
  Seed: LSLGCIFFPL (TYRP1_HUMAN)
LCLGCIFFPI

SEQ ID NO: 168692 - protein, 10 aa, Artificial Sequence
  Description of Artificial Sequence: Synthetic peptide
  Seed: FSVPEIIAIA (TYRP1_HUMAN)
FMVPEIIAIL

SEQ ID NO: 168693 - protein, 9 aa, Artificial Sequence
  Description of Artificial Sequence: Synthetic peptide
  Seed: AVFDEWLRR (TYRP1_HUMAN)
ATFDEWLRY

SEQ ID NO: 168694 - protein, 11 aa, Artificial Sequence
  Description of Artificial Sequence: Synthetic peptide
  Seed: YNMVPFWPPVT (TYRP1_HUMAN)
YQMVPFWPPVE

SEQ ID NO: 168695 - protein, 9 aa, Artificial Sequence
  Description of Artificial Sequence: Synthetic peptide
  Seed: HLSPNDPIF (TYRP1_HUMAN)
HMSPNDPIF

SEQ ID NO: 168696 - protein, 10 aa, Artificial Sequence
  Description of Artificial Sequence: Synthetic peptide
  Seed: TPQFENISIY (TYRP1_HUMAN)
TQQFENISIM

SEQ ID NO: 168697 - protein, 9 aa, Artificial Sequence
  Description of Artificial Sequence: Synthetic peptide
  Seed: RLEKDMQEM (TYRP1_HUMAN)
RMEKDMQEW

SEQ ID NO: 168698 - protein, 9 aa, Artificial Sequence
  Description of Artificial Sequence: Synthetic peptide
  Seed: SVKKTFLGV (TYRP1_HUMAN)
SSKKTFLGS

SEQ ID NO: 168699 - protein, 9 aa, Artificial Sequence
  Description of Artificial Sequence: Synthetic peptide
  Seed: YTYEIQWPS (TYRP1_HUMAN)
YSYEIQWPY

SEQ ID NO: 168700 - protein, 9 aa, Artificial Sequence
  Description of Artificial Sequence: Synthetic peptide
  Seed: HEGPAFLTW (TYRP1_HUMAN)
HDGPAFLTM

SEQ ID NO: 168701 - protein, 10 aa, Artificial Sequence
  Description of Artificial Sequence: Synthetic peptide
  Seed: YNMVPFWPPV (TYRP1_HUMAN)
YIMVPFWPPI

SEQ ID NO: 168702 - protein, 9 aa, Artificial Sequence
  Description of Artificial Sequence: Synthetic peptide
  Seed: GTASYLIRA (TYRP1_HUMAN)
GVASYLIRI

SEQ ID NO: 168703 - protein, 9 aa, Artificial Sequence
  Description of Artificial Sequence: Synthetic peptide
  Seed: RQYNMVPFW (TYRP1_HUMAN)
RRYNMVPFM

SEQ ID NO: 168704 - protein, 9 aa, Artificial Sequence
  Description of Artificial Sequence: Synthetic peptide
  Seed: TAPDNLGYT (TYRP1_HUMAN)
TFPDNLGYM

SEQ ID NO: 168705 - protein, 10 aa, Artificial Sequence
  Description of Artificial Sequence: Synthetic peptide
  Seed: FVTAPDNLGY (TYRP1_HUMAN)
FDTAPDNLGW

SEQ ID NO: 168706 - protein, 9 aa, Artificial Sequence
  Description of Artificial Sequence: Synthetic peptide
  Seed: MAKRTTHPL (TYRP1_HUMAN)
MFKRTTHPI

SEQ ID NO: 168707 - protein, 9 aa, Artificial Sequence
  Description of Artificial Sequence: Synthetic peptide
  Seed: GLFDTPPFY (TYRP1_HUMAN)
GVFDTPPFR

SEQ ID NO: 168708 - protein, 9 aa, Artificial Sequence
  Description of Artificial Sequence: Synthetic peptide
  Seed: HLSPNDPIF (TYRP1_HUMAN)
HVSPNDPIY

SEQ ID NO: 168709 - protein, 10 aa, Artificial Sequence
  Description of Artificial Sequence: Synthetic peptide
  Seed: LQEPSFSLPY (TYRP1_HUMAN)
LWEPSFSLPY

SEQ ID NO: 168710 - protein, 10 aa, Artificial Sequence
  Description of Artificial Sequence: Synthetic peptide
  Seed: MAKRTTHPLF (TYRP1_HUMAN)
MQKRTTHPLF

SEQ ID NO: 168711 - protein, 9 aa, Artificial Sequence
  Description of Artificial Sequence: Synthetic peptide
  Seed: RQYNMVPFW (TYRP1_HUMAN)
RHYNMVPFF

SEQ ID NO: 168712 - protein, 9 aa, Artificial Sequence
  Description of Artificial Sequence: Synthetic peptide
  Seed: YNYFVWTHY (TYRP1_HUMAN)
YGYFVWTHF

SEQ ID NO: 168713 - protein, 9 aa, Artificial Sequence
  Description of Artificial Sequence: Synthetic peptide
  Seed: SPNSVFSQW (TYRP1_HUMAN)
SMNSVFSQY

SEQ ID NO: 168714 - protein, 11 aa, Artificial Sequence
  Description of Artificial Sequence: Synthetic peptide
  Seed: RRYNADISTFP (TYRP1_HUMAN)
RYYNADISTFS

SEQ ID NO: 168715 - protein, 9 aa, Artificial Sequence
  Description of Artificial Sequence: Synthetic peptide
  Seed: FLGVGQESF (TYRP1_HUMAN)
FMGVGQESI

SEQ ID NO: 168716 - protein, 9 aa, Artificial Sequence
  Description of Artificial Sequence: Synthetic peptide
  Seed: TLISPNSVF (TYRP1_HUMAN)
TKISPNSVF

SEQ ID NO: 168717 - protein, 10 aa, Artificial Sequence
  Description of Artificial Sequence: Synthetic peptide
  Seed: LSPNDPIFVL (TYRP1_HUMAN)
LRPNDPIFVY

SEQ ID NO: 168718 - protein, 9 aa, Artificial Sequence
  Description of Artificial Sequence: Synthetic peptide
  Seed: TEMFVTAPD (TYRP1_HUMAN)
TEMFVTAPW

SEQ ID NO: 168719 - protein, 9 aa, Artificial Sequence
  Description of Artificial Sequence: Synthetic peptide
  Seed: NADISTFPL (TYRP1_HUMAN)
NVDISTFPV

SEQ ID NO: 168720 - protein, 10 aa, Artificial Sequence
  Description of Artificial Sequence: Synthetic peptide
  Seed: RSMDEANQPL (TYRP1_HUMAN)
RNMDEANQPF

SEQ ID NO: 168721 - protein, 10 aa, Artificial Sequence
  Description of Artificial Sequence: Synthetic peptide
  Seed: EMLQEPSFSL (TYRP1_HUMAN)
ECLQEPSFSV

SEQ ID NO: 168722 - protein, 11 aa, Artificial Sequence
  Description of Artificial Sequence: Synthetic peptide
  Seed: MFVTAPDNLGY (TYRP1_HUMAN)
MTVTAPDNLGY

SEQ ID NO: 168723 - protein, 9 aa, Artificial Sequence
  Description of Artificial Sequence: Synthetic peptide
  Seed: FVWTHYYSV (TYRP1_HUMAN)
FMWTHYYSG

SEQ ID NO: 168724 - protein, 10 aa, Artificial Sequence
  Description of Artificial Sequence: Synthetic peptide
  Seed: LSLGCIFFPL (TYRP1_HUMAN)
LNLGCIFFPI

SEQ ID NO: 168725 - protein, 9 aa, Artificial Sequence
  Description of Artificial Sequence: Synthetic peptide
  Seed: ENAPIGHNR (TYRP1_HUMAN)
EGAPIGHNK

SEQ ID NO: 168726 - protein, 10 aa, Artificial Sequence
  Description of Artificial Sequence: Synthetic peptide
  Seed: YNMVPFWPPV (TYRP1_HUMAN)
YYMVPFWPPL

SEQ ID NO: 168727 - protein, 9 aa, Artificial Sequence
  Description of Artificial Sequence: Synthetic peptide
  Seed: AKRTTHPLF (TYRP1_HUMAN)
AERTTHPLY

SEQ ID NO: 168728 - protein, 9 aa, Artificial Sequence
  Description of Artificial Sequence: Synthetic peptide
  Seed: RQYNMVPFW (TYRP1_HUMAN)
RTYNMVPFI

SEQ ID NO: 168729 - protein, 10 aa, Artificial Sequence
  Description of Artificial Sequence: Synthetic peptide
  Seed: YNADISTFPL (TYRP1_HUMAN)
YQADISTFPV

SEQ ID NO: 168730 - protein, 11 aa, Artificial Sequence
  Description of Artificial Sequence: Synthetic peptide
  Seed: MLQEPSFSLPY (TYRP1_HUMAN)
MQQEPSFSLPM

SEQ ID NO: 168731 - protein, 9 aa, Artificial Sequence
  Description of Artificial Sequence: Synthetic peptide
  Seed: NYFVWTHYY (TYRP1_HUMAN)
NMFVWTHYY

SEQ ID NO: 168732 - protein, 11 aa, Artificial Sequence
  Description of Artificial Sequence: Synthetic peptide
  Seed: YTYEIQWPSRE (TYRP1_HUMAN)
YIYEIQWPSRR

SEQ ID NO: 168733 - protein, 8 aa, Artificial Sequence
  Description of Artificial Sequence: Synthetic peptide
  Seed: YYSVKKTF (TYRP1_HUMAN)
YFSVKKTM

SEQ ID NO: 168734 - protein, 9 aa, Artificial Sequence
  Description of Artificial Sequence: Synthetic peptide
  Seed: LQNPNQSVV (TYRP1_HUMAN)
LMNPNQSVV

SEQ ID NO: 168735 - protein, 9 aa, Artificial Sequence
  Description of Artificial Sequence: Synthetic peptide
  Seed: RQCATVEAL (TYRP1_HUMAN)
RMCATVEAA

SEQ ID NO: 168736 - protein, 9 aa, Artificial Sequence
  Description of Artificial Sequence: Synthetic peptide
  Seed: RGRCEAVTA (TYRP1_HUMAN)
RVRCEAVTR

SEQ ID NO: 168737 - protein, 9 aa, Artificial Sequence
  Description of Artificial Sequence: Synthetic peptide
  Seed: YLIRARRSM (TYRP1_HUMAN)
YAIRARRSM

SEQ ID NO: 168738 - protein, 10 aa, Artificial Sequence
  Description of Artificial Sequence: Synthetic peptide
  Seed: ENISIYNYFV (TYRP1_HUMAN)
EMISIYNYFI

SEQ ID NO: 168739 - protein, 9 aa, Artificial Sequence
  Description of Artificial Sequence: Synthetic peptide
  Seed: YTYEIQWPS (TYRP1_HUMAN)
YMYEIQWPE

SEQ ID NO: 168740 - protein, 10 aa, Artificial Sequence
  Description of Artificial Sequence: Synthetic peptide
  Seed: RSMDEANQPL (TYRP1_HUMAN)
RIMDEANQPM

SEQ ID NO: 168741 - protein, 9 aa, Artificial Sequence
  Description of Artificial Sequence: Synthetic peptide
  Seed: EDYDTLGTL (TYRP1_HUMAN)
EEYDTLGTL

SEQ ID NO: 168742 - protein, 9 aa, Artificial Sequence
  Description of Artificial Sequence: Synthetic peptide
  Seed: SPNDPIFVL (TYRP1_HUMAN)
STNDPIFVI

SEQ ID NO: 168743 - protein, 9 aa, Artificial Sequence
  Description of Artificial Sequence: Synthetic peptide
  Seed: VFDEWLRRY (TYRP1_HUMAN)
VSDEWLRRM

SEQ ID NO: 168744 - protein, 9 aa, Artificial Sequence
  Description of Artificial Sequence: Synthetic peptide
  Seed: ISIYNYFVW (TYRP1_HUMAN)
IWIYNYFVI

SEQ ID NO: 168745 - protein, 10 aa, Artificial Sequence
  Description of Artificial Sequence: Synthetic peptide
  Seed: RTTHPLFVIA (TYRP1_HUMAN)
RHTHPLFVIK

SEQ ID NO: 168746 - protein, 9 aa, Artificial Sequence
  Description of Artificial Sequence: Synthetic peptide
  Seed: FSHEGPAFL (TYRP1_HUMAN)
FFHEGPAFI

SEQ ID NO: 168747 - protein, 11 aa, Artificial Sequence
  Description of Artificial Sequence: Synthetic peptide
  Seed: FWPPVTNTEMF (TYRP1_HUMAN)
FSPPVTNTEMY

SEQ ID NO: 168748 - protein, 9 aa, Artificial Sequence
  Description of Artificial Sequence: Synthetic peptide
  Seed: RRNLLDLSK (TYRP1_HUMAN)
RRNLLDLSI

SEQ ID NO: 168749 - protein, 9 aa, Artificial Sequence
  Description of Artificial Sequence: Synthetic peptide
  Seed: SMDEANQPL (TYRP1_HUMAN)
SSDEANQPY

SEQ ID NO: 168750 - protein, 10 aa, Artificial Sequence
  Description of Artificial Sequence: Synthetic peptide
  Seed: MVPFWPPVTN (TYRP1_HUMAN)
MYPFWPPVTY

SEQ ID NO: 168751 - protein, 9 aa, Artificial Sequence
  Description of Artificial Sequence: Synthetic peptide
  Seed: RQCATVEAL (TYRP1_HUMAN)
RVCATVEAV

SEQ ID NO: 168752 - protein, 10 aa, Artificial Sequence
  Description of Artificial Sequence: Synthetic peptide
  Seed: SMDEANQPLL (TYRP1_HUMAN)
SMDEANQPLW

SEQ ID NO: 168753 - protein, 10 aa, Artificial Sequence
  Description of Artificial Sequence: Synthetic peptide
  Seed: NLLDLSKEEK (TYRP1_HUMAN)
NTLDLSKEEK

SEQ ID NO: 168754 - protein, 9 aa, Artificial Sequence
  Description of Artificial Sequence: Synthetic peptide
  Seed: ISIYNYFVW (TYRP1_HUMAN)
IRIYNYFVM

SEQ ID NO: 168755 - protein, 9 aa, Artificial Sequence
  Description of Artificial Sequence: Synthetic peptide
  Seed: GPIRRNPAG (TYRP1_HUMAN)
GPIRRNPAA

SEQ ID NO: 168756 - protein, 9 aa, Artificial Sequence
  Description of Artificial Sequence: Synthetic peptide
  Seed: FTDAVFDEW (TYRP1_HUMAN)
FSDAVFDEV

SEQ ID NO: 168757 - protein, 10 aa, Artificial Sequence
  Description of Artificial Sequence: Synthetic peptide
  Seed: LQEPSFSLPY (TYRP1_HUMAN)
LKEPSFSLPM

SEQ ID NO: 168758 - protein, 9 aa, Artificial Sequence
  Description of Artificial Sequence: Synthetic peptide
  Seed: TFPLENAPI (TYRP1_HUMAN)
TTPLENAPM

SEQ ID NO: 168759 - protein, 9 aa, Artificial Sequence
  Description of Artificial Sequence: Synthetic peptide
  Seed: YLIRARRSM (TYRP1_HUMAN)
YIIRARRSL

SEQ ID NO: 168760 - protein, 9 aa, Artificial Sequence
  Description of Artificial Sequence: Synthetic peptide
  Seed: ENAPIGHNR (TYRP1_HUMAN)
EAAPIGHNL

SEQ ID NO: 168761 - protein, 9 aa, Artificial Sequence
  Description of Artificial Sequence: Synthetic peptide
  Seed: RSLHNLAHL (TYRP1_HUMAN)
RLLHNLAHL

SEQ ID NO: 168762 - protein, 9 aa, Artificial Sequence
  Description of Artificial Sequence: Synthetic peptide
  Seed: VTAPDNLGY (TYRP1_HUMAN)
VSAPDNLGK

SEQ ID NO: 168763 - protein, 10 aa, Artificial Sequence
  Description of Artificial Sequence: Synthetic peptide
  Seed: MAKRTTHPLF (TYRP1_HUMAN)
MPKRTTHPLR

SEQ ID NO: 168764 - protein, 9 aa, Artificial Sequence
  Description of Artificial Sequence: Synthetic peptide
  Seed: LFDTPPFYS (TYRP1_HUMAN)
LFDTPPFYL

SEQ ID NO: 168765 - protein, 9 aa, Artificial Sequence
  Description of Artificial Sequence: Synthetic peptide
  Seed: YTYEIQWPS (TYRP1_HUMAN)
YKYEIQWPL

SEQ ID NO: 168766 - protein, 11 aa, Artificial Sequence
  Description of Artificial Sequence: Synthetic peptide
  Seed: HLSPNDPIFVL (TYRP1_HUMAN)
HYSPNDPIFVF

SEQ ID NO: 168767 - protein, 9 aa, Artificial Sequence
  Description of Artificial Sequence: Synthetic peptide
  Seed: RYNADISTF (TYRP1_HUMAN)
RYNADISTW

SEQ ID NO: 168768 - protein, 9 aa, Artificial Sequence
  Description of Artificial Sequence: Synthetic peptide
  Seed: STNSFRNTV (TYRP1_HUMAN)
SQNSFRNTI

SEQ ID NO: 168769 - protein, 9 aa, Artificial Sequence
  Description of Artificial Sequence: Synthetic peptide
  Seed: DYDTLGTLC (TYRP1_HUMAN)
DYDTLGTLL

SEQ ID NO: 168770 - protein, 11 aa, Artificial Sequence
  Description of Artificial Sequence: Synthetic peptide
  Seed: SLGCIFFPLLL (TYRP1_HUMAN)
SMGCIFFPLLI

SEQ ID NO: 168771 - protein, 9 aa, Artificial Sequence
  Description of Artificial Sequence: Synthetic peptide
  Seed: HEGPAFLTW (TYRP1_HUMAN)
HSGPAFLTL

SEQ ID NO: 168772 - protein, 9 aa, Artificial Sequence
  Description of Artificial Sequence: Synthetic peptide
  Seed: GPDGNTPQF (TYRP1_HUMAN)
GVDGNTPQI

SEQ ID NO: 168773 - protein, 9 aa, Artificial Sequence
  Description of Artificial Sequence: Synthetic peptide
  Seed: LHTFTDAVF (TYRP1_HUMAN)
LITFTDAVF

SEQ ID NO: 168774 - protein, 9 aa, Artificial Sequence
  Description of Artificial Sequence: Synthetic peptide
  Seed: PNDPIFVLL (TYRP1_HUMAN)
PADPIFVLM

SEQ ID NO: 168775 - protein, 10 aa, Artificial Sequence
  Description of Artificial Sequence: Synthetic peptide
  Seed: NSFRNTVEGY (TYRP1_HUMAN)
NQFRNTVEGY

SEQ ID NO: 168776 - protein, 11 aa, Artificial Sequence
  Description of Artificial Sequence: Synthetic peptide
  Seed: ILGPDGNTPQF (TYRP1_HUMAN)
IGGPDGNTPQW

SEQ ID NO: 168777 - protein, 10 aa, Artificial Sequence
  Description of Artificial Sequence: Synthetic peptide
  Seed: LTWHRYHLLR (TYRP1_HUMAN)
LRWHRYHLLR

SEQ ID NO: 168778 - protein, 10 aa, Artificial Sequence
  Description of Artificial Sequence: Synthetic peptide
  Seed: RTTHPLFVIA (TYRP1_HUMAN)
RETHPLFVIA

SEQ ID NO: 168779 - protein, 9 aa, Artificial Sequence
  Description of Artificial Sequence: Synthetic peptide
  Seed: SVPEIIAIA (TYRP1_HUMAN)
SMPEIIAII

SEQ ID NO: 168780 - protein, 9 aa, Artificial Sequence
  Description of Artificial Sequence: Synthetic peptide
  Seed: DAVFDEWLR (TYRP1_HUMAN)
DIVFDEWLK

SEQ ID NO: 168781 - protein, 9 aa, Artificial Sequence
  Description of Artificial Sequence: Synthetic peptide
  Seed: RLEKDMQEM (TYRP1_HUMAN)
RLEKDMQEY

SEQ ID NO: 168782 - protein, 11 aa, Artificial Sequence
  Description of Artificial Sequence: Synthetic peptide
  Seed: RLPEPQDVAQC (TYRP1_HUMAN)
RMPEPQDVAQW

SEQ ID NO: 168783 - protein, 10 aa, Artificial Sequence
  Description of Artificial Sequence: Synthetic peptide
  Seed: ALIFGTASYL (TYRP1_HUMAN)
AMIFGTASYM

SEQ ID NO: 168784 - protein, 9 aa, Artificial Sequence
  Description of Artificial Sequence: Synthetic peptide
  Seed: HEGPAFLTW (TYRP1_HUMAN)
HVGPAFLTL

SEQ ID NO: 168785 - protein, 10 aa, Artificial Sequence
  Description of Artificial Sequence: Synthetic peptide
  Seed: FVWTHYYSVK (TYRP1_HUMAN)
FSWTHYYSVR

SEQ ID NO: 168786 - protein, 9 aa, Artificial Sequence
  Description of Artificial Sequence: Synthetic peptide
  Seed: FSVPEIIAI (TYRP1_HUMAN)
FMVPEIIAY

SEQ ID NO: 168787 - protein, 9 aa, Artificial Sequence
  Description of Artificial Sequence: Synthetic peptide
  Seed: ASYLIRARR (TYRP1_HUMAN)
ALYLIRARK

SEQ ID NO: 168788 - protein, 9 aa, Artificial Sequence
  Description of Artificial Sequence: Synthetic peptide
  Seed: DYDTLGTLC (TYRP1_HUMAN)
DWDTLGTLF

SEQ ID NO: 168789 - protein, 9 aa, Artificial Sequence
  Description of Artificial Sequence: Synthetic peptide
  Seed: FSVPEIIAI (TYRP1_HUMAN)
FIVPEIIAF

SEQ ID NO: 168790 - protein, 10 aa, Artificial Sequence
  Description of Artificial Sequence: Synthetic peptide
  Seed: RVLIVRRNLL (TYRP1_HUMAN)
RILIVRRNLK

SEQ ID NO: 168791 - protein, 9 aa, Artificial Sequence
  Description of Artificial Sequence: Synthetic peptide
  Seed: YSNSTNSFR (TYRP1_HUMAN)
YSNSTNSFY

SEQ ID NO: 168792 - protein, 8 aa, Artificial Sequence
  Description of Artificial Sequence: Synthetic peptide
  Seed: RQYNMVPF (TYRP1_HUMAN)
RAYNMVPF

SEQ ID NO: 168793 - protein, 9 aa, Artificial Sequence
  Description of Artificial Sequence: Synthetic peptide
  Seed: ENAPIGHNR (TYRP1_HUMAN)
EQAPIGHNR

SEQ ID NO: 168794 - protein, 10 aa, Artificial Sequence
  Description of Artificial Sequence: Synthetic peptide
  Seed: SMDEANQPLL (TYRP1_HUMAN)
SFDEANQPLI

SEQ ID NO: 168795 - protein, 9 aa, Artificial Sequence
  Description of Artificial Sequence: Synthetic peptide
  Seed: FPRQCATVE (TYRP1_HUMAN)
FPRQCATVW

SEQ ID NO: 168796 - protein, 9 aa, Artificial Sequence
  Description of Artificial Sequence: Synthetic peptide
  Seed: LSKEEKNHF (TYRP1_HUMAN)
LVKEEKNHF

SEQ ID NO: 168797 - protein, 10 aa, Artificial Sequence
  Description of Artificial Sequence: Synthetic peptide
  Seed: FWPPVTNTEM (TYRP1_HUMAN)
FIPPVTNTEF

SEQ ID NO: 168798 - protein, 11 aa, Artificial Sequence
  Description of Artificial Sequence: Synthetic peptide
  Seed: THLSPNDPIFV (TYRP1_HUMAN)
THLSPNDPIFF

SEQ ID NO: 168799 - protein, 11 aa, Artificial Sequence
  Description of Artificial Sequence: Synthetic peptide
  Seed: FWPPVTNTEMF (TYRP1_HUMAN)
FNPPVTNTEMY

SEQ ID NO: 168800 - protein, 9 aa, Artificial Sequence
  Description of Artificial Sequence: Synthetic peptide
  Seed: LTDQYQCYA (TYRP1_HUMAN)
LSDQYQCYM

SEQ ID NO: 168801 - protein, 9 aa, Artificial Sequence
  Description of Artificial Sequence: Synthetic peptide
  Seed: MLQEPSFSL (TYRP1_HUMAN)
MIQEPSFSA

SEQ ID NO: 168802 - protein, 10 aa, Artificial Sequence
  Description of Artificial Sequence: Synthetic peptide
  Seed: EIIAIAVVGA (TYRP1_HUMAN)
ETIAIAVVGL

SEQ ID NO: 168803 - protein, 9 aa, Artificial Sequence
  Description of Artificial Sequence: Synthetic peptide
  Seed: MAKRTTHPL (TYRP1_HUMAN)
MVKRTTHPY

SEQ ID NO: 168804 - protein, 11 aa, Artificial Sequence
  Description of Artificial Sequence: Synthetic peptide
  Seed: YQCYAEEYEKL (TYRP1_HUMAN)
YMCYAEEYEKF

SEQ ID NO: 168805 - protein, 10 aa, Artificial Sequence
  Description of Artificial Sequence: Synthetic peptide
  Seed: AQFPRQCATV (TYRP1_HUMAN)
AIFPRQCATY

SEQ ID NO: 168806 - protein, 9 aa, Artificial Sequence
  Description of Artificial Sequence: Synthetic peptide
  Seed: IAIAVVGAL (TYRP1_HUMAN)
ITIAVVGAV

SEQ ID NO: 168807 - protein, 10 aa, Artificial Sequence
  Description of Artificial Sequence: Synthetic peptide
  Seed: RSMDEANQPL (TYRP1_HUMAN)
RQMDEANQPI

SEQ ID NO: 168808 - protein, 10 aa, Artificial Sequence
  Description of Artificial Sequence: Synthetic peptide
  Seed: HRYHLLRLEK (TYRP1_HUMAN)
HYYHLLRLER

SEQ ID NO: 168809 - protein, 9 aa, Artificial Sequence
  Description of Artificial Sequence: Synthetic peptide
  Seed: TASYLIRAR (TYRP1_HUMAN)
TVSYLIRAK

SEQ ID NO: 168810 - protein, 8 aa, Artificial Sequence
  Description of Artificial Sequence: Synthetic peptide
  Seed: YSDPTGKY (TYRP1_HUMAN)
YTDPTGKV

SEQ ID NO: 168811 - protein, 9 aa, Artificial Sequence
  Description of Artificial Sequence: Synthetic peptide
  Seed: LIFGTASYL (TYRP1_HUMAN)
LKFGTASYM

SEQ ID NO: 168812 - protein, 10 aa, Artificial Sequence
  Description of Artificial Sequence: Synthetic peptide
  Seed: RTTHPLFVIA (TYRP1_HUMAN)
RPTHPLFVIK

SEQ ID NO: 168813 - protein, 10 aa, Artificial Sequence
  Description of Artificial Sequence: Synthetic peptide
  Seed: AVRSLHNLAH (TYRP1_HUMAN)
ATRSLHNLAI

SEQ ID NO: 168814 - protein, 9 aa, Artificial Sequence
  Description of Artificial Sequence: Synthetic peptide
  Seed: AQCLEVGLF (TYRP1_HUMAN)
AMCLEVGLY

SEQ ID NO: 168815 - protein, 10 aa, Artificial Sequence
  Description of Artificial Sequence: Synthetic peptide
  Seed: FLTWHRYHLL (TYRP1_HUMAN)
FITWHRYHLI

SEQ ID NO: 168816 - protein, 9 aa, Artificial Sequence
  Description of Artificial Sequence: Synthetic peptide
  Seed: GEVDFSHEG (TYRP1_HUMAN)
GEVDFSHEM

SEQ ID NO: 168817 - protein, 9 aa, Artificial Sequence
  Description of Artificial Sequence: Synthetic peptide
  Seed: RGRCEAVTA (TYRP1_HUMAN)
RTRCEAVTS

SEQ ID NO: 168818 - protein, 9 aa, Artificial Sequence
  Description of Artificial Sequence: Synthetic peptide
  Seed: SVKKTFLGV (TYRP1_HUMAN)
SSKKTFLGV

SEQ ID NO: 168819 - protein, 9 aa, Artificial Sequence
  Description of Artificial Sequence: Synthetic peptide
  Seed: KYDPAVRSL (TYRP1_HUMAN)
KTDPAVRSM

SEQ ID NO: 168820 - protein, 9 aa, Artificial Sequence
  Description of Artificial Sequence: Synthetic peptide
  Seed: YTYEIQWPS (TYRP1_HUMAN)
YTYEIQWPL

SEQ ID NO: 168821 - protein, 10 aa, Artificial Sequence
  Description of Artificial Sequence: Synthetic peptide
  Seed: RYNADISTFP (TYRP1_HUMAN)
RYNADISTFY

SEQ ID NO: 168822 - protein, 10 aa, Artificial Sequence
  Description of Artificial Sequence: Synthetic peptide
  Seed: FVWTHYYSVK (TYRP1_HUMAN)
FIWTHYYSVH

SEQ ID NO: 168823 - protein, 9 aa, Artificial Sequence
  Description of Artificial Sequence: Synthetic peptide
  Seed: FVWTHYYSV (TYRP1_HUMAN)
FVWTHYYSL

SEQ ID NO: 168824 - protein, 10 aa, Artificial Sequence
  Description of Artificial Sequence: Synthetic peptide
  Seed: YNMVPFWPPV (TYRP1_HUMAN)
YPMVPFWPPI

SEQ ID NO: 168825 - protein, 9 aa, Artificial Sequence
  Description of Artificial Sequence: Synthetic peptide
  Seed: HEGPAFLTW (TYRP1_HUMAN)
HPGPAFLTW

SEQ ID NO: 168826 - protein, 9 aa, Artificial Sequence
  Description of Artificial Sequence: Synthetic peptide
  Seed: RTTHPLFVI (TYRP1_HUMAN)
RATHPLFVY

SEQ ID NO: 168827 - protein, 10 aa, Artificial Sequence
  Description of Artificial Sequence: Synthetic peptide
  Seed: NTVEGYSDPT (TYRP1_HUMAN)
NSVEGYSDPV

SEQ ID NO: 168828 - protein, 10 aa, Artificial Sequence
  Description of Artificial Sequence: Synthetic peptide
  Seed: TPQFENISIY (TYRP1_HUMAN)
TWQFENISIM

SEQ ID NO: 168829 - protein, 10 aa, Artificial Sequence
  Description of Artificial Sequence: Synthetic peptide
  Seed: YNMVPFWPPV (TYRP1_HUMAN)
YNMVPFWPPA

SEQ ID NO: 168830 - protein, 10 aa, Artificial Sequence
  Description of Artificial Sequence: Synthetic peptide
  Seed: FGTASYLIRA (TYRP1_HUMAN)
FMTASYLIRL

SEQ ID NO: 168831 - protein, 9 aa, Artificial Sequence
  Description of Artificial Sequence: Synthetic peptide
  Seed: AIAVVGALL (TYRP1_HUMAN)
ATAVVGALF

SEQ ID NO: 168832 - protein, 9 aa, Artificial Sequence
  Description of Artificial Sequence: Synthetic peptide
  Seed: RGRCEAVTA (TYRP1_HUMAN)
RIRCEAVTM

SEQ ID NO: 168833 - protein, 9 aa, Artificial Sequence
  Description of Artificial Sequence: Synthetic peptide
  Seed: TLISPNSVF (TYRP1_HUMAN)
TLISPNSVL

SEQ ID NO: 168834 - protein, 9 aa, Artificial Sequence
  Description of Artificial Sequence: Synthetic peptide
  Seed: ALLLVALIF (TYRP1_HUMAN)
AKLLVALIY

SEQ ID NO: 168835 - protein, 11 aa, Artificial Sequence
  Description of Artificial Sequence: Synthetic peptide
  Seed: REFSVPEIIAI (TYRP1_HUMAN)
RLFSVPEIIAL

SEQ ID NO: 168836 - protein, 9 aa, Artificial Sequence
  Description of Artificial Sequence: Synthetic peptide
  Seed: HEGPAFLTW (TYRP1_HUMAN)
HVGPAFLTW

SEQ ID NO: 168837 - protein, 9 aa, Artificial Sequence
  Description of Artificial Sequence: Synthetic peptide
  Seed: MSAPKLLSL (TYRP1_HUMAN)
MLAPKLLSR

SEQ ID NO: 168838 - protein, 8 aa, Artificial Sequence
  Description of Artificial Sequence: Synthetic peptide
  Seed: FSHEGPAF (TYRP1_HUMAN)
FQHEGPAY

SEQ ID NO: 168839 - protein, 9 aa, Artificial Sequence
  Description of Artificial Sequence: Synthetic peptide
  Seed: VCDICTDDL (TYRP1_HUMAN)
VVDICTDDL

SEQ ID NO: 168840 - protein, 9 aa, Artificial Sequence
  Description of Artificial Sequence: Synthetic peptide
  Seed: IFGTASYLI (TYRP1_HUMAN)
IYGTASYLM

SEQ ID NO: 168841 - protein, 9 aa, Artificial Sequence
  Description of Artificial Sequence: Synthetic peptide
  Seed: IYNYFVWTH (TYRP1_HUMAN)
INNYFVWTR

SEQ ID NO: 168842 - protein, 9 aa, Artificial Sequence
  Description of Artificial Sequence: Synthetic peptide
  Seed: SLHNLAHLF (TYRP1_HUMAN)
SLHNLAHLV

SEQ ID NO: 168843 - protein, 9 aa, Artificial Sequence
  Description of Artificial Sequence: Synthetic peptide
  Seed: HEGPAFLTW (TYRP1_HUMAN)
HPGPAFLTY

SEQ ID NO: 168844 - protein, 9 aa, Artificial Sequence
  Description of Artificial Sequence: Synthetic peptide
  Seed: GTASYLIRA (TYRP1_HUMAN)
GIASYLIRV

SEQ ID NO: 168845 - protein, 8 aa, Artificial Sequence
  Description of Artificial Sequence: Synthetic peptide
  Seed: YYSVKKTF (TYRP1_HUMAN)
YASVKKTY

SEQ ID NO: 168846 - protein, 10 aa, Artificial Sequence
  Description of Artificial Sequence: Synthetic peptide
  Seed: ALIFGTASYL (TYRP1_HUMAN)
ATIFGTASYY

SEQ ID NO: 168847 - protein, 9 aa, Artificial Sequence
  Description of Artificial Sequence: Synthetic peptide
  Seed: LLDLSKEEK (TYRP1_HUMAN)
LVDLSKEEY

SEQ ID NO: 168848 - protein, 11 aa, Artificial Sequence
  Description of Artificial Sequence: Synthetic peptide
  Seed: YSDPTGKYDPA (TYRP1_HUMAN)
YVDPTGKYDPL

SEQ ID NO: 168849 - protein, 9 aa, Artificial Sequence
  Description of Artificial Sequence: Synthetic peptide
  Seed: NMVPFWPPV (TYRP1_HUMAN)
NVVPFWPPI

SEQ ID NO: 168850 - protein, 10 aa, Artificial Sequence
  Description of Artificial Sequence: Synthetic peptide
  Seed: RTTHPLFVIA (TYRP1_HUMAN)
RFTHPLFVIK

SEQ ID NO: 168851 - protein, 9 aa, Artificial Sequence
  Description of Artificial Sequence: Synthetic peptide
  Seed: FSLPYWNFA (TYRP1_HUMAN)
FSLPYWNFM

SEQ ID NO: 168852 - protein, 9 aa, Artificial Sequence
  Description of Artificial Sequence: Synthetic peptide
  Seed: RLEKDMQEM (TYRP1_HUMAN)
RLEKDMQEW

SEQ ID NO: 168853 - protein, 9 aa, Artificial Sequence
  Description of Artificial Sequence: Synthetic peptide
  Seed: LFQQARAQF (TYRP1_HUMAN)
LMQQARAQY

SEQ ID NO: 168854 - protein, 10 aa, Artificial Sequence
  Description of Artificial Sequence: Synthetic peptide
  Seed: SPNSVFSQWR (TYRP1_HUMAN)
SYNSVFSQWR

SEQ ID NO: 168855 - protein, 9 aa, Artificial Sequence
  Description of Artificial Sequence: Synthetic peptide
  Seed: RFFNRTCHC (TYRP1_HUMAN)
RFFNRTCHY

SEQ ID NO: 168856 - protein, 9 aa, Artificial Sequence
  Description of Artificial Sequence: Synthetic peptide
  Seed: YTYEIQWPS (TYRP1_HUMAN)
YTYEIQWPY

SEQ ID NO: 168857 - protein, 11 aa, Artificial Sequence
  Description of Artificial Sequence: Synthetic peptide
  Seed: EVWPLRFFNRT (TYRP1_HUMAN)
EVWPLRFFNRR

SEQ ID NO: 168858 - protein, 11 aa, Artificial Sequence
  Description of Artificial Sequence: Synthetic peptide
  Seed: HLSPNDPIFVL (TYRP1_HUMAN)
HLSPNDPIFVF

SEQ ID NO: 168859 - protein, 9 aa, Artificial Sequence
  Description of Artificial Sequence: Synthetic peptide
  Seed: NMVPFWPPV (TYRP1_HUMAN)
NMVPFWPPF

SEQ ID NO: 168860 - protein, 9 aa, Artificial Sequence
  Description of Artificial Sequence: Synthetic peptide
  Seed: SRSNFDSTL (TYRP1_HUMAN)
SYSNFDSTY

SEQ ID NO: 168861 - protein, 8 aa, Artificial Sequence
  Description of Artificial Sequence: Synthetic peptide
  Seed: LIFGTASY (TYRP1_HUMAN)
LKFGTASM

SEQ ID NO: 168862 - protein, 8 aa, Artificial Sequence
  Description of Artificial Sequence: Synthetic peptide
  Seed: YSDPTGKY (TYRP1_HUMAN)
YCDPTGKV

SEQ ID NO: 168863 - protein, 8 aa, Artificial Sequence
  Description of Artificial Sequence: Synthetic peptide
  Seed: RQYNMVPF (TYRP1_HUMAN)
REYNMVPF

SEQ ID NO: 168864 - protein, 10 aa, Artificial Sequence
  Description of Artificial Sequence: Synthetic peptide
  Seed: ALIFGTASYL (TYRP1_HUMAN)
AYIFGTASYY

SEQ ID NO: 168865 - protein, 9 aa, Artificial Sequence
  Description of Artificial Sequence: Synthetic peptide
  Seed: SMDEANQPL (TYRP1_HUMAN)
SGDEANQPI

SEQ ID NO: 168866 - protein, 10 aa, Artificial Sequence
  Description of Artificial Sequence: Synthetic peptide
  Seed: FVTAPDNLGY (TYRP1_HUMAN)
FVTAPDNLGW

SEQ ID NO: 168867 - protein, 10 aa, Artificial Sequence
  Description of Artificial Sequence: Synthetic peptide
  Seed: FSLPYWNFAT (TYRP1_HUMAN)
FLLPYWNFAC

SEQ ID NO: 168868 - protein, 10 aa, Artificial Sequence
  Description of Artificial Sequence: Synthetic peptide
  Seed: RRYNADISTF (TYRP1_HUMAN)
REYNADISTY

SEQ ID NO: 168869 - protein, 9 aa, Artificial Sequence
  Description of Artificial Sequence: Synthetic peptide
  Seed: REFSVPEII (TYRP1_HUMAN)
RDFSVPEIV

SEQ ID NO: 168870 - protein, 10 aa, Artificial Sequence
  Description of Artificial Sequence: Synthetic peptide
  Seed: HPLFVIATRR (TYRP1_HUMAN)
HTLFVIATRW

SEQ ID NO: 168871 - protein, 9 aa, Artificial Sequence
  Description of Artificial Sequence: Synthetic peptide
  Seed: FSLPYWNFA (TYRP1_HUMAN)
FPLPYWNFT

SEQ ID NO: 168872 - protein, 10 aa, Artificial Sequence
  Description of Artificial Sequence: Synthetic peptide
  Seed: FVWTHYYSVK (TYRP1_HUMAN)
FMWTHYYSVN

SEQ ID NO: 168873 - protein, 9 aa, Artificial Sequence
  Description of Artificial Sequence: Synthetic peptide
  Seed: FVWTHYYSV (TYRP1_HUMAN)
FLWTHYYSR

SEQ ID NO: 168874 - protein, 10 aa, Artificial Sequence
  Description of Artificial Sequence: Synthetic peptide
  Seed: VDFSHEGPAF (TYRP1_HUMAN)
VLFSHEGPAF

SEQ ID NO: 168875 - protein, 10 aa, Artificial Sequence
  Description of Artificial Sequence: Synthetic peptide
  Seed: RSMDEANQPL (TYRP1_HUMAN)
RFMDEANQPF

SEQ ID NO: 168876 - protein, 9 aa, Artificial Sequence
  Description of Artificial Sequence: Synthetic peptide
  Seed: LIFGTASYL (TYRP1_HUMAN)
LIFGTASYF

SEQ ID NO: 168877 - protein, 10 aa, Artificial Sequence
  Description of Artificial Sequence: Synthetic peptide
  Seed: VALIFGTASY (TYRP1_HUMAN)
VWLIFGTASF

SEQ ID NO: 168878 - protein, 8 aa, Artificial Sequence
  Description of Artificial Sequence: Synthetic peptide
  Seed: ACDQRVLI (TYRP1_HUMAN)
ATDQRVLL

SEQ ID NO: 168879 - protein, 10 aa, Artificial Sequence
  Description of Artificial Sequence: Synthetic peptide
  Seed: ADSRPHSPQY (TYRP1_HUMAN)
ARSRPHSPQV

SEQ ID NO: 168880 - protein, 10 aa, Artificial Sequence
  Description of Artificial Sequence: Synthetic peptide
  Seed: GKYDPAVRSL (TYRP1_HUMAN)
GFYDPAVRSF

SEQ ID NO: 168881 - protein, 9 aa, Artificial Sequence
  Description of Artificial Sequence: Synthetic peptide
  Seed: KYDPAVRSL (TYRP1_HUMAN)
KRDPAVRSY

SEQ ID NO: 168882 - protein, 10 aa, Artificial Sequence
  Description of Artificial Sequence: Synthetic peptide
  Seed: FVWTHYYSVK (TYRP1_HUMAN)
FMWTHYYSVE

SEQ ID NO: 168883 - protein, 9 aa, Artificial Sequence
  Description of Artificial Sequence: Synthetic peptide
  Seed: FSHEGPAFL (TYRP1_HUMAN)
FYHEGPAFH

SEQ ID NO: 168884 - protein, 10 aa, Artificial Sequence
  Description of Artificial Sequence: Synthetic peptide
  Seed: YFVWTHYYSV (TYRP1_HUMAN)
YCVWTHYYSL

SEQ ID NO: 168885 - protein, 10 aa, Artificial Sequence
  Description of Artificial Sequence: Synthetic peptide
  Seed: KLLSLGCIFF (TYRP1_HUMAN)
KSLSLGCIFW

SEQ ID NO: 168886 - protein, 10 aa, Artificial Sequence
  Description of Artificial Sequence: Synthetic peptide
  Seed: LSLGCIFFPL (TYRP1_HUMAN)
LKLGCIFFPV

SEQ ID NO: 168887 - protein, 9 aa, Artificial Sequence
  Description of Artificial Sequence: Synthetic peptide
  Seed: GLFDTPPFY (TYRP1_HUMAN)
GQFDTPPFY

SEQ ID NO: 168888 - protein, 10 aa, Artificial Sequence
  Description of Artificial Sequence: Synthetic peptide
  Seed: MAKRTTHPLF (TYRP1_HUMAN)
MPKRTTHPLL

SEQ ID NO: 168889 - protein, 9 aa, Artificial Sequence
  Description of Artificial Sequence: Synthetic peptide
  Seed: TFPLENAPI (TYRP1_HUMAN)
TAPLENAPM

SEQ ID NO: 168890 - protein, 9 aa, Artificial Sequence
  Description of Artificial Sequence: Synthetic peptide
  Seed: LGCIFFPLL (TYRP1_HUMAN)
LICIFFPLV

SEQ ID NO: 168891 - protein, 9 aa, Artificial Sequence
  Description of Artificial Sequence: Synthetic peptide
  Seed: RARRSMDEA (TYRP1_HUMAN)
RARRSMDEK

SEQ ID NO: 168892 - protein, 11 aa, Artificial Sequence
  Description of Artificial Sequence: Synthetic peptide
  Seed: LISPNSVFSQW (TYRP1_HUMAN)
LSSPNSVFSQF

SEQ ID NO: 168893 - protein, 9 aa, Artificial Sequence
  Description of Artificial Sequence: Synthetic peptide
  Seed: TLISPNSVF (TYRP1_HUMAN)
TRISPNSVF

SEQ ID NO: 168894 - protein, 9 aa, Artificial Sequence
  Description of Artificial Sequence: Synthetic peptide
  Seed: VGLFDTPPF (TYRP1_HUMAN)
VMLFDTPPM

SEQ ID NO: 168895 - protein, 9 aa, Artificial Sequence
  Description of Artificial Sequence: Synthetic peptide
  Seed: RQCATVEAL (TYRP1_HUMAN)
RQCATVEAM

SEQ ID NO: 168896 - protein, 9 aa, Artificial Sequence
  Description of Artificial Sequence: Synthetic peptide
  Seed: VFDEWLRRY (TYRP1_HUMAN)
VWDEWLRRF

SEQ ID NO: 168897 - protein, 10 aa, Artificial Sequence
  Description of Artificial Sequence: Synthetic peptide
  Seed: MVPFWPPVTN (TYRP1_HUMAN)
MRPFWPPVTF

SEQ ID NO: 168898 - protein, 10 aa, Artificial Sequence
  Description of Artificial Sequence: Synthetic peptide
  Seed: TAPDNLGYTY (TYRP1_HUMAN)
TIPDNLGYTF

SEQ ID NO: 168899 - protein, 9 aa, Artificial Sequence
  Description of Artificial Sequence: Synthetic peptide
  Seed: YTYEIQWPS (TYRP1_HUMAN)
YNYEIQWPK

SEQ ID NO: 168900 - protein, 9 aa, Artificial Sequence
  Description of Artificial Sequence: Synthetic peptide
  Seed: VARPMVQRL (TYRP1_HUMAN)
VSRPMVQRY

SEQ ID NO: 168901 - protein, 9 aa, Artificial Sequence
  Description of Artificial Sequence: Synthetic peptide
  Seed: SVKKTFLGV (TYRP1_HUMAN)
SIKKTFLGK

SEQ ID NO: 168902 - protein, 9 aa, Artificial Sequence
  Description of Artificial Sequence: Synthetic peptide
  Seed: SVPEIIAIA (TYRP1_HUMAN)
SLPEIIAIA

SEQ ID NO: 168903 - protein, 9 aa, Artificial Sequence
  Description of Artificial Sequence: Synthetic peptide
  Seed: RQCATVEAL (TYRP1_HUMAN)
RRCATVEAY

SEQ ID NO: 168904 - protein, 10 aa, Artificial Sequence
  Description of Artificial Sequence: Synthetic peptide
  Seed: YEIQWPSREF (TYRP1_HUMAN)
YHIQWPSREY

SEQ ID NO: 168905 - protein, 10 aa, Artificial Sequence
  Description of Artificial Sequence: Synthetic peptide
  Seed: PSFSLPYWNF (TYRP1_HUMAN)
PFFSLPYWNF

SEQ ID NO: 168906 - protein, 11 aa, Artificial Sequence
  Description of Artificial Sequence: Synthetic peptide
  Seed: KTFLGVGQESF (TYRP1_HUMAN)
KLFLGVGQESF

SEQ ID NO: 168907 - protein, 9 aa, Artificial Sequence
  Description of Artificial Sequence: Synthetic peptide
  Seed: FSHEGPAFL (TYRP1_HUMAN)
FMHEGPAFA

SEQ ID NO: 168908 - protein, 9 aa, Artificial Sequence
  Description of Artificial Sequence: Synthetic peptide
  Seed: LHNLAHLFL (TYRP1_HUMAN)
LQNLAHLFI

SEQ ID NO: 168909 - protein, 9 aa, Artificial Sequence
  Description of Artificial Sequence: Synthetic peptide
  Seed: RLEKDMQEM (TYRP1_HUMAN)
RIEKDMQEF

SEQ ID NO: 168910 - protein, 11 aa, Artificial Sequence
  Description of Artificial Sequence: Synthetic peptide
  Seed: VRSLHNLAHLF (TYRP1_HUMAN)
VQSLHNLAHLF

SEQ ID NO: 168911 - protein, 9 aa, Artificial Sequence
  Description of Artificial Sequence: Synthetic peptide
  Seed: LTDQYQCYA (TYRP1_HUMAN)
LADQYQCYL

SEQ ID NO: 168912 - protein, 10 aa, Artificial Sequence
  Description of Artificial Sequence: Synthetic peptide
  Seed: SQWRVVCDSL (TYRP1_HUMAN)
SLWRVVCDSY

SEQ ID NO: 168913 - protein, 9 aa, Artificial Sequence
  Description of Artificial Sequence: Synthetic peptide
  Seed: TADSRPHSP (TYRP1_HUMAN)
TLDSRPHSF

SEQ ID NO: 168914 - protein, 9 aa, Artificial Sequence
  Description of Artificial Sequence: Synthetic peptide
  Seed: RPMVQRLPE (TYRP1_HUMAN)
RSMVQRLPL

SEQ ID NO: 168915 - protein, 9 aa, Artificial Sequence
  Description of Artificial Sequence: Synthetic peptide
  Seed: VCDICTDDL (TYRP1_HUMAN)
VFDICTDDI

SEQ ID NO: 168916 - protein, 8 aa, Artificial Sequence
  Description of Artificial Sequence: Synthetic peptide
  Seed: AGNVARPM (TYRP1_HUMAN)
AANVARPL

SEQ ID NO: 168917 - protein, 9 aa, Artificial Sequence
  Description of Artificial Sequence: Synthetic peptide
  Seed: FSHEGPAFL (TYRP1_HUMAN)
FYHEGPAFI

SEQ ID NO: 168918 - protein, 9 aa, Artificial Sequence
  Description of Artificial Sequence: Synthetic peptide
  Seed: ISIYNYFVW (TYRP1_HUMAN)
ITIYNYFVM

SEQ ID NO: 168919 - protein, 9 aa, Artificial Sequence
  Description of Artificial Sequence: Synthetic peptide
  Seed: RSNFDSTLI (TYRP1_HUMAN)
RSNFDSTLL

SEQ ID NO: 168920 - protein, 9 aa, Artificial Sequence
  Description of Artificial Sequence: Synthetic peptide
  Seed: FSVPEIIAI (TYRP1_HUMAN)
FSVPEIIAA

SEQ ID NO: 168921 - protein, 9 aa, Artificial Sequence
  Description of Artificial Sequence: Synthetic peptide
  Seed: LIFGTASYL (TYRP1_HUMAN)
LLFGTASYV

SEQ ID NO: 168922 - protein, 11 aa, Artificial Sequence
  Description of Artificial Sequence: Synthetic peptide
  Seed: HTFTDAVFDEW (TYRP1_HUMAN)
HTFTDAVFDEF

SEQ ID NO: 168923 - protein, 10 aa, Artificial Sequence
  Description of Artificial Sequence: Synthetic peptide
  Seed: NPAGNVARPM (TYRP1_HUMAN)
NAAGNVARPY

SEQ ID NO: 168924 - protein, 8 aa, Artificial Sequence
  Description of Artificial Sequence: Synthetic peptide
  Seed: RQYNMVPF (TYRP1_HUMAN)
RVYNMVPY

SEQ ID NO: 168925 - protein, 9 aa, Artificial Sequence
  Description of Artificial Sequence: Synthetic peptide
  Seed: YYSVKKTFL (TYRP1_HUMAN)
YASVKKTFI

SEQ ID NO: 168926 - protein, 9 aa, Artificial Sequence
  Description of Artificial Sequence: Synthetic peptide
  Seed: LQNPNQSVV (TYRP1_HUMAN)
LYNPNQSVL

SEQ ID NO: 168927 - protein, 10 aa, Artificial Sequence
  Description of Artificial Sequence: Synthetic peptide
  Seed: LPYWNFATGK (TYRP1_HUMAN)
LYYWNFATGR

SEQ ID NO: 168928 - protein, 9 aa, Artificial Sequence
  Description of Artificial Sequence: Synthetic peptide
  Seed: APIGHNRQY (TYRP1_HUMAN)
AAIGHNRQL

SEQ ID NO: 168929 - protein, 10 aa, Artificial Sequence
  Description of Artificial Sequence: Synthetic peptide
  Seed: STLISPNSVF (TYRP1_HUMAN)
SVLISPNSVY

SEQ ID NO: 168930 - protein, 10 aa, Artificial Sequence
  Description of Artificial Sequence: Synthetic peptide
  Seed: ALIFGTASYL (TYRP1_HUMAN)
AQIFGTASYR

SEQ ID NO: 168931 - protein, 9 aa, Artificial Sequence
  Description of Artificial Sequence: Synthetic peptide
  Seed: NYFVWTHYY (TYRP1_HUMAN)
NFFVWTHYR

SEQ ID NO: 168932 - protein, 9 aa, Artificial Sequence
  Description of Artificial Sequence: Synthetic peptide
  Seed: APIGHNRQY (TYRP1_HUMAN)
AAIGHNRQI

SEQ ID NO: 168933 - protein, 9 aa, Artificial Sequence
  Description of Artificial Sequence: Synthetic peptide
  Seed: HYYSVKKTF (TYRP1_HUMAN)
HMYSVKKTL

SEQ ID NO: 168934 - protein, 11 aa, Artificial Sequence
  Description of Artificial Sequence: Synthetic peptide
  Seed: YNMVPFWPPVT (TYRP1_HUMAN)
YMMVPFWPPVR

SEQ ID NO: 168935 - protein, 9 aa, Artificial Sequence
  Description of Artificial Sequence: Synthetic peptide
  Seed: LHTFTDAVF (TYRP1_HUMAN)
LKTFTDAVL

SEQ ID NO: 168936 - protein, 8 aa, Artificial Sequence
  Description of Artificial Sequence: Synthetic peptide
  Seed: REFSVPEI (TYRP1_HUMAN)
REFSVPEL

SEQ ID NO: 168937 - protein, 10 aa, Artificial Sequence
  Description of Artificial Sequence: Synthetic peptide
  Seed: FWPPVTNTEM (TYRP1_HUMAN)
FHPPVTNTEY

SEQ ID NO: 168938 - protein, 9 aa, Artificial Sequence
  Description of Artificial Sequence: Synthetic peptide
  Seed: AVRSLHNLA (TYRP1_HUMAN)
AMRSLHNLI

SEQ ID NO: 168939 - protein, 9 aa, Artificial Sequence
  Description of Artificial Sequence: Synthetic peptide
  Seed: AQFPRQCAT (TYRP1_HUMAN)
AMFPRQCAM

SEQ ID NO: 168940 - protein, 9 aa, Artificial Sequence
  Description of Artificial Sequence: Synthetic peptide
  Seed: FVWTHYYSV (TYRP1_HUMAN)
FPWTHYYSF

SEQ ID NO: 168941 - protein, 9 aa, Artificial Sequence
  Description of Artificial Sequence: Synthetic peptide
  Seed: MAKRTTHPL (TYRP1_HUMAN)
MNKRTTHPL

SEQ ID NO: 168942 - protein, 9 aa, Artificial Sequence
  Description of Artificial Sequence: Synthetic peptide
  Seed: KLLSLGCIF (TYRP1_HUMAN)
KVLSLGCIW

SEQ ID NO: 168943 - protein, 10 aa, Artificial Sequence
  Description of Artificial Sequence: Synthetic peptide
  Seed: HPLFVIATRR (TYRP1_HUMAN)
HTLFVIATRE

SEQ ID NO: 168944 - protein, 8 aa, Artificial Sequence
  Description of Artificial Sequence: Synthetic peptide
  Seed: LIFGTASY (TYRP1_HUMAN)
LPFGTASY

SEQ ID NO: 168945 - protein, 10 aa, Artificial Sequence
  Description of Artificial Sequence: Synthetic peptide
  Seed: LQEPSFSLPY (TYRP1_HUMAN)
LREPSFSLPY

SEQ ID NO: 168946 - protein, 9 aa, Artificial Sequence
  Description of Artificial Sequence: Synthetic peptide
  Seed: VFDEWLRRY (TYRP1_HUMAN)
VSDEWLRRL

SEQ ID NO: 168947 - protein, 10 aa, Artificial Sequence
  Description of Artificial Sequence: Synthetic peptide
  Seed: LPYWNFATGK (TYRP1_HUMAN)
LTYWNFATGR

SEQ ID NO: 168948 - protein, 9 aa, Artificial Sequence
  Description of Artificial Sequence: Synthetic peptide
  Seed: IAVVGALLL (TYRP1_HUMAN)
ILVVGALLY

SEQ ID NO: 168949 - protein, 11 aa, Artificial Sequence
  Description of Artificial Sequence: Synthetic peptide
  Seed: GYTYEIQWPSR (TYRP1_HUMAN)
GHTYEIQWPSR

SEQ ID NO: 168950 - protein, 9 aa, Artificial Sequence
  Description of Artificial Sequence: Synthetic peptide
  Seed: FLGVGQESF (TYRP1_HUMAN)
FYGVGQESY

SEQ ID NO: 168951 - protein, 11 aa, Artificial Sequence
  Description of Artificial Sequence: Synthetic peptide
  Seed: QEMLQEPSFSL (TYRP1_HUMAN)
QMMLQEPSFSV

SEQ ID NO: 168952 - protein, 10 aa, Artificial Sequence
  Description of Artificial Sequence: Synthetic peptide
  Seed: TAPDNLGYTY (TYRP1_HUMAN)
TMPDNLGYTF

SEQ ID NO: 168953 - protein, 9 aa, Artificial Sequence
  Description of Artificial Sequence: Synthetic peptide
  Seed: MAKRTTHPL (TYRP1_HUMAN)
MSKRTTHPK

SEQ ID NO: 168954 - protein, 10 aa, Artificial Sequence
  Description of Artificial Sequence: Synthetic peptide
  Seed: FVLLHTFTDA (TYRP1_HUMAN)
FSLLHTFTDI

SEQ ID NO: 168955 - protein, 8 aa, Artificial Sequence
  Description of Artificial Sequence: Synthetic peptide
  Seed: LIRARRSM (TYRP1_HUMAN)
LMRARRSL

SEQ ID NO: 168956 - protein, 9 aa, Artificial Sequence
  Description of Artificial Sequence: Synthetic peptide
  Seed: NADISTFPL (TYRP1_HUMAN)
NMDISTFPY

SEQ ID NO: 168957 - protein, 9 aa, Artificial Sequence
  Description of Artificial Sequence: Synthetic peptide
  Seed: RTTHPLFVI (TYRP1_HUMAN)
RVTHPLFVI

SEQ ID NO: 168958 - protein, 9 aa, Artificial Sequence
  Description of Artificial Sequence: Synthetic peptide
  Seed: REFSVPEII (TYRP1_HUMAN)
RRFSVPEIY

SEQ ID NO: 168959 - protein, 9 aa, Artificial Sequence
  Description of Artificial Sequence: Synthetic peptide
  Seed: MLQEPSFSL (TYRP1_HUMAN)
MTQEPSFSV

SEQ ID NO: 168960 - protein, 10 aa, Artificial Sequence
  Description of Artificial Sequence: Synthetic peptide
  Seed: YFVWTHYYSV (TYRP1_HUMAN)
YEVWTHYYSL

SEQ ID NO: 168961 - protein, 10 aa, Artificial Sequence
  Description of Artificial Sequence: Synthetic peptide
  Seed: PAVRSLHNLA (TYRP1_HUMAN)
PKVRSLHNLK

SEQ ID NO: 168962 - protein, 11 aa, Artificial Sequence
  Description of Artificial Sequence: Synthetic peptide
  Seed: GYTYEIQWPSR (TYRP1_HUMAN)
GMTYEIQWPSR

SEQ ID NO: 168963 - protein, 9 aa, Artificial Sequence
  Description of Artificial Sequence: Synthetic peptide
  Seed: DQRVLIVRR (TYRP1_HUMAN)
DLRVLIVRR

SEQ ID NO: 168964 - protein, 9 aa, Artificial Sequence
  Description of Artificial Sequence: Synthetic peptide
  Seed: RYNADISTF (TYRP1_HUMAN)
RENADISTM

SEQ ID NO: 168965 - protein, 10 aa, Artificial Sequence
  Description of Artificial Sequence: Synthetic peptide
  Seed: LSPNDPIFVL (TYRP1_HUMAN)
LVPNDPIFVM

SEQ ID NO: 168966 - protein, 10 aa, Artificial Sequence
  Description of Artificial Sequence: Synthetic peptide
  Seed: LSLGCIFFPL (TYRP1_HUMAN)
LALGCIFFPV

SEQ ID NO: 168967 - protein, 9 aa, Artificial Sequence
  Description of Artificial Sequence: Synthetic peptide
  Seed: DSRPHSPQY (TYRP1_HUMAN)
DLRPHSPQF

SEQ ID NO: 168968 - protein, 10 aa, Artificial Sequence
  Description of Artificial Sequence: Synthetic peptide
  Seed: RRYNADISTF (TYRP1_HUMAN)
RQYNADISTH

SEQ ID NO: 168969 - protein, 9 aa, Artificial Sequence
  Description of Artificial Sequence: Synthetic peptide
  Seed: MSAPKLLSL (TYRP1_HUMAN)
MVAPKLLSH

SEQ ID NO: 168970 - protein, 9 aa, Artificial Sequence
  Description of Artificial Sequence: Synthetic peptide
  Seed: SRSNFDSTL (TYRP1_HUMAN)
SHSNFDSTL

SEQ ID NO: 168971 - protein, 9 aa, Artificial Sequence
  Description of Artificial Sequence: Synthetic peptide
  Seed: RSLHNLAHL (TYRP1_HUMAN)
RQLHNLAHY

SEQ ID NO: 168972 - protein, 11 aa, Artificial Sequence
  Description of Artificial Sequence: Synthetic peptide
  Seed: FPLLLFQQARA (TYRP1_HUMAN)
FSLLLFQQARV

SEQ ID NO: 168973 - protein, 9 aa, Artificial Sequence
  Description of Artificial Sequence: Synthetic peptide
  Seed: WHRYHLLRL (TYRP1_HUMAN)
WARYHLLRF

SEQ ID NO: 168974 - protein, 10 aa, Artificial Sequence
  Description of Artificial Sequence: Synthetic peptide
  Seed: FSLPYWNFAT (TYRP1_HUMAN)
FRLPYWNFAV

SEQ ID NO: 168975 - protein, 10 aa, Artificial Sequence
  Description of Artificial Sequence: Synthetic peptide
  Seed: TPQFENISIY (TYRP1_HUMAN)
TIQFENISIY

SEQ ID NO: 168976 - protein, 8 aa, Artificial Sequence
  Description of Artificial Sequence: Synthetic peptide
  Seed: YDPAVRSL (TYRP1_HUMAN)
YAPAVRSF

SEQ ID NO: 168977 - protein, 9 aa, Artificial Sequence
  Description of Artificial Sequence: Synthetic peptide
  Seed: TLISPNSVF (TYRP1_HUMAN)
TQISPNSVH

SEQ ID NO: 168978 - protein, 9 aa, Artificial Sequence
  Description of Artificial Sequence: Synthetic peptide
  Seed: MSAPKLLSL (TYRP1_HUMAN)
MRAPKLLSV

SEQ ID NO: 168979 - protein, 9 aa, Artificial Sequence
  Description of Artificial Sequence: Synthetic peptide
  Seed: MSAPKLLSL (TYRP1_HUMAN)
MMAPKLLSM

SEQ ID NO: 168980 - protein, 9 aa, Artificial Sequence
  Description of Artificial Sequence: Synthetic peptide
  Seed: VLIVRRNLL (TYRP1_HUMAN)
VMIVRRNLL

SEQ ID NO: 168981 - protein, 10 aa, Artificial Sequence
  Description of Artificial Sequence: Synthetic peptide
  Seed: TAPDNLGYTY (TYRP1_HUMAN)
TSPDNLGYTL

SEQ ID NO: 168982 - protein, 10 aa, Artificial Sequence
  Description of Artificial Sequence: Synthetic peptide
  Seed: FWPPVTNTEM (TYRP1_HUMAN)
FYPPVTNTEF

SEQ ID NO: 168983 - protein, 10 aa, Artificial Sequence
  Description of Artificial Sequence: Synthetic peptide
  Seed: AQFPRQCATV (TYRP1_HUMAN)
AMFPRQCATL

SEQ ID NO: 168984 - protein, 9 aa, Artificial Sequence
  Description of Artificial Sequence: Synthetic peptide
  Seed: FPRQCATVE (TYRP1_HUMAN)
FPRQCATVF

SEQ ID NO: 168985 - protein, 9 aa, Artificial Sequence
  Description of Artificial Sequence: Synthetic peptide
  Seed: QEMLQEPSF (TYRP1_HUMAN)
QVMLQEPSY

SEQ ID NO: 168986 - protein, 9 aa, Artificial Sequence
  Description of Artificial Sequence: Synthetic peptide
  Seed: GLFDTPPFY (TYRP1_HUMAN)
GLFDTPPFK

SEQ ID NO: 168987 - protein, 10 aa, Artificial Sequence
  Description of Artificial Sequence: Synthetic peptide
  Seed: GPAFLTWHRY (TYRP1_HUMAN)
GMAFLTWHRY

SEQ ID NO: 168988 - protein, 11 aa, Artificial Sequence
  Description of Artificial Sequence: Synthetic peptide
  Seed: REFSVPEIIAI (TYRP1_HUMAN)
RQFSVPEIIAM

SEQ ID NO: 168989 - protein, 11 aa, Artificial Sequence
  Description of Artificial Sequence: Synthetic peptide
  Seed: RRYNADISTFP (TYRP1_HUMAN)
RWYNADISTFA

SEQ ID NO: 168990 - protein, 10 aa, Artificial Sequence
  Description of Artificial Sequence: Synthetic peptide
  Seed: TTHPLFVIAT (TYRP1_HUMAN)
TTHPLFVIAI

SEQ ID NO: 168991 - protein, 9 aa, Artificial Sequence
  Description of Artificial Sequence: Synthetic peptide
  Seed: LSPNDPIFV (TYRP1_HUMAN)
LIPNDPIFI

SEQ ID NO: 168992 - protein, 10 aa, Artificial Sequence
  Description of Artificial Sequence: Synthetic peptide
  Seed: FGTASYLIRA (TYRP1_HUMAN)
FITASYLIRA

SEQ ID NO: 168993 - protein, 11 aa, Artificial Sequence
  Description of Artificial Sequence: Synthetic peptide
  Seed: IYNYFVWTHYY (TYRP1_HUMAN)
ISNYFVWTHYF

SEQ ID NO: 168994 - protein, 10 aa, Artificial Sequence
  Description of Artificial Sequence: Synthetic peptide
  Seed: VLLHTFTDAV (TYRP1_HUMAN)
VSLHTFTDAV

SEQ ID NO: 168995 - protein, 9 aa, Artificial Sequence
  Description of Artificial Sequence: Synthetic peptide
  Seed: SPNSVFSQW (TYRP1_HUMAN)
SQNSVFSQY

SEQ ID NO: 168996 - protein, 10 aa, Artificial Sequence
  Description of Artificial Sequence: Synthetic peptide
  Seed: ADSRPHSPQY (TYRP1_HUMAN)
AVSRPHSPQA

SEQ ID NO: 168997 - protein, 9 aa, Artificial Sequence
  Description of Artificial Sequence: Synthetic peptide
  Seed: TADSRPHSP (TYRP1_HUMAN)
TQDSRPHSL

SEQ ID NO: 168998 - protein, 10 aa, Artificial Sequence
  Description of Artificial Sequence: Synthetic peptide
  Seed: MVPFWPPVTN (TYRP1_HUMAN)
MIPFWPPVTY

SEQ ID NO: 168999 - protein, 9 aa, Artificial Sequence
  Description of Artificial Sequence: Synthetic peptide
  Seed: AIAVVGALL (TYRP1_HUMAN)
ATAVVGALY

SEQ ID NO: 169000 - protein, 9 aa, Artificial Sequence
  Description of Artificial Sequence: Synthetic peptide
  Seed: FSLPYWNFA (TYRP1_HUMAN)
FALPYWNFL

SEQ ID NO: 169001 - protein, 9 aa, Artificial Sequence
  Description of Artificial Sequence: Synthetic peptide
  Seed: IAIAVVGAL (TYRP1_HUMAN)
ISIAVVGAV

SEQ ID NO: 169002 - protein, 9 aa, Artificial Sequence
  Description of Artificial Sequence: Synthetic peptide
  Seed: AACDQRVLI (TYRP1_HUMAN)
ASCDQRVLY

SEQ ID NO: 169003 - protein, 9 aa, Artificial Sequence
  Description of Artificial Sequence: Synthetic peptide
  Seed: GLFDTPPFY (TYRP1_HUMAN)
GFFDTPPFY

SEQ ID NO: 169004 - protein, 9 aa, Artificial Sequence
  Description of Artificial Sequence: Synthetic peptide
  Seed: SVPEIIAIA (TYRP1_HUMAN)
SSPEIIAIY

SEQ ID NO: 169005 - protein, 9 aa, Artificial Sequence
  Description of Artificial Sequence: Synthetic peptide
  Seed: YLIRARRSM (TYRP1_HUMAN)
YTIRARRSY

SEQ ID NO: 169006 - protein, 9 aa, Artificial Sequence
  Description of Artificial Sequence: Synthetic peptide
  Seed: SLHNLAHLF (TYRP1_HUMAN)
SMHNLAHLK

SEQ ID NO: 169007 - protein, 9 aa, Artificial Sequence
  Description of Artificial Sequence: Synthetic peptide
  Seed: STNSFRNTV (TYRP1_HUMAN)
SMNSFRNTY

SEQ ID NO: 169008 - protein, 10 aa, Artificial Sequence
  Description of Artificial Sequence: Synthetic peptide
  Seed: STFPLENAPI (TYRP1_HUMAN)
STFPLENAPF

SEQ ID NO: 169009 - protein, 10 aa, Artificial Sequence
  Description of Artificial Sequence: Synthetic peptide
  Seed: GKYDPAVRSL (TYRP1_HUMAN)
GHYDPAVRSM

SEQ ID NO: 169010 - protein, 9 aa, Artificial Sequence
  Description of Artificial Sequence: Synthetic peptide
  Seed: ACDQRVLIV (TYRP1_HUMAN)
ASDQRVLII

SEQ ID NO: 169011 - protein, 9 aa, Artificial Sequence
  Description of Artificial Sequence: Synthetic peptide
  Seed: FVWTHYYSV (TYRP1_HUMAN)
FVWTHYYSR

SEQ ID NO: 169012 - protein, 11 aa, Artificial Sequence
  Description of Artificial Sequence: Synthetic peptide
  Seed: LISPNSVFSQW (TYRP1_HUMAN)
LQSPNSVFSQW

SEQ ID NO: 169013 - protein, 10 aa, Artificial Sequence
  Description of Artificial Sequence: Synthetic peptide
  Seed: FSVPEIIAIA (TYRP1_HUMAN)
FGVPEIIAIV

SEQ ID NO: 169014 - protein, 10 aa, Artificial Sequence
  Description of Artificial Sequence: Synthetic peptide
  Seed: RRYNADISTF (TYRP1_HUMAN)
RHYNADISTM

SEQ ID NO: 169015 - protein, 9 aa, Artificial Sequence
  Description of Artificial Sequence: Synthetic peptide
  Seed: REFSVPEII (TYRP1_HUMAN)
RLFSVPEIV

SEQ ID NO: 169016 - protein, 9 aa, Artificial Sequence
  Description of Artificial Sequence: Synthetic peptide
  Seed: SPNDPIFVL (TYRP1_HUMAN)
SYNDPIFVL

SEQ ID NO: 169017 - protein, 10 aa, Artificial Sequence
  Description of Artificial Sequence: Synthetic peptide
  Seed: FVWTHYYSVK (TYRP1_HUMAN)
FQWTHYYSVM

SEQ ID NO: 169018 - protein, 10 aa, Artificial Sequence
  Description of Artificial Sequence: Synthetic peptide
  Seed: RTTHPLFVIA (TYRP1_HUMAN)
RLTHPLFVIA

SEQ ID NO: 169019 - protein, 10 aa, Artificial Sequence
  Description of Artificial Sequence: Synthetic peptide
  Seed: AQFPRQCATV (TYRP1_HUMAN)
ALFPRQCATL

SEQ ID NO: 169020 - protein, 9 aa, Artificial Sequence
  Description of Artificial Sequence: Synthetic peptide
  Seed: NRQYNMVPF (TYRP1_HUMAN)
NYQYNMVPI

SEQ ID NO: 169021 - protein, 10 aa, Artificial Sequence
  Description of Artificial Sequence: Synthetic peptide
  Seed: YFVWTHYYSV (TYRP1_HUMAN)
YMVWTHYYST

SEQ ID NO: 169022 - protein, 9 aa, Artificial Sequence
  Description of Artificial Sequence: Synthetic peptide
  Seed: YTYEIQWPS (TYRP1_HUMAN)
YMYEIQWPY

SEQ ID NO: 169023 - protein, 9 aa, Artificial Sequence
  Description of Artificial Sequence: Synthetic peptide
  Seed: FSHEGPAFL (TYRP1_HUMAN)
FPHEGPAFI

SEQ ID NO: 169024 - protein, 9 aa, Artificial Sequence
  Description of Artificial Sequence: Synthetic peptide
  Seed: FLTWHRYHL (TYRP1_HUMAN)
FLTWHRYHV

SEQ ID NO: 169025 - protein, 9 aa, Artificial Sequence
  Description of Artificial Sequence: Synthetic peptide
  Seed: FVWTHYYSV (TYRP1_HUMAN)
FTWTHYYSF

SEQ ID NO: 169026 - protein, 10 aa, Artificial Sequence
  Description of Artificial Sequence: Synthetic peptide
  Seed: FSVPEIIAIA (TYRP1_HUMAN)
FVVPEIIAIL

SEQ ID NO: 169027 - protein, 9 aa, Artificial Sequence
  Description of Artificial Sequence: Synthetic peptide
  Seed: PNDPIFVLL (TYRP1_HUMAN)
PYDPIFVLM

SEQ ID NO: 169028 - protein, 9 aa, Artificial Sequence
  Description of Artificial Sequence: Synthetic peptide
  Seed: SVFSQWRVV (TYRP1_HUMAN)
SAFSQWRVF

SEQ ID NO: 169029 - protein, 10 aa, Artificial Sequence
  Description of Artificial Sequence: Synthetic peptide
  Seed: ATVEALRSGM (TYRP1_HUMAN)
ALVEALRSGL

SEQ ID NO: 169030 - protein, 9 aa, Artificial Sequence
  Description of Artificial Sequence: Synthetic peptide
  Seed: SVKKTFLGV (TYRP1_HUMAN)
STKKTFLGV

SEQ ID NO: 169031 - protein, 9 aa, Artificial Sequence
  Description of Artificial Sequence: Synthetic peptide
  Seed: VGLFDTPPF (TYRP1_HUMAN)
VPLFDTPPL

SEQ ID NO: 169032 - protein, 9 aa, Artificial Sequence
  Description of Artificial Sequence: Synthetic peptide
  Seed: NGTGGQTHL (TYRP1_HUMAN)
NATGGQTHL

SEQ ID NO: 169033 - protein, 10 aa, Artificial Sequence
  Description of Artificial Sequence: Synthetic peptide
  Seed: DAVFDEWLRR (TYRP1_HUMAN)
DDVFDEWLRR

SEQ ID NO: 169034 - protein, 10 aa, Artificial Sequence
  Description of Artificial Sequence: Synthetic peptide
  Seed: QFENISIYNY (TYRP1_HUMAN)
QWENISIYNW

SEQ ID NO: 169035 - protein, 10 aa, Artificial Sequence
  Description of Artificial Sequence: Synthetic peptide
  Seed: FLTWHRYHLL (TYRP1_HUMAN)
FMTWHRYHLI

SEQ ID NO: 169036 - protein, 10 aa, Artificial Sequence
  Description of Artificial Sequence: Synthetic peptide
  Seed: RSMDEANQPL (TYRP1_HUMAN)
RCMDEANQPL

SEQ ID NO: 169037 - protein, 9 aa, Artificial Sequence
  Description of Artificial Sequence: Synthetic peptide
  Seed: TLISPNSVF (TYRP1_HUMAN)
TFISPNSVF

SEQ ID NO: 169038 - protein, 9 aa, Artificial Sequence
  Description of Artificial Sequence: Synthetic peptide
  Seed: ACDQRVLIV (TYRP1_HUMAN)
AVDQRVLIV

SEQ ID NO: 169039 - protein, 9 aa, Artificial Sequence
  Description of Artificial Sequence: Synthetic peptide
  Seed: DDREVWPLR (TYRP1_HUMAN)
DMREVWPLK

SEQ ID NO: 169040 - protein, 8 aa, Artificial Sequence
  Description of Artificial Sequence: Synthetic peptide
  Seed: YYSVKKTF (TYRP1_HUMAN)
YSSVKKTM

SEQ ID NO: 169041 - protein, 10 aa, Artificial Sequence
  Description of Artificial Sequence: Synthetic peptide
  Seed: SLHNLAHLFL (TYRP1_HUMAN)
SMHNLAHLFI

SEQ ID NO: 169042 - protein, 9 aa, Artificial Sequence
  Description of Artificial Sequence: Synthetic peptide
  Seed: KYDPAVRSL (TYRP1_HUMAN)
KFDPAVRSY

SEQ ID NO: 169043 - protein, 9 aa, Artificial Sequence
  Description of Artificial Sequence: Synthetic peptide
  Seed: SVFSQWRVV (TYRP1_HUMAN)
SSFSQWRVL

SEQ ID NO: 169044 - protein, 10 aa, Artificial Sequence
  Description of Artificial Sequence: Synthetic peptide
  Seed: ADSRPHSPQY (TYRP1_HUMAN)
AHSRPHSPQV

SEQ ID NO: 169045 - protein, 9 aa, Artificial Sequence
  Description of Artificial Sequence: Synthetic peptide
  Seed: MDEANQPLL (TYRP1_HUMAN)
MEEANQPLI

SEQ ID NO: 169046 - protein, 10 aa, Artificial Sequence
  Description of Artificial Sequence: Synthetic peptide
  Seed: GLFDTPPFYS (TYRP1_HUMAN)
GMFDTPPFYV

SEQ ID NO: 169047 - protein, 9 aa, Artificial Sequence
  Description of Artificial Sequence: Synthetic peptide
  Seed: HPLFVIATR (TYRP1_HUMAN)
HYLFVIATK

SEQ ID NO: 169048 - protein, 10 aa, Artificial Sequence
  Description of Artificial Sequence: Synthetic peptide
  Seed: YNYFVWTHYY (TYRP1_HUMAN)
YVYFVWTHYF

SEQ ID NO: 169049 - protein, 9 aa, Artificial Sequence
  Description of Artificial Sequence: Synthetic peptide
  Seed: TNTEMFVTA (TYRP1_HUMAN)
THTEMFVTM

SEQ ID NO: 169050 - protein, 8 aa, Artificial Sequence
  Description of Artificial Sequence: Synthetic peptide
  Seed: DYDTLGTL (TYRP1_HUMAN)
DFDTLGTL

SEQ ID NO: 169051 - protein, 10 aa, Artificial Sequence
  Description of Artificial Sequence: Synthetic peptide
  Seed: LLLVALIFGT (TYRP1_HUMAN)
LDLVALIFGI

SEQ ID NO: 169052 - protein, 11 aa, Artificial Sequence
  Description of Artificial Sequence: Synthetic peptide
  Seed: SLPYWNFATGK (TYRP1_HUMAN)
SFPYWNFATGR

SEQ ID NO: 169053 - protein, 9 aa, Artificial Sequence
  Description of Artificial Sequence: Synthetic peptide
  Seed: APIGHNRQY (TYRP1_HUMAN)
AYIGHNRQL

SEQ ID NO: 169054 - protein, 9 aa, Artificial Sequence
  Description of Artificial Sequence: Synthetic peptide
  Seed: TTHPLFVIA (TYRP1_HUMAN)
TPHPLFVIA

SEQ ID NO: 169055 - protein, 10 aa, Artificial Sequence
  Description of Artificial Sequence: Synthetic peptide
  Seed: HPLFVIATRR (TYRP1_HUMAN)
HVLFVIATRR

SEQ ID NO: 169056 - protein, 9 aa, Artificial Sequence
  Description of Artificial Sequence: Synthetic peptide
  Seed: FTDAVFDEW (TYRP1_HUMAN)
FADAVFDEV

SEQ ID NO: 169057 - protein, 9 aa, Artificial Sequence
  Description of Artificial Sequence: Synthetic peptide
  Seed: RGRCEAVTA (TYRP1_HUMAN)
RVRCEAVTI

SEQ ID NO: 169058 - protein, 10 aa, Artificial Sequence
  Description of Artificial Sequence: Synthetic peptide
  Seed: RSMDEANQPL (TYRP1_HUMAN)
RMMDEANQPL

SEQ ID NO: 169059 - protein, 9 aa, Artificial Sequence
  Description of Artificial Sequence: Synthetic peptide
  Seed: VTAPDNLGY (TYRP1_HUMAN)
VTAPDNLGI

SEQ ID NO: 169060 - protein, 10 aa, Artificial Sequence
  Description of Artificial Sequence: Synthetic peptide
  Seed: EGYSDPTGKY (TYRP1_HUMAN)
EVYSDPTGKR

SEQ ID NO: 169061 - protein, 8 aa, Artificial Sequence
  Description of Artificial Sequence: Synthetic peptide
  Seed: ACDQRVLI (TYRP1_HUMAN)
AFDQRVLF

SEQ ID NO: 169062 - protein, 10 aa, Artificial Sequence
  Description of Artificial Sequence: Synthetic peptide
  Seed: AFLTWHRYHL (TYRP1_HUMAN)
AWLTWHRYHW

SEQ ID NO: 169063 - protein, 10 aa, Artificial Sequence
  Description of Artificial Sequence: Synthetic peptide
  Seed: YNADISTFPL (TYRP1_HUMAN)
YMADISTFPG

SEQ ID NO: 169064 - protein, 9 aa, Artificial Sequence
  Description of Artificial Sequence: Synthetic peptide
  Seed: LFDTPPFYS (TYRP1_HUMAN)
LFDTPPFYI

SEQ ID NO: 169065 - protein, 9 aa, Artificial Sequence
  Description of Artificial Sequence: Synthetic peptide
  Seed: YNYFVWTHY (TYRP1_HUMAN)
YRYFVWTHM

SEQ ID NO: 169066 - protein, 9 aa, Artificial Sequence
  Description of Artificial Sequence: Synthetic peptide
  Seed: NVARPMVQR (TYRP1_HUMAN)
NNARPMVQR

SEQ ID NO: 169067 - protein, 8 aa, Artificial Sequence
  Description of Artificial Sequence: Synthetic peptide
  Seed: REFSVPEI (TYRP1_HUMAN)
REFSVPEV

SEQ ID NO: 169068 - protein, 10 aa, Artificial Sequence
  Description of Artificial Sequence: Synthetic peptide
  Seed: RQCATVEALR (TYRP1_HUMAN)
RYCATVEALK

SEQ ID NO: 169069 - protein, 9 aa, Artificial Sequence
  Description of Artificial Sequence: Synthetic peptide
  Seed: VTAPDNLGY (TYRP1_HUMAN)
VSAPDNLGI

SEQ ID NO: 169070 - protein, 10 aa, Artificial Sequence
  Description of Artificial Sequence: Synthetic peptide
  Seed: YNADISTFPL (TYRP1_HUMAN)
YIADISTFPI

SEQ ID NO: 169071 - protein, 10 aa, Artificial Sequence
  Description of Artificial Sequence: Synthetic peptide
  Seed: NPAGNVARPM (TYRP1_HUMAN)
NPAGNVARPY

SEQ ID NO: 169072 - protein, 10 aa, Artificial Sequence
  Description of Artificial Sequence: Synthetic peptide
  Seed: PSFSLPYWNF (TYRP1_HUMAN)
PWFSLPYWNI

SEQ ID NO: 169073 - protein, 10 aa, Artificial Sequence
  Description of Artificial Sequence: Synthetic peptide
  Seed: MLQEPSFSLP (TYRP1_HUMAN)
MIQEPSFSLV

SEQ ID NO: 169074 - protein, 9 aa, Artificial Sequence
  Description of Artificial Sequence: Synthetic peptide
  Seed: LLDLSKEEK (TYRP1_HUMAN)
LSDLSKEEY

SEQ ID NO: 169075 - protein, 10 aa, Artificial Sequence
  Description of Artificial Sequence: Synthetic peptide
  Seed: YNADISTFPL (TYRP1_HUMAN)
YVADISTFPS

SEQ ID NO: 169076 - protein, 9 aa, Artificial Sequence
  Description of Artificial Sequence: Synthetic peptide
  Seed: VGLFDTPPF (TYRP1_HUMAN)
VSLFDTPPL

SEQ ID NO: 169077 - protein, 10 aa, Artificial Sequence
  Description of Artificial Sequence: Synthetic peptide
  Seed: FQQARAQFPR (TYRP1_HUMAN)
FFQARAQFPK

SEQ ID NO: 169078 - protein, 9 aa, Artificial Sequence
  Description of Artificial Sequence: Synthetic peptide
  Seed: LTWHRYHLL (TYRP1_HUMAN)
LAWHRYHLY

SEQ ID NO: 169079 - protein, 9 aa, Artificial Sequence
  Description of Artificial Sequence: Synthetic peptide
  Seed: LTWHRYHLL (TYRP1_HUMAN)
LIWHRYHLV

SEQ ID NO: 169080 - protein, 9 aa, Artificial Sequence
  Description of Artificial Sequence: Synthetic peptide
  Seed: TPQFENISI (TYRP1_HUMAN)
TPQFENISL

SEQ ID NO: 169081 - protein, 9 aa, Artificial Sequence
  Description of Artificial Sequence: Synthetic peptide
  Seed: YNYFVWTHY (TYRP1_HUMAN)
YHYFVWTHF

SEQ ID NO: 169082 - protein, 9 aa, Artificial Sequence
  Description of Artificial Sequence: Synthetic peptide
  Seed: FTDAVFDEW (TYRP1_HUMAN)
FGDAVFDEY

SEQ ID NO: 169083 - protein, 9 aa, Artificial Sequence
  Description of Artificial Sequence: Synthetic peptide
  Seed: MLQEPSFSL (TYRP1_HUMAN)
MYQEPSFSW

SEQ ID NO: 169084 - protein, 11 aa, Artificial Sequence
  Description of Artificial Sequence: Synthetic peptide
  Seed: SMDEANQPLLT (TYRP1_HUMAN)
SIDEANQPLLL

SEQ ID NO: 169085 - protein, 9 aa, Artificial Sequence
  Description of Artificial Sequence: Synthetic peptide
  Seed: LQNPNQSVV (TYRP1_HUMAN)
LQNPNQSVI

SEQ ID NO: 169086 - protein, 9 aa, Artificial Sequence
  Description of Artificial Sequence: Synthetic peptide
  Seed: AVFDEWLRR (TYRP1_HUMAN)
AAFDEWLRF

SEQ ID NO: 169087 - protein, 10 aa, Artificial Sequence
  Description of Artificial Sequence: Synthetic peptide
  Seed: SMDEANQPLL (TYRP1_HUMAN)
SVDEANQPLL

SEQ ID NO: 169088 - protein, 10 aa, Artificial Sequence
  Description of Artificial Sequence: Synthetic peptide
  Seed: YSVKKTFLGV (TYRP1_HUMAN)
YLVKKTFLGV

SEQ ID NO: 169089 - protein, 10 aa, Artificial Sequence
  Description of Artificial Sequence: Synthetic peptide
  Seed: YNYFVWTHYY (TYRP1_HUMAN)
YQYFVWTHYG

SEQ ID NO: 169090 - protein, 10 aa, Artificial Sequence
  Description of Artificial Sequence: Synthetic peptide
  Seed: VALIFGTASY (TYRP1_HUMAN)
VPLIFGTASM

SEQ ID NO: 169091 - protein, 9 aa, Artificial Sequence
  Description of Artificial Sequence: Synthetic peptide
  Seed: SMDEANQPL (TYRP1_HUMAN)
SCDEANQPM

SEQ ID NO: 169092 - protein, 10 aa, Artificial Sequence
  Description of Artificial Sequence: Synthetic peptide
  Seed: FVRALDMAKR (TYRP1_HUMAN)
FYRALDMAKR

SEQ ID NO: 169093 - protein, 9 aa, Artificial Sequence
  Description of Artificial Sequence: Synthetic peptide
  Seed: FGTASYLIR (TYRP1_HUMAN)
FTTASYLIK

SEQ ID NO: 169094 - protein, 9 aa, Artificial Sequence
  Description of Artificial Sequence: Synthetic peptide
  Seed: FVWTHYYSV (TYRP1_HUMAN)
FSWTHYYSL

SEQ ID NO: 169095 - protein, 10 aa, Artificial Sequence
  Description of Artificial Sequence: Synthetic peptide
  Seed: TASYLIRARR (TYRP1_HUMAN)
TVSYLIRARK

SEQ ID NO: 169096 - protein, 8 aa, Artificial Sequence
  Description of Artificial Sequence: Synthetic peptide
  Seed: SIYNYFVW (TYRP1_HUMAN)
SSYNYFVW

SEQ ID NO: 169097 - protein, 9 aa, Artificial Sequence
  Description of Artificial Sequence: Synthetic peptide
  Seed: NFDSTLISP (TYRP1_HUMAN)
NMDSTLISF

SEQ ID NO: 169098 - protein, 10 aa, Artificial Sequence
  Description of Artificial Sequence: Synthetic peptide
  Seed: GNVARPMVQR (TYRP1_HUMAN)
GVVARPMVQK

SEQ ID NO: 169099 - protein, 11 aa, Artificial Sequence
  Description of Artificial Sequence: Synthetic peptide
  Seed: AFLTWHRYHLL (TYRP1_HUMAN)
AMLTWHRYHLI

SEQ ID NO: 169100 - protein, 9 aa, Artificial Sequence
  Description of Artificial Sequence: Synthetic peptide
  Seed: LLHTFTDAV (TYRP1_HUMAN)
LVHTFTDAI

SEQ ID NO: 169101 - protein, 9 aa, Artificial Sequence
  Description of Artificial Sequence: Synthetic peptide
  Seed: DLMGSRSNF (TYRP1_HUMAN)
DVMGSRSNF

SEQ ID NO: 169102 - protein, 9 aa, Artificial Sequence
  Description of Artificial Sequence: Synthetic peptide
  Seed: AVRSLHNLA (TYRP1_HUMAN)
ANRSLHNLK

SEQ ID NO: 169103 - protein, 11 aa, Artificial Sequence
  Description of Artificial Sequence: Synthetic peptide
  Seed: VLLHTFTDAVF (TYRP1_HUMAN)
VMLHTFTDAVF

SEQ ID NO: 169104 - protein, 10 aa, Artificial Sequence
  Description of Artificial Sequence: Synthetic peptide
  Seed: YNMVPFWPPV (TYRP1_HUMAN)
YMMVPFWPPI

SEQ ID NO: 169105 - protein, 9 aa, Artificial Sequence
  Description of Artificial Sequence: Synthetic peptide
  Seed: RRNPAGNVA (TYRP1_HUMAN)
RQNPAGNVL

SEQ ID NO: 169106 - protein, 10 aa, Artificial Sequence
  Description of Artificial Sequence: Synthetic peptide
  Seed: HNRQYNMVPF (TYRP1_HUMAN)
HMRQYNMVPF

SEQ ID NO: 169107 - protein, 10 aa, Artificial Sequence
  Description of Artificial Sequence: Synthetic peptide
  Seed: RRYNADISTF (TYRP1_HUMAN)
RVYNADISTM

SEQ ID NO: 169108 - protein, 10 aa, Artificial Sequence
  Description of Artificial Sequence: Synthetic peptide
  Seed: KLLSLGCIFF (TYRP1_HUMAN)
KLLSLGCIFW

SEQ ID NO: 169109 - protein, 11 aa, Artificial Sequence
  Description of Artificial Sequence: Synthetic peptide
  Seed: FWPPVTNTEMF (TYRP1_HUMAN)
FFPPVTNTEMF

SEQ ID NO: 169110 - protein, 9 aa, Artificial Sequence
  Description of Artificial Sequence: Synthetic peptide
  Seed: LQNPNQSVV (TYRP1_HUMAN)
LENPNQSVY

SEQ ID NO: 169111 - protein, 10 aa, Artificial Sequence
  Description of Artificial Sequence: Synthetic peptide
  Seed: STFPLENAPI (TYRP1_HUMAN)
SMFPLENAPA

SEQ ID NO: 169112 - protein, 9 aa, Artificial Sequence
  Description of Artificial Sequence: Synthetic peptide
  Seed: RQYNMVPFW (TYRP1_HUMAN)
RAYNMVPFI

SEQ ID NO: 169113 - protein, 9 aa, Artificial Sequence
  Description of Artificial Sequence: Synthetic peptide
  Seed: ENISIYNYF (TYRP1_HUMAN)
ESISIYNYY

SEQ ID NO: 169114 - protein, 9 aa, Artificial Sequence
  Description of Artificial Sequence: Synthetic peptide
  Seed: FTDAVFDEW (TYRP1_HUMAN)
FTDAVFDEM

SEQ ID NO: 169115 - protein, 9 aa, Artificial Sequence
  Description of Artificial Sequence: Synthetic peptide
  Seed: TAPDNLGYT (TYRP1_HUMAN)
TCPDNLGYL

SEQ ID NO: 169116 - protein, 9 aa, Artificial Sequence
  Description of Artificial Sequence: Synthetic peptide
  Seed: MAKRTTHPL (TYRP1_HUMAN)
MSKRTTHPY

SEQ ID NO: 169117 - protein, 10 aa, Artificial Sequence
  Description of Artificial Sequence: Synthetic peptide
  Seed: THPLFVIATR (TYRP1_HUMAN)
TAPLFVIATK

SEQ ID NO: 169118 - protein, 9 aa, Artificial Sequence
  Description of Artificial Sequence: Synthetic peptide
  Seed: DNLGYTYEI (TYRP1_HUMAN)
DMLGYTYEV

SEQ ID NO: 169119 - protein, 9 aa, Artificial Sequence
  Description of Artificial Sequence: Synthetic peptide
  Seed: VGLFDTPPF (TYRP1_HUMAN)
VTLFDTPPW

SEQ ID NO: 169120 - protein, 9 aa, Artificial Sequence
  Description of Artificial Sequence: Synthetic peptide
  Seed: ALIFGTASY (TYRP1_HUMAN)
ASIFGTASL

SEQ ID NO: 169121 - protein, 9 aa, Artificial Sequence
  Description of Artificial Sequence: Synthetic peptide
  Seed: FPRQCATVE (TYRP1_HUMAN)
FPRQCATVP

SEQ ID NO: 169122 - protein, 10 aa, Artificial Sequence
  Description of Artificial Sequence: Synthetic peptide
  Seed: EMLQEPSFSL (TYRP1_HUMAN)
EMLQEPSFSV

SEQ ID NO: 169123 - protein, 9 aa, Artificial Sequence
  Description of Artificial Sequence: Synthetic peptide
  Seed: RFFNRTCHC (TYRP1_HUMAN)
RSFNRTCHA

SEQ ID NO: 169124 - protein, 10 aa, Artificial Sequence
  Description of Artificial Sequence: Synthetic peptide
  Seed: SPNDPIFVLL (TYRP1_HUMAN)
SLNDPIFVLL

SEQ ID NO: 169125 - protein, 9 aa, Artificial Sequence
  Description of Artificial Sequence: Synthetic peptide
  Seed: NMVPFWPPV (TYRP1_HUMAN)
NQVPFWPPI

SEQ ID NO: 169126 - protein, 9 aa, Artificial Sequence
  Description of Artificial Sequence: Synthetic peptide
  Seed: QEMLQEPSF (TYRP1_HUMAN)
QKMLQEPSF

SEQ ID NO: 169127 - protein, 10 aa, Artificial Sequence
  Description of Artificial Sequence: Synthetic peptide
  Seed: NYFVWTHYYS (TYRP1_HUMAN)
NVFVWTHYYY

SEQ ID NO: 169128 - protein, 9 aa, Artificial Sequence
  Description of Artificial Sequence: Synthetic peptide
  Seed: NMVPFWPPV (TYRP1_HUMAN)
NYVPFWPPI

SEQ ID NO: 169129 - protein, 9 aa, Artificial Sequence
  Description of Artificial Sequence: Synthetic peptide
  Seed: LTDQYQCYA (TYRP1_HUMAN)
LVDQYQCYL

SEQ ID NO: 169130 - protein, 9 aa, Artificial Sequence
  Description of Artificial Sequence: Synthetic peptide
  Seed: YYSVKKTFL (TYRP1_HUMAN)
YASVKKTFV

SEQ ID NO: 169131 - protein, 10 aa, Artificial Sequence
  Description of Artificial Sequence: Synthetic peptide
  Seed: YFVWTHYYSV (TYRP1_HUMAN)
YQVWTHYYSV

SEQ ID NO: 169132 - protein, 9 aa, Artificial Sequence
  Description of Artificial Sequence: Synthetic peptide
  Seed: MLQEPSFSL (TYRP1_HUMAN)
MYQEPSFSF

SEQ ID NO: 169133 - protein, 10 aa, Artificial Sequence
  Description of Artificial Sequence: Synthetic peptide
  Seed: LGPDGNTPQF (TYRP1_HUMAN)
LMPDGNTPQI

SEQ ID NO: 169134 - protein, 9 aa, Artificial Sequence
  Description of Artificial Sequence: Synthetic peptide
  Seed: RSLHNLAHL (TYRP1_HUMAN)
RSLHNLAHK

SEQ ID NO: 169135 - protein, 10 aa, Artificial Sequence
  Description of Artificial Sequence: Synthetic peptide
  Seed: ENISIYNYFV (TYRP1_HUMAN)
EAISIYNYFV

SEQ ID NO: 169136 - protein, 9 aa, Artificial Sequence
  Description of Artificial Sequence: Synthetic peptide
  Seed: ASYLIRARR (TYRP1_HUMAN)
AGYLIRARR

SEQ ID NO: 169137 - protein, 10 aa, Artificial Sequence
  Description of Artificial Sequence: Synthetic peptide
  Seed: YNMVPFWPPV (TYRP1_HUMAN)
YHMVPFWPPM

SEQ ID NO: 169138 - protein, 10 aa, Artificial Sequence
  Description of Artificial Sequence: Synthetic peptide
  Seed: GNVARPMVQR (TYRP1_HUMAN)
GRVARPMVQK

SEQ ID NO: 169139 - protein, 9 aa, Artificial Sequence
  Description of Artificial Sequence: Synthetic peptide
  Seed: RVLIVRRNL (TYRP1_HUMAN)
RILIVRRNY

SEQ ID NO: 169140 - protein, 10 aa, Artificial Sequence
  Description of Artificial Sequence: Synthetic peptide
  Seed: RYNADISTFP (TYRP1_HUMAN)
RWNADISTFW

SEQ ID NO: 169141 - protein, 9 aa, Artificial Sequence
  Description of Artificial Sequence: Synthetic peptide
  Seed: SVPEIIAIA (TYRP1_HUMAN)
SQPEIIAIM

SEQ ID NO: 169142 - protein, 10 aa, Artificial Sequence
  Description of Artificial Sequence: Synthetic peptide
  Seed: KLLSLGCIFF (TYRP1_HUMAN)
KYLSLGCIFF

SEQ ID NO: 169143 - protein, 10 aa, Artificial Sequence
  Description of Artificial Sequence: Synthetic peptide
  Seed: IIAIAVVGAL (TYRP1_HUMAN)
IMAIAVVGAI

SEQ ID NO: 169144 - protein, 9 aa, Artificial Sequence
  Description of Artificial Sequence: Synthetic peptide
  Seed: RVLIVRRNL (TYRP1_HUMAN)
RALIVRRNK

SEQ ID NO: 169145 - protein, 10 aa, Artificial Sequence
  Description of Artificial Sequence: Synthetic peptide
  Seed: LSLGCIFFPL (TYRP1_HUMAN)
LLLGCIFFPV

SEQ ID NO: 169146 - protein, 11 aa, Artificial Sequence
  Description of Artificial Sequence: Synthetic peptide
  Seed: FWPPVTNTEMF (TYRP1_HUMAN)
FSPPVTNTEMW

SEQ ID NO: 169147 - protein, 10 aa, Artificial Sequence
  Description of Artificial Sequence: Synthetic peptide
  Seed: LLLVALIFGT (TYRP1_HUMAN)
LYLVALIFGV

SEQ ID NO: 169148 - protein, 9 aa, Artificial Sequence
  Description of Artificial Sequence: Synthetic peptide
  Seed: TASYLIRAR (TYRP1_HUMAN)
TASYLIRAK

SEQ ID NO: 169149 - protein, 9 aa, Artificial Sequence
  Description of Artificial Sequence: Synthetic peptide
  Seed: VWPLRFFNR (TYRP1_HUMAN)
VTPLRFFNR

SEQ ID NO: 169150 - protein, 10 aa, Artificial Sequence
  Description of Artificial Sequence: Synthetic peptide
  Seed: FSLPYWNFAT (TYRP1_HUMAN)
FRLPYWNFAM

SEQ ID NO: 169151 - protein, 9 aa, Artificial Sequence
  Description of Artificial Sequence: Synthetic peptide
  Seed: FSHEGPAFL (TYRP1_HUMAN)
FVHEGPAFT

SEQ ID NO: 169152 - protein, 9 aa, Artificial Sequence
  Description of Artificial Sequence: Synthetic peptide
  Seed: KLLSLGCIF (TYRP1_HUMAN)
KQLSLGCIH

SEQ ID NO: 169153 - protein, 11 aa, Artificial Sequence
  Description of Artificial Sequence: Synthetic peptide
  Seed: YNMVPFWPPVT (TYRP1_HUMAN)
YMMVPFWPPVH

SEQ ID NO: 169154 - protein, 9 aa, Artificial Sequence
  Description of Artificial Sequence: Synthetic peptide
  Seed: RYHLLRLEK (TYRP1_HUMAN)
RMHLLRLEV

SEQ ID NO: 169155 - protein, 10 aa, Artificial Sequence
  Description of Artificial Sequence: Synthetic peptide
  Seed: YNADISTFPL (TYRP1_HUMAN)
YQADISTFPL

SEQ ID NO: 169156 - protein, 9 aa, Artificial Sequence
  Description of Artificial Sequence: Synthetic peptide
  Seed: NMVPFWPPV (TYRP1_HUMAN)
NVVPFWPPL

SEQ ID NO: 169157 - protein, 9 aa, Artificial Sequence
  Description of Artificial Sequence: Synthetic peptide
  Seed: REVWPLRFF (TYRP1_HUMAN)
RHVWPLRFY

SEQ ID NO: 169158 - protein, 10 aa, Artificial Sequence
  Description of Artificial Sequence: Synthetic peptide
  Seed: QFENISIYNY (TYRP1_HUMAN)
QFENISIYNW

SEQ ID NO: 169159 - protein, 9 aa, Artificial Sequence
  Description of Artificial Sequence: Synthetic peptide
  Seed: EGYSDPTGK (TYRP1_HUMAN)
EWYSDPTGR

SEQ ID NO: 169160 - protein, 9 aa, Artificial Sequence
  Description of Artificial Sequence: Synthetic peptide
  Seed: KYDPAVRSL (TYRP1_HUMAN)
KHDPAVRSL

SEQ ID NO: 169161 - protein, 10 aa, Artificial Sequence
  Description of Artificial Sequence: Synthetic peptide
  Seed: FFPLLLFQQA (TYRP1_HUMAN)
FHPLLLFQQA

SEQ ID NO: 169162 - protein, 9 aa, Artificial Sequence
  Description of Artificial Sequence: Synthetic peptide
  Seed: TFPLENAPI (TYRP1_HUMAN)
TFPLENAPY

SEQ ID NO: 169163 - protein, 11 aa, Artificial Sequence
  Description of Artificial Sequence: Synthetic peptide
  Seed: MFVTAPDNLGY (TYRP1_HUMAN)
MCVTAPDNLGF

SEQ ID NO: 169164 - protein, 9 aa, Artificial Sequence
  Description of Artificial Sequence: Synthetic peptide
  Seed: ENISIYNYF (TYRP1_HUMAN)
EAISIYNYF

SEQ ID NO: 169165 - protein, 8 aa, Artificial Sequence
  Description of Artificial Sequence: Synthetic peptide
  Seed: IQWPSREF (TYRP1_HUMAN)
IMWPSREY

SEQ ID NO: 169166 - protein, 9 aa, Artificial Sequence
  Description of Artificial Sequence: Synthetic peptide
  Seed: FSHEGPAFL (TYRP1_HUMAN)
FMHEGPAFI

SEQ ID NO: 169167 - protein, 10 aa, Artificial Sequence
  Description of Artificial Sequence: Synthetic peptide
  Seed: MLQEPSFSLP (TYRP1_HUMAN)
MVQEPSFSLV

SEQ ID NO: 169168 - protein, 10 aa, Artificial Sequence
  Description of Artificial Sequence: Synthetic peptide
  Seed: YNYFVWTHYY (TYRP1_HUMAN)
YRYFVWTHYM

SEQ ID NO: 169169 - protein, 9 aa, Artificial Sequence
  Description of Artificial Sequence: Synthetic peptide
  Seed: IAIAVVGAL (TYRP1_HUMAN)
ITIAVVGAA

SEQ ID NO: 169170 - protein, 9 aa, Artificial Sequence
  Description of Artificial Sequence: Synthetic peptide
  Seed: MSAPKLLSL (TYRP1_HUMAN)
MTAPKLLSW

SEQ ID NO: 169171 - protein, 9 aa, Artificial Sequence
  Description of Artificial Sequence: Synthetic peptide
  Seed: EGYSDPTGK (TYRP1_HUMAN)
EGYSDPTGR

SEQ ID NO: 169172 - protein, 10 aa, Artificial Sequence
  Description of Artificial Sequence: Synthetic peptide
  Seed: GPAFLTWHRY (TYRP1_HUMAN)
GIAFLTWHRY

SEQ ID NO: 169173 - protein, 9 aa, Artificial Sequence
  Description of Artificial Sequence: Synthetic peptide
  Seed: RARRSMDEA (TYRP1_HUMAN)
RMRRSMDEK

SEQ ID NO: 169174 - protein, 10 aa, Artificial Sequence
  Description of Artificial Sequence: Synthetic peptide
  Seed: TPQFENISIY (TYRP1_HUMAN)
TRQFENISIY

SEQ ID NO: 169175 - protein, 10 aa, Artificial Sequence
  Description of Artificial Sequence: Synthetic peptide
  Seed: FWPPVTNTEM (TYRP1_HUMAN)
FSPPVTNTEL

SEQ ID NO: 169176 - protein, 10 aa, Artificial Sequence
  Description of Artificial Sequence: Synthetic peptide
  Seed: QFENISIYNY (TYRP1_HUMAN)
QTENISIYNW

SEQ ID NO: 169177 - protein, 10 aa, Artificial Sequence
  Description of Artificial Sequence: Synthetic peptide
  Seed: RVLIVRRNLL (TYRP1_HUMAN)
RFLIVRRNLK

SEQ ID NO: 169178 - protein, 10 aa, Artificial Sequence
  Description of Artificial Sequence: Synthetic peptide
  Seed: RVLIVRRNLL (TYRP1_HUMAN)
RVLIVRRNLK

SEQ ID NO: 169179 - protein, 9 aa, Artificial Sequence
  Description of Artificial Sequence: Synthetic peptide
  Seed: YNYFVWTHY (TYRP1_HUMAN)
YVYFVWTHY

SEQ ID NO: 169180 - protein, 10 aa, Artificial Sequence
  Description of Artificial Sequence: Synthetic peptide
  Seed: YNYFVWTHYY (TYRP1_HUMAN)
YFYFVWTHYT

SEQ ID NO: 169181 - protein, 10 aa, Artificial Sequence
  Description of Artificial Sequence: Synthetic peptide
  Seed: DAVFDEWLRR (TYRP1_HUMAN)
DYVFDEWLRR

SEQ ID NO: 169182 - protein, 11 aa, Artificial Sequence
  Description of Artificial Sequence: Synthetic peptide
  Seed: FVLLHTFTDAV (TYRP1_HUMAN)
FGLLHTFTDAL

SEQ ID NO: 169183 - protein, 10 aa, Artificial Sequence
  Description of Artificial Sequence: Synthetic peptide
  Seed: TASYLIRARR (TYRP1_HUMAN)
TNSYLIRARR

SEQ ID NO: 169184 - protein, 11 aa, Artificial Sequence
  Description of Artificial Sequence: Synthetic peptide
  Seed: FWPPVTNTEMF (TYRP1_HUMAN)
FPPPVTNTEMY

SEQ ID NO: 169185 - protein, 9 aa, Artificial Sequence
  Description of Artificial Sequence: Synthetic peptide
  Seed: SVPEIIAIA (TYRP1_HUMAN)
SIPEIIAIA

SEQ ID NO: 169186 - protein, 10 aa, Artificial Sequence
  Description of Artificial Sequence: Synthetic peptide
  Seed: YTYEIQWPSR (TYRP1_HUMAN)
YWYEIQWPSR

SEQ ID NO: 169187 - protein, 10 aa, Artificial Sequence
  Description of Artificial Sequence: Synthetic peptide
  Seed: LPYWNFATGK (TYRP1_HUMAN)
LSYWNFATGR

SEQ ID NO: 169188 - protein, 9 aa, Artificial Sequence
  Description of Artificial Sequence: Synthetic peptide
  Seed: YTYEIQWPS (TYRP1_HUMAN)
YGYEIQWPL

SEQ ID NO: 169189 - protein, 9 aa, Artificial Sequence
  Description of Artificial Sequence: Synthetic peptide
  Seed: IAIAVVGAL (TYRP1_HUMAN)
ILIAVVGAM

SEQ ID NO: 169190 - protein, 9 aa, Artificial Sequence
  Description of Artificial Sequence: Synthetic peptide
  Seed: KYDPAVRSL (TYRP1_HUMAN)
KQDPAVRSF

SEQ ID NO: 169191 - protein, 9 aa, Artificial Sequence
  Description of Artificial Sequence: Synthetic peptide
  Seed: SMDEANQPL (TYRP1_HUMAN)
SCDEANQPV

SEQ ID NO: 169192 - protein, 9 aa, Artificial Sequence
  Description of Artificial Sequence: Synthetic peptide
  Seed: SPVSGPGTD (TYRP1_HUMAN)
SPVSGPGTI

SEQ ID NO: 169193 - protein, 9 aa, Artificial Sequence
  Description of Artificial Sequence: Synthetic peptide
  Seed: SVPEIIAIA (TYRP1_HUMAN)
SSPEIIAIR

SEQ ID NO: 169194 - protein, 9 aa, Artificial Sequence
  Description of Artificial Sequence: Synthetic peptide
  Seed: YTYEIQWPS (TYRP1_HUMAN)
YCYEIQWPL

SEQ ID NO: 169195 - protein, 11 aa, Artificial Sequence
  Description of Artificial Sequence: Synthetic peptide
  Seed: QEMLQEPSFSL (TYRP1_HUMAN)
QMMLQEPSFSA

SEQ ID NO: 169196 - protein, 11 aa, Artificial Sequence
  Description of Artificial Sequence: Synthetic peptide
  Seed: KTFLGVGQESF (TYRP1_HUMAN)
KSFLGVGQESW

SEQ ID NO: 169197 - protein, 9 aa, Artificial Sequence
  Description of Artificial Sequence: Synthetic peptide
  Seed: AVFDEWLRR (TYRP1_HUMAN)
ALFDEWLRR

SEQ ID NO: 169198 - protein, 9 aa, Artificial Sequence
  Description of Artificial Sequence: Synthetic peptide
  Seed: KLLSLGCIF (TYRP1_HUMAN)
KQLSLGCIY

SEQ ID NO: 169199 - protein, 9 aa, Artificial Sequence
  Description of Artificial Sequence: Synthetic peptide
  Seed: SFSLPYWNF (TYRP1_HUMAN)
SWSLPYWNL

SEQ ID NO: 169200 - protein, 10 aa, Artificial Sequence
  Description of Artificial Sequence: Synthetic peptide
  Seed: LLLVALIFGT (TYRP1_HUMAN)
LKLVALIFGL

SEQ ID NO: 169201 - protein, 9 aa, Artificial Sequence
  Description of Artificial Sequence: Synthetic peptide
  Seed: KLQNPNQSV (TYRP1_HUMAN)
KVQNPNQSL

SEQ ID NO: 169202 - protein, 10 aa, Artificial Sequence
  Description of Artificial Sequence: Synthetic peptide
  Seed: FFPLLLFQQA (TYRP1_HUMAN)
FWPLLLFQQA

SEQ ID NO: 169203 - protein, 9 aa, Artificial Sequence
  Description of Artificial Sequence: Synthetic peptide
  Seed: IIAIAVVGA (TYRP1_HUMAN)
ILAIAVVGL

SEQ ID NO: 169204 - protein, 8 aa, Artificial Sequence
  Description of Artificial Sequence: Synthetic peptide
  Seed: FSHEGPAF (TYRP1_HUMAN)
FGHEGPAL

SEQ ID NO: 169205 - protein, 9 aa, Artificial Sequence
  Description of Artificial Sequence: Synthetic peptide
  Seed: TFPLENAPI (TYRP1_HUMAN)
TFPLENAPF

SEQ ID NO: 169206 - protein, 10 aa, Artificial Sequence
  Description of Artificial Sequence: Synthetic peptide
  Seed: YNADISTFPL (TYRP1_HUMAN)
YMADISTFPC

SEQ ID NO: 169207 - protein, 9 aa, Artificial Sequence
  Description of Artificial Sequence: Synthetic peptide
  Seed: SVPEIIAIA (TYRP1_HUMAN)
SSPEIIAIL

SEQ ID NO: 169208 - protein, 10 aa, Artificial Sequence
  Description of Artificial Sequence: Synthetic peptide
  Seed: RSLHNLAHLF (TYRP1_HUMAN)
RTLHNLAHLF

SEQ ID NO: 169209 - protein, 10 aa, Artificial Sequence
  Description of Artificial Sequence: Synthetic peptide
  Seed: FVWTHYYSVK (TYRP1_HUMAN)
FLWTHYYSVF

SEQ ID NO: 169210 - protein, 10 aa, Artificial Sequence
  Description of Artificial Sequence: Synthetic peptide
  Seed: VLLHTFTDAV (TYRP1_HUMAN)
VVLHTFTDAV

SEQ ID NO: 169211 - protein, 11 aa, Artificial Sequence
  Description of Artificial Sequence: Synthetic peptide
  Seed: YNYFVWTHYYS (TYRP1_HUMAN)
YMYFVWTHYYG

SEQ ID NO: 169212 - protein, 9 aa, Artificial Sequence
  Description of Artificial Sequence: Synthetic peptide
  Seed: LIFGTASYL (TYRP1_HUMAN)
LTFGTASYR

SEQ ID NO: 169213 - protein, 9 aa, Artificial Sequence
  Description of Artificial Sequence: Synthetic peptide
  Seed: FPLENAPIG (TYRP1_HUMAN)
FPLENAPIH

SEQ ID NO: 169214 - protein, 10 aa, Artificial Sequence
  Description of Artificial Sequence: Synthetic peptide
  Seed: YNYFVWTHYY (TYRP1_HUMAN)
YIYFVWTHYF

SEQ ID NO: 169215 - protein, 10 aa, Artificial Sequence
  Description of Artificial Sequence: Synthetic peptide
  Seed: ISPNSVFSQW (TYRP1_HUMAN)
IVPNSVFSQW

SEQ ID NO: 169216 - protein, 9 aa, Artificial Sequence
  Description of Artificial Sequence: Synthetic peptide
  Seed: MSAPKLLSL (TYRP1_HUMAN)
MLAPKLLSF

SEQ ID NO: 169217 - protein, 9 aa, Artificial Sequence
  Description of Artificial Sequence: Synthetic peptide
  Seed: MAKRTTHPL (TYRP1_HUMAN)
MMKRTTHPK

SEQ ID NO: 169218 - protein, 8 aa, Artificial Sequence
  Description of Artificial Sequence: Synthetic peptide
  Seed: ACDQRVLI (TYRP1_HUMAN)
ALDQRVLL

SEQ ID NO: 169219 - protein, 9 aa, Artificial Sequence
  Description of Artificial Sequence: Synthetic peptide
  Seed: NADISTFPL (TYRP1_HUMAN)
NIDISTFPM

SEQ ID NO: 169220 - protein, 9 aa, Artificial Sequence
  Description of Artificial Sequence: Synthetic peptide
  Seed: DDREVWPLR (TYRP1_HUMAN)
DFREVWPLK

SEQ ID NO: 169221 - protein, 9 aa, Artificial Sequence
  Description of Artificial Sequence: Synthetic peptide
  Seed: STNSFRNTV (TYRP1_HUMAN)
SLNSFRNTF

SEQ ID NO: 169222 - protein, 9 aa, Artificial Sequence
  Description of Artificial Sequence: Synthetic peptide
  Seed: LTWHRYHLL (TYRP1_HUMAN)
LRWHRYHLF

SEQ ID NO: 169223 - protein, 10 aa, Artificial Sequence
  Description of Artificial Sequence: Synthetic peptide
  Seed: FLNGTGGQTH (TYRP1_HUMAN)
FINGTGGQTM

SEQ ID NO: 169224 - protein, 9 aa, Artificial Sequence
  Description of Artificial Sequence: Synthetic peptide
  Seed: ALIFGTASY (TYRP1_HUMAN)
ASIFGTASK

SEQ ID NO: 169225 - protein, 10 aa, Artificial Sequence
  Description of Artificial Sequence: Synthetic peptide
  Seed: ADSRPHSPQY (TYRP1_HUMAN)
ANSRPHSPQV

SEQ ID NO: 169226 - protein, 11 aa, Artificial Sequence
  Description of Artificial Sequence: Synthetic peptide
  Seed: AFLTWHRYHLL (TYRP1_HUMAN)
AMLTWHRYHLV

SEQ ID NO: 169227 - protein, 11 aa, Artificial Sequence
  Description of Artificial Sequence: Synthetic peptide
  Seed: REFSVPEIIAI (TYRP1_HUMAN)
RSFSVPEIIAM

SEQ ID NO: 169228 - protein, 9 aa, Artificial Sequence
  Description of Artificial Sequence: Synthetic peptide
  Seed: KLLSLGCIF (TYRP1_HUMAN)
KKLSLGCIY

SEQ ID NO: 169229 - protein, 9 aa, Artificial Sequence
  Description of Artificial Sequence: Synthetic peptide
  Seed: RTTHPLFVI (TYRP1_HUMAN)
RNTHPLFVY

SEQ ID NO: 169230 - protein, 11 aa, Artificial Sequence
  Description of Artificial Sequence: Synthetic peptide
  Seed: YNMVPFWPPVT (TYRP1_HUMAN)
YMMVPFWPPVA

SEQ ID NO: 169231 - protein, 10 aa, Artificial Sequence
  Description of Artificial Sequence: Synthetic peptide
  Seed: AVVGALLLVA (TYRP1_HUMAN)
AQVGALLLVV

SEQ ID NO: 169232 - protein, 9 aa, Artificial Sequence
  Description of Artificial Sequence: Synthetic peptide
  Seed: FSVPEIIAI (TYRP1_HUMAN)
FPVPEIIAI

SEQ ID NO: 169233 - protein, 9 aa, Artificial Sequence
  Description of Artificial Sequence: Synthetic peptide
  Seed: FSLPYWNFA (TYRP1_HUMAN)
FILPYWNFI

SEQ ID NO: 169234 - protein, 10 aa, Artificial Sequence
  Description of Artificial Sequence: Synthetic peptide
  Seed: MLQEPSFSLP (TYRP1_HUMAN)
MMQEPSFSLV

SEQ ID NO: 169235 - protein, 9 aa, Artificial Sequence
  Description of Artificial Sequence: Synthetic peptide
  Seed: NFDSTLISP (TYRP1_HUMAN)
NIDSTLISM

SEQ ID NO: 169236 - protein, 9 aa, Artificial Sequence
  Description of Artificial Sequence: Synthetic peptide
  Seed: QEMLQEPSF (TYRP1_HUMAN)
QLMLQEPSF

SEQ ID NO: 169237 - protein, 9 aa, Artificial Sequence
  Description of Artificial Sequence: Synthetic peptide
  Seed: RSLHNLAHL (TYRP1_HUMAN)
RTLHNLAHM

SEQ ID NO: 169238 - protein, 8 aa, Artificial Sequence
  Description of Artificial Sequence: Synthetic peptide
  Seed: VSGPGTDR (TYRP1_HUMAN)
VSGPGTDL

SEQ ID NO: 169239 - protein, 9 aa, Artificial Sequence
  Description of Artificial Sequence: Synthetic peptide
  Seed: CIFFPLLLF (TYRP1_HUMAN)
CSFFPLLLF

SEQ ID NO: 169240 - protein, 10 aa, Artificial Sequence
  Description of Artificial Sequence: Synthetic peptide
  Seed: FSLPYWNFAT (TYRP1_HUMAN)
FGLPYWNFAI

SEQ ID NO: 169241 - protein, 10 aa, Artificial Sequence
  Description of Artificial Sequence: Synthetic peptide
  Seed: SIYNYFVWTH (TYRP1_HUMAN)
SHYNYFVWTR

SEQ ID NO: 169242 - protein, 10 aa, Artificial Sequence
  Description of Artificial Sequence: Synthetic peptide
  Seed: WPPVTNTEMF (TYRP1_HUMAN)
WAPVTNTEMW

SEQ ID NO: 169243 - protein, 9 aa, Artificial Sequence
  Description of Artificial Sequence: Synthetic peptide
  Seed: GPDGNTPQF (TYRP1_HUMAN)
GIDGNTPQL

SEQ ID NO: 169244 - protein, 9 aa, Artificial Sequence
  Description of Artificial Sequence: Synthetic peptide
  Seed: LQNPNQSVV (TYRP1_HUMAN)
LPNPNQSVY

SEQ ID NO: 169245 - protein, 9 aa, Artificial Sequence
  Description of Artificial Sequence: Synthetic peptide
  Seed: VFDEWLRRY (TYRP1_HUMAN)
VVDEWLRRV

SEQ ID NO: 169246 - protein, 9 aa, Artificial Sequence
  Description of Artificial Sequence: Synthetic peptide
  Seed: NRQYNMVPF (TYRP1_HUMAN)
NYQYNMVPL

SEQ ID NO: 169247 - protein, 9 aa, Artificial Sequence
  Description of Artificial Sequence: Synthetic peptide
  Seed: RQYNMVPFW (TYRP1_HUMAN)
REYNMVPFF

SEQ ID NO: 169248 - protein, 9 aa, Artificial Sequence
  Description of Artificial Sequence: Synthetic peptide
  Seed: RGRCEAVTA (TYRP1_HUMAN)
RTRCEAVTK

SEQ ID NO: 169249 - protein, 10 aa, Artificial Sequence
  Description of Artificial Sequence: Synthetic peptide
  Seed: HLSPNDPIFV (TYRP1_HUMAN)
HMSPNDPIFV

SEQ ID NO: 169250 - protein, 9 aa, Artificial Sequence
  Description of Artificial Sequence: Synthetic peptide
  Seed: THPLFVIAT (TYRP1_HUMAN)
THPLFVIAA

SEQ ID NO: 169251 - protein, 11 aa, Artificial Sequence
  Description of Artificial Sequence: Synthetic peptide
  Seed: YNMVPFWPPVT (TYRP1_HUMAN)
YMMVPFWPPVY

SEQ ID NO: 169252 - protein, 9 aa, Artificial Sequence
  Description of Artificial Sequence: Synthetic peptide
  Seed: WPPVTNTEM (TYRP1_HUMAN)
WIPVTNTEY

SEQ ID NO: 169253 - protein, 10 aa, Artificial Sequence
  Description of Artificial Sequence: Synthetic peptide
  Seed: LLHTFTDAVF (TYRP1_HUMAN)
LLHTFTDAVY

SEQ ID NO: 169254 - protein, 10 aa, Artificial Sequence
  Description of Artificial Sequence: Synthetic peptide
  Seed: VALIFGTASY (TYRP1_HUMAN)
VQLIFGTASM

SEQ ID NO: 169255 - protein, 9 aa, Artificial Sequence
  Description of Artificial Sequence: Synthetic peptide
  Seed: RSLHNLAHL (TYRP1_HUMAN)
RTLHNLAHV

SEQ ID NO: 169256 - protein, 8 aa, Artificial Sequence
  Description of Artificial Sequence: Synthetic peptide
  Seed: FSHEGPAF (TYRP1_HUMAN)
FFHEGPAM

SEQ ID NO: 169257 - protein, 10 aa, Artificial Sequence
  Description of Artificial Sequence: Synthetic peptide
  Seed: LGPDGNTPQF (TYRP1_HUMAN)
LYPDGNTPQL

SEQ ID NO: 169258 - protein, 9 aa, Artificial Sequence
  Description of Artificial Sequence: Synthetic peptide
  Seed: LQNPNQSVV (TYRP1_HUMAN)
LLNPNQSVL

SEQ ID NO: 169259 - protein, 9 aa, Artificial Sequence
  Description of Artificial Sequence: Synthetic peptide
  Seed: ALIFGTASY (TYRP1_HUMAN)
APIFGTASL

SEQ ID NO: 169260 - protein, 9 aa, Artificial Sequence
  Description of Artificial Sequence: Synthetic peptide
  Seed: RVLIVRRNL (TYRP1_HUMAN)
RTLIVRRNG

SEQ ID NO: 169261 - protein, 9 aa, Artificial Sequence
  Description of Artificial Sequence: Synthetic peptide
  Seed: CYAEEYEKL (TYRP1_HUMAN)
CRAEEYEKF

SEQ ID NO: 169262 - protein, 9 aa, Artificial Sequence
  Description of Artificial Sequence: Synthetic peptide
  Seed: YTYEIQWPS (TYRP1_HUMAN)
YFYEIQWPV

SEQ ID NO: 169263 - protein, 9 aa, Artificial Sequence
  Description of Artificial Sequence: Synthetic peptide
  Seed: LIFGTASYL (TYRP1_HUMAN)
LYFGTASYY

SEQ ID NO: 169264 - protein, 10 aa, Artificial Sequence
  Description of Artificial Sequence: Synthetic peptide
  Seed: RSMDEANQPL (TYRP1_HUMAN)
RTMDEANQPI

SEQ ID NO: 169265 - protein, 9 aa, Artificial Sequence
  Description of Artificial Sequence: Synthetic peptide
  Seed: DSRPHSPQY (TYRP1_HUMAN)
DHRPHSPQY

SEQ ID NO: 169266 - protein, 9 aa, Artificial Sequence
  Description of Artificial Sequence: Synthetic peptide
  Seed: SPNDPIFVL (TYRP1_HUMAN)
SINDPIFVI

SEQ ID NO: 169267 - protein, 10 aa, Artificial Sequence
  Description of Artificial Sequence: Synthetic peptide
  Seed: MVPFWPPVTN (TYRP1_HUMAN)
MGPFWPPVTY

SEQ ID NO: 169268 - protein, 10 aa, Artificial Sequence
  Description of Artificial Sequence: Synthetic peptide
  Seed: TWHRYHLLRL (TYRP1_HUMAN)
TFHRYHLLRF

SEQ ID NO: 169269 - protein, 10 aa, Artificial Sequence
  Description of Artificial Sequence: Synthetic peptide
  Seed: LLTDQYQCYA (TYRP1_HUMAN)
LMTDQYQCYL

SEQ ID NO: 169270 - protein, 9 aa, Artificial Sequence
  Description of Artificial Sequence: Synthetic peptide
  Seed: RTTHPLFVI (TYRP1_HUMAN)
RMTHPLFVK

SEQ ID NO: 169271 - protein, 9 aa, Artificial Sequence
  Description of Artificial Sequence: Synthetic peptide
  Seed: TTHPLFVIA (TYRP1_HUMAN)
TTHPLFVII

SEQ ID NO: 169272 - protein, 10 aa, Artificial Sequence
  Description of Artificial Sequence: Synthetic peptide
  Seed: FSVPEIIAIA (TYRP1_HUMAN)
FIVPEIIAIV

SEQ ID NO: 169273 - protein, 11 aa, Artificial Sequence
  Description of Artificial Sequence: Synthetic peptide
  Seed: SLGCIFFPLLL (TYRP1_HUMAN)
SMGCIFFPLLL

SEQ ID NO: 169274 - protein, 9 aa, Artificial Sequence
  Description of Artificial Sequence: Synthetic peptide
  Seed: LTWHRYHLL (TYRP1_HUMAN)
LFWHRYHLF

SEQ ID NO: 169275 - protein, 9 aa, Artificial Sequence
  Description of Artificial Sequence: Synthetic peptide
  Seed: RQYNMVPFW (TYRP1_HUMAN)
RMYNMVPFL

SEQ ID NO: 169276 - protein, 9 aa, Artificial Sequence
  Description of Artificial Sequence: Synthetic peptide
  Seed: FENISIYNY (TYRP1_HUMAN)
FANISIYNY

SEQ ID NO: 169277 - protein, 9 aa, Artificial Sequence
  Description of Artificial Sequence: Synthetic peptide
  Seed: QCATVEALR (TYRP1_HUMAN)
QVATVEALK

SEQ ID NO: 169278 - protein, 9 aa, Artificial Sequence
  Description of Artificial Sequence: Synthetic peptide
  Seed: IYNYFVWTH (TYRP1_HUMAN)
IFNYFVWTR

SEQ ID NO: 169279 - protein, 9 aa, Artificial Sequence
  Description of Artificial Sequence: Synthetic peptide
  Seed: SFSLPYWNF (TYRP1_HUMAN)
SFSLPYWNW

SEQ ID NO: 169280 - protein, 10 aa, Artificial Sequence
  Description of Artificial Sequence: Synthetic peptide
  Seed: ADSRPHSPQY (TYRP1_HUMAN)
ALSRPHSPQW

SEQ ID NO: 169281 - protein, 8 aa, Artificial Sequence
  Description of Artificial Sequence: Synthetic peptide
  Seed: YSDPTGKY (TYRP1_HUMAN)
YCDPTGKM

SEQ ID NO: 169282 - protein, 10 aa, Artificial Sequence
  Description of Artificial Sequence: Synthetic peptide
  Seed: GNVARPMVQR (TYRP1_HUMAN)
GWVARPMVQK

SEQ ID NO: 169283 - protein, 10 aa, Artificial Sequence
  Description of Artificial Sequence: Synthetic peptide
  Seed: GLFDTPPFYS (TYRP1_HUMAN)
GTFDTPPFYA

SEQ ID NO: 169284 - protein, 10 aa, Artificial Sequence
  Description of Artificial Sequence: Synthetic peptide
  Seed: KRTTHPLFVI (TYRP1_HUMAN)
KETTHPLFVY

SEQ ID NO: 169285 - protein, 9 aa, Artificial Sequence
  Description of Artificial Sequence: Synthetic peptide
  Seed: WPPVTNTEM (TYRP1_HUMAN)
WLPVTNTEY

SEQ ID NO: 169286 - protein, 10 aa, Artificial Sequence
  Description of Artificial Sequence: Synthetic peptide
  Seed: NLAHLFLNGT (TYRP1_HUMAN)
NLAHLFLNGL

SEQ ID NO: 169287 - protein, 9 aa, Artificial Sequence
  Description of Artificial Sequence: Synthetic peptide
  Seed: RGRCEAVTA (TYRP1_HUMAN)
RTRCEAVTV

SEQ ID NO: 169288 - protein, 10 aa, Artificial Sequence
  Description of Artificial Sequence: Synthetic peptide
  Seed: FVLLHTFTDA (TYRP1_HUMAN)
FPLLHTFTDV

SEQ ID NO: 169289 - protein, 11 aa, Artificial Sequence
  Description of Artificial Sequence: Synthetic peptide
  Seed: LVALIFGTASY (TYRP1_HUMAN)
LQALIFGTASF

SEQ ID NO: 169290 - protein, 10 aa, Artificial Sequence
  Description of Artificial Sequence: Synthetic peptide
  Seed: GKYDPAVRSL (TYRP1_HUMAN)
GQYDPAVRSI

SEQ ID NO: 169291 - protein, 9 aa, Artificial Sequence
  Description of Artificial Sequence: Synthetic peptide
  Seed: YLIRARRSM (TYRP1_HUMAN)
YMIRARRSF

SEQ ID NO: 169292 - protein, 10 aa, Artificial Sequence
  Description of Artificial Sequence: Synthetic peptide
  Seed: MLQEPSFSLP (TYRP1_HUMAN)
MMQEPSFSLW

SEQ ID NO: 169293 - protein, 11 aa, Artificial Sequence
  Description of Artificial Sequence: Synthetic peptide
  Seed: YFVWTHYYSVK (TYRP1_HUMAN)
YSVWTHYYSVR

SEQ ID NO: 169294 - protein, 10 aa, Artificial Sequence
  Description of Artificial Sequence: Synthetic peptide
  Seed: ENISIYNYFV (TYRP1_HUMAN)
ETISIYNYFM

SEQ ID NO: 169295 - protein, 9 aa, Artificial Sequence
  Description of Artificial Sequence: Synthetic peptide
  Seed: REFSVPEII (TYRP1_HUMAN)
RIFSVPEII

SEQ ID NO: 169296 - protein, 10 aa, Artificial Sequence
  Description of Artificial Sequence: Synthetic peptide
  Seed: VDFSHEGPAF (TYRP1_HUMAN)
VPFSHEGPAF

SEQ ID NO: 169297 - protein, 9 aa, Artificial Sequence
  Description of Artificial Sequence: Synthetic peptide
  Seed: ISIYNYFVW (TYRP1_HUMAN)
IKIYNYFVL

SEQ ID NO: 169298 - protein, 8 aa, Artificial Sequence
  Description of Artificial Sequence: Synthetic peptide
  Seed: YSDPTGKY (TYRP1_HUMAN)
YDDPTGKL

SEQ ID NO: 169299 - protein, 9 aa, Artificial Sequence
  Description of Artificial Sequence: Synthetic peptide
  Seed: IATRRSEEI (TYRP1_HUMAN)
ISTRRSEEW

SEQ ID NO: 169300 - protein, 10 aa, Artificial Sequence
  Description of Artificial Sequence: Synthetic peptide
  Seed: LGPDGNTPQF (TYRP1_HUMAN)
LFPDGNTPQY

SEQ ID NO: 169301 - protein, 10 aa, Artificial Sequence
  Description of Artificial Sequence: Synthetic peptide
  Seed: MLQEPSFSLP (TYRP1_HUMAN)
MLQEPSFSLY

SEQ ID NO: 169302 - protein, 10 aa, Artificial Sequence
  Description of Artificial Sequence: Synthetic peptide
  Seed: VGLFDTPPFY (TYRP1_HUMAN)
VALFDTPPFK

SEQ ID NO: 169303 - protein, 9 aa, Artificial Sequence
  Description of Artificial Sequence: Synthetic peptide
  Seed: SVPEIIAIA (TYRP1_HUMAN)
SSPEIIAII

SEQ ID NO: 169304 - protein, 10 aa, Artificial Sequence
  Description of Artificial Sequence: Synthetic peptide
  Seed: QFENISIYNY (TYRP1_HUMAN)
QSENISIYNW

SEQ ID NO: 169305 - protein, 10 aa, Artificial Sequence
  Description of Artificial Sequence: Synthetic peptide
  Seed: LSPNDPIFVL (TYRP1_HUMAN)
LLPNDPIFVW

SEQ ID NO: 169306 - protein, 9 aa, Artificial Sequence
  Description of Artificial Sequence: Synthetic peptide
  Seed: LIFGTASYL (TYRP1_HUMAN)
LIFGTASYI

SEQ ID NO: 169307 - protein, 9 aa, Artificial Sequence
  Description of Artificial Sequence: Synthetic peptide
  Seed: NISIYNYFV (TYRP1_HUMAN)
NMSIYNYFI

SEQ ID NO: 169308 - protein, 11 aa, Artificial Sequence
  Description of Artificial Sequence: Synthetic peptide
  Seed: LQEPSFSLPYW (TYRP1_HUMAN)
LPEPSFSLPYW

SEQ ID NO: 169309 - protein, 9 aa, Artificial Sequence
  Description of Artificial Sequence: Synthetic peptide
  Seed: SLGCIFFPL (TYRP1_HUMAN)
STGCIFFPI

SEQ ID NO: 169310 - protein, 10 aa, Artificial Sequence
  Description of Artificial Sequence: Synthetic peptide
  Seed: FTDAVFDEWL (TYRP1_HUMAN)
FTDAVFDEWY

SEQ ID NO: 169311 - protein, 10 aa, Artificial Sequence
  Description of Artificial Sequence: Synthetic peptide
  Seed: RVVCDSLEDY (TYRP1_HUMAN)
RKVCDSLEDY

SEQ ID NO: 169312 - protein, 10 aa, Artificial Sequence
  Description of Artificial Sequence: Synthetic peptide
  Seed: LSPNDPIFVL (TYRP1_HUMAN)
LEPNDPIFVW

SEQ ID NO: 169313 - protein, 10 aa, Artificial Sequence
  Description of Artificial Sequence: Synthetic peptide
  Seed: LGPDGNTPQF (TYRP1_HUMAN)
LSPDGNTPQY

SEQ ID NO: 169314 - protein, 9 aa, Artificial Sequence
  Description of Artificial Sequence: Synthetic peptide
  Seed: FYSNSTNSF (TYRP1_HUMAN)
FASNSTNSL

SEQ ID NO: 169315 - protein, 10 aa, Artificial Sequence
  Description of Artificial Sequence: Synthetic peptide
  Seed: NYFVWTHYYS (TYRP1_HUMAN)
NMFVWTHYYF

SEQ ID NO: 169316 - protein, 9 aa, Artificial Sequence
  Description of Artificial Sequence: Synthetic peptide
  Seed: LFDTPPFYS (TYRP1_HUMAN)
LIDTPPFYM

SEQ ID NO: 169317 - protein, 9 aa, Artificial Sequence
  Description of Artificial Sequence: Synthetic peptide
  Seed: VCDICTDDL (TYRP1_HUMAN)
VADICTDDV

SEQ ID NO: 169318 - protein, 10 aa, Artificial Sequence
  Description of Artificial Sequence: Synthetic peptide
  Seed: RSLHNLAHLF (TYRP1_HUMAN)
RSLHNLAHLW

SEQ ID NO: 169319 - protein, 10 aa, Artificial Sequence
  Description of Artificial Sequence: Synthetic peptide
  Seed: IAIAVVGALL (TYRP1_HUMAN)
ITIAVVGALW

SEQ ID NO: 169320 - protein, 9 aa, Artificial Sequence
  Description of Artificial Sequence: Synthetic peptide
  Seed: RDDREVWPL (TYRP1_HUMAN)
REDREVWPA

SEQ ID NO: 169321 - protein, 9 aa, Artificial Sequence
  Description of Artificial Sequence: Synthetic peptide
  Seed: FSHEGPAFL (TYRP1_HUMAN)
FMHEGPAFY

SEQ ID NO: 169322 - protein, 9 aa, Artificial Sequence
  Description of Artificial Sequence: Synthetic peptide
  Seed: EDYDTLGTL (TYRP1_HUMAN)
EEYDTLGTY

SEQ ID NO: 169323 - protein, 10 aa, Artificial Sequence
  Description of Artificial Sequence: Synthetic peptide
  Seed: HYYSVKKTFL (TYRP1_HUMAN)
HYYSVKKTFY

SEQ ID NO: 169324 - protein, 9 aa, Artificial Sequence
  Description of Artificial Sequence: Synthetic peptide
  Seed: SFSLPYWNF (TYRP1_HUMAN)
SRSLPYWNF

SEQ ID NO: 169325 - protein, 10 aa, Artificial Sequence
  Description of Artificial Sequence: Synthetic peptide
  Seed: YNYFVWTHYY (TYRP1_HUMAN)
YSYFVWTHYR

SEQ ID NO: 169326 - protein, 9 aa, Artificial Sequence
  Description of Artificial Sequence: Synthetic peptide
  Seed: REFSVPEII (TYRP1_HUMAN)
RLFSVPEIM

SEQ ID NO: 169327 - protein, 10 aa, Artificial Sequence
  Description of Artificial Sequence: Synthetic peptide
  Seed: AQFPRQCATV (TYRP1_HUMAN)
AKFPRQCATM

SEQ ID NO: 169328 - protein, 8 aa, Artificial Sequence
  Description of Artificial Sequence: Synthetic peptide
  Seed: SNFDSTLI (TYRP1_HUMAN)
SQFDSTLV

SEQ ID NO: 169329 - protein, 9 aa, Artificial Sequence
  Description of Artificial Sequence: Synthetic peptide
  Seed: YSNSTNSFR (TYRP1_HUMAN)
YANSTNSFL

SEQ ID NO: 169330 - protein, 9 aa, Artificial Sequence
  Description of Artificial Sequence: Synthetic peptide
  Seed: FLNGTGGQT (TYRP1_HUMAN)
FLNGTGGQL

SEQ ID NO: 169331 - protein, 10 aa, Artificial Sequence
  Description of Artificial Sequence: Synthetic peptide
  Seed: SREFSVPEII (TYRP1_HUMAN)
SYEFSVPEIL

SEQ ID NO: 169332 - protein, 9 aa, Artificial Sequence
  Description of Artificial Sequence: Synthetic peptide
  Seed: QEPSFSLPY (TYRP1_HUMAN)
QKPSFSLPM

SEQ ID NO: 169333 - protein, 9 aa, Artificial Sequence
  Description of Artificial Sequence: Synthetic peptide
  Seed: LHTFTDAVF (TYRP1_HUMAN)
LQTFTDAVF

SEQ ID NO: 169334 - protein, 10 aa, Artificial Sequence
  Description of Artificial Sequence: Synthetic peptide
  Seed: AVFDEWLRRY (TYRP1_HUMAN)
ASFDEWLRRW

SEQ ID NO: 169335 - protein, 10 aa, Artificial Sequence
  Description of Artificial Sequence: Synthetic peptide
  Seed: FQQARAQFPR (TYRP1_HUMAN)
FSQARAQFPR

SEQ ID NO: 169336 - protein, 9 aa, Artificial Sequence
  Description of Artificial Sequence: Synthetic peptide
  Seed: AACDQRVLI (TYRP1_HUMAN)
ASCDQRVLF

SEQ ID NO: 169337 - protein, 10 aa, Artificial Sequence
  Description of Artificial Sequence: Synthetic peptide
  Seed: EMLQEPSFSL (TYRP1_HUMAN)
ETLQEPSFSI

SEQ ID NO: 169338 - protein, 10 aa, Artificial Sequence
  Description of Artificial Sequence: Synthetic peptide
  Seed: LLTDQYQCYA (TYRP1_HUMAN)
LLTDQYQCYL

SEQ ID NO: 169339 - protein, 9 aa, Artificial Sequence
  Description of Artificial Sequence: Synthetic peptide
  Seed: RGRCEAVTA (TYRP1_HUMAN)
RPRCEAVTV

SEQ ID NO: 169340 - protein, 9 aa, Artificial Sequence
  Description of Artificial Sequence: Synthetic peptide
  Seed: SGHNCGTCR (TYRP1_HUMAN)
SAHNCGTCF

SEQ ID NO: 169341 - protein, 10 aa, Artificial Sequence
  Description of Artificial Sequence: Synthetic peptide
  Seed: VLLHTFTDAV (TYRP1_HUMAN)
VDLHTFTDAV

SEQ ID NO: 169342 - protein, 9 aa, Artificial Sequence
  Description of Artificial Sequence: Synthetic peptide
  Seed: SIYNYFVWT (TYRP1_HUMAN)
STYNYFVWA

SEQ ID NO: 169343 - protein, 11 aa, Artificial Sequence
  Description of Artificial Sequence: Synthetic peptide
  Seed: YNMVPFWPPVT (TYRP1_HUMAN)
YIMVPFWPPVA

SEQ ID NO: 169344 - protein, 10 aa, Artificial Sequence
  Description of Artificial Sequence: Synthetic peptide
  Seed: VWTHYYSVKK (TYRP1_HUMAN)
VFTHYYSVKR

SEQ ID NO: 169345 - protein, 9 aa, Artificial Sequence
  Description of Artificial Sequence: Synthetic peptide
  Seed: KYDPAVRSL (TYRP1_HUMAN)
KRDPAVRSL

SEQ ID NO: 169346 - protein, 9 aa, Artificial Sequence
  Description of Artificial Sequence: Synthetic peptide
  Seed: SMDEANQPL (TYRP1_HUMAN)
SMDEANQPY

SEQ ID NO: 169347 - protein, 10 aa, Artificial Sequence
  Description of Artificial Sequence: Synthetic peptide
  Seed: SVPEIIAIAV (TYRP1_HUMAN)
SAPEIIAIAM

SEQ ID NO: 169348 - protein, 9 aa, Artificial Sequence
  Description of Artificial Sequence: Synthetic peptide
  Seed: VTAPDNLGY (TYRP1_HUMAN)
VMAPDNLGW

SEQ ID NO: 169349 - protein, 9 aa, Artificial Sequence
  Description of Artificial Sequence: Synthetic peptide
  Seed: RTTHPLFVI (TYRP1_HUMAN)
RTTHPLFVY

SEQ ID NO: 169350 - protein, 10 aa, Artificial Sequence
  Description of Artificial Sequence: Synthetic peptide
  Seed: LLHTFTDAVF (TYRP1_HUMAN)
LMHTFTDAVW

SEQ ID NO: 169351 - protein, 9 aa, Artificial Sequence
  Description of Artificial Sequence: Synthetic peptide
  Seed: IAVVGALLL (TYRP1_HUMAN)
IYVVGALLL

SEQ ID NO: 169352 - protein, 9 aa, Artificial Sequence
  Description of Artificial Sequence: Synthetic peptide
  Seed: IAIAVVGAL (TYRP1_HUMAN)
IYIAVVGAF

SEQ ID NO: 169353 - protein, 9 aa, Artificial Sequence
  Description of Artificial Sequence: Synthetic peptide
  Seed: RARRSMDEA (TYRP1_HUMAN)
RIRRSMDEI

SEQ ID NO: 169354 - protein, 9 aa, Artificial Sequence
  Description of Artificial Sequence: Synthetic peptide
  Seed: KYDPAVRSL (TYRP1_HUMAN)
KLDPAVRSF

SEQ ID NO: 169355 - protein, 9 aa, Artificial Sequence
  Description of Artificial Sequence: Synthetic peptide
  Seed: QEMLQEPSF (TYRP1_HUMAN)
QMMLQEPSL

SEQ ID NO: 169356 - protein, 9 aa, Artificial Sequence
  Description of Artificial Sequence: Synthetic peptide
  Seed: SMDEANQPL (TYRP1_HUMAN)
SNDEANQPM

SEQ ID NO: 169357 - protein, 8 aa, Artificial Sequence
  Description of Artificial Sequence: Synthetic peptide
  Seed: VPFWPPVT (TYRP1_HUMAN)
VPFWPPVI

SEQ ID NO: 169358 - protein, 9 aa, Artificial Sequence
  Description of Artificial Sequence: Synthetic peptide
  Seed: ASYLIRARR (TYRP1_HUMAN)
AFYLIRARK

SEQ ID NO: 169359 - protein, 10 aa, Artificial Sequence
  Description of Artificial Sequence: Synthetic peptide
  Seed: LIFGTASYLI (TYRP1_HUMAN)
LSFGTASYLF

SEQ ID NO: 169360 - protein, 9 aa, Artificial Sequence
  Description of Artificial Sequence: Synthetic peptide
  Seed: RTTHPLFVI (TYRP1_HUMAN)
RQTHPLFVW

SEQ ID NO: 169361 - protein, 9 aa, Artificial Sequence
  Description of Artificial Sequence: Synthetic peptide
  Seed: VFDEWLRRY (TYRP1_HUMAN)
VRDEWLRRF

SEQ ID NO: 169362 - protein, 9 aa, Artificial Sequence
  Description of Artificial Sequence: Synthetic peptide
  Seed: FYSNSTNSF (TYRP1_HUMAN)
FFSNSTNSY

SEQ ID NO: 169363 - protein, 11 aa, Artificial Sequence
  Description of Artificial Sequence: Synthetic peptide
  Seed: SLPYWNFATGK (TYRP1_HUMAN)
SKPYWNFATGR

SEQ ID NO: 169364 - protein, 9 aa, Artificial Sequence
  Description of Artificial Sequence: Synthetic peptide
  Seed: ENISIYNYF (TYRP1_HUMAN)
EVISIYNYW

SEQ ID NO: 169365 - protein, 9 aa, Artificial Sequence
  Description of Artificial Sequence: Synthetic peptide
  Seed: FVRALDMAK (TYRP1_HUMAN)
FIRALDMAR

SEQ ID NO: 169366 - protein, 9 aa, Artificial Sequence
  Description of Artificial Sequence: Synthetic peptide
  Seed: IYNYFVWTH (TYRP1_HUMAN)
IMNYFVWTR

SEQ ID NO: 169367 - protein, 8 aa, Artificial Sequence
  Description of Artificial Sequence: Synthetic peptide
  Seed: LIFGTASY (TYRP1_HUMAN)
LKFGTASY

SEQ ID NO: 169368 - protein, 9 aa, Artificial Sequence
  Description of Artificial Sequence: Synthetic peptide
  Seed: RQCATVEAL (TYRP1_HUMAN)
RECATVEAC

SEQ ID NO: 169369 - protein, 10 aa, Artificial Sequence
  Description of Artificial Sequence: Synthetic peptide
  Seed: LLVALIFGTA (TYRP1_HUMAN)
LMVALIFGTV

SEQ ID NO: 169370 - protein, 10 aa, Artificial Sequence
  Description of Artificial Sequence: Synthetic peptide
  Seed: FVWTHYYSVK (TYRP1_HUMAN)
FTWTHYYSVV

SEQ ID NO: 169371 - protein, 10 aa, Artificial Sequence
  Description of Artificial Sequence: Synthetic peptide
  Seed: AVRSLHNLAH (TYRP1_HUMAN)
AFRSLHNLAK

SEQ ID NO: 169372 - protein, 9 aa, Artificial Sequence
  Description of Artificial Sequence: Synthetic peptide
  Seed: NRQYNMVPF (TYRP1_HUMAN)
NYQYNMVPV

SEQ ID NO: 169373 - protein, 10 aa, Artificial Sequence
  Description of Artificial Sequence: Synthetic peptide
  Seed: GLFDTPPFYS (TYRP1_HUMAN)
GMFDTPPFYS

SEQ ID NO: 169374 - protein, 9 aa, Artificial Sequence
  Description of Artificial Sequence: Synthetic peptide
  Seed: SRSNFDSTL (TYRP1_HUMAN)
SKSNFDSTM

SEQ ID NO: 169375 - protein, 9 aa, Artificial Sequence
  Description of Artificial Sequence: Synthetic peptide
  Seed: LPYWNFATG (TYRP1_HUMAN)
LPYWNFATF

SEQ ID NO: 169376 - protein, 9 aa, Artificial Sequence
  Description of Artificial Sequence: Synthetic peptide
  Seed: TLISPNSVF (TYRP1_HUMAN)
TMISPNSVI

SEQ ID NO: 169377 - protein, 11 aa, Artificial Sequence
  Description of Artificial Sequence: Synthetic peptide
  Seed: MFVTAPDNLGY (TYRP1_HUMAN)
MYVTAPDNLGF

SEQ ID NO: 169378 - protein, 9 aa, Artificial Sequence
  Description of Artificial Sequence: Synthetic peptide
  Seed: GEVDFSHEG (TYRP1_HUMAN)
GEVDFSHES

SEQ ID NO: 169379 - protein, 9 aa, Artificial Sequence
  Description of Artificial Sequence: Synthetic peptide
  Seed: FSVPEIIAI (TYRP1_HUMAN)
FMVPEIIAC

SEQ ID NO: 169380 - protein, 9 aa, Artificial Sequence
  Description of Artificial Sequence: Synthetic peptide
  Seed: NYFVWTHYY (TYRP1_HUMAN)
NPFVWTHYL

SEQ ID NO: 169381 - protein, 9 aa, Artificial Sequence
  Description of Artificial Sequence: Synthetic peptide
  Seed: TADSRPHSP (TYRP1_HUMAN)
TVDSRPHSF

SEQ ID NO: 169382 - protein, 11 aa, Artificial Sequence
  Description of Artificial Sequence: Synthetic peptide
  Seed: YFVWTHYYSVK (TYRP1_HUMAN)
YRVWTHYYSVR

SEQ ID NO: 169383 - protein, 9 aa, Artificial Sequence
  Description of Artificial Sequence: Synthetic peptide
  Seed: FSVPEIIAI (TYRP1_HUMAN)
FGVPEIIAF

SEQ ID NO: 169384 - protein, 10 aa, Artificial Sequence
  Description of Artificial Sequence: Synthetic peptide
  Seed: LLFQQARAQF (TYRP1_HUMAN)
LHFQQARAQF

SEQ ID NO: 169385 - protein, 11 aa, Artificial Sequence
  Description of Artificial Sequence: Synthetic peptide
  Seed: YQCYAEEYEKL (TYRP1_HUMAN)
YSCYAEEYEKF

SEQ ID NO: 169386 - protein, 9 aa, Artificial Sequence
  Description of Artificial Sequence: Synthetic peptide
  Seed: MSAPKLLSL (TYRP1_HUMAN)
MGAPKLLSM

SEQ ID NO: 169387 - protein, 10 aa, Artificial Sequence
  Description of Artificial Sequence: Synthetic peptide
  Seed: FVLLHTFTDA (TYRP1_HUMAN)
FWLLHTFTDV

SEQ ID NO: 169388 - protein, 11 aa, Artificial Sequence
  Description of Artificial Sequence: Synthetic peptide
  Seed: FENISIYNYFV (TYRP1_HUMAN)
FLNISIYNYFV

SEQ ID NO: 169389 - protein, 9 aa, Artificial Sequence
  Description of Artificial Sequence: Synthetic peptide
  Seed: KYDPAVRSL (TYRP1_HUMAN)
KWDPAVRSM

SEQ ID NO: 169390 - protein, 10 aa, Artificial Sequence
  Description of Artificial Sequence: Synthetic peptide
  Seed: NISIYNYFVW (TYRP1_HUMAN)
NASIYNYFVW

SEQ ID NO: 169391 - protein, 9 aa, Artificial Sequence
  Description of Artificial Sequence: Synthetic peptide
  Seed: AVVGALLLV (TYRP1_HUMAN)
AVVGALLLA

SEQ ID NO: 169392 - protein, 9 aa, Artificial Sequence
  Description of Artificial Sequence: Synthetic peptide
  Seed: LLVALIFGT (TYRP1_HUMAN)
LLVALIFGI

SEQ ID NO: 169393 - protein, 9 aa, Artificial Sequence
  Description of Artificial Sequence: Synthetic peptide
  Seed: KLLSLGCIF (TYRP1_HUMAN)
KYLSLGCIY

SEQ ID NO: 169394 - protein, 10 aa, Artificial Sequence
  Description of Artificial Sequence: Synthetic peptide
  Seed: SIYNYFVWTH (TYRP1_HUMAN)
SPYNYFVWTR

SEQ ID NO: 169395 - protein, 9 aa, Artificial Sequence
  Description of Artificial Sequence: Synthetic peptide
  Seed: MSAPKLLSL (TYRP1_HUMAN)
MVAPKLLSA

SEQ ID NO: 169396 - protein, 10 aa, Artificial Sequence
  Description of Artificial Sequence: Synthetic peptide
  Seed: DAVFDEWLRR (TYRP1_HUMAN)
DHVFDEWLRR

SEQ ID NO: 169397 - protein, 9 aa, Artificial Sequence
  Description of Artificial Sequence: Synthetic peptide
  Seed: NSVFSQWRV (TYRP1_HUMAN)
NMVFSQWRV

SEQ ID NO: 169398 - protein, 10 aa, Artificial Sequence
  Description of Artificial Sequence: Synthetic peptide
  Seed: FENISIYNYF (TYRP1_HUMAN)
FMNISIYNYF

SEQ ID NO: 169399 - protein, 9 aa, Artificial Sequence
  Description of Artificial Sequence: Synthetic peptide
  Seed: SPNDPIFVL (TYRP1_HUMAN)
SLNDPIFVY

SEQ ID NO: 169400 - protein, 10 aa, Artificial Sequence
  Description of Artificial Sequence: Synthetic peptide
  Seed: IAIAVVGALL (TYRP1_HUMAN)
IAIAVVGALF

SEQ ID NO: 169401 - protein, 10 aa, Artificial Sequence
  Description of Artificial Sequence: Synthetic peptide
  Seed: YEIQWPSREF (TYRP1_HUMAN)
YSIQWPSREY

SEQ ID NO: 169402 - protein, 10 aa, Artificial Sequence
  Description of Artificial Sequence: Synthetic peptide
  Seed: ASYLIRARRS (TYRP1_HUMAN)
AIYLIRARRR

SEQ ID NO: 169403 - protein, 9 aa, Artificial Sequence
  Description of Artificial Sequence: Synthetic peptide
  Seed: LPYWNFATG (TYRP1_HUMAN)
LPYWNFATT

SEQ ID NO: 169404 - protein, 9 aa, Artificial Sequence
  Description of Artificial Sequence: Synthetic peptide
  Seed: LHTFTDAVF (TYRP1_HUMAN)
LKTFTDAVM

SEQ ID NO: 169405 - protein, 9 aa, Artificial Sequence
  Description of Artificial Sequence: Synthetic peptide
  Seed: LGYTYEIQW (TYRP1_HUMAN)
LAYTYEIQM

SEQ ID NO: 169406 - protein, 10 aa, Artificial Sequence
  Description of Artificial Sequence: Synthetic peptide
  Seed: SIYNYFVWTH (TYRP1_HUMAN)
SMYNYFVWTR

SEQ ID NO: 169407 - protein, 10 aa, Artificial Sequence
  Description of Artificial Sequence: Synthetic peptide
  Seed: DVAQCLEVGL (TYRP1_HUMAN)
DVAQCLEVGR

SEQ ID NO: 169408 - protein, 10 aa, Artificial Sequence
  Description of Artificial Sequence: Synthetic peptide
  Seed: HRYHLLRLEK (TYRP1_HUMAN)
HRYHLLRLER

SEQ ID NO: 169409 - protein, 9 aa, Artificial Sequence
  Description of Artificial Sequence: Synthetic peptide
  Seed: IYNYFVWTH (TYRP1_HUMAN)
ILNYFVWTK

SEQ ID NO: 169410 - protein, 9 aa, Artificial Sequence
  Description of Artificial Sequence: Synthetic peptide
  Seed: LIFGTASYL (TYRP1_HUMAN)
LSFGTASYM

SEQ ID NO: 169411 - protein, 9 aa, Artificial Sequence
  Description of Artificial Sequence: Synthetic peptide
  Seed: RARRSMDEA (TYRP1_HUMAN)
RYRRSMDEV

SEQ ID NO: 169412 - protein, 9 aa, Artificial Sequence
  Description of Artificial Sequence: Synthetic peptide
  Seed: MAKRTTHPL (TYRP1_HUMAN)
MRKRTTHPF

SEQ ID NO: 169413 - protein, 9 aa, Artificial Sequence
  Description of Artificial Sequence: Synthetic peptide
  Seed: AQFPRQCAT (TYRP1_HUMAN)
AAFPRQCAF

SEQ ID NO: 169414 - protein, 9 aa, Artificial Sequence
  Description of Artificial Sequence: Synthetic peptide
  Seed: LLSLGCIFF (TYRP1_HUMAN)
LLSLGCIFY

SEQ ID NO: 169415 - protein, 10 aa, Artificial Sequence
  Description of Artificial Sequence: Synthetic peptide
  Seed: AVRSLHNLAH (TYRP1_HUMAN)
ASRSLHNLAK

SEQ ID NO: 169416 - protein, 10 aa, Artificial Sequence
  Description of Artificial Sequence: Synthetic peptide
  Seed: FLNGTGGQTH (TYRP1_HUMAN)
FTNGTGGQTY

SEQ ID NO: 169417 - protein, 9 aa, Artificial Sequence
  Description of Artificial Sequence: Synthetic peptide
  Seed: RRSEEILGP (TYRP1_HUMAN)
RRSEEILGF

SEQ ID NO: 169418 - protein, 10 aa, Artificial Sequence
  Description of Artificial Sequence: Synthetic peptide
  Seed: SVKKTFLGVG (TYRP1_HUMAN)
SSKKTFLGVK

SEQ ID NO: 169419 - protein, 10 aa, Artificial Sequence
  Description of Artificial Sequence: Synthetic peptide
  Seed: SPNDPIFVLL (TYRP1_HUMAN)
SVNDPIFVLM

SEQ ID NO: 169420 - protein, 10 aa, Artificial Sequence
  Description of Artificial Sequence: Synthetic peptide
  Seed: LSPNDPIFVL (TYRP1_HUMAN)
LCPNDPIFVM

SEQ ID NO: 169421 - protein, 11 aa, Artificial Sequence
  Description of Artificial Sequence: Synthetic peptide
  Seed: FSVPEIIAIAV (TYRP1_HUMAN)
FVVPEIIAIAV

SEQ ID NO: 169422 - protein, 9 aa, Artificial Sequence
  Description of Artificial Sequence: Synthetic peptide
  Seed: FLGVGQESF (TYRP1_HUMAN)
FLGVGQESA

SEQ ID NO: 169423 - protein, 9 aa, Artificial Sequence
  Description of Artificial Sequence: Synthetic peptide
  Seed: VGQESFGEV (TYRP1_HUMAN)
VAQESFGEM

SEQ ID NO: 169424 - protein, 9 aa, Artificial Sequence
  Description of Artificial Sequence: Synthetic peptide
  Seed: SRSNFDSTL (TYRP1_HUMAN)
SQSNFDSTY

SEQ ID NO: 169425 - protein, 9 aa, Artificial Sequence
  Description of Artificial Sequence: Synthetic peptide
  Seed: FSHEGPAFL (TYRP1_HUMAN)
FIHEGPAFR

SEQ ID NO: 169426 - protein, 10 aa, Artificial Sequence
  Description of Artificial Sequence: Synthetic peptide
  Seed: VGLFDTPPFY (TYRP1_HUMAN)
VKLFDTPPFY

SEQ ID NO: 169427 - protein, 9 aa, Artificial Sequence
  Description of Artificial Sequence: Synthetic peptide
  Seed: MLQEPSFSL (TYRP1_HUMAN)
MHQEPSFSY

SEQ ID NO: 169428 - protein, 9 aa, Artificial Sequence
  Description of Artificial Sequence: Synthetic peptide
  Seed: FLTWHRYHL (TYRP1_HUMAN)
FFTWHRYHI

SEQ ID NO: 169429 - protein, 9 aa, Artificial Sequence
  Description of Artificial Sequence: Synthetic peptide
  Seed: FTDAVFDEW (TYRP1_HUMAN)
FQDAVFDEF

SEQ ID NO: 169430 - protein, 9 aa, Artificial Sequence
  Description of Artificial Sequence: Synthetic peptide
  Seed: TAPDNLGYT (TYRP1_HUMAN)
TAPDNLGYF

SEQ ID NO: 169431 - protein, 9 aa, Artificial Sequence
  Description of Artificial Sequence: Synthetic peptide
  Seed: LTWHRYHLL (TYRP1_HUMAN)
LVWHRYHLR

SEQ ID NO: 169432 - protein, 10 aa, Artificial Sequence
  Description of Artificial Sequence: Synthetic peptide
  Seed: LLFQQARAQF (TYRP1_HUMAN)
LQFQQARAQL

SEQ ID NO: 169433 - protein, 9 aa, Artificial Sequence
  Description of Artificial Sequence: Synthetic peptide
  Seed: LTWHRYHLL (TYRP1_HUMAN)
LLWHRYHLI

SEQ ID NO: 169434 - protein, 8 aa, Artificial Sequence
  Description of Artificial Sequence: Synthetic peptide
  Seed: IQWPSREF (TYRP1_HUMAN)
IAWPSREY

SEQ ID NO: 169435 - protein, 9 aa, Artificial Sequence
  Description of Artificial Sequence: Synthetic peptide
  Seed: NPAGNVARP (TYRP1_HUMAN)
NPAGNVARA

SEQ ID NO: 169436 - protein, 9 aa, Artificial Sequence
  Description of Artificial Sequence: Synthetic peptide
  Seed: RGRCEAVTA (TYRP1_HUMAN)
RIRCEAVTY

SEQ ID NO: 169437 - protein, 9 aa, Artificial Sequence
  Description of Artificial Sequence: Synthetic peptide
  Seed: RAQFPRQCA (TYRP1_HUMAN)
RPQFPRQCA

SEQ ID NO: 169438 - protein, 9 aa, Artificial Sequence
  Description of Artificial Sequence: Synthetic peptide
  Seed: QQARAQFPR (TYRP1_HUMAN)
QWARAQFPR

SEQ ID NO: 169439 - protein, 9 aa, Artificial Sequence
  Description of Artificial Sequence: Synthetic peptide
  Seed: YTYEIQWPS (TYRP1_HUMAN)
YTYEIQWPT

SEQ ID NO: 169440 - protein, 11 aa, Artificial Sequence
  Description of Artificial Sequence: Synthetic peptide
  Seed: QYNMVPFWPPV (TYRP1_HUMAN)
QYNMVPFWPPW

SEQ ID NO: 169441 - protein, 10 aa, Artificial Sequence
  Description of Artificial Sequence: Synthetic peptide
  Seed: QFENISIYNY (TYRP1_HUMAN)
QGENISIYNW

SEQ ID NO: 169442 - protein, 10 aa, Artificial Sequence
  Description of Artificial Sequence: Synthetic peptide
  Seed: SHEGPAFLTW (TYRP1_HUMAN)
STEGPAFLTW

SEQ ID NO: 169443 - protein, 9 aa, Artificial Sequence
  Description of Artificial Sequence: Synthetic peptide
  Seed: RSLHNLAHL (TYRP1_HUMAN)
RTLHNLAHF

SEQ ID NO: 169444 - protein, 11 aa, Artificial Sequence
  Description of Artificial Sequence: Synthetic peptide
  Seed: RRYNADISTFP (TYRP1_HUMAN)
RYYNADISTFD

SEQ ID NO: 169445 - protein, 9 aa, Artificial Sequence
  Description of Artificial Sequence: Synthetic peptide
  Seed: GPDGNTPQF (TYRP1_HUMAN)
GMDGNTPQF

SEQ ID NO: 169446 - protein, 9 aa, Artificial Sequence
  Description of Artificial Sequence: Synthetic peptide
  Seed: LFDTPPFYS (TYRP1_HUMAN)
LLDTPPFYL

SEQ ID NO: 169447 - protein, 9 aa, Artificial Sequence
  Description of Artificial Sequence: Synthetic peptide
  Seed: MLQEPSFSL (TYRP1_HUMAN)
MMQEPSFSV

SEQ ID NO: 169448 - protein, 9 aa, Artificial Sequence
  Description of Artificial Sequence: Synthetic peptide
  Seed: SVPEIIAIA (TYRP1_HUMAN)
SAPEIIAIL

SEQ ID NO: 169449 - protein, 9 aa, Artificial Sequence
  Description of Artificial Sequence: Synthetic peptide
  Seed: SVFSQWRVV (TYRP1_HUMAN)
SMFSQWRVV

SEQ ID NO: 169450 - protein, 10 aa, Artificial Sequence
  Description of Artificial Sequence: Synthetic peptide
  Seed: DAVFDEWLRR (TYRP1_HUMAN)
DGVFDEWLRR

SEQ ID NO: 169451 - protein, 10 aa, Artificial Sequence
  Description of Artificial Sequence: Synthetic peptide
  Seed: RSMDEANQPL (TYRP1_HUMAN)
RAMDEANQPW

SEQ ID NO: 169452 - protein, 10 aa, Artificial Sequence
  Description of Artificial Sequence: Synthetic peptide
  Seed: LLHTFTDAVF (TYRP1_HUMAN)
LLHTFTDAVV

SEQ ID NO: 169453 - protein, 9 aa, Artificial Sequence
  Description of Artificial Sequence: Synthetic peptide
  Seed: GLFDTPPFY (TYRP1_HUMAN)
GLFDTPPFI

SEQ ID NO: 169454 - protein, 9 aa, Artificial Sequence
  Description of Artificial Sequence: Synthetic peptide
  Seed: SVPEIIAIA (TYRP1_HUMAN)
SFPEIIAIM

SEQ ID NO: 169455 - protein, 10 aa, Artificial Sequence
  Description of Artificial Sequence: Synthetic peptide
  Seed: SMDEANQPLL (TYRP1_HUMAN)
SMDEANQPLY

SEQ ID NO: 169456 - protein, 9 aa, Artificial Sequence
  Description of Artificial Sequence: Synthetic peptide
  Seed: LLVALIFGT (TYRP1_HUMAN)
LVVALIFGV

SEQ ID NO: 169457 - protein, 9 aa, Artificial Sequence
  Description of Artificial Sequence: Synthetic peptide
  Seed: QEMLQEPSF (TYRP1_HUMAN)
QMMLQEPSY

SEQ ID NO: 169458 - protein, 9 aa, Artificial Sequence
  Description of Artificial Sequence: Synthetic peptide
  Seed: SMDEANQPL (TYRP1_HUMAN)
STDEANQPV

SEQ ID NO: 169459 - protein, 10 aa, Artificial Sequence
  Description of Artificial Sequence: Synthetic peptide
  Seed: LLVALIFGTA (TYRP1_HUMAN)
LQVALIFGTI

SEQ ID NO: 169460 - protein, 9 aa, Artificial Sequence
  Description of Artificial Sequence: Synthetic peptide
  Seed: FSLPYWNFA (TYRP1_HUMAN)
FILPYWNFV

SEQ ID NO: 169461 - protein, 10 aa, Artificial Sequence
  Description of Artificial Sequence: Synthetic peptide
  Seed: LGPDGNTPQF (TYRP1_HUMAN)
LIPDGNTPQI

SEQ ID NO: 169462 - protein, 11 aa, Artificial Sequence
  Description of Artificial Sequence: Synthetic peptide
  Seed: YNYFVWTHYYS (TYRP1_HUMAN)
YFYFVWTHYYK

SEQ ID NO: 169463 - protein, 9 aa, Artificial Sequence
  Description of Artificial Sequence: Synthetic peptide
  Seed: FPLENAPIG (TYRP1_HUMAN)
FALENAPIL

SEQ ID NO: 169464 - protein, 10 aa, Artificial Sequence
  Description of Artificial Sequence: Synthetic peptide
  Seed: STFPLENAPI (TYRP1_HUMAN)
SLFPLENAPA

SEQ ID NO: 169465 - protein, 9 aa, Artificial Sequence
  Description of Artificial Sequence: Synthetic peptide
  Seed: TADSRPHSP (TYRP1_HUMAN)
TTDSRPHSM

SEQ ID NO: 169466 - protein, 9 aa, Artificial Sequence
  Description of Artificial Sequence: Synthetic peptide
  Seed: TASYLIRAR (TYRP1_HUMAN)
TSSYLIRAK

SEQ ID NO: 169467 - protein, 9 aa, Artificial Sequence
  Description of Artificial Sequence: Synthetic peptide
  Seed: FYSNSTNSF (TYRP1_HUMAN)
FWSNSTNSM

SEQ ID NO: 169468 - protein, 9 aa, Artificial Sequence
  Description of Artificial Sequence: Synthetic peptide
  Seed: NADISTFPL (TYRP1_HUMAN)
NTDISTFPV

SEQ ID NO: 169469 - protein, 9 aa, Artificial Sequence
  Description of Artificial Sequence: Synthetic peptide
  Seed: DSLEDYDTL (TYRP1_HUMAN)
DVLEDYDTV

SEQ ID NO: 169470 - protein, 10 aa, Artificial Sequence
  Description of Artificial Sequence: Synthetic peptide
  Seed: YNMVPFWPPV (TYRP1_HUMAN)
YQMVPFWPPV

SEQ ID NO: 169471 - protein, 9 aa, Artificial Sequence
  Description of Artificial Sequence: Synthetic peptide
  Seed: YNYFVWTHY (TYRP1_HUMAN)
YVYFVWTHF

SEQ ID NO: 169472 - protein, 11 aa, Artificial Sequence
  Description of Artificial Sequence: Synthetic peptide
  Seed: RRYNADISTFP (TYRP1_HUMAN)
RWYNADISTFR

SEQ ID NO: 169473 - protein, 10 aa, Artificial Sequence
  Description of Artificial Sequence: Synthetic peptide
  Seed: NVARPMVQRL (TYRP1_HUMAN)
NVARPMVQRR

SEQ ID NO: 169474 - protein, 8 aa, Artificial Sequence
  Description of Artificial Sequence: Synthetic peptide
  Seed: RQYNMVPF (TYRP1_HUMAN)
RQYNMVPL

SEQ ID NO: 169475 - protein, 11 aa, Artificial Sequence
  Description of Artificial Sequence: Synthetic peptide
  Seed: HLSPNDPIFVL (TYRP1_HUMAN)
HASPNDPIFVM

SEQ ID NO: 169476 - protein, 9 aa, Artificial Sequence
  Description of Artificial Sequence: Synthetic peptide
  Seed: KLLSLGCIF (TYRP1_HUMAN)
KSLSLGCIL

SEQ ID NO: 169477 - protein, 11 aa, Artificial Sequence
  Description of Artificial Sequence: Synthetic peptide
  Seed: RRSMDEANQPL (TYRP1_HUMAN)
RGSMDEANQPV

SEQ ID NO: 169478 - protein, 9 aa, Artificial Sequence
  Description of Artificial Sequence: Synthetic peptide
  Seed: AIAVVGALL (TYRP1_HUMAN)
AMAVVGALM

SEQ ID NO: 169479 - protein, 9 aa, Artificial Sequence
  Description of Artificial Sequence: Synthetic peptide
  Seed: AIAVVGALL (TYRP1_HUMAN)
AVAVVGALF

SEQ ID NO: 169480 - protein, 9 aa, Artificial Sequence
  Description of Artificial Sequence: Synthetic peptide
  Seed: NYFVWTHYY (TYRP1_HUMAN)
NNFVWTHYY

SEQ ID NO: 169481 - protein, 10 aa, Artificial Sequence
  Description of Artificial Sequence: Synthetic peptide
  Seed: YNYFVWTHYY (TYRP1_HUMAN)
YGYFVWTHYM

SEQ ID NO: 169482 - protein, 10 aa, Artificial Sequence
  Description of Artificial Sequence: Synthetic peptide
  Seed: MLQEPSFSLP (TYRP1_HUMAN)
MLQEPSFSLA

SEQ ID NO: 169483 - protein, 10 aa, Artificial Sequence
  Description of Artificial Sequence: Synthetic peptide
  Seed: VDFSHEGPAF (TYRP1_HUMAN)
VEFSHEGPAI

SEQ ID NO: 169484 - protein, 9 aa, Artificial Sequence
  Description of Artificial Sequence: Synthetic peptide
  Seed: FSHEGPAFL (TYRP1_HUMAN)
FTHEGPAFW

SEQ ID NO: 169485 - protein, 10 aa, Artificial Sequence
  Description of Artificial Sequence: Synthetic peptide
  Seed: KLLSLGCIFF (TYRP1_HUMAN)
KLLSLGCIFM

SEQ ID NO: 169486 - protein, 9 aa, Artificial Sequence
  Description of Artificial Sequence: Synthetic peptide
  Seed: HPLFVIATR (TYRP1_HUMAN)
HPLFVIATL

SEQ ID NO: 169487 - protein, 9 aa, Artificial Sequence
  Description of Artificial Sequence: Synthetic peptide
  Seed: LLVALIFGT (TYRP1_HUMAN)
LSVALIFGL

SEQ ID NO: 169488 - protein, 11 aa, Artificial Sequence
  Description of Artificial Sequence: Synthetic peptide
  Seed: RRYNADISTFP (TYRP1_HUMAN)
RSYNADISTFF

SEQ ID NO: 169489 - protein, 11 aa, Artificial Sequence
  Description of Artificial Sequence: Synthetic peptide
  Seed: RRSMDEANQPL (TYRP1_HUMAN)
RKSMDEANQPV

SEQ ID NO: 169490 - protein, 10 aa, Artificial Sequence
  Description of Artificial Sequence: Synthetic peptide
  Seed: MVPFWPPVTN (TYRP1_HUMAN)
MSPFWPPVTL

SEQ ID NO: 169491 - protein, 10 aa, Artificial Sequence
  Description of Artificial Sequence: Synthetic peptide
  Seed: RRYNADISTF (TYRP1_HUMAN)
RSYNADISTM

SEQ ID NO: 169492 - protein, 9 aa, Artificial Sequence
  Description of Artificial Sequence: Synthetic peptide
  Seed: IAVVGALLL (TYRP1_HUMAN)
IQVVGALLY

SEQ ID NO: 169493 - protein, 9 aa, Artificial Sequence
  Description of Artificial Sequence: Synthetic peptide
  Seed: VARPMVQRL (TYRP1_HUMAN)
VLRPMVQRF

SEQ ID NO: 169494 - protein, 10 aa, Artificial Sequence
  Description of Artificial Sequence: Synthetic peptide
  Seed: MVPFWPPVTN (TYRP1_HUMAN)
MCPFWPPVTF

SEQ ID NO: 169495 - protein, 9 aa, Artificial Sequence
  Description of Artificial Sequence: Synthetic peptide
  Seed: RARRSMDEA (TYRP1_HUMAN)
RIRRSMDEK

SEQ ID NO: 169496 - protein, 10 aa, Artificial Sequence
  Description of Artificial Sequence: Synthetic peptide
  Seed: IAIAVVGALL (TYRP1_HUMAN)
ILIAVVGALA

SEQ ID NO: 169497 - protein, 9 aa, Artificial Sequence
  Description of Artificial Sequence: Synthetic peptide
  Seed: AQFPRQCAT (TYRP1_HUMAN)
ARFPRQCAL

SEQ ID NO: 169498 - protein, 9 aa, Artificial Sequence
  Description of Artificial Sequence: Synthetic peptide
  Seed: LGYTYEIQW (TYRP1_HUMAN)
LSYTYEIQY

SEQ ID NO: 169499 - protein, 8 aa, Artificial Sequence
  Description of Artificial Sequence: Synthetic peptide
  Seed: REFSVPEI (TYRP1_HUMAN)
RDFSVPEL

SEQ ID NO: 169500 - protein, 9 aa, Artificial Sequence
  Description of Artificial Sequence: Synthetic peptide
  Seed: RQYNMVPFW (TYRP1_HUMAN)
RKYNMVPFI

SEQ ID NO: 169501 - protein, 11 aa, Artificial Sequence
  Description of Artificial Sequence: Synthetic peptide
  Seed: ILGPDGNTPQF (TYRP1_HUMAN)
IIGPDGNTPQW

SEQ ID NO: 169502 - protein, 9 aa, Artificial Sequence
  Description of Artificial Sequence: Synthetic peptide
  Seed: STLISPNSV (TYRP1_HUMAN)
SSLISPNSY

SEQ ID NO: 169503 - protein, 9 aa, Artificial Sequence
  Description of Artificial Sequence: Synthetic peptide
  Seed: FTDAVFDEW (TYRP1_HUMAN)
FGDAVFDEF

SEQ ID NO: 169504 - protein, 10 aa, Artificial Sequence
  Description of Artificial Sequence: Synthetic peptide
  Seed: FTDAVFDEWL (TYRP1_HUMAN)
FQDAVFDEWV

SEQ ID NO: 169505 - protein, 9 aa, Artificial Sequence
  Description of Artificial Sequence: Synthetic peptide
  Seed: KYDPAVRSL (TYRP1_HUMAN)
KADPAVRSI

SEQ ID NO: 169506 - protein, 9 aa, Artificial Sequence
  Description of Artificial Sequence: Synthetic peptide
  Seed: NRQYNMVPF (TYRP1_HUMAN)
NWQYNMVPM

SEQ ID NO: 169507 - protein, 9 aa, Artificial Sequence
  Description of Artificial Sequence: Synthetic peptide
  Seed: QESFGEVDF (TYRP1_HUMAN)
QESFGEVDW

SEQ ID NO: 169508 - protein, 9 aa, Artificial Sequence
  Description of Artificial Sequence: Synthetic peptide
  Seed: FYSNSTNSF (TYRP1_HUMAN)
FSSNSTNSL

SEQ ID NO: 169509 - protein, 9 aa, Artificial Sequence
  Description of Artificial Sequence: Synthetic peptide
  Seed: RRNLLDLSK (TYRP1_HUMAN)
RRNLLDLSR

SEQ ID NO: 169510 - protein, 9 aa, Artificial Sequence
  Description of Artificial Sequence: Synthetic peptide
  Seed: NMVPFWPPV (TYRP1_HUMAN)
NQVPFWPPL

SEQ ID NO: 169511 - protein, 9 aa, Artificial Sequence
  Description of Artificial Sequence: Synthetic peptide
  Seed: TWHRYHLLR (TYRP1_HUMAN)
TIHRYHLLR

SEQ ID NO: 169512 - protein, 10 aa, Artificial Sequence
  Description of Artificial Sequence: Synthetic peptide
  Seed: FWPPVTNTEM (TYRP1_HUMAN)
FGPPVTNTEY

SEQ ID NO: 169513 - protein, 10 aa, Artificial Sequence
  Description of Artificial Sequence: Synthetic peptide
  Seed: WPPVTNTEMF (TYRP1_HUMAN)
WRPVTNTEMW

SEQ ID NO: 169514 - protein, 8 aa, Artificial Sequence
  Description of Artificial Sequence: Synthetic peptide
  Seed: FSHEGPAF (TYRP1_HUMAN)
FWHEGPAL

SEQ ID NO: 169515 - protein, 9 aa, Artificial Sequence
  Description of Artificial Sequence: Synthetic peptide
  Seed: NADISTFPL (TYRP1_HUMAN)
NADISTFPI

SEQ ID NO: 169516 - protein, 9 aa, Artificial Sequence
  Description of Artificial Sequence: Synthetic peptide
  Seed: DLMGSRSNF (TYRP1_HUMAN)
DIMGSRSNK

SEQ ID NO: 169517 - protein, 10 aa, Artificial Sequence
  Description of Artificial Sequence: Synthetic peptide
  Seed: FVTAPDNLGY (TYRP1_HUMAN)
FMTAPDNLGF

SEQ ID NO: 169518 - protein, 10 aa, Artificial Sequence
  Description of Artificial Sequence: Synthetic peptide
  Seed: FQQARAQFPR (TYRP1_HUMAN)
FRQARAQFPR

SEQ ID NO: 169519 - protein, 11 aa, Artificial Sequence
  Description of Artificial Sequence: Synthetic peptide
  Seed: YNMVPFWPPVT (TYRP1_HUMAN)
YQMVPFWPPVY

SEQ ID NO: 169520 - protein, 9 aa, Artificial Sequence
  Description of Artificial Sequence: Synthetic peptide
  Seed: RLEKDMQEM (TYRP1_HUMAN)
RLEKDMQEL

SEQ ID NO: 169521 - protein, 10 aa, Artificial Sequence
  Description of Artificial Sequence: Synthetic peptide
  Seed: DAVFDEWLRR (TYRP1_HUMAN)
DKVFDEWLRR

SEQ ID NO: 169522 - protein, 9 aa, Artificial Sequence
  Description of Artificial Sequence: Synthetic peptide
  Seed: MAKRTTHPL (TYRP1_HUMAN)
MPKRTTHPV

SEQ ID NO: 169523 - protein, 9 aa, Artificial Sequence
  Description of Artificial Sequence: Synthetic peptide
  Seed: RFFNRTCHC (TYRP1_HUMAN)
RMFNRTCHA

SEQ ID NO: 169524 - protein, 11 aa, Artificial Sequence
  Description of Artificial Sequence: Synthetic peptide
  Seed: AVVGALLLVAL (TYRP1_HUMAN)
AMVGALLLVAV

SEQ ID NO: 169525 - protein, 10 aa, Artificial Sequence
  Description of Artificial Sequence: Synthetic peptide
  Seed: THYYSVKKTF (TYRP1_HUMAN)
TNYYSVKKTF

SEQ ID NO: 169526 - protein, 9 aa, Artificial Sequence
  Description of Artificial Sequence: Synthetic peptide
  Seed: RYNADISTF (TYRP1_HUMAN)
RINADISTF

SEQ ID NO: 169527 - protein, 9 aa, Artificial Sequence
  Description of Artificial Sequence: Synthetic peptide
  Seed: KYDPAVRSL (TYRP1_HUMAN)
KGDPAVRSM

SEQ ID NO: 169528 - protein, 9 aa, Artificial Sequence
  Description of Artificial Sequence: Synthetic peptide
  Seed: SLHNLAHLF (TYRP1_HUMAN)
SSHNLAHLY

SEQ ID NO: 169529 - protein, 9 aa, Artificial Sequence
  Description of Artificial Sequence: Synthetic peptide
  Seed: SMDEANQPL (TYRP1_HUMAN)
SPDEANQPY

SEQ ID NO: 169530 - protein, 10 aa, Artificial Sequence
  Description of Artificial Sequence: Synthetic peptide
  Seed: FSLPYWNFAT (TYRP1_HUMAN)
FELPYWNFAI

SEQ ID NO: 169531 - protein, 9 aa, Artificial Sequence
  Description of Artificial Sequence: Synthetic peptide
  Seed: MLQEPSFSL (TYRP1_HUMAN)
MYQEPSFSV

SEQ ID NO: 169532 - protein, 10 aa, Artificial Sequence
  Description of Artificial Sequence: Synthetic peptide
  Seed: YSVKKTFLGV (TYRP1_HUMAN)
YIVKKTFLGV

SEQ ID NO: 169533 - protein, 10 aa, Artificial Sequence
  Description of Artificial Sequence: Synthetic peptide
  Seed: YNMVPFWPPV (TYRP1_HUMAN)
YKMVPFWPPA

SEQ ID NO: 169534 - protein, 9 aa, Artificial Sequence
  Description of Artificial Sequence: Synthetic peptide
  Seed: YNYFVWTHY (TYRP1_HUMAN)
YAYFVWTHR

SEQ ID NO: 169535 - protein, 10 aa, Artificial Sequence
  Description of Artificial Sequence: Synthetic peptide
  Seed: FPRQCATVEA (TYRP1_HUMAN)
FPRQCATVEI

SEQ ID NO: 169536 - protein, 9 aa, Artificial Sequence
  Description of Artificial Sequence: Synthetic peptide
  Seed: NVARPMVQR (TYRP1_HUMAN)
NVARPMVQK

SEQ ID NO: 169537 - protein, 9 aa, Artificial Sequence
  Description of Artificial Sequence: Synthetic peptide
  Seed: SLPYWNFAT (TYRP1_HUMAN)
SMPYWNFAV

SEQ ID NO: 169538 - protein, 9 aa, Artificial Sequence
  Description of Artificial Sequence: Synthetic peptide
  Seed: FENISIYNY (TYRP1_HUMAN)
FENISIYNF

SEQ ID NO: 169539 - protein, 10 aa, Artificial Sequence
  Description of Artificial Sequence: Synthetic peptide
  Seed: YNYFVWTHYY (TYRP1_HUMAN)
YRYFVWTHYK

SEQ ID NO: 169540 - protein, 9 aa, Artificial Sequence
  Description of Artificial Sequence: Synthetic peptide
  Seed: KYDPAVRSL (TYRP1_HUMAN)
KIDPAVRSM

SEQ ID NO: 169541 - protein, 9 aa, Artificial Sequence
  Description of Artificial Sequence: Synthetic peptide
  Seed: SVKKTFLGV (TYRP1_HUMAN)
SSKKTFLGA

SEQ ID NO: 169542 - protein, 9 aa, Artificial Sequence
  Description of Artificial Sequence: Synthetic peptide
  Seed: ENAPIGHNR (TYRP1_HUMAN)
EVAPIGHNR

SEQ ID NO: 169543 - protein, 10 aa, Artificial Sequence
  Description of Artificial Sequence: Synthetic peptide
  Seed: YNMVPFWPPV (TYRP1_HUMAN)
YEMVPFWPPI

SEQ ID NO: 169544 - protein, 9 aa, Artificial Sequence
  Description of Artificial Sequence: Synthetic peptide
  Seed: FENISIYNY (TYRP1_HUMAN)
FENISIYNI

SEQ ID NO: 169545 - protein, 10 aa, Artificial Sequence
  Description of Artificial Sequence: Synthetic peptide
  Seed: KRTTHPLFVI (TYRP1_HUMAN)
KVTTHPLFVW

SEQ ID NO: 169546 - protein, 9 aa, Artificial Sequence
  Description of Artificial Sequence: Synthetic peptide
  Seed: LPYWNFATG (TYRP1_HUMAN)
LPYWNFATS

SEQ ID NO: 169547 - protein, 10 aa, Artificial Sequence
  Description of Artificial Sequence: Synthetic peptide
  Seed: RRYNADISTF (TYRP1_HUMAN)
REYNADISTW

SEQ ID NO: 169548 - protein, 9 aa, Artificial Sequence
  Description of Artificial Sequence: Synthetic peptide
  Seed: LPYWNFATG (TYRP1_HUMAN)
LAYWNFATM

SEQ ID NO: 169549 - protein, 8 aa, Artificial Sequence
  Description of Artificial Sequence: Synthetic peptide
  Seed: FSHEGPAF (TYRP1_HUMAN)
FSHEGPAI

SEQ ID NO: 169550 - protein, 9 aa, Artificial Sequence
  Description of Artificial Sequence: Synthetic peptide
  Seed: VGALLLVAL (TYRP1_HUMAN)
VAALLLVAY

SEQ ID NO: 169551 - protein, 11 aa, Artificial Sequence
  Description of Artificial Sequence: Synthetic peptide
  Seed: SLEDYDTLGTL (TYRP1_HUMAN)
SLEDYDTLGTA

SEQ ID NO: 169552 - protein, 9 aa, Artificial Sequence
  Description of Artificial Sequence: Synthetic peptide
  Seed: GYSDPTGKY (TYRP1_HUMAN)
GYSDPTGKM

SEQ ID NO: 169553 - protein, 9 aa, Artificial Sequence
  Description of Artificial Sequence: Synthetic peptide
  Seed: FLTWHRYHL (TYRP1_HUMAN)
FQTWHRYHI

SEQ ID NO: 169554 - protein, 9 aa, Artificial Sequence
  Description of Artificial Sequence: Synthetic peptide
  Seed: HLSPNDPIF (TYRP1_HUMAN)
HPSPNDPIM

SEQ ID NO: 169555 - protein, 10 aa, Artificial Sequence
  Description of Artificial Sequence: Synthetic peptide
  Seed: FLTWHRYHLL (TYRP1_HUMAN)
FQTWHRYHLI

SEQ ID NO: 169556 - protein, 9 aa, Artificial Sequence
  Description of Artificial Sequence: Synthetic peptide
  Seed: VWPLRFFNR (TYRP1_HUMAN)
VSPLRFFNR

SEQ ID NO: 169557 - protein, 11 aa, Artificial Sequence
  Description of Artificial Sequence: Synthetic peptide
  Seed: QEMLQEPSFSL (TYRP1_HUMAN)
QFMLQEPSFSV

SEQ ID NO: 169558 - protein, 9 aa, Artificial Sequence
  Description of Artificial Sequence: Synthetic peptide
  Seed: RYNADISTF (TYRP1_HUMAN)
RTNADISTF

SEQ ID NO: 169559 - protein, 10 aa, Artificial Sequence
  Description of Artificial Sequence: Synthetic peptide
  Seed: QFENISIYNY (TYRP1_HUMAN)
QQENISIYNW

SEQ ID NO: 169560 - protein, 9 aa, Artificial Sequence
  Description of Artificial Sequence: Synthetic peptide
  Seed: RTCHCNGNF (TYRP1_HUMAN)
RFCHCNGNY

SEQ ID NO: 169561 - protein, 8 aa, Artificial Sequence
  Description of Artificial Sequence: Synthetic peptide
  Seed: IQWPSREF (TYRP1_HUMAN)
IMWPSREF

SEQ ID NO: 169562 - protein, 10 aa, Artificial Sequence
  Description of Artificial Sequence: Synthetic peptide
  Seed: TPQFENISIY (TYRP1_HUMAN)
TPQFENISIM

SEQ ID NO: 169563 - protein, 10 aa, Artificial Sequence
  Description of Artificial Sequence: Synthetic peptide
  Seed: FSLPYWNFAT (TYRP1_HUMAN)
FKLPYWNFAI

SEQ ID NO: 169564 - protein, 11 aa, Artificial Sequence
  Description of Artificial Sequence: Synthetic peptide
  Seed: MLQEPSFSLPY (TYRP1_HUMAN)
MAQEPSFSLPY

SEQ ID NO: 169565 - protein, 8 aa, Artificial Sequence
  Description of Artificial Sequence: Synthetic peptide
  Seed: TWHRYHLL (TYRP1_HUMAN)
TYHRYHLF

SEQ ID NO: 169566 - protein, 9 aa, Artificial Sequence
  Description of Artificial Sequence: Synthetic peptide
  Seed: NMVPFWPPV (TYRP1_HUMAN)
NTVPFWPPI

SEQ ID NO: 169567 - protein, 9 aa, Artificial Sequence
  Description of Artificial Sequence: Synthetic peptide
  Seed: TAPDNLGYT (TYRP1_HUMAN)
TLPDNLGYL

SEQ ID NO: 169568 - protein, 9 aa, Artificial Sequence
  Description of Artificial Sequence: Synthetic peptide
  Seed: ISIYNYFVW (TYRP1_HUMAN)
IQIYNYFVA

SEQ ID NO: 169569 - protein, 10 aa, Artificial Sequence
  Description of Artificial Sequence: Synthetic peptide
  Seed: AVFDEWLRRY (TYRP1_HUMAN)
ATFDEWLRRY

SEQ ID NO: 169570 - protein, 9 aa, Artificial Sequence
  Description of Artificial Sequence: Synthetic peptide
  Seed: RVLIVRRNL (TYRP1_HUMAN)
RPLIVRRNM

SEQ ID NO: 169571 - protein, 9 aa, Artificial Sequence
  Description of Artificial Sequence: Synthetic peptide
  Seed: GTASYLIRA (TYRP1_HUMAN)
GMASYLIRL

SEQ ID NO: 169572 - protein, 9 aa, Artificial Sequence
  Description of Artificial Sequence: Synthetic peptide
  Seed: TFPLENAPI (TYRP1_HUMAN)
TGPLENAPL

SEQ ID NO: 169573 - protein, 9 aa, Artificial Sequence
  Description of Artificial Sequence: Synthetic peptide
  Seed: MFVTAPDNL (TYRP1_HUMAN)
MAVTAPDNL

SEQ ID NO: 169574 - protein, 9 aa, Artificial Sequence
  Description of Artificial Sequence: Synthetic peptide
  Seed: QRLPEPQDV (TYRP1_HUMAN)
QRLPEPQDY

SEQ ID NO: 169575 - protein, 9 aa, Artificial Sequence
  Description of Artificial Sequence: Synthetic peptide
  Seed: TTHPLFVIA (TYRP1_HUMAN)
TIHPLFVIY

SEQ ID NO: 169576 - protein, 10 aa, Artificial Sequence
  Description of Artificial Sequence: Synthetic peptide
  Seed: ATVEALRSGM (TYRP1_HUMAN)
AVVEALRSGV

SEQ ID NO: 169577 - protein, 9 aa, Artificial Sequence
  Description of Artificial Sequence: Synthetic peptide
  Seed: LHTFTDAVF (TYRP1_HUMAN)
LATFTDAVY

SEQ ID NO: 169578 - protein, 9 aa, Artificial Sequence
  Description of Artificial Sequence: Synthetic peptide
  Seed: RQYNMVPFW (TYRP1_HUMAN)
RIYNMVPFW

SEQ ID NO: 169579 - protein, 9 aa, Artificial Sequence
  Description of Artificial Sequence: Synthetic peptide
  Seed: ASYLIRARR (TYRP1_HUMAN)
ATYLIRARR

SEQ ID NO: 169580 - protein, 9 aa, Artificial Sequence
  Description of Artificial Sequence: Synthetic peptide
  Seed: IGHNRQYNM (TYRP1_HUMAN)
ISHNRQYNY

SEQ ID NO: 169581 - protein, 9 aa, Artificial Sequence
  Description of Artificial Sequence: Synthetic peptide
  Seed: IAIAVVGAL (TYRP1_HUMAN)
IVIAVVGAM

SEQ ID NO: 169582 - protein, 9 aa, Artificial Sequence
  Description of Artificial Sequence: Synthetic peptide
  Seed: AVVGALLLV (TYRP1_HUMAN)
ASVGALLLF

SEQ ID NO: 169583 - protein, 8 aa, Artificial Sequence
  Description of Artificial Sequence: Synthetic peptide
  Seed: ADISTFPL (TYRP1_HUMAN)
AEISTFPM

SEQ ID NO: 169584 - protein, 9 aa, Artificial Sequence
  Description of Artificial Sequence: Synthetic peptide
  Seed: FLTWHRYHL (TYRP1_HUMAN)
FMTWHRYHM

SEQ ID NO: 169585 - protein, 10 aa, Artificial Sequence
  Description of Artificial Sequence: Synthetic peptide
  Seed: YFVWTHYYSV (TYRP1_HUMAN)
YLVWTHYYSL

SEQ ID NO: 169586 - protein, 9 aa, Artificial Sequence
  Description of Artificial Sequence: Synthetic peptide
  Seed: YNYFVWTHY (TYRP1_HUMAN)
YAYFVWTHV

SEQ ID NO: 169587 - protein, 10 aa, Artificial Sequence
  Description of Artificial Sequence: Synthetic peptide
  Seed: VGLFDTPPFY (TYRP1_HUMAN)
VRLFDTPPFY

SEQ ID NO: 169588 - protein, 9 aa, Artificial Sequence
  Description of Artificial Sequence: Synthetic peptide
  Seed: FSHEGPAFL (TYRP1_HUMAN)
FEHEGPAFY

SEQ ID NO: 169589 - protein, 8 aa, Artificial Sequence
  Description of Artificial Sequence: Synthetic peptide
  Seed: FSHEGPAF (TYRP1_HUMAN)
FFHEGPAI

SEQ ID NO: 169590 - protein, 9 aa, Artificial Sequence
  Description of Artificial Sequence: Synthetic peptide
  Seed: MLQEPSFSL (TYRP1_HUMAN)
MSQEPSFSW

SEQ ID NO: 169591 - protein, 10 aa, Artificial Sequence
  Description of Artificial Sequence: Synthetic peptide
  Seed: MQEMLQEPSF (TYRP1_HUMAN)
MLEMLQEPSW

SEQ ID NO: 169592 - protein, 11 aa, Artificial Sequence
  Description of Artificial Sequence: Synthetic peptide
  Seed: PPFYSNSTNSF (TYRP1_HUMAN)
PYFYSNSTNSF

SEQ ID NO: 169593 - protein, 9 aa, Artificial Sequence
  Description of Artificial Sequence: Synthetic peptide
  Seed: KYDPAVRSL (TYRP1_HUMAN)
KDDPAVRSL

SEQ ID NO: 169594 - protein, 9 aa, Artificial Sequence
  Description of Artificial Sequence: Synthetic peptide
  Seed: SKEEKNHFV (TYRP1_HUMAN)
SQEEKNHFL

SEQ ID NO: 169595 - protein, 10 aa, Artificial Sequence
  Description of Artificial Sequence: Synthetic peptide
  Seed: KRTTHPLFVI (TYRP1_HUMAN)
KRTTHPLFVF

SEQ ID NO: 169596 - protein, 11 aa, Artificial Sequence
  Description of Artificial Sequence: Synthetic peptide
  Seed: REVWPLRFFNR (TYRP1_HUMAN)
RNVWPLRFFNR

SEQ ID NO: 169597 - protein, 9 aa, Artificial Sequence
  Description of Artificial Sequence: Synthetic peptide
  Seed: FTDAVFDEW (TYRP1_HUMAN)
FQDAVFDEW

SEQ ID NO: 169598 - protein, 9 aa, Artificial Sequence
  Description of Artificial Sequence: Synthetic peptide
  Seed: KLLSLGCIF (TYRP1_HUMAN)
KRLSLGCIF

SEQ ID NO: 169599 - protein, 10 aa, Artificial Sequence
  Description of Artificial Sequence: Synthetic peptide
  Seed: NYFVWTHYYS (TYRP1_HUMAN)
NFFVWTHYYD

SEQ ID NO: 169600 - protein, 10 aa, Artificial Sequence
  Description of Artificial Sequence: Synthetic peptide
  Seed: LGPDGNTPQF (TYRP1_HUMAN)
LIPDGNTPQY

SEQ ID NO: 169601 - protein, 10 aa, Artificial Sequence
  Description of Artificial Sequence: Synthetic peptide
  Seed: RSMDEANQPL (TYRP1_HUMAN)
RVMDEANQPV

SEQ ID NO: 169602 - protein, 10 aa, Artificial Sequence
  Description of Artificial Sequence: Synthetic peptide
  Seed: EDYDTLGTLC (TYRP1_HUMAN)
EEYDTLGTLA

SEQ ID NO: 169603 - protein, 9 aa, Artificial Sequence
  Description of Artificial Sequence: Synthetic peptide
  Seed: FYSNSTNSF (TYRP1_HUMAN)
FWSNSTNSY

SEQ ID NO: 169604 - protein, 10 aa, Artificial Sequence
  Description of Artificial Sequence: Synthetic peptide
  Seed: LQEPSFSLPY (TYRP1_HUMAN)
LQEPSFSLPF

SEQ ID NO: 169605 - protein, 9 aa, Artificial Sequence
  Description of Artificial Sequence: Synthetic peptide
  Seed: RQYNMVPFW (TYRP1_HUMAN)
RVYNMVPFI

SEQ ID NO: 169606 - protein, 9 aa, Artificial Sequence
  Description of Artificial Sequence: Synthetic peptide
  Seed: GLFDTPPFY (TYRP1_HUMAN)
GVFDTPPFM

SEQ ID NO: 169607 - protein, 8 aa, Artificial Sequence
  Description of Artificial Sequence: Synthetic peptide
  Seed: IFFPLLLF (TYRP1_HUMAN)
IYFPLLLY

SEQ ID NO: 169608 - protein, 9 aa, Artificial Sequence
  Description of Artificial Sequence: Synthetic peptide
  Seed: STNSFRNTV (TYRP1_HUMAN)
SMNSFRNTI

SEQ ID NO: 169609 - protein, 11 aa, Artificial Sequence
  Description of Artificial Sequence: Synthetic peptide
  Seed: MFVTAPDNLGY (TYRP1_HUMAN)
MQVTAPDNLGW

SEQ ID NO: 169610 - protein, 9 aa, Artificial Sequence
  Description of Artificial Sequence: Synthetic peptide
  Seed: MFVTAPDNL (TYRP1_HUMAN)
MYVTAPDNI

SEQ ID NO: 169611 - protein, 8 aa, Artificial Sequence
  Description of Artificial Sequence: Synthetic peptide
  Seed: YSNSTNSF (TYRP1_HUMAN)
YANSTNSL

SEQ ID NO: 169612 - protein, 9 aa, Artificial Sequence
  Description of Artificial Sequence: Synthetic peptide
  Seed: SFSLPYWNF (TYRP1_HUMAN)
SWSLPYWNY

SEQ ID NO: 169613 - protein, 10 aa, Artificial Sequence
  Description of Artificial Sequence: Synthetic peptide
  Seed: RRYNADISTF (TYRP1_HUMAN)
RFYNADISTW

SEQ ID NO: 169614 - protein, 9 aa, Artificial Sequence
  Description of Artificial Sequence: Synthetic peptide
  Seed: IATRRSEEI (TYRP1_HUMAN)
ISTRRSEEM

SEQ ID NO: 169615 - protein, 9 aa, Artificial Sequence
  Description of Artificial Sequence: Synthetic peptide
  Seed: QQARAQFPR (TYRP1_HUMAN)
QMARAQFPR

SEQ ID NO: 169616 - protein, 9 aa, Artificial Sequence
  Description of Artificial Sequence: Synthetic peptide
  Seed: LSKEEKNHF (TYRP1_HUMAN)
LMKEEKNHY

SEQ ID NO: 169617 - protein, 10 aa, Artificial Sequence
  Description of Artificial Sequence: Synthetic peptide
  Seed: LSPNDPIFVL (TYRP1_HUMAN)
LMPNDPIFVL

SEQ ID NO: 169618 - protein, 9 aa, Artificial Sequence
  Description of Artificial Sequence: Synthetic peptide
  Seed: MDEANQPLL (TYRP1_HUMAN)
MIEANQPLM

SEQ ID NO: 169619 - protein, 11 aa, Artificial Sequence
  Description of Artificial Sequence: Synthetic peptide
  Seed: RRYNADISTFP (TYRP1_HUMAN)
RWYNADISTFF

SEQ ID NO: 169620 - protein, 10 aa, Artificial Sequence
  Description of Artificial Sequence: Synthetic peptide
  Seed: ADSRPHSPQY (TYRP1_HUMAN)
ARSRPHSPQK

SEQ ID NO: 169621 - protein, 10 aa, Artificial Sequence
  Description of Artificial Sequence: Synthetic peptide
  Seed: GMCCPDLSPV (TYRP1_HUMAN)
GMCCPDLSPL

SEQ ID NO: 169622 - protein, 10 aa, Artificial Sequence
  Description of Artificial Sequence: Synthetic peptide
  Seed: WPPVTNTEMF (TYRP1_HUMAN)
WIPVTNTEMY

SEQ ID NO: 169623 - protein, 9 aa, Artificial Sequence
  Description of Artificial Sequence: Synthetic peptide
  Seed: MLQEPSFSL (TYRP1_HUMAN)
MWQEPSFSL

SEQ ID NO: 169624 - protein, 9 aa, Artificial Sequence
  Description of Artificial Sequence: Synthetic peptide
  Seed: MSAPKLLSL (TYRP1_HUMAN)
MSAPKLLSH

SEQ ID NO: 169625 - protein, 9 aa, Artificial Sequence
  Description of Artificial Sequence: Synthetic peptide
  Seed: LEVGLFDTP (TYRP1_HUMAN)
LEVGLFDTV

SEQ ID NO: 169626 - protein, 10 aa, Artificial Sequence
  Description of Artificial Sequence: Synthetic peptide
  Seed: MLQEPSFSLP (TYRP1_HUMAN)
MLQEPSFSLW

SEQ ID NO: 169627 - protein, 10 aa, Artificial Sequence
  Description of Artificial Sequence: Synthetic peptide
  Seed: FLNGTGGQTH (TYRP1_HUMAN)
FSNGTGGQTY

SEQ ID NO: 169628 - protein, 9 aa, Artificial Sequence
  Description of Artificial Sequence: Synthetic peptide
  Seed: FSHEGPAFL (TYRP1_HUMAN)
FNHEGPAFL

SEQ ID NO: 169629 - protein, 9 aa, Artificial Sequence
  Description of Artificial Sequence: Synthetic peptide
  Seed: FSHEGPAFL (TYRP1_HUMAN)
FSHEGPAFW

SEQ ID NO: 169630 - protein, 10 aa, Artificial Sequence
  Description of Artificial Sequence: Synthetic peptide
  Seed: NISIYNYFVW (TYRP1_HUMAN)
NYSIYNYFVW

SEQ ID NO: 169631 - protein, 9 aa, Artificial Sequence
  Description of Artificial Sequence: Synthetic peptide
  Seed: SLHNLAHLF (TYRP1_HUMAN)
SQHNLAHLL

SEQ ID NO: 169632 - protein, 9 aa, Artificial Sequence
  Description of Artificial Sequence: Synthetic peptide
  Seed: SFSLPYWNF (TYRP1_HUMAN)
SQSLPYWNY

SEQ ID NO: 169633 - protein, 9 aa, Artificial Sequence
  Description of Artificial Sequence: Synthetic peptide
  Seed: RRNLLDLSK (TYRP1_HUMAN)
RQNLLDLSL

SEQ ID NO: 169634 - protein, 9 aa, Artificial Sequence
  Description of Artificial Sequence: Synthetic peptide
  Seed: LLHTFTDAV (TYRP1_HUMAN)
LLHTFTDAM

SEQ ID NO: 169635 - protein, 10 aa, Artificial Sequence
  Description of Artificial Sequence: Synthetic peptide
  Seed: FLNGTGGQTH (TYRP1_HUMAN)
FMNGTGGQTY

SEQ ID NO: 169636 - protein, 9 aa, Artificial Sequence
  Description of Artificial Sequence: Synthetic peptide
  Seed: TTHPLFVIA (TYRP1_HUMAN)
TSHPLFVIY

SEQ ID NO: 169637 - protein, 10 aa, Artificial Sequence
  Description of Artificial Sequence: Synthetic peptide
  Seed: GNVARPMVQR (TYRP1_HUMAN)
GNVARPMVQK

SEQ ID NO: 169638 - protein, 9 aa, Artificial Sequence
  Description of Artificial Sequence: Synthetic peptide
  Seed: FVWTHYYSV (TYRP1_HUMAN)
FCWTHYYSV

SEQ ID NO: 169639 - protein, 9 aa, Artificial Sequence
  Description of Artificial Sequence: Synthetic peptide
  Seed: REFSVPEII (TYRP1_HUMAN)
RTFSVPEIV

SEQ ID NO: 169640 - protein, 9 aa, Artificial Sequence
  Description of Artificial Sequence: Synthetic peptide
  Seed: FSHEGPAFL (TYRP1_HUMAN)
FAHEGPAFV

SEQ ID NO: 169641 - protein, 9 aa, Artificial Sequence
  Description of Artificial Sequence: Synthetic peptide
  Seed: RQYNMVPFW (TYRP1_HUMAN)
RRYNMVPFY

SEQ ID NO: 169642 - protein, 10 aa, Artificial Sequence
  Description of Artificial Sequence: Synthetic peptide
  Seed: ADSRPHSPQY (TYRP1_HUMAN)
AQSRPHSPQK

SEQ ID NO: 169643 - protein, 10 aa, Artificial Sequence
  Description of Artificial Sequence: Synthetic peptide
  Seed: YFVWTHYYSV (TYRP1_HUMAN)
YHVWTHYYSV

SEQ ID NO: 169644 - protein, 9 aa, Artificial Sequence
  Description of Artificial Sequence: Synthetic peptide
  Seed: GLFDTPPFY (TYRP1_HUMAN)
GLFDTPPFV

SEQ ID NO: 169645 - protein, 9 aa, Artificial Sequence
  Description of Artificial Sequence: Synthetic peptide
  Seed: AVRSLHNLA (TYRP1_HUMAN)
AARSLHNLI

SEQ ID NO: 169646 - protein, 10 aa, Artificial Sequence
  Description of Artificial Sequence: Synthetic peptide
  Seed: AVRSLHNLAH (TYRP1_HUMAN)
ALRSLHNLAK

SEQ ID NO: 169647 - protein, 10 aa, Artificial Sequence
  Description of Artificial Sequence: Synthetic peptide
  Seed: LSPNDPIFVL (TYRP1_HUMAN)
LAPNDPIFVY

SEQ ID NO: 169648 - protein, 9 aa, Artificial Sequence
  Description of Artificial Sequence: Synthetic peptide
  Seed: EGYSDPTGK (TYRP1_HUMAN)
EAYSDPTGR

SEQ ID NO: 169649 - protein, 9 aa, Artificial Sequence
  Description of Artificial Sequence: Synthetic peptide
  Seed: FYSNSTNSF (TYRP1_HUMAN)
FMSNSTNSF

SEQ ID NO: 169650 - protein, 10 aa, Artificial Sequence
  Description of Artificial Sequence: Synthetic peptide
  Seed: YFVWTHYYSV (TYRP1_HUMAN)
YIVWTHYYSL

SEQ ID NO: 169651 - protein, 10 aa, Artificial Sequence
  Description of Artificial Sequence: Synthetic peptide
  Seed: SPNSVFSQWR (TYRP1_HUMAN)
SLNSVFSQWR

SEQ ID NO: 169652 - protein, 9 aa, Artificial Sequence
  Description of Artificial Sequence: Synthetic peptide
  Seed: MAKRTTHPL (TYRP1_HUMAN)
MFKRTTHPK

SEQ ID NO: 169653 - protein, 9 aa, Artificial Sequence
  Description of Artificial Sequence: Synthetic peptide
  Seed: SMDEANQPL (TYRP1_HUMAN)
SQDEANQPW

SEQ ID NO: 169654 - protein, 10 aa, Artificial Sequence
  Description of Artificial Sequence: Synthetic peptide
  Seed: LLTDQYQCYA (TYRP1_HUMAN)
LLTDQYQCYV

SEQ ID NO: 169655 - protein, 10 aa, Artificial Sequence
  Description of Artificial Sequence: Synthetic peptide
  Seed: KRTTHPLFVI (TYRP1_HUMAN)
KHTTHPLFVF

SEQ ID NO: 169656 - protein, 9 aa, Artificial Sequence
  Description of Artificial Sequence: Synthetic peptide
  Seed: KEEKNHFVR (TYRP1_HUMAN)
KEEKNHFVW

SEQ ID NO: 169657 - protein, 9 aa, Artificial Sequence
  Description of Artificial Sequence: Synthetic peptide
  Seed: GTASYLIRA (TYRP1_HUMAN)
GQASYLIRV

SEQ ID NO: 169658 - protein, 9 aa, Artificial Sequence
  Description of Artificial Sequence: Synthetic peptide
  Seed: SMDEANQPL (TYRP1_HUMAN)
SVDEANQPL

SEQ ID NO: 169659 - protein, 9 aa, Artificial Sequence
  Description of Artificial Sequence: Synthetic peptide
  Seed: RFFNRTCHC (TYRP1_HUMAN)
RTFNRTCHG

SEQ ID NO: 169660 - protein, 9 aa, Artificial Sequence
  Description of Artificial Sequence: Synthetic peptide
  Seed: MLQEPSFSL (TYRP1_HUMAN)
MMQEPSFSK

SEQ ID NO: 169661 - protein, 10 aa, Artificial Sequence
  Description of Artificial Sequence: Synthetic peptide
  Seed: LIFGTASYLI (TYRP1_HUMAN)
LGFGTASYLF

SEQ ID NO: 169662 - protein, 9 aa, Artificial Sequence
  Description of Artificial Sequence: Synthetic peptide
  Seed: LVALIFGTA (TYRP1_HUMAN)
LPALIFGTP

SEQ ID NO: 169663 - protein, 9 aa, Artificial Sequence
  Description of Artificial Sequence: Synthetic peptide
  Seed: FTDAVFDEW (TYRP1_HUMAN)
FTDAVFDEL

SEQ ID NO: 169664 - protein, 9 aa, Artificial Sequence
  Description of Artificial Sequence: Synthetic peptide
  Seed: LEKDMQEML (TYRP1_HUMAN)
LEKDMQEMP

SEQ ID NO: 169665 - protein, 9 aa, Artificial Sequence
  Description of Artificial Sequence: Synthetic peptide
  Seed: FSLPYWNFA (TYRP1_HUMAN)
FMLPYWNFL

SEQ ID NO: 169666 - protein, 9 aa, Artificial Sequence
  Description of Artificial Sequence: Synthetic peptide
  Seed: RSLHNLAHL (TYRP1_HUMAN)
RVLHNLAHY

SEQ ID NO: 169667 - protein, 9 aa, Artificial Sequence
  Description of Artificial Sequence: Synthetic peptide
  Seed: MLQEPSFSL (TYRP1_HUMAN)
MKQEPSFSI

SEQ ID NO: 169668 - protein, 9 aa, Artificial Sequence
  Description of Artificial Sequence: Synthetic peptide
  Seed: ENISIYNYF (TYRP1_HUMAN)
EAISIYNYW

SEQ ID NO: 169669 - protein, 9 aa, Artificial Sequence
  Description of Artificial Sequence: Synthetic peptide
  Seed: TTHPLFVIA (TYRP1_HUMAN)
TQHPLFVIV

SEQ ID NO: 169670 - protein, 10 aa, Artificial Sequence
  Description of Artificial Sequence: Synthetic peptide
  Seed: LGPDGNTPQF (TYRP1_HUMAN)
LVPDGNTPQL

SEQ ID NO: 169671 - protein, 11 aa, Artificial Sequence
  Description of Artificial Sequence: Synthetic peptide
  Seed: KTFLGVGQESF (TYRP1_HUMAN)
KMFLGVGQESY

SEQ ID NO: 169672 - protein, 10 aa, Artificial Sequence
  Description of Artificial Sequence: Synthetic peptide
  Seed: FLNGTGGQTH (TYRP1_HUMAN)
FANGTGGQTF

SEQ ID NO: 169673 - protein, 8 aa, Artificial Sequence
  Description of Artificial Sequence: Synthetic peptide
  Seed: RQYNMVPF (TYRP1_HUMAN)
RMYNMVPM

SEQ ID NO: 169674 - protein, 10 aa, Artificial Sequence
  Description of Artificial Sequence: Synthetic peptide
  Seed: AQFPRQCATV (TYRP1_HUMAN)
ASFPRQCATY

SEQ ID NO: 169675 - protein, 9 aa, Artificial Sequence
  Description of Artificial Sequence: Synthetic peptide
  Seed: VFDEWLRRY (TYRP1_HUMAN)
VQDEWLRRL

SEQ ID NO: 169676 - protein, 9 aa, Artificial Sequence
  Description of Artificial Sequence: Synthetic peptide
  Seed: IFGTASYLI (TYRP1_HUMAN)
IYGTASYLW

SEQ ID NO: 169677 - protein, 9 aa, Artificial Sequence
  Description of Artificial Sequence: Synthetic peptide
  Seed: GPDGNTPQF (TYRP1_HUMAN)
GMDGNTPQY

SEQ ID NO: 169678 - protein, 11 aa, Artificial Sequence
  Description of Artificial Sequence: Synthetic peptide
  Seed: YNYFVWTHYYS (TYRP1_HUMAN)
YFYFVWTHYYD

SEQ ID NO: 169679 - protein, 9 aa, Artificial Sequence
  Description of Artificial Sequence: Synthetic peptide
  Seed: NRQYNMVPF (TYRP1_HUMAN)
NKQYNMVPF

SEQ ID NO: 169680 - protein, 9 aa, Artificial Sequence
  Description of Artificial Sequence: Synthetic peptide
  Seed: KLQNPNQSV (TYRP1_HUMAN)
KQQNPNQSW

SEQ ID NO: 169681 - protein, 10 aa, Artificial Sequence
  Description of Artificial Sequence: Synthetic peptide
  Seed: LLLVALIFGT (TYRP1_HUMAN)
LELVALIFGL

SEQ ID NO: 169682 - protein, 9 aa, Artificial Sequence
  Description of Artificial Sequence: Synthetic peptide
  Seed: RQYNMVPFW (TYRP1_HUMAN)
RIYNMVPFM

SEQ ID NO: 169683 - protein, 9 aa, Artificial Sequence
  Description of Artificial Sequence: Synthetic peptide
  Seed: FVWTHYYSV (TYRP1_HUMAN)
FMWTHYYST

SEQ ID NO: 169684 - protein, 10 aa, Artificial Sequence
  Description of Artificial Sequence: Synthetic peptide
  Seed: SQWRVVCDSL (TYRP1_HUMAN)
SQWRVVCDSY

SEQ ID NO: 169685 - protein, 9 aa, Artificial Sequence
  Description of Artificial Sequence: Synthetic peptide
  Seed: FYSNSTNSF (TYRP1_HUMAN)
FISNSTNSL

SEQ ID NO: 169686 - protein, 10 aa, Artificial Sequence
  Description of Artificial Sequence: Synthetic peptide
  Seed: TAPDNLGYTY (TYRP1_HUMAN)
TSPDNLGYTM

SEQ ID NO: 169687 - protein, 9 aa, Artificial Sequence
  Description of Artificial Sequence: Synthetic peptide
  Seed: RLEKDMQEM (TYRP1_HUMAN)
RQEKDMQEY

SEQ ID NO: 169688 - protein, 9 aa, Artificial Sequence
  Description of Artificial Sequence: Synthetic peptide
  Seed: AQFPRQCAT (TYRP1_HUMAN)
AFFPRQCAF

SEQ ID NO: 169689 - protein, 9 aa, Artificial Sequence
  Description of Artificial Sequence: Synthetic peptide
  Seed: YLIRARRSM (TYRP1_HUMAN)
YAIRARRSL

SEQ ID NO: 169690 - protein, 9 aa, Artificial Sequence
  Description of Artificial Sequence: Synthetic peptide
  Seed: LLHTFTDAV (TYRP1_HUMAN)
LVHTFTDAL

SEQ ID NO: 169691 - protein, 10 aa, Artificial Sequence
  Description of Artificial Sequence: Synthetic peptide
  Seed: YNMVPFWPPV (TYRP1_HUMAN)
YRMVPFWPPA

SEQ ID NO: 169692 - protein, 9 aa, Artificial Sequence
  Description of Artificial Sequence: Synthetic peptide
  Seed: SMDEANQPL (TYRP1_HUMAN)
SHDEANQPW

SEQ ID NO: 169693 - protein, 9 aa, Artificial Sequence
  Description of Artificial Sequence: Synthetic peptide
  Seed: RYNADISTF (TYRP1_HUMAN)
RWNADISTF

SEQ ID NO: 169694 - protein, 9 aa, Artificial Sequence
  Description of Artificial Sequence: Synthetic peptide
  Seed: GPDGNTPQF (TYRP1_HUMAN)
GWDGNTPQM

SEQ ID NO: 169695 - protein, 10 aa, Artificial Sequence
  Description of Artificial Sequence: Synthetic peptide
  Seed: EMLQEPSFSL (TYRP1_HUMAN)
ELLQEPSFSL

SEQ ID NO: 169696 - protein, 10 aa, Artificial Sequence
  Description of Artificial Sequence: Synthetic peptide
  Seed: NYFVWTHYYS (TYRP1_HUMAN)
NFFVWTHYYW

SEQ ID NO: 169697 - protein, 9 aa, Artificial Sequence
  Description of Artificial Sequence: Synthetic peptide
  Seed: NYFVWTHYY (TYRP1_HUMAN)
NLFVWTHYR

SEQ ID NO: 169698 - protein, 9 aa, Artificial Sequence
  Description of Artificial Sequence: Synthetic peptide
  Seed: TLISPNSVF (TYRP1_HUMAN)
TWISPNSVL

SEQ ID NO: 169699 - protein, 9 aa, Artificial Sequence
  Description of Artificial Sequence: Synthetic peptide
  Seed: TTHPLFVIA (TYRP1_HUMAN)
TPHPLFVIV

SEQ ID NO: 169700 - protein, 9 aa, Artificial Sequence
  Description of Artificial Sequence: Synthetic peptide
  Seed: FSLPYWNFA (TYRP1_HUMAN)
FILPYWNFM

SEQ ID NO: 169701 - protein, 9 aa, Artificial Sequence
  Description of Artificial Sequence: Synthetic peptide
  Seed: VPFWPPVTN (TYRP1_HUMAN)
VPFWPPVTY

SEQ ID NO: 169702 - protein, 10 aa, Artificial Sequence
  Description of Artificial Sequence: Synthetic peptide
  Seed: VALIFGTASY (TYRP1_HUMAN)
VKLIFGTASY

SEQ ID NO: 169703 - protein, 9 aa, Artificial Sequence
  Description of Artificial Sequence: Synthetic peptide
  Seed: ALIFGTASY (TYRP1_HUMAN)
ATIFGTASK

SEQ ID NO: 169704 - protein, 9 aa, Artificial Sequence
  Description of Artificial Sequence: Synthetic peptide
  Seed: ENAPIGHNR (TYRP1_HUMAN)
EGAPIGHNR

SEQ ID NO: 169705 - protein, 9 aa, Artificial Sequence
  Description of Artificial Sequence: Synthetic peptide
  Seed: SLHNLAHLF (TYRP1_HUMAN)
SVHNLAHLF

SEQ ID NO: 169706 - protein, 9 aa, Artificial Sequence
  Description of Artificial Sequence: Synthetic peptide
  Seed: EIQWPSREF (TYRP1_HUMAN)
EMQWPSRER

SEQ ID NO: 169707 - protein, 11 aa, Artificial Sequence
  Description of Artificial Sequence: Synthetic peptide
  Seed: VTAPDNLGYTY (TYRP1_HUMAN)
VSAPDNLGYTW

SEQ ID NO: 169708 - protein, 9 aa, Artificial Sequence
  Description of Artificial Sequence: Synthetic peptide
  Seed: APIGHNRQY (TYRP1_HUMAN)
AHIGHNRQF

SEQ ID NO: 169709 - protein, 9 aa, Artificial Sequence
  Description of Artificial Sequence: Synthetic peptide
  Seed: SVPEIIAIA (TYRP1_HUMAN)
SPPEIIAIA

SEQ ID NO: 169710 - protein, 9 aa, Artificial Sequence
  Description of Artificial Sequence: Synthetic peptide
  Seed: VLIVRRNLL (TYRP1_HUMAN)
VAIVRRNLF

SEQ ID NO: 169711 - protein, 10 aa, Artificial Sequence
  Description of Artificial Sequence: Synthetic peptide
  Seed: KLLSLGCIFF (TYRP1_HUMAN)
KMLSLGCIFF

SEQ ID NO: 169712 - protein, 9 aa, Artificial Sequence
  Description of Artificial Sequence: Synthetic peptide
  Seed: YTYEIQWPS (TYRP1_HUMAN)
YAYEIQWPI

SEQ ID NO: 169713 - protein, 10 aa, Artificial Sequence
  Description of Artificial Sequence: Synthetic peptide
  Seed: ENISIYNYFV (TYRP1_HUMAN)
ELISIYNYFI

SEQ ID NO: 169714 - protein, 9 aa, Artificial Sequence
  Description of Artificial Sequence: Synthetic peptide
  Seed: RAQFPRQCA (TYRP1_HUMAN)
RMQFPRQCK

SEQ ID NO: 169715 - protein, 10 aa, Artificial Sequence
  Description of Artificial Sequence: Synthetic peptide
  Seed: STLISPNSVF (TYRP1_HUMAN)
SNLISPNSVY

SEQ ID NO: 169716 - protein, 10 aa, Artificial Sequence
  Description of Artificial Sequence: Synthetic peptide
  Seed: SIYNYFVWTH (TYRP1_HUMAN)
SYYNYFVWTK

SEQ ID NO: 169717 - protein, 10 aa, Artificial Sequence
  Description of Artificial Sequence: Synthetic peptide
  Seed: YNYFVWTHYY (TYRP1_HUMAN)
YFYFVWTHYD

SEQ ID NO: 169718 - protein, 9 aa, Artificial Sequence
  Description of Artificial Sequence: Synthetic peptide
  Seed: FYSNSTNSF (TYRP1_HUMAN)
FCSNSTNSY

SEQ ID NO: 169719 - protein, 9 aa, Artificial Sequence
  Description of Artificial Sequence: Synthetic peptide
  Seed: SMDEANQPL (TYRP1_HUMAN)
SIDEANQPF

SEQ ID NO: 169720 - protein, 8 aa, Artificial Sequence
  Description of Artificial Sequence: Synthetic peptide
  Seed: YSNSTNSF (TYRP1_HUMAN)
YYNSTNSI

SEQ ID NO: 169721 - protein, 9 aa, Artificial Sequence
  Description of Artificial Sequence: Synthetic peptide
  Seed: TLISPNSVF (TYRP1_HUMAN)
TYISPNSVF

SEQ ID NO: 169722 - protein, 9 aa, Artificial Sequence
  Description of Artificial Sequence: Synthetic peptide
  Seed: SVFSQWRVV (TYRP1_HUMAN)
SAFSQWRVI

SEQ ID NO: 169723 - protein, 9 aa, Artificial Sequence
  Description of Artificial Sequence: Synthetic peptide
  Seed: FSVPEIIAI (TYRP1_HUMAN)
FTVPEIIAY

SEQ ID NO: 169724 - protein, 9 aa, Artificial Sequence
  Description of Artificial Sequence: Synthetic peptide
  Seed: GYSDPTGKY (TYRP1_HUMAN)
GQSDPTGKF

SEQ ID NO: 169725 - protein, 9 aa, Artificial Sequence
  Description of Artificial Sequence: Synthetic peptide
  Seed: YTYEIQWPS (TYRP1_HUMAN)
YTYEIQWPG

SEQ ID NO: 169726 - protein, 11 aa, Artificial Sequence
  Description of Artificial Sequence: Synthetic peptide
  Seed: MLQEPSFSLPY (TYRP1_HUMAN)
MPQEPSFSLPF

SEQ ID NO: 169727 - protein, 9 aa, Artificial Sequence
  Description of Artificial Sequence: Synthetic peptide
  Seed: AIAVVGALL (TYRP1_HUMAN)
AQAVVGALV

SEQ ID NO: 169728 - protein, 10 aa, Artificial Sequence
  Description of Artificial Sequence: Synthetic peptide
  Seed: AFLTWHRYHL (TYRP1_HUMAN)
AYLTWHRYHF

SEQ ID NO: 169729 - protein, 10 aa, Artificial Sequence
  Description of Artificial Sequence: Synthetic peptide
  Seed: LLLVALIFGT (TYRP1_HUMAN)
LHLVALIFGL

SEQ ID NO: 169730 - protein, 10 aa, Artificial Sequence
  Description of Artificial Sequence: Synthetic peptide
  Seed: SQWRVVCDSL (TYRP1_HUMAN)
SLWRVVCDSA

SEQ ID NO: 169731 - protein, 9 aa, Artificial Sequence
  Description of Artificial Sequence: Synthetic peptide
  Seed: VARPMVQRL (TYRP1_HUMAN)
VSRPMVQRF

SEQ ID NO: 169732 - protein, 9 aa, Artificial Sequence
  Description of Artificial Sequence: Synthetic peptide
  Seed: GLFDTPPFY (TYRP1_HUMAN)
GVFDTPPFF

SEQ ID NO: 169733 - protein, 9 aa, Artificial Sequence
  Description of Artificial Sequence: Synthetic peptide
  Seed: FVWTHYYSV (TYRP1_HUMAN)
FTWTHYYST

SEQ ID NO: 169734 - protein, 9 aa, Artificial Sequence
  Description of Artificial Sequence: Synthetic peptide
  Seed: SMDEANQPL (TYRP1_HUMAN)
SQDEANQPV

SEQ ID NO: 169735 - protein, 11 aa, Artificial Sequence
  Description of Artificial Sequence: Synthetic peptide
  Seed: FSHEGPAFLTW (TYRP1_HUMAN)
FVHEGPAFLTY

SEQ ID NO: 169736 - protein, 10 aa, Artificial Sequence
  Description of Artificial Sequence: Synthetic peptide
  Seed: EIIAIAVVGA (TYRP1_HUMAN)
ETIAIAVVGV

SEQ ID NO: 169737 - protein, 10 aa, Artificial Sequence
  Description of Artificial Sequence: Synthetic peptide
  Seed: ENISIYNYFV (TYRP1_HUMAN)
ETISIYNYFL

SEQ ID NO: 169738 - protein, 10 aa, Artificial Sequence
  Description of Artificial Sequence: Synthetic peptide
  Seed: LGPDGNTPQF (TYRP1_HUMAN)
LAPDGNTPQM

SEQ ID NO: 169739 - protein, 9 aa, Artificial Sequence
  Description of Artificial Sequence: Synthetic peptide
  Seed: AKRTTHPLF (TYRP1_HUMAN)
AQRTTHPLF

SEQ ID NO: 169740 - protein, 9 aa, Artificial Sequence
  Description of Artificial Sequence: Synthetic peptide
  Seed: ENAPIGHNR (TYRP1_HUMAN)
ETAPIGHNR

SEQ ID NO: 169741 - protein, 11 aa, Artificial Sequence
  Description of Artificial Sequence: Synthetic peptide
  Seed: YNYFVWTHYYS (TYRP1_HUMAN)
YFYFVWTHYYH

SEQ ID NO: 169742 - protein, 11 aa, Artificial Sequence
  Description of Artificial Sequence: Synthetic peptide
  Seed: LVALIFGTASY (TYRP1_HUMAN)
LMALIFGTASF

SEQ ID NO: 169743 - protein, 10 aa, Artificial Sequence
  Description of Artificial Sequence: Synthetic peptide
  Seed: YEIQWPSREF (TYRP1_HUMAN)
YMIQWPSREY

SEQ ID NO: 169744 - protein, 10 aa, Artificial Sequence
  Description of Artificial Sequence: Synthetic peptide
  Seed: FVTAPDNLGY (TYRP1_HUMAN)
FQTAPDNLGW

SEQ ID NO: 169745 - protein, 11 aa, Artificial Sequence
  Description of Artificial Sequence: Synthetic peptide
  Seed: RRYNADISTFP (TYRP1_HUMAN)
RWYNADISTFG

SEQ ID NO: 169746 - protein, 10 aa, Artificial Sequence
  Description of Artificial Sequence: Synthetic peptide
  Seed: SIYNYFVWTH (TYRP1_HUMAN)
SCYNYFVWTR

SEQ ID NO: 169747 - protein, 10 aa, Artificial Sequence
  Description of Artificial Sequence: Synthetic peptide
  Seed: HPLFVIATRR (TYRP1_HUMAN)
HTLFVIATRC

SEQ ID NO: 169748 - protein, 9 aa, Artificial Sequence
  Description of Artificial Sequence: Synthetic peptide
  Seed: ARAQFPRQC (TYRP1_HUMAN)
AAAQFPRQL

SEQ ID NO: 169749 - protein, 9 aa, Artificial Sequence
  Description of Artificial Sequence: Synthetic peptide
  Seed: REFSVPEII (TYRP1_HUMAN)
RRFSVPEIF

SEQ ID NO: 169750 - protein, 9 aa, Artificial Sequence
  Description of Artificial Sequence: Synthetic peptide
  Seed: LTWHRYHLL (TYRP1_HUMAN)
LQWHRYHLY

SEQ ID NO: 169751 - protein, 11 aa, Artificial Sequence
  Description of Artificial Sequence: Synthetic peptide
  Seed: IYNYFVWTHYY (TYRP1_HUMAN)
IDNYFVWTHYF

SEQ ID NO: 169752 - protein, 9 aa, Artificial Sequence
  Description of Artificial Sequence: Synthetic peptide
  Seed: YNYFVWTHY (TYRP1_HUMAN)
YQYFVWTHI

SEQ ID NO: 169753 - protein, 10 aa, Artificial Sequence
  Description of Artificial Sequence: Synthetic peptide
  Seed: VWTHYYSVKK (TYRP1_HUMAN)
VETHYYSVKR

SEQ ID NO: 169754 - protein, 10 aa, Artificial Sequence
  Description of Artificial Sequence: Synthetic peptide
  Seed: LSLGCIFFPL (TYRP1_HUMAN)
LNLGCIFFPV

SEQ ID NO: 169755 - protein, 10 aa, Artificial Sequence
  Description of Artificial Sequence: Synthetic peptide
  Seed: GLFDTPPFYS (TYRP1_HUMAN)
GIFDTPPFYL

SEQ ID NO: 169756 - protein, 9 aa, Artificial Sequence
  Description of Artificial Sequence: Synthetic peptide
  Seed: FPLLLFQQA (TYRP1_HUMAN)
FALLLFQQY

SEQ ID NO: 169757 - protein, 9 aa, Artificial Sequence
  Description of Artificial Sequence: Synthetic peptide
  Seed: VCDICTDDL (TYRP1_HUMAN)
VVDICTDDM

SEQ ID NO: 169758 - protein, 10 aa, Artificial Sequence
  Description of Artificial Sequence: Synthetic peptide
  Seed: RTTHPLFVIA (TYRP1_HUMAN)
RHTHPLFVIA

SEQ ID NO: 169759 - protein, 10 aa, Artificial Sequence
  Description of Artificial Sequence: Synthetic peptide
  Seed: TAPDNLGYTY (TYRP1_HUMAN)
TQPDNLGYTF

SEQ ID NO: 169760 - protein, 10 aa, Artificial Sequence
  Description of Artificial Sequence: Synthetic peptide
  Seed: STLISPNSVF (TYRP1_HUMAN)
SGLISPNSVF

SEQ ID NO: 169761 - protein, 11 aa, Artificial Sequence
  Description of Artificial Sequence: Synthetic peptide
  Seed: HEGPAFLTWHR (TYRP1_HUMAN)
HVGPAFLTWHK

SEQ ID NO: 169762 - protein, 8 aa, Artificial Sequence
  Description of Artificial Sequence: Synthetic peptide
  Seed: FSHEGPAF (TYRP1_HUMAN)
FIHEGPAF

SEQ ID NO: 169763 - protein, 10 aa, Artificial Sequence
  Description of Artificial Sequence: Synthetic peptide
  Seed: GKYDPAVRSL (TYRP1_HUMAN)
GRYDPAVRSV

SEQ ID NO: 169764 - protein, 9 aa, Artificial Sequence
  Description of Artificial Sequence: Synthetic peptide
  Seed: SVPEIIAIA (TYRP1_HUMAN)
SAPEIIAIF

SEQ ID NO: 169765 - protein, 9 aa, Artificial Sequence
  Description of Artificial Sequence: Synthetic peptide
  Seed: REFSVPEII (TYRP1_HUMAN)
RQFSVPEIL

SEQ ID NO: 169766 - protein, 9 aa, Artificial Sequence
  Description of Artificial Sequence: Synthetic peptide
  Seed: AVFDEWLRR (TYRP1_HUMAN)
ATFDEWLRL

SEQ ID NO: 169767 - protein, 11 aa, Artificial Sequence
  Description of Artificial Sequence: Synthetic peptide
  Seed: RSMDEANQPLL (TYRP1_HUMAN)
RLMDEANQPLY

SEQ ID NO: 169768 - protein, 9 aa, Artificial Sequence
  Description of Artificial Sequence: Synthetic peptide
  Seed: FSLPYWNFA (TYRP1_HUMAN)
FILPYWNFA

SEQ ID NO: 169769 - protein, 9 aa, Artificial Sequence
  Description of Artificial Sequence: Synthetic peptide
  Seed: EEKNHFVRA (TYRP1_HUMAN)
EEKNHFVRM

SEQ ID NO: 169770 - protein, 9 aa, Artificial Sequence
  Description of Artificial Sequence: Synthetic peptide
  Seed: SMDEANQPL (TYRP1_HUMAN)
SKDEANQPF

SEQ ID NO: 169771 - protein, 9 aa, Artificial Sequence
  Description of Artificial Sequence: Synthetic peptide
  Seed: LGCIFFPLL (TYRP1_HUMAN)
LACIFFPLF

SEQ ID NO: 169772 - protein, 10 aa, Artificial Sequence
  Description of Artificial Sequence: Synthetic peptide
  Seed: RTTHPLFVIA (TYRP1_HUMAN)
RQTHPLFVIK

SEQ ID NO: 169773 - protein, 9 aa, Artificial Sequence
  Description of Artificial Sequence: Synthetic peptide
  Seed: MSAPKLLSL (TYRP1_HUMAN)
MMAPKLLSC

SEQ ID NO: 169774 - protein, 9 aa, Artificial Sequence
  Description of Artificial Sequence: Synthetic peptide
  Seed: MLQEPSFSL (TYRP1_HUMAN)
MEQEPSFSM

SEQ ID NO: 169775 - protein, 9 aa, Artificial Sequence
  Description of Artificial Sequence: Synthetic peptide
  Seed: FSHEGPAFL (TYRP1_HUMAN)
FPHEGPAFY

SEQ ID NO: 169776 - protein, 9 aa, Artificial Sequence
  Description of Artificial Sequence: Synthetic peptide
  Seed: LFQQARAQF (TYRP1_HUMAN)
LFQQARAQY

SEQ ID NO: 169777 - protein, 11 aa, Artificial Sequence
  Description of Artificial Sequence: Synthetic peptide
  Seed: REVWPLRFFNR (TYRP1_HUMAN)
RSVWPLRFFNR

SEQ ID NO: 169778 - protein, 10 aa, Artificial Sequence
  Description of Artificial Sequence: Synthetic peptide
  Seed: RRYNADISTF (TYRP1_HUMAN)
RVYNADISTL

SEQ ID NO: 169779 - protein, 11 aa, Artificial Sequence
  Description of Artificial Sequence: Synthetic peptide
  Seed: MSAPKLLSLGC (TYRP1_HUMAN)
MTAPKLLSLGF

SEQ ID NO: 169780 - protein, 9 aa, Artificial Sequence
  Description of Artificial Sequence: Synthetic peptide
  Seed: AFLTWHRYH (TYRP1_HUMAN)
AYLTWHRYK

SEQ ID NO: 169781 - protein, 9 aa, Artificial Sequence
  Description of Artificial Sequence: Synthetic peptide
  Seed: HYYSVKKTF (TYRP1_HUMAN)
HMYSVKKTF

SEQ ID NO: 169782 - protein, 10 aa, Artificial Sequence
  Description of Artificial Sequence: Synthetic peptide
  Seed: KRTTHPLFVI (TYRP1_HUMAN)
KCTTHPLFVF

SEQ ID NO: 169783 - protein, 9 aa, Artificial Sequence
  Description of Artificial Sequence: Synthetic peptide
  Seed: DDREVWPLR (TYRP1_HUMAN)
DFREVWPLR

SEQ ID NO: 169784 - protein, 10 aa, Artificial Sequence
  Description of Artificial Sequence: Synthetic peptide
  Seed: LSLGCIFFPL (TYRP1_HUMAN)
LILGCIFFPV

SEQ ID NO: 169785 - protein, 11 aa, Artificial Sequence
  Description of Artificial Sequence: Synthetic peptide
  Seed: LIFGTASYLIR (TYRP1_HUMAN)
LMFGTASYLIR

SEQ ID NO: 169786 - protein, 10 aa, Artificial Sequence
  Description of Artificial Sequence: Synthetic peptide
  Seed: YNYFVWTHYY (TYRP1_HUMAN)
YTYFVWTHYR

SEQ ID NO: 169787 - protein, 9 aa, Artificial Sequence
  Description of Artificial Sequence: Synthetic peptide
  Seed: SMDEANQPL (TYRP1_HUMAN)
SLDEANQPA

SEQ ID NO: 169788 - protein, 9 aa, Artificial Sequence
  Description of Artificial Sequence: Synthetic peptide
  Seed: MAKRTTHPL (TYRP1_HUMAN)
MEKRTTHPY

SEQ ID NO: 169789 - protein, 10 aa, Artificial Sequence
  Description of Artificial Sequence: Synthetic peptide
  Seed: FWPPVTNTEM (TYRP1_HUMAN)
FQPPVTNTEM

SEQ ID NO: 169790 - protein, 11 aa, Artificial Sequence
  Description of Artificial Sequence: Synthetic peptide
  Seed: GYTYEIQWPSR (TYRP1_HUMAN)
GETYEIQWPSR

SEQ ID NO: 169791 - protein, 10 aa, Artificial Sequence
  Description of Artificial Sequence: Synthetic peptide
  Seed: GTASYLIRAR (TYRP1_HUMAN)
GSASYLIRAR

SEQ ID NO: 169792 - protein, 9 aa, Artificial Sequence
  Description of Artificial Sequence: Synthetic peptide
  Seed: YTYEIQWPS (TYRP1_HUMAN)
YTYEIQWPC

SEQ ID NO: 169793 - protein, 9 aa, Artificial Sequence
  Description of Artificial Sequence: Synthetic peptide
  Seed: ACDQRVLIV (TYRP1_HUMAN)
AMDQRVLIF

SEQ ID NO: 169794 - protein, 9 aa, Artificial Sequence
  Description of Artificial Sequence: Synthetic peptide
  Seed: GTASYLIRA (TYRP1_HUMAN)
GVASYLIRA

SEQ ID NO: 169795 - protein, 10 aa, Artificial Sequence
  Description of Artificial Sequence: Synthetic peptide
  Seed: YNYFVWTHYY (TYRP1_HUMAN)
YEYFVWTHYM

SEQ ID NO: 169796 - protein, 11 aa, Artificial Sequence
  Description of Artificial Sequence: Synthetic peptide
  Seed: YTYEIQWPSRE (TYRP1_HUMAN)
YTYEIQWPSRR

SEQ ID NO: 169797 - protein, 9 aa, Artificial Sequence
  Description of Artificial Sequence: Synthetic peptide
  Seed: VCDICTDDL (TYRP1_HUMAN)
VLDICTDDM

SEQ ID NO: 169798 - protein, 9 aa, Artificial Sequence
  Description of Artificial Sequence: Synthetic peptide
  Seed: LTDQYQCYA (TYRP1_HUMAN)
LFDQYQCYL

SEQ ID NO: 169799 - protein, 11 aa, Artificial Sequence
  Description of Artificial Sequence: Synthetic peptide
  Seed: HLSPNDPIFVL (TYRP1_HUMAN)
HLSPNDPIFVW

SEQ ID NO: 169800 - protein, 9 aa, Artificial Sequence
  Description of Artificial Sequence: Synthetic peptide
  Seed: FENISIYNY (TYRP1_HUMAN)
FWNISIYNY

SEQ ID NO: 169801 - protein, 11 aa, Artificial Sequence
  Description of Artificial Sequence: Synthetic peptide
  Seed: YNMVPFWPPVT (TYRP1_HUMAN)
YVMVPFWPPVI

SEQ ID NO: 169802 - protein, 10 aa, Artificial Sequence
  Description of Artificial Sequence: Synthetic peptide
  Seed: VPFWPPVTNT (TYRP1_HUMAN)
VPFWPPVTNV

SEQ ID NO: 169803 - protein, 9 aa, Artificial Sequence
  Description of Artificial Sequence: Synthetic peptide
  Seed: FYSNSTNSF (TYRP1_HUMAN)
FESNSTNSY

SEQ ID NO: 169804 - protein, 9 aa, Artificial Sequence
  Description of Artificial Sequence: Synthetic peptide
  Seed: SPNSVFSQW (TYRP1_HUMAN)
SQNSVFSQW

SEQ ID NO: 169805 - protein, 11 aa, Artificial Sequence
  Description of Artificial Sequence: Synthetic peptide
  Seed: QYNMVPFWPPV (TYRP1_HUMAN)
QWNMVPFWPPF

SEQ ID NO: 169806 - protein, 9 aa, Artificial Sequence
  Description of Artificial Sequence: Synthetic peptide
  Seed: FSHEGPAFL (TYRP1_HUMAN)
FYHEGPAFA

SEQ ID NO: 169807 - protein, 10 aa, Artificial Sequence
  Description of Artificial Sequence: Synthetic peptide
  Seed: LLVALIFGTA (TYRP1_HUMAN)
LLVALIFGTL

SEQ ID NO: 169808 - protein, 10 aa, Artificial Sequence
  Description of Artificial Sequence: Synthetic peptide
  Seed: VALIFGTASY (TYRP1_HUMAN)
VGLIFGTASF

SEQ ID NO: 169809 - protein, 11 aa, Artificial Sequence
  Description of Artificial Sequence: Synthetic peptide
  Seed: REFSVPEIIAI (TYRP1_HUMAN)
RQFSVPEIIAF

SEQ ID NO: 169810 - protein, 9 aa, Artificial Sequence
  Description of Artificial Sequence: Synthetic peptide
  Seed: REFSVPEII (TYRP1_HUMAN)
RAFSVPEIF

SEQ ID NO: 169811 - protein, 10 aa, Artificial Sequence
  Description of Artificial Sequence: Synthetic peptide
  Seed: FWPPVTNTEM (TYRP1_HUMAN)
FFPPVTNTEF

SEQ ID NO: 169812 - protein, 9 aa, Artificial Sequence
  Description of Artificial Sequence: Synthetic peptide
  Seed: NYFVWTHYY (TYRP1_HUMAN)
NRFVWTHYL

SEQ ID NO: 169813 - protein, 9 aa, Artificial Sequence
  Description of Artificial Sequence: Synthetic peptide
  Seed: LTWHRYHLL (TYRP1_HUMAN)
LVWHRYHLI

SEQ ID NO: 169814 - protein, 10 aa, Artificial Sequence
  Description of Artificial Sequence: Synthetic peptide
  Seed: RSLHNLAHLF (TYRP1_HUMAN)
RKLHNLAHLY

SEQ ID NO: 169815 - protein, 10 aa, Artificial Sequence
  Description of Artificial Sequence: Synthetic peptide
  Seed: YNADISTFPL (TYRP1_HUMAN)
YVADISTFPM

SEQ ID NO: 169816 - protein, 10 aa, Artificial Sequence
  Description of Artificial Sequence: Synthetic peptide
  Seed: YFVWTHYYSV (TYRP1_HUMAN)
YDVWTHYYSV

SEQ ID NO: 169817 - protein, 10 aa, Artificial Sequence
  Description of Artificial Sequence: Synthetic peptide
  Seed: AQFPRQCATV (TYRP1_HUMAN)
AAFPRQCATY

SEQ ID NO: 169818 - protein, 11 aa, Artificial Sequence
  Description of Artificial Sequence: Synthetic peptide
  Seed: FPLLLFQQARA (TYRP1_HUMAN)
FNLLLFQQARV

SEQ ID NO: 169819 - protein, 10 aa, Artificial Sequence
  Description of Artificial Sequence: Synthetic peptide
  Seed: ADSRPHSPQY (TYRP1_HUMAN)
AISRPHSPQK

SEQ ID NO: 169820 - protein, 9 aa, Artificial Sequence
  Description of Artificial Sequence: Synthetic peptide
  Seed: FENISIYNY (TYRP1_HUMAN)
FPNISIYNY

SEQ ID NO: 169821 - protein, 9 aa, Artificial Sequence
  Description of Artificial Sequence: Synthetic peptide
  Seed: TADSRPHSP (TYRP1_HUMAN)
TGDSRPHSF

SEQ ID NO: 169822 - protein, 9 aa, Artificial Sequence
  Description of Artificial Sequence: Synthetic peptide
  Seed: RSLHNLAHL (TYRP1_HUMAN)
RQLHNLAHK

SEQ ID NO: 169823 - protein, 9 aa, Artificial Sequence
  Description of Artificial Sequence: Synthetic peptide
  Seed: FTDAVFDEW (TYRP1_HUMAN)
FGDAVFDEM

SEQ ID NO: 169824 - protein, 10 aa, Artificial Sequence
  Description of Artificial Sequence: Synthetic peptide
  Seed: ADSRPHSPQY (TYRP1_HUMAN)
ASSRPHSPQY

SEQ ID NO: 169825 - protein, 9 aa, Artificial Sequence
  Description of Artificial Sequence: Synthetic peptide
  Seed: RSLHNLAHL (TYRP1_HUMAN)
RMLHNLAHY

SEQ ID NO: 169826 - protein, 9 aa, Artificial Sequence
  Description of Artificial Sequence: Synthetic peptide
  Seed: SKEEKNHFV (TYRP1_HUMAN)
SREEKNHFL

SEQ ID NO: 169827 - protein, 9 aa, Artificial Sequence
  Description of Artificial Sequence: Synthetic peptide
  Seed: YLIRARRSM (TYRP1_HUMAN)
YPIRARRSC

SEQ ID NO: 169828 - protein, 9 aa, Artificial Sequence
  Description of Artificial Sequence: Synthetic peptide
  Seed: IAIAVVGAL (TYRP1_HUMAN)
IWIAVVGAL

SEQ ID NO: 169829 - protein, 9 aa, Artificial Sequence
  Description of Artificial Sequence: Synthetic peptide
  Seed: MAKRTTHPL (TYRP1_HUMAN)
MGKRTTHPK

SEQ ID NO: 169830 - protein, 9 aa, Artificial Sequence
  Description of Artificial Sequence: Synthetic peptide
  Seed: LSPNDPIFV (TYRP1_HUMAN)
LAPNDPIFM

SEQ ID NO: 169831 - protein, 11 aa, Artificial Sequence
  Description of Artificial Sequence: Synthetic peptide
  Seed: QEMLQEPSFSL (TYRP1_HUMAN)
QLMLQEPSFSV

SEQ ID NO: 169832 - protein, 10 aa, Artificial Sequence
  Description of Artificial Sequence: Synthetic peptide
  Seed: TPQFENISIY (TYRP1_HUMAN)
TEQFENISIM

SEQ ID NO: 169833 - protein, 10 aa, Artificial Sequence
  Description of Artificial Sequence: Synthetic peptide
  Seed: YNMVPFWPPV (TYRP1_HUMAN)
YRMVPFWPPV

SEQ ID NO: 169834 - protein, 9 aa, Artificial Sequence
  Description of Artificial Sequence: Synthetic peptide
  Seed: STNSFRNTV (TYRP1_HUMAN)
SSNSFRNTI

SEQ ID NO: 169835 - protein, 9 aa, Artificial Sequence
  Description of Artificial Sequence: Synthetic peptide
  Seed: STNSFRNTV (TYRP1_HUMAN)
SLNSFRNTI

SEQ ID NO: 169836 - protein, 9 aa, Artificial Sequence
  Description of Artificial Sequence: Synthetic peptide
  Seed: APIGHNRQY (TYRP1_HUMAN)
AYIGHNRQM

SEQ ID NO: 169837 - protein, 9 aa, Artificial Sequence
  Description of Artificial Sequence: Synthetic peptide
  Seed: KLLSLGCIF (TYRP1_HUMAN)
KALSLGCIY

SEQ ID NO: 169838 - protein, 10 aa, Artificial Sequence
  Description of Artificial Sequence: Synthetic peptide
  Seed: KLLSLGCIFF (TYRP1_HUMAN)
KTLSLGCIFF

SEQ ID NO: 169839 - protein, 9 aa, Artificial Sequence
  Description of Artificial Sequence: Synthetic peptide
  Seed: IAIAVVGAL (TYRP1_HUMAN)
ILIAVVGAL

SEQ ID NO: 169840 - protein, 10 aa, Artificial Sequence
  Description of Artificial Sequence: Synthetic peptide
  Seed: AFLTWHRYHL (TYRP1_HUMAN)
AVLTWHRYHV

SEQ ID NO: 169841 - protein, 10 aa, Artificial Sequence
  Description of Artificial Sequence: Synthetic peptide
  Seed: LSPNDPIFVL (TYRP1_HUMAN)
LSPNDPIFVY

SEQ ID NO: 169842 - protein, 10 aa, Artificial Sequence
  Description of Artificial Sequence: Synthetic peptide
  Seed: FWPPVTNTEM (TYRP1_HUMAN)
FWPPVTNTEF

SEQ ID NO: 169843 - protein, 9 aa, Artificial Sequence
  Description of Artificial Sequence: Synthetic peptide
  Seed: FENISIYNY (TYRP1_HUMAN)
FINISIYNY

SEQ ID NO: 169844 - protein, 9 aa, Artificial Sequence
  Description of Artificial Sequence: Synthetic peptide
  Seed: SLPYWNFAT (TYRP1_HUMAN)
SVPYWNFAI

SEQ ID NO: 169845 - protein, 9 aa, Artificial Sequence
  Description of Artificial Sequence: Synthetic peptide
  Seed: FSVPEIIAI (TYRP1_HUMAN)
FNVPEIIAV

SEQ ID NO: 169846 - protein, 9 aa, Artificial Sequence
  Description of Artificial Sequence: Synthetic peptide
  Seed: RSLHNLAHL (TYRP1_HUMAN)
RYLHNLAHK

SEQ ID NO: 169847 - protein, 9 aa, Artificial Sequence
  Description of Artificial Sequence: Synthetic peptide
  Seed: IIAIAVVGA (TYRP1_HUMAN)
IMAIAVVGL

SEQ ID NO: 169848 - protein, 9 aa, Artificial Sequence
  Description of Artificial Sequence: Synthetic peptide
  Seed: LTWHRYHLL (TYRP1_HUMAN)
LMWHRYHLM

SEQ ID NO: 169849 - protein, 10 aa, Artificial Sequence
  Description of Artificial Sequence: Synthetic peptide
  Seed: FLNGTGGQTH (TYRP1_HUMAN)
FLNGTGGQTY

SEQ ID NO: 169850 - protein, 10 aa, Artificial Sequence
  Description of Artificial Sequence: Synthetic peptide
  Seed: FLTWHRYHLL (TYRP1_HUMAN)
FSTWHRYHLV

SEQ ID NO: 169851 - protein, 10 aa, Artificial Sequence
  Description of Artificial Sequence: Synthetic peptide
  Seed: EGPAFLTWHR (TYRP1_HUMAN)
ETPAFLTWHK

SEQ ID NO: 169852 - protein, 9 aa, Artificial Sequence
  Description of Artificial Sequence: Synthetic peptide
  Seed: ENISIYNYF (TYRP1_HUMAN)
ELISIYNYY

SEQ ID NO: 169853 - protein, 8 aa, Artificial Sequence
  Description of Artificial Sequence: Synthetic peptide
  Seed: FSHEGPAF (TYRP1_HUMAN)
FFHEGPAV

SEQ ID NO: 169854 - protein, 9 aa, Artificial Sequence
  Description of Artificial Sequence: Synthetic peptide
  Seed: IAIAVVGAL (TYRP1_HUMAN)
IPIAVVGAW

SEQ ID NO: 169855 - protein, 9 aa, Artificial Sequence
  Description of Artificial Sequence: Synthetic peptide
  Seed: RTCHCNGNF (TYRP1_HUMAN)
RYCHCNGNY

SEQ ID NO: 169856 - protein, 11 aa, Artificial Sequence
  Description of Artificial Sequence: Synthetic peptide
  Seed: ILGPDGNTPQF (TYRP1_HUMAN)
IAGPDGNTPQY

SEQ ID NO: 169857 - protein, 9 aa, Artificial Sequence
  Description of Artificial Sequence: Synthetic peptide
  Seed: SLHNLAHLF (TYRP1_HUMAN)
SQHNLAHLI

SEQ ID NO: 169858 - protein, 8 aa, Artificial Sequence
  Description of Artificial Sequence: Synthetic peptide
  Seed: RQYNMVPF (TYRP1_HUMAN)
RTYNMVPF

SEQ ID NO: 169859 - protein, 10 aa, Artificial Sequence
  Description of Artificial Sequence: Synthetic peptide
  Seed: LSPNDPIFVL (TYRP1_HUMAN)
LHPNDPIFVY

SEQ ID NO: 169860 - protein, 9 aa, Artificial Sequence
  Description of Artificial Sequence: Synthetic peptide
  Seed: MAKRTTHPL (TYRP1_HUMAN)
MIKRTTHPM

SEQ ID NO: 169861 - protein, 10 aa, Artificial Sequence
  Description of Artificial Sequence: Synthetic peptide
  Seed: FWPPVTNTEM (TYRP1_HUMAN)
FRPPVTNTEL

SEQ ID NO: 169862 - protein, 10 aa, Artificial Sequence
  Description of Artificial Sequence: Synthetic peptide
  Seed: VDFSHEGPAF (TYRP1_HUMAN)
VTFSHEGPAM

SEQ ID NO: 169863 - protein, 9 aa, Artificial Sequence
  Description of Artificial Sequence: Synthetic peptide
  Seed: SPNDPIFVL (TYRP1_HUMAN)
SFNDPIFVF

SEQ ID NO: 169864 - protein, 10 aa, Artificial Sequence
  Description of Artificial Sequence: Synthetic peptide
  Seed: THPLFVIATR (TYRP1_HUMAN)
TTPLFVIATK

SEQ ID NO: 169865 - protein, 9 aa, Artificial Sequence
  Description of Artificial Sequence: Synthetic peptide
  Seed: MAKRTTHPL (TYRP1_HUMAN)
MVKRTTHPA

SEQ ID NO: 169866 - protein, 9 aa, Artificial Sequence
  Description of Artificial Sequence: Synthetic peptide
  Seed: YNYFVWTHY (TYRP1_HUMAN)
YQYFVWTHA

SEQ ID NO: 169867 - protein, 9 aa, Artificial Sequence
  Description of Artificial Sequence: Synthetic peptide
  Seed: RQYNMVPFW (TYRP1_HUMAN)
RFYNMVPFM

SEQ ID NO: 169868 - protein, 9 aa, Artificial Sequence
  Description of Artificial Sequence: Synthetic peptide
  Seed: STNSFRNTV (TYRP1_HUMAN)
SSNSFRNTK

SEQ ID NO: 169869 - protein, 9 aa, Artificial Sequence
  Description of Artificial Sequence: Synthetic peptide
  Seed: RSLHNLAHL (TYRP1_HUMAN)
RALHNLAHR

SEQ ID NO: 169870 - protein, 9 aa, Artificial Sequence
  Description of Artificial Sequence: Synthetic peptide
  Seed: REFSVPEII (TYRP1_HUMAN)
RAFSVPEIL

SEQ ID NO: 169871 - protein, 10 aa, Artificial Sequence
  Description of Artificial Sequence: Synthetic peptide
  Seed: LPYWNFATGK (TYRP1_HUMAN)
LGYWNFATGK

SEQ ID NO: 169872 - protein, 11 aa, Artificial Sequence
  Description of Artificial Sequence: Synthetic peptide
  Seed: RYNADISTFPL (TYRP1_HUMAN)
RWNADISTFPW

SEQ ID NO: 169873 - protein, 10 aa, Artificial Sequence
  Description of Artificial Sequence: Synthetic peptide
  Seed: WPPVTNTEMF (TYRP1_HUMAN)
WEPVTNTEMW

SEQ ID NO: 169874 - protein, 9 aa, Artificial Sequence
  Description of Artificial Sequence: Synthetic peptide
  Seed: IFGTASYLI (TYRP1_HUMAN)
IYGTASYLF

SEQ ID NO: 169875 - protein, 10 aa, Artificial Sequence
  Description of Artificial Sequence: Synthetic peptide
  Seed: LIFGTASYLI (TYRP1_HUMAN)
LRFGTASYLF

SEQ ID NO: 169876 - protein, 9 aa, Artificial Sequence
  Description of Artificial Sequence: Synthetic peptide
  Seed: AVVGALLLV (TYRP1_HUMAN)
ATVGALLLW

SEQ ID NO: 169877 - protein, 11 aa, Artificial Sequence
  Description of Artificial Sequence: Synthetic peptide
  Seed: YNMVPFWPPVT (TYRP1_HUMAN)
YMMVPFWPPVF

SEQ ID NO: 169878 - protein, 9 aa, Artificial Sequence
  Description of Artificial Sequence: Synthetic peptide
  Seed: YNYFVWTHY (TYRP1_HUMAN)
YTYFVWTHF

SEQ ID NO: 169879 - protein, 11 aa, Artificial Sequence
  Description of Artificial Sequence: Synthetic peptide
  Seed: FLNGTGGQTHL (TYRP1_HUMAN)
FMNGTGGQTHY

SEQ ID NO: 169880 - protein, 9 aa, Artificial Sequence
  Description of Artificial Sequence: Synthetic peptide
  Seed: HLSPNDPIF (TYRP1_HUMAN)
HYSPNDPIL

SEQ ID NO: 169881 - protein, 10 aa, Artificial Sequence
  Description of Artificial Sequence: Synthetic peptide
  Seed: LSPNDPIFVL (TYRP1_HUMAN)
LHPNDPIFVW

SEQ ID NO: 169882 - protein, 11 aa, Artificial Sequence
  Description of Artificial Sequence: Synthetic peptide
  Seed: LRRYNADISTF (TYRP1_HUMAN)
LPRYNADISTF

SEQ ID NO: 169883 - protein, 9 aa, Artificial Sequence
  Description of Artificial Sequence: Synthetic peptide
  Seed: SLGCIFFPL (TYRP1_HUMAN)
SMGCIFFPL

SEQ ID NO: 169884 - protein, 10 aa, Artificial Sequence
  Description of Artificial Sequence: Synthetic peptide
  Seed: LGPDGNTPQF (TYRP1_HUMAN)
LCPDGNTPQL

SEQ ID NO: 169885 - protein, 9 aa, Artificial Sequence
  Description of Artificial Sequence: Synthetic peptide
  Seed: LVALIFGTA (TYRP1_HUMAN)
LPALIFGTS

SEQ ID NO: 169886 - protein, 9 aa, Artificial Sequence
  Description of Artificial Sequence: Synthetic peptide
  Seed: FLTWHRYHL (TYRP1_HUMAN)
FATWHRYHV

SEQ ID NO: 169887 - protein, 11 aa, Artificial Sequence
  Description of Artificial Sequence: Synthetic peptide
  Seed: EVWPLRFFNRT (TYRP1_HUMAN)
EIWPLRFFNRR

SEQ ID NO: 169888 - protein, 9 aa, Artificial Sequence
  Description of Artificial Sequence: Synthetic peptide
  Seed: IVRRNLLDL (TYRP1_HUMAN)
IQRRNLLDK

SEQ ID NO: 169889 - protein, 9 aa, Artificial Sequence
  Description of Artificial Sequence: Synthetic peptide
  Seed: LLHTFTDAV (TYRP1_HUMAN)
LQHTFTDAV

SEQ ID NO: 169890 - protein, 9 aa, Artificial Sequence
  Description of Artificial Sequence: Synthetic peptide
  Seed: RGRCEAVTA (TYRP1_HUMAN)
RYRCEAVTV

SEQ ID NO: 169891 - protein, 10 aa, Artificial Sequence
  Description of Artificial Sequence: Synthetic peptide
  Seed: STFPLENAPI (TYRP1_HUMAN)
SSFPLENAPY

SEQ ID NO: 169892 - protein, 9 aa, Artificial Sequence
  Description of Artificial Sequence: Synthetic peptide
  Seed: LGYTYEIQW (TYRP1_HUMAN)
LMYTYEIQW

SEQ ID NO: 169893 - protein, 9 aa, Artificial Sequence
  Description of Artificial Sequence: Synthetic peptide
  Seed: FVWTHYYSV (TYRP1_HUMAN)
FMWTHYYSI

SEQ ID NO: 169894 - protein, 11 aa, Artificial Sequence
  Description of Artificial Sequence: Synthetic peptide
  Seed: YSDPTGKYDPA (TYRP1_HUMAN)
YVDPTGKYDPF

SEQ ID NO: 169895 - protein, 8 aa, Artificial Sequence
  Description of Artificial Sequence: Synthetic peptide
  Seed: ACDQRVLI (TYRP1_HUMAN)
AADQRVLL

SEQ ID NO: 169896 - protein, 10 aa, Artificial Sequence
  Description of Artificial Sequence: Synthetic peptide
  Seed: YNMVPFWPPV (TYRP1_HUMAN)
YMMVPFWPPV

SEQ ID NO: 169897 - protein, 10 aa, Artificial Sequence
  Description of Artificial Sequence: Synthetic peptide
  Seed: RRYNADISTF (TYRP1_HUMAN)
REYNADISTF

SEQ ID NO: 169898 - protein, 10 aa, Artificial Sequence
  Description of Artificial Sequence: Synthetic peptide
  Seed: TPQFENISIY (TYRP1_HUMAN)
TTQFENISIM

SEQ ID NO: 169899 - protein, 9 aa, Artificial Sequence
  Description of Artificial Sequence: Synthetic peptide
  Seed: FSVPEIIAI (TYRP1_HUMAN)
FLVPEIIAV

SEQ ID NO: 169900 - protein, 11 aa, Artificial Sequence
  Description of Artificial Sequence: Synthetic peptide
  Seed: AGNVARPMVQR (TYRP1_HUMAN)
ADNVARPMVQK

SEQ ID NO: 169901 - protein, 9 aa, Artificial Sequence
  Description of Artificial Sequence: Synthetic peptide
  Seed: NRQYNMVPF (TYRP1_HUMAN)
NFQYNMVPF

SEQ ID NO: 169902 - protein, 10 aa, Artificial Sequence
  Description of Artificial Sequence: Synthetic peptide
  Seed: GEVDFSHEGP (TYRP1_HUMAN)
GEVDFSHEGL

SEQ ID NO: 169903 - protein, 10 aa, Artificial Sequence
  Description of Artificial Sequence: Synthetic peptide
  Seed: NYFVWTHYYS (TYRP1_HUMAN)
NWFVWTHYYY

SEQ ID NO: 169904 - protein, 9 aa, Artificial Sequence
  Description of Artificial Sequence: Synthetic peptide
  Seed: PNDPIFVLL (TYRP1_HUMAN)
PVDPIFVLM

SEQ ID NO: 169905 - protein, 10 aa, Artificial Sequence
  Description of Artificial Sequence: Synthetic peptide
  Seed: NYFVWTHYYS (TYRP1_HUMAN)
NHFVWTHYYY

SEQ ID NO: 169906 - protein, 9 aa, Artificial Sequence
  Description of Artificial Sequence: Synthetic peptide
  Seed: MLQEPSFSL (TYRP1_HUMAN)
MVQEPSFSR

SEQ ID NO: 169907 - protein, 9 aa, Artificial Sequence
  Description of Artificial Sequence: Synthetic peptide
  Seed: LGCIFFPLL (TYRP1_HUMAN)
LLCIFFPLL

SEQ ID NO: 169908 - protein, 8 aa, Artificial Sequence
  Description of Artificial Sequence: Synthetic peptide
  Seed: GPIRRNPA (TYRP1_HUMAN)
GPIRRNPM

SEQ ID NO: 169909 - protein, 11 aa, Artificial Sequence
  Description of Artificial Sequence: Synthetic peptide
  Seed: LIFGTASYLIR (TYRP1_HUMAN)
LAFGTASYLIR

SEQ ID NO: 169910 - protein, 9 aa, Artificial Sequence
  Description of Artificial Sequence: Synthetic peptide
  Seed: YNYFVWTHY (TYRP1_HUMAN)
YEYFVWTHM

SEQ ID NO: 169911 - protein, 9 aa, Artificial Sequence
  Description of Artificial Sequence: Synthetic peptide
  Seed: MSAPKLLSL (TYRP1_HUMAN)
MTAPKLLSM

SEQ ID NO: 169912 - protein, 10 aa, Artificial Sequence
  Description of Artificial Sequence: Synthetic peptide
  Seed: VDFSHEGPAF (TYRP1_HUMAN)
VMFSHEGPAY

SEQ ID NO: 169913 - protein, 8 aa, Artificial Sequence
  Description of Artificial Sequence: Synthetic peptide
  Seed: ACDQRVLI (TYRP1_HUMAN)
AFDQRVLM

SEQ ID NO: 169914 - protein, 9 aa, Artificial Sequence
  Description of Artificial Sequence: Synthetic peptide
  Seed: IYNYFVWTH (TYRP1_HUMAN)
IMNYFVWTK

SEQ ID NO: 169915 - protein, 9 aa, Artificial Sequence
  Description of Artificial Sequence: Synthetic peptide
  Seed: FSLPYWNFA (TYRP1_HUMAN)
FTLPYWNFY

SEQ ID NO: 169916 - protein, 10 aa, Artificial Sequence
  Description of Artificial Sequence: Synthetic peptide
  Seed: SVPEIIAIAV (TYRP1_HUMAN)
SIPEIIAIAL

SEQ ID NO: 169917 - protein, 10 aa, Artificial Sequence
  Description of Artificial Sequence: Synthetic peptide
  Seed: STLISPNSVF (TYRP1_HUMAN)
SELISPNSVY

SEQ ID NO: 169918 - protein, 9 aa, Artificial Sequence
  Description of Artificial Sequence: Synthetic peptide
  Seed: IYNYFVWTH (TYRP1_HUMAN)
IYNYFVWTR

SEQ ID NO: 169919 - protein, 9 aa, Artificial Sequence
  Description of Artificial Sequence: Synthetic peptide
  Seed: QEPSFSLPY (TYRP1_HUMAN)
QMPSFSLPF

SEQ ID NO: 169920 - protein, 10 aa, Artificial Sequence
  Description of Artificial Sequence: Synthetic peptide
  Seed: YTYEIQWPSR (TYRP1_HUMAN)
YAYEIQWPSR

SEQ ID NO: 169921 - protein, 9 aa, Artificial Sequence
  Description of Artificial Sequence: Synthetic peptide
  Seed: VFDEWLRRY (TYRP1_HUMAN)
VCDEWLRRL

SEQ ID NO: 169922 - protein, 9 aa, Artificial Sequence
  Description of Artificial Sequence: Synthetic peptide
  Seed: SFRNTVEGY (TYRP1_HUMAN)
SYRNTVEGM

SEQ ID NO: 169923 - protein, 9 aa, Artificial Sequence
  Description of Artificial Sequence: Synthetic peptide
  Seed: FVRALDMAK (TYRP1_HUMAN)
FMRALDMAR

SEQ ID NO: 169924 - protein, 9 aa, Artificial Sequence
  Description of Artificial Sequence: Synthetic peptide
  Seed: AVRSLHNLA (TYRP1_HUMAN)
AFRSLHNLA

SEQ ID NO: 169925 - protein, 9 aa, Artificial Sequence
  Description of Artificial Sequence: Synthetic peptide
  Seed: HPLFVIATR (TYRP1_HUMAN)
HLLFVIATR

SEQ ID NO: 169926 - protein, 8 aa, Artificial Sequence
  Description of Artificial Sequence: Synthetic peptide
  Seed: GLFDTPPF (TYRP1_HUMAN)
GQFDTPPM

SEQ ID NO: 169927 - protein, 9 aa, Artificial Sequence
  Description of Artificial Sequence: Synthetic peptide
  Seed: VGLFDTPPF (TYRP1_HUMAN)
VILFDTPPF

SEQ ID NO: 169928 - protein, 9 aa, Artificial Sequence
  Description of Artificial Sequence: Synthetic peptide
  Seed: HPLFVIATR (TYRP1_HUMAN)
HPLFVIATP

SEQ ID NO: 169929 - protein, 8 aa, Artificial Sequence
  Description of Artificial Sequence: Synthetic peptide
  Seed: IFGTASYL (TYRP1_HUMAN)
IYGTASYF

SEQ ID NO: 169930 - protein, 10 aa, Artificial Sequence
  Description of Artificial Sequence: Synthetic peptide
  Seed: TAPDNLGYTY (TYRP1_HUMAN)
TRPDNLGYTY

SEQ ID NO: 169931 - protein, 9 aa, Artificial Sequence
  Description of Artificial Sequence: Synthetic peptide
  Seed: YLIRARRSM (TYRP1_HUMAN)
YYIRARRSA

SEQ ID NO: 169932 - protein, 9 aa, Artificial Sequence
  Description of Artificial Sequence: Synthetic peptide
  Seed: VVGALLLVA (TYRP1_HUMAN)
VLGALLLVV

SEQ ID NO: 169933 - protein, 11 aa, Artificial Sequence
  Description of Artificial Sequence: Synthetic peptide
  Seed: DRCGSSSGRGR (TYRP1_HUMAN)
DFCGSSSGRGR

SEQ ID NO: 169934 - protein, 9 aa, Artificial Sequence
  Description of Artificial Sequence: Synthetic peptide
  Seed: SMDEANQPL (TYRP1_HUMAN)
SGDEANQPM

SEQ ID NO: 169935 - protein, 9 aa, Artificial Sequence
  Description of Artificial Sequence: Synthetic peptide
  Seed: MLQEPSFSL (TYRP1_HUMAN)
MTQEPSFSL

SEQ ID NO: 169936 - protein, 9 aa, Artificial Sequence
  Description of Artificial Sequence: Synthetic peptide
  Seed: DSRPHSPQY (TYRP1_HUMAN)
DTRPHSPQK

SEQ ID NO: 169937 - protein, 10 aa, Artificial Sequence
  Description of Artificial Sequence: Synthetic peptide
  Seed: TPQFENISIY (TYRP1_HUMAN)
TVQFENISIF

SEQ ID NO: 169938 - protein, 9 aa, Artificial Sequence
  Description of Artificial Sequence: Synthetic peptide
  Seed: APDNLGYTY (TYRP1_HUMAN)
ALDNLGYTY

SEQ ID NO: 169939 - protein, 9 aa, Artificial Sequence
  Description of Artificial Sequence: Synthetic peptide
  Seed: YTYEIQWPS (TYRP1_HUMAN)
YFYEIQWPT

SEQ ID NO: 169940 - protein, 10 aa, Artificial Sequence
  Description of Artificial Sequence: Synthetic peptide
  Seed: EIIAIAVVGA (TYRP1_HUMAN)
EFIAIAVVGV

SEQ ID NO: 169941 - protein, 9 aa, Artificial Sequence
  Description of Artificial Sequence: Synthetic peptide
  Seed: SLPYWNFAT (TYRP1_HUMAN)
SMPYWNFAI

SEQ ID NO: 169942 - protein, 9 aa, Artificial Sequence
  Description of Artificial Sequence: Synthetic peptide
  Seed: QDVAQCLEV (TYRP1_HUMAN)
QEVAQCLEV

SEQ ID NO: 169943 - protein, 9 aa, Artificial Sequence
  Description of Artificial Sequence: Synthetic peptide
  Seed: YNYFVWTHY (TYRP1_HUMAN)
YEYFVWTHF

SEQ ID NO: 169944 - protein, 9 aa, Artificial Sequence
  Description of Artificial Sequence: Synthetic peptide
  Seed: AVVGALLLV (TYRP1_HUMAN)
ATVGALLLA

SEQ ID NO: 169945 - protein, 8 aa, Artificial Sequence
  Description of Artificial Sequence: Synthetic peptide
  Seed: VSGPGTDR (TYRP1_HUMAN)
VAGPGTDF

SEQ ID NO: 169946 - protein, 10 aa, Artificial Sequence
  Description of Artificial Sequence: Synthetic peptide
  Seed: RSLHNLAHLF (TYRP1_HUMAN)
RYLHNLAHLF

SEQ ID NO: 169947 - protein, 9 aa, Artificial Sequence
  Description of Artificial Sequence: Synthetic peptide
  Seed: FSHEGPAFL (TYRP1_HUMAN)
FHHEGPAFM

SEQ ID NO: 169948 - protein, 9 aa, Artificial Sequence
  Description of Artificial Sequence: Synthetic peptide
  Seed: VTAPDNLGY (TYRP1_HUMAN)
VMAPDNLGK

SEQ ID NO: 169949 - protein, 10 aa, Artificial Sequence
  Description of Artificial Sequence: Synthetic peptide
  Seed: EGYSDPTGKY (TYRP1_HUMAN)
ESYSDPTGKR

SEQ ID NO: 169950 - protein, 10 aa, Artificial Sequence
  Description of Artificial Sequence: Synthetic peptide
  Seed: ENISIYNYFV (TYRP1_HUMAN)
EIISIYNYFV

SEQ ID NO: 169951 - protein, 10 aa, Artificial Sequence
  Description of Artificial Sequence: Synthetic peptide
  Seed: SREFSVPEII (TYRP1_HUMAN)
SDEFSVPEIL

SEQ ID NO: 169952 - protein, 9 aa, Artificial Sequence
  Description of Artificial Sequence: Synthetic peptide
  Seed: STNSFRNTV (TYRP1_HUMAN)
SMNSFRNTW

SEQ ID NO: 169953 - protein, 9 aa, Artificial Sequence
  Description of Artificial Sequence: Synthetic peptide
  Seed: FSVPEIIAI (TYRP1_HUMAN)
FWVPEIIAY

SEQ ID NO: 169954 - protein, 9 aa, Artificial Sequence
  Description of Artificial Sequence: Synthetic peptide
  Seed: GPDGNTPQF (TYRP1_HUMAN)
GGDGNTPQI

SEQ ID NO: 169955 - protein, 9 aa, Artificial Sequence
  Description of Artificial Sequence: Synthetic peptide
  Seed: MCCPDLSPV (TYRP1_HUMAN)
MMCPDLSPA

SEQ ID NO: 169956 - protein, 10 aa, Artificial Sequence
  Description of Artificial Sequence: Synthetic peptide
  Seed: ATVEALRSGM (TYRP1_HUMAN)
ATVEALRSGR

SEQ ID NO: 169957 - protein, 9 aa, Artificial Sequence
  Description of Artificial Sequence: Synthetic peptide
  Seed: RSNFDSTLI (TYRP1_HUMAN)
RMNFDSTLF

SEQ ID NO: 169958 - protein, 9 aa, Artificial Sequence
  Description of Artificial Sequence: Synthetic peptide
  Seed: SLGCIFFPL (TYRP1_HUMAN)
SAGCIFFPA

SEQ ID NO: 169959 - protein, 9 aa, Artificial Sequence
  Description of Artificial Sequence: Synthetic peptide
  Seed: KYDPAVRSL (TYRP1_HUMAN)
KGDPAVRSI

SEQ ID NO: 169960 - protein, 10 aa, Artificial Sequence
  Description of Artificial Sequence: Synthetic peptide
  Seed: ADSRPHSPQY (TYRP1_HUMAN)
ANSRPHSPQK

SEQ ID NO: 169961 - protein, 9 aa, Artificial Sequence
  Description of Artificial Sequence: Synthetic peptide
  Seed: RRNPAGNVA (TYRP1_HUMAN)
RANPAGNVM

SEQ ID NO: 169962 - protein, 9 aa, Artificial Sequence
  Description of Artificial Sequence: Synthetic peptide
  Seed: VFDEWLRRY (TYRP1_HUMAN)
VADEWLRRW

SEQ ID NO: 169963 - protein, 9 aa, Artificial Sequence
  Description of Artificial Sequence: Synthetic peptide
  Seed: REFSVPEII (TYRP1_HUMAN)
RVFSVPEIV

SEQ ID NO: 169964 - protein, 9 aa, Artificial Sequence
  Description of Artificial Sequence: Synthetic peptide
  Seed: VFDEWLRRY (TYRP1_HUMAN)
VPDEWLRRY

SEQ ID NO: 169965 - protein, 10 aa, Artificial Sequence
  Description of Artificial Sequence: Synthetic peptide
  Seed: AVFDEWLRRY (TYRP1_HUMAN)
AMFDEWLRRY

SEQ ID NO: 169966 - protein, 10 aa, Artificial Sequence
  Description of Artificial Sequence: Synthetic peptide
  Seed: FLTWHRYHLL (TYRP1_HUMAN)
FPTWHRYHLL

SEQ ID NO: 169967 - protein, 10 aa, Artificial Sequence
  Description of Artificial Sequence: Synthetic peptide
  Seed: MLQEPSFSLP (TYRP1_HUMAN)
MMQEPSFSLD

SEQ ID NO: 169968 - protein, 9 aa, Artificial Sequence
  Description of Artificial Sequence: Synthetic peptide
  Seed: SVFSQWRVV (TYRP1_HUMAN)
SSFSQWRVF

SEQ ID NO: 169969 - protein, 11 aa, Artificial Sequence
  Description of Artificial Sequence: Synthetic peptide
  Seed: FVLLHTFTDAV (TYRP1_HUMAN)
FPLLHTFTDAL

SEQ ID NO: 169970 - protein, 9 aa, Artificial Sequence
  Description of Artificial Sequence: Synthetic peptide
  Seed: ALIFGTASY (TYRP1_HUMAN)
AQIFGTASV

SEQ ID NO: 169971 - protein, 10 aa, Artificial Sequence
  Description of Artificial Sequence: Synthetic peptide
  Seed: ENISIYNYFV (TYRP1_HUMAN)
EKISIYNYFV

SEQ ID NO: 169972 - protein, 10 aa, Artificial Sequence
  Description of Artificial Sequence: Synthetic peptide
  Seed: ADSRPHSPQY (TYRP1_HUMAN)
AGSRPHSPQV

SEQ ID NO: 169973 - protein, 10 aa, Artificial Sequence
  Description of Artificial Sequence: Synthetic peptide
  Seed: YNYFVWTHYY (TYRP1_HUMAN)
YCYFVWTHYR

SEQ ID NO: 169974 - protein, 9 aa, Artificial Sequence
  Description of Artificial Sequence: Synthetic peptide
  Seed: QEMLQEPSF (TYRP1_HUMAN)
QHMLQEPSY

SEQ ID NO: 169975 - protein, 9 aa, Artificial Sequence
  Description of Artificial Sequence: Synthetic peptide
  Seed: CIFFPLLLF (TYRP1_HUMAN)
CTFFPLLLM

SEQ ID NO: 169976 - protein, 9 aa, Artificial Sequence
  Description of Artificial Sequence: Synthetic peptide
  Seed: MLQEPSFSL (TYRP1_HUMAN)
MHQEPSFSM

SEQ ID NO: 169977 - protein, 10 aa, Artificial Sequence
  Description of Artificial Sequence: Synthetic peptide
  Seed: FVTAPDNLGY (TYRP1_HUMAN)
FTTAPDNLGY

SEQ ID NO: 169978 - protein, 10 aa, Artificial Sequence
  Description of Artificial Sequence: Synthetic peptide
  Seed: MSAPKLLSLG (TYRP1_HUMAN)
MLAPKLLSLW

SEQ ID NO: 169979 - protein, 9 aa, Artificial Sequence
  Description of Artificial Sequence: Synthetic peptide
  Seed: RPGWRGAAC (TYRP1_HUMAN)
RPGWRGAAA

SEQ ID NO: 169980 - protein, 9 aa, Artificial Sequence
  Description of Artificial Sequence: Synthetic peptide
  Seed: NADISTFPL (TYRP1_HUMAN)
NFDISTFPF

SEQ ID NO: 169981 - protein, 10 aa, Artificial Sequence
  Description of Artificial Sequence: Synthetic peptide
  Seed: FTDAVFDEWL (TYRP1_HUMAN)
FLDAVFDEWA

SEQ ID NO: 169982 - protein, 11 aa, Artificial Sequence
  Description of Artificial Sequence: Synthetic peptide
  Seed: YNMVPFWPPVT (TYRP1_HUMAN)
YIMVPFWPPVQ

SEQ ID NO: 169983 - protein, 9 aa, Artificial Sequence
  Description of Artificial Sequence: Synthetic peptide
  Seed: EPQDVAQCL (TYRP1_HUMAN)
EPQDVAQCY

SEQ ID NO: 169984 - protein, 11 aa, Artificial Sequence
  Description of Artificial Sequence: Synthetic peptide
  Seed: YNMVPFWPPVT (TYRP1_HUMAN)
YTMVPFWPPVA

SEQ ID NO: 169985 - protein, 11 aa, Artificial Sequence
  Description of Artificial Sequence: Synthetic peptide
  Seed: RSMDEANQPLL (TYRP1_HUMAN)
RIMDEANQPLY

SEQ ID NO: 169986 - protein, 9 aa, Artificial Sequence
  Description of Artificial Sequence: Synthetic peptide
  Seed: GSRSNFDST (TYRP1_HUMAN)
GMRSNFDSK

SEQ ID NO: 169987 - protein, 9 aa, Artificial Sequence
  Description of Artificial Sequence: Synthetic peptide
  Seed: MSAPKLLSL (TYRP1_HUMAN)
MLAPKLLSL

SEQ ID NO: 169988 - protein, 10 aa, Artificial Sequence
  Description of Artificial Sequence: Synthetic peptide
  Seed: GSRSNFDSTL (TYRP1_HUMAN)
GARSNFDSTK

SEQ ID NO: 169989 - protein, 10 aa, Artificial Sequence
  Description of Artificial Sequence: Synthetic peptide
  Seed: MVPFWPPVTN (TYRP1_HUMAN)
MFPFWPPVTM

SEQ ID NO: 169990 - protein, 9 aa, Artificial Sequence
  Description of Artificial Sequence: Synthetic peptide
  Seed: RGRCEAVTA (TYRP1_HUMAN)
RTRCEAVTG

SEQ ID NO: 169991 - protein, 9 aa, Artificial Sequence
  Description of Artificial Sequence: Synthetic peptide
  Seed: YTYEIQWPS (TYRP1_HUMAN)
YEYEIQWPI

SEQ ID NO: 169992 - protein, 8 aa, Artificial Sequence
  Description of Artificial Sequence: Synthetic peptide
  Seed: HTFTDAVF (TYRP1_HUMAN)
HQFTDAVM

SEQ ID NO: 169993 - protein, 10 aa, Artificial Sequence
  Description of Artificial Sequence: Synthetic peptide
  Seed: HPLFVIATRR (TYRP1_HUMAN)
HTLFVIATRV

SEQ ID NO: 169994 - protein, 9 aa, Artificial Sequence
  Description of Artificial Sequence: Synthetic peptide
  Seed: ACDQRVLIV (TYRP1_HUMAN)
ANDQRVLIL

SEQ ID NO: 169995 - protein, 9 aa, Artificial Sequence
  Description of Artificial Sequence: Synthetic peptide
  Seed: RLEKDMQEM (TYRP1_HUMAN)
RVEKDMQEF

SEQ ID NO: 169996 - protein, 10 aa, Artificial Sequence
  Description of Artificial Sequence: Synthetic peptide
  Seed: YNYFVWTHYY (TYRP1_HUMAN)
YTYFVWTHYM

SEQ ID NO: 169997 - protein, 9 aa, Artificial Sequence
  Description of Artificial Sequence: Synthetic peptide
  Seed: SPVSGPGTD (TYRP1_HUMAN)
SPVSGPGTP

SEQ ID NO: 169998 - protein, 9 aa, Artificial Sequence
  Description of Artificial Sequence: Synthetic peptide
  Seed: ISIYNYFVW (TYRP1_HUMAN)
IQIYNYFVM

SEQ ID NO: 169999 - protein, 9 aa, Artificial Sequence
  Description of Artificial Sequence: Synthetic peptide
  Seed: FLGVGQESF (TYRP1_HUMAN)
FSGVGQESL

SEQ ID NO: 170000 - protein, 9 aa, Artificial Sequence
  Description of Artificial Sequence: Synthetic peptide
  Seed: ALIFGTASY (TYRP1_HUMAN)
ATIFGTASM

SEQ ID NO: 170001 - protein, 9 aa, Artificial Sequence
  Description of Artificial Sequence: Synthetic peptide
  Seed: RVLIVRRNL (TYRP1_HUMAN)
RLLIVRRNY

SEQ ID NO: 170002 - protein, 9 aa, Artificial Sequence
  Description of Artificial Sequence: Synthetic peptide
  Seed: APDNLGYTY (TYRP1_HUMAN)
ARDNLGYTF

SEQ ID NO: 170003 - protein, 10 aa, Artificial Sequence
  Description of Artificial Sequence: Synthetic peptide
  Seed: NYFVWTHYYS (TYRP1_HUMAN)
NFFVWTHYYQ

SEQ ID NO: 170004 - protein, 11 aa, Artificial Sequence
  Description of Artificial Sequence: Synthetic peptide
  Seed: RYNADISTFPL (TYRP1_HUMAN)
RYNADISTFPM

SEQ ID NO: 170005 - protein, 11 aa, Artificial Sequence
  Description of Artificial Sequence: Synthetic peptide
  Seed: SLGCIFFPLLL (TYRP1_HUMAN)
SLGCIFFPLLV

SEQ ID NO: 170006 - protein, 11 aa, Artificial Sequence
  Description of Artificial Sequence: Synthetic peptide
  Seed: ILGPDGNTPQF (TYRP1_HUMAN)
ISGPDGNTPQF

SEQ ID NO: 170007 - protein, 11 aa, Artificial Sequence
  Description of Artificial Sequence: Synthetic peptide
  Seed: TVEGYSDPTGK (TYRP1_HUMAN)
TSEGYSDPTGY

SEQ ID NO: 170008 - protein, 10 aa, Artificial Sequence
  Description of Artificial Sequence: Synthetic peptide
  Seed: RRYNADISTF (TYRP1_HUMAN)
RCYNADISTW

SEQ ID NO: 170009 - protein, 9 aa, Artificial Sequence
  Description of Artificial Sequence: Synthetic peptide
  Seed: LSPNDPIFV (TYRP1_HUMAN)
LLPNDPIFM

SEQ ID NO: 170010 - protein, 9 aa, Artificial Sequence
  Description of Artificial Sequence: Synthetic peptide
  Seed: IAIAVVGAL (TYRP1_HUMAN)
IYIAVVGAV

SEQ ID NO: 170011 - protein, 10 aa, Artificial Sequence
  Description of Artificial Sequence: Synthetic peptide
  Seed: AACDQRVLIV (TYRP1_HUMAN)
AQCDQRVLIV

SEQ ID NO: 170012 - protein, 9 aa, Artificial Sequence
  Description of Artificial Sequence: Synthetic peptide
  Seed: AVRSLHNLA (TYRP1_HUMAN)
AMRSLHNLR

SEQ ID NO: 170013 - protein, 9 aa, Artificial Sequence
  Description of Artificial Sequence: Synthetic peptide
  Seed: VFDEWLRRY (TYRP1_HUMAN)
VSDEWLRRF

SEQ ID NO: 170014 - protein, 10 aa, Artificial Sequence
  Description of Artificial Sequence: Synthetic peptide
  Seed: SLHNLAHLFL (TYRP1_HUMAN)
SMHNLAHLFL

SEQ ID NO: 170015 - protein, 10 aa, Artificial Sequence
  Description of Artificial Sequence: Synthetic peptide
  Seed: EGPAFLTWHR (TYRP1_HUMAN)
EQPAFLTWHR

SEQ ID NO: 170016 - protein, 11 aa, Artificial Sequence
  Description of Artificial Sequence: Synthetic peptide
  Seed: RRYNADISTFP (TYRP1_HUMAN)
RWYNADISTFD

SEQ ID NO: 170017 - protein, 10 aa, Artificial Sequence
  Description of Artificial Sequence: Synthetic peptide
  Seed: FVTAPDNLGY (TYRP1_HUMAN)
FFTAPDNLGF

SEQ ID NO: 170018 - protein, 10 aa, Artificial Sequence
  Description of Artificial Sequence: Synthetic peptide
  Seed: VLLHTFTDAV (TYRP1_HUMAN)
VWLHTFTDAV

SEQ ID NO: 170019 - protein, 9 aa, Artificial Sequence
  Description of Artificial Sequence: Synthetic peptide
  Seed: LVALIFGTA (TYRP1_HUMAN)
LSALIFGTV

SEQ ID NO: 170020 - protein, 9 aa, Artificial Sequence
  Description of Artificial Sequence: Synthetic peptide
  Seed: SMDEANQPL (TYRP1_HUMAN)
SPDEANQPM

SEQ ID NO: 170021 - protein, 10 aa, Artificial Sequence
  Description of Artificial Sequence: Synthetic peptide
  Seed: FYSNSTNSFR (TYRP1_HUMAN)
FKSNSTNSFR

SEQ ID NO: 170022 - protein, 9 aa, Artificial Sequence
  Description of Artificial Sequence: Synthetic peptide
  Seed: RQCATVEAL (TYRP1_HUMAN)
RSCATVEAF

SEQ ID NO: 170023 - protein, 10 aa, Artificial Sequence
  Description of Artificial Sequence: Synthetic peptide
  Seed: EIIAIAVVGA (TYRP1_HUMAN)
ECIAIAVVGI

SEQ ID NO: 170024 - protein, 9 aa, Artificial Sequence
  Description of Artificial Sequence: Synthetic peptide
  Seed: LHTFTDAVF (TYRP1_HUMAN)
LRTFTDAVF

SEQ ID NO: 170025 - protein, 9 aa, Artificial Sequence
  Description of Artificial Sequence: Synthetic peptide
  Seed: LVALIFGTA (TYRP1_HUMAN)
LTALIFGTL

SEQ ID NO: 170026 - protein, 10 aa, Artificial Sequence
  Description of Artificial Sequence: Synthetic peptide
  Seed: YNMVPFWPPV (TYRP1_HUMAN)
YHMVPFWPPV

SEQ ID NO: 170027 - protein, 9 aa, Artificial Sequence
  Description of Artificial Sequence: Synthetic peptide
  Seed: KYDPAVRSL (TYRP1_HUMAN)
KSDPAVRSV

SEQ ID NO: 170028 - protein, 10 aa, Artificial Sequence
  Description of Artificial Sequence: Synthetic peptide
  Seed: YNMVPFWPPV (TYRP1_HUMAN)
YAMVPFWPPV

SEQ ID NO: 170029 - protein, 9 aa, Artificial Sequence
  Description of Artificial Sequence: Synthetic peptide
  Seed: MAKRTTHPL (TYRP1_HUMAN)
MPKRTTHPP

SEQ ID NO: 170030 - protein, 9 aa, Artificial Sequence
  Description of Artificial Sequence: Synthetic peptide
  Seed: VFDEWLRRY (TYRP1_HUMAN)
VMDEWLRRI

SEQ ID NO: 170031 - protein, 10 aa, Artificial Sequence
  Description of Artificial Sequence: Synthetic peptide
  Seed: VALIFGTASY (TYRP1_HUMAN)
VTLIFGTASY

SEQ ID NO: 170032 - protein, 11 aa, Artificial Sequence
  Description of Artificial Sequence: Synthetic peptide
  Seed: LRRYNADISTF (TYRP1_HUMAN)
LHRYNADISTF

SEQ ID NO: 170033 - protein, 10 aa, Artificial Sequence
  Description of Artificial Sequence: Synthetic peptide
  Seed: MAKRTTHPLF (TYRP1_HUMAN)
MAKRTTHPLY

SEQ ID NO: 170034 - protein, 11 aa, Artificial Sequence
  Description of Artificial Sequence: Synthetic peptide
  Seed: YNYFVWTHYYS (TYRP1_HUMAN)
YFYFVWTHYYS

SEQ ID NO: 170035 - protein, 9 aa, Artificial Sequence
  Description of Artificial Sequence: Synthetic peptide
  Seed: HLSPNDPIF (TYRP1_HUMAN)
HPSPNDPIF

SEQ ID NO: 170036 - protein, 9 aa, Artificial Sequence
  Description of Artificial Sequence: Synthetic peptide
  Seed: KLQNPNQSV (TYRP1_HUMAN)
KVQNPNQSK

SEQ ID NO: 170037 - protein, 11 aa, Artificial Sequence
  Description of Artificial Sequence: Synthetic peptide
  Seed: FWPPVTNTEMF (TYRP1_HUMAN)
FWPPVTNTEMW

SEQ ID NO: 170038 - protein, 9 aa, Artificial Sequence
  Description of Artificial Sequence: Synthetic peptide
  Seed: NMVPFWPPV (TYRP1_HUMAN)
NLVPFWPPA

SEQ ID NO: 170039 - protein, 9 aa, Artificial Sequence
  Description of Artificial Sequence: Synthetic peptide
  Seed: MAKRTTHPL (TYRP1_HUMAN)
MAKRTTHPI

SEQ ID NO: 170040 - protein, 9 aa, Artificial Sequence
  Description of Artificial Sequence: Synthetic peptide
  Seed: NFDSTLISP (TYRP1_HUMAN)
NFDSTLISC

SEQ ID NO: 170041 - protein, 9 aa, Artificial Sequence
  Description of Artificial Sequence: Synthetic peptide
  Seed: RVLIVRRNL (TYRP1_HUMAN)
RFLIVRRNK

SEQ ID NO: 170042 - protein, 9 aa, Artificial Sequence
  Description of Artificial Sequence: Synthetic peptide
  Seed: AIAVVGALL (TYRP1_HUMAN)
AIAVVGALV

SEQ ID NO: 170043 - protein, 11 aa, Artificial Sequence
  Description of Artificial Sequence: Synthetic peptide
  Seed: TADSRPHSPQY (TYRP1_HUMAN)
TSDSRPHSPQY

SEQ ID NO: 170044 - protein, 10 aa, Artificial Sequence
  Description of Artificial Sequence: Synthetic peptide
  Seed: SIYNYFVWTH (TYRP1_HUMAN)
SKYNYFVWTK

SEQ ID NO: 170045 - protein, 11 aa, Artificial Sequence
  Description of Artificial Sequence: Synthetic peptide
  Seed: IYNYFVWTHYY (TYRP1_HUMAN)
IVNYFVWTHYY

SEQ ID NO: 170046 - protein, 9 aa, Artificial Sequence
  Description of Artificial Sequence: Synthetic peptide
  Seed: LGYTYEIQW (TYRP1_HUMAN)
LPYTYEIQW

SEQ ID NO: 170047 - protein, 10 aa, Artificial Sequence
  Description of Artificial Sequence: Synthetic peptide
  Seed: KYDPAVRSLH (TYRP1_HUMAN)
KYDPAVRSLY

SEQ ID NO: 170048 - protein, 9 aa, Artificial Sequence
  Description of Artificial Sequence: Synthetic peptide
  Seed: VVGALLLVA (TYRP1_HUMAN)
VMGALLLVA

SEQ ID NO: 170049 - protein, 10 aa, Artificial Sequence
  Description of Artificial Sequence: Synthetic peptide
  Seed: FGTASYLIRA (TYRP1_HUMAN)
FSTASYLIRI

SEQ ID NO: 170050 - protein, 10 aa, Artificial Sequence
  Description of Artificial Sequence: Synthetic peptide
  Seed: TPQFENISIY (TYRP1_HUMAN)
TPQFENISIF

SEQ ID NO: 170051 - protein, 10 aa, Artificial Sequence
  Description of Artificial Sequence: Synthetic peptide
  Seed: TPQFENISIY (TYRP1_HUMAN)
TKQFENISIF

SEQ ID NO: 170052 - protein, 9 aa, Artificial Sequence
  Description of Artificial Sequence: Synthetic peptide
  Seed: YTYEIQWPS (TYRP1_HUMAN)
YSYEIQWPT

SEQ ID NO: 170053 - protein, 9 aa, Artificial Sequence
  Description of Artificial Sequence: Synthetic peptide
  Seed: TADSRPHSP (TYRP1_HUMAN)
TTDSRPHSL

SEQ ID NO: 170054 - protein, 9 aa, Artificial Sequence
  Description of Artificial Sequence: Synthetic peptide
  Seed: YSNSTNSFR (TYRP1_HUMAN)
YVNSTNSFR

SEQ ID NO: 170055 - protein, 9 aa, Artificial Sequence
  Description of Artificial Sequence: Synthetic peptide
  Seed: CIFFPLLLF (TYRP1_HUMAN)
CQFFPLLLF

SEQ ID NO: 170056 - protein, 9 aa, Artificial Sequence
  Description of Artificial Sequence: Synthetic peptide
  Seed: CIFFPLLLF (TYRP1_HUMAN)
CNFFPLLLY

SEQ ID NO: 170057 - protein, 9 aa, Artificial Sequence
  Description of Artificial Sequence: Synthetic peptide
  Seed: FSLPYWNFA (TYRP1_HUMAN)
FQLPYWNFV

SEQ ID NO: 170058 - protein, 9 aa, Artificial Sequence
  Description of Artificial Sequence: Synthetic peptide
  Seed: RRYNADIST (TYRP1_HUMAN)
RQYNADISY

SEQ ID NO: 170059 - protein, 9 aa, Artificial Sequence
  Description of Artificial Sequence: Synthetic peptide
  Seed: MAKRTTHPL (TYRP1_HUMAN)
MYKRTTHPA

SEQ ID NO: 170060 - protein, 9 aa, Artificial Sequence
  Description of Artificial Sequence: Synthetic peptide
  Seed: YLIRARRSM (TYRP1_HUMAN)
YVIRARRSV

SEQ ID NO: 170061 - protein, 9 aa, Artificial Sequence
  Description of Artificial Sequence: Synthetic peptide
  Seed: FLTWHRYHL (TYRP1_HUMAN)
FVTWHRYHV

SEQ ID NO: 170062 - protein, 11 aa, Artificial Sequence
  Description of Artificial Sequence: Synthetic peptide
  Seed: SLPYWNFATGK (TYRP1_HUMAN)
SGPYWNFATGR

SEQ ID NO: 170063 - protein, 10 aa, Artificial Sequence
  Description of Artificial Sequence: Synthetic peptide
  Seed: AVRSLHNLAH (TYRP1_HUMAN)
ATRSLHNLAY

SEQ ID NO: 170064 - protein, 10 aa, Artificial Sequence
  Description of Artificial Sequence: Synthetic peptide
  Seed: HYYSVKKTFL (TYRP1_HUMAN)
HYYSVKKTFW

SEQ ID NO: 170065 - protein, 10 aa, Artificial Sequence
  Description of Artificial Sequence: Synthetic peptide
  Seed: LQEPSFSLPY (TYRP1_HUMAN)
LMEPSFSLPY

SEQ ID NO: 170066 - protein, 11 aa, Artificial Sequence
  Description of Artificial Sequence: Synthetic peptide
  Seed: RRYNADISTFP (TYRP1_HUMAN)
RYYNADISTFP

SEQ ID NO: 170067 - protein, 9 aa, Artificial Sequence
  Description of Artificial Sequence: Synthetic peptide
  Seed: RPMVQRLPE (TYRP1_HUMAN)
RPMVQRLPT

SEQ ID NO: 170068 - protein, 9 aa, Artificial Sequence
  Description of Artificial Sequence: Synthetic peptide
  Seed: FLGVGQESF (TYRP1_HUMAN)
FQGVGQESW

SEQ ID NO: 170069 - protein, 9 aa, Artificial Sequence
  Description of Artificial Sequence: Synthetic peptide
  Seed: STNSFRNTV (TYRP1_HUMAN)
SGNSFRNTW

SEQ ID NO: 170070 - protein, 9 aa, Artificial Sequence
  Description of Artificial Sequence: Synthetic peptide
  Seed: SMDEANQPL (TYRP1_HUMAN)
SPDEANQPI

SEQ ID NO: 170071 - protein, 9 aa, Artificial Sequence
  Description of Artificial Sequence: Synthetic peptide
  Seed: YNYFVWTHY (TYRP1_HUMAN)
YTYFVWTHK

SEQ ID NO: 170072 - protein, 9 aa, Artificial Sequence
  Description of Artificial Sequence: Synthetic peptide
  Seed: LQNPNQSVV (TYRP1_HUMAN)
LVNPNQSVF

SEQ ID NO: 170073 - protein, 10 aa, Artificial Sequence
  Description of Artificial Sequence: Synthetic peptide
  Seed: SQWRVVCDSL (TYRP1_HUMAN)
SQWRVVCDSM

SEQ ID NO: 170074 - protein, 9 aa, Artificial Sequence
  Description of Artificial Sequence: Synthetic peptide
  Seed: YTYEIQWPS (TYRP1_HUMAN)
YIYEIQWPG

SEQ ID NO: 170075 - protein, 9 aa, Artificial Sequence
  Description of Artificial Sequence: Synthetic peptide
  Seed: APIGHNRQY (TYRP1_HUMAN)
ATIGHNRQF

SEQ ID NO: 170076 - protein, 9 aa, Artificial Sequence
  Description of Artificial Sequence: Synthetic peptide
  Seed: VFDEWLRRY (TYRP1_HUMAN)
VFDEWLRRM

SEQ ID NO: 170077 - protein, 9 aa, Artificial Sequence
  Description of Artificial Sequence: Synthetic peptide
  Seed: YSNSTNSFR (TYRP1_HUMAN)
YINSTNSFK

SEQ ID NO: 170078 - protein, 9 aa, Artificial Sequence
  Description of Artificial Sequence: Synthetic peptide
  Seed: ALIFGTASY (TYRP1_HUMAN)
AWIFGTASM

SEQ ID NO: 170079 - protein, 9 aa, Artificial Sequence
  Description of Artificial Sequence: Synthetic peptide
  Seed: YSNSTNSFR (TYRP1_HUMAN)
YVNSTNSFK

SEQ ID NO: 170080 - protein, 9 aa, Artificial Sequence
  Description of Artificial Sequence: Synthetic peptide
  Seed: NRQYNMVPF (TYRP1_HUMAN)
NQQYNMVPY

SEQ ID NO: 170081 - protein, 9 aa, Artificial Sequence
  Description of Artificial Sequence: Synthetic peptide
  Seed: FLTWHRYHL (TYRP1_HUMAN)
FPTWHRYHV

SEQ ID NO: 170082 - protein, 9 aa, Artificial Sequence
  Description of Artificial Sequence: Synthetic peptide
  Seed: LHTFTDAVF (TYRP1_HUMAN)
LHTFTDAVY

SEQ ID NO: 170083 - protein, 11 aa, Artificial Sequence
  Description of Artificial Sequence: Synthetic peptide
  Seed: RRYNADISTFP (TYRP1_HUMAN)
RYYNADISTFM

SEQ ID NO: 170084 - protein, 9 aa, Artificial Sequence
  Description of Artificial Sequence: Synthetic peptide
  Seed: SPNSVFSQW (TYRP1_HUMAN)
SANSVFSQM

SEQ ID NO: 170085 - protein, 10 aa, Artificial Sequence
  Description of Artificial Sequence: Synthetic peptide
  Seed: THYYSVKKTF (TYRP1_HUMAN)
TCYYSVKKTF

SEQ ID NO: 170086 - protein, 11 aa, Artificial Sequence
  Description of Artificial Sequence: Synthetic peptide
  Seed: FWPPVTNTEMF (TYRP1_HUMAN)
FIPPVTNTEMY

SEQ ID NO: 170087 - protein, 10 aa, Artificial Sequence
  Description of Artificial Sequence: Synthetic peptide
  Seed: LIFGTASYLI (TYRP1_HUMAN)
LWFGTASYLL

SEQ ID NO: 170088 - protein, 9 aa, Artificial Sequence
  Description of Artificial Sequence: Synthetic peptide
  Seed: MAKRTTHPL (TYRP1_HUMAN)
MTKRTTHPY

SEQ ID NO: 170089 - protein, 9 aa, Artificial Sequence
  Description of Artificial Sequence: Synthetic peptide
  Seed: KYDPAVRSL (TYRP1_HUMAN)
KSDPAVRSA

SEQ ID NO: 170090 - protein, 9 aa, Artificial Sequence
  Description of Artificial Sequence: Synthetic peptide
  Seed: AFLTWHRYH (TYRP1_HUMAN)
AQLTWHRYR

SEQ ID NO: 170091 - protein, 10 aa, Artificial Sequence
  Description of Artificial Sequence: Synthetic peptide
  Seed: RQCATVEALR (TYRP1_HUMAN)
RGCATVEALR

SEQ ID NO: 170092 - protein, 10 aa, Artificial Sequence
  Description of Artificial Sequence: Synthetic peptide
  Seed: SHEGPAFLTW (TYRP1_HUMAN)
SVEGPAFLTW

SEQ ID NO: 170093 - protein, 9 aa, Artificial Sequence
  Description of Artificial Sequence: Synthetic peptide
  Seed: IAIAVVGAL (TYRP1_HUMAN)
IQIAVVGAL

SEQ ID NO: 170094 - protein, 10 aa, Artificial Sequence
  Description of Artificial Sequence: Synthetic peptide
  Seed: YNMVPFWPPV (TYRP1_HUMAN)
YFMVPFWPPL

SEQ ID NO: 170095 - protein, 10 aa, Artificial Sequence
  Description of Artificial Sequence: Synthetic peptide
  Seed: VGLFDTPPFY (TYRP1_HUMAN)
VKLFDTPPFK

SEQ ID NO: 170096 - protein, 9 aa, Artificial Sequence
  Description of Artificial Sequence: Synthetic peptide
  Seed: RQCATVEAL (TYRP1_HUMAN)
RECATVEAV

SEQ ID NO: 170097 - protein, 10 aa, Artificial Sequence
  Description of Artificial Sequence: Synthetic peptide
  Seed: ADSRPHSPQY (TYRP1_HUMAN)
ACSRPHSPQK

SEQ ID NO: 170098 - protein, 10 aa, Artificial Sequence
  Description of Artificial Sequence: Synthetic peptide
  Seed: FGTASYLIRA (TYRP1_HUMAN)
FVTASYLIRV

SEQ ID NO: 170099 - protein, 9 aa, Artificial Sequence
  Description of Artificial Sequence: Synthetic peptide
  Seed: ACDQRVLIV (TYRP1_HUMAN)
AWDQRVLIF

SEQ ID NO: 170100 - protein, 11 aa, Artificial Sequence
  Description of Artificial Sequence: Synthetic peptide
  Seed: RSLHNLAHLFL (TYRP1_HUMAN)
RTLHNLAHLFF

SEQ ID NO: 170101 - protein, 10 aa, Artificial Sequence
  Description of Artificial Sequence: Synthetic peptide
  Seed: ALIFGTASYL (TYRP1_HUMAN)
AMIFGTASYK

SEQ ID NO: 170102 - protein, 10 aa, Artificial Sequence
  Description of Artificial Sequence: Synthetic peptide
  Seed: RSLHNLAHLF (TYRP1_HUMAN)
RALHNLAHLY

SEQ ID NO: 170103 - protein, 9 aa, Artificial Sequence
  Description of Artificial Sequence: Synthetic peptide
  Seed: REFSVPEII (TYRP1_HUMAN)
RHFSVPEII

SEQ ID NO: 170104 - protein, 10 aa, Artificial Sequence
  Description of Artificial Sequence: Synthetic peptide
  Seed: VDFSHEGPAF (TYRP1_HUMAN)
VEFSHEGPAV

SEQ ID NO: 170105 - protein, 9 aa, Artificial Sequence
  Description of Artificial Sequence: Synthetic peptide
  Seed: NRQYNMVPF (TYRP1_HUMAN)
NHQYNMVPM

SEQ ID NO: 170106 - protein, 11 aa, Artificial Sequence
  Description of Artificial Sequence: Synthetic peptide
  Seed: ILGPDGNTPQF (TYRP1_HUMAN)
IMGPDGNTPQY

SEQ ID NO: 170107 - protein, 9 aa, Artificial Sequence
  Description of Artificial Sequence: Synthetic peptide
  Seed: DLMGSRSNF (TYRP1_HUMAN)
DTMGSRSNK

SEQ ID NO: 170108 - protein, 10 aa, Artificial Sequence
  Description of Artificial Sequence: Synthetic peptide
  Seed: AVRSLHNLAH (TYRP1_HUMAN)
ATRSLHNLAM

SEQ ID NO: 170109 - protein, 10 aa, Artificial Sequence
  Description of Artificial Sequence: Synthetic peptide
  Seed: FLNGTGGQTH (TYRP1_HUMAN)
FSNGTGGQTL

SEQ ID NO: 170110 - protein, 9 aa, Artificial Sequence
  Description of Artificial Sequence: Synthetic peptide
  Seed: RGRCEAVTA (TYRP1_HUMAN)
RVRCEAVTK

SEQ ID NO: 170111 - protein, 10 aa, Artificial Sequence
  Description of Artificial Sequence: Synthetic peptide
  Seed: QFENISIYNY (TYRP1_HUMAN)
QCENISIYNW

SEQ ID NO: 170112 - protein, 9 aa, Artificial Sequence
  Description of Artificial Sequence: Synthetic peptide
  Seed: VFDEWLRRY (TYRP1_HUMAN)
VMDEWLRRV

SEQ ID NO: 170113 - protein, 9 aa, Artificial Sequence
  Description of Artificial Sequence: Synthetic peptide
  Seed: AIAVVGALL (TYRP1_HUMAN)
AQAVVGALL

SEQ ID NO: 170114 - protein, 9 aa, Artificial Sequence
  Description of Artificial Sequence: Synthetic peptide
  Seed: KYDPAVRSL (TYRP1_HUMAN)
KLDPAVRSW

SEQ ID NO: 170115 - protein, 10 aa, Artificial Sequence
  Description of Artificial Sequence: Synthetic peptide
  Seed: SQWRVVCDSL (TYRP1_HUMAN)
SMWRVVCDSI

SEQ ID NO: 170116 - protein, 10 aa, Artificial Sequence
  Description of Artificial Sequence: Synthetic peptide
  Seed: ADSRPHSPQY (TYRP1_HUMAN)
ACSRPHSPQV

SEQ ID NO: 170117 - protein, 10 aa, Artificial Sequence
  Description of Artificial Sequence: Synthetic peptide
  Seed: ISPNSVFSQW (TYRP1_HUMAN)
IQPNSVFSQW

SEQ ID NO: 170118 - protein, 9 aa, Artificial Sequence
  Description of Artificial Sequence: Synthetic peptide
  Seed: FSVPEIIAI (TYRP1_HUMAN)
FVVPEIIAV

SEQ ID NO: 170119 - protein, 10 aa, Artificial Sequence
  Description of Artificial Sequence: Synthetic peptide
  Seed: SRSNFDSTLI (TYRP1_HUMAN)
SRSNFDSTLL

SEQ ID NO: 170120 - protein, 10 aa, Artificial Sequence
  Description of Artificial Sequence: Synthetic peptide
  Seed: ISIYNYFVWT (TYRP1_HUMAN)
ISIYNYFVWY

SEQ ID NO: 170121 - protein, 11 aa, Artificial Sequence
  Description of Artificial Sequence: Synthetic peptide
  Seed: FLTWHRYHLLR (TYRP1_HUMAN)
FYTWHRYHLLR

SEQ ID NO: 170122 - protein, 10 aa, Artificial Sequence
  Description of Artificial Sequence: Synthetic peptide
  Seed: VGLFDTPPFY (TYRP1_HUMAN)
VHLFDTPPFY

SEQ ID NO: 170123 - protein, 10 aa, Artificial Sequence
  Description of Artificial Sequence: Synthetic peptide
  Seed: VALIFGTASY (TYRP1_HUMAN)
VMLIFGTASY

SEQ ID NO: 170124 - protein, 11 aa, Artificial Sequence
  Description of Artificial Sequence: Synthetic peptide
  Seed: LVALIFGTASY (TYRP1_HUMAN)
LSALIFGTASF

SEQ ID NO: 170125 - protein, 9 aa, Artificial Sequence
  Description of Artificial Sequence: Synthetic peptide
  Seed: GLFDTPPFY (TYRP1_HUMAN)
GLFDTPPFM

SEQ ID NO: 170126 - protein, 9 aa, Artificial Sequence
  Description of Artificial Sequence: Synthetic peptide
  Seed: WHRYHLLRL (TYRP1_HUMAN)
WMRYHLLRY

SEQ ID NO: 170127 - protein, 9 aa, Artificial Sequence
  Description of Artificial Sequence: Synthetic peptide
  Seed: MAKRTTHPL (TYRP1_HUMAN)
MNKRTTHPK

SEQ ID NO: 170128 - protein, 9 aa, Artificial Sequence
  Description of Artificial Sequence: Synthetic peptide
  Seed: ACDQRVLIV (TYRP1_HUMAN)
AADQRVLII

SEQ ID NO: 170129 - protein, 9 aa, Artificial Sequence
  Description of Artificial Sequence: Synthetic peptide
  Seed: SRSNFDSTL (TYRP1_HUMAN)
SYSNFDSTM

SEQ ID NO: 170130 - protein, 11 aa, Artificial Sequence
  Description of Artificial Sequence: Synthetic peptide
  Seed: EVWPLRFFNRT (TYRP1_HUMAN)
EAWPLRFFNRR

SEQ ID NO: 170131 - protein, 9 aa, Artificial Sequence
  Description of Artificial Sequence: Synthetic peptide
  Seed: SLPYWNFAT (TYRP1_HUMAN)
SVPYWNFAL

SEQ ID NO: 170132 - protein, 9 aa, Artificial Sequence
  Description of Artificial Sequence: Synthetic peptide
  Seed: YTYEIQWPS (TYRP1_HUMAN)
YWYEIQWPI

SEQ ID NO: 170133 - protein, 9 aa, Artificial Sequence
  Description of Artificial Sequence: Synthetic peptide
  Seed: RSLHNLAHL (TYRP1_HUMAN)
RYLHNLAHF

SEQ ID NO: 170134 - protein, 9 aa, Artificial Sequence
  Description of Artificial Sequence: Synthetic peptide
  Seed: MSAPKLLSL (TYRP1_HUMAN)
MQAPKLLSV

SEQ ID NO: 170135 - protein, 11 aa, Artificial Sequence
  Description of Artificial Sequence: Synthetic peptide
  Seed: VTAPDNLGYTY (TYRP1_HUMAN)
VIAPDNLGYTW

SEQ ID NO: 170136 - protein, 10 aa, Artificial Sequence
  Description of Artificial Sequence: Synthetic peptide
  Seed: YFVWTHYYSV (TYRP1_HUMAN)
YQVWTHYYSM

SEQ ID NO: 170137 - protein, 10 aa, Artificial Sequence
  Description of Artificial Sequence: Synthetic peptide
  Seed: RQCATVEALR (TYRP1_HUMAN)
RLCATVEALK

SEQ ID NO: 170138 - protein, 10 aa, Artificial Sequence
  Description of Artificial Sequence: Synthetic peptide
  Seed: YFVWTHYYSV (TYRP1_HUMAN)
YYVWTHYYSM

SEQ ID NO: 170139 - protein, 10 aa, Artificial Sequence
  Description of Artificial Sequence: Synthetic peptide
  Seed: THYYSVKKTF (TYRP1_HUMAN)
TQYYSVKKTF

SEQ ID NO: 170140 - protein, 10 aa, Artificial Sequence
  Description of Artificial Sequence: Synthetic peptide
  Seed: FLNGTGGQTH (TYRP1_HUMAN)
FVNGTGGQTL

SEQ ID NO: 170141 - protein, 9 aa, Artificial Sequence
  Description of Artificial Sequence: Synthetic peptide
  Seed: RSNFDSTLI (TYRP1_HUMAN)
RQNFDSTLF

SEQ ID NO: 170142 - protein, 10 aa, Artificial Sequence
  Description of Artificial Sequence: Synthetic peptide
  Seed: RTTHPLFVIA (TYRP1_HUMAN)
RFTHPLFVIA

SEQ ID NO: 170143 - protein, 9 aa, Artificial Sequence
  Description of Artificial Sequence: Synthetic peptide
  Seed: TADSRPHSP (TYRP1_HUMAN)
TQDSRPHSI

SEQ ID NO: 170144 - protein, 9 aa, Artificial Sequence
  Description of Artificial Sequence: Synthetic peptide
  Seed: SLHNLAHLF (TYRP1_HUMAN)
SWHNLAHLF

SEQ ID NO: 170145 - protein, 10 aa, Artificial Sequence
  Description of Artificial Sequence: Synthetic peptide
  Seed: YNYFVWTHYY (TYRP1_HUMAN)
YMYFVWTHYR

SEQ ID NO: 170146 - protein, 9 aa, Artificial Sequence
  Description of Artificial Sequence: Synthetic peptide
  Seed: TLISPNSVF (TYRP1_HUMAN)
TIISPNSVF

SEQ ID NO: 170147 - protein, 9 aa, Artificial Sequence
  Description of Artificial Sequence: Synthetic peptide
  Seed: RYNADISTF (TYRP1_HUMAN)
RKNADISTY

SEQ ID NO: 170148 - protein, 9 aa, Artificial Sequence
  Description of Artificial Sequence: Synthetic peptide
  Seed: MAKRTTHPL (TYRP1_HUMAN)
MLKRTTHPF

SEQ ID NO: 170149 - protein, 11 aa, Artificial Sequence
  Description of Artificial Sequence: Synthetic peptide
  Seed: YSDPTGKYDPA (TYRP1_HUMAN)
YGDPTGKYDPM

SEQ ID NO: 170150 - protein, 11 aa, Artificial Sequence
  Description of Artificial Sequence: Synthetic peptide
  Seed: YNYFVWTHYYS (TYRP1_HUMAN)
YFYFVWTHYYN

SEQ ID NO: 170151 - protein, 10 aa, Artificial Sequence
  Description of Artificial Sequence: Synthetic peptide
  Seed: LIFGTASYLI (TYRP1_HUMAN)
LVFGTASYLF

SEQ ID NO: 170152 - protein, 9 aa, Artificial Sequence
  Description of Artificial Sequence: Synthetic peptide
  Seed: MSAPKLLSL (TYRP1_HUMAN)
MNAPKLLSV

SEQ ID NO: 170153 - protein, 8 aa, Artificial Sequence
  Description of Artificial Sequence: Synthetic peptide
  Seed: SVPEIIAI (TYRP1_HUMAN)
SAPEIIAL

SEQ ID NO: 170154 - protein, 10 aa, Artificial Sequence
  Description of Artificial Sequence: Synthetic peptide
  Seed: YNYFVWTHYY (TYRP1_HUMAN)
YPYFVWTHYR

SEQ ID NO: 170155 - protein, 9 aa, Artificial Sequence
  Description of Artificial Sequence: Synthetic peptide
  Seed: AKRTTHPLF (TYRP1_HUMAN)
AQRTTHPLL

SEQ ID NO: 170156 - protein, 9 aa, Artificial Sequence
  Description of Artificial Sequence: Synthetic peptide
  Seed: YTYEIQWPS (TYRP1_HUMAN)
YVYEIQWPT

SEQ ID NO: 170157 - protein, 9 aa, Artificial Sequence
  Description of Artificial Sequence: Synthetic peptide
  Seed: NYFVWTHYY (TYRP1_HUMAN)
NLFVWTHYL

SEQ ID NO: 170158 - protein, 10 aa, Artificial Sequence
  Description of Artificial Sequence: Synthetic peptide
  Seed: LLHTFTDAVF (TYRP1_HUMAN)
LSHTFTDAVY

SEQ ID NO: 170159 - protein, 8 aa, Artificial Sequence
  Description of Artificial Sequence: Synthetic peptide
  Seed: ACDQRVLI (TYRP1_HUMAN)
AFDQRVLL

SEQ ID NO: 170160 - protein, 10 aa, Artificial Sequence
  Description of Artificial Sequence: Synthetic peptide
  Seed: FFPLLLFQQA (TYRP1_HUMAN)
FAPLLLFQQA

SEQ ID NO: 170161 - protein, 9 aa, Artificial Sequence
  Description of Artificial Sequence: Synthetic peptide
  Seed: NISIYNYFV (TYRP1_HUMAN)
NSSIYNYFI

SEQ ID NO: 170162 - protein, 11 aa, Artificial Sequence
  Description of Artificial Sequence: Synthetic peptide
  Seed: FVLLHTFTDAV (TYRP1_HUMAN)
FHLLHTFTDAV

SEQ ID NO: 170163 - protein, 9 aa, Artificial Sequence
  Description of Artificial Sequence: Synthetic peptide
  Seed: RSLHNLAHL (TYRP1_HUMAN)
RVLHNLAHL

SEQ ID NO: 170164 - protein, 10 aa, Artificial Sequence
  Description of Artificial Sequence: Synthetic peptide
  Seed: LIFGTASYLI (TYRP1_HUMAN)
LIFGTASYLF

SEQ ID NO: 170165 - protein, 9 aa, Artificial Sequence
  Description of Artificial Sequence: Synthetic peptide
  Seed: MSAPKLLSL (TYRP1_HUMAN)
MEAPKLLSM

SEQ ID NO: 170166 - protein, 10 aa, Artificial Sequence
  Description of Artificial Sequence: Synthetic peptide
  Seed: VGLFDTPPFY (TYRP1_HUMAN)
VTLFDTPPFK

SEQ ID NO: 170167 - protein, 9 aa, Artificial Sequence
  Description of Artificial Sequence: Synthetic peptide
  Seed: SMDEANQPL (TYRP1_HUMAN)
SHDEANQPL

SEQ ID NO: 170168 - protein, 9 aa, Artificial Sequence
  Description of Artificial Sequence: Synthetic peptide
  Seed: VFDEWLRRY (TYRP1_HUMAN)
VIDEWLRRY

SEQ ID NO: 170169 - protein, 10 aa, Artificial Sequence
  Description of Artificial Sequence: Synthetic peptide
  Seed: ALIFGTASYL (TYRP1_HUMAN)
ADIFGTASYV

SEQ ID NO: 170170 - protein, 9 aa, Artificial Sequence
  Description of Artificial Sequence: Synthetic peptide
  Seed: FSHEGPAFL (TYRP1_HUMAN)
FWHEGPAFF

SEQ ID NO: 170171 - protein, 9 aa, Artificial Sequence
  Description of Artificial Sequence: Synthetic peptide
  Seed: ENISIYNYF (TYRP1_HUMAN)
EAISIYNYY

SEQ ID NO: 170172 - protein, 9 aa, Artificial Sequence
  Description of Artificial Sequence: Synthetic peptide
  Seed: FVWTHYYSV (TYRP1_HUMAN)
FRWTHYYSY

SEQ ID NO: 170173 - protein, 10 aa, Artificial Sequence
  Description of Artificial Sequence: Synthetic peptide
  Seed: RVLIVRRNLL (TYRP1_HUMAN)
RSLIVRRNLA

SEQ ID NO: 170174 - protein, 10 aa, Artificial Sequence
  Description of Artificial Sequence: Synthetic peptide
  Seed: VGLFDTPPFY (TYRP1_HUMAN)
VVLFDTPPFK

SEQ ID NO: 170175 - protein, 9 aa, Artificial Sequence
  Description of Artificial Sequence: Synthetic peptide
  Seed: SMDEANQPL (TYRP1_HUMAN)
SRDEANQPM

SEQ ID NO: 170176 - protein, 10 aa, Artificial Sequence
  Description of Artificial Sequence: Synthetic peptide
  Seed: RTTHPLFVIA (TYRP1_HUMAN)
RYTHPLFVIK

SEQ ID NO: 170177 - protein, 9 aa, Artificial Sequence
  Description of Artificial Sequence: Synthetic peptide
  Seed: FSHEGPAFL (TYRP1_HUMAN)
FGHEGPAFY

SEQ ID NO: 170178 - protein, 9 aa, Artificial Sequence
  Description of Artificial Sequence: Synthetic peptide
  Seed: RQYNMVPFW (TYRP1_HUMAN)
RFYNMVPFW

SEQ ID NO: 170179 - protein, 9 aa, Artificial Sequence
  Description of Artificial Sequence: Synthetic peptide
  Seed: FLTWHRYHL (TYRP1_HUMAN)
FFTWHRYHY

SEQ ID NO: 170180 - protein, 10 aa, Artificial Sequence
  Description of Artificial Sequence: Synthetic peptide
  Seed: YNADISTFPL (TYRP1_HUMAN)
YHADISTFPV

SEQ ID NO: 170181 - protein, 10 aa, Artificial Sequence
  Description of Artificial Sequence: Synthetic peptide
  Seed: ISPNSVFSQW (TYRP1_HUMAN)
IPPNSVFSQW

SEQ ID NO: 170182 - protein, 9 aa, Artificial Sequence
  Description of Artificial Sequence: Synthetic peptide
  Seed: RFFNRTCHC (TYRP1_HUMAN)
RTFNRTCHF

SEQ ID NO: 170183 - protein, 9 aa, Artificial Sequence
  Description of Artificial Sequence: Synthetic peptide
  Seed: LLSLGCIFF (TYRP1_HUMAN)
LASLGCIFW

SEQ ID NO: 170184 - protein, 11 aa, Artificial Sequence
  Description of Artificial Sequence: Synthetic peptide
  Seed: FSHEGPAFLTW (TYRP1_HUMAN)
FQHEGPAFLTW

SEQ ID NO: 170185 - protein, 9 aa, Artificial Sequence
  Description of Artificial Sequence: Synthetic peptide
  Seed: AVVGALLLV (TYRP1_HUMAN)
ASVGALLLM

SEQ ID NO: 170186 - protein, 9 aa, Artificial Sequence
  Description of Artificial Sequence: Synthetic peptide
  Seed: RYHLLRLEK (TYRP1_HUMAN)
RSHLLRLEA

SEQ ID NO: 170187 - protein, 9 aa, Artificial Sequence
  Description of Artificial Sequence: Synthetic peptide
  Seed: VARPMVQRL (TYRP1_HUMAN)
VSRPMVQRL

SEQ ID NO: 170188 - protein, 10 aa, Artificial Sequence
  Description of Artificial Sequence: Synthetic peptide
  Seed: TFTDAVFDEW (TYRP1_HUMAN)
TYTDAVFDEF

SEQ ID NO: 170189 - protein, 11 aa, Artificial Sequence
  Description of Artificial Sequence: Synthetic peptide
  Seed: YQCYAEEYEKL (TYRP1_HUMAN)
YHCYAEEYEKF

SEQ ID NO: 170190 - protein, 9 aa, Artificial Sequence
  Description of Artificial Sequence: Synthetic peptide
  Seed: GPIRRNPAG (TYRP1_HUMAN)
GPIRRNPAI

SEQ ID NO: 170191 - protein, 10 aa, Artificial Sequence
  Description of Artificial Sequence: Synthetic peptide
  Seed: FTDAVFDEWL (TYRP1_HUMAN)
FMDAVFDEWV

SEQ ID NO: 170192 - protein, 11 aa, Artificial Sequence
  Description of Artificial Sequence: Synthetic peptide
  Seed: RRNPAGNVARP (TYRP1_HUMAN)
RRNPAGNVARF

SEQ ID NO: 170193 - protein, 9 aa, Artificial Sequence
  Description of Artificial Sequence: Synthetic peptide
  Seed: SFRNTVEGY (TYRP1_HUMAN)
SSRNTVEGF

SEQ ID NO: 170194 - protein, 9 aa, Artificial Sequence
  Description of Artificial Sequence: Synthetic peptide
  Seed: REFSVPEII (TYRP1_HUMAN)
RIFSVPEIY

SEQ ID NO: 170195 - protein, 10 aa, Artificial Sequence
  Description of Artificial Sequence: Synthetic peptide
  Seed: LSPNDPIFVL (TYRP1_HUMAN)
LAPNDPIFVW

SEQ ID NO: 170196 - protein, 9 aa, Artificial Sequence
  Description of Artificial Sequence: Synthetic peptide
  Seed: YTYEIQWPS (TYRP1_HUMAN)
YYYEIQWPA

SEQ ID NO: 170197 - protein, 10 aa, Artificial Sequence
  Description of Artificial Sequence: Synthetic peptide
  Seed: RRYNADISTF (TYRP1_HUMAN)
RLYNADISTY

SEQ ID NO: 170198 - protein, 9 aa, Artificial Sequence
  Description of Artificial Sequence: Synthetic peptide
  Seed: YYSVKKTFL (TYRP1_HUMAN)
YTSVKKTFM

SEQ ID NO: 170199 - protein, 10 aa, Artificial Sequence
  Description of Artificial Sequence: Synthetic peptide
  Seed: EMLQEPSFSL (TYRP1_HUMAN)
EYLQEPSFSV

SEQ ID NO: 170200 - protein, 10 aa, Artificial Sequence
  Description of Artificial Sequence: Synthetic peptide
  Seed: YTYEIQWPSR (TYRP1_HUMAN)
YGYEIQWPSR

SEQ ID NO: 170201 - protein, 9 aa, Artificial Sequence
  Description of Artificial Sequence: Synthetic peptide
  Seed: LQNPNQSVV (TYRP1_HUMAN)
LMNPNQSVF

SEQ ID NO: 170202 - protein, 9 aa, Artificial Sequence
  Description of Artificial Sequence: Synthetic peptide
  Seed: KLLSLGCIF (TYRP1_HUMAN)
KTLSLGCII

SEQ ID NO: 170203 - protein, 9 aa, Artificial Sequence
  Description of Artificial Sequence: Synthetic peptide
  Seed: RTTHPLFVI (TYRP1_HUMAN)
RQTHPLFVV

SEQ ID NO: 170204 - protein, 10 aa, Artificial Sequence
  Description of Artificial Sequence: Synthetic peptide
  Seed: FYSNSTNSFR (TYRP1_HUMAN)
FWSNSTNSFK

SEQ ID NO: 170205 - protein, 9 aa, Artificial Sequence
  Description of Artificial Sequence: Synthetic peptide
  Seed: KYDPAVRSL (TYRP1_HUMAN)
KDDPAVRSM

SEQ ID NO: 170206 - protein, 10 aa, Artificial Sequence
  Description of Artificial Sequence: Synthetic peptide
  Seed: YFVWTHYYSV (TYRP1_HUMAN)
YWVWTHYYSM

SEQ ID NO: 170207 - protein, 9 aa, Artificial Sequence
  Description of Artificial Sequence: Synthetic peptide
  Seed: AKRTTHPLF (TYRP1_HUMAN)
ASRTTHPLY

SEQ ID NO: 170208 - protein, 10 aa, Artificial Sequence
  Description of Artificial Sequence: Synthetic peptide
  Seed: LLLVALIFGT (TYRP1_HUMAN)
LSLVALIFGV

SEQ ID NO: 170209 - protein, 9 aa, Artificial Sequence
  Description of Artificial Sequence: Synthetic peptide
  Seed: MAKRTTHPL (TYRP1_HUMAN)
MQKRTTHPL

SEQ ID NO: 170210 - protein, 9 aa, Artificial Sequence
  Description of Artificial Sequence: Synthetic peptide
  Seed: RFFNRTCHC (TYRP1_HUMAN)
RIFNRTCHI

SEQ ID NO: 170211 - protein, 10 aa, Artificial Sequence
  Description of Artificial Sequence: Synthetic peptide
  Seed: YNMVPFWPPV (TYRP1_HUMAN)
YKMVPFWPPL

SEQ ID NO: 170212 - protein, 10 aa, Artificial Sequence
  Description of Artificial Sequence: Synthetic peptide
  Seed: ALIFGTASYL (TYRP1_HUMAN)
ALIFGTASYY

SEQ ID NO: 170213 - protein, 9 aa, Artificial Sequence
  Description of Artificial Sequence: Synthetic peptide
  Seed: YTYEIQWPS (TYRP1_HUMAN)
YTYEIQWPI

SEQ ID NO: 170214 - protein, 10 aa, Artificial Sequence
  Description of Artificial Sequence: Synthetic peptide
  Seed: NSFRNTVEGY (TYRP1_HUMAN)
NSFRNTVEGK

SEQ ID NO: 170215 - protein, 9 aa, Artificial Sequence
  Description of Artificial Sequence: Synthetic peptide
  Seed: RVLIVRRNL (TYRP1_HUMAN)
RALIVRRNY

SEQ ID NO: 170216 - protein, 10 aa, Artificial Sequence
  Description of Artificial Sequence: Synthetic peptide
  Seed: FWPPVTNTEM (TYRP1_HUMAN)
FNPPVTNTEL

SEQ ID NO: 170217 - protein, 9 aa, Artificial Sequence
  Description of Artificial Sequence: Synthetic peptide
  Seed: FLGVGQESF (TYRP1_HUMAN)
FIGVGQESF

SEQ ID NO: 170218 - protein, 9 aa, Artificial Sequence
  Description of Artificial Sequence: Synthetic peptide
  Seed: GYSDPTGKY (TYRP1_HUMAN)
GYSDPTGKL

SEQ ID NO: 170219 - protein, 9 aa, Artificial Sequence
  Description of Artificial Sequence: Synthetic peptide
  Seed: FSVPEIIAI (TYRP1_HUMAN)
FAVPEIIAF

SEQ ID NO: 170220 - protein, 9 aa, Artificial Sequence
  Description of Artificial Sequence: Synthetic peptide
  Seed: RSLHNLAHL (TYRP1_HUMAN)
RILHNLAHI

SEQ ID NO: 170221 - protein, 9 aa, Artificial Sequence
  Description of Artificial Sequence: Synthetic peptide
  Seed: ALIFGTASY (TYRP1_HUMAN)
AKIFGTASY

SEQ ID NO: 170222 - protein, 10 aa, Artificial Sequence
  Description of Artificial Sequence: Synthetic peptide
  Seed: AFLTWHRYHL (TYRP1_HUMAN)
AYLTWHRYHW

SEQ ID NO: 170223 - protein, 10 aa, Artificial Sequence
  Description of Artificial Sequence: Synthetic peptide
  Seed: RVVCDSLEDY (TYRP1_HUMAN)
RQVCDSLEDY

SEQ ID NO: 170224 - protein, 9 aa, Artificial Sequence
  Description of Artificial Sequence: Synthetic peptide
  Seed: GLFDTPPFY (TYRP1_HUMAN)
GLFDTPPFA

SEQ ID NO: 170225 - protein, 10 aa, Artificial Sequence
  Description of Artificial Sequence: Synthetic peptide
  Seed: GNVARPMVQR (TYRP1_HUMAN)
GLVARPMVQK

SEQ ID NO: 170226 - protein, 9 aa, Artificial Sequence
  Description of Artificial Sequence: Synthetic peptide
  Seed: IAIAVVGAL (TYRP1_HUMAN)
IVIAVVGAI

SEQ ID NO: 170227 - protein, 11 aa, Artificial Sequence
  Description of Artificial Sequence: Synthetic peptide
  Seed: YNYFVWTHYYS (TYRP1_HUMAN)
YNYFVWTHYYY

SEQ ID NO: 170228 - protein, 10 aa, Artificial Sequence
  Description of Artificial Sequence: Synthetic peptide
  Seed: YNYFVWTHYY (TYRP1_HUMAN)
YDYFVWTHYW

SEQ ID NO: 170229 - protein, 11 aa, Artificial Sequence
  Description of Artificial Sequence: Synthetic peptide
  Seed: SIYNYFVWTHY (TYRP1_HUMAN)
SQYNYFVWTHY

SEQ ID NO: 170230 - protein, 10 aa, Artificial Sequence
  Description of Artificial Sequence: Synthetic peptide
  Seed: SVPEIIAIAV (TYRP1_HUMAN)
SLPEIIAIAL

SEQ ID NO: 170231 - protein, 9 aa, Artificial Sequence
  Description of Artificial Sequence: Synthetic peptide
  Seed: FSVPEIIAI (TYRP1_HUMAN)
FQVPEIIAF

SEQ ID NO: 170232 - protein, 9 aa, Artificial Sequence
  Description of Artificial Sequence: Synthetic peptide
  Seed: LHTFTDAVF (TYRP1_HUMAN)
LMTFTDAVL

SEQ ID NO: 170233 - protein, 10 aa, Artificial Sequence
  Description of Artificial Sequence: Synthetic peptide
  Seed: LLLVALIFGT (TYRP1_HUMAN)
LWLVALIFGI

SEQ ID NO: 170234 - protein, 10 aa, Artificial Sequence
  Description of Artificial Sequence: Synthetic peptide
  Seed: WPLRFFNRTC (TYRP1_HUMAN)
WPLRFFNRTF

SEQ ID NO: 170235 - protein, 9 aa, Artificial Sequence
  Description of Artificial Sequence: Synthetic peptide
  Seed: MSAPKLLSL (TYRP1_HUMAN)
MDAPKLLSV

SEQ ID NO: 170236 - protein, 9 aa, Artificial Sequence
  Description of Artificial Sequence: Synthetic peptide
  Seed: MSAPKLLSL (TYRP1_HUMAN)
MLAPKLLSY

SEQ ID NO: 170237 - protein, 10 aa, Artificial Sequence
  Description of Artificial Sequence: Synthetic peptide
  Seed: FTDAVFDEWL (TYRP1_HUMAN)
FVDAVFDEWY

SEQ ID NO: 170238 - protein, 9 aa, Artificial Sequence
  Description of Artificial Sequence: Synthetic peptide
  Seed: ISIYNYFVW (TYRP1_HUMAN)
IQIYNYFVF

SEQ ID NO: 170239 - protein, 10 aa, Artificial Sequence
  Description of Artificial Sequence: Synthetic peptide
  Seed: RPMVQRLPEP (TYRP1_HUMAN)
RPMVQRLPEM

SEQ ID NO: 170240 - protein, 9 aa, Artificial Sequence
  Description of Artificial Sequence: Synthetic peptide
  Seed: TLISPNSVF (TYRP1_HUMAN)
TSISPNSVW

SEQ ID NO: 170241 - protein, 9 aa, Artificial Sequence
  Description of Artificial Sequence: Synthetic peptide
  Seed: FPRQCATVE (TYRP1_HUMAN)
FPRQCATVC

SEQ ID NO: 170242 - protein, 10 aa, Artificial Sequence
  Description of Artificial Sequence: Synthetic peptide
  Seed: ALIFGTASYL (TYRP1_HUMAN)
AQIFGTASYQ

SEQ ID NO: 170243 - protein, 8 aa, Artificial Sequence
  Description of Artificial Sequence: Synthetic peptide
  Seed: IFFPLLLF (TYRP1_HUMAN)
IYFPLLLF

SEQ ID NO: 170244 - protein, 9 aa, Artificial Sequence
  Description of Artificial Sequence: Synthetic peptide
  Seed: YLIRARRSM (TYRP1_HUMAN)
YQIRARRSI

SEQ ID NO: 170245 - protein, 10 aa, Artificial Sequence
  Description of Artificial Sequence: Synthetic peptide
  Seed: RSLHNLAHLF (TYRP1_HUMAN)
RFLHNLAHLM

SEQ ID NO: 170246 - protein, 9 aa, Artificial Sequence
  Description of Artificial Sequence: Synthetic peptide
  Seed: MDEANQPLL (TYRP1_HUMAN)
MAEANQPLI

SEQ ID NO: 170247 - protein, 10 aa, Artificial Sequence
  Description of Artificial Sequence: Synthetic peptide
  Seed: YNYFVWTHYY (TYRP1_HUMAN)
YQYFVWTHYM

SEQ ID NO: 170248 - protein, 10 aa, Artificial Sequence
  Description of Artificial Sequence: Synthetic peptide
  Seed: GSRSNFDSTL (TYRP1_HUMAN)
GMRSNFDSTK

SEQ ID NO: 170249 - protein, 9 aa, Artificial Sequence
  Description of Artificial Sequence: Synthetic peptide
  Seed: LFQQARAQF (TYRP1_HUMAN)
LIQQARAQF

SEQ ID NO: 170250 - protein, 9 aa, Artificial Sequence
  Description of Artificial Sequence: Synthetic peptide
  Seed: LLTDQYQCY (TYRP1_HUMAN)
LQTDQYQCF

SEQ ID NO: 170251 - protein, 10 aa, Artificial Sequence
  Description of Artificial Sequence: Synthetic peptide
  Seed: TAPDNLGYTY (TYRP1_HUMAN)
TYPDNLGYTF

SEQ ID NO: 170252 - protein, 9 aa, Artificial Sequence
  Description of Artificial Sequence: Synthetic peptide
  Seed: QEMLQEPSF (TYRP1_HUMAN)
QLMLQEPSY

SEQ ID NO: 170253 - protein, 9 aa, Artificial Sequence
  Description of Artificial Sequence: Synthetic peptide
  Seed: HPLFVIATR (TYRP1_HUMAN)
HGLFVIATR

SEQ ID NO: 170254 - protein, 9 aa, Artificial Sequence
  Description of Artificial Sequence: Synthetic peptide
  Seed: LHNLAHLFL (TYRP1_HUMAN)
LANLAHLFY

SEQ ID NO: 170255 - protein, 11 aa, Artificial Sequence
  Description of Artificial Sequence: Synthetic peptide
  Seed: QEMLQEPSFSL (TYRP1_HUMAN)
QLMLQEPSFSL

SEQ ID NO: 170256 - protein, 10 aa, Artificial Sequence
  Description of Artificial Sequence: Synthetic peptide
  Seed: YNADISTFPL (TYRP1_HUMAN)
YSADISTFPM

SEQ ID NO: 170257 - protein, 9 aa, Artificial Sequence
  Description of Artificial Sequence: Synthetic peptide
  Seed: AIAVVGALL (TYRP1_HUMAN)
AVAVVGALY

SEQ ID NO: 170258 - protein, 11 aa, Artificial Sequence
  Description of Artificial Sequence: Synthetic peptide
  Seed: RSLHNLAHLFL (TYRP1_HUMAN)
RTLHNLAHLFM

SEQ ID NO: 170259 - protein, 10 aa, Artificial Sequence
  Description of Artificial Sequence: Synthetic peptide
  Seed: ALIFGTASYL (TYRP1_HUMAN)
AVIFGTASYR

SEQ ID NO: 170260 - protein, 8 aa, Artificial Sequence
  Description of Artificial Sequence: Synthetic peptide
  Seed: RQYNMVPF (TYRP1_HUMAN)
RRYNMVPM

SEQ ID NO: 170261 - protein, 10 aa, Artificial Sequence
  Description of Artificial Sequence: Synthetic peptide
  Seed: LPYWNFATGK (TYRP1_HUMAN)
LVYWNFATGR

SEQ ID NO: 170262 - protein, 8 aa, Artificial Sequence
  Description of Artificial Sequence: Synthetic peptide
  Seed: SIYNYFVW (TYRP1_HUMAN)
STYNYFVF

SEQ ID NO: 170263 - protein, 9 aa, Artificial Sequence
  Description of Artificial Sequence: Synthetic peptide
  Seed: SMDEANQPL (TYRP1_HUMAN)
SVDEANQPV

SEQ ID NO: 170264 - protein, 9 aa, Artificial Sequence
  Description of Artificial Sequence: Synthetic peptide
  Seed: KLQNPNQSV (TYRP1_HUMAN)
KSQNPNQSY

SEQ ID NO: 170265 - protein, 9 aa, Artificial Sequence
  Description of Artificial Sequence: Synthetic peptide
  Seed: LGCIFFPLL (TYRP1_HUMAN)
LACIFFPLW

SEQ ID NO: 170266 - protein, 9 aa, Artificial Sequence
  Description of Artificial Sequence: Synthetic peptide
  Seed: HEGPAFLTW (TYRP1_HUMAN)
HGGPAFLTM

SEQ ID NO: 170267 - protein, 9 aa, Artificial Sequence
  Description of Artificial Sequence: Synthetic peptide
  Seed: YTYEIQWPS (TYRP1_HUMAN)
YMYEIQWPH

SEQ ID NO: 170268 - protein, 9 aa, Artificial Sequence
  Description of Artificial Sequence: Synthetic peptide
  Seed: RQYNMVPFW (TYRP1_HUMAN)
RYYNMVPFF

SEQ ID NO: 170269 - protein, 9 aa, Artificial Sequence
  Description of Artificial Sequence: Synthetic peptide
  Seed: FSVPEIIAI (TYRP1_HUMAN)
FCVPEIIAL

SEQ ID NO: 170270 - protein, 9 aa, Artificial Sequence
  Description of Artificial Sequence: Synthetic peptide
  Seed: LLVALIFGT (TYRP1_HUMAN)
LMVALIFGT

SEQ ID NO: 170271 - protein, 11 aa, Artificial Sequence
  Description of Artificial Sequence: Synthetic peptide
  Seed: ALIFGTASYLI (TYRP1_HUMAN)
AFIFGTASYLV

SEQ ID NO: 170272 - protein, 10 aa, Artificial Sequence
  Description of Artificial Sequence: Synthetic peptide
  Seed: LLFQQARAQF (TYRP1_HUMAN)
LMFQQARAQM

SEQ ID NO: 170273 - protein, 10 aa, Artificial Sequence
  Description of Artificial Sequence: Synthetic peptide
  Seed: NSFRNTVEGY (TYRP1_HUMAN)
NTFRNTVEGR

SEQ ID NO: 170274 - protein, 9 aa, Artificial Sequence
  Description of Artificial Sequence: Synthetic peptide
  Seed: AIAVVGALL (TYRP1_HUMAN)
AQAVVGALI

SEQ ID NO: 170275 - protein, 9 aa, Artificial Sequence
  Description of Artificial Sequence: Synthetic peptide
  Seed: YYSVKKTFL (TYRP1_HUMAN)
YWSVKKTFF

SEQ ID NO: 170276 - protein, 10 aa, Artificial Sequence
  Description of Artificial Sequence: Synthetic peptide
  Seed: HPLFVIATRR (TYRP1_HUMAN)
HTLFVIATRH

SEQ ID NO: 170277 - protein, 10 aa, Artificial Sequence
  Description of Artificial Sequence: Synthetic peptide
  Seed: RSLHNLAHLF (TYRP1_HUMAN)
RGLHNLAHLW

SEQ ID NO: 170278 - protein, 9 aa, Artificial Sequence
  Description of Artificial Sequence: Synthetic peptide
  Seed: RQYNMVPFW (TYRP1_HUMAN)
RRYNMVPFC

SEQ ID NO: 170279 - protein, 9 aa, Artificial Sequence
  Description of Artificial Sequence: Synthetic peptide
  Seed: IIAIAVVGA (TYRP1_HUMAN)
ILAIAVVGV

SEQ ID NO: 170280 - protein, 9 aa, Artificial Sequence
  Description of Artificial Sequence: Synthetic peptide
  Seed: DSRPHSPQY (TYRP1_HUMAN)
DVRPHSPQR

SEQ ID NO: 170281 - protein, 9 aa, Artificial Sequence
  Description of Artificial Sequence: Synthetic peptide
  Seed: LGCIFFPLL (TYRP1_HUMAN)
LMCIFFPLM

SEQ ID NO: 170282 - protein, 9 aa, Artificial Sequence
  Description of Artificial Sequence: Synthetic peptide
  Seed: SKEEKNHFV (TYRP1_HUMAN)
SFEEKNHFL

SEQ ID NO: 170283 - protein, 9 aa, Artificial Sequence
  Description of Artificial Sequence: Synthetic peptide
  Seed: YSNSTNSFR (TYRP1_HUMAN)
YVNSTNSFY

SEQ ID NO: 170284 - protein, 9 aa, Artificial Sequence
  Description of Artificial Sequence: Synthetic peptide
  Seed: STLISPNSV (TYRP1_HUMAN)
SALISPNSM

SEQ ID NO: 170285 - protein, 9 aa, Artificial Sequence
  Description of Artificial Sequence: Synthetic peptide
  Seed: DAVFDEWLR (TYRP1_HUMAN)
DTVFDEWLR

SEQ ID NO: 170286 - protein, 10 aa, Artificial Sequence
  Description of Artificial Sequence: Synthetic peptide
  Seed: RSMDEANQPL (TYRP1_HUMAN)
RTMDEANQPL

SEQ ID NO: 170287 - protein, 9 aa, Artificial Sequence
  Description of Artificial Sequence: Synthetic peptide
  Seed: FSHEGPAFL (TYRP1_HUMAN)
FPHEGPAFW

SEQ ID NO: 170288 - protein, 10 aa, Artificial Sequence
  Description of Artificial Sequence: Synthetic peptide
  Seed: DVAQCLEVGL (TYRP1_HUMAN)
DVAQCLEVGK

SEQ ID NO: 170289 - protein, 11 aa, Artificial Sequence
  Description of Artificial Sequence: Synthetic peptide
  Seed: REFSVPEIIAI (TYRP1_HUMAN)
RTFSVPEIIAF

SEQ ID NO: 170290 - protein, 9 aa, Artificial Sequence
  Description of Artificial Sequence: Synthetic peptide
  Seed: ENAPIGHNR (TYRP1_HUMAN)
EAAPIGHNF

SEQ ID NO: 170291 - protein, 9 aa, Artificial Sequence
  Description of Artificial Sequence: Synthetic peptide
  Seed: LVALIFGTA (TYRP1_HUMAN)
LAALIFGTV

SEQ ID NO: 170292 - protein, 9 aa, Artificial Sequence
  Description of Artificial Sequence: Synthetic peptide
  Seed: SLGCIFFPL (TYRP1_HUMAN)
SVGCIFFPV

SEQ ID NO: 170293 - protein, 10 aa, Artificial Sequence
  Description of Artificial Sequence: Synthetic peptide
  Seed: EFSVPEIIAI (TYRP1_HUMAN)
EVSVPEIIAV

SEQ ID NO: 170294 - protein, 10 aa, Artificial Sequence
  Description of Artificial Sequence: Synthetic peptide
  Seed: YFVWTHYYSV (TYRP1_HUMAN)
YFVWTHYYSF

SEQ ID NO: 170295 - protein, 10 aa, Artificial Sequence
  Description of Artificial Sequence: Synthetic peptide
  Seed: FYSNSTNSFR (TYRP1_HUMAN)
FRSNSTNSFR

SEQ ID NO: 170296 - protein, 9 aa, Artificial Sequence
  Description of Artificial Sequence: Synthetic peptide
  Seed: RARRSMDEA (TYRP1_HUMAN)
RYRRSMDEA

SEQ ID NO: 170297 - protein, 9 aa, Artificial Sequence
  Description of Artificial Sequence: Synthetic peptide
  Seed: MSAPKLLSL (TYRP1_HUMAN)
MQAPKLLSH

SEQ ID NO: 170298 - protein, 9 aa, Artificial Sequence
  Description of Artificial Sequence: Synthetic peptide
  Seed: KYDPAVRSL (TYRP1_HUMAN)
KEDPAVRSV

SEQ ID NO: 170299 - protein, 9 aa, Artificial Sequence
  Description of Artificial Sequence: Synthetic peptide
  Seed: FSHEGPAFL (TYRP1_HUMAN)
FAHEGPAFK

SEQ ID NO: 170300 - protein, 11 aa, Artificial Sequence
  Description of Artificial Sequence: Synthetic peptide
  Seed: IYNYFVWTHYY (TYRP1_HUMAN)
ILNYFVWTHYF

SEQ ID NO: 170301 - protein, 9 aa, Artificial Sequence
  Description of Artificial Sequence: Synthetic peptide
  Seed: FSHEGPAFL (TYRP1_HUMAN)
FAHEGPAFY

SEQ ID NO: 170302 - protein, 9 aa, Artificial Sequence
  Description of Artificial Sequence: Synthetic peptide
  Seed: SVKKTFLGV (TYRP1_HUMAN)
SMKKTFLGR

SEQ ID NO: 170303 - protein, 11 aa, Artificial Sequence
  Description of Artificial Sequence: Synthetic peptide
  Seed: IYNYFVWTHYY (TYRP1_HUMAN)
ICNYFVWTHYF

SEQ ID NO: 170304 - protein, 9 aa, Artificial Sequence
  Description of Artificial Sequence: Synthetic peptide
  Seed: RYHLLRLEK (TYRP1_HUMAN)
RSHLLRLEY

SEQ ID NO: 170305 - protein, 9 aa, Artificial Sequence
  Description of Artificial Sequence: Synthetic peptide
  Seed: NYFVWTHYY (TYRP1_HUMAN)
NVFVWTHYY

SEQ ID NO: 170306 - protein, 9 aa, Artificial Sequence
  Description of Artificial Sequence: Synthetic peptide
  Seed: STNSFRNTV (TYRP1_HUMAN)
SQNSFRNTL

SEQ ID NO: 170307 - protein, 9 aa, Artificial Sequence
  Description of Artificial Sequence: Synthetic peptide
  Seed: FVWTHYYSV (TYRP1_HUMAN)
FAWTHYYSK

SEQ ID NO: 170308 - protein, 10 aa, Artificial Sequence
  Description of Artificial Sequence: Synthetic peptide
  Seed: MAKRTTHPLF (TYRP1_HUMAN)
MPKRTTHPLS

SEQ ID NO: 170309 - protein, 9 aa, Artificial Sequence
  Description of Artificial Sequence: Synthetic peptide
  Seed: FVWTHYYSV (TYRP1_HUMAN)
FIWTHYYSY

SEQ ID NO: 170310 - protein, 9 aa, Artificial Sequence
  Description of Artificial Sequence: Synthetic peptide
  Seed: RSLHNLAHL (TYRP1_HUMAN)
RQLHNLAHA

SEQ ID NO: 170311 - protein, 8 aa, Artificial Sequence
  Description of Artificial Sequence: Synthetic peptide
  Seed: IFFPLLLF (TYRP1_HUMAN)
ITFPLLLY

SEQ ID NO: 170312 - protein, 9 aa, Artificial Sequence
  Description of Artificial Sequence: Synthetic peptide
  Seed: TNTEMFVTA (TYRP1_HUMAN)
THTEMFVTL

SEQ ID NO: 170313 - protein, 10 aa, Artificial Sequence
  Description of Artificial Sequence: Synthetic peptide
  Seed: ISPNSVFSQW (TYRP1_HUMAN)
ISPNSVFSQF

SEQ ID NO: 170314 - protein, 10 aa, Artificial Sequence
  Description of Artificial Sequence: Synthetic peptide
  Seed: YNYFVWTHYY (TYRP1_HUMAN)
YEYFVWTHYW

SEQ ID NO: 170315 - protein, 9 aa, Artificial Sequence
  Description of Artificial Sequence: Synthetic peptide
  Seed: MSAPKLLSL (TYRP1_HUMAN)
MAAPKLLSY

SEQ ID NO: 170316 - protein, 9 aa, Artificial Sequence
  Description of Artificial Sequence: Synthetic peptide
  Seed: RVLIVRRNL (TYRP1_HUMAN)
RSLIVRRNF

SEQ ID NO: 170317 - protein, 10 aa, Artificial Sequence
  Description of Artificial Sequence: Synthetic peptide
  Seed: YNYFVWTHYY (TYRP1_HUMAN)
YPYFVWTHYW

SEQ ID NO: 170318 - protein, 9 aa, Artificial Sequence
  Description of Artificial Sequence: Synthetic peptide
  Seed: EEYEKLQNP (TYRP1_HUMAN)
EEYEKLQNT

SEQ ID NO: 170319 - protein, 9 aa, Artificial Sequence
  Description of Artificial Sequence: Synthetic peptide
  Seed: FYSNSTNSF (TYRP1_HUMAN)
FISNSTNSF

SEQ ID NO: 170320 - protein, 10 aa, Artificial Sequence
  Description of Artificial Sequence: Synthetic peptide
  Seed: FSLPYWNFAT (TYRP1_HUMAN)
FTLPYWNFAV

SEQ ID NO: 170321 - protein, 9 aa, Artificial Sequence
  Description of Artificial Sequence: Synthetic peptide
  Seed: ALIFGTASY (TYRP1_HUMAN)
AFIFGTASY

SEQ ID NO: 170322 - protein, 9 aa, Artificial Sequence
  Description of Artificial Sequence: Synthetic peptide
  Seed: FSVPEIIAI (TYRP1_HUMAN)
FFVPEIIAL

SEQ ID NO: 170323 - protein, 9 aa, Artificial Sequence
  Description of Artificial Sequence: Synthetic peptide
  Seed: RGRCEAVTA (TYRP1_HUMAN)
RSRCEAVTS

SEQ ID NO: 170324 - protein, 10 aa, Artificial Sequence
  Description of Artificial Sequence: Synthetic peptide
  Seed: STLISPNSVF (TYRP1_HUMAN)
SCLISPNSVF

SEQ ID NO: 170325 - protein, 10 aa, Artificial Sequence
  Description of Artificial Sequence: Synthetic peptide
  Seed: STLISPNSVF (TYRP1_HUMAN)
SFLISPNSVF

SEQ ID NO: 170326 - protein, 9 aa, Artificial Sequence
  Description of Artificial Sequence: Synthetic peptide
  Seed: LSPNDPIFV (TYRP1_HUMAN)
LAPNDPIFL

SEQ ID NO: 170327 - protein, 11 aa, Artificial Sequence
  Description of Artificial Sequence: Synthetic peptide
  Seed: EILGPDGNTPQ (TYRP1_HUMAN)
ETLGPDGNTPR

SEQ ID NO: 170328 - protein, 9 aa, Artificial Sequence
  Description of Artificial Sequence: Synthetic peptide
  Seed: WHRYHLLRL (TYRP1_HUMAN)
WQRYHLLRM

SEQ ID NO: 170329 - protein, 9 aa, Artificial Sequence
  Description of Artificial Sequence: Synthetic peptide
  Seed: LPYWNFATG (TYRP1_HUMAN)
LIYWNFATF

SEQ ID NO: 170330 - protein, 9 aa, Artificial Sequence
  Description of Artificial Sequence: Synthetic peptide
  Seed: NADISTFPL (TYRP1_HUMAN)
NRDISTFPV

SEQ ID NO: 170331 - protein, 9 aa, Artificial Sequence
  Description of Artificial Sequence: Synthetic peptide
  Seed: IAVVGALLL (TYRP1_HUMAN)
IIVVGALLY

SEQ ID NO: 170332 - protein, 9 aa, Artificial Sequence
  Description of Artificial Sequence: Synthetic peptide
  Seed: SMDEANQPL (TYRP1_HUMAN)
SFDEANQPY

SEQ ID NO: 170333 - protein, 10 aa, Artificial Sequence
  Description of Artificial Sequence: Synthetic peptide
  Seed: YNADISTFPL (TYRP1_HUMAN)
YGADISTFPV

SEQ ID NO: 170334 - protein, 9 aa, Artificial Sequence
  Description of Artificial Sequence: Synthetic peptide
  Seed: LTDQYQCYA (TYRP1_HUMAN)
LVDQYQCYI

SEQ ID NO: 170335 - protein, 9 aa, Artificial Sequence
  Description of Artificial Sequence: Synthetic peptide
  Seed: NYFVWTHYY (TYRP1_HUMAN)
NWFVWTHYM

SEQ ID NO: 170336 - protein, 10 aa, Artificial Sequence
  Description of Artificial Sequence: Synthetic peptide
  Seed: WPPVTNTEMF (TYRP1_HUMAN)
WYPVTNTEMW

SEQ ID NO: 170337 - protein, 11 aa, Artificial Sequence
  Description of Artificial Sequence: Synthetic peptide
  Seed: RSMDEANQPLL (TYRP1_HUMAN)
RMMDEANQPLY

SEQ ID NO: 170338 - protein, 10 aa, Artificial Sequence
  Description of Artificial Sequence: Synthetic peptide
  Seed: GPAFLTWHRY (TYRP1_HUMAN)
GLAFLTWHRY

SEQ ID NO: 170339 - protein, 9 aa, Artificial Sequence
  Description of Artificial Sequence: Synthetic peptide
  Seed: WTHYYSVKK (TYRP1_HUMAN)
WFHYYSVKR

SEQ ID NO: 170340 - protein, 9 aa, Artificial Sequence
  Description of Artificial Sequence: Synthetic peptide
  Seed: AVFDEWLRR (TYRP1_HUMAN)
AMFDEWLRF

SEQ ID NO: 170341 - protein, 10 aa, Artificial Sequence
  Description of Artificial Sequence: Synthetic peptide
  Seed: TDAVFDEWLR (TYRP1_HUMAN)
TFAVFDEWLK

SEQ ID NO: 170342 - protein, 9 aa, Artificial Sequence
  Description of Artificial Sequence: Synthetic peptide
  Seed: TEMFVTAPD (TYRP1_HUMAN)
TEMFVTAPY

SEQ ID NO: 170343 - protein, 8 aa, Artificial Sequence
  Description of Artificial Sequence: Synthetic peptide
  Seed: YSNSTNSF (TYRP1_HUMAN)
YSNSTNSY

SEQ ID NO: 170344 - protein, 10 aa, Artificial Sequence
  Description of Artificial Sequence: Synthetic peptide
  Seed: TASYLIRARR (TYRP1_HUMAN)
TQSYLIRARR

SEQ ID NO: 170345 - protein, 9 aa, Artificial Sequence
  Description of Artificial Sequence: Synthetic peptide
  Seed: HRYHLLRLE (TYRP1_HUMAN)
HRYHLLRLY

SEQ ID NO: 170346 - protein, 10 aa, Artificial Sequence
  Description of Artificial Sequence: Synthetic peptide
  Seed: FVTAPDNLGY (TYRP1_HUMAN)
FLTAPDNLGW

SEQ ID NO: 170347 - protein, 9 aa, Artificial Sequence
  Description of Artificial Sequence: Synthetic peptide
  Seed: IYNYFVWTH (TYRP1_HUMAN)
ITNYFVWTR

SEQ ID NO: 170348 - protein, 10 aa, Artificial Sequence
  Description of Artificial Sequence: Synthetic peptide
  Seed: YNADISTFPL (TYRP1_HUMAN)
YMADISTFPA

SEQ ID NO: 170349 - protein, 9 aa, Artificial Sequence
  Description of Artificial Sequence: Synthetic peptide
  Seed: MDEANQPLL (TYRP1_HUMAN)
MLEANQPLL

SEQ ID NO: 170350 - protein, 9 aa, Artificial Sequence
  Description of Artificial Sequence: Synthetic peptide
  Seed: WPLRFFNRT (TYRP1_HUMAN)
WPLRFFNRV

SEQ ID NO: 170351 - protein, 8 aa, Artificial Sequence
  Description of Artificial Sequence: Synthetic peptide
  Seed: YSDPTGKY (TYRP1_HUMAN)
YADPTGKL

SEQ ID NO: 170352 - protein, 11 aa, Artificial Sequence
  Description of Artificial Sequence: Synthetic peptide
  Seed: RRSMDEANQPL (TYRP1_HUMAN)
RNSMDEANQPV

SEQ ID NO: 170353 - protein, 10 aa, Artificial Sequence
  Description of Artificial Sequence: Synthetic peptide
  Seed: NMVPFWPPVT (TYRP1_HUMAN)
NIVPFWPPVV

SEQ ID NO: 170354 - protein, 9 aa, Artificial Sequence
  Description of Artificial Sequence: Synthetic peptide
  Seed: RARRSMDEA (TYRP1_HUMAN)
RSRRSMDEI

SEQ ID NO: 170355 - protein, 10 aa, Artificial Sequence
  Description of Artificial Sequence: Synthetic peptide
  Seed: FWPPVTNTEM (TYRP1_HUMAN)
FMPPVTNTEY

SEQ ID NO: 170356 - protein, 9 aa, Artificial Sequence
  Description of Artificial Sequence: Synthetic peptide
  Seed: KLLSLGCIF (TYRP1_HUMAN)
KMLSLGCIM

SEQ ID NO: 170357 - protein, 11 aa, Artificial Sequence
  Description of Artificial Sequence: Synthetic peptide
  Seed: FLTWHRYHLLR (TYRP1_HUMAN)
FMTWHRYHLLR

SEQ ID NO: 170358 - protein, 10 aa, Artificial Sequence
  Description of Artificial Sequence: Synthetic peptide
  Seed: GKYDPAVRSL (TYRP1_HUMAN)
GVYDPAVRSF

SEQ ID NO: 170359 - protein, 10 aa, Artificial Sequence
  Description of Artificial Sequence: Synthetic peptide
  Seed: RSLHNLAHLF (TYRP1_HUMAN)
RILHNLAHLY

SEQ ID NO: 170360 - protein, 10 aa, Artificial Sequence
  Description of Artificial Sequence: Synthetic peptide
  Seed: STLISPNSVF (TYRP1_HUMAN)
SSLISPNSVW

SEQ ID NO: 170361 - protein, 9 aa, Artificial Sequence
  Description of Artificial Sequence: Synthetic peptide
  Seed: LQNPNQSVV (TYRP1_HUMAN)
LINPNQSVL

SEQ ID NO: 170362 - protein, 9 aa, Artificial Sequence
  Description of Artificial Sequence: Synthetic peptide
  Seed: NYFVWTHYY (TYRP1_HUMAN)
NIFVWTHYF

SEQ ID NO: 170363 - protein, 10 aa, Artificial Sequence
  Description of Artificial Sequence: Synthetic peptide
  Seed: NYFVWTHYYS (TYRP1_HUMAN)
NFFVWTHYYP

SEQ ID NO: 170364 - protein, 10 aa, Artificial Sequence
  Description of Artificial Sequence: Synthetic peptide
  Seed: SPNSVFSQWR (TYRP1_HUMAN)
SINSVFSQWR

SEQ ID NO: 170365 - protein, 11 aa, Artificial Sequence
  Description of Artificial Sequence: Synthetic peptide
  Seed: REFSVPEIIAI (TYRP1_HUMAN)
RSFSVPEIIAW

SEQ ID NO: 170366 - protein, 11 aa, Artificial Sequence
  Description of Artificial Sequence: Synthetic peptide
  Seed: YNYFVWTHYYS (TYRP1_HUMAN)
YFYFVWTHYYC

SEQ ID NO: 170367 - protein, 10 aa, Artificial Sequence
  Description of Artificial Sequence: Synthetic peptide
  Seed: IAIAVVGALL (TYRP1_HUMAN)
ILIAVVGALI

SEQ ID NO: 170368 - protein, 9 aa, Artificial Sequence
  Description of Artificial Sequence: Synthetic peptide
  Seed: TAPDNLGYT (TYRP1_HUMAN)
TMPDNLGYM

SEQ ID NO: 170369 - protein, 10 aa, Artificial Sequence
  Description of Artificial Sequence: Synthetic peptide
  Seed: FWPPVTNTEM (TYRP1_HUMAN)
FYPPVTNTEW

SEQ ID NO: 170370 - protein, 9 aa, Artificial Sequence
  Description of Artificial Sequence: Synthetic peptide
  Seed: VPFWPPVTN (TYRP1_HUMAN)
VVFWPPVTY

SEQ ID NO: 170371 - protein, 9 aa, Artificial Sequence
  Description of Artificial Sequence: Synthetic peptide
  Seed: VGLFDTPPF (TYRP1_HUMAN)
VSLFDTPPI

SEQ ID NO: 170372 - protein, 9 aa, Artificial Sequence
  Description of Artificial Sequence: Synthetic peptide
  Seed: SPNDPIFVL (TYRP1_HUMAN)
SSNDPIFVV

SEQ ID NO: 170373 - protein, 10 aa, Artificial Sequence
  Description of Artificial Sequence: Synthetic peptide
  Seed: GSRSNFDSTL (TYRP1_HUMAN)
GTRSNFDSTK

SEQ ID NO: 170374 - protein, 9 aa, Artificial Sequence
  Description of Artificial Sequence: Synthetic peptide
  Seed: IAVVGALLL (TYRP1_HUMAN)
IHVVGALLY

SEQ ID NO: 170375 - protein, 9 aa, Artificial Sequence
  Description of Artificial Sequence: Synthetic peptide
  Seed: QEMLQEPSF (TYRP1_HUMAN)
QEMLQEPSP

SEQ ID NO: 170376 - protein, 10 aa, Artificial Sequence
  Description of Artificial Sequence: Synthetic peptide
  Seed: MSAPKLLSLG (TYRP1_HUMAN)
MPAPKLLSLW

SEQ ID NO: 170377 - protein, 9 aa, Artificial Sequence
  Description of Artificial Sequence: Synthetic peptide
  Seed: ATRRSEEIL (TYRP1_HUMAN)
ATRRSEEIF

SEQ ID NO: 170378 - protein, 10 aa, Artificial Sequence
  Description of Artificial Sequence: Synthetic peptide
  Seed: RRYNADISTF (TYRP1_HUMAN)
RLYNADISTF

SEQ ID NO: 170379 - protein, 8 aa, Artificial Sequence
  Description of Artificial Sequence: Synthetic peptide
  Seed: FSHEGPAF (TYRP1_HUMAN)
FGHEGPAY

SEQ ID NO: 170380 - protein, 9 aa, Artificial Sequence
  Description of Artificial Sequence: Synthetic peptide
  Seed: VGQESFGEV (TYRP1_HUMAN)
VAQESFGEY

SEQ ID NO: 170381 - protein, 10 aa, Artificial Sequence
  Description of Artificial Sequence: Synthetic peptide
  Seed: AVFDEWLRRY (TYRP1_HUMAN)
ALFDEWLRRK

SEQ ID NO: 170382 - protein, 9 aa, Artificial Sequence
  Description of Artificial Sequence: Synthetic peptide
  Seed: NMVPFWPPV (TYRP1_HUMAN)
NSVPFWPPI

SEQ ID NO: 170383 - protein, 10 aa, Artificial Sequence
  Description of Artificial Sequence: Synthetic peptide
  Seed: SIYNYFVWTH (TYRP1_HUMAN)
SDYNYFVWTR

SEQ ID NO: 170384 - protein, 10 aa, Artificial Sequence
  Description of Artificial Sequence: Synthetic peptide
  Seed: ALIFGTASYL (TYRP1_HUMAN)
AAIFGTASYY

SEQ ID NO: 170385 - protein, 9 aa, Artificial Sequence
  Description of Artificial Sequence: Synthetic peptide
  Seed: RQCATVEAL (TYRP1_HUMAN)
RKCATVEAF

SEQ ID NO: 170386 - protein, 9 aa, Artificial Sequence
  Description of Artificial Sequence: Synthetic peptide
  Seed: SMDEANQPL (TYRP1_HUMAN)
SWDEANQPV

SEQ ID NO: 170387 - protein, 11 aa, Artificial Sequence
  Description of Artificial Sequence: Synthetic peptide
  Seed: RSMDEANQPLL (TYRP1_HUMAN)
RLMDEANQPLI

SEQ ID NO: 170388 - protein, 10 aa, Artificial Sequence
  Description of Artificial Sequence: Synthetic peptide
  Seed: TPQFENISIY (TYRP1_HUMAN)
TTQFENISIY

SEQ ID NO: 170389 - protein, 9 aa, Artificial Sequence
  Description of Artificial Sequence: Synthetic peptide
  Seed: QQARAQFPR (TYRP1_HUMAN)
QAARAQFPR

SEQ ID NO: 170390 - protein, 10 aa, Artificial Sequence
  Description of Artificial Sequence: Synthetic peptide
  Seed: FSLPYWNFAT (TYRP1_HUMAN)
FMLPYWNFAI

SEQ ID NO: 170391 - protein, 9 aa, Artificial Sequence
  Description of Artificial Sequence: Synthetic peptide
  Seed: QESFGEVDF (TYRP1_HUMAN)
QESFGEVDL

SEQ ID NO: 170392 - protein, 10 aa, Artificial Sequence
  Description of Artificial Sequence: Synthetic peptide
  Seed: HRYHLLRLEK (TYRP1_HUMAN)
HVYHLLRLER

SEQ ID NO: 170393 - protein, 9 aa, Artificial Sequence
  Description of Artificial Sequence: Synthetic peptide
  Seed: NMVPFWPPV (TYRP1_HUMAN)
NVVPFWPPV

SEQ ID NO: 170394 - protein, 9 aa, Artificial Sequence
  Description of Artificial Sequence: Synthetic peptide
  Seed: RVLIVRRNL (TYRP1_HUMAN)
RILIVRRNF

SEQ ID NO: 170395 - protein, 9 aa, Artificial Sequence
  Description of Artificial Sequence: Synthetic peptide
  Seed: RSLHNLAHL (TYRP1_HUMAN)
RLLHNLAHV

SEQ ID NO: 170396 - protein, 10 aa, Artificial Sequence
  Description of Artificial Sequence: Synthetic peptide
  Seed: SMDEANQPLL (TYRP1_HUMAN)
SIDEANQPLI

SEQ ID NO: 170397 - protein, 8 aa, Artificial Sequence
  Description of Artificial Sequence: Synthetic peptide
  Seed: YSDPTGKY (TYRP1_HUMAN)
YGDPTGKV

SEQ ID NO: 170398 - protein, 10 aa, Artificial Sequence
  Description of Artificial Sequence: Synthetic peptide
  Seed: YNYFVWTHYY (TYRP1_HUMAN)
YMYFVWTHYK

SEQ ID NO: 170399 - protein, 9 aa, Artificial Sequence
  Description of Artificial Sequence: Synthetic peptide
  Seed: AACDQRVLI (TYRP1_HUMAN)
AQCDQRVLF

SEQ ID NO: 170400 - protein, 9 aa, Artificial Sequence
  Description of Artificial Sequence: Synthetic peptide
  Seed: IAIAVVGAL (TYRP1_HUMAN)
IAIAVVGAI

SEQ ID NO: 170401 - protein, 9 aa, Artificial Sequence
  Description of Artificial Sequence: Synthetic peptide
  Seed: AQFPRQCAT (TYRP1_HUMAN)
ATFPRQCAY

SEQ ID NO: 170402 - protein, 9 aa, Artificial Sequence
  Description of Artificial Sequence: Synthetic peptide
  Seed: SRSNFDSTL (TYRP1_HUMAN)
SQSNFDSTH

SEQ ID NO: 170403 - protein, 9 aa, Artificial Sequence
  Description of Artificial Sequence: Synthetic peptide
  Seed: APIGHNRQY (TYRP1_HUMAN)
AIIGHNRQF

SEQ ID NO: 170404 - protein, 9 aa, Artificial Sequence
  Description of Artificial Sequence: Synthetic peptide
  Seed: VARPMVQRL (TYRP1_HUMAN)
VQRPMVQRI

SEQ ID NO: 170405 - protein, 10 aa, Artificial Sequence
  Description of Artificial Sequence: Synthetic peptide
  Seed: YNMVPFWPPV (TYRP1_HUMAN)
YMMVPFWPPT

SEQ ID NO: 170406 - protein, 9 aa, Artificial Sequence
  Description of Artificial Sequence: Synthetic peptide
  Seed: RYHLLRLEK (TYRP1_HUMAN)
RVHLLRLES

SEQ ID NO: 170407 - protein, 10 aa, Artificial Sequence
  Description of Artificial Sequence: Synthetic peptide
  Seed: LIFGTASYLI (TYRP1_HUMAN)
LIFGTASYLL

SEQ ID NO: 170408 - protein, 10 aa, Artificial Sequence
  Description of Artificial Sequence: Synthetic peptide
  Seed: VLLHTFTDAV (TYRP1_HUMAN)
VNLHTFTDAV

SEQ ID NO: 170409 - protein, 9 aa, Artificial Sequence
  Description of Artificial Sequence: Synthetic peptide
  Seed: FTDAVFDEW (TYRP1_HUMAN)
FGDAVFDEI

SEQ ID NO: 170410 - protein, 9 aa, Artificial Sequence
  Description of Artificial Sequence: Synthetic peptide
  Seed: ISIYNYFVW (TYRP1_HUMAN)
IMIYNYFVW

SEQ ID NO: 170411 - protein, 9 aa, Artificial Sequence
  Description of Artificial Sequence: Synthetic peptide
  Seed: QEPSFSLPY (TYRP1_HUMAN)
QKPSFSLPY

SEQ ID NO: 170412 - protein, 9 aa, Artificial Sequence
  Description of Artificial Sequence: Synthetic peptide
  Seed: MLQEPSFSL (TYRP1_HUMAN)
MRQEPSFSV

SEQ ID NO: 170413 - protein, 10 aa, Artificial Sequence
  Description of Artificial Sequence: Synthetic peptide
  Seed: FVWTHYYSVK (TYRP1_HUMAN)
FIWTHYYSVS

SEQ ID NO: 170414 - protein, 10 aa, Artificial Sequence
  Description of Artificial Sequence: Synthetic peptide
  Seed: YFVWTHYYSV (TYRP1_HUMAN)
YNVWTHYYSL

SEQ ID NO: 170415 - protein, 10 aa, Artificial Sequence
  Description of Artificial Sequence: Synthetic peptide
  Seed: ASYLIRARRS (TYRP1_HUMAN)
AFYLIRARRR

SEQ ID NO: 170416 - protein, 10 aa, Artificial Sequence
  Description of Artificial Sequence: Synthetic peptide
  Seed: QFENISIYNY (TYRP1_HUMAN)
QMENISIYNW

SEQ ID NO: 170417 - protein, 9 aa, Artificial Sequence
  Description of Artificial Sequence: Synthetic peptide
  Seed: SLHNLAHLF (TYRP1_HUMAN)
SIHNLAHLF

SEQ ID NO: 170418 - protein, 9 aa, Artificial Sequence
  Description of Artificial Sequence: Synthetic peptide
  Seed: RFFNRTCHC (TYRP1_HUMAN)
RIFNRTCHM

SEQ ID NO: 170419 - protein, 9 aa, Artificial Sequence
  Description of Artificial Sequence: Synthetic peptide
  Seed: YSNSTNSFR (TYRP1_HUMAN)
YINSTNSFR

SEQ ID NO: 170420 - protein, 11 aa, Artificial Sequence
  Description of Artificial Sequence: Synthetic peptide
  Seed: FVLLHTFTDAV (TYRP1_HUMAN)
FQLLHTFTDAV

SEQ ID NO: 170421 - protein, 9 aa, Artificial Sequence
  Description of Artificial Sequence: Synthetic peptide
  Seed: LIFGTASYL (TYRP1_HUMAN)
LPFGTASYY

SEQ ID NO: 170422 - protein, 9 aa, Artificial Sequence
  Description of Artificial Sequence: Synthetic peptide
  Seed: ISIYNYFVW (TYRP1_HUMAN)
ITIYNYFVI

SEQ ID NO: 170423 - protein, 10 aa, Artificial Sequence
  Description of Artificial Sequence: Synthetic peptide
  Seed: FYSNSTNSFR (TYRP1_HUMAN)
FTSNSTNSFR

SEQ ID NO: 170424 - protein, 11 aa, Artificial Sequence
  Description of Artificial Sequence: Synthetic peptide
  Seed: REVWPLRFFNR (TYRP1_HUMAN)
RKVWPLRFFNK

SEQ ID NO: 170425 - protein, 9 aa, Artificial Sequence
  Description of Artificial Sequence: Synthetic peptide
  Seed: MSAPKLLSL (TYRP1_HUMAN)
MNAPKLLSL

SEQ ID NO: 170426 - protein, 9 aa, Artificial Sequence
  Description of Artificial Sequence: Synthetic peptide
  Seed: RRNPAGNVA (TYRP1_HUMAN)
RFNPAGNVY

SEQ ID NO: 170427 - protein, 9 aa, Artificial Sequence
  Description of Artificial Sequence: Synthetic peptide
  Seed: SIYNYFVWT (TYRP1_HUMAN)
STYNYFVWI

SEQ ID NO: 170428 - protein, 9 aa, Artificial Sequence
  Description of Artificial Sequence: Synthetic peptide
  Seed: RSLHNLAHL (TYRP1_HUMAN)
RMLHNLAHR

SEQ ID NO: 170429 - protein, 10 aa, Artificial Sequence
  Description of Artificial Sequence: Synthetic peptide
  Seed: QFENISIYNY (TYRP1_HUMAN)
QNENISIYNW

SEQ ID NO: 170430 - protein, 9 aa, Artificial Sequence
  Description of Artificial Sequence: Synthetic peptide
  Seed: YLIRARRSM (TYRP1_HUMAN)
YPIRARRSF

SEQ ID NO: 170431 - protein, 9 aa, Artificial Sequence
  Description of Artificial Sequence: Synthetic peptide
  Seed: AVRSLHNLA (TYRP1_HUMAN)
ASRSLHNLL

SEQ ID NO: 170432 - protein, 11 aa, Artificial Sequence
  Description of Artificial Sequence: Synthetic peptide
  Seed: KTFLGVGQESF (TYRP1_HUMAN)
KIFLGVGQESW

SEQ ID NO: 170433 - protein, 10 aa, Artificial Sequence
  Description of Artificial Sequence: Synthetic peptide
  Seed: YFVWTHYYSV (TYRP1_HUMAN)
YLVWTHYYSI

SEQ ID NO: 170434 - protein, 10 aa, Artificial Sequence
  Description of Artificial Sequence: Synthetic peptide
  Seed: FSVPEIIAIA (TYRP1_HUMAN)
FAVPEIIAIL

SEQ ID NO: 170435 - protein, 11 aa, Artificial Sequence
  Description of Artificial Sequence: Synthetic peptide
  Seed: AIAVVGALLLV (TYRP1_HUMAN)
AMAVVGALLLV

SEQ ID NO: 170436 - protein, 10 aa, Artificial Sequence
  Description of Artificial Sequence: Synthetic peptide
  Seed: FYSNSTNSFR (TYRP1_HUMAN)
FYSNSTNSFI

SEQ ID NO: 170437 - protein, 9 aa, Artificial Sequence
  Description of Artificial Sequence: Synthetic peptide
  Seed: MAKRTTHPL (TYRP1_HUMAN)
MAKRTTHPW

SEQ ID NO: 170438 - protein, 10 aa, Artificial Sequence
  Description of Artificial Sequence: Synthetic peptide
  Seed: FVLLHTFTDA (TYRP1_HUMAN)
FHLLHTFTDI

SEQ ID NO: 170439 - protein, 9 aa, Artificial Sequence
  Description of Artificial Sequence: Synthetic peptide
  Seed: CIFFPLLLF (TYRP1_HUMAN)
CKFFPLLLF

SEQ ID NO: 170440 - protein, 9 aa, Artificial Sequence
  Description of Artificial Sequence: Synthetic peptide
  Seed: SVPEIIAIA (TYRP1_HUMAN)
STPEIIAIA

SEQ ID NO: 170441 - protein, 9 aa, Artificial Sequence
  Description of Artificial Sequence: Synthetic peptide
  Seed: HYYSVKKTF (TYRP1_HUMAN)
HSYSVKKTY

SEQ ID NO: 170442 - protein, 9 aa, Artificial Sequence
  Description of Artificial Sequence: Synthetic peptide
  Seed: YNYFVWTHY (TYRP1_HUMAN)
YYYFVWTHF

SEQ ID NO: 170443 - protein, 9 aa, Artificial Sequence
  Description of Artificial Sequence: Synthetic peptide
  Seed: FSLPYWNFA (TYRP1_HUMAN)
FMLPYWNFM

SEQ ID NO: 170444 - protein, 9 aa, Artificial Sequence
  Description of Artificial Sequence: Synthetic peptide
  Seed: NYFVWTHYY (TYRP1_HUMAN)
NVFVWTHYR

SEQ ID NO: 170445 - protein, 9 aa, Artificial Sequence
  Description of Artificial Sequence: Synthetic peptide
  Seed: QQARAQFPR (TYRP1_HUMAN)
QSARAQFPR

SEQ ID NO: 170446 - protein, 10 aa, Artificial Sequence
  Description of Artificial Sequence: Synthetic peptide
  Seed: STFPLENAPI (TYRP1_HUMAN)
SSFPLENAPV

SEQ ID NO: 170447 - protein, 10 aa, Artificial Sequence
  Description of Artificial Sequence: Synthetic peptide
  Seed: AVFDEWLRRY (TYRP1_HUMAN)
AGFDEWLRRW

SEQ ID NO: 170448 - protein, 11 aa, Artificial Sequence
  Description of Artificial Sequence: Synthetic peptide
  Seed: IYNYFVWTHYY (TYRP1_HUMAN)
IPNYFVWTHYY

SEQ ID NO: 170449 - protein, 11 aa, Artificial Sequence
  Description of Artificial Sequence: Synthetic peptide
  Seed: FWPPVTNTEMF (TYRP1_HUMAN)
FDPPVTNTEMW

SEQ ID NO: 170450 - protein, 11 aa, Artificial Sequence
  Description of Artificial Sequence: Synthetic peptide
  Seed: MFVTAPDNLGY (TYRP1_HUMAN)
MDVTAPDNLGF

SEQ ID NO: 170451 - protein, 9 aa, Artificial Sequence
  Description of Artificial Sequence: Synthetic peptide
  Seed: TADSRPHSP (TYRP1_HUMAN)
TTDSRPHSF

SEQ ID NO: 170452 - protein, 11 aa, Artificial Sequence
  Description of Artificial Sequence: Synthetic peptide
  Seed: NYFVWTHYYSV (TYRP1_HUMAN)
NMFVWTHYYSV

SEQ ID NO: 170453 - protein, 9 aa, Artificial Sequence
  Description of Artificial Sequence: Synthetic peptide
  Seed: LIFGTASYL (TYRP1_HUMAN)
LWFGTASYY

SEQ ID NO: 170454 - protein, 11 aa, Artificial Sequence
  Description of Artificial Sequence: Synthetic peptide
  Seed: YNMVPFWPPVT (TYRP1_HUMAN)
YMMVPFWPPVG

SEQ ID NO: 170455 - protein, 10 aa, Artificial Sequence
  Description of Artificial Sequence: Synthetic peptide
  Seed: GLFDTPPFYS (TYRP1_HUMAN)
GQFDTPPFYL

SEQ ID NO: 170456 - protein, 9 aa, Artificial Sequence
  Description of Artificial Sequence: Synthetic peptide
  Seed: VCDICTDDL (TYRP1_HUMAN)
VIDICTDDF

SEQ ID NO: 170457 - protein, 10 aa, Artificial Sequence
  Description of Artificial Sequence: Synthetic peptide
  Seed: LIFGTASYLI (TYRP1_HUMAN)
LMFGTASYLF

SEQ ID NO: 170458 - protein, 9 aa, Artificial Sequence
  Description of Artificial Sequence: Synthetic peptide
  Seed: LFQQARAQF (TYRP1_HUMAN)
LYQQARAQF

SEQ ID NO: 170459 - protein, 9 aa, Artificial Sequence
  Description of Artificial Sequence: Synthetic peptide
  Seed: RTTHPLFVI (TYRP1_HUMAN)
RVTHPLFVM

SEQ ID NO: 170460 - protein, 9 aa, Artificial Sequence
  Description of Artificial Sequence: Synthetic peptide
  Seed: VGALLLVAL (TYRP1_HUMAN)
VLALLLVAI

SEQ ID NO: 170461 - protein, 9 aa, Artificial Sequence
  Description of Artificial Sequence: Synthetic peptide
  Seed: ISIYNYFVW (TYRP1_HUMAN)
ILIYNYFVF

SEQ ID NO: 170462 - protein, 8 aa, Artificial Sequence
  Description of Artificial Sequence: Synthetic peptide
  Seed: FSHEGPAF (TYRP1_HUMAN)
FIHEGPAM

SEQ ID NO: 170463 - protein, 9 aa, Artificial Sequence
  Description of Artificial Sequence: Synthetic peptide
  Seed: KLLSLGCIF (TYRP1_HUMAN)
KGLSLGCIW

SEQ ID NO: 170464 - protein, 9 aa, Artificial Sequence
  Description of Artificial Sequence: Synthetic peptide
  Seed: GLFDTPPFY (TYRP1_HUMAN)
GIFDTPPFK

SEQ ID NO: 170465 - protein, 9 aa, Artificial Sequence
  Description of Artificial Sequence: Synthetic peptide
  Seed: QYQCYAEEY (TYRP1_HUMAN)
QFQCYAEEF

SEQ ID NO: 170466 - protein, 9 aa, Artificial Sequence
  Description of Artificial Sequence: Synthetic peptide
  Seed: IAIAVVGAL (TYRP1_HUMAN)
IYIAVVGAM

SEQ ID NO: 170467 - protein, 11 aa, Artificial Sequence
  Description of Artificial Sequence: Synthetic peptide
  Seed: YNYFVWTHYYS (TYRP1_HUMAN)
YMYFVWTHYYN

SEQ ID NO: 170468 - protein, 9 aa, Artificial Sequence
  Description of Artificial Sequence: Synthetic peptide
  Seed: SFRNTVEGY (TYRP1_HUMAN)
SARNTVEGF

SEQ ID NO: 170469 - protein, 10 aa, Artificial Sequence
  Description of Artificial Sequence: Synthetic peptide
  Seed: TAPDNLGYTY (TYRP1_HUMAN)
TGPDNLGYTL

SEQ ID NO: 170470 - protein, 9 aa, Artificial Sequence
  Description of Artificial Sequence: Synthetic peptide
  Seed: AFLTWHRYH (TYRP1_HUMAN)
AALTWHRYK

SEQ ID NO: 170471 - protein, 10 aa, Artificial Sequence
  Description of Artificial Sequence: Synthetic peptide
  Seed: FVLLHTFTDA (TYRP1_HUMAN)
FYLLHTFTDV

SEQ ID NO: 170472 - protein, 10 aa, Artificial Sequence
  Description of Artificial Sequence: Synthetic peptide
  Seed: LSLGCIFFPL (TYRP1_HUMAN)
LPLGCIFFPL

SEQ ID NO: 170473 - protein, 9 aa, Artificial Sequence
  Description of Artificial Sequence: Synthetic peptide
  Seed: RFFNRTCHC (TYRP1_HUMAN)
RMFNRTCHV

SEQ ID NO: 170474 - protein, 9 aa, Artificial Sequence
  Description of Artificial Sequence: Synthetic peptide
  Seed: FSHEGPAFL (TYRP1_HUMAN)
FVHEGPAFF

SEQ ID NO: 170475 - protein, 9 aa, Artificial Sequence
  Description of Artificial Sequence: Synthetic peptide
  Seed: VRSLHNLAH (TYRP1_HUMAN)
VRSLHNLAM

SEQ ID NO: 170476 - protein, 10 aa, Artificial Sequence
  Description of Artificial Sequence: Synthetic peptide
  Seed: FVLLHTFTDA (TYRP1_HUMAN)
FDLLHTFTDL

SEQ ID NO: 170477 - protein, 9 aa, Artificial Sequence
  Description of Artificial Sequence: Synthetic peptide
  Seed: YNYFVWTHY (TYRP1_HUMAN)
YAYFVWTHF

SEQ ID NO: 170478 - protein, 11 aa, Artificial Sequence
  Description of Artificial Sequence: Synthetic peptide
  Seed: YNMVPFWPPVT (TYRP1_HUMAN)
YQMVPFWPPVN

SEQ ID NO: 170479 - protein, 9 aa, Artificial Sequence
  Description of Artificial Sequence: Synthetic peptide
  Seed: TTHPLFVIA (TYRP1_HUMAN)
TMHPLFVIL

SEQ ID NO: 170480 - protein, 10 aa, Artificial Sequence
  Description of Artificial Sequence: Synthetic peptide
  Seed: LLHTFTDAVF (TYRP1_HUMAN)
LVHTFTDAVY

SEQ ID NO: 170481 - protein, 10 aa, Artificial Sequence
  Description of Artificial Sequence: Synthetic peptide
  Seed: LSLGCIFFPL (TYRP1_HUMAN)
LHLGCIFFPI

SEQ ID NO: 170482 - protein, 10 aa, Artificial Sequence
  Description of Artificial Sequence: Synthetic peptide
  Seed: RQCATVEALR (TYRP1_HUMAN)
RMCATVEALR

SEQ ID NO: 170483 - protein, 9 aa, Artificial Sequence
  Description of Artificial Sequence: Synthetic peptide
  Seed: NSVFSQWRV (TYRP1_HUMAN)
NTVFSQWRI

SEQ ID NO: 170484 - protein, 9 aa, Artificial Sequence
  Description of Artificial Sequence: Synthetic peptide
  Seed: MLQEPSFSL (TYRP1_HUMAN)
MAQEPSFSF

SEQ ID NO: 170485 - protein, 9 aa, Artificial Sequence
  Description of Artificial Sequence: Synthetic peptide
  Seed: MCCPDLSPV (TYRP1_HUMAN)
MVCPDLSPT

SEQ ID NO: 170486 - protein, 9 aa, Artificial Sequence
  Description of Artificial Sequence: Synthetic peptide
  Seed: REFSVPEII (TYRP1_HUMAN)
RQFSVPEIM

SEQ ID NO: 170487 - protein, 9 aa, Artificial Sequence
  Description of Artificial Sequence: Synthetic peptide
  Seed: AVVGALLLV (TYRP1_HUMAN)
ATVGALLLF

SEQ ID NO: 170488 - protein, 10 aa, Artificial Sequence
  Description of Artificial Sequence: Synthetic peptide
  Seed: FLTWHRYHLL (TYRP1_HUMAN)
FQTWHRYHLV

SEQ ID NO: 170489 - protein, 10 aa, Artificial Sequence
  Description of Artificial Sequence: Synthetic peptide
  Seed: TPQFENISIY (TYRP1_HUMAN)
TAQFENISIF

SEQ ID NO: 170490 - protein, 10 aa, Artificial Sequence
  Description of Artificial Sequence: Synthetic peptide
  Seed: KRTTHPLFVI (TYRP1_HUMAN)
KYTTHPLFVW

SEQ ID NO: 170491 - protein, 9 aa, Artificial Sequence
  Description of Artificial Sequence: Synthetic peptide
  Seed: MSAPKLLSL (TYRP1_HUMAN)
MRAPKLLSI

SEQ ID NO: 170492 - protein, 9 aa, Artificial Sequence
  Description of Artificial Sequence: Synthetic peptide
  Seed: RQCATVEAL (TYRP1_HUMAN)
RHCATVEAV

SEQ ID NO: 170493 - protein, 9 aa, Artificial Sequence
  Description of Artificial Sequence: Synthetic peptide
  Seed: RPGWRGAAC (TYRP1_HUMAN)
RTGWRGAAL

SEQ ID NO: 170494 - protein, 10 aa, Artificial Sequence
  Description of Artificial Sequence: Synthetic peptide
  Seed: SPNDPIFVLL (TYRP1_HUMAN)
SPNDPIFVLM

SEQ ID NO: 170495 - protein, 9 aa, Artificial Sequence
  Description of Artificial Sequence: Synthetic peptide
  Seed: FPLENAPIG (TYRP1_HUMAN)
FPLENAPIM

SEQ ID NO: 170496 - protein, 9 aa, Artificial Sequence
  Description of Artificial Sequence: Synthetic peptide
  Seed: RRYNADIST (TYRP1_HUMAN)
RRYNADISC

SEQ ID NO: 170497 - protein, 11 aa, Artificial Sequence
  Description of Artificial Sequence: Synthetic peptide
  Seed: IYNYFVWTHYY (TYRP1_HUMAN)
IRNYFVWTHYY

SEQ ID NO: 170498 - protein, 11 aa, Artificial Sequence
  Description of Artificial Sequence: Synthetic peptide
  Seed: LFQQARAQFPR (TYRP1_HUMAN)
LVQQARAQFPR

SEQ ID NO: 170499 - protein, 9 aa, Artificial Sequence
  Description of Artificial Sequence: Synthetic peptide
  Seed: KLLSLGCIF (TYRP1_HUMAN)
KILSLGCIF

SEQ ID NO: 170500 - protein, 11 aa, Artificial Sequence
  Description of Artificial Sequence: Synthetic peptide
  Seed: RSLHNLAHLFL (TYRP1_HUMAN)
RVLHNLAHLFW

SEQ ID NO: 170501 - protein, 11 aa, Artificial Sequence
  Description of Artificial Sequence: Synthetic peptide
  Seed: RRSMDEANQPL (TYRP1_HUMAN)
RYSMDEANQPV

SEQ ID NO: 170502 - protein, 10 aa, Artificial Sequence
  Description of Artificial Sequence: Synthetic peptide
  Seed: LSPNDPIFVL (TYRP1_HUMAN)
LRPNDPIFVW

SEQ ID NO: 170503 - protein, 11 aa, Artificial Sequence
  Description of Artificial Sequence: Synthetic peptide
  Seed: AGNVARPMVQR (TYRP1_HUMAN)
AFNVARPMVQK

SEQ ID NO: 170504 - protein, 9 aa, Artificial Sequence
  Description of Artificial Sequence: Synthetic peptide
  Seed: RTTHPLFVI (TYRP1_HUMAN)
RQTHPLFVI

SEQ ID NO: 170505 - protein, 9 aa, Artificial Sequence
  Description of Artificial Sequence: Synthetic peptide
  Seed: VCDICTDDL (TYRP1_HUMAN)
VFDICTDDL

SEQ ID NO: 170506 - protein, 8 aa, Artificial Sequence
  Description of Artificial Sequence: Synthetic peptide
  Seed: LIRARRSM (TYRP1_HUMAN)
LPRARRSL

SEQ ID NO: 170507 - protein, 8 aa, Artificial Sequence
  Description of Artificial Sequence: Synthetic peptide
  Seed: YYSVKKTF (TYRP1_HUMAN)
YFSVKKTF

SEQ ID NO: 170508 - protein, 11 aa, Artificial Sequence
  Description of Artificial Sequence: Synthetic peptide
  Seed: RLPEPQDVAQC (TYRP1_HUMAN)
RIPEPQDVAQV

SEQ ID NO: 170509 - protein, 9 aa, Artificial Sequence
  Description of Artificial Sequence: Synthetic peptide
  Seed: APDNLGYTY (TYRP1_HUMAN)
AYDNLGYTL

SEQ ID NO: 170510 - protein, 9 aa, Artificial Sequence
  Description of Artificial Sequence: Synthetic peptide
  Seed: STLISPNSV (TYRP1_HUMAN)
SALISPNSL

SEQ ID NO: 170511 - protein, 9 aa, Artificial Sequence
  Description of Artificial Sequence: Synthetic peptide
  Seed: SVKKTFLGV (TYRP1_HUMAN)
SPKKTFLGA

SEQ ID NO: 170512 - protein, 10 aa, Artificial Sequence
  Description of Artificial Sequence: Synthetic peptide
  Seed: RSMDEANQPL (TYRP1_HUMAN)
RIMDEANQPI

SEQ ID NO: 170513 - protein, 8 aa, Artificial Sequence
  Description of Artificial Sequence: Synthetic peptide
  Seed: YSDPTGKY (TYRP1_HUMAN)
YCDPTGKI

SEQ ID NO: 170514 - protein, 9 aa, Artificial Sequence
  Description of Artificial Sequence: Synthetic peptide
  Seed: SREFSVPEI (TYRP1_HUMAN)
SYEFSVPEM

SEQ ID NO: 170515 - protein, 9 aa, Artificial Sequence
  Description of Artificial Sequence: Synthetic peptide
  Seed: FTDAVFDEW (TYRP1_HUMAN)
FVDAVFDEY

SEQ ID NO: 170516 - protein, 9 aa, Artificial Sequence
  Description of Artificial Sequence: Synthetic peptide
  Seed: NYFVWTHYY (TYRP1_HUMAN)
NPFVWTHYR

SEQ ID NO: 170517 - protein, 9 aa, Artificial Sequence
  Description of Artificial Sequence: Synthetic peptide
  Seed: FPLLLFQQA (TYRP1_HUMAN)
FPLLLFQQP

SEQ ID NO: 170518 - protein, 10 aa, Artificial Sequence
  Description of Artificial Sequence: Synthetic peptide
  Seed: QFENISIYNY (TYRP1_HUMAN)
QPENISIYNW

SEQ ID NO: 170519 - protein, 10 aa, Artificial Sequence
  Description of Artificial Sequence: Synthetic peptide
  Seed: RSLHNLAHLF (TYRP1_HUMAN)
RQLHNLAHLM

SEQ ID NO: 170520 - protein, 9 aa, Artificial Sequence
  Description of Artificial Sequence: Synthetic peptide
  Seed: VTAPDNLGY (TYRP1_HUMAN)
VSAPDNLGW

SEQ ID NO: 170521 - protein, 10 aa, Artificial Sequence
  Description of Artificial Sequence: Synthetic peptide
  Seed: GKYDPAVRSL (TYRP1_HUMAN)
GQYDPAVRSV

SEQ ID NO: 170522 - protein, 9 aa, Artificial Sequence
  Description of Artificial Sequence: Synthetic peptide
  Seed: KYDPAVRSL (TYRP1_HUMAN)
KLDPAVRSY

SEQ ID NO: 170523 - protein, 9 aa, Artificial Sequence
  Description of Artificial Sequence: Synthetic peptide
  Seed: VFDEWLRRY (TYRP1_HUMAN)
VLDEWLRRW

SEQ ID NO: 170524 - protein, 9 aa, Artificial Sequence
  Description of Artificial Sequence: Synthetic peptide
  Seed: DSRPHSPQY (TYRP1_HUMAN)
DMRPHSPQY

SEQ ID NO: 170525 - protein, 9 aa, Artificial Sequence
  Description of Artificial Sequence: Synthetic peptide
  Seed: SFRNTVEGY (TYRP1_HUMAN)
SARNTVEGM

SEQ ID NO: 170526 - protein, 9 aa, Artificial Sequence
  Description of Artificial Sequence: Synthetic peptide
  Seed: LPEPQDVAQ (TYRP1_HUMAN)
LAEPQDVAY

SEQ ID NO: 170527 - protein, 9 aa, Artificial Sequence
  Description of Artificial Sequence: Synthetic peptide
  Seed: FSHEGPAFL (TYRP1_HUMAN)
FMHEGPAFV

SEQ ID NO: 170528 - protein, 10 aa, Artificial Sequence
  Description of Artificial Sequence: Synthetic peptide
  Seed: ALIFGTASYL (TYRP1_HUMAN)
AQIFGTASYH

SEQ ID NO: 170529 - protein, 9 aa, Artificial Sequence
  Description of Artificial Sequence: Synthetic peptide
  Seed: TLISPNSVF (TYRP1_HUMAN)
TPISPNSVF

SEQ ID NO: 170530 - protein, 11 aa, Artificial Sequence
  Description of Artificial Sequence: Synthetic peptide
  Seed: YNMVPFWPPVT (TYRP1_HUMAN)
YQMVPFWPPVF

SEQ ID NO: 170531 - protein, 9 aa, Artificial Sequence
  Description of Artificial Sequence: Synthetic peptide
  Seed: GPDGNTPQF (TYRP1_HUMAN)
GWDGNTPQL

SEQ ID NO: 170532 - protein, 10 aa, Artificial Sequence
  Description of Artificial Sequence: Synthetic peptide
  Seed: HPLFVIATRR (TYRP1_HUMAN)
HTLFVIATRA

SEQ ID NO: 170533 - protein, 9 aa, Artificial Sequence
  Description of Artificial Sequence: Synthetic peptide
  Seed: VARPMVQRL (TYRP1_HUMAN)
VRRPMVQRM

SEQ ID NO: 170534 - protein, 10 aa, Artificial Sequence
  Description of Artificial Sequence: Synthetic peptide
  Seed: THPLFVIATR (TYRP1_HUMAN)
TFPLFVIATR

SEQ ID NO: 170535 - protein, 11 aa, Artificial Sequence
  Description of Artificial Sequence: Synthetic peptide
  Seed: LRRYNADISTF (TYRP1_HUMAN)
LFRYNADISTF

SEQ ID NO: 170536 - protein, 10 aa, Artificial Sequence
  Description of Artificial Sequence: Synthetic peptide
  Seed: GNVARPMVQR (TYRP1_HUMAN)
GKVARPMVQK

SEQ ID NO: 170537 - protein, 9 aa, Artificial Sequence
  Description of Artificial Sequence: Synthetic peptide
  Seed: FTDAVFDEW (TYRP1_HUMAN)
FNDAVFDEL

SEQ ID NO: 170538 - protein, 9 aa, Artificial Sequence
  Description of Artificial Sequence: Synthetic peptide
  Seed: RYHLLRLEK (TYRP1_HUMAN)
RTHLLRLEA

SEQ ID NO: 170539 - protein, 9 aa, Artificial Sequence
  Description of Artificial Sequence: Synthetic peptide
  Seed: KLQNPNQSV (TYRP1_HUMAN)
KVQNPNQSF

SEQ ID NO: 170540 - protein, 9 aa, Artificial Sequence
  Description of Artificial Sequence: Synthetic peptide
  Seed: YNYFVWTHY (TYRP1_HUMAN)
YAYFVWTHA

SEQ ID NO: 170541 - protein, 9 aa, Artificial Sequence
  Description of Artificial Sequence: Synthetic peptide
  Seed: GLFDTPPFY (TYRP1_HUMAN)
GAFDTPPFI

SEQ ID NO: 170542 - protein, 10 aa, Artificial Sequence
  Description of Artificial Sequence: Synthetic peptide
  Seed: STLISPNSVF (TYRP1_HUMAN)
SHLISPNSVF

SEQ ID NO: 170543 - protein, 10 aa, Artificial Sequence
  Description of Artificial Sequence: Synthetic peptide
  Seed: FSLPYWNFAT (TYRP1_HUMAN)
FQLPYWNFAF

SEQ ID NO: 170544 - protein, 9 aa, Artificial Sequence
  Description of Artificial Sequence: Synthetic peptide
  Seed: SPNSVFSQW (TYRP1_HUMAN)
SPNSVFSQP

SEQ ID NO: 170545 - protein, 8 aa, Artificial Sequence
  Description of Artificial Sequence: Synthetic peptide
  Seed: YSNSTNSF (TYRP1_HUMAN)
YFNSTNSY

SEQ ID NO: 170546 - protein, 10 aa, Artificial Sequence
  Description of Artificial Sequence: Synthetic peptide
  Seed: ATVEALRSGM (TYRP1_HUMAN)
ATVEALRSGV

SEQ ID NO: 170547 - protein, 9 aa, Artificial Sequence
  Description of Artificial Sequence: Synthetic peptide
  Seed: SPNDPIFVL (TYRP1_HUMAN)
SANDPIFVW

SEQ ID NO: 170548 - protein, 9 aa, Artificial Sequence
  Description of Artificial Sequence: Synthetic peptide
  Seed: AVRSLHNLA (TYRP1_HUMAN)
ATRSLHNLP

SEQ ID NO: 170549 - protein, 9 aa, Artificial Sequence
  Description of Artificial Sequence: Synthetic peptide
  Seed: YSNSTNSFR (TYRP1_HUMAN)
YGNSTNSFR

SEQ ID NO: 170550 - protein, 11 aa, Artificial Sequence
  Description of Artificial Sequence: Synthetic peptide
  Seed: RRSMDEANQPL (TYRP1_HUMAN)
RVSMDEANQPV

SEQ ID NO: 170551 - protein, 10 aa, Artificial Sequence
  Description of Artificial Sequence: Synthetic peptide
  Seed: FVRALDMAKR (TYRP1_HUMAN)
FSRALDMAKR

SEQ ID NO: 170552 - protein, 11 aa, Artificial Sequence
  Description of Artificial Sequence: Synthetic peptide
  Seed: YNYFVWTHYYS (TYRP1_HUMAN)
YPYFVWTHYYY

SEQ ID NO: 170553 - protein, 9 aa, Artificial Sequence
  Description of Artificial Sequence: Synthetic peptide
  Seed: QYQCYAEEY (TYRP1_HUMAN)
QQQCYAEEY

SEQ ID NO: 170554 - protein, 8 aa, Artificial Sequence
  Description of Artificial Sequence: Synthetic peptide
  Seed: YSVKKTFL (TYRP1_HUMAN)
YAVKKTFL

SEQ ID NO: 170555 - protein, 9 aa, Artificial Sequence
  Description of Artificial Sequence: Synthetic peptide
  Seed: NYFVWTHYY (TYRP1_HUMAN)
NFFVWTHYK

SEQ ID NO: 170556 - protein, 10 aa, Artificial Sequence
  Description of Artificial Sequence: Synthetic peptide
  Seed: TAPDNLGYTY (TYRP1_HUMAN)
TMPDNLGYTI

SEQ ID NO: 170557 - protein, 11 aa, Artificial Sequence
  Description of Artificial Sequence: Synthetic peptide
  Seed: YFVWTHYYSVK (TYRP1_HUMAN)
YTVWTHYYSVK

SEQ ID NO: 170558 - protein, 10 aa, Artificial Sequence
  Description of Artificial Sequence: Synthetic peptide
  Seed: RSMDEANQPL (TYRP1_HUMAN)
RLMDEANQPV

SEQ ID NO: 170559 - protein, 9 aa, Artificial Sequence
  Description of Artificial Sequence: Synthetic peptide
  Seed: LGCIFFPLL (TYRP1_HUMAN)
LLCIFFPLI

SEQ ID NO: 170560 - protein, 10 aa, Artificial Sequence
  Description of Artificial Sequence: Synthetic peptide
  Seed: HFVRALDMAK (TYRP1_HUMAN)
HYVRALDMAR

SEQ ID NO: 170561 - protein, 9 aa, Artificial Sequence
  Description of Artificial Sequence: Synthetic peptide
  Seed: RVLIVRRNL (TYRP1_HUMAN)
RQLIVRRNK

SEQ ID NO: 170562 - protein, 9 aa, Artificial Sequence
  Description of Artificial Sequence: Synthetic peptide
  Seed: KLLSLGCIF (TYRP1_HUMAN)
KVLSLGCIY

SEQ ID NO: 170563 - protein, 10 aa, Artificial Sequence
  Description of Artificial Sequence: Synthetic peptide
  Seed: YFVWTHYYSV (TYRP1_HUMAN)
YHVWTHYYSL

SEQ ID NO: 170564 - protein, 8 aa, Artificial Sequence
  Description of Artificial Sequence: Synthetic peptide
  Seed: YSDPTGKY (TYRP1_HUMAN)
YLDPTGKI

SEQ ID NO: 170565 - protein, 10 aa, Artificial Sequence
  Description of Artificial Sequence: Synthetic peptide
  Seed: YNYFVWTHYY (TYRP1_HUMAN)
YMYFVWTHYH

SEQ ID NO: 170566 - protein, 10 aa, Artificial Sequence
  Description of Artificial Sequence: Synthetic peptide
  Seed: LSPNDPIFVL (TYRP1_HUMAN)
LLPNDPIFVM

SEQ ID NO: 170567 - protein, 10 aa, Artificial Sequence
  Description of Artificial Sequence: Synthetic peptide
  Seed: SMDEANQPLL (TYRP1_HUMAN)
SMDEANQPLI

SEQ ID NO: 170568 - protein, 9 aa, Artificial Sequence
  Description of Artificial Sequence: Synthetic peptide
  Seed: TLISPNSVF (TYRP1_HUMAN)
TSISPNSVF

SEQ ID NO: 170569 - protein, 9 aa, Artificial Sequence
  Description of Artificial Sequence: Synthetic peptide
  Seed: RPMVQRLPE (TYRP1_HUMAN)
RPMVQRLPV

SEQ ID NO: 170570 - protein, 8 aa, Artificial Sequence
  Description of Artificial Sequence: Synthetic peptide
  Seed: YSNSTNSF (TYRP1_HUMAN)
YKNSTNSY

SEQ ID NO: 170571 - protein, 9 aa, Artificial Sequence
  Description of Artificial Sequence: Synthetic peptide
  Seed: LQNPNQSVV (TYRP1_HUMAN)
LHNPNQSVI

SEQ ID NO: 170572 - protein, 9 aa, Artificial Sequence
  Description of Artificial Sequence: Synthetic peptide
  Seed: MAKRTTHPL (TYRP1_HUMAN)
MQKRTTHPH

SEQ ID NO: 170573 - protein, 9 aa, Artificial Sequence
  Description of Artificial Sequence: Synthetic peptide
  Seed: LQNPNQSVV (TYRP1_HUMAN)
LANPNQSVI

SEQ ID NO: 170574 - protein, 9 aa, Artificial Sequence
  Description of Artificial Sequence: Synthetic peptide
  Seed: RQYNMVPFW (TYRP1_HUMAN)
RWYNMVPFV

SEQ ID NO: 170575 - protein, 10 aa, Artificial Sequence
  Description of Artificial Sequence: Synthetic peptide
  Seed: TASYLIRARR (TYRP1_HUMAN)
TPSYLIRARR

SEQ ID NO: 170576 - protein, 9 aa, Artificial Sequence
  Description of Artificial Sequence: Synthetic peptide
  Seed: VARPMVQRL (TYRP1_HUMAN)
VPRPMVQRV

SEQ ID NO: 170577 - protein, 9 aa, Artificial Sequence
  Description of Artificial Sequence: Synthetic peptide
  Seed: IYNYFVWTH (TYRP1_HUMAN)
ISNYFVWTR

SEQ ID NO: 170578 - protein, 9 aa, Artificial Sequence
  Description of Artificial Sequence: Synthetic peptide
  Seed: LEKDMQEML (TYRP1_HUMAN)
LQKDMQEMV

SEQ ID NO: 170579 - protein, 9 aa, Artificial Sequence
  Description of Artificial Sequence: Synthetic peptide
  Seed: VFDEWLRRY (TYRP1_HUMAN)
VWDEWLRRM

SEQ ID NO: 170580 - protein, 9 aa, Artificial Sequence
  Description of Artificial Sequence: Synthetic peptide
  Seed: EDYDTLGTL (TYRP1_HUMAN)
EEYDTLGTW

SEQ ID NO: 170581 - protein, 11 aa, Artificial Sequence
  Description of Artificial Sequence: Synthetic peptide
  Seed: IYNYFVWTHYY (TYRP1_HUMAN)
IPNYFVWTHYL

SEQ ID NO: 170582 - protein, 10 aa, Artificial Sequence
  Description of Artificial Sequence: Synthetic peptide
  Seed: LGPDGNTPQF (TYRP1_HUMAN)
LMPDGNTPQY

SEQ ID NO: 170583 - protein, 11 aa, Artificial Sequence
  Description of Artificial Sequence: Synthetic peptide
  Seed: MFVTAPDNLGY (TYRP1_HUMAN)
MTVTAPDNLGF

SEQ ID NO: 170584 - protein, 9 aa, Artificial Sequence
  Description of Artificial Sequence: Synthetic peptide
  Seed: ALIFGTASY (TYRP1_HUMAN)
AYIFGTASF

SEQ ID NO: 170585 - protein, 10 aa, Artificial Sequence
  Description of Artificial Sequence: Synthetic peptide
  Seed: LLFQQARAQF (TYRP1_HUMAN)
LLFQQARAQY

SEQ ID NO: 170586 - protein, 9 aa, Artificial Sequence
  Description of Artificial Sequence: Synthetic peptide
  Seed: REFSVPEII (TYRP1_HUMAN)
RAFSVPEIV

SEQ ID NO: 170587 - protein, 9 aa, Artificial Sequence
  Description of Artificial Sequence: Synthetic peptide
  Seed: RARRSMDEA (TYRP1_HUMAN)
RLRRSMDEK

SEQ ID NO: 170588 - protein, 9 aa, Artificial Sequence
  Description of Artificial Sequence: Synthetic peptide
  Seed: AFLTWHRYH (TYRP1_HUMAN)
AVLTWHRYR

SEQ ID NO: 170589 - protein, 9 aa, Artificial Sequence
  Description of Artificial Sequence: Synthetic peptide
  Seed: YTYEIQWPS (TYRP1_HUMAN)
YTYEIQWPK

SEQ ID NO: 170590 - protein, 9 aa, Artificial Sequence
  Description of Artificial Sequence: Synthetic peptide
  Seed: LFQQARAQF (TYRP1_HUMAN)
LYQQARAQI

SEQ ID NO: 170591 - protein, 9 aa, Artificial Sequence
  Description of Artificial Sequence: Synthetic peptide
  Seed: LIFGTASYL (TYRP1_HUMAN)
LVFGTASYA

SEQ ID NO: 170592 - protein, 9 aa, Artificial Sequence
  Description of Artificial Sequence: Synthetic peptide
  Seed: VFDEWLRRY (TYRP1_HUMAN)
VVDEWLRRF

SEQ ID NO: 170593 - protein, 9 aa, Artificial Sequence
  Description of Artificial Sequence: Synthetic peptide
  Seed: FYSNSTNSF (TYRP1_HUMAN)
FFSNSTNSW

SEQ ID NO: 170594 - protein, 10 aa, Artificial Sequence
  Description of Artificial Sequence: Synthetic peptide
  Seed: STFPLENAPI (TYRP1_HUMAN)
STFPLENAPW

SEQ ID NO: 170595 - protein, 11 aa, Artificial Sequence
  Description of Artificial Sequence: Synthetic peptide
  Seed: LVALIFGTASY (TYRP1_HUMAN)
LEALIFGTASY

SEQ ID NO: 170596 - protein, 10 aa, Artificial Sequence
  Description of Artificial Sequence: Synthetic peptide
  Seed: GLFDTPPFYS (TYRP1_HUMAN)
GQFDTPPFYV

SEQ ID NO: 170597 - protein, 10 aa, Artificial Sequence
  Description of Artificial Sequence: Synthetic peptide
  Seed: YNYFVWTHYY (TYRP1_HUMAN)
YPYFVWTHYF

SEQ ID NO: 170598 - protein, 11 aa, Artificial Sequence
  Description of Artificial Sequence: Synthetic peptide
  Seed: FENISIYNYFV (TYRP1_HUMAN)
FMNISIYNYFI

SEQ ID NO: 170599 - protein, 9 aa, Artificial Sequence
  Description of Artificial Sequence: Synthetic peptide
  Seed: DSRPHSPQY (TYRP1_HUMAN)
DTRPHSPQR

SEQ ID NO: 170600 - protein, 9 aa, Artificial Sequence
  Description of Artificial Sequence: Synthetic peptide
  Seed: LQNPNQSVV (TYRP1_HUMAN)
LINPNQSVM

SEQ ID NO: 170601 - protein, 9 aa, Artificial Sequence
  Description of Artificial Sequence: Synthetic peptide
  Seed: AVFDEWLRR (TYRP1_HUMAN)
AGFDEWLRY

SEQ ID NO: 170602 - protein, 9 aa, Artificial Sequence
  Description of Artificial Sequence: Synthetic peptide
  Seed: MSAPKLLSL (TYRP1_HUMAN)
MSAPKLLSY

SEQ ID NO: 170603 - protein, 9 aa, Artificial Sequence
  Description of Artificial Sequence: Synthetic peptide
  Seed: YSNSTNSFR (TYRP1_HUMAN)
YANSTNSFF

SEQ ID NO: 170604 - protein, 11 aa, Artificial Sequence
  Description of Artificial Sequence: Synthetic peptide
  Seed: LRRYNADISTF (TYRP1_HUMAN)
LQRYNADISTM

SEQ ID NO: 170605 - protein, 9 aa, Artificial Sequence
  Description of Artificial Sequence: Synthetic peptide
  Seed: DNLGYTYEI (TYRP1_HUMAN)
DVLGYTYEV

SEQ ID NO: 170606 - protein, 10 aa, Artificial Sequence
  Description of Artificial Sequence: Synthetic peptide
  Seed: SPNDPIFVLL (TYRP1_HUMAN)
SANDPIFVLY

SEQ ID NO: 170607 - protein, 11 aa, Artificial Sequence
  Description of Artificial Sequence: Synthetic peptide
  Seed: RRYNADISTFP (TYRP1_HUMAN)
RFYNADISTFF

SEQ ID NO: 170608 - protein, 10 aa, Artificial Sequence
  Description of Artificial Sequence: Synthetic peptide
  Seed: LLVALIFGTA (TYRP1_HUMAN)
LLVALIFGTI

SEQ ID NO: 170609 - protein, 9 aa, Artificial Sequence
  Description of Artificial Sequence: Synthetic peptide
  Seed: AIAVVGALL (TYRP1_HUMAN)
AMAVVGALL

SEQ ID NO: 170610 - protein, 10 aa, Artificial Sequence
  Description of Artificial Sequence: Synthetic peptide
  Seed: EGYSDPTGKY (TYRP1_HUMAN)
ETYSDPTGKY

SEQ ID NO: 170611 - protein, 9 aa, Artificial Sequence
  Description of Artificial Sequence: Synthetic peptide
  Seed: HLSPNDPIF (TYRP1_HUMAN)
HASPNDPIF

SEQ ID NO: 170612 - protein, 9 aa, Artificial Sequence
  Description of Artificial Sequence: Synthetic peptide
  Seed: SVKKTFLGV (TYRP1_HUMAN)
SIKKTFLGA

SEQ ID NO: 170613 - protein, 10 aa, Artificial Sequence
  Description of Artificial Sequence: Synthetic peptide
  Seed: FWPPVTNTEM (TYRP1_HUMAN)
FSPPVTNTEI

SEQ ID NO: 170614 - protein, 10 aa, Artificial Sequence
  Description of Artificial Sequence: Synthetic peptide
  Seed: VDFSHEGPAF (TYRP1_HUMAN)
VEFSHEGPAW

SEQ ID NO: 170615 - protein, 9 aa, Artificial Sequence
  Description of Artificial Sequence: Synthetic peptide
  Seed: KLQNPNQSV (TYRP1_HUMAN)
KMQNPNQSL

SEQ ID NO: 170616 - protein, 10 aa, Artificial Sequence
  Description of Artificial Sequence: Synthetic peptide
  Seed: FWPPVTNTEM (TYRP1_HUMAN)
FAPPVTNTEI

SEQ ID NO: 170617 - protein, 10 aa, Artificial Sequence
  Description of Artificial Sequence: Synthetic peptide
  Seed: RRNLLDLSKE (TYRP1_HUMAN)
RRNLLDLSKL

SEQ ID NO: 170618 - protein, 10 aa, Artificial Sequence
  Description of Artificial Sequence: Synthetic peptide
  Seed: QCYAEEYEKL (TYRP1_HUMAN)
QWYAEEYEKF

SEQ ID NO: 170619 - protein, 9 aa, Artificial Sequence
  Description of Artificial Sequence: Synthetic peptide
  Seed: QEMLQEPSF (TYRP1_HUMAN)
QEMLQEPST

SEQ ID NO: 170620 - protein, 10 aa, Artificial Sequence
  Description of Artificial Sequence: Synthetic peptide
  Seed: EIIAIAVVGA (TYRP1_HUMAN)
EGIAIAVVGI

SEQ ID NO: 170621 - protein, 9 aa, Artificial Sequence
  Description of Artificial Sequence: Synthetic peptide
  Seed: RQCATVEAL (TYRP1_HUMAN)
RMCATVEAI

SEQ ID NO: 170622 - protein, 10 aa, Artificial Sequence
  Description of Artificial Sequence: Synthetic peptide
  Seed: VALIFGTASY (TYRP1_HUMAN)
VNLIFGTASF

SEQ ID NO: 170623 - protein, 11 aa, Artificial Sequence
  Description of Artificial Sequence: Synthetic peptide
  Seed: WHRYHLLRLEK (TYRP1_HUMAN)
WRRYHLLRLEL

SEQ ID NO: 170624 - protein, 11 aa, Artificial Sequence
  Description of Artificial Sequence: Synthetic peptide
  Seed: YSDPTGKYDPA (TYRP1_HUMAN)
YIDPTGKYDPI

SEQ ID NO: 170625 - protein, 9 aa, Artificial Sequence
  Description of Artificial Sequence: Synthetic peptide
  Seed: IAIAVVGAL (TYRP1_HUMAN)
IQIAVVGAH

SEQ ID NO: 170626 - protein, 9 aa, Artificial Sequence
  Description of Artificial Sequence: Synthetic peptide
  Seed: TAPDNLGYT (TYRP1_HUMAN)
TIPDNLGYI

SEQ ID NO: 170627 - protein, 11 aa, Artificial Sequence
  Description of Artificial Sequence: Synthetic peptide
  Seed: RRYNADISTFP (TYRP1_HUMAN)
RYYNADISTFT

SEQ ID NO: 170628 - protein, 10 aa, Artificial Sequence
  Description of Artificial Sequence: Synthetic peptide
  Seed: ADSRPHSPQY (TYRP1_HUMAN)
AWSRPHSPQK

SEQ ID NO: 170629 - protein, 9 aa, Artificial Sequence
  Description of Artificial Sequence: Synthetic peptide
  Seed: RPMVQRLPE (TYRP1_HUMAN)
RPMVQRLPY

SEQ ID NO: 170630 - protein, 10 aa, Artificial Sequence
  Description of Artificial Sequence: Synthetic peptide
  Seed: YSVKKTFLGV (TYRP1_HUMAN)
YLVKKTFLGM

SEQ ID NO: 170631 - protein, 10 aa, Artificial Sequence
  Description of Artificial Sequence: Synthetic peptide
  Seed: GNVARPMVQR (TYRP1_HUMAN)
GQVARPMVQK

SEQ ID NO: 170632 - protein, 9 aa, Artificial Sequence
  Description of Artificial Sequence: Synthetic peptide
  Seed: ASYLIRARR (TYRP1_HUMAN)
ALYLIRARR

SEQ ID NO: 170633 - protein, 9 aa, Artificial Sequence
  Description of Artificial Sequence: Synthetic peptide
  Seed: QWRVVCDSL (TYRP1_HUMAN)
QWRVVCDSF

SEQ ID NO: 170634 - protein, 8 aa, Artificial Sequence
  Description of Artificial Sequence: Synthetic peptide
  Seed: YDPAVRSL (TYRP1_HUMAN)
YVPAVRSL

SEQ ID NO: 170635 - protein, 10 aa, Artificial Sequence
  Description of Artificial Sequence: Synthetic peptide
  Seed: YEIQWPSREF (TYRP1_HUMAN)
YQIQWPSREY

SEQ ID NO: 170636 - protein, 9 aa, Artificial Sequence
  Description of Artificial Sequence: Synthetic peptide
  Seed: GPAFLTWHR (TYRP1_HUMAN)
GSAFLTWHK

SEQ ID NO: 170637 - protein, 9 aa, Artificial Sequence
  Description of Artificial Sequence: Synthetic peptide
  Seed: SVKKTFLGV (TYRP1_HUMAN)
SAKKTFLGF

SEQ ID NO: 170638 - protein, 10 aa, Artificial Sequence
  Description of Artificial Sequence: Synthetic peptide
  Seed: MVPFWPPVTN (TYRP1_HUMAN)
MEPFWPPVTF

SEQ ID NO: 170639 - protein, 9 aa, Artificial Sequence
  Description of Artificial Sequence: Synthetic peptide
  Seed: IAVVGALLL (TYRP1_HUMAN)
ISVVGALLW

SEQ ID NO: 170640 - protein, 10 aa, Artificial Sequence
  Description of Artificial Sequence: Synthetic peptide
  Seed: ADSRPHSPQY (TYRP1_HUMAN)
ALSRPHSPQF

SEQ ID NO: 170641 - protein, 9 aa, Artificial Sequence
  Description of Artificial Sequence: Synthetic peptide
  Seed: MSAPKLLSL (TYRP1_HUMAN)
MPAPKLLSP

SEQ ID NO: 170642 - protein, 9 aa, Artificial Sequence
  Description of Artificial Sequence: Synthetic peptide
  Seed: VGQESFGEV (TYRP1_HUMAN)
VIQESFGEL

SEQ ID NO: 170643 - protein, 10 aa, Artificial Sequence
  Description of Artificial Sequence: Synthetic peptide
  Seed: RRYNADISTF (TYRP1_HUMAN)
RMYNADISTW

SEQ ID NO: 170644 - protein, 9 aa, Artificial Sequence
  Description of Artificial Sequence: Synthetic peptide
  Seed: RDDREVWPL (TYRP1_HUMAN)
REDREVWPV

SEQ ID NO: 170645 - protein, 10 aa, Artificial Sequence
  Description of Artificial Sequence: Synthetic peptide
  Seed: YNYFVWTHYY (TYRP1_HUMAN)
YAYFVWTHYW

SEQ ID NO: 170646 - protein, 10 aa, Artificial Sequence
  Description of Artificial Sequence: Synthetic peptide
  Seed: HFVRALDMAK (TYRP1_HUMAN)
HMVRALDMAR

SEQ ID NO: 170647 - protein, 9 aa, Artificial Sequence
  Description of Artificial Sequence: Synthetic peptide
  Seed: LHTFTDAVF (TYRP1_HUMAN)
LRTFTDAVY

SEQ ID NO: 170648 - protein, 10 aa, Artificial Sequence
  Description of Artificial Sequence: Synthetic peptide
  Seed: PSFSLPYWNF (TYRP1_HUMAN)
PYFSLPYWNW

SEQ ID NO: 170649 - protein, 9 aa, Artificial Sequence
  Description of Artificial Sequence: Synthetic peptide
  Seed: HRYHLLRLE (TYRP1_HUMAN)
HRYHLLRLV

SEQ ID NO: 170650 - protein, 10 aa, Artificial Sequence
  Description of Artificial Sequence: Synthetic peptide
  Seed: QEPSFSLPYW (TYRP1_HUMAN)
QFPSFSLPYW

SEQ ID NO: 170651 - protein, 9 aa, Artificial Sequence
  Description of Artificial Sequence: Synthetic peptide
  Seed: LSKEEKNHF (TYRP1_HUMAN)
LIKEEKNHY

SEQ ID NO: 170652 - protein, 9 aa, Artificial Sequence
  Description of Artificial Sequence: Synthetic peptide
  Seed: STLISPNSV (TYRP1_HUMAN)
SQLISPNSI

SEQ ID NO: 170653 - protein, 11 aa, Artificial Sequence
  Description of Artificial Sequence: Synthetic peptide
  Seed: AGNVARPMVQR (TYRP1_HUMAN)
AGNVARPMVQK

SEQ ID NO: 170654 - protein, 9 aa, Artificial Sequence
  Description of Artificial Sequence: Synthetic peptide
  Seed: IAVVGALLL (TYRP1_HUMAN)
IQVVGALLW

SEQ ID NO: 170655 - protein, 9 aa, Artificial Sequence
  Description of Artificial Sequence: Synthetic peptide
  Seed: ATRRSEEIL (TYRP1_HUMAN)
ASRRSEEIK

SEQ ID NO: 170656 - protein, 9 aa, Artificial Sequence
  Description of Artificial Sequence: Synthetic peptide
  Seed: RVLIVRRNL (TYRP1_HUMAN)
RTLIVRRNI

SEQ ID NO: 170657 - protein, 10 aa, Artificial Sequence
  Description of Artificial Sequence: Synthetic peptide
  Seed: FVTAPDNLGY (TYRP1_HUMAN)
FPTAPDNLGM

SEQ ID NO: 170658 - protein, 10 aa, Artificial Sequence
  Description of Artificial Sequence: Synthetic peptide
  Seed: SMDEANQPLL (TYRP1_HUMAN)
SIDEANQPLV

SEQ ID NO: 170659 - protein, 9 aa, Artificial Sequence
  Description of Artificial Sequence: Synthetic peptide
  Seed: LLVALIFGT (TYRP1_HUMAN)
LMVALIFGA

SEQ ID NO: 170660 - protein, 9 aa, Artificial Sequence
  Description of Artificial Sequence: Synthetic peptide
  Seed: EGYSDPTGK (TYRP1_HUMAN)
ESYSDPTGK

SEQ ID NO: 170661 - protein, 9 aa, Artificial Sequence
  Description of Artificial Sequence: Synthetic peptide
  Seed: SVPEIIAIA (TYRP1_HUMAN)
SLPEIIAIC

SEQ ID NO: 170662 - protein, 10 aa, Artificial Sequence
  Description of Artificial Sequence: Synthetic peptide
  Seed: FWPPVTNTEM (TYRP1_HUMAN)
FIPPVTNTEV

SEQ ID NO: 170663 - protein, 10 aa, Artificial Sequence
  Description of Artificial Sequence: Synthetic peptide
  Seed: MVPFWPPVTN (TYRP1_HUMAN)
MRPFWPPVTY

SEQ ID NO: 170664 - protein, 9 aa, Artificial Sequence
  Description of Artificial Sequence: Synthetic peptide
  Seed: YTYEIQWPS (TYRP1_HUMAN)
YMYEIQWPS

SEQ ID NO: 170665 - protein, 8 aa, Artificial Sequence
  Description of Artificial Sequence: Synthetic peptide
  Seed: YYSVKKTF (TYRP1_HUMAN)
YSSVKKTY

SEQ ID NO: 170666 - protein, 10 aa, Artificial Sequence
  Description of Artificial Sequence: Synthetic peptide
  Seed: FGTASYLIRA (TYRP1_HUMAN)
FSTASYLIRV

SEQ ID NO: 170667 - protein, 9 aa, Artificial Sequence
  Description of Artificial Sequence: Synthetic peptide
  Seed: YTYEIQWPS (TYRP1_HUMAN)
YNYEIQWPA

SEQ ID NO: 170668 - protein, 9 aa, Artificial Sequence
  Description of Artificial Sequence: Synthetic peptide
  Seed: DAVFDEWLR (TYRP1_HUMAN)
DMVFDEWLK

SEQ ID NO: 170669 - protein, 9 aa, Artificial Sequence
  Description of Artificial Sequence: Synthetic peptide
  Seed: VFDEWLRRY (TYRP1_HUMAN)
VGDEWLRRF

SEQ ID NO: 170670 - protein, 9 aa, Artificial Sequence
  Description of Artificial Sequence: Synthetic peptide
  Seed: FSHEGPAFL (TYRP1_HUMAN)
FGHEGPAFW

SEQ ID NO: 170671 - protein, 9 aa, Artificial Sequence
  Description of Artificial Sequence: Synthetic peptide
  Seed: GLFDTPPFY (TYRP1_HUMAN)
GSFDTPPFL

SEQ ID NO: 170672 - protein, 9 aa, Artificial Sequence
  Description of Artificial Sequence: Synthetic peptide
  Seed: RSNFDSTLI (TYRP1_HUMAN)
RINFDSTLF

SEQ ID NO: 170673 - protein, 9 aa, Artificial Sequence
  Description of Artificial Sequence: Synthetic peptide
  Seed: MLQEPSFSL (TYRP1_HUMAN)
MHQEPSFSF

SEQ ID NO: 170674 - protein, 10 aa, Artificial Sequence
  Description of Artificial Sequence: Synthetic peptide
  Seed: FVTAPDNLGY (TYRP1_HUMAN)
FQTAPDNLGY

SEQ ID NO: 170675 - protein, 11 aa, Artificial Sequence
  Description of Artificial Sequence: Synthetic peptide
  Seed: IAIAVVGALLL (TYRP1_HUMAN)
ITIAVVGALLF

SEQ ID NO: 170676 - protein, 9 aa, Artificial Sequence
  Description of Artificial Sequence: Synthetic peptide
  Seed: MAKRTTHPL (TYRP1_HUMAN)
MMKRTTHPF

SEQ ID NO: 170677 - protein, 11 aa, Artificial Sequence
  Description of Artificial Sequence: Synthetic peptide
  Seed: YNMVPFWPPVT (TYRP1_HUMAN)
YMMVPFWPPVP

SEQ ID NO: 170678 - protein, 9 aa, Artificial Sequence
  Description of Artificial Sequence: Synthetic peptide
  Seed: HEGPAFLTW (TYRP1_HUMAN)
HTGPAFLTW

SEQ ID NO: 170679 - protein, 9 aa, Artificial Sequence
  Description of Artificial Sequence: Synthetic peptide
  Seed: LPYWNFATG (TYRP1_HUMAN)
LPYWNFATL

SEQ ID NO: 170680 - protein, 9 aa, Artificial Sequence
  Description of Artificial Sequence: Synthetic peptide
  Seed: QEPSFSLPY (TYRP1_HUMAN)
QLPSFSLPF

SEQ ID NO: 170681 - protein, 9 aa, Artificial Sequence
  Description of Artificial Sequence: Synthetic peptide
  Seed: GEVDFSHEG (TYRP1_HUMAN)
GDVDFSHEL

SEQ ID NO: 170682 - protein, 9 aa, Artificial Sequence
  Description of Artificial Sequence: Synthetic peptide
  Seed: MAKRTTHPL (TYRP1_HUMAN)
MSKRTTHPV

SEQ ID NO: 170683 - protein, 11 aa, Artificial Sequence
  Description of Artificial Sequence: Synthetic peptide
  Seed: FLNGTGGQTHL (TYRP1_HUMAN)
FRNGTGGQTHF

SEQ ID NO: 170684 - protein, 9 aa, Artificial Sequence
  Description of Artificial Sequence: Synthetic peptide
  Seed: FVWTHYYSV (TYRP1_HUMAN)
FLWTHYYSA

SEQ ID NO: 170685 - protein, 11 aa, Artificial Sequence
  Description of Artificial Sequence: Synthetic peptide
  Seed: MLQEPSFSLPY (TYRP1_HUMAN)
MEQEPSFSLPF

SEQ ID NO: 170686 - protein, 9 aa, Artificial Sequence
  Description of Artificial Sequence: Synthetic peptide
  Seed: RFFNRTCHC (TYRP1_HUMAN)
RWFNRTCHL

SEQ ID NO: 170687 - protein, 10 aa, Artificial Sequence
  Description of Artificial Sequence: Synthetic peptide
  Seed: YNMVPFWPPV (TYRP1_HUMAN)
YQMVPFWPPI

SEQ ID NO: 170688 - protein, 11 aa, Artificial Sequence
  Description of Artificial Sequence: Synthetic peptide
  Seed: YNMVPFWPPVT (TYRP1_HUMAN)
YAMVPFWPPVV

SEQ ID NO: 170689 - protein, 9 aa, Artificial Sequence
  Description of Artificial Sequence: Synthetic peptide
  Seed: RYNADISTF (TYRP1_HUMAN)
RHNADISTF

SEQ ID NO: 170690 - protein, 9 aa, Artificial Sequence
  Description of Artificial Sequence: Synthetic peptide
  Seed: LPEPQDVAQ (TYRP1_HUMAN)
LPEPQDVAF

SEQ ID NO: 170691 - protein, 9 aa, Artificial Sequence
  Description of Artificial Sequence: Synthetic peptide
  Seed: RTCHCNGNF (TYRP1_HUMAN)
RMCHCNGNY

SEQ ID NO: 170692 - protein, 10 aa, Artificial Sequence
  Description of Artificial Sequence: Synthetic peptide
  Seed: VDFSHEGPAF (TYRP1_HUMAN)
VEFSHEGPAM

SEQ ID NO: 170693 - protein, 10 aa, Artificial Sequence
  Description of Artificial Sequence: Synthetic peptide
  Seed: TAPDNLGYTY (TYRP1_HUMAN)
TIPDNLGYTL

SEQ ID NO: 170694 - protein, 10 aa, Artificial Sequence
  Description of Artificial Sequence: Synthetic peptide
  Seed: LSLGCIFFPL (TYRP1_HUMAN)
LTLGCIFFPL

SEQ ID NO: 170695 - protein, 9 aa, Artificial Sequence
  Description of Artificial Sequence: Synthetic peptide
  Seed: SPNDPIFVL (TYRP1_HUMAN)
SINDPIFVM

SEQ ID NO: 170696 - protein, 9 aa, Artificial Sequence
  Description of Artificial Sequence: Synthetic peptide
  Seed: HEGPAFLTW (TYRP1_HUMAN)
HEGPAFLTS

SEQ ID NO: 170697 - protein, 9 aa, Artificial Sequence
  Description of Artificial Sequence: Synthetic peptide
  Seed: FTDAVFDEW (TYRP1_HUMAN)
FLDAVFDEI

SEQ ID NO: 170698 - protein, 9 aa, Artificial Sequence
  Description of Artificial Sequence: Synthetic peptide
  Seed: NYFVWTHYY (TYRP1_HUMAN)
NNFVWTHYR

SEQ ID NO: 170699 - protein, 9 aa, Artificial Sequence
  Description of Artificial Sequence: Synthetic peptide
  Seed: RFFNRTCHC (TYRP1_HUMAN)
RFFNRTCHI

SEQ ID NO: 170700 - protein, 9 aa, Artificial Sequence
  Description of Artificial Sequence: Synthetic peptide
  Seed: ISIYNYFVW (TYRP1_HUMAN)
IFIYNYFVI

SEQ ID NO: 170701 - protein, 9 aa, Artificial Sequence
  Description of Artificial Sequence: Synthetic peptide
  Seed: LLSLGCIFF (TYRP1_HUMAN)
LQSLGCIFY

SEQ ID NO: 170702 - protein, 9 aa, Artificial Sequence
  Description of Artificial Sequence: Synthetic peptide
  Seed: FTDAVFDEW (TYRP1_HUMAN)
FFDAVFDEV

SEQ ID NO: 170703 - protein, 9 aa, Artificial Sequence
  Description of Artificial Sequence: Synthetic peptide
  Seed: VRSLHNLAH (TYRP1_HUMAN)
VYSLHNLAF

SEQ ID NO: 170704 - protein, 9 aa, Artificial Sequence
  Description of Artificial Sequence: Synthetic peptide
  Seed: FLTWHRYHL (TYRP1_HUMAN)
FPTWHRYHF

SEQ ID NO: 170705 - protein, 9 aa, Artificial Sequence
  Description of Artificial Sequence: Synthetic peptide
  Seed: IAIAVVGAL (TYRP1_HUMAN)
IFIAVVGAM

SEQ ID NO: 170706 - protein, 10 aa, Artificial Sequence
  Description of Artificial Sequence: Synthetic peptide
  Seed: FSLPYWNFAT (TYRP1_HUMAN)
FLLPYWNFAS

SEQ ID NO: 170707 - protein, 10 aa, Artificial Sequence
  Description of Artificial Sequence: Synthetic peptide
  Seed: FSLPYWNFAT (TYRP1_HUMAN)
FHLPYWNFAM

SEQ ID NO: 170708 - protein, 9 aa, Artificial Sequence
  Description of Artificial Sequence: Synthetic peptide
  Seed: RARRSMDEA (TYRP1_HUMAN)
RQRRSMDEK

SEQ ID NO: 170709 - protein, 10 aa, Artificial Sequence
  Description of Artificial Sequence: Synthetic peptide
  Seed: MSAPKLLSLG (TYRP1_HUMAN)
MTAPKLLSLW

SEQ ID NO: 170710 - protein, 10 aa, Artificial Sequence
  Description of Artificial Sequence: Synthetic peptide
  Seed: YTYEIQWPSR (TYRP1_HUMAN)
YNYEIQWPSR

SEQ ID NO: 170711 - protein, 10 aa, Artificial Sequence
  Description of Artificial Sequence: Synthetic peptide
  Seed: FWPPVTNTEM (TYRP1_HUMAN)
FTPPVTNTEI

SEQ ID NO: 170712 - protein, 11 aa, Artificial Sequence
  Description of Artificial Sequence: Synthetic peptide
  Seed: YNMVPFWPPVT (TYRP1_HUMAN)
YLMVPFWPPVS

SEQ ID NO: 170713 - protein, 8 aa, Artificial Sequence
  Description of Artificial Sequence: Synthetic peptide
  Seed: KEEKNHFV (TYRP1_HUMAN)
KEEKNHFL

SEQ ID NO: 170714 - protein, 8 aa, Artificial Sequence
  Description of Artificial Sequence: Synthetic peptide
  Seed: YFVWTHYY (TYRP1_HUMAN)
YYVWTHYL

SEQ ID NO: 170715 - protein, 9 aa, Artificial Sequence
  Description of Artificial Sequence: Synthetic peptide
  Seed: RYNADISTF (TYRP1_HUMAN)
RRNADISTL

SEQ ID NO: 170716 - protein, 9 aa, Artificial Sequence
  Description of Artificial Sequence: Synthetic peptide
  Seed: SPNDPIFVL (TYRP1_HUMAN)
SFNDPIFVL

SEQ ID NO: 170717 - protein, 10 aa, Artificial Sequence
  Description of Artificial Sequence: Synthetic peptide
  Seed: HNCGTCRPGW (TYRP1_HUMAN)
HSCGTCRPGW

SEQ ID NO: 170718 - protein, 9 aa, Artificial Sequence
  Description of Artificial Sequence: Synthetic peptide
  Seed: RGRCEAVTA (TYRP1_HUMAN)
RSRCEAVTL

SEQ ID NO: 170719 - protein, 10 aa, Artificial Sequence
  Description of Artificial Sequence: Synthetic peptide
  Seed: FVLLHTFTDA (TYRP1_HUMAN)
FGLLHTFTDI

SEQ ID NO: 170720 - protein, 11 aa, Artificial Sequence
  Description of Artificial Sequence: Synthetic peptide
  Seed: FLNGTGGQTHL (TYRP1_HUMAN)
FANGTGGQTHL

SEQ ID NO: 170721 - protein, 9 aa, Artificial Sequence
  Description of Artificial Sequence: Synthetic peptide
  Seed: VFDEWLRRY (TYRP1_HUMAN)
VNDEWLRRL

SEQ ID NO: 170722 - protein, 9 aa, Artificial Sequence
  Description of Artificial Sequence: Synthetic peptide
  Seed: SPNDPIFVL (TYRP1_HUMAN)
SANDPIFVL

SEQ ID NO: 170723 - protein, 9 aa, Artificial Sequence
  Description of Artificial Sequence: Synthetic peptide
  Seed: SFRNTVEGY (TYRP1_HUMAN)
SQRNTVEGY

SEQ ID NO: 170724 - protein, 9 aa, Artificial Sequence
  Description of Artificial Sequence: Synthetic peptide
  Seed: YLIRARRSM (TYRP1_HUMAN)
YTIRARRSM

SEQ ID NO: 170725 - protein, 9 aa, Artificial Sequence
  Description of Artificial Sequence: Synthetic peptide
  Seed: FYSNSTNSF (TYRP1_HUMAN)
FPSNSTNSL

SEQ ID NO: 170726 - protein, 9 aa, Artificial Sequence
  Description of Artificial Sequence: Synthetic peptide
  Seed: NYFVWTHYY (TYRP1_HUMAN)
NAFVWTHYL

SEQ ID NO: 170727 - protein, 11 aa, Artificial Sequence
  Description of Artificial Sequence: Synthetic peptide
  Seed: VTAPDNLGYTY (TYRP1_HUMAN)
VTAPDNLGYTL

SEQ ID NO: 170728 - protein, 10 aa, Artificial Sequence
  Description of Artificial Sequence: Synthetic peptide
  Seed: YNMVPFWPPV (TYRP1_HUMAN)
YSMVPFWPPM

SEQ ID NO: 170729 - protein, 9 aa, Artificial Sequence
  Description of Artificial Sequence: Synthetic peptide
  Seed: APIGHNRQY (TYRP1_HUMAN)
AAIGHNRQY

SEQ ID NO: 170730 - protein, 9 aa, Artificial Sequence
  Description of Artificial Sequence: Synthetic peptide
  Seed: RVLIVRRNL (TYRP1_HUMAN)
RALIVRRNW

SEQ ID NO: 170731 - protein, 10 aa, Artificial Sequence
  Description of Artificial Sequence: Synthetic peptide
  Seed: GNVARPMVQR (TYRP1_HUMAN)
GTVARPMVQR

SEQ ID NO: 170732 - protein, 11 aa, Artificial Sequence
  Description of Artificial Sequence: Synthetic peptide
  Seed: MLQEPSFSLPY (TYRP1_HUMAN)
MEQEPSFSLPY

SEQ ID NO: 170733 - protein, 9 aa, Artificial Sequence
  Description of Artificial Sequence: Synthetic peptide
  Seed: MAKRTTHPL (TYRP1_HUMAN)
MIKRTTHPI

SEQ ID NO: 170734 - protein, 10 aa, Artificial Sequence
  Description of Artificial Sequence: Synthetic peptide
  Seed: VALIFGTASY (TYRP1_HUMAN)
VELIFGTASY

SEQ ID NO: 170735 - protein, 9 aa, Artificial Sequence
  Description of Artificial Sequence: Synthetic peptide
  Seed: FSLPYWNFA (TYRP1_HUMAN)
FALPYWNFV

SEQ ID NO: 170736 - protein, 10 aa, Artificial Sequence
  Description of Artificial Sequence: Synthetic peptide
  Seed: EVWPLRFFNR (TYRP1_HUMAN)
EYWPLRFFNR

SEQ ID NO: 170737 - protein, 9 aa, Artificial Sequence
  Description of Artificial Sequence: Synthetic peptide
  Seed: RQCATVEAL (TYRP1_HUMAN)
RSCATVEAL

SEQ ID NO: 170738 - protein, 10 aa, Artificial Sequence
  Description of Artificial Sequence: Synthetic peptide
  Seed: FTDAVFDEWL (TYRP1_HUMAN)
FLDAVFDEWM

SEQ ID NO: 170739 - protein, 10 aa, Artificial Sequence
  Description of Artificial Sequence: Synthetic peptide
  Seed: ADSRPHSPQY (TYRP1_HUMAN)
ANSRPHSPQA

SEQ ID NO: 170740 - protein, 10 aa, Artificial Sequence
  Description of Artificial Sequence: Synthetic peptide
  Seed: LQEPSFSLPY (TYRP1_HUMAN)
LYEPSFSLPY

SEQ ID NO: 170741 - protein, 10 aa, Artificial Sequence
  Description of Artificial Sequence: Synthetic peptide
  Seed: SVPEIIAIAV (TYRP1_HUMAN)
SLPEIIAIAI

SEQ ID NO: 170742 - protein, 10 aa, Artificial Sequence
  Description of Artificial Sequence: Synthetic peptide
  Seed: YNMVPFWPPV (TYRP1_HUMAN)
YVMVPFWPPL

SEQ ID NO: 170743 - protein, 8 aa, Artificial Sequence
  Description of Artificial Sequence: Synthetic peptide
  Seed: TEMFVTAP (TYRP1_HUMAN)
TEMFVTAM

SEQ ID NO: 170744 - protein, 9 aa, Artificial Sequence
  Description of Artificial Sequence: Synthetic peptide
  Seed: FVWTHYYSV (TYRP1_HUMAN)
FMWTHYYSY

SEQ ID NO: 170745 - protein, 8 aa, Artificial Sequence
  Description of Artificial Sequence: Synthetic peptide
  Seed: YSNSTNSF (TYRP1_HUMAN)
YKNSTNSF

SEQ ID NO: 170746 - protein, 10 aa, Artificial Sequence
  Description of Artificial Sequence: Synthetic peptide
  Seed: TASYLIRARR (TYRP1_HUMAN)
TCSYLIRARR

SEQ ID NO: 170747 - protein, 10 aa, Artificial Sequence
  Description of Artificial Sequence: Synthetic peptide
  Seed: SPNDPIFVLL (TYRP1_HUMAN)
STNDPIFVLV

SEQ ID NO: 170748 - protein, 10 aa, Artificial Sequence
  Description of Artificial Sequence: Synthetic peptide
  Seed: ADSRPHSPQY (TYRP1_HUMAN)
APSRPHSPQW

SEQ ID NO: 170749 - protein, 9 aa, Artificial Sequence
  Description of Artificial Sequence: Synthetic peptide
  Seed: LFQQARAQF (TYRP1_HUMAN)
LLQQARAQF

SEQ ID NO: 170750 - protein, 11 aa, Artificial Sequence
  Description of Artificial Sequence: Synthetic peptide
  Seed: YNMVPFWPPVT (TYRP1_HUMAN)
YTMVPFWPPVI

SEQ ID NO: 170751 - protein, 10 aa, Artificial Sequence
  Description of Artificial Sequence: Synthetic peptide
  Seed: ISIYNYFVWT (TYRP1_HUMAN)
ISIYNYFVWW

SEQ ID NO: 170752 - protein, 10 aa, Artificial Sequence
  Description of Artificial Sequence: Synthetic peptide
  Seed: GNVARPMVQR (TYRP1_HUMAN)
GMVARPMVQK

SEQ ID NO: 170753 - protein, 10 aa, Artificial Sequence
  Description of Artificial Sequence: Synthetic peptide
  Seed: EDYDTLGTLC (TYRP1_HUMAN)
EEYDTLGTLT

SEQ ID NO: 170754 - protein, 9 aa, Artificial Sequence
  Description of Artificial Sequence: Synthetic peptide
  Seed: FLTWHRYHL (TYRP1_HUMAN)
FSTWHRYHM

SEQ ID NO: 170755 - protein, 9 aa, Artificial Sequence
  Description of Artificial Sequence: Synthetic peptide
  Seed: YNYFVWTHY (TYRP1_HUMAN)
YCYFVWTHY

SEQ ID NO: 170756 - protein, 9 aa, Artificial Sequence
  Description of Artificial Sequence: Synthetic peptide
  Seed: RLEKDMQEM (TYRP1_HUMAN)
RIEKDMQEI

SEQ ID NO: 170757 - protein, 9 aa, Artificial Sequence
  Description of Artificial Sequence: Synthetic peptide
  Seed: RQCATVEAL (TYRP1_HUMAN)
RTCATVEAW

SEQ ID NO: 170758 - protein, 9 aa, Artificial Sequence
  Description of Artificial Sequence: Synthetic peptide
  Seed: VWPLRFFNR (TYRP1_HUMAN)
VIPLRFFNR

SEQ ID NO: 170759 - protein, 9 aa, Artificial Sequence
  Description of Artificial Sequence: Synthetic peptide
  Seed: FYSNSTNSF (TYRP1_HUMAN)
FQSNSTNSM

SEQ ID NO: 170760 - protein, 9 aa, Artificial Sequence
  Description of Artificial Sequence: Synthetic peptide
  Seed: AACDQRVLI (TYRP1_HUMAN)
ALCDQRVLF

SEQ ID NO: 170761 - protein, 9 aa, Artificial Sequence
  Description of Artificial Sequence: Synthetic peptide
  Seed: FLGVGQESF (TYRP1_HUMAN)
FWGVGQESM

SEQ ID NO: 170762 - protein, 10 aa, Artificial Sequence
  Description of Artificial Sequence: Synthetic peptide
  Seed: YTYEIQWPSR (TYRP1_HUMAN)
YYYEIQWPSR

SEQ ID NO: 170763 - protein, 11 aa, Artificial Sequence
  Description of Artificial Sequence: Synthetic peptide
  Seed: IYNYFVWTHYY (TYRP1_HUMAN)
IMNYFVWTHYY

SEQ ID NO: 170764 - protein, 10 aa, Artificial Sequence
  Description of Artificial Sequence: Synthetic peptide
  Seed: SQWRVVCDSL (TYRP1_HUMAN)
SRWRVVCDSL

SEQ ID NO: 170765 - protein, 11 aa, Artificial Sequence
  Description of Artificial Sequence: Synthetic peptide
  Seed: IYNYFVWTHYY (TYRP1_HUMAN)
IINYFVWTHYL

SEQ ID NO: 170766 - protein, 10 aa, Artificial Sequence
  Description of Artificial Sequence: Synthetic peptide
  Seed: IQWPSREFSV (TYRP1_HUMAN)
ILWPSREFSA

SEQ ID NO: 170767 - protein, 10 aa, Artificial Sequence
  Description of Artificial Sequence: Synthetic peptide
  Seed: WPPVTNTEMF (TYRP1_HUMAN)
WTPVTNTEMY

SEQ ID NO: 170768 - protein, 9 aa, Artificial Sequence
  Description of Artificial Sequence: Synthetic peptide
  Seed: GLFDTPPFY (TYRP1_HUMAN)
GSFDTPPFV

SEQ ID NO: 170769 - protein, 9 aa, Artificial Sequence
  Description of Artificial Sequence: Synthetic peptide
  Seed: TADSRPHSP (TYRP1_HUMAN)
TIDSRPHSV

SEQ ID NO: 170770 - protein, 9 aa, Artificial Sequence
  Description of Artificial Sequence: Synthetic peptide
  Seed: HLSPNDPIF (TYRP1_HUMAN)
HASPNDPIY

SEQ ID NO: 170771 - protein, 9 aa, Artificial Sequence
  Description of Artificial Sequence: Synthetic peptide
  Seed: FLTWHRYHL (TYRP1_HUMAN)
FPTWHRYHI

SEQ ID NO: 170772 - protein, 9 aa, Artificial Sequence
  Description of Artificial Sequence: Synthetic peptide
  Seed: SGRGRCEAV (TYRP1_HUMAN)
SLRGRCEAL

SEQ ID NO: 170773 - protein, 9 aa, Artificial Sequence
  Description of Artificial Sequence: Synthetic peptide
  Seed: GEVDFSHEG (TYRP1_HUMAN)
GEVDFSHEW

SEQ ID NO: 170774 - protein, 10 aa, Artificial Sequence
  Description of Artificial Sequence: Synthetic peptide
  Seed: KRTTHPLFVI (TYRP1_HUMAN)
KKTTHPLFVY

SEQ ID NO: 170775 - protein, 9 aa, Artificial Sequence
  Description of Artificial Sequence: Synthetic peptide
  Seed: RGRCEAVTA (TYRP1_HUMAN)
RSRCEAVTK

SEQ ID NO: 170776 - protein, 9 aa, Artificial Sequence
  Description of Artificial Sequence: Synthetic peptide
  Seed: FPRQCATVE (TYRP1_HUMAN)
FARQCATVL

SEQ ID NO: 170777 - protein, 9 aa, Artificial Sequence
  Description of Artificial Sequence: Synthetic peptide
  Seed: APIGHNRQY (TYRP1_HUMAN)
ASIGHNRQM

SEQ ID NO: 170778 - protein, 9 aa, Artificial Sequence
  Description of Artificial Sequence: Synthetic peptide
  Seed: TADSRPHSP (TYRP1_HUMAN)
TCDSRPHSV

SEQ ID NO: 170779 - protein, 10 aa, Artificial Sequence
  Description of Artificial Sequence: Synthetic peptide
  Seed: LGPDGNTPQF (TYRP1_HUMAN)
LQPDGNTPQL

SEQ ID NO: 170780 - protein, 9 aa, Artificial Sequence
  Description of Artificial Sequence: Synthetic peptide
  Seed: AKRTTHPLF (TYRP1_HUMAN)
AHRTTHPLY

SEQ ID NO: 170781 - protein, 9 aa, Artificial Sequence
  Description of Artificial Sequence: Synthetic peptide
  Seed: ENISIYNYF (TYRP1_HUMAN)
EQISIYNYF

SEQ ID NO: 170782 - protein, 9 aa, Artificial Sequence
  Description of Artificial Sequence: Synthetic peptide
  Seed: MCCPDLSPV (TYRP1_HUMAN)
MTCPDLSPL

SEQ ID NO: 170783 - protein, 9 aa, Artificial Sequence
  Description of Artificial Sequence: Synthetic peptide
  Seed: SMDEANQPL (TYRP1_HUMAN)
SWDEANQPL

SEQ ID NO: 170784 - protein, 9 aa, Artificial Sequence
  Description of Artificial Sequence: Synthetic peptide
  Seed: LIFGTASYL (TYRP1_HUMAN)
LIFGTASYA

SEQ ID NO: 170785 - protein, 9 aa, Artificial Sequence
  Description of Artificial Sequence: Synthetic peptide
  Seed: FSVPEIIAI (TYRP1_HUMAN)
FVVPEIIAT

SEQ ID NO: 170786 - protein, 9 aa, Artificial Sequence
  Description of Artificial Sequence: Synthetic peptide
  Seed: NISIYNYFV (TYRP1_HUMAN)
NMSIYNYFA

SEQ ID NO: 170787 - protein, 10 aa, Artificial Sequence
  Description of Artificial Sequence: Synthetic peptide
  Seed: FGTASYLIRA (TYRP1_HUMAN)
FDTASYLIRV

SEQ ID NO: 170788 - protein, 9 aa, Artificial Sequence
  Description of Artificial Sequence: Synthetic peptide
  Seed: YNYFVWTHY (TYRP1_HUMAN)
YLYFVWTHK

SEQ ID NO: 170789 - protein, 9 aa, Artificial Sequence
  Description of Artificial Sequence: Synthetic peptide
  Seed: QWPSREFSV (TYRP1_HUMAN)
QFPSREFSF

SEQ ID NO: 170790 - protein, 9 aa, Artificial Sequence
  Description of Artificial Sequence: Synthetic peptide
  Seed: FTDAVFDEW (TYRP1_HUMAN)
FIDAVFDEF

SEQ ID NO: 170791 - protein, 9 aa, Artificial Sequence
  Description of Artificial Sequence: Synthetic peptide
  Seed: FVRALDMAK (TYRP1_HUMAN)
FARALDMAR

SEQ ID NO: 170792 - protein, 10 aa, Artificial Sequence
  Description of Artificial Sequence: Synthetic peptide
  Seed: AVRSLHNLAH (TYRP1_HUMAN)
ASRSLHNLAI

SEQ ID NO: 170793 - protein, 9 aa, Artificial Sequence
  Description of Artificial Sequence: Synthetic peptide
  Seed: IAIAVVGAL (TYRP1_HUMAN)
IIIAVVGAF

SEQ ID NO: 170794 - protein, 9 aa, Artificial Sequence
  Description of Artificial Sequence: Synthetic peptide
  Seed: LVALIFGTA (TYRP1_HUMAN)
LMALIFGTL

SEQ ID NO: 170795 - protein, 9 aa, Artificial Sequence
  Description of Artificial Sequence: Synthetic peptide
  Seed: IAIAVVGAL (TYRP1_HUMAN)
IKIAVVGAF

SEQ ID NO: 170796 - protein, 9 aa, Artificial Sequence
  Description of Artificial Sequence: Synthetic peptide
  Seed: RFFNRTCHC (TYRP1_HUMAN)
RSFNRTCHY

SEQ ID NO: 170797 - protein, 10 aa, Artificial Sequence
  Description of Artificial Sequence: Synthetic peptide
  Seed: RTTHPLFVIA (TYRP1_HUMAN)
RCTHPLFVIA

SEQ ID NO: 170798 - protein, 9 aa, Artificial Sequence
  Description of Artificial Sequence: Synthetic peptide
  Seed: TLISPNSVF (TYRP1_HUMAN)
TAISPNSVF

SEQ ID NO: 170799 - protein, 9 aa, Artificial Sequence
  Description of Artificial Sequence: Synthetic peptide
  Seed: IIAIAVVGA (TYRP1_HUMAN)
IVAIAVVGL

SEQ ID NO: 170800 - protein, 10 aa, Artificial Sequence
  Description of Artificial Sequence: Synthetic peptide
  Seed: KLLSLGCIFF (TYRP1_HUMAN)
KILSLGCIFY

SEQ ID NO: 170801 - protein, 9 aa, Artificial Sequence
  Description of Artificial Sequence: Synthetic peptide
  Seed: FSHEGPAFL (TYRP1_HUMAN)
FGHEGPAFM

SEQ ID NO: 170802 - protein, 9 aa, Artificial Sequence
  Description of Artificial Sequence: Synthetic peptide
  Seed: FTDAVFDEW (TYRP1_HUMAN)
FPDAVFDEY

SEQ ID NO: 170803 - protein, 9 aa, Artificial Sequence
  Description of Artificial Sequence: Synthetic peptide
  Seed: SPNDPIFVL (TYRP1_HUMAN)
SPNDPIFVF

SEQ ID NO: 170804 - protein, 9 aa, Artificial Sequence
  Description of Artificial Sequence: Synthetic peptide
  Seed: LFDTPPFYS (TYRP1_HUMAN)
LADTPPFYM

SEQ ID NO: 170805 - protein, 9 aa, Artificial Sequence
  Description of Artificial Sequence: Synthetic peptide
  Seed: SLHNLAHLF (TYRP1_HUMAN)
SMHNLAHLW

SEQ ID NO: 170806 - protein, 11 aa, Artificial Sequence
  Description of Artificial Sequence: Synthetic peptide
  Seed: RSLHNLAHLFL (TYRP1_HUMAN)
RTLHNLAHLFY

SEQ ID NO: 170807 - protein, 10 aa, Artificial Sequence
  Description of Artificial Sequence: Synthetic peptide
  Seed: RSMDEANQPL (TYRP1_HUMAN)
RSMDEANQPV

SEQ ID NO: 170808 - protein, 9 aa, Artificial Sequence
  Description of Artificial Sequence: Synthetic peptide
  Seed: LIFGTASYL (TYRP1_HUMAN)
LTFGTASYI

SEQ ID NO: 170809 - protein, 10 aa, Artificial Sequence
  Description of Artificial Sequence: Synthetic peptide
  Seed: FSLPYWNFAT (TYRP1_HUMAN)
FELPYWNFAV

SEQ ID NO: 170810 - protein, 10 aa, Artificial Sequence
  Description of Artificial Sequence: Synthetic peptide
  Seed: FLTWHRYHLL (TYRP1_HUMAN)
FGTWHRYHLV

SEQ ID NO: 170811 - protein, 11 aa, Artificial Sequence
  Description of Artificial Sequence: Synthetic peptide
  Seed: EVWPLRFFNRT (TYRP1_HUMAN)
EMWPLRFFNRR

SEQ ID NO: 170812 - protein, 9 aa, Artificial Sequence
  Description of Artificial Sequence: Synthetic peptide
  Seed: FPLENAPIG (TYRP1_HUMAN)
FPLENAPIW

SEQ ID NO: 170813 - protein, 10 aa, Artificial Sequence
  Description of Artificial Sequence: Synthetic peptide
  Seed: NYFVWTHYYS (TYRP1_HUMAN)
NFFVWTHYYS

SEQ ID NO: 170814 - protein, 9 aa, Artificial Sequence
  Description of Artificial Sequence: Synthetic peptide
  Seed: RRNPAGNVA (TYRP1_HUMAN)
RRNPAGNVI

SEQ ID NO: 170815 - protein, 10 aa, Artificial Sequence
  Description of Artificial Sequence: Synthetic peptide
  Seed: AVFDEWLRRY (TYRP1_HUMAN)
AFFDEWLRRR

SEQ ID NO: 170816 - protein, 10 aa, Artificial Sequence
  Description of Artificial Sequence: Synthetic peptide
  Seed: AVFDEWLRRY (TYRP1_HUMAN)
AVFDEWLRRR

SEQ ID NO: 170817 - protein, 9 aa, Artificial Sequence
  Description of Artificial Sequence: Synthetic peptide
  Seed: FVWTHYYSV (TYRP1_HUMAN)
FTWTHYYSY

SEQ ID NO: 170818 - protein, 9 aa, Artificial Sequence
  Description of Artificial Sequence: Synthetic peptide
  Seed: RVLIVRRNL (TYRP1_HUMAN)
RTLIVRRNK

SEQ ID NO: 170819 - protein, 10 aa, Artificial Sequence
  Description of Artificial Sequence: Synthetic peptide
  Seed: YNADISTFPL (TYRP1_HUMAN)
YYADISTFPM

SEQ ID NO: 170820 - protein, 9 aa, Artificial Sequence
  Description of Artificial Sequence: Synthetic peptide
  Seed: ALIFGTASY (TYRP1_HUMAN)
AAIFGTASK

SEQ ID NO: 170821 - protein, 9 aa, Artificial Sequence
  Description of Artificial Sequence: Synthetic peptide
  Seed: EGYSDPTGK (TYRP1_HUMAN)
EAYSDPTGK

SEQ ID NO: 170822 - protein, 9 aa, Artificial Sequence
  Description of Artificial Sequence: Synthetic peptide
  Seed: HYYSVKKTF (TYRP1_HUMAN)
HTYSVKKTL

SEQ ID NO: 170823 - protein, 9 aa, Artificial Sequence
  Description of Artificial Sequence: Synthetic peptide
  Seed: LIFGTASYL (TYRP1_HUMAN)
LVFGTASYK

SEQ ID NO: 170824 - protein, 8 aa, Artificial Sequence
  Description of Artificial Sequence: Synthetic peptide
  Seed: YDPAVRSL (TYRP1_HUMAN)
YTPAVRSL

SEQ ID NO: 170825 - protein, 11 aa, Artificial Sequence
  Description of Artificial Sequence: Synthetic peptide
  Seed: IAIAVVGALLL (TYRP1_HUMAN)
IAIAVVGALLW

SEQ ID NO: 170826 - protein, 9 aa, Artificial Sequence
  Description of Artificial Sequence: Synthetic peptide
  Seed: SLGCIFFPL (TYRP1_HUMAN)
SQGCIFFPM

SEQ ID NO: 170827 - protein, 11 aa, Artificial Sequence
  Description of Artificial Sequence: Synthetic peptide
  Seed: YNMVPFWPPVT (TYRP1_HUMAN)
YVMVPFWPPVA

SEQ ID NO: 170828 - protein, 10 aa, Artificial Sequence
  Description of Artificial Sequence: Synthetic peptide
  Seed: LTWHRYHLLR (TYRP1_HUMAN)
LVWHRYHLLK

SEQ ID NO: 170829 - protein, 10 aa, Artificial Sequence
  Description of Artificial Sequence: Synthetic peptide
  Seed: KLLSLGCIFF (TYRP1_HUMAN)
KMLSLGCIFY

SEQ ID NO: 170830 - protein, 10 aa, Artificial Sequence
  Description of Artificial Sequence: Synthetic peptide
  Seed: HPLFVIATRR (TYRP1_HUMAN)
HTLFVIATRM

SEQ ID NO: 170831 - protein, 9 aa, Artificial Sequence
  Description of Artificial Sequence: Synthetic peptide
  Seed: ALIFGTASY (TYRP1_HUMAN)
AYIFGTASY

SEQ ID NO: 170832 - protein, 10 aa, Artificial Sequence
  Description of Artificial Sequence: Synthetic peptide
  Seed: FPLLLFQQAR (TYRP1_HUMAN)
FPLLLFQQAV

SEQ ID NO: 170833 - protein, 9 aa, Artificial Sequence
  Description of Artificial Sequence: Synthetic peptide
  Seed: QCATVEALR (TYRP1_HUMAN)
QVATVEALR

SEQ ID NO: 170834 - protein, 9 aa, Artificial Sequence
  Description of Artificial Sequence: Synthetic peptide
  Seed: ENAPIGHNR (TYRP1_HUMAN)
EVAPIGHNM

SEQ ID NO: 170835 - protein, 10 aa, Artificial Sequence
  Description of Artificial Sequence: Synthetic peptide
  Seed: MSAPKLLSLG (TYRP1_HUMAN)
MSAPKLLSLM

SEQ ID NO: 170836 - protein, 9 aa, Artificial Sequence
  Description of Artificial Sequence: Synthetic peptide
  Seed: TADSRPHSP (TYRP1_HUMAN)
TQDSRPHSV

SEQ ID NO: 170837 - protein, 9 aa, Artificial Sequence
  Description of Artificial Sequence: Synthetic peptide
  Seed: YYSVKKTFL (TYRP1_HUMAN)
YASVKKTFM

SEQ ID NO: 170838 - protein, 9 aa, Artificial Sequence
  Description of Artificial Sequence: Synthetic peptide
  Seed: PNDPIFVLL (TYRP1_HUMAN)
PTDPIFVLL

SEQ ID NO: 170839 - protein, 9 aa, Artificial Sequence
  Description of Artificial Sequence: Synthetic peptide
  Seed: YNYFVWTHY (TYRP1_HUMAN)
YSYFVWTHV

SEQ ID NO: 170840 - protein, 10 aa, Artificial Sequence
  Description of Artificial Sequence: Synthetic peptide
  Seed: ADSRPHSPQY (TYRP1_HUMAN)
AESRPHSPQF

SEQ ID NO: 170841 - protein, 8 aa, Artificial Sequence
  Description of Artificial Sequence: Synthetic peptide
  Seed: YSDPTGKY (TYRP1_HUMAN)
YADPTGKI

SEQ ID NO: 170842 - protein, 10 aa, Artificial Sequence
  Description of Artificial Sequence: Synthetic peptide
  Seed: FSVPEIIAIA (TYRP1_HUMAN)
FLVPEIIAIV

SEQ ID NO: 170843 - protein, 9 aa, Artificial Sequence
  Description of Artificial Sequence: Synthetic peptide
  Seed: AVVGALLLV (TYRP1_HUMAN)
AMVGALLLA

SEQ ID NO: 170844 - protein, 9 aa, Artificial Sequence
  Description of Artificial Sequence: Synthetic peptide
  Seed: SVFSQWRVV (TYRP1_HUMAN)
SQFSQWRVV

SEQ ID NO: 170845 - protein, 9 aa, Artificial Sequence
  Description of Artificial Sequence: Synthetic peptide
  Seed: FENISIYNY (TYRP1_HUMAN)
FENISIYNM

SEQ ID NO: 170846 - protein, 9 aa, Artificial Sequence
  Description of Artificial Sequence: Synthetic peptide
  Seed: DFSHEGPAF (TYRP1_HUMAN)
DMSHEGPAF

SEQ ID NO: 170847 - protein, 9 aa, Artificial Sequence
  Description of Artificial Sequence: Synthetic peptide
  Seed: RQYNMVPFW (TYRP1_HUMAN)
RMYNMVPFI

SEQ ID NO: 170848 - protein, 11 aa, Artificial Sequence
  Description of Artificial Sequence: Synthetic peptide
  Seed: RRYNADISTFP (TYRP1_HUMAN)
RYYNADISTFA

SEQ ID NO: 170849 - protein, 9 aa, Artificial Sequence
  Description of Artificial Sequence: Synthetic peptide
  Seed: RYHLLRLEK (TYRP1_HUMAN)
RAHLLRLEK

SEQ ID NO: 170850 - protein, 10 aa, Artificial Sequence
  Description of Artificial Sequence: Synthetic peptide
  Seed: SIYNYFVWTH (TYRP1_HUMAN)
SNYNYFVWTK

SEQ ID NO: 170851 - protein, 9 aa, Artificial Sequence
  Description of Artificial Sequence: Synthetic peptide
  Seed: ISIYNYFVW (TYRP1_HUMAN)
ITIYNYFVY

SEQ ID NO: 170852 - protein, 9 aa, Artificial Sequence
  Description of Artificial Sequence: Synthetic peptide
  Seed: REFSVPEII (TYRP1_HUMAN)
RVFSVPEIM

SEQ ID NO: 170853 - protein, 10 aa, Artificial Sequence
  Description of Artificial Sequence: Synthetic peptide
  Seed: GMCCPDLSPV (TYRP1_HUMAN)
GMCCPDLSPI

SEQ ID NO: 170854 - protein, 11 aa, Artificial Sequence
  Description of Artificial Sequence: Synthetic peptide
  Seed: YNYFVWTHYYS (TYRP1_HUMAN)
YDYFVWTHYYY

SEQ ID NO: 170855 - protein, 9 aa, Artificial Sequence
  Description of Artificial Sequence: Synthetic peptide
  Seed: VVGALLLVA (TYRP1_HUMAN)
VMGALLLVI

SEQ ID NO: 170856 - protein, 9 aa, Artificial Sequence
  Description of Artificial Sequence: Synthetic peptide
  Seed: KYDPAVRSL (TYRP1_HUMAN)
KSDPAVRSY

SEQ ID NO: 170857 - protein, 9 aa, Artificial Sequence
  Description of Artificial Sequence: Synthetic peptide
  Seed: PNDPIFVLL (TYRP1_HUMAN)
PADPIFVLV

SEQ ID NO: 170858 - protein, 9 aa, Artificial Sequence
  Description of Artificial Sequence: Synthetic peptide
  Seed: YTYEIQWPS (TYRP1_HUMAN)
YQYEIQWPC

SEQ ID NO: 170859 - protein, 9 aa, Artificial Sequence
  Description of Artificial Sequence: Synthetic peptide
  Seed: MSAPKLLSL (TYRP1_HUMAN)
MEAPKLLSI

SEQ ID NO: 170860 - protein, 9 aa, Artificial Sequence
  Description of Artificial Sequence: Synthetic peptide
  Seed: FLGVGQESF (TYRP1_HUMAN)
FKGVGQESF

SEQ ID NO: 170861 - protein, 8 aa, Artificial Sequence
  Description of Artificial Sequence: Synthetic peptide
  Seed: RPMVQRLP (TYRP1_HUMAN)
RPMVQRLV

SEQ ID NO: 170862 - protein, 11 aa, Artificial Sequence
  Description of Artificial Sequence: Synthetic peptide
  Seed: FVLLHTFTDAV (TYRP1_HUMAN)
FYLLHTFTDAV

SEQ ID NO: 170863 - protein, 9 aa, Artificial Sequence
  Description of Artificial Sequence: Synthetic peptide
  Seed: RYNADISTF (TYRP1_HUMAN)
RFNADISTI

SEQ ID NO: 170864 - protein, 10 aa, Artificial Sequence
  Description of Artificial Sequence: Synthetic peptide
  Seed: LSLGCIFFPL (TYRP1_HUMAN)
LWLGCIFFPI

SEQ ID NO: 170865 - protein, 10 aa, Artificial Sequence
  Description of Artificial Sequence: Synthetic peptide
  Seed: FWPPVTNTEM (TYRP1_HUMAN)
FMPPVTNTEF

SEQ ID NO: 170866 - protein, 9 aa, Artificial Sequence
  Description of Artificial Sequence: Synthetic peptide
  Seed: ALIFGTASY (TYRP1_HUMAN)
ATIFGTASI

SEQ ID NO: 170867 - protein, 10 aa, Artificial Sequence
  Description of Artificial Sequence: Synthetic peptide
  Seed: YNYFVWTHYY (TYRP1_HUMAN)
YKYFVWTHYK

SEQ ID NO: 170868 - protein, 10 aa, Artificial Sequence
  Description of Artificial Sequence: Synthetic peptide
  Seed: LLHTFTDAVF (TYRP1_HUMAN)
LQHTFTDAVF

SEQ ID NO: 170869 - protein, 9 aa, Artificial Sequence
  Description of Artificial Sequence: Synthetic peptide
  Seed: MLQEPSFSL (TYRP1_HUMAN)
MAQEPSFSM

SEQ ID NO: 170870 - protein, 10 aa, Artificial Sequence
  Description of Artificial Sequence: Synthetic peptide
  Seed: AQFPRQCATV (TYRP1_HUMAN)
AHFPRQCATF

SEQ ID NO: 170871 - protein, 9 aa, Artificial Sequence
  Description of Artificial Sequence: Synthetic peptide
  Seed: AQFPRQCAT (TYRP1_HUMAN)
AEFPRQCAT

SEQ ID NO: 170872 - protein, 9 aa, Artificial Sequence
  Description of Artificial Sequence: Synthetic peptide
  Seed: SLGCIFFPL (TYRP1_HUMAN)
SMGCIFFPM

SEQ ID NO: 170873 - protein, 10 aa, Artificial Sequence
  Description of Artificial Sequence: Synthetic peptide
  Seed: YNMVPFWPPV (TYRP1_HUMAN)
YTMVPFWPPA

SEQ ID NO: 170874 - protein, 9 aa, Artificial Sequence
  Description of Artificial Sequence: Synthetic peptide
  Seed: SVFSQWRVV (TYRP1_HUMAN)
SAFSQWRVY

SEQ ID NO: 170875 - protein, 9 aa, Artificial Sequence
  Description of Artificial Sequence: Synthetic peptide
  Seed: EGYSDPTGK (TYRP1_HUMAN)
ETYSDPTGK

SEQ ID NO: 170876 - protein, 10 aa, Artificial Sequence
  Description of Artificial Sequence: Synthetic peptide
  Seed: LPYWNFATGK (TYRP1_HUMAN)
LRYWNFATGK

SEQ ID NO: 170877 - protein, 10 aa, Artificial Sequence
  Description of Artificial Sequence: Synthetic peptide
  Seed: RVVCDSLEDY (TYRP1_HUMAN)
RTVCDSLEDF

SEQ ID NO: 170878 - protein, 9 aa, Artificial Sequence
  Description of Artificial Sequence: Synthetic peptide
  Seed: TLISPNSVF (TYRP1_HUMAN)
TWISPNSVY

SEQ ID NO: 170879 - protein, 11 aa, Artificial Sequence
  Description of Artificial Sequence: Synthetic peptide
  Seed: VRSLHNLAHLF (TYRP1_HUMAN)
VMSLHNLAHLW

SEQ ID NO: 170880 - protein, 10 aa, Artificial Sequence
  Description of Artificial Sequence: Synthetic peptide
  Seed: ADSRPHSPQY (TYRP1_HUMAN)
AVSRPHSPQI

SEQ ID NO: 170881 - protein, 10 aa, Artificial Sequence
  Description of Artificial Sequence: Synthetic peptide
  Seed: LGPDGNTPQF (TYRP1_HUMAN)
LGPDGNTPQY

SEQ ID NO: 170882 - protein, 9 aa, Artificial Sequence
  Description of Artificial Sequence: Synthetic peptide
  Seed: IYNYFVWTH (TYRP1_HUMAN)
IANYFVWTR

SEQ ID NO: 170883 - protein, 9 aa, Artificial Sequence
  Description of Artificial Sequence: Synthetic peptide
  Seed: REFSVPEII (TYRP1_HUMAN)
RIFSVPEIW

SEQ ID NO: 170884 - protein, 10 aa, Artificial Sequence
  Description of Artificial Sequence: Synthetic peptide
  Seed: WPPVTNTEMF (TYRP1_HUMAN)
WLPVTNTEMW

SEQ ID NO: 170885 - protein, 10 aa, Artificial Sequence
  Description of Artificial Sequence: Synthetic peptide
  Seed: SPNDPIFVLL (TYRP1_HUMAN)
SSNDPIFVLM

SEQ ID NO: 170886 - protein, 10 aa, Artificial Sequence
  Description of Artificial Sequence: Synthetic peptide
  Seed: MSAPKLLSLG (TYRP1_HUMAN)
MAAPKLLSLY

SEQ ID NO: 170887 - protein, 9 aa, Artificial Sequence
  Description of Artificial Sequence: Synthetic peptide
  Seed: MLQEPSFSL (TYRP1_HUMAN)
MIQEPSFSV

SEQ ID NO: 170888 - protein, 9 aa, Artificial Sequence
  Description of Artificial Sequence: Synthetic peptide
  Seed: AQFPRQCAT (TYRP1_HUMAN)
AIFPRQCAF

SEQ ID NO: 170889 - protein, 11 aa, Artificial Sequence
  Description of Artificial Sequence: Synthetic peptide
  Seed: REVWPLRFFNR (TYRP1_HUMAN)
RQVWPLRFFNR

SEQ ID NO: 170890 - protein, 11 aa, Artificial Sequence
  Description of Artificial Sequence: Synthetic peptide
  Seed: YNMVPFWPPVT (TYRP1_HUMAN)
YIMVPFWPPVV

SEQ ID NO: 170891 - protein, 9 aa, Artificial Sequence
  Description of Artificial Sequence: Synthetic peptide
  Seed: KLQNPNQSV (TYRP1_HUMAN)
KQQNPNQSM

SEQ ID NO: 170892 - protein, 11 aa, Artificial Sequence
  Description of Artificial Sequence: Synthetic peptide
  Seed: VLLHTFTDAVF (TYRP1_HUMAN)
VQLHTFTDAVF

SEQ ID NO: 170893 - protein, 10 aa, Artificial Sequence
  Description of Artificial Sequence: Synthetic peptide
  Seed: YNMVPFWPPV (TYRP1_HUMAN)
YNMVPFWPPM

SEQ ID NO: 170894 - protein, 10 aa, Artificial Sequence
  Description of Artificial Sequence: Synthetic peptide
  Seed: FSVPEIIAIA (TYRP1_HUMAN)
FAVPEIIAII

SEQ ID NO: 170895 - protein, 9 aa, Artificial Sequence
  Description of Artificial Sequence: Synthetic peptide
  Seed: ISIYNYFVW (TYRP1_HUMAN)
IWIYNYFVV

SEQ ID NO: 170896 - protein, 9 aa, Artificial Sequence
  Description of Artificial Sequence: Synthetic peptide
  Seed: HEGPAFLTW (TYRP1_HUMAN)
HHGPAFLTC

SEQ ID NO: 170897 - protein, 9 aa, Artificial Sequence
  Description of Artificial Sequence: Synthetic peptide
  Seed: SLGCIFFPL (TYRP1_HUMAN)
SLGCIFFPR

SEQ ID NO: 170898 - protein, 9 aa, Artificial Sequence
  Description of Artificial Sequence: Synthetic peptide
  Seed: ALLLVALIF (TYRP1_HUMAN)
AMLLVALIF

SEQ ID NO: 170899 - protein, 9 aa, Artificial Sequence
  Description of Artificial Sequence: Synthetic peptide
  Seed: GPAFLTWHR (TYRP1_HUMAN)
GAAFLTWHR

SEQ ID NO: 170900 - protein, 9 aa, Artificial Sequence
  Description of Artificial Sequence: Synthetic peptide
  Seed: YLIRARRSM (TYRP1_HUMAN)
YMIRARRSV

SEQ ID NO: 170901 - protein, 10 aa, Artificial Sequence
  Description of Artificial Sequence: Synthetic peptide
  Seed: YNYFVWTHYY (TYRP1_HUMAN)
YRYFVWTHYL

SEQ ID NO: 170902 - protein, 9 aa, Artificial Sequence
  Description of Artificial Sequence: Synthetic peptide
  Seed: FSLPYWNFA (TYRP1_HUMAN)
FGLPYWNFV

SEQ ID NO: 170903 - protein, 8 aa, Artificial Sequence
  Description of Artificial Sequence: Synthetic peptide
  Seed: RQYNMVPF (TYRP1_HUMAN)
RQYNMVPM

SEQ ID NO: 170904 - protein, 9 aa, Artificial Sequence
  Description of Artificial Sequence: Synthetic peptide
  Seed: FVWTHYYSV (TYRP1_HUMAN)
FVWTHYYSF

SEQ ID NO: 170905 - protein, 9 aa, Artificial Sequence
  Description of Artificial Sequence: Synthetic peptide
  Seed: VTAPDNLGY (TYRP1_HUMAN)
VAAPDNLGF

SEQ ID NO: 170906 - protein, 8 aa, Artificial Sequence
  Description of Artificial Sequence: Synthetic peptide
  Seed: AQFPRQCA (TYRP1_HUMAN)
AQFPRQCV

SEQ ID NO: 170907 - protein, 9 aa, Artificial Sequence
  Description of Artificial Sequence: Synthetic peptide
  Seed: VGLFDTPPF (TYRP1_HUMAN)
VHLFDTPPF

SEQ ID NO: 170908 - protein, 8 aa, Artificial Sequence
  Description of Artificial Sequence: Synthetic peptide
  Seed: IQWPSREF (TYRP1_HUMAN)
IQWPSREV

SEQ ID NO: 170909 - protein, 9 aa, Artificial Sequence
  Description of Artificial Sequence: Synthetic peptide
  Seed: FLGVGQESF (TYRP1_HUMAN)
FYGVGQESM

SEQ ID NO: 170910 - protein, 9 aa, Artificial Sequence
  Description of Artificial Sequence: Synthetic peptide
  Seed: PNDPIFVLL (TYRP1_HUMAN)
PSDPIFVLL

SEQ ID NO: 170911 - protein, 9 aa, Artificial Sequence
  Description of Artificial Sequence: Synthetic peptide
  Seed: AKRTTHPLF (TYRP1_HUMAN)
AVRTTHPLF

SEQ ID NO: 170912 - protein, 10 aa, Artificial Sequence
  Description of Artificial Sequence: Synthetic peptide
  Seed: SHEGPAFLTW (TYRP1_HUMAN)
SEEGPAFLTW

SEQ ID NO: 170913 - protein, 10 aa, Artificial Sequence
  Description of Artificial Sequence: Synthetic peptide
  Seed: FYSNSTNSFR (TYRP1_HUMAN)
FMSNSTNSFK

SEQ ID NO: 170914 - protein, 9 aa, Artificial Sequence
  Description of Artificial Sequence: Synthetic peptide
  Seed: FYSNSTNSF (TYRP1_HUMAN)
FMSNSTNSW

SEQ ID NO: 170915 - protein, 9 aa, Artificial Sequence
  Description of Artificial Sequence: Synthetic peptide
  Seed: KEEKNHFVR (TYRP1_HUMAN)
KEEKNHFVF

SEQ ID NO: 170916 - protein, 10 aa, Artificial Sequence
  Description of Artificial Sequence: Synthetic peptide
  Seed: ALIFGTASYL (TYRP1_HUMAN)
AMIFGTASYQ

SEQ ID NO: 170917 - protein, 10 aa, Artificial Sequence
  Description of Artificial Sequence: Synthetic peptide
  Seed: DISTFPLENA (TYRP1_HUMAN)
DTSTFPLENI

SEQ ID NO: 170918 - protein, 9 aa, Artificial Sequence
  Description of Artificial Sequence: Synthetic peptide
  Seed: FTDAVFDEW (TYRP1_HUMAN)
FIDAVFDEM

SEQ ID NO: 170919 - protein, 9 aa, Artificial Sequence
  Description of Artificial Sequence: Synthetic peptide
  Seed: RFFNRTCHC (TYRP1_HUMAN)
RAFNRTCHI

SEQ ID NO: 170920 - protein, 10 aa, Artificial Sequence
  Description of Artificial Sequence: Synthetic peptide
  Seed: YNADISTFPL (TYRP1_HUMAN)
YQADISTFPF

SEQ ID NO: 170921 - protein, 9 aa, Artificial Sequence
  Description of Artificial Sequence: Synthetic peptide
  Seed: DNLGYTYEI (TYRP1_HUMAN)
DILGYTYEI

SEQ ID NO: 170922 - protein, 9 aa, Artificial Sequence
  Description of Artificial Sequence: Synthetic peptide
  Seed: GPDGNTPQF (TYRP1_HUMAN)
GWDGNTPQF

SEQ ID NO: 170923 - protein, 10 aa, Artificial Sequence
  Description of Artificial Sequence: Synthetic peptide
  Seed: KLLSLGCIFF (TYRP1_HUMAN)
KALSLGCIFY

SEQ ID NO: 170924 - protein, 9 aa, Artificial Sequence
  Description of Artificial Sequence: Synthetic peptide
  Seed: VCDICTDDL (TYRP1_HUMAN)
VFDICTDDV

SEQ ID NO: 170925 - protein, 9 aa, Artificial Sequence
  Description of Artificial Sequence: Synthetic peptide
  Seed: WPPVTNTEM (TYRP1_HUMAN)
WMPVTNTEY

SEQ ID NO: 170926 - protein, 8 aa, Artificial Sequence
  Description of Artificial Sequence: Synthetic peptide
  Seed: LFDTPPFY (TYRP1_HUMAN)
LYDTPPFL

SEQ ID NO: 170927 - protein, 9 aa, Artificial Sequence
  Description of Artificial Sequence: Synthetic peptide
  Seed: FTDAVFDEW (TYRP1_HUMAN)
FNDAVFDEF

SEQ ID NO: 170928 - protein, 9 aa, Artificial Sequence
  Description of Artificial Sequence: Synthetic peptide
  Seed: LIFGTASYL (TYRP1_HUMAN)
LNFGTASYF

SEQ ID NO: 170929 - protein, 9 aa, Artificial Sequence
  Description of Artificial Sequence: Synthetic peptide
  Seed: RVLIVRRNL (TYRP1_HUMAN)
RLLIVRRNW

SEQ ID NO: 170930 - protein, 10 aa, Artificial Sequence
  Description of Artificial Sequence: Synthetic peptide
  Seed: YNYFVWTHYY (TYRP1_HUMAN)
YHYFVWTHYK

SEQ ID NO: 170931 - protein, 9 aa, Artificial Sequence
  Description of Artificial Sequence: Synthetic peptide
  Seed: FGTASYLIR (TYRP1_HUMAN)
FTTASYLIR

SEQ ID NO: 170932 - protein, 9 aa, Artificial Sequence
  Description of Artificial Sequence: Synthetic peptide
  Seed: STLISPNSV (TYRP1_HUMAN)
SALISPNSI

SEQ ID NO: 170933 - protein, 11 aa, Artificial Sequence
  Description of Artificial Sequence: Synthetic peptide
  Seed: KTFLGVGQESF (TYRP1_HUMAN)
KQFLGVGQESY

SEQ ID NO: 170934 - protein, 9 aa, Artificial Sequence
  Description of Artificial Sequence: Synthetic peptide
  Seed: RFFNRTCHC (TYRP1_HUMAN)
RTFNRTCHV

SEQ ID NO: 170935 - protein, 9 aa, Artificial Sequence
  Description of Artificial Sequence: Synthetic peptide
  Seed: LQNPNQSVV (TYRP1_HUMAN)
LLNPNQSVM

SEQ ID NO: 170936 - protein, 9 aa, Artificial Sequence
  Description of Artificial Sequence: Synthetic peptide
  Seed: TADSRPHSP (TYRP1_HUMAN)
TADSRPHSL

SEQ ID NO: 170937 - protein, 10 aa, Artificial Sequence
  Description of Artificial Sequence: Synthetic peptide
  Seed: EVWPLRFFNR (TYRP1_HUMAN)
EVWPLRFFNK

SEQ ID NO: 170938 - protein, 9 aa, Artificial Sequence
  Description of Artificial Sequence: Synthetic peptide
  Seed: RGRCEAVTA (TYRP1_HUMAN)
RVRCEAVTS

SEQ ID NO: 170939 - protein, 8 aa, Artificial Sequence
  Description of Artificial Sequence: Synthetic peptide
  Seed: TEMFVTAP (TYRP1_HUMAN)
TEMFVTAL

SEQ ID NO: 170940 - protein, 8 aa, Artificial Sequence
  Description of Artificial Sequence: Synthetic peptide
  Seed: YSDPTGKY (TYRP1_HUMAN)
YTDPTGKY

SEQ ID NO: 170941 - protein, 9 aa, Artificial Sequence
  Description of Artificial Sequence: Synthetic peptide
  Seed: MSAPKLLSL (TYRP1_HUMAN)
MYAPKLLSM

SEQ ID NO: 170942 - protein, 9 aa, Artificial Sequence
  Description of Artificial Sequence: Synthetic peptide
  Seed: MSAPKLLSL (TYRP1_HUMAN)
MIAPKLLST

SEQ ID NO: 170943 - protein, 10 aa, Artificial Sequence
  Description of Artificial Sequence: Synthetic peptide
  Seed: FVWTHYYSVK (TYRP1_HUMAN)
FMWTHYYSVF

SEQ ID NO: 170944 - protein, 8 aa, Artificial Sequence
  Description of Artificial Sequence: Synthetic peptide
  Seed: YSDPTGKY (TYRP1_HUMAN)
YLDPTGKM

SEQ ID NO: 170945 - protein, 9 aa, Artificial Sequence
  Description of Artificial Sequence: Synthetic peptide
  Seed: RSLHNLAHL (TYRP1_HUMAN)
RLLHNLAHR

SEQ ID NO: 170946 - protein, 10 aa, Artificial Sequence
  Description of Artificial Sequence: Synthetic peptide
  Seed: SPNSVFSQWR (TYRP1_HUMAN)
SQNSVFSQWR

SEQ ID NO: 170947 - protein, 10 aa, Artificial Sequence
  Description of Artificial Sequence: Synthetic peptide
  Seed: KLLSLGCIFF (TYRP1_HUMAN)
KQLSLGCIFY

SEQ ID NO: 170948 - protein, 9 aa, Artificial Sequence
  Description of Artificial Sequence: Synthetic peptide
  Seed: PQFENISIY (TYRP1_HUMAN)
PQFENISIF

SEQ ID NO: 170949 - protein, 9 aa, Artificial Sequence
  Description of Artificial Sequence: Synthetic peptide
  Seed: LEKDMQEML (TYRP1_HUMAN)
LEKDMQEMW

SEQ ID NO: 170950 - protein, 10 aa, Artificial Sequence
  Description of Artificial Sequence: Synthetic peptide
  Seed: RSMDEANQPL (TYRP1_HUMAN)
RMMDEANQPW

SEQ ID NO: 170951 - protein, 10 aa, Artificial Sequence
  Description of Artificial Sequence: Synthetic peptide
  Seed: RQCATVEALR (TYRP1_HUMAN)
RSCATVEALR

SEQ ID NO: 170952 - protein, 9 aa, Artificial Sequence
  Description of Artificial Sequence: Synthetic peptide
  Seed: SRSNFDSTL (TYRP1_HUMAN)
SQSNFDSTF

SEQ ID NO: 170953 - protein, 9 aa, Artificial Sequence
  Description of Artificial Sequence: Synthetic peptide
  Seed: RAQFPRQCA (TYRP1_HUMAN)
RVQFPRQCK

SEQ ID NO: 170954 - protein, 9 aa, Artificial Sequence
  Description of Artificial Sequence: Synthetic peptide
  Seed: FYSNSTNSF (TYRP1_HUMAN)
FPSNSTNSI

SEQ ID NO: 170955 - protein, 9 aa, Artificial Sequence
  Description of Artificial Sequence: Synthetic peptide
  Seed: CTDDLMGSR (TYRP1_HUMAN)
CADDLMGSY

SEQ ID NO: 170956 - protein, 9 aa, Artificial Sequence
  Description of Artificial Sequence: Synthetic peptide
  Seed: KYDPAVRSL (TYRP1_HUMAN)
KQDPAVRSV

SEQ ID NO: 170957 - protein, 9 aa, Artificial Sequence
  Description of Artificial Sequence: Synthetic peptide
  Seed: LEKDMQEML (TYRP1_HUMAN)
LHKDMQEML

SEQ ID NO: 170958 - protein, 11 aa, Artificial Sequence
  Description of Artificial Sequence: Synthetic peptide
  Seed: SLPYWNFATGK (TYRP1_HUMAN)
SDPYWNFATGR

SEQ ID NO: 170959 - protein, 9 aa, Artificial Sequence
  Description of Artificial Sequence: Synthetic peptide
  Seed: MDEANQPLL (TYRP1_HUMAN)
MTEANQPLL

SEQ ID NO: 170960 - protein, 9 aa, Artificial Sequence
  Description of Artificial Sequence: Synthetic peptide
  Seed: LFQQARAQF (TYRP1_HUMAN)
LFQQARAQL

SEQ ID NO: 170961 - protein, 10 aa, Artificial Sequence
  Description of Artificial Sequence: Synthetic peptide
  Seed: LGPDGNTPQF (TYRP1_HUMAN)
LAPDGNTPQV

SEQ ID NO: 170962 - protein, 11 aa, Artificial Sequence
  Description of Artificial Sequence: Synthetic peptide
  Seed: MLQEPSFSLPY (TYRP1_HUMAN)
MLQEPSFSLPF

SEQ ID NO: 170963 - protein, 10 aa, Artificial Sequence
  Description of Artificial Sequence: Synthetic peptide
  Seed: VDFSHEGPAF (TYRP1_HUMAN)
VAFSHEGPAM

SEQ ID NO: 170964 - protein, 10 aa, Artificial Sequence
  Description of Artificial Sequence: Synthetic peptide
  Seed: FSLPYWNFAT (TYRP1_HUMAN)
FTLPYWNFAL

SEQ ID NO: 170965 - protein, 10 aa, Artificial Sequence
  Description of Artificial Sequence: Synthetic peptide
  Seed: VWTHYYSVKK (TYRP1_HUMAN)
VMTHYYSVKK

SEQ ID NO: 170966 - protein, 9 aa, Artificial Sequence
  Description of Artificial Sequence: Synthetic peptide
  Seed: RPMVQRLPE (TYRP1_HUMAN)
RLMVQRLPM

SEQ ID NO: 170967 - protein, 9 aa, Artificial Sequence
  Description of Artificial Sequence: Synthetic peptide
  Seed: ACDQRVLIV (TYRP1_HUMAN)
AQDQRVLII

SEQ ID NO: 170968 - protein, 9 aa, Artificial Sequence
  Description of Artificial Sequence: Synthetic peptide
  Seed: FLTWHRYHL (TYRP1_HUMAN)
FITWHRYHL

SEQ ID NO: 170969 - protein, 9 aa, Artificial Sequence
  Description of Artificial Sequence: Synthetic peptide
  Seed: SVFSQWRVV (TYRP1_HUMAN)
SMFSQWRVW

SEQ ID NO: 170970 - protein, 9 aa, Artificial Sequence
  Description of Artificial Sequence: Synthetic peptide
  Seed: RQYNMVPFW (TYRP1_HUMAN)
RHYNMVPFY

SEQ ID NO: 170971 - protein, 9 aa, Artificial Sequence
  Description of Artificial Sequence: Synthetic peptide
  Seed: FSVPEIIAI (TYRP1_HUMAN)
FTVPEIIAM

SEQ ID NO: 170972 - protein, 9 aa, Artificial Sequence
  Description of Artificial Sequence: Synthetic peptide
  Seed: FSHEGPAFL (TYRP1_HUMAN)
FIHEGPAFA

SEQ ID NO: 170973 - protein, 9 aa, Artificial Sequence
  Description of Artificial Sequence: Synthetic peptide
  Seed: WLRRYNADI (TYRP1_HUMAN)
WMRRYNADL

SEQ ID NO: 170974 - protein, 8 aa, Artificial Sequence
  Description of Artificial Sequence: Synthetic peptide
  Seed: FSHEGPAF (TYRP1_HUMAN)
FAHEGPAI

SEQ ID NO: 170975 - protein, 9 aa, Artificial Sequence
  Description of Artificial Sequence: Synthetic peptide
  Seed: SFRNTVEGY (TYRP1_HUMAN)
SSRNTVEGY

SEQ ID NO: 170976 - protein, 9 aa, Artificial Sequence
  Description of Artificial Sequence: Synthetic peptide
  Seed: FSLPYWNFA (TYRP1_HUMAN)
FQLPYWNFS

SEQ ID NO: 170977 - protein, 9 aa, Artificial Sequence
  Description of Artificial Sequence: Synthetic peptide
  Seed: RFFNRTCHC (TYRP1_HUMAN)
RSFNRTCHV

SEQ ID NO: 170978 - protein, 10 aa, Artificial Sequence
  Description of Artificial Sequence: Synthetic peptide
  Seed: LLHTFTDAVF (TYRP1_HUMAN)
LMHTFTDAVY

SEQ ID NO: 170979 - protein, 9 aa, Artificial Sequence
  Description of Artificial Sequence: Synthetic peptide
  Seed: SVPEIIAIA (TYRP1_HUMAN)
SMPEIIAIC

SEQ ID NO: 170980 - protein, 9 aa, Artificial Sequence
  Description of Artificial Sequence: Synthetic peptide
  Seed: MLQEPSFSL (TYRP1_HUMAN)
MLQEPSFSS

SEQ ID NO: 170981 - protein, 9 aa, Artificial Sequence
  Description of Artificial Sequence: Synthetic peptide
  Seed: RQYNMVPFW (TYRP1_HUMAN)
RVYNMVPFV

SEQ ID NO: 170982 - protein, 10 aa, Artificial Sequence
  Description of Artificial Sequence: Synthetic peptide
  Seed: DVAQCLEVGL (TYRP1_HUMAN)
DTAQCLEVGR

SEQ ID NO: 170983 - protein, 10 aa, Artificial Sequence
  Description of Artificial Sequence: Synthetic peptide
  Seed: VGLFDTPPFY (TYRP1_HUMAN)
VWLFDTPPFK

SEQ ID NO: 170984 - protein, 9 aa, Artificial Sequence
  Description of Artificial Sequence: Synthetic peptide
  Seed: MLQEPSFSL (TYRP1_HUMAN)
MPQEPSFSI

SEQ ID NO: 170985 - protein, 9 aa, Artificial Sequence
  Description of Artificial Sequence: Synthetic peptide
  Seed: VLLHTFTDA (TYRP1_HUMAN)
VQLHTFTDV

SEQ ID NO: 170986 - protein, 9 aa, Artificial Sequence
  Description of Artificial Sequence: Synthetic peptide
  Seed: IAIAVVGAL (TYRP1_HUMAN)
IPIAVVGAI

SEQ ID NO: 170987 - protein, 10 aa, Artificial Sequence
  Description of Artificial Sequence: Synthetic peptide
  Seed: TAPDNLGYTY (TYRP1_HUMAN)
TRPDNLGYTF

SEQ ID NO: 170988 - protein, 9 aa, Artificial Sequence
  Description of Artificial Sequence: Synthetic peptide
  Seed: VFDEWLRRY (TYRP1_HUMAN)
VIDEWLRRM

SEQ ID NO: 170989 - protein, 9 aa, Artificial Sequence
  Description of Artificial Sequence: Synthetic peptide
  Seed: LQNPNQSVV (TYRP1_HUMAN)
LHNPNQSVF

SEQ ID NO: 170990 - protein, 9 aa, Artificial Sequence
  Description of Artificial Sequence: Synthetic peptide
  Seed: GLFDTPPFY (TYRP1_HUMAN)
GSFDTPPFK

SEQ ID NO: 170991 - protein, 9 aa, Artificial Sequence
  Description of Artificial Sequence: Synthetic peptide
  Seed: GLFDTPPFY (TYRP1_HUMAN)
GWFDTPPFY

SEQ ID NO: 170992 - protein, 10 aa, Artificial Sequence
  Description of Artificial Sequence: Synthetic peptide
  Seed: RSMDEANQPL (TYRP1_HUMAN)
RVMDEANQPL

SEQ ID NO: 170993 - protein, 11 aa, Artificial Sequence
  Description of Artificial Sequence: Synthetic peptide
  Seed: YNMVPFWPPVT (TYRP1_HUMAN)
YLMVPFWPPVI

SEQ ID NO: 170994 - protein, 10 aa, Artificial Sequence
  Description of Artificial Sequence: Synthetic peptide
  Seed: YNYFVWTHYY (TYRP1_HUMAN)
YVYFVWTHYR

SEQ ID NO: 170995 - protein, 10 aa, Artificial Sequence
  Description of Artificial Sequence: Synthetic peptide
  Seed: HYYSVKKTFL (TYRP1_HUMAN)
HYYSVKKTFM

SEQ ID NO: 170996 - protein, 9 aa, Artificial Sequence
  Description of Artificial Sequence: Synthetic peptide
  Seed: FYSNSTNSF (TYRP1_HUMAN)
FASNSTNSH

SEQ ID NO: 170997 - protein, 9 aa, Artificial Sequence
  Description of Artificial Sequence: Synthetic peptide
  Seed: KLLSLGCIF (TYRP1_HUMAN)
KWLSLGCIF

SEQ ID NO: 170998 - protein, 9 aa, Artificial Sequence
  Description of Artificial Sequence: Synthetic peptide
  Seed: DNLGYTYEI (TYRP1_HUMAN)
DILGYTYEL

SEQ ID NO: 170999 - protein, 9 aa, Artificial Sequence
  Description of Artificial Sequence: Synthetic peptide
  Seed: SLHNLAHLF (TYRP1_HUMAN)
SMHNLAHLY

SEQ ID NO: 171000 - protein, 11 aa, Artificial Sequence
  Description of Artificial Sequence: Synthetic peptide
  Seed: FPLLLFQQARA (TYRP1_HUMAN)
FGLLLFQQARV

SEQ ID NO: 171001 - protein, 9 aa, Artificial Sequence
  Description of Artificial Sequence: Synthetic peptide
  Seed: MCCPDLSPV (TYRP1_HUMAN)
MLCPDLSPA

SEQ ID NO: 171002 - protein, 10 aa, Artificial Sequence
  Description of Artificial Sequence: Synthetic peptide
  Seed: VGLFDTPPFY (TYRP1_HUMAN)
VGLFDTPPFK

SEQ ID NO: 171003 - protein, 10 aa, Artificial Sequence
  Description of Artificial Sequence: Synthetic peptide
  Seed: YNMVPFWPPV (TYRP1_HUMAN)
YRMVPFWPPI

SEQ ID NO: 171004 - protein, 9 aa, Artificial Sequence
  Description of Artificial Sequence: Synthetic peptide
  Seed: SVPEIIAIA (TYRP1_HUMAN)
SLPEIIAIM

SEQ ID NO: 171005 - protein, 9 aa, Artificial Sequence
  Description of Artificial Sequence: Synthetic peptide
  Seed: FTDAVFDEW (TYRP1_HUMAN)
FADAVFDEF

SEQ ID NO: 171006 - protein, 9 aa, Artificial Sequence
  Description of Artificial Sequence: Synthetic peptide
  Seed: STEDGPIRR (TYRP1_HUMAN)
SAEDGPIRY

SEQ ID NO: 171007 - protein, 9 aa, Artificial Sequence
  Description of Artificial Sequence: Synthetic peptide
  Seed: YTYEIQWPS (TYRP1_HUMAN)
YMYEIQWPV

SEQ ID NO: 171008 - protein, 10 aa, Artificial Sequence
  Description of Artificial Sequence: Synthetic peptide
  Seed: TAPDNLGYTY (TYRP1_HUMAN)
TTPDNLGYTM

SEQ ID NO: 171009 - protein, 11 aa, Artificial Sequence
  Description of Artificial Sequence: Synthetic peptide
  Seed: LVALIFGTASY (TYRP1_HUMAN)
LQALIFGTASY

SEQ ID NO: 171010 - protein, 11 aa, Artificial Sequence
  Description of Artificial Sequence: Synthetic peptide
  Seed: YFVWTHYYSVK (TYRP1_HUMAN)
YMVWTHYYSVR

SEQ ID NO: 171011 - protein, 10 aa, Artificial Sequence
  Description of Artificial Sequence: Synthetic peptide
  Seed: FSLPYWNFAT (TYRP1_HUMAN)
FLLPYWNFAP

SEQ ID NO: 171012 - protein, 11 aa, Artificial Sequence
  Description of Artificial Sequence: Synthetic peptide
  Seed: RSMDEANQPLL (TYRP1_HUMAN)
RQMDEANQPLL

SEQ ID NO: 171013 - protein, 10 aa, Artificial Sequence
  Description of Artificial Sequence: Synthetic peptide
  Seed: ENISIYNYFV (TYRP1_HUMAN)
EFISIYNYFV

SEQ ID NO: 171014 - protein, 9 aa, Artificial Sequence
  Description of Artificial Sequence: Synthetic peptide
  Seed: RVLIVRRNL (TYRP1_HUMAN)
RVLIVRRNA

SEQ ID NO: 171015 - protein, 9 aa, Artificial Sequence
  Description of Artificial Sequence: Synthetic peptide
  Seed: ASYLIRARR (TYRP1_HUMAN)
AYYLIRARR

SEQ ID NO: 171016 - protein, 9 aa, Artificial Sequence
  Description of Artificial Sequence: Synthetic peptide
  Seed: FVWTHYYSV (TYRP1_HUMAN)
FMWTHYYSM

SEQ ID NO: 171017 - protein, 9 aa, Artificial Sequence
  Description of Artificial Sequence: Synthetic peptide
  Seed: NADISTFPL (TYRP1_HUMAN)
NFDISTFPI

SEQ ID NO: 171018 - protein, 10 aa, Artificial Sequence
  Description of Artificial Sequence: Synthetic peptide
  Seed: RSMDEANQPL (TYRP1_HUMAN)
RYMDEANQPL

SEQ ID NO: 171019 - protein, 10 aa, Artificial Sequence
  Description of Artificial Sequence: Synthetic peptide
  Seed: YNADISTFPL (TYRP1_HUMAN)
YMADISTFPM

SEQ ID NO: 171020 - protein, 10 aa, Artificial Sequence
  Description of Artificial Sequence: Synthetic peptide
  Seed: YNADISTFPL (TYRP1_HUMAN)
YVADISTFPF

SEQ ID NO: 171021 - protein, 9 aa, Artificial Sequence
  Description of Artificial Sequence: Synthetic peptide
  Seed: RTTHPLFVI (TYRP1_HUMAN)
RMTHPLFVL

SEQ ID NO: 171022 - protein, 8 aa, Artificial Sequence
  Description of Artificial Sequence: Synthetic peptide
  Seed: ACDQRVLI (TYRP1_HUMAN)
AYDQRVLL

SEQ ID NO: 171023 - protein, 9 aa, Artificial Sequence
  Description of Artificial Sequence: Synthetic peptide
  Seed: FENISIYNY (TYRP1_HUMAN)
FMNISIYNY

SEQ ID NO: 171024 - protein, 9 aa, Artificial Sequence
  Description of Artificial Sequence: Synthetic peptide
  Seed: YSNSTNSFR (TYRP1_HUMAN)
YTNSTNSFK

SEQ ID NO: 171025 - protein, 9 aa, Artificial Sequence
  Description of Artificial Sequence: Synthetic peptide
  Seed: APIGHNRQY (TYRP1_HUMAN)
AQIGHNRQL

SEQ ID NO: 171026 - protein, 11 aa, Artificial Sequence
  Description of Artificial Sequence: Synthetic peptide
  Seed: KTFLGVGQESF (TYRP1_HUMAN)
KGFLGVGQESW

SEQ ID NO: 171027 - protein, 10 aa, Artificial Sequence
  Description of Artificial Sequence: Synthetic peptide
  Seed: RSMDEANQPL (TYRP1_HUMAN)
RWMDEANQPF

SEQ ID NO: 171028 - protein, 8 aa, Artificial Sequence
  Description of Artificial Sequence: Synthetic peptide
  Seed: TEMFVTAP (TYRP1_HUMAN)
TEMFVTAF

SEQ ID NO: 171029 - protein, 9 aa, Artificial Sequence
  Description of Artificial Sequence: Synthetic peptide
  Seed: FSLPYWNFA (TYRP1_HUMAN)
FLLPYWNFF

SEQ ID NO: 171030 - protein, 9 aa, Artificial Sequence
  Description of Artificial Sequence: Synthetic peptide
  Seed: LIFGTASYL (TYRP1_HUMAN)
LLFGTASYF

SEQ ID NO: 171031 - protein, 9 aa, Artificial Sequence
  Description of Artificial Sequence: Synthetic peptide
  Seed: DAVFDEWLR (TYRP1_HUMAN)
DSVFDEWLR

SEQ ID NO: 171032 - protein, 9 aa, Artificial Sequence
  Description of Artificial Sequence: Synthetic peptide
  Seed: NFDSTLISP (TYRP1_HUMAN)
NIDSTLISL

SEQ ID NO: 171033 - protein, 9 aa, Artificial Sequence
  Description of Artificial Sequence: Synthetic peptide
  Seed: FTDAVFDEW (TYRP1_HUMAN)
FWDAVFDEV

SEQ ID NO: 171034 - protein, 11 aa, Artificial Sequence
  Description of Artificial Sequence: Synthetic peptide
  Seed: MFVTAPDNLGY (TYRP1_HUMAN)
MVVTAPDNLGF

SEQ ID NO: 171035 - protein, 9 aa, Artificial Sequence
  Description of Artificial Sequence: Synthetic peptide
  Seed: KYDPAVRSL (TYRP1_HUMAN)
KIDPAVRSC

SEQ ID NO: 171036 - protein, 9 aa, Artificial Sequence
  Description of Artificial Sequence: Synthetic peptide
  Seed: STNSFRNTV (TYRP1_HUMAN)
SANSFRNTW

SEQ ID NO: 171037 - protein, 9 aa, Artificial Sequence
  Description of Artificial Sequence: Synthetic peptide
  Seed: GLFDTPPFY (TYRP1_HUMAN)
GTFDTPPFW

SEQ ID NO: 171038 - protein, 9 aa, Artificial Sequence
  Description of Artificial Sequence: Synthetic peptide
  Seed: AKRTTHPLF (TYRP1_HUMAN)
AARTTHPLF

SEQ ID NO: 171039 - protein, 9 aa, Artificial Sequence
  Description of Artificial Sequence: Synthetic peptide
  Seed: GPIRRNPAG (TYRP1_HUMAN)
GPIRRNPAL

SEQ ID NO: 171040 - protein, 10 aa, Artificial Sequence
  Description of Artificial Sequence: Synthetic peptide
  Seed: ENISIYNYFV (TYRP1_HUMAN)
EGISIYNYFV

SEQ ID NO: 171041 - protein, 9 aa, Artificial Sequence
  Description of Artificial Sequence: Synthetic peptide
  Seed: RYHLLRLEK (TYRP1_HUMAN)
RIHLLRLER

SEQ ID NO: 171042 - protein, 10 aa, Artificial Sequence
  Description of Artificial Sequence: Synthetic peptide
  Seed: THYYSVKKTF (TYRP1_HUMAN)
TKYYSVKKTF

SEQ ID NO: 171043 - protein, 9 aa, Artificial Sequence
  Description of Artificial Sequence: Synthetic peptide
  Seed: SVFSQWRVV (TYRP1_HUMAN)
SSFSQWRVK

SEQ ID NO: 171044 - protein, 9 aa, Artificial Sequence
  Description of Artificial Sequence: Synthetic peptide
  Seed: SLHNLAHLF (TYRP1_HUMAN)
SMHNLAHLF

SEQ ID NO: 171045 - protein, 10 aa, Artificial Sequence
  Description of Artificial Sequence: Synthetic peptide
  Seed: HFVRALDMAK (TYRP1_HUMAN)
HIVRALDMAR

SEQ ID NO: 171046 - protein, 10 aa, Artificial Sequence
  Description of Artificial Sequence: Synthetic peptide
  Seed: SHEGPAFLTW (TYRP1_HUMAN)
SAEGPAFLTW

SEQ ID NO: 171047 - protein, 9 aa, Artificial Sequence
  Description of Artificial Sequence: Synthetic peptide
  Seed: VFDEWLRRY (TYRP1_HUMAN)
VTDEWLRRV

SEQ ID NO: 171048 - protein, 9 aa, Artificial Sequence
  Description of Artificial Sequence: Synthetic peptide
  Seed: RAQFPRQCA (TYRP1_HUMAN)
RQQFPRQCK

SEQ ID NO: 171049 - protein, 9 aa, Artificial Sequence
  Description of Artificial Sequence: Synthetic peptide
  Seed: RYHLLRLEK (TYRP1_HUMAN)
RVHLLRLEM

SEQ ID NO: 171050 - protein, 11 aa, Artificial Sequence
  Description of Artificial Sequence: Synthetic peptide
  Seed: RRYNADISTFP (TYRP1_HUMAN)
RYYNADISTFR

SEQ ID NO: 171051 - protein, 10 aa, Artificial Sequence
  Description of Artificial Sequence: Synthetic peptide
  Seed: QFENISIYNY (TYRP1_HUMAN)
QHENISIYNW

SEQ ID NO: 171052 - protein, 11 aa, Artificial Sequence
  Description of Artificial Sequence: Synthetic peptide
  Seed: NYFVWTHYYSV (TYRP1_HUMAN)
NYFVWTHYYSI

SEQ ID NO: 171053 - protein, 9 aa, Artificial Sequence
  Description of Artificial Sequence: Synthetic peptide
  Seed: MSAPKLLSL (TYRP1_HUMAN)
MIAPKLLSK

SEQ ID NO: 171054 - protein, 9 aa, Artificial Sequence
  Description of Artificial Sequence: Synthetic peptide
  Seed: KYDPAVRSL (TYRP1_HUMAN)
KADPAVRSC

SEQ ID NO: 171055 - protein, 9 aa, Artificial Sequence
  Description of Artificial Sequence: Synthetic peptide
  Seed: LSPNDPIFV (TYRP1_HUMAN)
LIPNDPIFL

SEQ ID NO: 171056 - protein, 11 aa, Artificial Sequence
  Description of Artificial Sequence: Synthetic peptide
  Seed: FLTWHRYHLLR (TYRP1_HUMAN)
FVTWHRYHLLR

SEQ ID NO: 171057 - protein, 8 aa, Artificial Sequence
  Description of Artificial Sequence: Synthetic peptide
  Seed: RPMVQRLP (TYRP1_HUMAN)
RPMVQRLI

SEQ ID NO: 171058 - protein, 10 aa, Artificial Sequence
  Description of Artificial Sequence: Synthetic peptide
  Seed: HYYSVKKTFL (TYRP1_HUMAN)
HRYSVKKTFM

SEQ ID NO: 171059 - protein, 9 aa, Artificial Sequence
  Description of Artificial Sequence: Synthetic peptide
  Seed: KLQNPNQSV (TYRP1_HUMAN)
KTQNPNQSF

SEQ ID NO: 171060 - protein, 9 aa, Artificial Sequence
  Description of Artificial Sequence: Synthetic peptide
  Seed: FLGVGQESF (TYRP1_HUMAN)
FPGVGQESL

SEQ ID NO: 171061 - protein, 10 aa, Artificial Sequence
  Description of Artificial Sequence: Synthetic peptide
  Seed: FSVPEIIAIA (TYRP1_HUMAN)
FRVPEIIAIV

SEQ ID NO: 171062 - protein, 9 aa, Artificial Sequence
  Description of Artificial Sequence: Synthetic peptide
  Seed: RAQFPRQCA (TYRP1_HUMAN)
RIQFPRQCK

SEQ ID NO: 171063 - protein, 9 aa, Artificial Sequence
  Description of Artificial Sequence: Synthetic peptide
  Seed: LLTDQYQCY (TYRP1_HUMAN)
LMTDQYQCF

SEQ ID NO: 171064 - protein, 10 aa, Artificial Sequence
  Description of Artificial Sequence: Synthetic peptide
  Seed: LLHTFTDAVF (TYRP1_HUMAN)
LMHTFTDAVV

SEQ ID NO: 171065 - protein, 10 aa, Artificial Sequence
  Description of Artificial Sequence: Synthetic peptide
  Seed: YNADISTFPL (TYRP1_HUMAN)
YCADISTFPM

SEQ ID NO: 171066 - protein, 10 aa, Artificial Sequence
  Description of Artificial Sequence: Synthetic peptide
  Seed: YNYFVWTHYY (TYRP1_HUMAN)
YFYFVWTHYS

SEQ ID NO: 171067 - protein, 9 aa, Artificial Sequence
  Description of Artificial Sequence: Synthetic peptide
  Seed: RFFNRTCHC (TYRP1_HUMAN)
RSFNRTCHK

SEQ ID NO: 171068 - protein, 10 aa, Artificial Sequence
  Description of Artificial Sequence: Synthetic peptide
  Seed: YNYFVWTHYY (TYRP1_HUMAN)
YFYFVWTHYE

SEQ ID NO: 171069 - protein, 9 aa, Artificial Sequence
  Description of Artificial Sequence: Synthetic peptide
  Seed: AKRTTHPLF (TYRP1_HUMAN)
AMRTTHPLY

SEQ ID NO: 171070 - protein, 9 aa, Artificial Sequence
  Description of Artificial Sequence: Synthetic peptide
  Seed: EIQWPSREF (TYRP1_HUMAN)
EAQWPSRER

SEQ ID NO: 171071 - protein, 9 aa, Artificial Sequence
  Description of Artificial Sequence: Synthetic peptide
  Seed: RAQFPRQCA (TYRP1_HUMAN)
RTQFPRQCA

SEQ ID NO: 171072 - protein, 11 aa, Artificial Sequence
  Description of Artificial Sequence: Synthetic peptide
  Seed: AFLTWHRYHLL (TYRP1_HUMAN)
ALLTWHRYHLV

SEQ ID NO: 171073 - protein, 9 aa, Artificial Sequence
  Description of Artificial Sequence: Synthetic peptide
  Seed: RTTHPLFVI (TYRP1_HUMAN)
RATHPLFVL

SEQ ID NO: 171074 - protein, 10 aa, Artificial Sequence
  Description of Artificial Sequence: Synthetic peptide
  Seed: THYYSVKKTF (TYRP1_HUMAN)
TTYYSVKKTF

SEQ ID NO: 171075 - protein, 9 aa, Artificial Sequence
  Description of Artificial Sequence: Synthetic peptide
  Seed: TFPLENAPI (TYRP1_HUMAN)
TWPLENAPW

SEQ ID NO: 171076 - protein, 9 aa, Artificial Sequence
  Description of Artificial Sequence: Synthetic peptide
  Seed: ISIYNYFVW (TYRP1_HUMAN)
IKIYNYFVF

SEQ ID NO: 171077 - protein, 9 aa, Artificial Sequence
  Description of Artificial Sequence: Synthetic peptide
  Seed: QQARAQFPR (TYRP1_HUMAN)
QGARAQFPR

SEQ ID NO: 171078 - protein, 10 aa, Artificial Sequence
  Description of Artificial Sequence: Synthetic peptide
  Seed: YNADISTFPL (TYRP1_HUMAN)
YIADISTFPF

SEQ ID NO: 171079 - protein, 9 aa, Artificial Sequence
  Description of Artificial Sequence: Synthetic peptide
  Seed: RLEKDMQEM (TYRP1_HUMAN)
RLEKDMQEV

SEQ ID NO: 171080 - protein, 9 aa, Artificial Sequence
  Description of Artificial Sequence: Synthetic peptide
  Seed: RQYNMVPFW (TYRP1_HUMAN)
RRYNMVPFH

SEQ ID NO: 171081 - protein, 9 aa, Artificial Sequence
  Description of Artificial Sequence: Synthetic peptide
  Seed: GLFDTPPFY (TYRP1_HUMAN)
GMFDTPPFF

SEQ ID NO: 171082 - protein, 11 aa, Artificial Sequence
  Description of Artificial Sequence: Synthetic peptide
  Seed: LVALIFGTASY (TYRP1_HUMAN)
LHALIFGTASY

SEQ ID NO: 171083 - protein, 9 aa, Artificial Sequence
  Description of Artificial Sequence: Synthetic peptide
  Seed: RSLHNLAHL (TYRP1_HUMAN)
RKLHNLAHM

SEQ ID NO: 171084 - protein, 9 aa, Artificial Sequence
  Description of Artificial Sequence: Synthetic peptide
  Seed: HEGPAFLTW (TYRP1_HUMAN)
HMGPAFLTL

SEQ ID NO: 171085 - protein, 9 aa, Artificial Sequence
  Description of Artificial Sequence: Synthetic peptide
  Seed: ENAPIGHNR (TYRP1_HUMAN)
EMAPIGHNR

SEQ ID NO: 171086 - protein, 9 aa, Artificial Sequence
  Description of Artificial Sequence: Synthetic peptide
  Seed: IAIAVVGAL (TYRP1_HUMAN)
IMIAVVGAM

SEQ ID NO: 171087 - protein, 10 aa, Artificial Sequence
  Description of Artificial Sequence: Synthetic peptide
  Seed: RVVCDSLEDY (TYRP1_HUMAN)
RMVCDSLEDF

SEQ ID NO: 171088 - protein, 11 aa, Artificial Sequence
  Description of Artificial Sequence: Synthetic peptide
  Seed: YNMVPFWPPVT (TYRP1_HUMAN)
YMMVPFWPPVE

SEQ ID NO: 171089 - protein, 9 aa, Artificial Sequence
  Description of Artificial Sequence: Synthetic peptide
  Seed: MSAPKLLSL (TYRP1_HUMAN)
MFAPKLLSY

SEQ ID NO: 171090 - protein, 11 aa, Artificial Sequence
  Description of Artificial Sequence: Synthetic peptide
  Seed: REVWPLRFFNR (TYRP1_HUMAN)
RIVWPLRFFNK

SEQ ID NO: 171091 - protein, 9 aa, Artificial Sequence
  Description of Artificial Sequence: Synthetic peptide
  Seed: RQYNMVPFW (TYRP1_HUMAN)
RCYNMVPFY

SEQ ID NO: 171092 - protein, 9 aa, Artificial Sequence
  Description of Artificial Sequence: Synthetic peptide
  Seed: FSVPEIIAI (TYRP1_HUMAN)
FRVPEIIAY

SEQ ID NO: 171093 - protein, 9 aa, Artificial Sequence
  Description of Artificial Sequence: Synthetic peptide
  Seed: SLHNLAHLF (TYRP1_HUMAN)
SWHNLAHLI

SEQ ID NO: 171094 - protein, 9 aa, Artificial Sequence
  Description of Artificial Sequence: Synthetic peptide
  Seed: STNSFRNTV (TYRP1_HUMAN)
SANSFRNTY

SEQ ID NO: 171095 - protein, 9 aa, Artificial Sequence
  Description of Artificial Sequence: Synthetic peptide
  Seed: HYYSVKKTF (TYRP1_HUMAN)
HMYSVKKTY

SEQ ID NO: 171096 - protein, 9 aa, Artificial Sequence
  Description of Artificial Sequence: Synthetic peptide
  Seed: SIYNYFVWT (TYRP1_HUMAN)
SQYNYFVWL

SEQ ID NO: 171097 - protein, 9 aa, Artificial Sequence
  Description of Artificial Sequence: Synthetic peptide
  Seed: MLQEPSFSL (TYRP1_HUMAN)
MWQEPSFSY

SEQ ID NO: 171098 - protein, 10 aa, Artificial Sequence
  Description of Artificial Sequence: Synthetic peptide
  Seed: YNYFVWTHYY (TYRP1_HUMAN)
YAYFVWTHYY

SEQ ID NO: 171099 - protein, 9 aa, Artificial Sequence
  Description of Artificial Sequence: Synthetic peptide
  Seed: RYHLLRLEK (TYRP1_HUMAN)
RMHLLRLEK

SEQ ID NO: 171100 - protein, 11 aa, Artificial Sequence
  Description of Artificial Sequence: Synthetic peptide
  Seed: FVLLHTFTDAV (TYRP1_HUMAN)
FYLLHTFTDAL

SEQ ID NO: 171101 - protein, 9 aa, Artificial Sequence
  Description of Artificial Sequence: Synthetic peptide
  Seed: FTDAVFDEW (TYRP1_HUMAN)
FCDAVFDEY

SEQ ID NO: 171102 - protein, 11 aa, Artificial Sequence
  Description of Artificial Sequence: Synthetic peptide
  Seed: QEMLQEPSFSL (TYRP1_HUMAN)
QWMLQEPSFSL

SEQ ID NO: 171103 - protein, 10 aa, Artificial Sequence
  Description of Artificial Sequence: Synthetic peptide
  Seed: YNYFVWTHYY (TYRP1_HUMAN)
YPYFVWTHYI

SEQ ID NO: 171104 - protein, 10 aa, Artificial Sequence
  Description of Artificial Sequence: Synthetic peptide
  Seed: ALIFGTASYL (TYRP1_HUMAN)
AVIFGTASYF

SEQ ID NO: 171105 - protein, 10 aa, Artificial Sequence
  Description of Artificial Sequence: Synthetic peptide
  Seed: YNYFVWTHYY (TYRP1_HUMAN)
YGYFVWTHYK

SEQ ID NO: 171106 - protein, 9 aa, Artificial Sequence
  Description of Artificial Sequence: Synthetic peptide
  Seed: SMDEANQPL (TYRP1_HUMAN)
SADEANQPL

SEQ ID NO: 171107 - protein, 9 aa, Artificial Sequence
  Description of Artificial Sequence: Synthetic peptide
  Seed: RLEKDMQEM (TYRP1_HUMAN)
RMEKDMQEV

SEQ ID NO: 171108 - protein, 10 aa, Artificial Sequence
  Description of Artificial Sequence: Synthetic peptide
  Seed: YNMVPFWPPV (TYRP1_HUMAN)
YFMVPFWPPM

SEQ ID NO: 171109 - protein, 9 aa, Artificial Sequence
  Description of Artificial Sequence: Synthetic peptide
  Seed: KYDPAVRSL (TYRP1_HUMAN)
KYDPAVRSC

SEQ ID NO: 171110 - protein, 10 aa, Artificial Sequence
  Description of Artificial Sequence: Synthetic peptide
  Seed: FVLLHTFTDA (TYRP1_HUMAN)
FRLLHTFTDI

SEQ ID NO: 171111 - protein, 10 aa, Artificial Sequence
  Description of Artificial Sequence: Synthetic peptide
  Seed: MVPFWPPVTN (TYRP1_HUMAN)
MKPFWPPVTM

SEQ ID NO: 171112 - protein, 10 aa, Artificial Sequence
  Description of Artificial Sequence: Synthetic peptide
  Seed: ADSRPHSPQY (TYRP1_HUMAN)
ARSRPHSPQA

SEQ ID NO: 171113 - protein, 9 aa, Artificial Sequence
  Description of Artificial Sequence: Synthetic peptide
  Seed: FSVPEIIAI (TYRP1_HUMAN)
FNVPEIIAL

SEQ ID NO: 171114 - protein, 9 aa, Artificial Sequence
  Description of Artificial Sequence: Synthetic peptide
  Seed: SVKKTFLGV (TYRP1_HUMAN)
SWKKTFLGK

SEQ ID NO: 171115 - protein, 10 aa, Artificial Sequence
  Description of Artificial Sequence: Synthetic peptide
  Seed: HYYSVKKTFL (TYRP1_HUMAN)
HWYSVKKTFF

SEQ ID NO: 171116 - protein, 10 aa, Artificial Sequence
  Description of Artificial Sequence: Synthetic peptide
  Seed: FVRALDMAKR (TYRP1_HUMAN)
FARALDMAKR

SEQ ID NO: 171117 - protein, 9 aa, Artificial Sequence
  Description of Artificial Sequence: Synthetic peptide
  Seed: YTYEIQWPS (TYRP1_HUMAN)
YTYEIQWPA

SEQ ID NO: 171118 - protein, 9 aa, Artificial Sequence
  Description of Artificial Sequence: Synthetic peptide
  Seed: VARPMVQRL (TYRP1_HUMAN)
VRRPMVQRI

SEQ ID NO: 171119 - protein, 10 aa, Artificial Sequence
  Description of Artificial Sequence: Synthetic peptide
  Seed: ENISIYNYFV (TYRP1_HUMAN)
EVISIYNYFL

SEQ ID NO: 171120 - protein, 9 aa, Artificial Sequence
  Description of Artificial Sequence: Synthetic peptide
  Seed: SVKKTFLGV (TYRP1_HUMAN)
SPKKTFLGV

SEQ ID NO: 171121 - protein, 9 aa, Artificial Sequence
  Description of Artificial Sequence: Synthetic peptide
  Seed: ALIFGTASY (TYRP1_HUMAN)
ATIFGTASL

SEQ ID NO: 171122 - protein, 10 aa, Artificial Sequence
  Description of Artificial Sequence: Synthetic peptide
  Seed: MVPFWPPVTN (TYRP1_HUMAN)
MFPFWPPVTF

SEQ ID NO: 171123 - protein, 9 aa, Artificial Sequence
  Description of Artificial Sequence: Synthetic peptide
  Seed: SIYNYFVWT (TYRP1_HUMAN)
SVYNYFVWV

SEQ ID NO: 171124 - protein, 9 aa, Artificial Sequence
  Description of Artificial Sequence: Synthetic peptide
  Seed: VGLFDTPPF (TYRP1_HUMAN)
VLLFDTPPM

SEQ ID NO: 171125 - protein, 10 aa, Artificial Sequence
  Description of Artificial Sequence: Synthetic peptide
  Seed: ADSRPHSPQY (TYRP1_HUMAN)
AFSRPHSPQK

SEQ ID NO: 171126 - protein, 10 aa, Artificial Sequence
  Description of Artificial Sequence: Synthetic peptide
  Seed: RSMDEANQPL (TYRP1_HUMAN)
RSMDEANQPM

SEQ ID NO: 171127 - protein, 9 aa, Artificial Sequence
  Description of Artificial Sequence: Synthetic peptide
  Seed: TFPLENAPI (TYRP1_HUMAN)
TSPLENAPM

SEQ ID NO: 171128 - protein, 9 aa, Artificial Sequence
  Description of Artificial Sequence: Synthetic peptide
  Seed: KLQNPNQSV (TYRP1_HUMAN)
KQQNPNQSF

SEQ ID NO: 171129 - protein, 10 aa, Artificial Sequence
  Description of Artificial Sequence: Synthetic peptide
  Seed: MAKRTTHPLF (TYRP1_HUMAN)
MHKRTTHPLF

SEQ ID NO: 171130 - protein, 9 aa, Artificial Sequence
  Description of Artificial Sequence: Synthetic peptide
  Seed: YNYFVWTHY (TYRP1_HUMAN)
YFYFVWTHF

SEQ ID NO: 171131 - protein, 9 aa, Artificial Sequence
  Description of Artificial Sequence: Synthetic peptide
  Seed: VLIVRRNLL (TYRP1_HUMAN)
VYIVRRNLM

SEQ ID NO: 171132 - protein, 9 aa, Artificial Sequence
  Description of Artificial Sequence: Synthetic peptide
  Seed: LGYTYEIQW (TYRP1_HUMAN)
LSYTYEIQF

SEQ ID NO: 171133 - protein, 9 aa, Artificial Sequence
  Description of Artificial Sequence: Synthetic peptide
  Seed: TLISPNSVF (TYRP1_HUMAN)
TEISPNSVF

SEQ ID NO: 171134 - protein, 9 aa, Artificial Sequence
  Description of Artificial Sequence: Synthetic peptide
  Seed: SGHNCGTCR (TYRP1_HUMAN)
SVHNCGTCR

SEQ ID NO: 171135 - protein, 10 aa, Artificial Sequence
  Description of Artificial Sequence: Synthetic peptide
  Seed: RRYNADISTF (TYRP1_HUMAN)
RTYNADISTI

SEQ ID NO: 171136 - protein, 9 aa, Artificial Sequence
  Description of Artificial Sequence: Synthetic peptide
  Seed: FSVPEIIAI (TYRP1_HUMAN)
FFVPEIIAF

SEQ ID NO: 171137 - protein, 9 aa, Artificial Sequence
  Description of Artificial Sequence: Synthetic peptide
  Seed: ACDQRVLIV (TYRP1_HUMAN)
ANDQRVLIM

SEQ ID NO: 171138 - protein, 10 aa, Artificial Sequence
  Description of Artificial Sequence: Synthetic peptide
  Seed: YNYFVWTHYY (TYRP1_HUMAN)
YEYFVWTHYI

SEQ ID NO: 171139 - protein, 10 aa, Artificial Sequence
  Description of Artificial Sequence: Synthetic peptide
  Seed: LLLVALIFGT (TYRP1_HUMAN)
LQLVALIFGL

SEQ ID NO: 171140 - protein, 9 aa, Artificial Sequence
  Description of Artificial Sequence: Synthetic peptide
  Seed: MAKRTTHPL (TYRP1_HUMAN)
MLKRTTHPK

SEQ ID NO: 171141 - protein, 9 aa, Artificial Sequence
  Description of Artificial Sequence: Synthetic peptide
  Seed: TTHPLFVIA (TYRP1_HUMAN)
TSHPLFVIK

SEQ ID NO: 171142 - protein, 9 aa, Artificial Sequence
  Description of Artificial Sequence: Synthetic peptide
  Seed: RSLHNLAHL (TYRP1_HUMAN)
RLLHNLAHM

SEQ ID NO: 171143 - protein, 9 aa, Artificial Sequence
  Description of Artificial Sequence: Synthetic peptide
  Seed: RSLHNLAHL (TYRP1_HUMAN)
RQLHNLAHM

SEQ ID NO: 171144 - protein, 9 aa, Artificial Sequence
  Description of Artificial Sequence: Synthetic peptide
  Seed: IAIAVVGAL (TYRP1_HUMAN)
IPIAVVGAM

SEQ ID NO: 171145 - protein, 10 aa, Artificial Sequence
  Description of Artificial Sequence: Synthetic peptide
  Seed: GEVDFSHEGP (TYRP1_HUMAN)
GEVDFSHEGM

SEQ ID NO: 171146 - protein, 10 aa, Artificial Sequence
  Description of Artificial Sequence: Synthetic peptide
  Seed: LGPDGNTPQF (TYRP1_HUMAN)
LTPDGNTPQW

SEQ ID NO: 171147 - protein, 11 aa, Artificial Sequence
  Description of Artificial Sequence: Synthetic peptide
  Seed: MFVTAPDNLGY (TYRP1_HUMAN)
MWVTAPDNLGF

SEQ ID NO: 171148 - protein, 10 aa, Artificial Sequence
  Description of Artificial Sequence: Synthetic peptide
  Seed: GLFDTPPFYS (TYRP1_HUMAN)
GTFDTPPFYL

SEQ ID NO: 171149 - protein, 9 aa, Artificial Sequence
  Description of Artificial Sequence: Synthetic peptide
  Seed: IAIAVVGAL (TYRP1_HUMAN)
ISIAVVGAL

SEQ ID NO: 171150 - protein, 9 aa, Artificial Sequence
  Description of Artificial Sequence: Synthetic peptide
  Seed: FTDAVFDEW (TYRP1_HUMAN)
FDDAVFDEL

SEQ ID NO: 171151 - protein, 9 aa, Artificial Sequence
  Description of Artificial Sequence: Synthetic peptide
  Seed: REFSVPEII (TYRP1_HUMAN)
RHFSVPEIY

SEQ ID NO: 171152 - protein, 8 aa, Artificial Sequence
  Description of Artificial Sequence: Synthetic peptide
  Seed: YSNSTNSF (TYRP1_HUMAN)
YANSTNSY

SEQ ID NO: 171153 - protein, 10 aa, Artificial Sequence
  Description of Artificial Sequence: Synthetic peptide
  Seed: FFPLLLFQQA (TYRP1_HUMAN)
FDPLLLFQQA

SEQ ID NO: 171154 - protein, 9 aa, Artificial Sequence
  Description of Artificial Sequence: Synthetic peptide
  Seed: ASYLIRARR (TYRP1_HUMAN)
AWYLIRARR

SEQ ID NO: 171155 - protein, 9 aa, Artificial Sequence
  Description of Artificial Sequence: Synthetic peptide
  Seed: TASYLIRAR (TYRP1_HUMAN)
TSSYLIRAR

SEQ ID NO: 171156 - protein, 10 aa, Artificial Sequence
  Description of Artificial Sequence: Synthetic peptide
  Seed: PFYSNSTNSF (TYRP1_HUMAN)
PWYSNSTNSF

SEQ ID NO: 171157 - protein, 9 aa, Artificial Sequence
  Description of Artificial Sequence: Synthetic peptide
  Seed: RSNFDSTLI (TYRP1_HUMAN)
RLNFDSTLI

SEQ ID NO: 171158 - protein, 10 aa, Artificial Sequence
  Description of Artificial Sequence: Synthetic peptide
  Seed: VALIFGTASY (TYRP1_HUMAN)
VTLIFGTASW

SEQ ID NO: 171159 - protein, 9 aa, Artificial Sequence
  Description of Artificial Sequence: Synthetic peptide
  Seed: LQNPNQSVV (TYRP1_HUMAN)
LENPNQSVF

SEQ ID NO: 171160 - protein, 10 aa, Artificial Sequence
  Description of Artificial Sequence: Synthetic peptide
  Seed: TPQFENISIY (TYRP1_HUMAN)
TDQFENISIM

SEQ ID NO: 171161 - protein, 10 aa, Artificial Sequence
  Description of Artificial Sequence: Synthetic peptide
  Seed: RRYNADISTF (TYRP1_HUMAN)
RLYNADISTW

SEQ ID NO: 171162 - protein, 10 aa, Artificial Sequence
  Description of Artificial Sequence: Synthetic peptide
  Seed: VGLFDTPPFY (TYRP1_HUMAN)
VVLFDTPPFY

SEQ ID NO: 171163 - protein, 8 aa, Artificial Sequence
  Description of Artificial Sequence: Synthetic peptide
  Seed: YSDPTGKY (TYRP1_HUMAN)
YFDPTGKM

SEQ ID NO: 171164 - protein, 9 aa, Artificial Sequence
  Description of Artificial Sequence: Synthetic peptide
  Seed: KYDPAVRSL (TYRP1_HUMAN)
KQDPAVRSY

SEQ ID NO: 171165 - protein, 10 aa, Artificial Sequence
  Description of Artificial Sequence: Synthetic peptide
  Seed: ALIFGTASYL (TYRP1_HUMAN)
AIIFGTASYY

SEQ ID NO: 171166 - protein, 10 aa, Artificial Sequence
  Description of Artificial Sequence: Synthetic peptide
  Seed: MAKRTTHPLF (TYRP1_HUMAN)
MTKRTTHPLW

SEQ ID NO: 171167 - protein, 9 aa, Artificial Sequence
  Description of Artificial Sequence: Synthetic peptide
  Seed: AVRSLHNLA (TYRP1_HUMAN)
AVRSLHNLI

SEQ ID NO: 171168 - protein, 9 aa, Artificial Sequence
  Description of Artificial Sequence: Synthetic peptide
  Seed: FSVPEIIAI (TYRP1_HUMAN)
FRVPEIIAF

SEQ ID NO: 171169 - protein, 11 aa, Artificial Sequence
  Description of Artificial Sequence: Synthetic peptide
  Seed: YNYFVWTHYYS (TYRP1_HUMAN)
YFYFVWTHYYW

SEQ ID NO: 171170 - protein, 9 aa, Artificial Sequence
  Description of Artificial Sequence: Synthetic peptide
  Seed: FSHEGPAFL (TYRP1_HUMAN)
FYHEGPAFF

SEQ ID NO: 171171 - protein, 11 aa, Artificial Sequence
  Description of Artificial Sequence: Synthetic peptide
  Seed: QEMLQEPSFSL (TYRP1_HUMAN)
QMMLQEPSFSI

SEQ ID NO: 171172 - protein, 9 aa, Artificial Sequence
  Description of Artificial Sequence: Synthetic peptide
  Seed: AIAVVGALL (TYRP1_HUMAN)
AVAVVGALV

SEQ ID NO: 171173 - protein, 9 aa, Artificial Sequence
  Description of Artificial Sequence: Synthetic peptide
  Seed: HEGPAFLTW (TYRP1_HUMAN)
HAGPAFLTF

SEQ ID NO: 171174 - protein, 10 aa, Artificial Sequence
  Description of Artificial Sequence: Synthetic peptide
  Seed: FSLPYWNFAT (TYRP1_HUMAN)
FPLPYWNFAM

SEQ ID NO: 171175 - protein, 9 aa, Artificial Sequence
  Description of Artificial Sequence: Synthetic peptide
  Seed: FSHEGPAFL (TYRP1_HUMAN)
FYHEGPAFV

SEQ ID NO: 171176 - protein, 11 aa, Artificial Sequence
  Description of Artificial Sequence: Synthetic peptide
  Seed: AGNVARPMVQR (TYRP1_HUMAN)
AYNVARPMVQK

SEQ ID NO: 171177 - protein, 10 aa, Artificial Sequence
  Description of Artificial Sequence: Synthetic peptide
  Seed: REFSVPEIIA (TYRP1_HUMAN)
REFSVPEIII

SEQ ID NO: 171178 - protein, 10 aa, Artificial Sequence
  Description of Artificial Sequence: Synthetic peptide
  Seed: VLLHTFTDAV (TYRP1_HUMAN)
VMLHTFTDAV

SEQ ID NO: 171179 - protein, 9 aa, Artificial Sequence
  Description of Artificial Sequence: Synthetic peptide
  Seed: MCCPDLSPV (TYRP1_HUMAN)
MLCPDLSPT

SEQ ID NO: 171180 - protein, 10 aa, Artificial Sequence
  Description of Artificial Sequence: Synthetic peptide
  Seed: FPLLLFQQAR (TYRP1_HUMAN)
FPLLLFQQAI

SEQ ID NO: 171181 - protein, 9 aa, Artificial Sequence
  Description of Artificial Sequence: Synthetic peptide
  Seed: SVPEIIAIA (TYRP1_HUMAN)
SVPEIIAIF

SEQ ID NO: 171182 - protein, 9 aa, Artificial Sequence
  Description of Artificial Sequence: Synthetic peptide
  Seed: FLTWHRYHL (TYRP1_HUMAN)
FRTWHRYHY

SEQ ID NO: 171183 - protein, 9 aa, Artificial Sequence
  Description of Artificial Sequence: Synthetic peptide
  Seed: GPDGNTPQF (TYRP1_HUMAN)
GCDGNTPQM

SEQ ID NO: 171184 - protein, 9 aa, Artificial Sequence
  Description of Artificial Sequence: Synthetic peptide
  Seed: EGYSDPTGK (TYRP1_HUMAN)
EVYSDPTGR

SEQ ID NO: 171185 - protein, 11 aa, Artificial Sequence
  Description of Artificial Sequence: Synthetic peptide
  Seed: FVLLHTFTDAV (TYRP1_HUMAN)
FFLLHTFTDAV

SEQ ID NO: 171186 - protein, 10 aa, Artificial Sequence
  Description of Artificial Sequence: Synthetic peptide
  Seed: HFVRALDMAK (TYRP1_HUMAN)
HTVRALDMAK

SEQ ID NO: 171187 - protein, 10 aa, Artificial Sequence
  Description of Artificial Sequence: Synthetic peptide
  Seed: SLGCIFFPLL (TYRP1_HUMAN)
SLGCIFFPLM

SEQ ID NO: 171188 - protein, 9 aa, Artificial Sequence
  Description of Artificial Sequence: Synthetic peptide
  Seed: NMVPFWPPV (TYRP1_HUMAN)
NQVPFWPPF

SEQ ID NO: 171189 - protein, 10 aa, Artificial Sequence
  Description of Artificial Sequence: Synthetic peptide
  Seed: FVLLHTFTDA (TYRP1_HUMAN)
FVLLHTFTDI

SEQ ID NO: 171190 - protein, 9 aa, Artificial Sequence
  Description of Artificial Sequence: Synthetic peptide
  Seed: SIYNYFVWT (TYRP1_HUMAN)
SVYNYFVWI

SEQ ID NO: 171191 - protein, 11 aa, Artificial Sequence
  Description of Artificial Sequence: Synthetic peptide
  Seed: MAKRTTHPLFV (TYRP1_HUMAN)
MTKRTTHPLFK

SEQ ID NO: 171192 - protein, 8 aa, Artificial Sequence
  Description of Artificial Sequence: Synthetic peptide
  Seed: TTHPLFVI (TYRP1_HUMAN)
TQHPLFVL

SEQ ID NO: 171193 - protein, 10 aa, Artificial Sequence
  Description of Artificial Sequence: Synthetic peptide
  Seed: LLLVALIFGT (TYRP1_HUMAN)
LDLVALIFGV

SEQ ID NO: 171194 - protein, 10 aa, Artificial Sequence
  Description of Artificial Sequence: Synthetic peptide
  Seed: AQFPRQCATV (TYRP1_HUMAN)
AQFPRQCATL

SEQ ID NO: 171195 - protein, 9 aa, Artificial Sequence
  Description of Artificial Sequence: Synthetic peptide
  Seed: IAVVGALLL (TYRP1_HUMAN)
IQVVGALLI

SEQ ID NO: 171196 - protein, 10 aa, Artificial Sequence
  Description of Artificial Sequence: Synthetic peptide
  Seed: FSVPEIIAIA (TYRP1_HUMAN)
FLVPEIIAIT

SEQ ID NO: 171197 - protein, 9 aa, Artificial Sequence
  Description of Artificial Sequence: Synthetic peptide
  Seed: AVFDEWLRR (TYRP1_HUMAN)
AQFDEWLRY

SEQ ID NO: 171198 - protein, 9 aa, Artificial Sequence
  Description of Artificial Sequence: Synthetic peptide
  Seed: SFRNTVEGY (TYRP1_HUMAN)
SYRNTVEGL

SEQ ID NO: 171199 - protein, 9 aa, Artificial Sequence
  Description of Artificial Sequence: Synthetic peptide
  Seed: SMDEANQPL (TYRP1_HUMAN)
SQDEANQPI

SEQ ID NO: 171200 - protein, 9 aa, Artificial Sequence
  Description of Artificial Sequence: Synthetic peptide
  Seed: FSHEGPAFL (TYRP1_HUMAN)
FSHEGPAFR

SEQ ID NO: 171201 - protein, 9 aa, Artificial Sequence
  Description of Artificial Sequence: Synthetic peptide
  Seed: SLHNLAHLF (TYRP1_HUMAN)
SSHNLAHLM

SEQ ID NO: 171202 - protein, 9 aa, Artificial Sequence
  Description of Artificial Sequence: Synthetic peptide
  Seed: YLIRARRSM (TYRP1_HUMAN)
YQIRARRSF

SEQ ID NO: 171203 - protein, 10 aa, Artificial Sequence
  Description of Artificial Sequence: Synthetic peptide
  Seed: HLSPNDPIFV (TYRP1_HUMAN)
HQSPNDPIFF

SEQ ID NO: 171204 - protein, 10 aa, Artificial Sequence
  Description of Artificial Sequence: Synthetic peptide
  Seed: YFVWTHYYSV (TYRP1_HUMAN)
YMVWTHYYSV

SEQ ID NO: 171205 - protein, 10 aa, Artificial Sequence
  Description of Artificial Sequence: Synthetic peptide
  Seed: YNADISTFPL (TYRP1_HUMAN)
YSADISTFPY

SEQ ID NO: 171206 - protein, 10 aa, Artificial Sequence
  Description of Artificial Sequence: Synthetic peptide
  Seed: SPNSVFSQWR (TYRP1_HUMAN)
SFNSVFSQWK

SEQ ID NO: 171207 - protein, 9 aa, Artificial Sequence
  Description of Artificial Sequence: Synthetic peptide
  Seed: SRSNFDSTL (TYRP1_HUMAN)
SSSNFDSTY

SEQ ID NO: 171208 - protein, 9 aa, Artificial Sequence
  Description of Artificial Sequence: Synthetic peptide
  Seed: IAIAVVGAL (TYRP1_HUMAN)
IPIAVVGAL

SEQ ID NO: 171209 - protein, 9 aa, Artificial Sequence
  Description of Artificial Sequence: Synthetic peptide
  Seed: SHEGPAFLT (TYRP1_HUMAN)
SHEGPAFLL

SEQ ID NO: 171210 - protein, 9 aa, Artificial Sequence
  Description of Artificial Sequence: Synthetic peptide
  Seed: IAIAVVGAL (TYRP1_HUMAN)
IMIAVVGAI

SEQ ID NO: 171211 - protein, 8 aa, Artificial Sequence
  Description of Artificial Sequence: Synthetic peptide
  Seed: KNHFVRAL (TYRP1_HUMAN)
KQHFVRAV

SEQ ID NO: 171212 - protein, 9 aa, Artificial Sequence
  Description of Artificial Sequence: Synthetic peptide
  Seed: LPYWNFATG (TYRP1_HUMAN)
LPYWNFATV

SEQ ID NO: 171213 - protein, 9 aa, Artificial Sequence
  Description of Artificial Sequence: Synthetic peptide
  Seed: MAKRTTHPL (TYRP1_HUMAN)
MYKRTTHPV

SEQ ID NO: 171214 - protein, 9 aa, Artificial Sequence
  Description of Artificial Sequence: Synthetic peptide
  Seed: SRSNFDSTL (TYRP1_HUMAN)
SHSNFDSTV

SEQ ID NO: 171215 - protein, 10 aa, Artificial Sequence
  Description of Artificial Sequence: Synthetic peptide
  Seed: VLLHTFTDAV (TYRP1_HUMAN)
VRLHTFTDAV

SEQ ID NO: 171216 - protein, 9 aa, Artificial Sequence
  Description of Artificial Sequence: Synthetic peptide
  Seed: APIGHNRQY (TYRP1_HUMAN)
ATIGHNRQY

SEQ ID NO: 171217 - protein, 9 aa, Artificial Sequence
  Description of Artificial Sequence: Synthetic peptide
  Seed: LLSLGCIFF (TYRP1_HUMAN)
LISLGCIFY

SEQ ID NO: 171218 - protein, 9 aa, Artificial Sequence
  Description of Artificial Sequence: Synthetic peptide
  Seed: SVKKTFLGV (TYRP1_HUMAN)
SMKKTFLGL

SEQ ID NO: 171219 - protein, 10 aa, Artificial Sequence
  Description of Artificial Sequence: Synthetic peptide
  Seed: LLHTFTDAVF (TYRP1_HUMAN)
LMHTFTDAVA

SEQ ID NO: 171220 - protein, 10 aa, Artificial Sequence
  Description of Artificial Sequence: Synthetic peptide
  Seed: HNRQYNMVPF (TYRP1_HUMAN)
HHRQYNMVPF

SEQ ID NO: 171221 - protein, 8 aa, Artificial Sequence
  Description of Artificial Sequence: Synthetic peptide
  Seed: LIRARRSM (TYRP1_HUMAN)
LMRARRSF

SEQ ID NO: 171222 - protein, 9 aa, Artificial Sequence
  Description of Artificial Sequence: Synthetic peptide
  Seed: YTYEIQWPS (TYRP1_HUMAN)
YIYEIQWPP

SEQ ID NO: 171223 - protein, 10 aa, Artificial Sequence
  Description of Artificial Sequence: Synthetic peptide
  Seed: IYNYFVWTHY (TYRP1_HUMAN)
IINYFVWTHY

SEQ ID NO: 171224 - protein, 9 aa, Artificial Sequence
  Description of Artificial Sequence: Synthetic peptide
  Seed: TWHRYHLLR (TYRP1_HUMAN)
TVHRYHLLR

SEQ ID NO: 171225 - protein, 9 aa, Artificial Sequence
  Description of Artificial Sequence: Synthetic peptide
  Seed: RYNADISTF (TYRP1_HUMAN)
RANADISTL

SEQ ID NO: 171226 - protein, 9 aa, Artificial Sequence
  Description of Artificial Sequence: Synthetic peptide
  Seed: GSRSNFDST (TYRP1_HUMAN)
GTRSNFDSA

SEQ ID NO: 171227 - protein, 9 aa, Artificial Sequence
  Description of Artificial Sequence: Synthetic peptide
  Seed: REVWPLRFF (TYRP1_HUMAN)
RQVWPLRFF

SEQ ID NO: 171228 - protein, 9 aa, Artificial Sequence
  Description of Artificial Sequence: Synthetic peptide
  Seed: SPNDPIFVL (TYRP1_HUMAN)
SPNDPIFVA

SEQ ID NO: 171229 - protein, 10 aa, Artificial Sequence
  Description of Artificial Sequence: Synthetic peptide
  Seed: FLTWHRYHLL (TYRP1_HUMAN)
FLTWHRYHLI

SEQ ID NO: 171230 - protein, 9 aa, Artificial Sequence
  Description of Artificial Sequence: Synthetic peptide
  Seed: RYHLLRLEK (TYRP1_HUMAN)
RTHLLRLET

SEQ ID NO: 171231 - protein, 9 aa, Artificial Sequence
  Description of Artificial Sequence: Synthetic peptide
  Seed: ALIFGTASY (TYRP1_HUMAN)
AVIFGTASM

SEQ ID NO: 171232 - protein, 9 aa, Artificial Sequence
  Description of Artificial Sequence: Synthetic peptide
  Seed: APIGHNRQY (TYRP1_HUMAN)
AAIGHNRQM

SEQ ID NO: 171233 - protein, 9 aa, Artificial Sequence
  Description of Artificial Sequence: Synthetic peptide
  Seed: FGTASYLIR (TYRP1_HUMAN)
FATASYLIR

SEQ ID NO: 171234 - protein, 9 aa, Artificial Sequence
  Description of Artificial Sequence: Synthetic peptide
  Seed: IIAIAVVGA (TYRP1_HUMAN)
IMAIAVVGM

SEQ ID NO: 171235 - protein, 9 aa, Artificial Sequence
  Description of Artificial Sequence: Synthetic peptide
  Seed: MCCPDLSPV (TYRP1_HUMAN)
MMCPDLSPV

SEQ ID NO: 171236 - protein, 9 aa, Artificial Sequence
  Description of Artificial Sequence: Synthetic peptide
  Seed: QWPSREFSV (TYRP1_HUMAN)
QYPSREFSW

SEQ ID NO: 171237 - protein, 10 aa, Artificial Sequence
  Description of Artificial Sequence: Synthetic peptide
  Seed: ALIFGTASYL (TYRP1_HUMAN)
ALIFGTASYA

SEQ ID NO: 171238 - protein, 10 aa, Artificial Sequence
  Description of Artificial Sequence: Synthetic peptide
  Seed: YNYFVWTHYY (TYRP1_HUMAN)
YAYFVWTHYV

SEQ ID NO: 171239 - protein, 10 aa, Artificial Sequence
  Description of Artificial Sequence: Synthetic peptide
  Seed: MLQEPSFSLP (TYRP1_HUMAN)
MLQEPSFSLC

SEQ ID NO: 171240 - protein, 9 aa, Artificial Sequence
  Description of Artificial Sequence: Synthetic peptide
  Seed: NMVPFWPPV (TYRP1_HUMAN)
NAVPFWPPF

SEQ ID NO: 171241 - protein, 9 aa, Artificial Sequence
  Description of Artificial Sequence: Synthetic peptide
  Seed: RTTHPLFVI (TYRP1_HUMAN)
RSTHPLFVI

SEQ ID NO: 171242 - protein, 9 aa, Artificial Sequence
  Description of Artificial Sequence: Synthetic peptide
  Seed: RQYNMVPFW (TYRP1_HUMAN)
RFYNMVPFI

SEQ ID NO: 171243 - protein, 10 aa, Artificial Sequence
  Description of Artificial Sequence: Synthetic peptide
  Seed: YNADISTFPL (TYRP1_HUMAN)
YIADISTFPL

SEQ ID NO: 171244 - protein, 10 aa, Artificial Sequence
  Description of Artificial Sequence: Synthetic peptide
  Seed: RRYNADISTF (TYRP1_HUMAN)
RRYNADISTK

SEQ ID NO: 171245 - protein, 10 aa, Artificial Sequence
  Description of Artificial Sequence: Synthetic peptide
  Seed: TASYLIRARR (TYRP1_HUMAN)
TRSYLIRARR

SEQ ID NO: 171246 - protein, 10 aa, Artificial Sequence
  Description of Artificial Sequence: Synthetic peptide
  Seed: FPLLLFQQAR (TYRP1_HUMAN)
FPLLLFQQAS

SEQ ID NO: 171247 - protein, 9 aa, Artificial Sequence
  Description of Artificial Sequence: Synthetic peptide
  Seed: QEPSFSLPY (TYRP1_HUMAN)
QMPSFSLPM

SEQ ID NO: 171248 - protein, 9 aa, Artificial Sequence
  Description of Artificial Sequence: Synthetic peptide
  Seed: RSNFDSTLI (TYRP1_HUMAN)
RLNFDSTLW

SEQ ID NO: 171249 - protein, 10 aa, Artificial Sequence
  Description of Artificial Sequence: Synthetic peptide
  Seed: QEPSFSLPYW (TYRP1_HUMAN)
QSPSFSLPYW

SEQ ID NO: 171250 - protein, 9 aa, Artificial Sequence
  Description of Artificial Sequence: Synthetic peptide
  Seed: RARRSMDEA (TYRP1_HUMAN)
RVRRSMDEI

SEQ ID NO: 171251 - protein, 9 aa, Artificial Sequence
  Description of Artificial Sequence: Synthetic peptide
  Seed: APIGHNRQY (TYRP1_HUMAN)
AHIGHNRQY

SEQ ID NO: 171252 - protein, 9 aa, Artificial Sequence
  Description of Artificial Sequence: Synthetic peptide
  Seed: EGYSDPTGK (TYRP1_HUMAN)
ETYSDPTGY

SEQ ID NO: 171253 - protein, 9 aa, Artificial Sequence
  Description of Artificial Sequence: Synthetic peptide
  Seed: IIAIAVVGA (TYRP1_HUMAN)
IQAIAVVGL

SEQ ID NO: 171254 - protein, 10 aa, Artificial Sequence
  Description of Artificial Sequence: Synthetic peptide
  Seed: FVTAPDNLGY (TYRP1_HUMAN)
FTTAPDNLGW

SEQ ID NO: 171255 - protein, 9 aa, Artificial Sequence
  Description of Artificial Sequence: Synthetic peptide
  Seed: LTDQYQCYA (TYRP1_HUMAN)
LADQYQCYV

SEQ ID NO: 171256 - protein, 9 aa, Artificial Sequence
  Description of Artificial Sequence: Synthetic peptide
  Seed: FLTWHRYHL (TYRP1_HUMAN)
FMTWHRYHV

SEQ ID NO: 171257 - protein, 9 aa, Artificial Sequence
  Description of Artificial Sequence: Synthetic peptide
  Seed: TASYLIRAR (TYRP1_HUMAN)
TLSYLIRAR

SEQ ID NO: 171258 - protein, 9 aa, Artificial Sequence
  Description of Artificial Sequence: Synthetic peptide
  Seed: LLHTFTDAV (TYRP1_HUMAN)
LLHTFTDAL

SEQ ID NO: 171259 - protein, 9 aa, Artificial Sequence
  Description of Artificial Sequence: Synthetic peptide
  Seed: DNLGYTYEI (TYRP1_HUMAN)
DVLGYTYEL

SEQ ID NO: 171260 - protein, 9 aa, Artificial Sequence
  Description of Artificial Sequence: Synthetic peptide
  Seed: ENAPIGHNR (TYRP1_HUMAN)
ESAPIGHNR

SEQ ID NO: 171261 - protein, 10 aa, Artificial Sequence
  Description of Artificial Sequence: Synthetic peptide
  Seed: MVPFWPPVTN (TYRP1_HUMAN)
MWPFWPPVTF

SEQ ID NO: 171262 - protein, 9 aa, Artificial Sequence
  Description of Artificial Sequence: Synthetic peptide
  Seed: RYNADISTF (TYRP1_HUMAN)
RVNADISTM

SEQ ID NO: 171263 - protein, 9 aa, Artificial Sequence
  Description of Artificial Sequence: Synthetic peptide
  Seed: FLTWHRYHL (TYRP1_HUMAN)
FITWHRYHA

SEQ ID NO: 171264 - protein, 10 aa, Artificial Sequence
  Description of Artificial Sequence: Synthetic peptide
  Seed: LLLVALIFGT (TYRP1_HUMAN)
LPLVALIFGL

SEQ ID NO: 171265 - protein, 10 aa, Artificial Sequence
  Description of Artificial Sequence: Synthetic peptide
  Seed: MVPFWPPVTN (TYRP1_HUMAN)
MHPFWPPVTL

SEQ ID NO: 171266 - protein, 9 aa, Artificial Sequence
  Description of Artificial Sequence: Synthetic peptide
  Seed: YNYFVWTHY (TYRP1_HUMAN)
YFYFVWTHY

SEQ ID NO: 171267 - protein, 9 aa, Artificial Sequence
  Description of Artificial Sequence: Synthetic peptide
  Seed: AVRSLHNLA (TYRP1_HUMAN)
AYRSLHNLK

SEQ ID NO: 171268 - protein, 9 aa, Artificial Sequence
  Description of Artificial Sequence: Synthetic peptide
  Seed: TTHPLFVIA (TYRP1_HUMAN)
TTHPLFVIL

SEQ ID NO: 171269 - protein, 9 aa, Artificial Sequence
  Description of Artificial Sequence: Synthetic peptide
  Seed: RLEKDMQEM (TYRP1_HUMAN)
RLEKDMQEF

SEQ ID NO: 171270 - protein, 8 aa, Artificial Sequence
  Description of Artificial Sequence: Synthetic peptide
  Seed: SVPEIIAI (TYRP1_HUMAN)
SIPEIIAL

SEQ ID NO: 171271 - protein, 9 aa, Artificial Sequence
  Description of Artificial Sequence: Synthetic peptide
  Seed: SVKKTFLGV (TYRP1_HUMAN)
SGKKTFLGK

SEQ ID NO: 171272 - protein, 10 aa, Artificial Sequence
  Description of Artificial Sequence: Synthetic peptide
  Seed: RSMDEANQPL (TYRP1_HUMAN)
RVMDEANQPY

SEQ ID NO: 171273 - protein, 9 aa, Artificial Sequence
  Description of Artificial Sequence: Synthetic peptide
  Seed: IAIAVVGAL (TYRP1_HUMAN)
ISIAVVGAW

SEQ ID NO: 171274 - protein, 8 aa, Artificial Sequence
  Description of Artificial Sequence: Synthetic peptide
  Seed: LFDTPPFY (TYRP1_HUMAN)
LFDTPPFF

SEQ ID NO: 171275 - protein, 11 aa, Artificial Sequence
  Description of Artificial Sequence: Synthetic peptide
  Seed: YTYEIQWPSRE (TYRP1_HUMAN)
YAYEIQWPSRR

SEQ ID NO: 171276 - protein, 10 aa, Artificial Sequence
  Description of Artificial Sequence: Synthetic peptide
  Seed: VLLHTFTDAV (TYRP1_HUMAN)
VCLHTFTDAV

SEQ ID NO: 171277 - protein, 11 aa, Artificial Sequence
  Description of Artificial Sequence: Synthetic peptide
  Seed: RLPEPQDVAQC (TYRP1_HUMAN)
RMPEPQDVAQI

SEQ ID NO: 171278 - protein, 10 aa, Artificial Sequence
  Description of Artificial Sequence: Synthetic peptide
  Seed: FVWTHYYSVK (TYRP1_HUMAN)
FLWTHYYSVK

SEQ ID NO: 171279 - protein, 11 aa, Artificial Sequence
  Description of Artificial Sequence: Synthetic peptide
  Seed: YYSVKKTFLGV (TYRP1_HUMAN)
YYSVKKTFLGI

SEQ ID NO: 171280 - protein, 10 aa, Artificial Sequence
  Description of Artificial Sequence: Synthetic peptide
  Seed: YNADISTFPL (TYRP1_HUMAN)
YIADISTFPM

SEQ ID NO: 171281 - protein, 9 aa, Artificial Sequence
  Description of Artificial Sequence: Synthetic peptide
  Seed: FSHEGPAFL (TYRP1_HUMAN)
FHHEGPAFY

SEQ ID NO: 171282 - protein, 9 aa, Artificial Sequence
  Description of Artificial Sequence: Synthetic peptide
  Seed: MSAPKLLSL (TYRP1_HUMAN)
MFAPKLLSV

SEQ ID NO: 171283 - protein, 10 aa, Artificial Sequence
  Description of Artificial Sequence: Synthetic peptide
  Seed: RSLHNLAHLF (TYRP1_HUMAN)
RYLHNLAHLL

SEQ ID NO: 171284 - protein, 9 aa, Artificial Sequence
  Description of Artificial Sequence: Synthetic peptide
  Seed: LIFGTASYL (TYRP1_HUMAN)
LRFGTASYF

SEQ ID NO: 171285 - protein, 9 aa, Artificial Sequence
  Description of Artificial Sequence: Synthetic peptide
  Seed: RQCATVEAL (TYRP1_HUMAN)
RLCATVEAL

SEQ ID NO: 171286 - protein, 10 aa, Artificial Sequence
  Description of Artificial Sequence: Synthetic peptide
  Seed: SPNDPIFVLL (TYRP1_HUMAN)
SANDPIFVLF

SEQ ID NO: 171287 - protein, 10 aa, Artificial Sequence
  Description of Artificial Sequence: Synthetic peptide
  Seed: SMDEANQPLL (TYRP1_HUMAN)
STDEANQPLY

SEQ ID NO: 171288 - protein, 11 aa, Artificial Sequence
  Description of Artificial Sequence: Synthetic peptide
  Seed: FENISIYNYFV (TYRP1_HUMAN)
FMNISIYNYFV

SEQ ID NO: 171289 - protein, 9 aa, Artificial Sequence
  Description of Artificial Sequence: Synthetic peptide
  Seed: RRNLLDLSK (TYRP1_HUMAN)
RRNLLDLSF

SEQ ID NO: 171290 - protein, 10 aa, Artificial Sequence
  Description of Artificial Sequence: Synthetic peptide
  Seed: GPAFLTWHRY (TYRP1_HUMAN)
GVAFLTWHRY

SEQ ID NO: 171291 - protein, 10 aa, Artificial Sequence
  Description of Artificial Sequence: Synthetic peptide
  Seed: FSLPYWNFAT (TYRP1_HUMAN)
FMLPYWNFAP

SEQ ID NO: 171292 - protein, 9 aa, Artificial Sequence
  Description of Artificial Sequence: Synthetic peptide
  Seed: ISIYNYFVW (TYRP1_HUMAN)
ILIYNYFVW

SEQ ID NO: 171293 - protein, 9 aa, Artificial Sequence
  Description of Artificial Sequence: Synthetic peptide
  Seed: REVWPLRFF (TYRP1_HUMAN)
RQVWPLRFL

SEQ ID NO: 171294 - protein, 8 aa, Artificial Sequence
  Description of Artificial Sequence: Synthetic peptide
  Seed: YAEEYEKL (TYRP1_HUMAN)
YSEEYEKL

SEQ ID NO: 171295 - protein, 9 aa, Artificial Sequence
  Description of Artificial Sequence: Synthetic peptide
  Seed: RTTHPLFVI (TYRP1_HUMAN)
RATHPLFVF

SEQ ID NO: 171296 - protein, 9 aa, Artificial Sequence
  Description of Artificial Sequence: Synthetic peptide
  Seed: IGHNRQYNM (TYRP1_HUMAN)
IAHNRQYNM

SEQ ID NO: 171297 - protein, 10 aa, Artificial Sequence
  Description of Artificial Sequence: Synthetic peptide
  Seed: LSPNDPIFVL (TYRP1_HUMAN)
LLPNDPIFVY

SEQ ID NO: 171298 - protein, 9 aa, Artificial Sequence
  Description of Artificial Sequence: Synthetic peptide
  Seed: MFVTAPDNL (TYRP1_HUMAN)
MFVTAPDNM

SEQ ID NO: 171299 - protein, 10 aa, Artificial Sequence
  Description of Artificial Sequence: Synthetic peptide
  Seed: RRNPAGNVAR (TYRP1_HUMAN)
RYNPAGNVAY

SEQ ID NO: 171300 - protein, 9 aa, Artificial Sequence
  Description of Artificial Sequence: Synthetic peptide
  Seed: NYFVWTHYY (TYRP1_HUMAN)
NMFVWTHYF

SEQ ID NO: 171301 - protein, 9 aa, Artificial Sequence
  Description of Artificial Sequence: Synthetic peptide
  Seed: RSLHNLAHL (TYRP1_HUMAN)
RQLHNLAHR

SEQ ID NO: 171302 - protein, 9 aa, Artificial Sequence
  Description of Artificial Sequence: Synthetic peptide
  Seed: TADSRPHSP (TYRP1_HUMAN)
TCDSRPHSF

SEQ ID NO: 171303 - protein, 9 aa, Artificial Sequence
  Description of Artificial Sequence: Synthetic peptide
  Seed: VTAPDNLGY (TYRP1_HUMAN)
VMAPDNLGF

SEQ ID NO: 171304 - protein, 8 aa, Artificial Sequence
  Description of Artificial Sequence: Synthetic peptide
  Seed: HTFTDAVF (TYRP1_HUMAN)
HTFTDAVW

SEQ ID NO: 171305 - protein, 10 aa, Artificial Sequence
  Description of Artificial Sequence: Synthetic peptide
  Seed: RRYNADISTF (TYRP1_HUMAN)
RYYNADISTI

SEQ ID NO: 171306 - protein, 9 aa, Artificial Sequence
  Description of Artificial Sequence: Synthetic peptide
  Seed: NRQYNMVPF (TYRP1_HUMAN)
NQQYNMVPF

SEQ ID NO: 171307 - protein, 8 aa, Artificial Sequence
  Description of Artificial Sequence: Synthetic peptide
  Seed: YFVWTHYY (TYRP1_HUMAN)
YWVWTHYY

SEQ ID NO: 171308 - protein, 9 aa, Artificial Sequence
  Description of Artificial Sequence: Synthetic peptide
  Seed: NYFVWTHYY (TYRP1_HUMAN)
NFFVWTHYM

SEQ ID NO: 171309 - protein, 9 aa, Artificial Sequence
  Description of Artificial Sequence: Synthetic peptide
  Seed: TLISPNSVF (TYRP1_HUMAN)
TTISPNSVY

SEQ ID NO: 171310 - protein, 9 aa, Artificial Sequence
  Description of Artificial Sequence: Synthetic peptide
  Seed: DDREVWPLR (TYRP1_HUMAN)
DGREVWPLR

SEQ ID NO: 171311 - protein, 9 aa, Artificial Sequence
  Description of Artificial Sequence: Synthetic peptide
  Seed: HLSPNDPIF (TYRP1_HUMAN)
HHSPNDPIW

SEQ ID NO: 171312 - protein, 9 aa, Artificial Sequence
  Description of Artificial Sequence: Synthetic peptide
  Seed: TAPDNLGYT (TYRP1_HUMAN)
TAPDNLGYM

SEQ ID NO: 171313 - protein, 10 aa, Artificial Sequence
  Description of Artificial Sequence: Synthetic peptide
  Seed: YEIQWPSREF (TYRP1_HUMAN)
YRIQWPSREF

SEQ ID NO: 171314 - protein, 10 aa, Artificial Sequence
  Description of Artificial Sequence: Synthetic peptide
  Seed: KLLSLGCIFF (TYRP1_HUMAN)
KILSLGCIFL

SEQ ID NO: 171315 - protein, 10 aa, Artificial Sequence
  Description of Artificial Sequence: Synthetic peptide
  Seed: IIAIAVVGAL (TYRP1_HUMAN)
IIAIAVVGAV

SEQ ID NO: 171316 - protein, 9 aa, Artificial Sequence
  Description of Artificial Sequence: Synthetic peptide
  Seed: LLVALIFGT (TYRP1_HUMAN)
LTVALIFGI

SEQ ID NO: 171317 - protein, 9 aa, Artificial Sequence
  Description of Artificial Sequence: Synthetic peptide
  Seed: LHTFTDAVF (TYRP1_HUMAN)
LLTFTDAVY

SEQ ID NO: 171318 - protein, 11 aa, Artificial Sequence
  Description of Artificial Sequence: Synthetic peptide
  Seed: FWPPVTNTEMF (TYRP1_HUMAN)
FQPPVTNTEMW

SEQ ID NO: 171319 - protein, 9 aa, Artificial Sequence
  Description of Artificial Sequence: Synthetic peptide
  Seed: RTTHPLFVI (TYRP1_HUMAN)
RSTHPLFVY

SEQ ID NO: 171320 - protein, 9 aa, Artificial Sequence
  Description of Artificial Sequence: Synthetic peptide
  Seed: YTYEIQWPS (TYRP1_HUMAN)
YAYEIQWPC

SEQ ID NO: 171321 - protein, 9 aa, Artificial Sequence
  Description of Artificial Sequence: Synthetic peptide
  Seed: ACDQRVLIV (TYRP1_HUMAN)
AVDQRVLIL

SEQ ID NO: 171322 - protein, 9 aa, Artificial Sequence
  Description of Artificial Sequence: Synthetic peptide
  Seed: FVWTHYYSV (TYRP1_HUMAN)
FIWTHYYSM

SEQ ID NO: 171323 - protein, 10 aa, Artificial Sequence
  Description of Artificial Sequence: Synthetic peptide
  Seed: VALIFGTASY (TYRP1_HUMAN)
VGLIFGTASY

SEQ ID NO: 171324 - protein, 9 aa, Artificial Sequence
  Description of Artificial Sequence: Synthetic peptide
  Seed: GPDGNTPQF (TYRP1_HUMAN)
GGDGNTPQL

SEQ ID NO: 171325 - protein, 10 aa, Artificial Sequence
  Description of Artificial Sequence: Synthetic peptide
  Seed: VPEIIAIAVV (TYRP1_HUMAN)
VEEIIAIAVL

SEQ ID NO: 171326 - protein, 9 aa, Artificial Sequence
  Description of Artificial Sequence: Synthetic peptide
  Seed: MSAPKLLSL (TYRP1_HUMAN)
MWAPKLLSF

SEQ ID NO: 171327 - protein, 10 aa, Artificial Sequence
  Description of Artificial Sequence: Synthetic peptide
  Seed: LGPDGNTPQF (TYRP1_HUMAN)
LFPDGNTPQL

SEQ ID NO: 171328 - protein, 9 aa, Artificial Sequence
  Description of Artificial Sequence: Synthetic peptide
  Seed: FSVPEIIAI (TYRP1_HUMAN)
FYVPEIIAM

SEQ ID NO: 171329 - protein, 9 aa, Artificial Sequence
  Description of Artificial Sequence: Synthetic peptide
  Seed: FLTWHRYHL (TYRP1_HUMAN)
FMTWHRYHK

SEQ ID NO: 171330 - protein, 10 aa, Artificial Sequence
  Description of Artificial Sequence: Synthetic peptide
  Seed: YNYFVWTHYY (TYRP1_HUMAN)
YTYFVWTHYH

SEQ ID NO: 171331 - protein, 9 aa, Artificial Sequence
  Description of Artificial Sequence: Synthetic peptide
  Seed: MLQEPSFSL (TYRP1_HUMAN)
MFQEPSFSV

SEQ ID NO: 171332 - protein, 9 aa, Artificial Sequence
  Description of Artificial Sequence: Synthetic peptide
  Seed: ALIFGTASY (TYRP1_HUMAN)
ATIFGTASW

SEQ ID NO: 171333 - protein, 10 aa, Artificial Sequence
  Description of Artificial Sequence: Synthetic peptide
  Seed: AVFDEWLRRY (TYRP1_HUMAN)
AMFDEWLRRK

SEQ ID NO: 171334 - protein, 8 aa, Artificial Sequence
  Description of Artificial Sequence: Synthetic peptide
  Seed: RQYNMVPF (TYRP1_HUMAN)
RVYNMVPF

SEQ ID NO: 171335 - protein, 9 aa, Artificial Sequence
  Description of Artificial Sequence: Synthetic peptide
  Seed: AFLTWHRYH (TYRP1_HUMAN)
AILTWHRYK

SEQ ID NO: 171336 - protein, 10 aa, Artificial Sequence
  Description of Artificial Sequence: Synthetic peptide
  Seed: YNMVPFWPPV (TYRP1_HUMAN)
YTMVPFWPPL

SEQ ID NO: 171337 - protein, 9 aa, Artificial Sequence
  Description of Artificial Sequence: Synthetic peptide
  Seed: KYDPAVRSL (TYRP1_HUMAN)
KFDPAVRSV

SEQ ID NO: 171338 - protein, 9 aa, Artificial Sequence
  Description of Artificial Sequence: Synthetic peptide
  Seed: FVWTHYYSV (TYRP1_HUMAN)
FGWTHYYSL

SEQ ID NO: 171339 - protein, 9 aa, Artificial Sequence
  Description of Artificial Sequence: Synthetic peptide
  Seed: FTDAVFDEW (TYRP1_HUMAN)
FSDAVFDEM

SEQ ID NO: 171340 - protein, 9 aa, Artificial Sequence
  Description of Artificial Sequence: Synthetic peptide
  Seed: RQYNMVPFW (TYRP1_HUMAN)
RQYNMVPFR

SEQ ID NO: 171341 - protein, 9 aa, Artificial Sequence
  Description of Artificial Sequence: Synthetic peptide
  Seed: FLGVGQESF (TYRP1_HUMAN)
FYGVGQESL

SEQ ID NO: 171342 - protein, 9 aa, Artificial Sequence
  Description of Artificial Sequence: Synthetic peptide
  Seed: GLFDTPPFY (TYRP1_HUMAN)
GVFDTPPFK

SEQ ID NO: 171343 - protein, 9 aa, Artificial Sequence
  Description of Artificial Sequence: Synthetic peptide
  Seed: YTYEIQWPS (TYRP1_HUMAN)
YLYEIQWPW

SEQ ID NO: 171344 - protein, 11 aa, Artificial Sequence
  Description of Artificial Sequence: Synthetic peptide
  Seed: FPRQCATVEAL (TYRP1_HUMAN)
FPRQCATVEAM

SEQ ID NO: 171345 - protein, 10 aa, Artificial Sequence
  Description of Artificial Sequence: Synthetic peptide
  Seed: EFSVPEIIAI (TYRP1_HUMAN)
ECSVPEIIAV

SEQ ID NO: 171346 - protein, 10 aa, Artificial Sequence
  Description of Artificial Sequence: Synthetic peptide
  Seed: HPLFVIATRR (TYRP1_HUMAN)
HTLFVIATRN

SEQ ID NO: 171347 - protein, 11 aa, Artificial Sequence
  Description of Artificial Sequence: Synthetic peptide
  Seed: KTFLGVGQESF (TYRP1_HUMAN)
KAFLGVGQESF

SEQ ID NO: 171348 - protein, 10 aa, Artificial Sequence
  Description of Artificial Sequence: Synthetic peptide
  Seed: YNYFVWTHYY (TYRP1_HUMAN)
YNYFVWTHYI

SEQ ID NO: 171349 - protein, 10 aa, Artificial Sequence
  Description of Artificial Sequence: Synthetic peptide
  Seed: EIIAIAVVGA (TYRP1_HUMAN)
EWIAIAVVGI

SEQ ID NO: 171350 - protein, 9 aa, Artificial Sequence
  Description of Artificial Sequence: Synthetic peptide
  Seed: SLGCIFFPL (TYRP1_HUMAN)
SQGCIFFPA

SEQ ID NO: 171351 - protein, 9 aa, Artificial Sequence
  Description of Artificial Sequence: Synthetic peptide
  Seed: YNYFVWTHY (TYRP1_HUMAN)
YSYFVWTHK

SEQ ID NO: 171352 - protein, 9 aa, Artificial Sequence
  Description of Artificial Sequence: Synthetic peptide
  Seed: IAVVGALLL (TYRP1_HUMAN)
ISVVGALLI

SEQ ID NO: 171353 - protein, 8 aa, Artificial Sequence
  Description of Artificial Sequence: Synthetic peptide
  Seed: IFGTASYL (TYRP1_HUMAN)
IYGTASYM

SEQ ID NO: 171354 - protein, 9 aa, Artificial Sequence
  Description of Artificial Sequence: Synthetic peptide
  Seed: QRLPEPQDV (TYRP1_HUMAN)
QHLPEPQDM

SEQ ID NO: 171355 - protein, 10 aa, Artificial Sequence
  Description of Artificial Sequence: Synthetic peptide
  Seed: LSLGCIFFPL (TYRP1_HUMAN)
LYLGCIFFPL

SEQ ID NO: 171356 - protein, 10 aa, Artificial Sequence
  Description of Artificial Sequence: Synthetic peptide
  Seed: SREFSVPEII (TYRP1_HUMAN)
STEFSVPEIL

SEQ ID NO: 171357 - protein, 10 aa, Artificial Sequence
  Description of Artificial Sequence: Synthetic peptide
  Seed: YNYFVWTHYY (TYRP1_HUMAN)
YFYFVWTHYV

SEQ ID NO: 171358 - protein, 10 aa, Artificial Sequence
  Description of Artificial Sequence: Synthetic peptide
  Seed: LSPNDPIFVL (TYRP1_HUMAN)
LWPNDPIFVF

SEQ ID NO: 171359 - protein, 10 aa, Artificial Sequence
  Description of Artificial Sequence: Synthetic peptide
  Seed: VLLHTFTDAV (TYRP1_HUMAN)
VYLHTFTDAI

SEQ ID NO: 171360 - protein, 9 aa, Artificial Sequence
  Description of Artificial Sequence: Synthetic peptide
  Seed: RFFNRTCHC (TYRP1_HUMAN)
RFFNRTCHF

SEQ ID NO: 171361 - protein, 9 aa, Artificial Sequence
  Description of Artificial Sequence: Synthetic peptide
  Seed: FYSNSTNSF (TYRP1_HUMAN)
FSSNSTNSF

SEQ ID NO: 171362 - protein, 9 aa, Artificial Sequence
  Description of Artificial Sequence: Synthetic peptide
  Seed: IAVVGALLL (TYRP1_HUMAN)
ISVVGALLY

SEQ ID NO: 171363 - protein, 9 aa, Artificial Sequence
  Description of Artificial Sequence: Synthetic peptide
  Seed: YLIRARRSM (TYRP1_HUMAN)
YLIRARRSL

SEQ ID NO: 171364 - protein, 10 aa, Artificial Sequence
  Description of Artificial Sequence: Synthetic peptide
  Seed: LGPDGNTPQF (TYRP1_HUMAN)
LTPDGNTPQM

SEQ ID NO: 171365 - protein, 9 aa, Artificial Sequence
  Description of Artificial Sequence: Synthetic peptide
  Seed: REFSVPEII (TYRP1_HUMAN)
RLFSVPEIY

SEQ ID NO: 171366 - protein, 10 aa, Artificial Sequence
  Description of Artificial Sequence: Synthetic peptide
  Seed: LLLVALIFGT (TYRP1_HUMAN)
LSLVALIFGL

SEQ ID NO: 171367 - protein, 10 aa, Artificial Sequence
  Description of Artificial Sequence: Synthetic peptide
  Seed: LTWHRYHLLR (TYRP1_HUMAN)
LFWHRYHLLK

SEQ ID NO: 171368 - protein, 11 aa, Artificial Sequence
  Description of Artificial Sequence: Synthetic peptide
  Seed: RRSMDEANQPL (TYRP1_HUMAN)
RDSMDEANQPV

SEQ ID NO: 171369 - protein, 9 aa, Artificial Sequence
  Description of Artificial Sequence: Synthetic peptide
  Seed: IAIAVVGAL (TYRP1_HUMAN)
ITIAVVGAF

SEQ ID NO: 171370 - protein, 9 aa, Artificial Sequence
  Description of Artificial Sequence: Synthetic peptide
  Seed: ARAQFPRQC (TYRP1_HUMAN)
AQAQFPRQF

SEQ ID NO: 171371 - protein, 10 aa, Artificial Sequence
  Description of Artificial Sequence: Synthetic peptide
  Seed: RTTHPLFVIA (TYRP1_HUMAN)
RVTHPLFVIK

SEQ ID NO: 171372 - protein, 9 aa, Artificial Sequence
  Description of Artificial Sequence: Synthetic peptide
  Seed: QEPSFSLPY (TYRP1_HUMAN)
QLPSFSLPY

SEQ ID NO: 171373 - protein, 9 aa, Artificial Sequence
  Description of Artificial Sequence: Synthetic peptide
  Seed: RARRSMDEA (TYRP1_HUMAN)
RFRRSMDEA

SEQ ID NO: 171374 - protein, 9 aa, Artificial Sequence
  Description of Artificial Sequence: Synthetic peptide
  Seed: LIFGTASYL (TYRP1_HUMAN)
LSFGTASYL

SEQ ID NO: 171375 - protein, 10 aa, Artificial Sequence
  Description of Artificial Sequence: Synthetic peptide
  Seed: YNADISTFPL (TYRP1_HUMAN)
YTADISTFPT

SEQ ID NO: 171376 - protein, 9 aa, Artificial Sequence
  Description of Artificial Sequence: Synthetic peptide
  Seed: AVVGALLLV (TYRP1_HUMAN)
ALVGALLLT

SEQ ID NO: 171377 - protein, 9 aa, Artificial Sequence
  Description of Artificial Sequence: Synthetic peptide
  Seed: AFLTWHRYH (TYRP1_HUMAN)
ATLTWHRYK

SEQ ID NO: 171378 - protein, 9 aa, Artificial Sequence
  Description of Artificial Sequence: Synthetic peptide
  Seed: RARRSMDEA (TYRP1_HUMAN)
RSRRSMDEM

SEQ ID NO: 171379 - protein, 9 aa, Artificial Sequence
  Description of Artificial Sequence: Synthetic peptide
  Seed: SRSNFDSTL (TYRP1_HUMAN)
SHSNFDSTF

SEQ ID NO: 171380 - protein, 9 aa, Artificial Sequence
  Description of Artificial Sequence: Synthetic peptide
  Seed: GPAFLTWHR (TYRP1_HUMAN)
GIAFLTWHK

SEQ ID NO: 171381 - protein, 9 aa, Artificial Sequence
  Description of Artificial Sequence: Synthetic peptide
  Seed: LLSLGCIFF (TYRP1_HUMAN)
LTSLGCIFF

SEQ ID NO: 171382 - protein, 10 aa, Artificial Sequence
  Description of Artificial Sequence: Synthetic peptide
  Seed: SMDEANQPLL (TYRP1_HUMAN)
SIDEANQPLM

SEQ ID NO: 171383 - protein, 10 aa, Artificial Sequence
  Description of Artificial Sequence: Synthetic peptide
  Seed: SMDEANQPLL (TYRP1_HUMAN)
SFDEANQPLF

SEQ ID NO: 171384 - protein, 9 aa, Artificial Sequence
  Description of Artificial Sequence: Synthetic peptide
  Seed: SRSNFDSTL (TYRP1_HUMAN)
SLSNFDSTF

SEQ ID NO: 171385 - protein, 9 aa, Artificial Sequence
  Description of Artificial Sequence: Synthetic peptide
  Seed: FLGVGQESF (TYRP1_HUMAN)
FMGVGQESY

SEQ ID NO: 171386 - protein, 9 aa, Artificial Sequence
  Description of Artificial Sequence: Synthetic peptide
  Seed: MCCPDLSPV (TYRP1_HUMAN)
MVCPDLSPA

SEQ ID NO: 171387 - protein, 10 aa, Artificial Sequence
  Description of Artificial Sequence: Synthetic peptide
  Seed: ADSRPHSPQY (TYRP1_HUMAN)
ACSRPHSPQW

SEQ ID NO: 171388 - protein, 8 aa, Artificial Sequence
  Description of Artificial Sequence: Synthetic peptide
  Seed: REFSVPEI (TYRP1_HUMAN)
REFSVPEF

SEQ ID NO: 171389 - protein, 10 aa, Artificial Sequence
  Description of Artificial Sequence: Synthetic peptide
  Seed: LLLVALIFGT (TYRP1_HUMAN)
LCLVALIFGV

SEQ ID NO: 171390 - protein, 9 aa, Artificial Sequence
  Description of Artificial Sequence: Synthetic peptide
  Seed: AACDQRVLI (TYRP1_HUMAN)
ALCDQRVLV

SEQ ID NO: 171391 - protein, 9 aa, Artificial Sequence
  Description of Artificial Sequence: Synthetic peptide
  Seed: LHTFTDAVF (TYRP1_HUMAN)
LMTFTDAVF

SEQ ID NO: 171392 - protein, 9 aa, Artificial Sequence
  Description of Artificial Sequence: Synthetic peptide
  Seed: RSNFDSTLI (TYRP1_HUMAN)
RANFDSTLW

SEQ ID NO: 171393 - protein, 9 aa, Artificial Sequence
  Description of Artificial Sequence: Synthetic peptide
  Seed: SIYNYFVWT (TYRP1_HUMAN)
SQYNYFVWI

SEQ ID NO: 171394 - protein, 9 aa, Artificial Sequence
  Description of Artificial Sequence: Synthetic peptide
  Seed: HLSPNDPIF (TYRP1_HUMAN)
HTSPNDPIL

SEQ ID NO: 171395 - protein, 10 aa, Artificial Sequence
  Description of Artificial Sequence: Synthetic peptide
  Seed: TAPDNLGYTY (TYRP1_HUMAN)
TVPDNLGYTY

SEQ ID NO: 171396 - protein, 9 aa, Artificial Sequence
  Description of Artificial Sequence: Synthetic peptide
  Seed: YSNSTNSFR (TYRP1_HUMAN)
YSNSTNSFM

SEQ ID NO: 171397 - protein, 9 aa, Artificial Sequence
  Description of Artificial Sequence: Synthetic peptide
  Seed: ALIFGTASY (TYRP1_HUMAN)
ARIFGTASY

SEQ ID NO: 171398 - protein, 9 aa, Artificial Sequence
  Description of Artificial Sequence: Synthetic peptide
  Seed: RGAACDQRV (TYRP1_HUMAN)
RLAACDQRV

SEQ ID NO: 171399 - protein, 9 aa, Artificial Sequence
  Description of Artificial Sequence: Synthetic peptide
  Seed: ALLLVALIF (TYRP1_HUMAN)
AQLLVALIL

SEQ ID NO: 171400 - protein, 9 aa, Artificial Sequence
  Description of Artificial Sequence: Synthetic peptide
  Seed: YNYFVWTHY (TYRP1_HUMAN)
YIYFVWTHY

SEQ ID NO: 171401 - protein, 10 aa, Artificial Sequence
  Description of Artificial Sequence: Synthetic peptide
  Seed: GLFDTPPFYS (TYRP1_HUMAN)
GAFDTPPFYI

SEQ ID NO: 171402 - protein, 9 aa, Artificial Sequence
  Description of Artificial Sequence: Synthetic peptide
  Seed: RYNADISTF (TYRP1_HUMAN)
RKNADISTF

SEQ ID NO: 171403 - protein, 9 aa, Artificial Sequence
  Description of Artificial Sequence: Synthetic peptide
  Seed: AIAVVGALL (TYRP1_HUMAN)
AIAVVGALY

SEQ ID NO: 171404 - protein, 11 aa, Artificial Sequence
  Description of Artificial Sequence: Synthetic peptide
  Seed: RRYNADISTFP (TYRP1_HUMAN)
RYYNADISTFK

SEQ ID NO: 171405 - protein, 10 aa, Artificial Sequence
  Description of Artificial Sequence: Synthetic peptide
  Seed: EIIAIAVVGA (TYRP1_HUMAN)
EDIAIAVVGI

SEQ ID NO: 171406 - protein, 9 aa, Artificial Sequence
  Description of Artificial Sequence: Synthetic peptide
  Seed: RQYNMVPFW (TYRP1_HUMAN)
RSYNMVPFF

SEQ ID NO: 171407 - protein, 10 aa, Artificial Sequence
  Description of Artificial Sequence: Synthetic peptide
  Seed: TEDGPIRRNP (TYRP1_HUMAN)
TEDGPIRRNL

SEQ ID NO: 171408 - protein, 11 aa, Artificial Sequence
  Description of Artificial Sequence: Synthetic peptide
  Seed: YSDPTGKYDPA (TYRP1_HUMAN)
YVDPTGKYDPM

SEQ ID NO: 171409 - protein, 9 aa, Artificial Sequence
  Description of Artificial Sequence: Synthetic peptide
  Seed: RAQFPRQCA (TYRP1_HUMAN)
RPQFPRQCL

SEQ ID NO: 171410 - protein, 9 aa, Artificial Sequence
  Description of Artificial Sequence: Synthetic peptide
  Seed: VRSLHNLAH (TYRP1_HUMAN)
VYSLHNLAY

SEQ ID NO: 171411 - protein, 10 aa, Artificial Sequence
  Description of Artificial Sequence: Synthetic peptide
  Seed: GLFDTPPFYS (TYRP1_HUMAN)
GVFDTPPFYI

SEQ ID NO: 171412 - protein, 9 aa, Artificial Sequence
  Description of Artificial Sequence: Synthetic peptide
  Seed: FSLPYWNFA (TYRP1_HUMAN)
FPLPYWNFV

SEQ ID NO: 171413 - protein, 10 aa, Artificial Sequence
  Description of Artificial Sequence: Synthetic peptide
  Seed: YNYFVWTHYY (TYRP1_HUMAN)
YFYFVWTHYM

SEQ ID NO: 171414 - protein, 11 aa, Artificial Sequence
  Description of Artificial Sequence: Synthetic peptide
  Seed: YNMVPFWPPVT (TYRP1_HUMAN)
YIMVPFWPPVW

SEQ ID NO: 171415 - protein, 9 aa, Artificial Sequence
  Description of Artificial Sequence: Synthetic peptide
  Seed: HEGPAFLTW (TYRP1_HUMAN)
HAGPAFLTY

SEQ ID NO: 171416 - protein, 10 aa, Artificial Sequence
  Description of Artificial Sequence: Synthetic peptide
  Seed: TPQFENISIY (TYRP1_HUMAN)
TMQFENISIF

SEQ ID NO: 171417 - protein, 9 aa, Artificial Sequence
  Description of Artificial Sequence: Synthetic peptide
  Seed: KYDPAVRSL (TYRP1_HUMAN)
KDDPAVRSV

SEQ ID NO: 171418 - protein, 9 aa, Artificial Sequence
  Description of Artificial Sequence: Synthetic peptide
  Seed: VPEIIAIAV (TYRP1_HUMAN)
VPEIIAIAY

SEQ ID NO: 171419 - protein, 9 aa, Artificial Sequence
  Description of Artificial Sequence: Synthetic peptide
  Seed: FPLENAPIG (TYRP1_HUMAN)
FPLENAPIL

SEQ ID NO: 171420 - protein, 10 aa, Artificial Sequence
  Description of Artificial Sequence: Synthetic peptide
  Seed: HNRQYNMVPF (TYRP1_HUMAN)
HMRQYNMVPM

SEQ ID NO: 171421 - protein, 10 aa, Artificial Sequence
  Description of Artificial Sequence: Synthetic peptide
  Seed: LLVALIFGTA (TYRP1_HUMAN)
LMVALIFGTL

SEQ ID NO: 171422 - protein, 9 aa, Artificial Sequence
  Description of Artificial Sequence: Synthetic peptide
  Seed: SVFSQWRVV (TYRP1_HUMAN)
STFSQWRVF

SEQ ID NO: 171423 - protein, 10 aa, Artificial Sequence
  Description of Artificial Sequence: Synthetic peptide
  Seed: LLFQQARAQF (TYRP1_HUMAN)
LIFQQARAQF

SEQ ID NO: 171424 - protein, 9 aa, Artificial Sequence
  Description of Artificial Sequence: Synthetic peptide
  Seed: RSLHNLAHL (TYRP1_HUMAN)
RLLHNLAHW

SEQ ID NO: 171425 - protein, 10 aa, Artificial Sequence
  Description of Artificial Sequence: Synthetic peptide
  Seed: ASYLIRARRS (TYRP1_HUMAN)
ASYLIRARRR

SEQ ID NO: 171426 - protein, 9 aa, Artificial Sequence
  Description of Artificial Sequence: Synthetic peptide
  Seed: RPMVQRLPE (TYRP1_HUMAN)
RPMVQRLPL

SEQ ID NO: 171427 - protein, 9 aa, Artificial Sequence
  Description of Artificial Sequence: Synthetic peptide
  Seed: ISIYNYFVW (TYRP1_HUMAN)
IFIYNYFVF

SEQ ID NO: 171428 - protein, 9 aa, Artificial Sequence
  Description of Artificial Sequence: Synthetic peptide
  Seed: FLTWHRYHL (TYRP1_HUMAN)
FQTWHRYHV

SEQ ID NO: 171429 - protein, 10 aa, Artificial Sequence
  Description of Artificial Sequence: Synthetic peptide
  Seed: YNMVPFWPPV (TYRP1_HUMAN)
YIMVPFWPPL

SEQ ID NO: 171430 - protein, 9 aa, Artificial Sequence
  Description of Artificial Sequence: Synthetic peptide
  Seed: LLTDQYQCY (TYRP1_HUMAN)
LATDQYQCL

SEQ ID NO: 171431 - protein, 10 aa, Artificial Sequence
  Description of Artificial Sequence: Synthetic peptide
  Seed: FFPLLLFQQA (TYRP1_HUMAN)
FEPLLLFQQA

SEQ ID NO: 171432 - protein, 9 aa, Artificial Sequence
  Description of Artificial Sequence: Synthetic peptide
  Seed: LIFGTASYL (TYRP1_HUMAN)
LKFGTASYY

SEQ ID NO: 171433 - protein, 10 aa, Artificial Sequence
  Description of Artificial Sequence: Synthetic peptide
  Seed: SIYNYFVWTH (TYRP1_HUMAN)
SEYNYFVWTK

SEQ ID NO: 171434 - protein, 11 aa, Artificial Sequence
  Description of Artificial Sequence: Synthetic peptide
  Seed: FWPPVTNTEMF (TYRP1_HUMAN)
FYPPVTNTEMW

SEQ ID NO: 171435 - protein, 9 aa, Artificial Sequence
  Description of Artificial Sequence: Synthetic peptide
  Seed: SVKKTFLGV (TYRP1_HUMAN)
SYKKTFLGA

SEQ ID NO: 171436 - protein, 10 aa, Artificial Sequence
  Description of Artificial Sequence: Synthetic peptide
  Seed: YNADISTFPL (TYRP1_HUMAN)
YGADISTFPY

SEQ ID NO: 171437 - protein, 10 aa, Artificial Sequence
  Description of Artificial Sequence: Synthetic peptide
  Seed: RSMDEANQPL (TYRP1_HUMAN)
RQMDEANQPW

SEQ ID NO: 171438 - protein, 9 aa, Artificial Sequence
  Description of Artificial Sequence: Synthetic peptide
  Seed: SVPEIIAIA (TYRP1_HUMAN)
SMPEIIAIV

SEQ ID NO: 171439 - protein, 10 aa, Artificial Sequence
  Description of Artificial Sequence: Synthetic peptide
  Seed: YNYFVWTHYY (TYRP1_HUMAN)
YCYFVWTHYV

SEQ ID NO: 171440 - protein, 8 aa, Artificial Sequence
  Description of Artificial Sequence: Synthetic peptide
  Seed: TTHPLFVI (TYRP1_HUMAN)
TQHPLFVI

SEQ ID NO: 171441 - protein, 11 aa, Artificial Sequence
  Description of Artificial Sequence: Synthetic peptide
  Seed: IYNYFVWTHYY (TYRP1_HUMAN)
IKNYFVWTHYL

SEQ ID NO: 171442 - protein, 9 aa, Artificial Sequence
  Description of Artificial Sequence: Synthetic peptide
  Seed: STNSFRNTV (TYRP1_HUMAN)
SANSFRNTL

SEQ ID NO: 171443 - protein, 9 aa, Artificial Sequence
  Description of Artificial Sequence: Synthetic peptide
  Seed: LTWHRYHLL (TYRP1_HUMAN)
LQWHRYHLK

SEQ ID NO: 171444 - protein, 11 aa, Artificial Sequence
  Description of Artificial Sequence: Synthetic peptide
  Seed: MLQEPSFSLPY (TYRP1_HUMAN)
MVQEPSFSLPV

SEQ ID NO: 171445 - protein, 9 aa, Artificial Sequence
  Description of Artificial Sequence: Synthetic peptide
  Seed: SLHNLAHLF (TYRP1_HUMAN)
SLHNLAHLY

SEQ ID NO: 171446 - protein, 10 aa, Artificial Sequence
  Description of Artificial Sequence: Synthetic peptide
  Seed: TDAVFDEWLR (TYRP1_HUMAN)
TAAVFDEWLK

SEQ ID NO: 171447 - protein, 10 aa, Artificial Sequence
  Description of Artificial Sequence: Synthetic peptide
  Seed: EGYSDPTGKY (TYRP1_HUMAN)
EIYSDPTGKK

SEQ ID NO: 171448 - protein, 10 aa, Artificial Sequence
  Description of Artificial Sequence: Synthetic peptide
  Seed: LIFGTASYLI (TYRP1_HUMAN)
LVFGTASYLL

SEQ ID NO: 171449 - protein, 8 aa, Artificial Sequence
  Description of Artificial Sequence: Synthetic peptide
  Seed: YSNSTNSF (TYRP1_HUMAN)
YWNSTNSM

SEQ ID NO: 171450 - protein, 9 aa, Artificial Sequence
  Description of Artificial Sequence: Synthetic peptide
  Seed: SPNDPIFVL (TYRP1_HUMAN)
SLNDPIFVL

SEQ ID NO: 171451 - protein, 9 aa, Artificial Sequence
  Description of Artificial Sequence: Synthetic peptide
  Seed: HEGPAFLTW (TYRP1_HUMAN)
HMGPAFLTF

SEQ ID NO: 171452 - protein, 11 aa, Artificial Sequence
  Description of Artificial Sequence: Synthetic peptide
  Seed: YNYFVWTHYYS (TYRP1_HUMAN)
YMYFVWTHYYS

SEQ ID NO: 171453 - protein, 10 aa, Artificial Sequence
  Description of Artificial Sequence: Synthetic peptide
  Seed: LIFGTASYLI (TYRP1_HUMAN)
LYFGTASYLV

SEQ ID NO: 171454 - protein, 10 aa, Artificial Sequence
  Description of Artificial Sequence: Synthetic peptide
  Seed: LLLVALIFGT (TYRP1_HUMAN)
LLLVALIFGV

SEQ ID NO: 171455 - protein, 9 aa, Artificial Sequence
  Description of Artificial Sequence: Synthetic peptide
  Seed: APIGHNRQY (TYRP1_HUMAN)
APIGHNRQM

SEQ ID NO: 171456 - protein, 11 aa, Artificial Sequence
  Description of Artificial Sequence: Synthetic peptide
  Seed: GEVDFSHEGPA (TYRP1_HUMAN)
GEVDFSHEGPL

SEQ ID NO: 171457 - protein, 11 aa, Artificial Sequence
  Description of Artificial Sequence: Synthetic peptide
  Seed: MFVTAPDNLGY (TYRP1_HUMAN)
MNVTAPDNLGF

SEQ ID NO: 171458 - protein, 10 aa, Artificial Sequence
  Description of Artificial Sequence: Synthetic peptide
  Seed: SIYNYFVWTH (TYRP1_HUMAN)
SVYNYFVWTR

SEQ ID NO: 171459 - protein, 9 aa, Artificial Sequence
  Description of Artificial Sequence: Synthetic peptide
  Seed: GPDGNTPQF (TYRP1_HUMAN)
GYDGNTPQL

SEQ ID NO: 171460 - protein, 10 aa, Artificial Sequence
  Description of Artificial Sequence: Synthetic peptide
  Seed: FQQARAQFPR (TYRP1_HUMAN)
FGQARAQFPR

SEQ ID NO: 171461 - protein, 9 aa, Artificial Sequence
  Description of Artificial Sequence: Synthetic peptide
  Seed: RGRCEAVTA (TYRP1_HUMAN)
RTRCEAVTR

SEQ ID NO: 171462 - protein, 10 aa, Artificial Sequence
  Description of Artificial Sequence: Synthetic peptide
  Seed: FSLPYWNFAT (TYRP1_HUMAN)
FGLPYWNFAV

SEQ ID NO: 171463 - protein, 10 aa, Artificial Sequence
  Description of Artificial Sequence: Synthetic peptide
  Seed: RSMDEANQPL (TYRP1_HUMAN)
RLMDEANQPA

SEQ ID NO: 171464 - protein, 11 aa, Artificial Sequence
  Description of Artificial Sequence: Synthetic peptide
  Seed: YNMVPFWPPVT (TYRP1_HUMAN)
YQMVPFWPPVP

SEQ ID NO: 171465 - protein, 10 aa, Artificial Sequence
  Description of Artificial Sequence: Synthetic peptide
  Seed: ENISIYNYFV (TYRP1_HUMAN)
ETISIYNYFA

SEQ ID NO: 171466 - protein, 10 aa, Artificial Sequence
  Description of Artificial Sequence: Synthetic peptide
  Seed: SPNSVFSQWR (TYRP1_HUMAN)
SYNSVFSQWK

SEQ ID NO: 171467 - protein, 10 aa, Artificial Sequence
  Description of Artificial Sequence: Synthetic peptide
  Seed: EGPAFLTWHR (TYRP1_HUMAN)
ESPAFLTWHR

SEQ ID NO: 171468 - protein, 10 aa, Artificial Sequence
  Description of Artificial Sequence: Synthetic peptide
  Seed: STLISPNSVF (TYRP1_HUMAN)
SKLISPNSVF

SEQ ID NO: 171469 - protein, 9 aa, Artificial Sequence
  Description of Artificial Sequence: Synthetic peptide
  Seed: WPPVTNTEM (TYRP1_HUMAN)
WQPVTNTEY

SEQ ID NO: 171470 - protein, 9 aa, Artificial Sequence
  Description of Artificial Sequence: Synthetic peptide
  Seed: MAKRTTHPL (TYRP1_HUMAN)
MYKRTTHPK

SEQ ID NO: 171471 - protein, 11 aa, Artificial Sequence
  Description of Artificial Sequence: Synthetic peptide
  Seed: DRCGSSSGRGR (TYRP1_HUMAN)
DTCGSSSGRGR

SEQ ID NO: 171472 - protein, 9 aa, Artificial Sequence
  Description of Artificial Sequence: Synthetic peptide
  Seed: ALIFGTASY (TYRP1_HUMAN)
AMIFGTASK

SEQ ID NO: 171473 - protein, 10 aa, Artificial Sequence
  Description of Artificial Sequence: Synthetic peptide
  Seed: RSLHNLAHLF (TYRP1_HUMAN)
RTLHNLAHLW

SEQ ID NO: 171474 - protein, 9 aa, Artificial Sequence
  Description of Artificial Sequence: Synthetic peptide
  Seed: LPYWNFATG (TYRP1_HUMAN)
LTYWNFATF

SEQ ID NO: 171475 - protein, 9 aa, Artificial Sequence
  Description of Artificial Sequence: Synthetic peptide
  Seed: TLISPNSVF (TYRP1_HUMAN)
THISPNSVF

SEQ ID NO: 171476 - protein, 11 aa, Artificial Sequence
  Description of Artificial Sequence: Synthetic peptide
  Seed: HTFTDAVFDEW (TYRP1_HUMAN)
HQFTDAVFDEM

SEQ ID NO: 171477 - protein, 10 aa, Artificial Sequence
  Description of Artificial Sequence: Synthetic peptide
  Seed: TPQFENISIY (TYRP1_HUMAN)
TMQFENISIY

SEQ ID NO: 171478 - protein, 10 aa, Artificial Sequence
  Description of Artificial Sequence: Synthetic peptide
  Seed: YNADISTFPL (TYRP1_HUMAN)
YPADISTFPF

SEQ ID NO: 171479 - protein, 9 aa, Artificial Sequence
  Description of Artificial Sequence: Synthetic peptide
  Seed: SIYNYFVWT (TYRP1_HUMAN)
SSYNYFVWA

SEQ ID NO: 171480 - protein, 10 aa, Artificial Sequence
  Description of Artificial Sequence: Synthetic peptide
  Seed: SVPEIIAIAV (TYRP1_HUMAN)
SLPEIIAIAA

SEQ ID NO: 171481 - protein, 9 aa, Artificial Sequence
  Description of Artificial Sequence: Synthetic peptide
  Seed: REFSVPEII (TYRP1_HUMAN)
REFSVPEIP

SEQ ID NO: 171482 - protein, 9 aa, Artificial Sequence
  Description of Artificial Sequence: Synthetic peptide
  Seed: SRSNFDSTL (TYRP1_HUMAN)
SQSNFDSTM

SEQ ID NO: 171483 - protein, 10 aa, Artificial Sequence
  Description of Artificial Sequence: Synthetic peptide
  Seed: RSMDEANQPL (TYRP1_HUMAN)
RIMDEANQPY

SEQ ID NO: 171484 - protein, 11 aa, Artificial Sequence
  Description of Artificial Sequence: Synthetic peptide
  Seed: LPEPQDVAQCL (TYRP1_HUMAN)
LPEPQDVAQCY

SEQ ID NO: 171485 - protein, 10 aa, Artificial Sequence
  Description of Artificial Sequence: Synthetic peptide
  Seed: FSLPYWNFAT (TYRP1_HUMAN)
FELPYWNFAL

SEQ ID NO: 171486 - protein, 9 aa, Artificial Sequence
  Description of Artificial Sequence: Synthetic peptide
  Seed: FYSNSTNSF (TYRP1_HUMAN)
FHSNSTNSM

SEQ ID NO: 171487 - protein, 9 aa, Artificial Sequence
  Description of Artificial Sequence: Synthetic peptide
  Seed: YTYEIQWPS (TYRP1_HUMAN)
YLYEIQWPM

SEQ ID NO: 171488 - protein, 9 aa, Artificial Sequence
  Description of Artificial Sequence: Synthetic peptide
  Seed: RYNADISTF (TYRP1_HUMAN)
RTNADISTL

SEQ ID NO: 171489 - protein, 10 aa, Artificial Sequence
  Description of Artificial Sequence: Synthetic peptide
  Seed: LLLVALIFGT (TYRP1_HUMAN)
LRLVALIFGI

SEQ ID NO: 171490 - protein, 9 aa, Artificial Sequence
  Description of Artificial Sequence: Synthetic peptide
  Seed: RQYNMVPFW (TYRP1_HUMAN)
RTYNMVPFM

SEQ ID NO: 171491 - protein, 9 aa, Artificial Sequence
  Description of Artificial Sequence: Synthetic peptide
  Seed: YSNSTNSFR (TYRP1_HUMAN)
YMNSTNSFY

SEQ ID NO: 171492 - protein, 9 aa, Artificial Sequence
  Description of Artificial Sequence: Synthetic peptide
  Seed: SLGCIFFPL (TYRP1_HUMAN)
SQGCIFFPL

SEQ ID NO: 171493 - protein, 9 aa, Artificial Sequence
  Description of Artificial Sequence: Synthetic peptide
  Seed: APIGHNRQY (TYRP1_HUMAN)
AYIGHNRQF

SEQ ID NO: 171494 - protein, 10 aa, Artificial Sequence
  Description of Artificial Sequence: Synthetic peptide
  Seed: TAPDNLGYTY (TYRP1_HUMAN)
TAPDNLGYTM

SEQ ID NO: 171495 - protein, 9 aa, Artificial Sequence
  Description of Artificial Sequence: Synthetic peptide
  Seed: FENISIYNY (TYRP1_HUMAN)
FQNISIYNL

SEQ ID NO: 171496 - protein, 10 aa, Artificial Sequence
  Description of Artificial Sequence: Synthetic peptide
  Seed: NLLDLSKEEK (TYRP1_HUMAN)
NVLDLSKEER

SEQ ID NO: 171497 - protein, 9 aa, Artificial Sequence
  Description of Artificial Sequence: Synthetic peptide
  Seed: FPLLLFQQA (TYRP1_HUMAN)
FPLLLFQQF

SEQ ID NO: 171498 - protein, 10 aa, Artificial Sequence
  Description of Artificial Sequence: Synthetic peptide
  Seed: RRYNADISTF (TYRP1_HUMAN)
RVYNADISTI

SEQ ID NO: 171499 - protein, 9 aa, Artificial Sequence
  Description of Artificial Sequence: Synthetic peptide
  Seed: FYSNSTNSF (TYRP1_HUMAN)
FYSNSTNSI

SEQ ID NO: 171500 - protein, 9 aa, Artificial Sequence
  Description of Artificial Sequence: Synthetic peptide
  Seed: FLGVGQESF (TYRP1_HUMAN)
FLGVGQESM

SEQ ID NO: 171501 - protein, 9 aa, Artificial Sequence
  Description of Artificial Sequence: Synthetic peptide
  Seed: RSLHNLAHL (TYRP1_HUMAN)
RTLHNLAHW

SEQ ID NO: 171502 - protein, 9 aa, Artificial Sequence
  Description of Artificial Sequence: Synthetic peptide
  Seed: SLHNLAHLF (TYRP1_HUMAN)
SVHNLAHLY

SEQ ID NO: 171503 - protein, 9 aa, Artificial Sequence
  Description of Artificial Sequence: Synthetic peptide
  Seed: NYFVWTHYY (TYRP1_HUMAN)
NWFVWTHYK

SEQ ID NO: 171504 - protein, 9 aa, Artificial Sequence
  Description of Artificial Sequence: Synthetic peptide
  Seed: LTWHRYHLL (TYRP1_HUMAN)
LQWHRYHLR

SEQ ID NO: 171505 - protein, 10 aa, Artificial Sequence
  Description of Artificial Sequence: Synthetic peptide
  Seed: RSMDEANQPL (TYRP1_HUMAN)
RTMDEANQPV

SEQ ID NO: 171506 - protein, 11 aa, Artificial Sequence
  Description of Artificial Sequence: Synthetic peptide
  Seed: FWPPVTNTEMF (TYRP1_HUMAN)
FMPPVTNTEMW

SEQ ID NO: 171507 - protein, 9 aa, Artificial Sequence
  Description of Artificial Sequence: Synthetic peptide
  Seed: MAKRTTHPL (TYRP1_HUMAN)
MSKRTTHPM

SEQ ID NO: 171508 - protein, 9 aa, Artificial Sequence
  Description of Artificial Sequence: Synthetic peptide
  Seed: FVWTHYYSV (TYRP1_HUMAN)
FMWTHYYSR

SEQ ID NO: 171509 - protein, 10 aa, Artificial Sequence
  Description of Artificial Sequence: Synthetic peptide
  Seed: ENISIYNYFV (TYRP1_HUMAN)
ETISIYNYFS

SEQ ID NO: 171510 - protein, 9 aa, Artificial Sequence
  Description of Artificial Sequence: Synthetic peptide
  Seed: ATRRSEEIL (TYRP1_HUMAN)
ATRRSEEIK

SEQ ID NO: 171511 - protein, 11 aa, Artificial Sequence
  Description of Artificial Sequence: Synthetic peptide
  Seed: FVLLHTFTDAV (TYRP1_HUMAN)
FKLLHTFTDAL

SEQ ID NO: 171512 - protein, 10 aa, Artificial Sequence
  Description of Artificial Sequence: Synthetic peptide
  Seed: YNYFVWTHYY (TYRP1_HUMAN)
YSYFVWTHYI

SEQ ID NO: 171513 - protein, 9 aa, Artificial Sequence
  Description of Artificial Sequence: Synthetic peptide
  Seed: LQNPNQSVV (TYRP1_HUMAN)
LSNPNQSVI

SEQ ID NO: 171514 - protein, 10 aa, Artificial Sequence
  Description of Artificial Sequence: Synthetic peptide
  Seed: KRTTHPLFVI (TYRP1_HUMAN)
KQTTHPLFVW

SEQ ID NO: 171515 - protein, 9 aa, Artificial Sequence
  Description of Artificial Sequence: Synthetic peptide
  Seed: DYDTLGTLC (TYRP1_HUMAN)
DYDTLGTLM

SEQ ID NO: 171516 - protein, 9 aa, Artificial Sequence
  Description of Artificial Sequence: Synthetic peptide
  Seed: AVRSLHNLA (TYRP1_HUMAN)
AARSLHNLA

SEQ ID NO: 171517 - protein, 9 aa, Artificial Sequence
  Description of Artificial Sequence: Synthetic peptide
  Seed: RTTHPLFVI (TYRP1_HUMAN)
RLTHPLFVA

SEQ ID NO: 171518 - protein, 11 aa, Artificial Sequence
  Description of Artificial Sequence: Synthetic peptide
  Seed: FWPPVTNTEMF (TYRP1_HUMAN)
FAPPVTNTEMY

SEQ ID NO: 171519 - protein, 9 aa, Artificial Sequence
  Description of Artificial Sequence: Synthetic peptide
  Seed: HEGPAFLTW (TYRP1_HUMAN)
HNGPAFLTY

SEQ ID NO: 171520 - protein, 8 aa, Artificial Sequence
  Description of Artificial Sequence: Synthetic peptide
  Seed: YSDPTGKY (TYRP1_HUMAN)
YADPTGKV

SEQ ID NO: 171521 - protein, 9 aa, Artificial Sequence
  Description of Artificial Sequence: Synthetic peptide
  Seed: TLISPNSVF (TYRP1_HUMAN)
TEISPNSVY

SEQ ID NO: 171522 - protein, 11 aa, Artificial Sequence
  Description of Artificial Sequence: Synthetic peptide
  Seed: ILGPDGNTPQF (TYRP1_HUMAN)
ITGPDGNTPQF

SEQ ID NO: 171523 - protein, 9 aa, Artificial Sequence
  Description of Artificial Sequence: Synthetic peptide
  Seed: LQNPNQSVV (TYRP1_HUMAN)
LENPNQSVA

SEQ ID NO: 171524 - protein, 10 aa, Artificial Sequence
  Description of Artificial Sequence: Synthetic peptide
  Seed: YNYFVWTHYY (TYRP1_HUMAN)
YFYFVWTHYH

SEQ ID NO: 171525 - protein, 9 aa, Artificial Sequence
  Description of Artificial Sequence: Synthetic peptide
  Seed: DREVWPLRF (TYRP1_HUMAN)
DHEVWPLRI

SEQ ID NO: 171526 - protein, 9 aa, Artificial Sequence
  Description of Artificial Sequence: Synthetic peptide
  Seed: RQYNMVPFW (TYRP1_HUMAN)
RKYNMVPFF

SEQ ID NO: 171527 - protein, 9 aa, Artificial Sequence
  Description of Artificial Sequence: Synthetic peptide
  Seed: SPNDPIFVL (TYRP1_HUMAN)
SINDPIFVL

SEQ ID NO: 171528 - protein, 9 aa, Artificial Sequence
  Description of Artificial Sequence: Synthetic peptide
  Seed: DSRPHSPQY (TYRP1_HUMAN)
DIRPHSPQR

SEQ ID NO: 171529 - protein, 9 aa, Artificial Sequence
  Description of Artificial Sequence: Synthetic peptide
  Seed: MSAPKLLSL (TYRP1_HUMAN)
MFAPKLLSL

SEQ ID NO: 171530 - protein, 10 aa, Artificial Sequence
  Description of Artificial Sequence: Synthetic peptide
  Seed: YNMVPFWPPV (TYRP1_HUMAN)
YHMVPFWPPI

SEQ ID NO: 171531 - protein, 11 aa, Artificial Sequence
  Description of Artificial Sequence: Synthetic peptide
  Seed: YNYFVWTHYYS (TYRP1_HUMAN)
YYYFVWTHYYH

SEQ ID NO: 171532 - protein, 9 aa, Artificial Sequence
  Description of Artificial Sequence: Synthetic peptide
  Seed: CIFFPLLLF (TYRP1_HUMAN)
CSFFPLLLW

SEQ ID NO: 171533 - protein, 9 aa, Artificial Sequence
  Description of Artificial Sequence: Synthetic peptide
  Seed: KYDPAVRSL (TYRP1_HUMAN)
KQDPAVRSL

SEQ ID NO: 171534 - protein, 9 aa, Artificial Sequence
  Description of Artificial Sequence: Synthetic peptide
  Seed: NISIYNYFV (TYRP1_HUMAN)
NMSIYNYFV

SEQ ID NO: 171535 - protein, 10 aa, Artificial Sequence
  Description of Artificial Sequence: Synthetic peptide
  Seed: RSMDEANQPL (TYRP1_HUMAN)
RMMDEANQPA

SEQ ID NO: 171536 - protein, 10 aa, Artificial Sequence
  Description of Artificial Sequence: Synthetic peptide
  Seed: FSLPYWNFAT (TYRP1_HUMAN)
FYLPYWNFAV

SEQ ID NO: 171537 - protein, 9 aa, Artificial Sequence
  Description of Artificial Sequence: Synthetic peptide
  Seed: APIGHNRQY (TYRP1_HUMAN)
AQIGHNRQY

SEQ ID NO: 171538 - protein, 9 aa, Artificial Sequence
  Description of Artificial Sequence: Synthetic peptide
  Seed: SPNDPIFVL (TYRP1_HUMAN)
SPNDPIFVM

SEQ ID NO: 171539 - protein, 10 aa, Artificial Sequence
  Description of Artificial Sequence: Synthetic peptide
  Seed: LLFQQARAQF (TYRP1_HUMAN)
LYFQQARAQY

SEQ ID NO: 171540 - protein, 9 aa, Artificial Sequence
  Description of Artificial Sequence: Synthetic peptide
  Seed: LIFGTASYL (TYRP1_HUMAN)
LMFGTASYY

SEQ ID NO: 171541 - protein, 9 aa, Artificial Sequence
  Description of Artificial Sequence: Synthetic peptide
  Seed: RYNADISTF (TYRP1_HUMAN)
RQNADISTL

SEQ ID NO: 171542 - protein, 9 aa, Artificial Sequence
  Description of Artificial Sequence: Synthetic peptide
  Seed: SRSNFDSTL (TYRP1_HUMAN)
SASNFDSTF

SEQ ID NO: 171543 - protein, 9 aa, Artificial Sequence
  Description of Artificial Sequence: Synthetic peptide
  Seed: TPQFENISI (TYRP1_HUMAN)
TPQFENISM

SEQ ID NO: 171544 - protein, 10 aa, Artificial Sequence
  Description of Artificial Sequence: Synthetic peptide
  Seed: YNADISTFPL (TYRP1_HUMAN)
YSADISTFPL

SEQ ID NO: 171545 - protein, 9 aa, Artificial Sequence
  Description of Artificial Sequence: Synthetic peptide
  Seed: LFDTPPFYS (TYRP1_HUMAN)
LYDTPPFYL

SEQ ID NO: 171546 - protein, 9 aa, Artificial Sequence
  Description of Artificial Sequence: Synthetic peptide
  Seed: RTTHPLFVI (TYRP1_HUMAN)
RSTHPLFVV

SEQ ID NO: 171547 - protein, 9 aa, Artificial Sequence
  Description of Artificial Sequence: Synthetic peptide
  Seed: SVKKTFLGV (TYRP1_HUMAN)
SLKKTFLGK

SEQ ID NO: 171548 - protein, 9 aa, Artificial Sequence
  Description of Artificial Sequence: Synthetic peptide
  Seed: LFQQARAQF (TYRP1_HUMAN)
LQQQARAQM

SEQ ID NO: 171549 - protein, 8 aa, Artificial Sequence
  Description of Artificial Sequence: Synthetic peptide
  Seed: FSHEGPAF (TYRP1_HUMAN)
FFHEGPAL

SEQ ID NO: 171550 - protein, 9 aa, Artificial Sequence
  Description of Artificial Sequence: Synthetic peptide
  Seed: FSLPYWNFA (TYRP1_HUMAN)
FMLPYWNFI

SEQ ID NO: 171551 - protein, 9 aa, Artificial Sequence
  Description of Artificial Sequence: Synthetic peptide
  Seed: HYYSVKKTF (TYRP1_HUMAN)
HLYSVKKTY

SEQ ID NO: 171552 - protein, 10 aa, Artificial Sequence
  Description of Artificial Sequence: Synthetic peptide
  Seed: EGPAFLTWHR (TYRP1_HUMAN)
EMPAFLTWHR

SEQ ID NO: 171553 - protein, 9 aa, Artificial Sequence
  Description of Artificial Sequence: Synthetic peptide
  Seed: APIGHNRQY (TYRP1_HUMAN)
AIIGHNRQL

SEQ ID NO: 171554 - protein, 9 aa, Artificial Sequence
  Description of Artificial Sequence: Synthetic peptide
  Seed: FSVPEIIAI (TYRP1_HUMAN)
FMVPEIIAM

SEQ ID NO: 171555 - protein, 10 aa, Artificial Sequence
  Description of Artificial Sequence: Synthetic peptide
  Seed: STLISPNSVF (TYRP1_HUMAN)
SFLISPNSVY

SEQ ID NO: 171556 - protein, 10 aa, Artificial Sequence
  Description of Artificial Sequence: Synthetic peptide
  Seed: LSPNDPIFVL (TYRP1_HUMAN)
LFPNDPIFVY

SEQ ID NO: 171557 - protein, 9 aa, Artificial Sequence
  Description of Artificial Sequence: Synthetic peptide
  Seed: RYNADISTF (TYRP1_HUMAN)
RLNADISTY

SEQ ID NO: 171558 - protein, 10 aa, Artificial Sequence
  Description of Artificial Sequence: Synthetic peptide
  Seed: NYFVWTHYYS (TYRP1_HUMAN)
NMFVWTHYYL

SEQ ID NO: 171559 - protein, 9 aa, Artificial Sequence
  Description of Artificial Sequence: Synthetic peptide
  Seed: RARRSMDEA (TYRP1_HUMAN)
RTRRSMDET

SEQ ID NO: 171560 - protein, 9 aa, Artificial Sequence
  Description of Artificial Sequence: Synthetic peptide
  Seed: HYYSVKKTF (TYRP1_HUMAN)
HSYSVKKTM

SEQ ID NO: 171561 - protein, 9 aa, Artificial Sequence
  Description of Artificial Sequence: Synthetic peptide
  Seed: MAKRTTHPL (TYRP1_HUMAN)
MTKRTTHPF

SEQ ID NO: 171562 - protein, 9 aa, Artificial Sequence
  Description of Artificial Sequence: Synthetic peptide
  Seed: KYDPAVRSL (TYRP1_HUMAN)
KRDPAVRSF

SEQ ID NO: 171563 - protein, 10 aa, Artificial Sequence
  Description of Artificial Sequence: Synthetic peptide
  Seed: YEIQWPSREF (TYRP1_HUMAN)
YMIQWPSREM

SEQ ID NO: 171564 - protein, 9 aa, Artificial Sequence
  Description of Artificial Sequence: Synthetic peptide
  Seed: LIFGTASYL (TYRP1_HUMAN)
LMFGTASYF

SEQ ID NO: 171565 - protein, 11 aa, Artificial Sequence
  Description of Artificial Sequence: Synthetic peptide
  Seed: RSMDEANQPLL (TYRP1_HUMAN)
RAMDEANQPLL

SEQ ID NO: 171566 - protein, 9 aa, Artificial Sequence
  Description of Artificial Sequence: Synthetic peptide
  Seed: FYSNSTNSF (TYRP1_HUMAN)
FKSNSTNSF

SEQ ID NO: 171567 - protein, 10 aa, Artificial Sequence
  Description of Artificial Sequence: Synthetic peptide
  Seed: THPLFVIATR (TYRP1_HUMAN)
TIPLFVIATK

SEQ ID NO: 171568 - protein, 9 aa, Artificial Sequence
  Description of Artificial Sequence: Synthetic peptide
  Seed: AKRTTHPLF (TYRP1_HUMAN)
AQRTTHPLM

SEQ ID NO: 171569 - protein, 9 aa, Artificial Sequence
  Description of Artificial Sequence: Synthetic peptide
  Seed: VVGALLLVA (TYRP1_HUMAN)
VVGALLLVV

SEQ ID NO: 171570 - protein, 8 aa, Artificial Sequence
  Description of Artificial Sequence: Synthetic peptide
  Seed: REFSVPEI (TYRP1_HUMAN)
RAFSVPEI

SEQ ID NO: 171571 - protein, 9 aa, Artificial Sequence
  Description of Artificial Sequence: Synthetic peptide
  Seed: ALIFGTASY (TYRP1_HUMAN)
ARIFGTASF

SEQ ID NO: 171572 - protein, 10 aa, Artificial Sequence
  Description of Artificial Sequence: Synthetic peptide
  Seed: FVWTHYYSVK (TYRP1_HUMAN)
FIWTHYYSVW

SEQ ID NO: 171573 - protein, 9 aa, Artificial Sequence
  Description of Artificial Sequence: Synthetic peptide
  Seed: FPLLLFQQA (TYRP1_HUMAN)
FPLLLFQQL

SEQ ID NO: 171574 - protein, 9 aa, Artificial Sequence
  Description of Artificial Sequence: Synthetic peptide
  Seed: MSAPKLLSL (TYRP1_HUMAN)
MMAPKLLSS

SEQ ID NO: 171575 - protein, 9 aa, Artificial Sequence
  Description of Artificial Sequence: Synthetic peptide
  Seed: RSLHNLAHL (TYRP1_HUMAN)
RALHNLAHL

SEQ ID NO: 171576 - protein, 9 aa, Artificial Sequence
  Description of Artificial Sequence: Synthetic peptide
  Seed: HYYSVKKTF (TYRP1_HUMAN)
HTYSVKKTY

SEQ ID NO: 171577 - protein, 8 aa, Artificial Sequence
  Description of Artificial Sequence: Synthetic peptide
  Seed: IQWPSREF (TYRP1_HUMAN)
ISWPSREF

SEQ ID NO: 171578 - protein, 9 aa, Artificial Sequence
  Description of Artificial Sequence: Synthetic peptide
  Seed: LTWHRYHLL (TYRP1_HUMAN)
LLWHRYHLV

SEQ ID NO: 171579 - protein, 9 aa, Artificial Sequence
  Description of Artificial Sequence: Synthetic peptide
  Seed: RFFNRTCHC (TYRP1_HUMAN)
RVFNRTCHY

SEQ ID NO: 171580 - protein, 10 aa, Artificial Sequence
  Description of Artificial Sequence: Synthetic peptide
  Seed: LENAPIGHNR (TYRP1_HUMAN)
LTNAPIGHNR

SEQ ID NO: 171581 - protein, 10 aa, Artificial Sequence
  Description of Artificial Sequence: Synthetic peptide
  Seed: FSLPYWNFAT (TYRP1_HUMAN)
FILPYWNFAV

SEQ ID NO: 171582 - protein, 11 aa, Artificial Sequence
  Description of Artificial Sequence: Synthetic peptide
  Seed: NYFVWTHYYSV (TYRP1_HUMAN)
NWFVWTHYYSF

SEQ ID NO: 171583 - protein, 9 aa, Artificial Sequence
  Description of Artificial Sequence: Synthetic peptide
  Seed: HPLFVIATR (TYRP1_HUMAN)
HVLFVIATK

SEQ ID NO: 171584 - protein, 9 aa, Artificial Sequence
  Description of Artificial Sequence: Synthetic peptide
  Seed: MAKRTTHPL (TYRP1_HUMAN)
MGKRTTHPL

SEQ ID NO: 171585 - protein, 10 aa, Artificial Sequence
  Description of Artificial Sequence: Synthetic peptide
  Seed: FVWTHYYSVK (TYRP1_HUMAN)
FMWTHYYSVI

SEQ ID NO: 171586 - protein, 9 aa, Artificial Sequence
  Description of Artificial Sequence: Synthetic peptide
  Seed: VTAPDNLGY (TYRP1_HUMAN)
VGAPDNLGW

SEQ ID NO: 171587 - protein, 10 aa, Artificial Sequence
  Description of Artificial Sequence: Synthetic peptide
  Seed: RSMDEANQPL (TYRP1_HUMAN)
RWMDEANQPY

SEQ ID NO: 171588 - protein, 9 aa, Artificial Sequence
  Description of Artificial Sequence: Synthetic peptide
  Seed: YTYEIQWPS (TYRP1_HUMAN)
YLYEIQWPP

SEQ ID NO: 171589 - protein, 9 aa, Artificial Sequence
  Description of Artificial Sequence: Synthetic peptide
  Seed: MSAPKLLSL (TYRP1_HUMAN)
MRAPKLLSM

SEQ ID NO: 171590 - protein, 10 aa, Artificial Sequence
  Description of Artificial Sequence: Synthetic peptide
  Seed: GLFDTPPFYS (TYRP1_HUMAN)
GVFDTPPFYM

SEQ ID NO: 171591 - protein, 9 aa, Artificial Sequence
  Description of Artificial Sequence: Synthetic peptide
  Seed: FSVPEIIAI (TYRP1_HUMAN)
FVVPEIIAW

SEQ ID NO: 171592 - protein, 9 aa, Artificial Sequence
  Description of Artificial Sequence: Synthetic peptide
  Seed: SFSLPYWNF (TYRP1_HUMAN)
SISLPYWNY

SEQ ID NO: 171593 - protein, 10 aa, Artificial Sequence
  Description of Artificial Sequence: Synthetic peptide
  Seed: YNYFVWTHYY (TYRP1_HUMAN)
YPYFVWTHYK

SEQ ID NO: 171594 - protein, 11 aa, Artificial Sequence
  Description of Artificial Sequence: Synthetic peptide
  Seed: PPFYSNSTNSF (TYRP1_HUMAN)
PYFYSNSTNSM

SEQ ID NO: 171595 - protein, 9 aa, Artificial Sequence
  Description of Artificial Sequence: Synthetic peptide
  Seed: ALIFGTASY (TYRP1_HUMAN)
ASIFGTASW

SEQ ID NO: 171596 - protein, 9 aa, Artificial Sequence
  Description of Artificial Sequence: Synthetic peptide
  Seed: SGRGRCEAV (TYRP1_HUMAN)
SPRGRCEAV

SEQ ID NO: 171597 - protein, 9 aa, Artificial Sequence
  Description of Artificial Sequence: Synthetic peptide
  Seed: VARPMVQRL (TYRP1_HUMAN)
VARPMVQRK

SEQ ID NO: 171598 - protein, 9 aa, Artificial Sequence
  Description of Artificial Sequence: Synthetic peptide
  Seed: YSNSTNSFR (TYRP1_HUMAN)
YINSTNSFY

SEQ ID NO: 171599 - protein, 10 aa, Artificial Sequence
  Description of Artificial Sequence: Synthetic peptide
  Seed: LIFGTASYLI (TYRP1_HUMAN)
LVFGTASYLV

SEQ ID NO: 171600 - protein, 9 aa, Artificial Sequence
  Description of Artificial Sequence: Synthetic peptide
  Seed: RTCHCNGNF (TYRP1_HUMAN)
RQCHCNGNF

SEQ ID NO: 171601 - protein, 11 aa, Artificial Sequence
  Description of Artificial Sequence: Synthetic peptide
  Seed: VTAPDNLGYTY (TYRP1_HUMAN)
VGAPDNLGYTF

SEQ ID NO: 171602 - protein, 9 aa, Artificial Sequence
  Description of Artificial Sequence: Synthetic peptide
  Seed: LTDQYQCYA (TYRP1_HUMAN)
LTDQYQCYL

SEQ ID NO: 171603 - protein, 10 aa, Artificial Sequence
  Description of Artificial Sequence: Synthetic peptide
  Seed: FYSNSTNSFR (TYRP1_HUMAN)
FYSNSTNSFK

SEQ ID NO: 171604 - protein, 11 aa, Artificial Sequence
  Description of Artificial Sequence: Synthetic peptide
  Seed: YNYFVWTHYYS (TYRP1_HUMAN)
YMYFVWTHYYR

SEQ ID NO: 171605 - protein, 11 aa, Artificial Sequence
  Description of Artificial Sequence: Synthetic peptide
  Seed: VRSLHNLAHLF (TYRP1_HUMAN)
VRSLHNLAHLW

SEQ ID NO: 171606 - protein, 10 aa, Artificial Sequence
  Description of Artificial Sequence: Synthetic peptide
  Seed: FFPLLLFQQA (TYRP1_HUMAN)
FMPLLLFQQA

SEQ ID NO: 171607 - protein, 9 aa, Artificial Sequence
  Description of Artificial Sequence: Synthetic peptide
  Seed: LTWHRYHLL (TYRP1_HUMAN)
LIWHRYHLK

SEQ ID NO: 171608 - protein, 9 aa, Artificial Sequence
  Description of Artificial Sequence: Synthetic peptide
  Seed: ENAPIGHNR (TYRP1_HUMAN)
EIAPIGHNK

SEQ ID NO: 171609 - protein, 11 aa, Artificial Sequence
  Description of Artificial Sequence: Synthetic peptide
  Seed: MFVTAPDNLGY (TYRP1_HUMAN)
MLVTAPDNLGW

SEQ ID NO: 171610 - protein, 10 aa, Artificial Sequence
  Description of Artificial Sequence: Synthetic peptide
  Seed: SMDEANQPLL (TYRP1_HUMAN)
SLDEANQPLI

SEQ ID NO: 171611 - protein, 9 aa, Artificial Sequence
  Description of Artificial Sequence: Synthetic peptide
  Seed: EDYDTLGTL (TYRP1_HUMAN)
EEYDTLGTP

SEQ ID NO: 171612 - protein, 10 aa, Artificial Sequence
  Description of Artificial Sequence: Synthetic peptide
  Seed: RVVCDSLEDY (TYRP1_HUMAN)
RLVCDSLEDY

SEQ ID NO: 171613 - protein, 10 aa, Artificial Sequence
  Description of Artificial Sequence: Synthetic peptide
  Seed: GPAFLTWHRY (TYRP1_HUMAN)
GTAFLTWHRY

SEQ ID NO: 171614 - protein, 9 aa, Artificial Sequence
  Description of Artificial Sequence: Synthetic peptide
  Seed: FVWTHYYSV (TYRP1_HUMAN)
FQWTHYYSF

SEQ ID NO: 171615 - protein, 9 aa, Artificial Sequence
  Description of Artificial Sequence: Synthetic peptide
  Seed: LIFGTASYL (TYRP1_HUMAN)
LQFGTASYV

SEQ ID NO: 171616 - protein, 9 aa, Artificial Sequence
  Description of Artificial Sequence: Synthetic peptide
  Seed: VGLFDTPPF (TYRP1_HUMAN)
VQLFDTPPV

SEQ ID NO: 171617 - protein, 10 aa, Artificial Sequence
  Description of Artificial Sequence: Synthetic peptide
  Seed: GVGQESFGEV (TYRP1_HUMAN)
GLGQESFGEV

SEQ ID NO: 171618 - protein, 10 aa, Artificial Sequence
  Description of Artificial Sequence: Synthetic peptide
  Seed: KRTTHPLFVI (TYRP1_HUMAN)
KLTTHPLFVF

SEQ ID NO: 171619 - protein, 9 aa, Artificial Sequence
  Description of Artificial Sequence: Synthetic peptide
  Seed: MAKRTTHPL (TYRP1_HUMAN)
MSKRTTHPW

SEQ ID NO: 171620 - protein, 9 aa, Artificial Sequence
  Description of Artificial Sequence: Synthetic peptide
  Seed: RYHLLRLEK (TYRP1_HUMAN)
RTHLLRLEV

SEQ ID NO: 171621 - protein, 10 aa, Artificial Sequence
  Description of Artificial Sequence: Synthetic peptide
  Seed: SYLIRARRSM (TYRP1_HUMAN)
SYLIRARRSL

SEQ ID NO: 171622 - protein, 9 aa, Artificial Sequence
  Description of Artificial Sequence: Synthetic peptide
  Seed: YLIRARRSM (TYRP1_HUMAN)
YQIRARRSA

SEQ ID NO: 171623 - protein, 10 aa, Artificial Sequence
  Description of Artificial Sequence: Synthetic peptide
  Seed: YNYFVWTHYY (TYRP1_HUMAN)
YQYFVWTHYY

SEQ ID NO: 171624 - protein, 9 aa, Artificial Sequence
  Description of Artificial Sequence: Synthetic peptide
  Seed: FSHEGPAFL (TYRP1_HUMAN)
FYHEGPAFM

SEQ ID NO: 171625 - protein, 10 aa, Artificial Sequence
  Description of Artificial Sequence: Synthetic peptide
  Seed: FLTWHRYHLL (TYRP1_HUMAN)
FATWHRYHLV

SEQ ID NO: 171626 - protein, 10 aa, Artificial Sequence
  Description of Artificial Sequence: Synthetic peptide
  Seed: LSPNDPIFVL (TYRP1_HUMAN)
LFPNDPIFVF

SEQ ID NO: 171627 - protein, 9 aa, Artificial Sequence
  Description of Artificial Sequence: Synthetic peptide
  Seed: RQCATVEAL (TYRP1_HUMAN)
RICATVEAF

SEQ ID NO: 171628 - protein, 10 aa, Artificial Sequence
  Description of Artificial Sequence: Synthetic peptide
  Seed: RTCHCNGNFS (TYRP1_HUMAN)
RVCHCNGNFK

SEQ ID NO: 171629 - protein, 9 aa, Artificial Sequence
  Description of Artificial Sequence: Synthetic peptide
  Seed: TPQFENISI (TYRP1_HUMAN)
TPQFENISA

SEQ ID NO: 171630 - protein, 10 aa, Artificial Sequence
  Description of Artificial Sequence: Synthetic peptide
  Seed: RVLIVRRNLL (TYRP1_HUMAN)
RSLIVRRNLK

SEQ ID NO: 171631 - protein, 11 aa, Artificial Sequence
  Description of Artificial Sequence: Synthetic peptide
  Seed: VTAPDNLGYTY (TYRP1_HUMAN)
VTAPDNLGYTM

SEQ ID NO: 171632 - protein, 11 aa, Artificial Sequence
  Description of Artificial Sequence: Synthetic peptide
  Seed: VCDSLEDYDTL (TYRP1_HUMAN)
VTDSLEDYDTL

SEQ ID NO: 171633 - protein, 10 aa, Artificial Sequence
  Description of Artificial Sequence: Synthetic peptide
  Seed: LSPNDPIFVL (TYRP1_HUMAN)
LWPNDPIFVM

SEQ ID NO: 171634 - protein, 9 aa, Artificial Sequence
  Description of Artificial Sequence: Synthetic peptide
  Seed: LEKDMQEML (TYRP1_HUMAN)
LQKDMQEML

SEQ ID NO: 171635 - protein, 11 aa, Artificial Sequence
  Description of Artificial Sequence: Synthetic peptide
  Seed: MLQEPSFSLPY (TYRP1_HUMAN)
MQQEPSFSLPL

SEQ ID NO: 171636 - protein, 10 aa, Artificial Sequence
  Description of Artificial Sequence: Synthetic peptide
  Seed: LLLVALIFGT (TYRP1_HUMAN)
LALVALIFGV

SEQ ID NO: 171637 - protein, 9 aa, Artificial Sequence
  Description of Artificial Sequence: Synthetic peptide
  Seed: MCCPDLSPV (TYRP1_HUMAN)
MSCPDLSPL

SEQ ID NO: 171638 - protein, 11 aa, Artificial Sequence
  Description of Artificial Sequence: Synthetic peptide
  Seed: YNYFVWTHYYS (TYRP1_HUMAN)
YMYFVWTHYYT

SEQ ID NO: 171639 - protein, 10 aa, Artificial Sequence
  Description of Artificial Sequence: Synthetic peptide
  Seed: YNYFVWTHYY (TYRP1_HUMAN)
YMYFVWTHYV

SEQ ID NO: 171640 - protein, 10 aa, Artificial Sequence
  Description of Artificial Sequence: Synthetic peptide
  Seed: QCYAEEYEKL (TYRP1_HUMAN)
QPYAEEYEKF

SEQ ID NO: 171641 - protein, 10 aa, Artificial Sequence
  Description of Artificial Sequence: Synthetic peptide
  Seed: STLISPNSVF (TYRP1_HUMAN)
SRLISPNSVF

SEQ ID NO: 171642 - protein, 9 aa, Artificial Sequence
  Description of Artificial Sequence: Synthetic peptide
  Seed: AVRSLHNLA (TYRP1_HUMAN)
AVRSLHNLK

SEQ ID NO: 171643 - protein, 11 aa, Artificial Sequence
  Description of Artificial Sequence: Synthetic peptide
  Seed: KTFLGVGQESF (TYRP1_HUMAN)
KCFLGVGQESW

SEQ ID NO: 171644 - protein, 9 aa, Artificial Sequence
  Description of Artificial Sequence: Synthetic peptide
  Seed: AACDQRVLI (TYRP1_HUMAN)
ARCDQRVLM

SEQ ID NO: 171645 - protein, 9 aa, Artificial Sequence
  Description of Artificial Sequence: Synthetic peptide
  Seed: FSHEGPAFL (TYRP1_HUMAN)
FEHEGPAFF

SEQ ID NO: 171646 - protein, 10 aa, Artificial Sequence
  Description of Artificial Sequence: Synthetic peptide
  Seed: RTTHPLFVIA (TYRP1_HUMAN)
RETHPLFVIK

SEQ ID NO: 171647 - protein, 9 aa, Artificial Sequence
  Description of Artificial Sequence: Synthetic peptide
  Seed: QRLPEPQDV (TYRP1_HUMAN)
QRLPEPQDM

SEQ ID NO: 171648 - protein, 9 aa, Artificial Sequence
  Description of Artificial Sequence: Synthetic peptide
  Seed: SVKKTFLGV (TYRP1_HUMAN)
SQKKTFLGI

SEQ ID NO: 171649 - protein, 9 aa, Artificial Sequence
  Description of Artificial Sequence: Synthetic peptide
  Seed: FVWTHYYSV (TYRP1_HUMAN)
FSWTHYYSA

SEQ ID NO: 171650 - protein, 9 aa, Artificial Sequence
  Description of Artificial Sequence: Synthetic peptide
  Seed: IAVVGALLL (TYRP1_HUMAN)
ISVVGALLL

SEQ ID NO: 171651 - protein, 10 aa, Artificial Sequence
  Description of Artificial Sequence: Synthetic peptide
  Seed: SPNSVFSQWR (TYRP1_HUMAN)
STNSVFSQWK

SEQ ID NO: 171652 - protein, 11 aa, Artificial Sequence
  Description of Artificial Sequence: Synthetic peptide
  Seed: RSMDEANQPLL (TYRP1_HUMAN)
RQMDEANQPLW

SEQ ID NO: 171653 - protein, 8 aa, Artificial Sequence
  Description of Artificial Sequence: Synthetic peptide
  Seed: HTFTDAVF (TYRP1_HUMAN)
HMFTDAVF

SEQ ID NO: 171654 - protein, 9 aa, Artificial Sequence
  Description of Artificial Sequence: Synthetic peptide
  Seed: LVALIFGTA (TYRP1_HUMAN)
LTALIFGTI

SEQ ID NO: 171655 - protein, 10 aa, Artificial Sequence
  Description of Artificial Sequence: Synthetic peptide
  Seed: FSLPYWNFAT (TYRP1_HUMAN)
FWLPYWNFAA

SEQ ID NO: 171656 - protein, 9 aa, Artificial Sequence
  Description of Artificial Sequence: Synthetic peptide
  Seed: RFFNRTCHC (TYRP1_HUMAN)
RVFNRTCHM

SEQ ID NO: 171657 - protein, 9 aa, Artificial Sequence
  Description of Artificial Sequence: Synthetic peptide
  Seed: FPLENAPIG (TYRP1_HUMAN)
FCLENAPIY

SEQ ID NO: 171658 - protein, 9 aa, Artificial Sequence
  Description of Artificial Sequence: Synthetic peptide
  Seed: QYQCYAEEY (TYRP1_HUMAN)
QYQCYAEEF

SEQ ID NO: 171659 - protein, 10 aa, Artificial Sequence
  Description of Artificial Sequence: Synthetic peptide
  Seed: MVPFWPPVTN (TYRP1_HUMAN)
MEPFWPPVTL

SEQ ID NO: 171660 - protein, 10 aa, Artificial Sequence
  Description of Artificial Sequence: Synthetic peptide
  Seed: FQQARAQFPR (TYRP1_HUMAN)
FIQARAQFPR

SEQ ID NO: 171661 - protein, 10 aa, Artificial Sequence
  Description of Artificial Sequence: Synthetic peptide
  Seed: STLISPNSVF (TYRP1_HUMAN)
SSLISPNSVF

SEQ ID NO: 171662 - protein, 9 aa, Artificial Sequence
  Description of Artificial Sequence: Synthetic peptide
  Seed: FSLPYWNFA (TYRP1_HUMAN)
FVLPYWNFT

SEQ ID NO: 171663 - protein, 9 aa, Artificial Sequence
  Description of Artificial Sequence: Synthetic peptide
  Seed: MSAPKLLSL (TYRP1_HUMAN)
MIAPKLLSF

SEQ ID NO: 171664 - protein, 10 aa, Artificial Sequence
  Description of Artificial Sequence: Synthetic peptide
  Seed: NYFVWTHYYS (TYRP1_HUMAN)
NFFVWTHYYI

SEQ ID NO: 171665 - protein, 8 aa, Artificial Sequence
  Description of Artificial Sequence: Synthetic peptide
  Seed: TEMFVTAP (TYRP1_HUMAN)
TEMFVTAY

SEQ ID NO: 171666 - protein, 9 aa, Artificial Sequence
  Description of Artificial Sequence: Synthetic peptide
  Seed: FENISIYNY (TYRP1_HUMAN)
FENISIYNA

SEQ ID NO: 171667 - protein, 10 aa, Artificial Sequence
  Description of Artificial Sequence: Synthetic peptide
  Seed: YNYFVWTHYY (TYRP1_HUMAN)
YFYFVWTHYY

SEQ ID NO: 171668 - protein, 10 aa, Artificial Sequence
  Description of Artificial Sequence: Synthetic peptide
  Seed: YSNSTNSFRN (TYRP1_HUMAN)
YMNSTNSFRR

SEQ ID NO: 171669 - protein, 9 aa, Artificial Sequence
  Description of Artificial Sequence: Synthetic peptide
  Seed: LLVALIFGT (TYRP1_HUMAN)
LSVALIFGV

SEQ ID NO: 171670 - protein, 9 aa, Artificial Sequence
  Description of Artificial Sequence: Synthetic peptide
  Seed: REFSVPEII (TYRP1_HUMAN)
REFSVPEIL

SEQ ID NO: 171671 - protein, 10 aa, Artificial Sequence
  Description of Artificial Sequence: Synthetic peptide
  Seed: VALIFGTASY (TYRP1_HUMAN)
VDLIFGTASF

SEQ ID NO: 171672 - protein, 9 aa, Artificial Sequence
  Description of Artificial Sequence: Synthetic peptide
  Seed: DDREVWPLR (TYRP1_HUMAN)
DYREVWPLK

SEQ ID NO: 171673 - protein, 11 aa, Artificial Sequence
  Description of Artificial Sequence: Synthetic peptide
  Seed: GYTYEIQWPSR (TYRP1_HUMAN)
GKTYEIQWPSR

SEQ ID NO: 171674 - protein, 9 aa, Artificial Sequence
  Description of Artificial Sequence: Synthetic peptide
  Seed: TGKYDPAVR (TYRP1_HUMAN)
TVKYDPAVR

SEQ ID NO: 171675 - protein, 9 aa, Artificial Sequence
  Description of Artificial Sequence: Synthetic peptide
  Seed: FSVPEIIAI (TYRP1_HUMAN)
FSVPEIIAM

SEQ ID NO: 171676 - protein, 9 aa, Artificial Sequence
  Description of Artificial Sequence: Synthetic peptide
  Seed: YTYEIQWPS (TYRP1_HUMAN)
YPYEIQWPL

SEQ ID NO: 171677 - protein, 9 aa, Artificial Sequence
  Description of Artificial Sequence: Synthetic peptide
  Seed: RSNFDSTLI (TYRP1_HUMAN)
RTNFDSTLW

SEQ ID NO: 171678 - protein, 9 aa, Artificial Sequence
  Description of Artificial Sequence: Synthetic peptide
  Seed: NYFVWTHYY (TYRP1_HUMAN)
NVFVWTHYW

SEQ ID NO: 171679 - protein, 11 aa, Artificial Sequence
  Description of Artificial Sequence: Synthetic peptide
  Seed: QYNMVPFWPPV (TYRP1_HUMAN)
QMNMVPFWPPV

SEQ ID NO: 171680 - protein, 11 aa, Artificial Sequence
  Description of Artificial Sequence: Synthetic peptide
  Seed: AGNVARPMVQR (TYRP1_HUMAN)
ANNVARPMVQK

SEQ ID NO: 171681 - protein, 11 aa, Artificial Sequence
  Description of Artificial Sequence: Synthetic peptide
  Seed: YNMVPFWPPVT (TYRP1_HUMAN)
YQMVPFWPPVL

SEQ ID NO: 171682 - protein, 9 aa, Artificial Sequence
  Description of Artificial Sequence: Synthetic peptide
  Seed: MSAPKLLSL (TYRP1_HUMAN)
MHAPKLLSY

SEQ ID NO: 171683 - protein, 10 aa, Artificial Sequence
  Description of Artificial Sequence: Synthetic peptide
  Seed: STLISPNSVF (TYRP1_HUMAN)
SDLISPNSVY

SEQ ID NO: 171684 - protein, 10 aa, Artificial Sequence
  Description of Artificial Sequence: Synthetic peptide
  Seed: THPLFVIATR (TYRP1_HUMAN)
TYPLFVIATR

SEQ ID NO: 171685 - protein, 9 aa, Artificial Sequence
  Description of Artificial Sequence: Synthetic peptide
  Seed: MSAPKLLSL (TYRP1_HUMAN)
MEAPKLLSA

SEQ ID NO: 171686 - protein, 11 aa, Artificial Sequence
  Description of Artificial Sequence: Synthetic peptide
  Seed: RRSMDEANQPL (TYRP1_HUMAN)
RQSMDEANQPV

SEQ ID NO: 171687 - protein, 10 aa, Artificial Sequence
  Description of Artificial Sequence: Synthetic peptide
  Seed: RQCATVEALR (TYRP1_HUMAN)
RWCATVEALR

SEQ ID NO: 171688 - protein, 10 aa, Artificial Sequence
  Description of Artificial Sequence: Synthetic peptide
  Seed: TPQFENISIY (TYRP1_HUMAN)
TFQFENISIF

SEQ ID NO: 171689 - protein, 9 aa, Artificial Sequence
  Description of Artificial Sequence: Synthetic peptide
  Seed: FTDAVFDEW (TYRP1_HUMAN)
FYDAVFDEL

SEQ ID NO: 171690 - protein, 9 aa, Artificial Sequence
  Description of Artificial Sequence: Synthetic peptide
  Seed: WHRYHLLRL (TYRP1_HUMAN)
WHRYHLLRY

SEQ ID NO: 171691 - protein, 10 aa, Artificial Sequence
  Description of Artificial Sequence: Synthetic peptide
  Seed: SIYNYFVWTH (TYRP1_HUMAN)
SSYNYFVWTK

SEQ ID NO: 171692 - protein, 10 aa, Artificial Sequence
  Description of Artificial Sequence: Synthetic peptide
  Seed: FVWTHYYSVK (TYRP1_HUMAN)
FQWTHYYSVI

SEQ ID NO: 171693 - protein, 9 aa, Artificial Sequence
  Description of Artificial Sequence: Synthetic peptide
  Seed: WTHYYSVKK (TYRP1_HUMAN)
WTHYYSVKR

SEQ ID NO: 171694 - protein, 10 aa, Artificial Sequence
  Description of Artificial Sequence: Synthetic peptide
  Seed: NLLDLSKEEK (TYRP1_HUMAN)
NVLDLSKEEK

SEQ ID NO: 171695 - protein, 9 aa, Artificial Sequence
  Description of Artificial Sequence: Synthetic peptide
  Seed: SMDEANQPL (TYRP1_HUMAN)
SVDEANQPM

SEQ ID NO: 171696 - protein, 9 aa, Artificial Sequence
  Description of Artificial Sequence: Synthetic peptide
  Seed: ACDQRVLIV (TYRP1_HUMAN)
ACDQRVLIL

SEQ ID NO: 171697 - protein, 8 aa, Artificial Sequence
  Description of Artificial Sequence: Synthetic peptide
  Seed: YNADISTF (TYRP1_HUMAN)
YYADISTI

SEQ ID NO: 171698 - protein, 10 aa, Artificial Sequence
  Description of Artificial Sequence: Synthetic peptide
  Seed: FVWTHYYSVK (TYRP1_HUMAN)
FYWTHYYSVK

SEQ ID NO: 171699 - protein, 9 aa, Artificial Sequence
  Description of Artificial Sequence: Synthetic peptide
  Seed: VFDEWLRRY (TYRP1_HUMAN)
VYDEWLRRY

SEQ ID NO: 171700 - protein, 9 aa, Artificial Sequence
  Description of Artificial Sequence: Synthetic peptide
  Seed: TADSRPHSP (TYRP1_HUMAN)
TNDSRPHSI

SEQ ID NO: 171701 - protein, 9 aa, Artificial Sequence
  Description of Artificial Sequence: Synthetic peptide
  Seed: RGRCEAVTA (TYRP1_HUMAN)
RTRCEAVTY

SEQ ID NO: 171702 - protein, 9 aa, Artificial Sequence
  Description of Artificial Sequence: Synthetic peptide
  Seed: RSLHNLAHL (TYRP1_HUMAN)
RSLHNLAHI

SEQ ID NO: 171703 - protein, 10 aa, Artificial Sequence
  Description of Artificial Sequence: Synthetic peptide
  Seed: YNADISTFPL (TYRP1_HUMAN)
YSADISTFPA

SEQ ID NO: 171704 - protein, 9 aa, Artificial Sequence
  Description of Artificial Sequence: Synthetic peptide
  Seed: MAKRTTHPL (TYRP1_HUMAN)
MIKRTTHPA

SEQ ID NO: 171705 - protein, 10 aa, Artificial Sequence
  Description of Artificial Sequence: Synthetic peptide
  Seed: HPLFVIATRR (TYRP1_HUMAN)
HTLFVIATRF

SEQ ID NO: 171706 - protein, 10 aa, Artificial Sequence
  Description of Artificial Sequence: Synthetic peptide
  Seed: KRTTHPLFVI (TYRP1_HUMAN)
KRTTHPLFVW

SEQ ID NO: 171707 - protein, 10 aa, Artificial Sequence
  Description of Artificial Sequence: Synthetic peptide
  Seed: LSLGCIFFPL (TYRP1_HUMAN)
LQLGCIFFPL

SEQ ID NO: 171708 - protein, 9 aa, Artificial Sequence
  Description of Artificial Sequence: Synthetic peptide
  Seed: ALIFGTASY (TYRP1_HUMAN)
AAIFGTASW

SEQ ID NO: 171709 - protein, 9 aa, Artificial Sequence
  Description of Artificial Sequence: Synthetic peptide
  Seed: RQYNMVPFW (TYRP1_HUMAN)
RRYNMVPFW

SEQ ID NO: 171710 - protein, 9 aa, Artificial Sequence
  Description of Artificial Sequence: Synthetic peptide
  Seed: TLISPNSVF (TYRP1_HUMAN)
TIISPNSVM

SEQ ID NO: 171711 - protein, 10 aa, Artificial Sequence
  Description of Artificial Sequence: Synthetic peptide
  Seed: VLLHTFTDAV (TYRP1_HUMAN)
VFLHTFTDAV

SEQ ID NO: 171712 - protein, 9 aa, Artificial Sequence
  Description of Artificial Sequence: Synthetic peptide
  Seed: DEWLRRYNA (TYRP1_HUMAN)
DEWLRRYNY

SEQ ID NO: 171713 - protein, 11 aa, Artificial Sequence
  Description of Artificial Sequence: Synthetic peptide
  Seed: IYNYFVWTHYY (TYRP1_HUMAN)
IQNYFVWTHYY

SEQ ID NO: 171714 - protein, 9 aa, Artificial Sequence
  Description of Artificial Sequence: Synthetic peptide
  Seed: NADISTFPL (TYRP1_HUMAN)
NPDISTFPI

SEQ ID NO: 171715 - protein, 11 aa, Artificial Sequence
  Description of Artificial Sequence: Synthetic peptide
  Seed: RRYNADISTFP (TYRP1_HUMAN)
RYYNADISTFH

SEQ ID NO: 171716 - protein, 9 aa, Artificial Sequence
  Description of Artificial Sequence: Synthetic peptide
  Seed: RQCATVEAL (TYRP1_HUMAN)
RACATVEAW

SEQ ID NO: 171717 - protein, 9 aa, Artificial Sequence
  Description of Artificial Sequence: Synthetic peptide
  Seed: TADSRPHSP (TYRP1_HUMAN)
TIDSRPHSM

SEQ ID NO: 171718 - protein, 10 aa, Artificial Sequence
  Description of Artificial Sequence: Synthetic peptide
  Seed: ALIFGTASYL (TYRP1_HUMAN)
ASIFGTASYF

SEQ ID NO: 171719 - protein, 10 aa, Artificial Sequence
  Description of Artificial Sequence: Synthetic peptide
  Seed: LIFGTASYLI (TYRP1_HUMAN)
LWFGTASYLF

SEQ ID NO: 171720 - protein, 9 aa, Artificial Sequence
  Description of Artificial Sequence: Synthetic peptide
  Seed: DLMGSRSNF (TYRP1_HUMAN)
DVMGSRSNW

SEQ ID NO: 171721 - protein, 10 aa, Artificial Sequence
  Description of Artificial Sequence: Synthetic peptide
  Seed: ADSRPHSPQY (TYRP1_HUMAN)
AISRPHSPQW

SEQ ID NO: 171722 - protein, 10 aa, Artificial Sequence
  Description of Artificial Sequence: Synthetic peptide
  Seed: ADSRPHSPQY (TYRP1_HUMAN)
AMSRPHSPQW

SEQ ID NO: 171723 - protein, 10 aa, Artificial Sequence
  Description of Artificial Sequence: Synthetic peptide
  Seed: FPRQCATVEA (TYRP1_HUMAN)
FARQCATVEY

SEQ ID NO: 171724 - protein, 9 aa, Artificial Sequence
  Description of Artificial Sequence: Synthetic peptide
  Seed: KYDPAVRSL (TYRP1_HUMAN)
KEDPAVRSI

SEQ ID NO: 171725 - protein, 9 aa, Artificial Sequence
  Description of Artificial Sequence: Synthetic peptide
  Seed: REFSVPEII (TYRP1_HUMAN)
RIFSVPEIL

SEQ ID NO: 171726 - protein, 11 aa, Artificial Sequence
  Description of Artificial Sequence: Synthetic peptide
  Seed: FLTWHRYHLLR (TYRP1_HUMAN)
FATWHRYHLLR

SEQ ID NO: 171727 - protein, 9 aa, Artificial Sequence
  Description of Artificial Sequence: Synthetic peptide
  Seed: RARRSMDEA (TYRP1_HUMAN)
RTRRSMDES

SEQ ID NO: 171728 - protein, 9 aa, Artificial Sequence
  Description of Artificial Sequence: Synthetic peptide
  Seed: SFSLPYWNF (TYRP1_HUMAN)
SWSLPYWNF

SEQ ID NO: 171729 - protein, 9 aa, Artificial Sequence
  Description of Artificial Sequence: Synthetic peptide
  Seed: MAKRTTHPL (TYRP1_HUMAN)
MMKRTTHPW

SEQ ID NO: 171730 - protein, 9 aa, Artificial Sequence
  Description of Artificial Sequence: Synthetic peptide
  Seed: EDYDTLGTL (TYRP1_HUMAN)
EQYDTLGTL

SEQ ID NO: 171731 - protein, 10 aa, Artificial Sequence
  Description of Artificial Sequence: Synthetic peptide
  Seed: SMDEANQPLL (TYRP1_HUMAN)
SADEANQPLL

SEQ ID NO: 171732 - protein, 9 aa, Artificial Sequence
  Description of Artificial Sequence: Synthetic peptide
  Seed: LPYWNFATG (TYRP1_HUMAN)
LSYWNFATF

SEQ ID NO: 171733 - protein, 8 aa, Artificial Sequence
  Description of Artificial Sequence: Synthetic peptide
  Seed: FSHEGPAF (TYRP1_HUMAN)
FTHEGPAL

SEQ ID NO: 171734 - protein, 9 aa, Artificial Sequence
  Description of Artificial Sequence: Synthetic peptide
  Seed: NRQYNMVPF (TYRP1_HUMAN)
NKQYNMVPY

SEQ ID NO: 171735 - protein, 9 aa, Artificial Sequence
  Description of Artificial Sequence: Synthetic peptide
  Seed: LQNPNQSVV (TYRP1_HUMAN)
LSNPNQSVV

SEQ ID NO: 171736 - protein, 11 aa, Artificial Sequence
  Description of Artificial Sequence: Synthetic peptide
  Seed: YNMVPFWPPVT (TYRP1_HUMAN)
YLMVPFWPPVK

SEQ ID NO: 171737 - protein, 9 aa, Artificial Sequence
  Description of Artificial Sequence: Synthetic peptide
  Seed: EDYDTLGTL (TYRP1_HUMAN)
EEYDTLGTA

SEQ ID NO: 171738 - protein, 9 aa, Artificial Sequence
  Description of Artificial Sequence: Synthetic peptide
  Seed: FVWTHYYSV (TYRP1_HUMAN)
FQWTHYYSI

SEQ ID NO: 171739 - protein, 9 aa, Artificial Sequence
  Description of Artificial Sequence: Synthetic peptide
  Seed: QYQCYAEEY (TYRP1_HUMAN)
QYQCYAEEI

SEQ ID NO: 171740 - protein, 9 aa, Artificial Sequence
  Description of Artificial Sequence: Synthetic peptide
  Seed: RFFNRTCHC (TYRP1_HUMAN)
RVFNRTCHA

SEQ ID NO: 171741 - protein, 10 aa, Artificial Sequence
  Description of Artificial Sequence: Synthetic peptide
  Seed: FWPPVTNTEM (TYRP1_HUMAN)
FTPPVTNTEL

SEQ ID NO: 171742 - protein, 9 aa, Artificial Sequence
  Description of Artificial Sequence: Synthetic peptide
  Seed: HEGPAFLTW (TYRP1_HUMAN)
HAGPAFLTI

SEQ ID NO: 171743 - protein, 9 aa, Artificial Sequence
  Description of Artificial Sequence: Synthetic peptide
  Seed: YTYEIQWPS (TYRP1_HUMAN)
YQYEIQWPD

SEQ ID NO: 171744 - protein, 10 aa, Artificial Sequence
  Description of Artificial Sequence: Synthetic peptide
  Seed: YNYFVWTHYY (TYRP1_HUMAN)
YWYFVWTHYI

SEQ ID NO: 171745 - protein, 9 aa, Artificial Sequence
  Description of Artificial Sequence: Synthetic peptide
  Seed: AQFPRQCAT (TYRP1_HUMAN)
AQFPRQCAF

SEQ ID NO: 171746 - protein, 9 aa, Artificial Sequence
  Description of Artificial Sequence: Synthetic peptide
  Seed: FLTWHRYHL (TYRP1_HUMAN)
FRTWHRYHF

SEQ ID NO: 171747 - protein, 9 aa, Artificial Sequence
  Description of Artificial Sequence: Synthetic peptide
  Seed: RTTHPLFVI (TYRP1_HUMAN)
RLTHPLFVV

SEQ ID NO: 171748 - protein, 9 aa, Artificial Sequence
  Description of Artificial Sequence: Synthetic peptide
  Seed: EEYEKLQNP (TYRP1_HUMAN)
EEYEKLQNC

SEQ ID NO: 171749 - protein, 9 aa, Artificial Sequence
  Description of Artificial Sequence: Synthetic peptide
  Seed: RRNPAGNVA (TYRP1_HUMAN)
RYNPAGNVY

SEQ ID NO: 171750 - protein, 11 aa, Artificial Sequence
  Description of Artificial Sequence: Synthetic peptide
  Seed: FVLLHTFTDAV (TYRP1_HUMAN)
FSLLHTFTDAL

SEQ ID NO: 171751 - protein, 9 aa, Artificial Sequence
  Description of Artificial Sequence: Synthetic peptide
  Seed: QEMLQEPSF (TYRP1_HUMAN)
QEMLQEPSW

SEQ ID NO: 171752 - protein, 10 aa, Artificial Sequence
  Description of Artificial Sequence: Synthetic peptide
  Seed: FLTWHRYHLL (TYRP1_HUMAN)
FDTWHRYHLV

SEQ ID NO: 171753 - protein, 9 aa, Artificial Sequence
  Description of Artificial Sequence: Synthetic peptide
  Seed: SLGCIFFPL (TYRP1_HUMAN)
SSGCIFFPI

SEQ ID NO: 171754 - protein, 9 aa, Artificial Sequence
  Description of Artificial Sequence: Synthetic peptide
  Seed: KYDPAVRSL (TYRP1_HUMAN)
KWDPAVRSL

SEQ ID NO: 171755 - protein, 10 aa, Artificial Sequence
  Description of Artificial Sequence: Synthetic peptide
  Seed: LLLVALIFGT (TYRP1_HUMAN)
LLLVALIFGI

SEQ ID NO: 171756 - protein, 10 aa, Artificial Sequence
  Description of Artificial Sequence: Synthetic peptide
  Seed: WPPVTNTEMF (TYRP1_HUMAN)
WQPVTNTEMY

SEQ ID NO: 171757 - protein, 9 aa, Artificial Sequence
  Description of Artificial Sequence: Synthetic peptide
  Seed: LTWHRYHLL (TYRP1_HUMAN)
LMWHRYHLV

SEQ ID NO: 171758 - protein, 10 aa, Artificial Sequence
  Description of Artificial Sequence: Synthetic peptide
  Seed: SQWRVVCDSL (TYRP1_HUMAN)
SMWRVVCDSF

SEQ ID NO: 171759 - protein, 10 aa, Artificial Sequence
  Description of Artificial Sequence: Synthetic peptide
  Seed: YTYEIQWPSR (TYRP1_HUMAN)
YAYEIQWPSK

SEQ ID NO: 171760 - protein, 9 aa, Artificial Sequence
  Description of Artificial Sequence: Synthetic peptide
  Seed: GLFDTPPFY (TYRP1_HUMAN)
GYFDTPPFL

SEQ ID NO: 171761 - protein, 10 aa, Artificial Sequence
  Description of Artificial Sequence: Synthetic peptide
  Seed: YFVWTHYYSV (TYRP1_HUMAN)
YNVWTHYYSI

SEQ ID NO: 171762 - protein, 9 aa, Artificial Sequence
  Description of Artificial Sequence: Synthetic peptide
  Seed: GPDGNTPQF (TYRP1_HUMAN)
GWDGNTPQI

SEQ ID NO: 171763 - protein, 9 aa, Artificial Sequence
  Description of Artificial Sequence: Synthetic peptide
  Seed: IFGTASYLI (TYRP1_HUMAN)
IWGTASYLI

SEQ ID NO: 171764 - protein, 9 aa, Artificial Sequence
  Description of Artificial Sequence: Synthetic peptide
  Seed: FYSNSTNSF (TYRP1_HUMAN)
FHSNSTNSY

SEQ ID NO: 171765 - protein, 10 aa, Artificial Sequence
  Description of Artificial Sequence: Synthetic peptide
  Seed: VALIFGTASY (TYRP1_HUMAN)
VWLIFGTASY

SEQ ID NO: 171766 - protein, 10 aa, Artificial Sequence
  Description of Artificial Sequence: Synthetic peptide
  Seed: YSVKKTFLGV (TYRP1_HUMAN)
YTVKKTFLGV

SEQ ID NO: 171767 - protein, 10 aa, Artificial Sequence
  Description of Artificial Sequence: Synthetic peptide
  Seed: THYYSVKKTF (TYRP1_HUMAN)
TMYYSVKKTY

SEQ ID NO: 171768 - protein, 9 aa, Artificial Sequence
  Description of Artificial Sequence: Synthetic peptide
  Seed: ENAPIGHNR (TYRP1_HUMAN)
ETAPIGHNF

SEQ ID NO: 171769 - protein, 9 aa, Artificial Sequence
  Description of Artificial Sequence: Synthetic peptide
  Seed: IAIAVVGAL (TYRP1_HUMAN)
IIIAVVGAV

SEQ ID NO: 171770 - protein, 9 aa, Artificial Sequence
  Description of Artificial Sequence: Synthetic peptide
  Seed: HYYSVKKTF (TYRP1_HUMAN)
HFYSVKKTF

SEQ ID NO: 171771 - protein, 9 aa, Artificial Sequence
  Description of Artificial Sequence: Synthetic peptide
  Seed: SFRNTVEGY (TYRP1_HUMAN)
SYRNTVEGF

SEQ ID NO: 171772 - protein, 10 aa, Artificial Sequence
  Description of Artificial Sequence: Synthetic peptide
  Seed: ADSRPHSPQY (TYRP1_HUMAN)
AQSRPHSPQV

SEQ ID NO: 171773 - protein, 9 aa, Artificial Sequence
  Description of Artificial Sequence: Synthetic peptide
  Seed: SVKKTFLGV (TYRP1_HUMAN)
SVKKTFLGL

SEQ ID NO: 171774 - protein, 9 aa, Artificial Sequence
  Description of Artificial Sequence: Synthetic peptide
  Seed: SVPEIIAIA (TYRP1_HUMAN)
SSPEIIAIF

SEQ ID NO: 171775 - protein, 10 aa, Artificial Sequence
  Description of Artificial Sequence: Synthetic peptide
  Seed: LQEPSFSLPY (TYRP1_HUMAN)
LIEPSFSLPY

SEQ ID NO: 171776 - protein, 10 aa, Artificial Sequence
  Description of Artificial Sequence: Synthetic peptide
  Seed: VDFSHEGPAF (TYRP1_HUMAN)
VGFSHEGPAY

SEQ ID NO: 171777 - protein, 11 aa, Artificial Sequence
  Description of Artificial Sequence: Synthetic peptide
  Seed: FVLLHTFTDAV (TYRP1_HUMAN)
FFLLHTFTDAL

SEQ ID NO: 171778 - protein, 9 aa, Artificial Sequence
  Description of Artificial Sequence: Synthetic peptide
  Seed: AVFDEWLRR (TYRP1_HUMAN)
ANFDEWLRY

SEQ ID NO: 171779 - protein, 10 aa, Artificial Sequence
  Description of Artificial Sequence: Synthetic peptide
  Seed: ADSRPHSPQY (TYRP1_HUMAN)
AQSRPHSPQW

SEQ ID NO: 171780 - protein, 10 aa, Artificial Sequence
  Description of Artificial Sequence: Synthetic peptide
  Seed: LQEPSFSLPY (TYRP1_HUMAN)
LFEPSFSLPY

SEQ ID NO: 171781 - protein, 10 aa, Artificial Sequence
  Description of Artificial Sequence: Synthetic peptide
  Seed: FVRALDMAKR (TYRP1_HUMAN)
FTRALDMAKK

SEQ ID NO: 171782 - protein, 9 aa, Artificial Sequence
  Description of Artificial Sequence: Synthetic peptide
  Seed: LTDQYQCYA (TYRP1_HUMAN)
LIDQYQCYY

SEQ ID NO: 171783 - protein, 9 aa, Artificial Sequence
  Description of Artificial Sequence: Synthetic peptide
  Seed: ACDQRVLIV (TYRP1_HUMAN)
AMDQRVLIM

SEQ ID NO: 171784 - protein, 9 aa, Artificial Sequence
  Description of Artificial Sequence: Synthetic peptide
  Seed: RYNADISTF (TYRP1_HUMAN)
RINADISTY

SEQ ID NO: 171785 - protein, 9 aa, Artificial Sequence
  Description of Artificial Sequence: Synthetic peptide
  Seed: IAIAVVGAL (TYRP1_HUMAN)
ISIAVVGAM

SEQ ID NO: 171786 - protein, 10 aa, Artificial Sequence
  Description of Artificial Sequence: Synthetic peptide
  Seed: FSLPYWNFAT (TYRP1_HUMAN)
FTLPYWNFAI

SEQ ID NO: 171787 - protein, 9 aa, Artificial Sequence
  Description of Artificial Sequence: Synthetic peptide
  Seed: IIAIAVVGA (TYRP1_HUMAN)
IIAIAVVGV

SEQ ID NO: 171788 - protein, 9 aa, Artificial Sequence
  Description of Artificial Sequence: Synthetic peptide
  Seed: RQYNMVPFW (TYRP1_HUMAN)
RRYNMVPFK

SEQ ID NO: 171789 - protein, 9 aa, Artificial Sequence
  Description of Artificial Sequence: Synthetic peptide
  Seed: FVWTHYYSV (TYRP1_HUMAN)
FFWTHYYSL

SEQ ID NO: 171790 - protein, 10 aa, Artificial Sequence
  Description of Artificial Sequence: Synthetic peptide
  Seed: NSTEDGPIRR (TYRP1_HUMAN)
NTTEDGPIRR

SEQ ID NO: 171791 - protein, 10 aa, Artificial Sequence
  Description of Artificial Sequence: Synthetic peptide
  Seed: SFSLPYWNFA (TYRP1_HUMAN)
SMSLPYWNFK

SEQ ID NO: 171792 - protein, 10 aa, Artificial Sequence
  Description of Artificial Sequence: Synthetic peptide
  Seed: LSLGCIFFPL (TYRP1_HUMAN)
LALGCIFFPI

SEQ ID NO: 171793 - protein, 9 aa, Artificial Sequence
  Description of Artificial Sequence: Synthetic peptide
  Seed: AACDQRVLI (TYRP1_HUMAN)
AVCDQRVLV

SEQ ID NO: 171794 - protein, 11 aa, Artificial Sequence
  Description of Artificial Sequence: Synthetic peptide
  Seed: YSDPTGKYDPA (TYRP1_HUMAN)
YMDPTGKYDPM

SEQ ID NO: 171795 - protein, 9 aa, Artificial Sequence
  Description of Artificial Sequence: Synthetic peptide
  Seed: FGTASYLIR (TYRP1_HUMAN)
FVTASYLIK

SEQ ID NO: 171796 - protein, 10 aa, Artificial Sequence
  Description of Artificial Sequence: Synthetic peptide
  Seed: KRTTHPLFVI (TYRP1_HUMAN)
KGTTHPLFVF

SEQ ID NO: 171797 - protein, 9 aa, Artificial Sequence
  Description of Artificial Sequence: Synthetic peptide
  Seed: SPNDPIFVL (TYRP1_HUMAN)
SPNDPIFVI

SEQ ID NO: 171798 - protein, 10 aa, Artificial Sequence
  Description of Artificial Sequence: Synthetic peptide
  Seed: ALIFGTASYL (TYRP1_HUMAN)
AVIFGTASYI

SEQ ID NO: 171799 - protein, 10 aa, Artificial Sequence
  Description of Artificial Sequence: Synthetic peptide
  Seed: LSLGCIFFPL (TYRP1_HUMAN)
LMLGCIFFPM

SEQ ID NO: 171800 - protein, 10 aa, Artificial Sequence
  Description of Artificial Sequence: Synthetic peptide
  Seed: MAKRTTHPLF (TYRP1_HUMAN)
MRKRTTHPLF

SEQ ID NO: 171801 - protein, 10 aa, Artificial Sequence
  Description of Artificial Sequence: Synthetic peptide
  Seed: KLLSLGCIFF (TYRP1_HUMAN)
KQLSLGCIFM

SEQ ID NO: 171802 - protein, 9 aa, Artificial Sequence
  Description of Artificial Sequence: Synthetic peptide
  Seed: SLHNLAHLF (TYRP1_HUMAN)
STHNLAHLF

SEQ ID NO: 171803 - protein, 9 aa, Artificial Sequence
  Description of Artificial Sequence: Synthetic peptide
  Seed: HYYSVKKTF (TYRP1_HUMAN)
HKYSVKKTF

SEQ ID NO: 171804 - protein, 9 aa, Artificial Sequence
  Description of Artificial Sequence: Synthetic peptide
  Seed: NRQYNMVPF (TYRP1_HUMAN)
NYQYNMVPF

SEQ ID NO: 171805 - protein, 9 aa, Artificial Sequence
  Description of Artificial Sequence: Synthetic peptide
  Seed: SLGCIFFPL (TYRP1_HUMAN)
SVGCIFFPL

SEQ ID NO: 171806 - protein, 9 aa, Artificial Sequence
  Description of Artificial Sequence: Synthetic peptide
  Seed: VTAPDNLGY (TYRP1_HUMAN)
VFAPDNLGY

SEQ ID NO: 171807 - protein, 9 aa, Artificial Sequence
  Description of Artificial Sequence: Synthetic peptide
  Seed: RSLHNLAHL (TYRP1_HUMAN)
RNLHNLAHY

SEQ ID NO: 171808 - protein, 10 aa, Artificial Sequence
  Description of Artificial Sequence: Synthetic peptide
  Seed: LGPDGNTPQF (TYRP1_HUMAN)
LYPDGNTPQY

SEQ ID NO: 171809 - protein, 9 aa, Artificial Sequence
  Description of Artificial Sequence: Synthetic peptide
  Seed: SVKKTFLGV (TYRP1_HUMAN)
STKKTFLGG

SEQ ID NO: 171810 - protein, 10 aa, Artificial Sequence
  Description of Artificial Sequence: Synthetic peptide
  Seed: LLLVALIFGT (TYRP1_HUMAN)
LRLVALIFGV

SEQ ID NO: 171811 - protein, 10 aa, Artificial Sequence
  Description of Artificial Sequence: Synthetic peptide
  Seed: FSVPEIIAIA (TYRP1_HUMAN)
FLVPEIIAIA

SEQ ID NO: 171812 - protein, 9 aa, Artificial Sequence
  Description of Artificial Sequence: Synthetic peptide
  Seed: LTWHRYHLL (TYRP1_HUMAN)
LGWHRYHLW

SEQ ID NO: 171813 - protein, 9 aa, Artificial Sequence
  Description of Artificial Sequence: Synthetic peptide
  Seed: SMDEANQPL (TYRP1_HUMAN)
SMDEANQPA

SEQ ID NO: 171814 - protein, 9 aa, Artificial Sequence
  Description of Artificial Sequence: Synthetic peptide
  Seed: ENAPIGHNR (TYRP1_HUMAN)
EVAPIGHNY

SEQ ID NO: 171815 - protein, 9 aa, Artificial Sequence
  Description of Artificial Sequence: Synthetic peptide
  Seed: YNYFVWTHY (TYRP1_HUMAN)
YSYFVWTHM

SEQ ID NO: 171816 - protein, 11 aa, Artificial Sequence
  Description of Artificial Sequence: Synthetic peptide
  Seed: IYNYFVWTHYY (TYRP1_HUMAN)
IANYFVWTHYY

SEQ ID NO: 171817 - protein, 9 aa, Artificial Sequence
  Description of Artificial Sequence: Synthetic peptide
  Seed: ALIFGTASY (TYRP1_HUMAN)
AQIFGTASW

SEQ ID NO: 171818 - protein, 9 aa, Artificial Sequence
  Description of Artificial Sequence: Synthetic peptide
  Seed: RYHLLRLEK (TYRP1_HUMAN)
RAHLLRLEV

SEQ ID NO: 171819 - protein, 10 aa, Artificial Sequence
  Description of Artificial Sequence: Synthetic peptide
  Seed: YEIQWPSREF (TYRP1_HUMAN)
YQIQWPSREM

SEQ ID NO: 171820 - protein, 10 aa, Artificial Sequence
  Description of Artificial Sequence: Synthetic peptide
  Seed: STLISPNSVF (TYRP1_HUMAN)
SYLISPNSVF

SEQ ID NO: 171821 - protein, 9 aa, Artificial Sequence
  Description of Artificial Sequence: Synthetic peptide
  Seed: LIFGTASYL (TYRP1_HUMAN)
LHFGTASYY

SEQ ID NO: 171822 - protein, 10 aa, Artificial Sequence
  Description of Artificial Sequence: Synthetic peptide
  Seed: YNYFVWTHYY (TYRP1_HUMAN)
YTYFVWTHYV

SEQ ID NO: 171823 - protein, 10 aa, Artificial Sequence
  Description of Artificial Sequence: Synthetic peptide
  Seed: TAPDNLGYTY (TYRP1_HUMAN)
TMPDNLGYTL

SEQ ID NO: 171824 - protein, 9 aa, Artificial Sequence
  Description of Artificial Sequence: Synthetic peptide
  Seed: YTYEIQWPS (TYRP1_HUMAN)
YSYEIQWPL

SEQ ID NO: 171825 - protein, 9 aa, Artificial Sequence
  Description of Artificial Sequence: Synthetic peptide
  Seed: IGHNRQYNM (TYRP1_HUMAN)
IAHNRQYNY

SEQ ID NO: 171826 - protein, 9 aa, Artificial Sequence
  Description of Artificial Sequence: Synthetic peptide
  Seed: LQNPNQSVV (TYRP1_HUMAN)
LHNPNQSVY

SEQ ID NO: 171827 - protein, 10 aa, Artificial Sequence
  Description of Artificial Sequence: Synthetic peptide
  Seed: LSPNDPIFVL (TYRP1_HUMAN)
LGPNDPIFVF

SEQ ID NO: 171828 - protein, 10 aa, Artificial Sequence
  Description of Artificial Sequence: Synthetic peptide
  Seed: LSLGCIFFPL (TYRP1_HUMAN)
LALGCIFFPW

SEQ ID NO: 171829 - protein, 9 aa, Artificial Sequence
  Description of Artificial Sequence: Synthetic peptide
  Seed: TADSRPHSP (TYRP1_HUMAN)
TLDSRPHSM

SEQ ID NO: 171830 - protein, 9 aa, Artificial Sequence
  Description of Artificial Sequence: Synthetic peptide
  Seed: KLQNPNQSV (TYRP1_HUMAN)
KAQNPNQSM

SEQ ID NO: 171831 - protein, 9 aa, Artificial Sequence
  Description of Artificial Sequence: Synthetic peptide
  Seed: GTASYLIRA (TYRP1_HUMAN)
GMASYLIRI

SEQ ID NO: 171832 - protein, 9 aa, Artificial Sequence
  Description of Artificial Sequence: Synthetic peptide
  Seed: RQCATVEAL (TYRP1_HUMAN)
RECATVEAF

SEQ ID NO: 171833 - protein, 10 aa, Artificial Sequence
  Description of Artificial Sequence: Synthetic peptide
  Seed: YNMVPFWPPV (TYRP1_HUMAN)
YDMVPFWPPL

SEQ ID NO: 171834 - protein, 9 aa, Artificial Sequence
  Description of Artificial Sequence: Synthetic peptide
  Seed: YLIRARRSM (TYRP1_HUMAN)
YKIRARRSM

SEQ ID NO: 171835 - protein, 9 aa, Artificial Sequence
  Description of Artificial Sequence: Synthetic peptide
  Seed: NMVPFWPPV (TYRP1_HUMAN)
NVVPFWPPM

SEQ ID NO: 171836 - protein, 10 aa, Artificial Sequence
  Description of Artificial Sequence: Synthetic peptide
  Seed: YSNSTNSFRN (TYRP1_HUMAN)
YMNSTNSFRK

SEQ ID NO: 171837 - protein, 9 aa, Artificial Sequence
  Description of Artificial Sequence: Synthetic peptide
  Seed: VFDEWLRRY (TYRP1_HUMAN)
VVDEWLRRL

SEQ ID NO: 171838 - protein, 10 aa, Artificial Sequence
  Description of Artificial Sequence: Synthetic peptide
  Seed: HNRQYNMVPF (TYRP1_HUMAN)
HQRQYNMVPL

SEQ ID NO: 171839 - protein, 8 aa, Artificial Sequence
  Description of Artificial Sequence: Synthetic peptide
  Seed: IFFPLLLF (TYRP1_HUMAN)
ILFPLLLY

SEQ ID NO: 171840 - protein, 9 aa, Artificial Sequence
  Description of Artificial Sequence: Synthetic peptide
  Seed: FPLENAPIG (TYRP1_HUMAN)
FPLENAPIA

SEQ ID NO: 171841 - protein, 10 aa, Artificial Sequence
  Description of Artificial Sequence: Synthetic peptide
  Seed: SHEGPAFLTW (TYRP1_HUMAN)
SLEGPAFLTW

SEQ ID NO: 171842 - protein, 9 aa, Artificial Sequence
  Description of Artificial Sequence: Synthetic peptide
  Seed: YLIRARRSM (TYRP1_HUMAN)
YQIRARRSY

SEQ ID NO: 171843 - protein, 11 aa, Artificial Sequence
  Description of Artificial Sequence: Synthetic peptide
  Seed: FENISIYNYFV (TYRP1_HUMAN)
FLNISIYNYFL

SEQ ID NO: 171844 - protein, 11 aa, Artificial Sequence
  Description of Artificial Sequence: Synthetic peptide
  Seed: YNMVPFWPPVT (TYRP1_HUMAN)
YVMVPFWPPVV

SEQ ID NO: 171845 - protein, 9 aa, Artificial Sequence
  Description of Artificial Sequence: Synthetic peptide
  Seed: FTDAVFDEW (TYRP1_HUMAN)
FPDAVFDEW

SEQ ID NO: 171846 - protein, 10 aa, Artificial Sequence
  Description of Artificial Sequence: Synthetic peptide
  Seed: FGTASYLIRA (TYRP1_HUMAN)
FLTASYLIRI

SEQ ID NO: 171847 - protein, 9 aa, Artificial Sequence
  Description of Artificial Sequence: Synthetic peptide
  Seed: DDREVWPLR (TYRP1_HUMAN)
DWREVWPLR

SEQ ID NO: 171848 - protein, 9 aa, Artificial Sequence
  Description of Artificial Sequence: Synthetic peptide
  Seed: RARRSMDEA (TYRP1_HUMAN)
RVRRSMDER

SEQ ID NO: 171849 - protein, 10 aa, Artificial Sequence
  Description of Artificial Sequence: Synthetic peptide
  Seed: FSVPEIIAIA (TYRP1_HUMAN)
FAVPEIIAIV

SEQ ID NO: 171850 - protein, 9 aa, Artificial Sequence
  Description of Artificial Sequence: Synthetic peptide
  Seed: AFLTWHRYH (TYRP1_HUMAN)
AFLTWHRYK

SEQ ID NO: 171851 - protein, 9 aa, Artificial Sequence
  Description of Artificial Sequence: Synthetic peptide
  Seed: GLFDTPPFY (TYRP1_HUMAN)
GLFDTPPFR

SEQ ID NO: 171852 - protein, 11 aa, Artificial Sequence
  Description of Artificial Sequence: Synthetic peptide
  Seed: LVALIFGTASY (TYRP1_HUMAN)
LWALIFGTASY

SEQ ID NO: 171853 - protein, 9 aa, Artificial Sequence
  Description of Artificial Sequence: Synthetic peptide
  Seed: MFVTAPDNL (TYRP1_HUMAN)
MWVTAPDNW

SEQ ID NO: 171854 - protein, 10 aa, Artificial Sequence
  Description of Artificial Sequence: Synthetic peptide
  Seed: RSLHNLAHLF (TYRP1_HUMAN)
RNLHNLAHLW

SEQ ID NO: 171855 - protein, 10 aa, Artificial Sequence
  Description of Artificial Sequence: Synthetic peptide
  Seed: FLTWHRYHLL (TYRP1_HUMAN)
FMTWHRYHLM

SEQ ID NO: 171856 - protein, 9 aa, Artificial Sequence
  Description of Artificial Sequence: Synthetic peptide
  Seed: FYSNSTNSF (TYRP1_HUMAN)
FVSNSTNSL

SEQ ID NO: 171857 - protein, 9 aa, Artificial Sequence
  Description of Artificial Sequence: Synthetic peptide
  Seed: ACDQRVLIV (TYRP1_HUMAN)
ALDQRVLIF

SEQ ID NO: 171858 - protein, 10 aa, Artificial Sequence
  Description of Artificial Sequence: Synthetic peptide
  Seed: FVTAPDNLGY (TYRP1_HUMAN)
FVTAPDNLGF

SEQ ID NO: 171859 - protein, 10 aa, Artificial Sequence
  Description of Artificial Sequence: Synthetic peptide
  Seed: GTASYLIRAR (TYRP1_HUMAN)
GMASYLIRAK

SEQ ID NO: 171860 - protein, 9 aa, Artificial Sequence
  Description of Artificial Sequence: Synthetic peptide
  Seed: YTYEIQWPS (TYRP1_HUMAN)
YLYEIQWPI

SEQ ID NO: 171861 - protein, 9 aa, Artificial Sequence
  Description of Artificial Sequence: Synthetic peptide
  Seed: VTAPDNLGY (TYRP1_HUMAN)
VIAPDNLGR

SEQ ID NO: 171862 - protein, 10 aa, Artificial Sequence
  Description of Artificial Sequence: Synthetic peptide
  Seed: YNYFVWTHYY (TYRP1_HUMAN)
YDYFVWTHYM

SEQ ID NO: 171863 - protein, 9 aa, Artificial Sequence
  Description of Artificial Sequence: Synthetic peptide
  Seed: LPYWNFATG (TYRP1_HUMAN)
LPYWNFATP

SEQ ID NO: 171864 - protein, 9 aa, Artificial Sequence
  Description of Artificial Sequence: Synthetic peptide
  Seed: YTYEIQWPS (TYRP1_HUMAN)
YLYEIQWPC

SEQ ID NO: 171865 - protein, 10 aa, Artificial Sequence
  Description of Artificial Sequence: Synthetic peptide
  Seed: ADSRPHSPQY (TYRP1_HUMAN)
AFSRPHSPQW

SEQ ID NO: 171866 - protein, 9 aa, Artificial Sequence
  Description of Artificial Sequence: Synthetic peptide
  Seed: SLHNLAHLF (TYRP1_HUMAN)
SYHNLAHLY

SEQ ID NO: 171867 - protein, 9 aa, Artificial Sequence
  Description of Artificial Sequence: Synthetic peptide
  Seed: AQFPRQCAT (TYRP1_HUMAN)
AEFPRQCAL

SEQ ID NO: 171868 - protein, 9 aa, Artificial Sequence
  Description of Artificial Sequence: Synthetic peptide
  Seed: RFFNRTCHC (TYRP1_HUMAN)
RYFNRTCHA

SEQ ID NO: 171869 - protein, 10 aa, Artificial Sequence
  Description of Artificial Sequence: Synthetic peptide
  Seed: KLLSLGCIFF (TYRP1_HUMAN)
KMLSLGCIFI

SEQ ID NO: 171870 - protein, 9 aa, Artificial Sequence
  Description of Artificial Sequence: Synthetic peptide
  Seed: AFLTWHRYH (TYRP1_HUMAN)
AMLTWHRYR

SEQ ID NO: 171871 - protein, 8 aa, Artificial Sequence
  Description of Artificial Sequence: Synthetic peptide
  Seed: LFDTPPFY (TYRP1_HUMAN)
LYDTPPFI

SEQ ID NO: 171872 - protein, 11 aa, Artificial Sequence
  Description of Artificial Sequence: Synthetic peptide
  Seed: FLNGTGGQTHL (TYRP1_HUMAN)
FANGTGGQTHI

SEQ ID NO: 171873 - protein, 9 aa, Artificial Sequence
  Description of Artificial Sequence: Synthetic peptide
  Seed: SFSLPYWNF (TYRP1_HUMAN)
SMSLPYWNY

SEQ ID NO: 171874 - protein, 10 aa, Artificial Sequence
  Description of Artificial Sequence: Synthetic peptide
  Seed: IQWPSREFSV (TYRP1_HUMAN)
IIWPSREFSI

SEQ ID NO: 171875 - protein, 10 aa, Artificial Sequence
  Description of Artificial Sequence: Synthetic peptide
  Seed: LLLVALIFGT (TYRP1_HUMAN)
LQLVALIFGI

SEQ ID NO: 171876 - protein, 10 aa, Artificial Sequence
  Description of Artificial Sequence: Synthetic peptide
  Seed: SMDEANQPLL (TYRP1_HUMAN)
SADEANQPLM

SEQ ID NO: 171877 - protein, 9 aa, Artificial Sequence
  Description of Artificial Sequence: Synthetic peptide
  Seed: SLHNLAHLF (TYRP1_HUMAN)
SAHNLAHLI

SEQ ID NO: 171878 - protein, 10 aa, Artificial Sequence
  Description of Artificial Sequence: Synthetic peptide
  Seed: FLNGTGGQTH (TYRP1_HUMAN)
FQNGTGGQTM

SEQ ID NO: 171879 - protein, 10 aa, Artificial Sequence
  Description of Artificial Sequence: Synthetic peptide
  Seed: ISPNSVFSQW (TYRP1_HUMAN)
IGPNSVFSQW

SEQ ID NO: 171880 - protein, 10 aa, Artificial Sequence
  Description of Artificial Sequence: Synthetic peptide
  Seed: VGLFDTPPFY (TYRP1_HUMAN)
VQLFDTPPFY

SEQ ID NO: 171881 - protein, 8 aa, Artificial Sequence
  Description of Artificial Sequence: Synthetic peptide
  Seed: IAVVGALL (TYRP1_HUMAN)
IQVVGALI

SEQ ID NO: 171882 - protein, 10 aa, Artificial Sequence
  Description of Artificial Sequence: Synthetic peptide
  Seed: HRYHLLRLEK (TYRP1_HUMAN)
HLYHLLRLER

SEQ ID NO: 171883 - protein, 10 aa, Artificial Sequence
  Description of Artificial Sequence: Synthetic peptide
  Seed: TPQFENISIY (TYRP1_HUMAN)
TFQFENISIM

SEQ ID NO: 171884 - protein, 9 aa, Artificial Sequence
  Description of Artificial Sequence: Synthetic peptide
  Seed: KYDPAVRSL (TYRP1_HUMAN)
KGDPAVRSL

SEQ ID NO: 171885 - protein, 9 aa, Artificial Sequence
  Description of Artificial Sequence: Synthetic peptide
  Seed: ALIFGTASY (TYRP1_HUMAN)
ALIFGTASF

SEQ ID NO: 171886 - protein, 8 aa, Artificial Sequence
  Description of Artificial Sequence: Synthetic peptide
  Seed: LIFGTASY (TYRP1_HUMAN)
LAFGTASM

SEQ ID NO: 171887 - protein, 9 aa, Artificial Sequence
  Description of Artificial Sequence: Synthetic peptide
  Seed: RSLHNLAHL (TYRP1_HUMAN)
RQLHNLAHV

SEQ ID NO: 171888 - protein, 9 aa, Artificial Sequence
  Description of Artificial Sequence: Synthetic peptide
  Seed: APKLLSLGC (TYRP1_HUMAN)
APKLLSLGF

SEQ ID NO: 171889 - protein, 11 aa, Artificial Sequence
  Description of Artificial Sequence: Synthetic peptide
  Seed: YNYFVWTHYYS (TYRP1_HUMAN)
YFYFVWTHYYQ

SEQ ID NO: 171890 - protein, 10 aa, Artificial Sequence
  Description of Artificial Sequence: Synthetic peptide
  Seed: AVRSLHNLAH (TYRP1_HUMAN)
AVRSLHNLAV

SEQ ID NO: 171891 - protein, 10 aa, Artificial Sequence
  Description of Artificial Sequence: Synthetic peptide
  Seed: LQEPSFSLPY (TYRP1_HUMAN)
LMEPSFSLPF

SEQ ID NO: 171892 - protein, 11 aa, Artificial Sequence
  Description of Artificial Sequence: Synthetic peptide
  Seed: MLQEPSFSLPY (TYRP1_HUMAN)
MVQEPSFSLPF

SEQ ID NO: 171893 - protein, 9 aa, Artificial Sequence
  Description of Artificial Sequence: Synthetic peptide
  Seed: SIYNYFVWT (TYRP1_HUMAN)
SLYNYFVWS

SEQ ID NO: 171894 - protein, 9 aa, Artificial Sequence
  Description of Artificial Sequence: Synthetic peptide
  Seed: VFDEWLRRY (TYRP1_HUMAN)
VLDEWLRRY

SEQ ID NO: 171895 - protein, 9 aa, Artificial Sequence
  Description of Artificial Sequence: Synthetic peptide
  Seed: TTHPLFVIA (TYRP1_HUMAN)
TAHPLFVIH

SEQ ID NO: 171896 - protein, 9 aa, Artificial Sequence
  Description of Artificial Sequence: Synthetic peptide
  Seed: RRNPAGNVA (TYRP1_HUMAN)
RQNPAGNVM

SEQ ID NO: 171897 - protein, 9 aa, Artificial Sequence
  Description of Artificial Sequence: Synthetic peptide
  Seed: APIGHNRQY (TYRP1_HUMAN)
AVIGHNRQL

SEQ ID NO: 171898 - protein, 9 aa, Artificial Sequence
  Description of Artificial Sequence: Synthetic peptide
  Seed: LQNPNQSVV (TYRP1_HUMAN)
LHNPNQSVM

SEQ ID NO: 171899 - protein, 10 aa, Artificial Sequence
  Description of Artificial Sequence: Synthetic peptide
  Seed: YNADISTFPL (TYRP1_HUMAN)
YFADISTFPY

SEQ ID NO: 171900 - protein, 10 aa, Artificial Sequence
  Description of Artificial Sequence: Synthetic peptide
  Seed: RRNPAGNVAR (TYRP1_HUMAN)
RYNPAGNVAF

SEQ ID NO: 171901 - protein, 8 aa, Artificial Sequence
  Description of Artificial Sequence: Synthetic peptide
  Seed: HTFTDAVF (TYRP1_HUMAN)
HQFTDAVF

SEQ ID NO: 171902 - protein, 10 aa, Artificial Sequence
  Description of Artificial Sequence: Synthetic peptide
  Seed: LLLVALIFGT (TYRP1_HUMAN)
LYLVALIFGL

SEQ ID NO: 171903 - protein, 9 aa, Artificial Sequence
  Description of Artificial Sequence: Synthetic peptide
  Seed: RTTHPLFVI (TYRP1_HUMAN)
RLTHPLFVF

SEQ ID NO: 171904 - protein, 10 aa, Artificial Sequence
  Description of Artificial Sequence: Synthetic peptide
  Seed: SLHNLAHLFL (TYRP1_HUMAN)
SIHNLAHLFV

SEQ ID NO: 171905 - protein, 9 aa, Artificial Sequence
  Description of Artificial Sequence: Synthetic peptide
  Seed: SMDEANQPL (TYRP1_HUMAN)
SEDEANQPI

SEQ ID NO: 171906 - protein, 9 aa, Artificial Sequence
  Description of Artificial Sequence: Synthetic peptide
  Seed: APIGHNRQY (TYRP1_HUMAN)
ATIGHNRQI

SEQ ID NO: 171907 - protein, 9 aa, Artificial Sequence
  Description of Artificial Sequence: Synthetic peptide
  Seed: MSAPKLLSL (TYRP1_HUMAN)
MIAPKLLSA

SEQ ID NO: 171908 - protein, 10 aa, Artificial Sequence
  Description of Artificial Sequence: Synthetic peptide
  Seed: YNMVPFWPPV (TYRP1_HUMAN)
YWMVPFWPPV

SEQ ID NO: 171909 - protein, 10 aa, Artificial Sequence
  Description of Artificial Sequence: Synthetic peptide
  Seed: YNYFVWTHYY (TYRP1_HUMAN)
YVYFVWTHYW

SEQ ID NO: 171910 - protein, 9 aa, Artificial Sequence
  Description of Artificial Sequence: Synthetic peptide
  Seed: RQCATVEAL (TYRP1_HUMAN)
RRCATVEAM

SEQ ID NO: 171911 - protein, 9 aa, Artificial Sequence
  Description of Artificial Sequence: Synthetic peptide
  Seed: FSHEGPAFL (TYRP1_HUMAN)
FVHEGPAFR

SEQ ID NO: 171912 - protein, 9 aa, Artificial Sequence
  Description of Artificial Sequence: Synthetic peptide
  Seed: TLISPNSVF (TYRP1_HUMAN)
TQISPNSVV

SEQ ID NO: 171913 - protein, 9 aa, Artificial Sequence
  Description of Artificial Sequence: Synthetic peptide
  Seed: IAIAVVGAL (TYRP1_HUMAN)
ITIAVVGAI

SEQ ID NO: 171914 - protein, 10 aa, Artificial Sequence
  Description of Artificial Sequence: Synthetic peptide
  Seed: RSLHNLAHLF (TYRP1_HUMAN)
RILHNLAHLW

SEQ ID NO: 171915 - protein, 9 aa, Artificial Sequence
  Description of Artificial Sequence: Synthetic peptide
  Seed: MSAPKLLSL (TYRP1_HUMAN)
MCAPKLLSW

SEQ ID NO: 171916 - protein, 9 aa, Artificial Sequence
  Description of Artificial Sequence: Synthetic peptide
  Seed: SPNDPIFVL (TYRP1_HUMAN)
SHNDPIFVL

SEQ ID NO: 171917 - protein, 9 aa, Artificial Sequence
  Description of Artificial Sequence: Synthetic peptide
  Seed: YNYFVWTHY (TYRP1_HUMAN)
YWYFVWTHF

SEQ ID NO: 171918 - protein, 9 aa, Artificial Sequence
  Description of Artificial Sequence: Synthetic peptide
  Seed: KYDPAVRSL (TYRP1_HUMAN)
KWDPAVRSF

SEQ ID NO: 171919 - protein, 10 aa, Artificial Sequence
  Description of Artificial Sequence: Synthetic peptide
  Seed: YNMVPFWPPV (TYRP1_HUMAN)
YPMVPFWPPM

SEQ ID NO: 171920 - protein, 9 aa, Artificial Sequence
  Description of Artificial Sequence: Synthetic peptide
  Seed: APIGHNRQY (TYRP1_HUMAN)
AQIGHNRQF

SEQ ID NO: 171921 - protein, 10 aa, Artificial Sequence
  Description of Artificial Sequence: Synthetic peptide
  Seed: RRYNADISTF (TYRP1_HUMAN)
RPYNADISTL

SEQ ID NO: 171922 - protein, 9 aa, Artificial Sequence
  Description of Artificial Sequence: Synthetic peptide
  Seed: HEGPAFLTW (TYRP1_HUMAN)
HHGPAFLTV

SEQ ID NO: 171923 - protein, 10 aa, Artificial Sequence
  Description of Artificial Sequence: Synthetic peptide
  Seed: SIYNYFVWTH (TYRP1_HUMAN)
SCYNYFVWTK

SEQ ID NO: 171924 - protein, 9 aa, Artificial Sequence
  Description of Artificial Sequence: Synthetic peptide
  Seed: MLQEPSFSL (TYRP1_HUMAN)
MIQEPSFSY

SEQ ID NO: 171925 - protein, 9 aa, Artificial Sequence
  Description of Artificial Sequence: Synthetic peptide
  Seed: MLQEPSFSL (TYRP1_HUMAN)
MAQEPSFSL

SEQ ID NO: 171926 - protein, 10 aa, Artificial Sequence
  Description of Artificial Sequence: Synthetic peptide
  Seed: EEKNHFVRAL (TYRP1_HUMAN)
EEKNHFVRAY

SEQ ID NO: 171927 - protein, 9 aa, Artificial Sequence
  Description of Artificial Sequence: Synthetic peptide
  Seed: DLMGSRSNF (TYRP1_HUMAN)
DVMGSRSNY

SEQ ID NO: 171928 - protein, 10 aa, Artificial Sequence
  Description of Artificial Sequence: Synthetic peptide
  Seed: VALIFGTASY (TYRP1_HUMAN)
VQLIFGTASY

SEQ ID NO: 171929 - protein, 11 aa, Artificial Sequence
  Description of Artificial Sequence: Synthetic peptide
  Seed: AGNVARPMVQR (TYRP1_HUMAN)
ACNVARPMVQK

SEQ ID NO: 171930 - protein, 10 aa, Artificial Sequence
  Description of Artificial Sequence: Synthetic peptide
  Seed: LSPNDPIFVL (TYRP1_HUMAN)
LQPNDPIFVM

SEQ ID NO: 171931 - protein, 10 aa, Artificial Sequence
  Description of Artificial Sequence: Synthetic peptide
  Seed: FYSNSTNSFR (TYRP1_HUMAN)
FPSNSTNSFK

SEQ ID NO: 171932 - protein, 10 aa, Artificial Sequence
  Description of Artificial Sequence: Synthetic peptide
  Seed: SIYNYFVWTH (TYRP1_HUMAN)
SLYNYFVWTR

SEQ ID NO: 171933 - protein, 8 aa, Artificial Sequence
  Description of Artificial Sequence: Synthetic peptide
  Seed: REFSVPEI (TYRP1_HUMAN)
RQFSVPEI

SEQ ID NO: 171934 - protein, 10 aa, Artificial Sequence
  Description of Artificial Sequence: Synthetic peptide
  Seed: RSMDEANQPL (TYRP1_HUMAN)
RGMDEANQPY

SEQ ID NO: 171935 - protein, 11 aa, Artificial Sequence
  Description of Artificial Sequence: Synthetic peptide
  Seed: RRNPAGNVARP (TYRP1_HUMAN)
RRNPAGNVARL

SEQ ID NO: 171936 - protein, 10 aa, Artificial Sequence
  Description of Artificial Sequence: Synthetic peptide
  Seed: LSPNDPIFVL (TYRP1_HUMAN)
LAPNDPIFVM

SEQ ID NO: 171937 - protein, 11 aa, Artificial Sequence
  Description of Artificial Sequence: Synthetic peptide
  Seed: YNMVPFWPPVT (TYRP1_HUMAN)
YLMVPFWPPVN

SEQ ID NO: 171938 - protein, 9 aa, Artificial Sequence
  Description of Artificial Sequence: Synthetic peptide
  Seed: ALLLVALIF (TYRP1_HUMAN)
AQLLVALII

SEQ ID NO: 171939 - protein, 9 aa, Artificial Sequence
  Description of Artificial Sequence: Synthetic peptide
  Seed: FSVPEIIAI (TYRP1_HUMAN)
FGVPEIIAM

SEQ ID NO: 171940 - protein, 10 aa, Artificial Sequence
  Description of Artificial Sequence: Synthetic peptide
  Seed: DAVFDEWLRR (TYRP1_HUMAN)
DSVFDEWLRR

SEQ ID NO: 171941 - protein, 8 aa, Artificial Sequence
  Description of Artificial Sequence: Synthetic peptide
  Seed: FPLENAPI (TYRP1_HUMAN)
FPLENAPL

SEQ ID NO: 171942 - protein, 9 aa, Artificial Sequence
  Description of Artificial Sequence: Synthetic peptide
  Seed: HLSPNDPIF (TYRP1_HUMAN)
HQSPNDPIL

SEQ ID NO: 171943 - protein, 10 aa, Artificial Sequence
  Description of Artificial Sequence: Synthetic peptide
  Seed: TPQFENISIY (TYRP1_HUMAN)
TYQFENISIY

SEQ ID NO: 171944 - protein, 9 aa, Artificial Sequence
  Description of Artificial Sequence: Synthetic peptide
  Seed: SPVSGPGTD (TYRP1_HUMAN)
SPVSGPGTV

SEQ ID NO: 171945 - protein, 10 aa, Artificial Sequence
  Description of Artificial Sequence: Synthetic peptide
  Seed: SMDEANQPLL (TYRP1_HUMAN)
SVDEANQPLF

SEQ ID NO: 171946 - protein, 9 aa, Artificial Sequence
  Description of Artificial Sequence: Synthetic peptide
  Seed: FYSNSTNSF (TYRP1_HUMAN)
FMSNSTNSL

SEQ ID NO: 171947 - protein, 9 aa, Artificial Sequence
  Description of Artificial Sequence: Synthetic peptide
  Seed: SFRNTVEGY (TYRP1_HUMAN)
SIRNTVEGF

SEQ ID NO: 171948 - protein, 10 aa, Artificial Sequence
  Description of Artificial Sequence: Synthetic peptide
  Seed: HRYHLLRLEK (TYRP1_HUMAN)
HTYHLLRLER

SEQ ID NO: 171949 - protein, 11 aa, Artificial Sequence
  Description of Artificial Sequence: Synthetic peptide
  Seed: NYFVWTHYYSV (TYRP1_HUMAN)
NMFVWTHYYSA

SEQ ID NO: 171950 - protein, 9 aa, Artificial Sequence
  Description of Artificial Sequence: Synthetic peptide
  Seed: FLGVGQESF (TYRP1_HUMAN)
FFGVGQESF

SEQ ID NO: 171951 - protein, 10 aa, Artificial Sequence
  Description of Artificial Sequence: Synthetic peptide
  Seed: EVWPLRFFNR (TYRP1_HUMAN)
ETWPLRFFNR

SEQ ID NO: 171952 - protein, 10 aa, Artificial Sequence
  Description of Artificial Sequence: Synthetic peptide
  Seed: VALIFGTASY (TYRP1_HUMAN)
VKLIFGTASM

SEQ ID NO: 171953 - protein, 10 aa, Artificial Sequence
  Description of Artificial Sequence: Synthetic peptide
  Seed: RTTHPLFVIA (TYRP1_HUMAN)
RGTHPLFVIA

SEQ ID NO: 171954 - protein, 10 aa, Artificial Sequence
  Description of Artificial Sequence: Synthetic peptide
  Seed: FVWTHYYSVK (TYRP1_HUMAN)
FMWTHYYSVS

SEQ ID NO: 171955 - protein, 9 aa, Artificial Sequence
  Description of Artificial Sequence: Synthetic peptide
  Seed: SPNDPIFVL (TYRP1_HUMAN)
STNDPIFVY

SEQ ID NO: 171956 - protein, 9 aa, Artificial Sequence
  Description of Artificial Sequence: Synthetic peptide
  Seed: HEGPAFLTW (TYRP1_HUMAN)
HAGPAFLTV

SEQ ID NO: 171957 - protein, 11 aa, Artificial Sequence
  Description of Artificial Sequence: Synthetic peptide
  Seed: REFSVPEIIAI (TYRP1_HUMAN)
RIFSVPEIIAY

SEQ ID NO: 171958 - protein, 9 aa, Artificial Sequence
  Description of Artificial Sequence: Synthetic peptide
  Seed: KLLSLGCIF (TYRP1_HUMAN)
KYLSLGCIL

SEQ ID NO: 171959 - protein, 11 aa, Artificial Sequence
  Description of Artificial Sequence: Synthetic peptide
  Seed: YNMVPFWPPVT (TYRP1_HUMAN)
YIMVPFWPPVM

SEQ ID NO: 171960 - protein, 10 aa, Artificial Sequence
  Description of Artificial Sequence: Synthetic peptide
  Seed: FWPPVTNTEM (TYRP1_HUMAN)
FEPPVTNTEY

SEQ ID NO: 171961 - protein, 9 aa, Artificial Sequence
  Description of Artificial Sequence: Synthetic peptide
  Seed: IAVVGALLL (TYRP1_HUMAN)
IAVVGALLM

SEQ ID NO: 171962 - protein, 9 aa, Artificial Sequence
  Description of Artificial Sequence: Synthetic peptide
  Seed: LTWHRYHLL (TYRP1_HUMAN)
LLWHRYHLF

SEQ ID NO: 171963 - protein, 10 aa, Artificial Sequence
  Description of Artificial Sequence: Synthetic peptide
  Seed: ATVEALRSGM (TYRP1_HUMAN)
AQVEALRSGL

SEQ ID NO: 171964 - protein, 10 aa, Artificial Sequence
  Description of Artificial Sequence: Synthetic peptide
  Seed: RSLHNLAHLF (TYRP1_HUMAN)
RFLHNLAHLL

SEQ ID NO: 171965 - protein, 11 aa, Artificial Sequence
  Description of Artificial Sequence: Synthetic peptide
  Seed: LFQQARAQFPR (TYRP1_HUMAN)
LMQQARAQFPR

SEQ ID NO: 171966 - protein, 11 aa, Artificial Sequence
  Description of Artificial Sequence: Synthetic peptide
  Seed: MLQEPSFSLPY (TYRP1_HUMAN)
MFQEPSFSLPY

SEQ ID NO: 171967 - protein, 9 aa, Artificial Sequence
  Description of Artificial Sequence: Synthetic peptide
  Seed: WPPVTNTEM (TYRP1_HUMAN)
WVPVTNTEY

SEQ ID NO: 171968 - protein, 11 aa, Artificial Sequence
  Description of Artificial Sequence: Synthetic peptide
  Seed: YNMVPFWPPVT (TYRP1_HUMAN)
YQMVPFWPPVI

SEQ ID NO: 171969 - protein, 11 aa, Artificial Sequence
  Description of Artificial Sequence: Synthetic peptide
  Seed: YNMVPFWPPVT (TYRP1_HUMAN)
YIMVPFWPPVN

SEQ ID NO: 171970 - protein, 10 aa, Artificial Sequence
  Description of Artificial Sequence: Synthetic peptide
  Seed: YNMVPFWPPV (TYRP1_HUMAN)
YGMVPFWPPA

SEQ ID NO: 171971 - protein, 9 aa, Artificial Sequence
  Description of Artificial Sequence: Synthetic peptide
  Seed: AVFDEWLRR (TYRP1_HUMAN)
AMFDEWLRY

SEQ ID NO: 171972 - protein, 10 aa, Artificial Sequence
  Description of Artificial Sequence: Synthetic peptide
  Seed: FFPLLLFQQA (TYRP1_HUMAN)
FVPLLLFQQA

SEQ ID NO: 171973 - protein, 8 aa, Artificial Sequence
  Description of Artificial Sequence: Synthetic peptide
  Seed: IQWPSREF (TYRP1_HUMAN)
ITWPSREL

SEQ ID NO: 171974 - protein, 10 aa, Artificial Sequence
  Description of Artificial Sequence: Synthetic peptide
  Seed: FQQARAQFPR (TYRP1_HUMAN)
FYQARAQFPK

SEQ ID NO: 171975 - protein, 10 aa, Artificial Sequence
  Description of Artificial Sequence: Synthetic peptide
  Seed: NISIYNYFVW (TYRP1_HUMAN)
NVSIYNYFVW

SEQ ID NO: 171976 - protein, 9 aa, Artificial Sequence
  Description of Artificial Sequence: Synthetic peptide
  Seed: RSLHNLAHL (TYRP1_HUMAN)
RMLHNLAHA

SEQ ID NO: 171977 - protein, 11 aa, Artificial Sequence
  Description of Artificial Sequence: Synthetic peptide
  Seed: RLPEPQDVAQC (TYRP1_HUMAN)
RQPEPQDVAQI

SEQ ID NO: 171978 - protein, 9 aa, Artificial Sequence
  Description of Artificial Sequence: Synthetic peptide
  Seed: FLGVGQESF (TYRP1_HUMAN)
FQGVGQESY

SEQ ID NO: 171979 - protein, 10 aa, Artificial Sequence
  Description of Artificial Sequence: Synthetic peptide
  Seed: TAPDNLGYTY (TYRP1_HUMAN)
TMPDNLGYTY

SEQ ID NO: 171980 - protein, 10 aa, Artificial Sequence
  Description of Artificial Sequence: Synthetic peptide
  Seed: FSLPYWNFAT (TYRP1_HUMAN)
FCLPYWNFAL

SEQ ID NO: 171981 - protein, 9 aa, Artificial Sequence
  Description of Artificial Sequence: Synthetic peptide
  Seed: NADISTFPL (TYRP1_HUMAN)
NPDISTFPF

SEQ ID NO: 171982 - protein, 9 aa, Artificial Sequence
  Description of Artificial Sequence: Synthetic peptide
  Seed: STNSFRNTV (TYRP1_HUMAN)
SANSFRNTI

SEQ ID NO: 171983 - protein, 10 aa, Artificial Sequence
  Description of Artificial Sequence: Synthetic peptide
  Seed: HYYSVKKTFL (TYRP1_HUMAN)
HYYSVKKTFF

SEQ ID NO: 171984 - protein, 9 aa, Artificial Sequence
  Description of Artificial Sequence: Synthetic peptide
  Seed: NYFVWTHYY (TYRP1_HUMAN)
NFFVWTHYF

SEQ ID NO: 171985 - protein, 9 aa, Artificial Sequence
  Description of Artificial Sequence: Synthetic peptide
  Seed: REFSVPEII (TYRP1_HUMAN)
RLFSVPEII

SEQ ID NO: 171986 - protein, 9 aa, Artificial Sequence
  Description of Artificial Sequence: Synthetic peptide
  Seed: MLQEPSFSL (TYRP1_HUMAN)
MLQEPSFSI

SEQ ID NO: 171987 - protein, 10 aa, Artificial Sequence
  Description of Artificial Sequence: Synthetic peptide
  Seed: GLFDTPPFYS (TYRP1_HUMAN)
GMFDTPPFYC

SEQ ID NO: 171988 - protein, 9 aa, Artificial Sequence
  Description of Artificial Sequence: Synthetic peptide
  Seed: MSAPKLLSL (TYRP1_HUMAN)
MLAPKLLSC

SEQ ID NO: 171989 - protein, 9 aa, Artificial Sequence
  Description of Artificial Sequence: Synthetic peptide
  Seed: MAKRTTHPL (TYRP1_HUMAN)
MKKRTTHPM

SEQ ID NO: 171990 - protein, 10 aa, Artificial Sequence
  Description of Artificial Sequence: Synthetic peptide
  Seed: ADSRPHSPQY (TYRP1_HUMAN)
AASRPHSPQK

SEQ ID NO: 171991 - protein, 10 aa, Artificial Sequence
  Description of Artificial Sequence: Synthetic peptide
  Seed: LSPNDPIFVL (TYRP1_HUMAN)
LSPNDPIFVM

SEQ ID NO: 171992 - protein, 9 aa, Artificial Sequence
  Description of Artificial Sequence: Synthetic peptide
  Seed: SVPEIIAIA (TYRP1_HUMAN)
SQPEIIAIL

SEQ ID NO: 171993 - protein, 10 aa, Artificial Sequence
  Description of Artificial Sequence: Synthetic peptide
  Seed: FVWTHYYSVK (TYRP1_HUMAN)
FLWTHYYSVP

SEQ ID NO: 171994 - protein, 9 aa, Artificial Sequence
  Description of Artificial Sequence: Synthetic peptide
  Seed: YTYEIQWPS (TYRP1_HUMAN)
YEYEIQWPV

SEQ ID NO: 171995 - protein, 10 aa, Artificial Sequence
  Description of Artificial Sequence: Synthetic peptide
  Seed: VGLFDTPPFY (TYRP1_HUMAN)
VQLFDTPPFK

SEQ ID NO: 171996 - protein, 9 aa, Artificial Sequence
  Description of Artificial Sequence: Synthetic peptide
  Seed: FLGVGQESF (TYRP1_HUMAN)
FMGVGQESV

SEQ ID NO: 171997 - protein, 8 aa, Artificial Sequence
  Description of Artificial Sequence: Synthetic peptide
  Seed: LIRARRSM (TYRP1_HUMAN)
LVRARRSL

SEQ ID NO: 171998 - protein, 11 aa, Artificial Sequence
  Description of Artificial Sequence: Synthetic peptide
  Seed: QEMLQEPSFSL (TYRP1_HUMAN)
QFMLQEPSFSI

SEQ ID NO: 171999 - protein, 9 aa, Artificial Sequence
  Description of Artificial Sequence: Synthetic peptide
  Seed: LIFGTASYL (TYRP1_HUMAN)
LMFGTASYK

SEQ ID NO: 172000 - protein, 10 aa, Artificial Sequence
  Description of Artificial Sequence: Synthetic peptide
  Seed: YNYFVWTHYY (TYRP1_HUMAN)
YDYFVWTHYV

SEQ ID NO: 172001 - protein, 9 aa, Artificial Sequence
  Description of Artificial Sequence: Synthetic peptide
  Seed: RTTHPLFVI (TYRP1_HUMAN)
RVTHPLFVW

SEQ ID NO: 172002 - protein, 9 aa, Artificial Sequence
  Description of Artificial Sequence: Synthetic peptide
  Seed: FSVPEIIAI (TYRP1_HUMAN)
FPVPEIIAW

SEQ ID NO: 172003 - protein, 10 aa, Artificial Sequence
  Description of Artificial Sequence: Synthetic peptide
  Seed: FQQARAQFPR (TYRP1_HUMAN)
FFQARAQFPR

SEQ ID NO: 172004 - protein, 9 aa, Artificial Sequence
  Description of Artificial Sequence: Synthetic peptide
  Seed: FVWTHYYSV (TYRP1_HUMAN)
FTWTHYYSA

SEQ ID NO: 172005 - protein, 9 aa, Artificial Sequence
  Description of Artificial Sequence: Synthetic peptide
  Seed: IAIAVVGAL (TYRP1_HUMAN)
IAIAVVGAY

SEQ ID NO: 172006 - protein, 9 aa, Artificial Sequence
  Description of Artificial Sequence: Synthetic peptide
  Seed: HYYSVKKTF (TYRP1_HUMAN)
HGYSVKKTY

SEQ ID NO: 172007 - protein, 9 aa, Artificial Sequence
  Description of Artificial Sequence: Synthetic peptide
  Seed: FLTWHRYHL (TYRP1_HUMAN)
FMTWHRYHF

SEQ ID NO: 172008 - protein, 9 aa, Artificial Sequence
  Description of Artificial Sequence: Synthetic peptide
  Seed: TADSRPHSP (TYRP1_HUMAN)
TNDSRPHSF

SEQ ID NO: 172009 - protein, 9 aa, Artificial Sequence
  Description of Artificial Sequence: Synthetic peptide
  Seed: RYHLLRLEK (TYRP1_HUMAN)
RNHLLRLEK

SEQ ID NO: 172010 - protein, 9 aa, Artificial Sequence
  Description of Artificial Sequence: Synthetic peptide
  Seed: FSLPYWNFA (TYRP1_HUMAN)
FVLPYWNFV

SEQ ID NO: 172011 - protein, 9 aa, Artificial Sequence
  Description of Artificial Sequence: Synthetic peptide
  Seed: WTHYYSVKK (TYRP1_HUMAN)
WVHYYSVKK

SEQ ID NO: 172012 - protein, 11 aa, Artificial Sequence
  Description of Artificial Sequence: Synthetic peptide
  Seed: VTAPDNLGYTY (TYRP1_HUMAN)
VNAPDNLGYTW

SEQ ID NO: 172013 - protein, 9 aa, Artificial Sequence
  Description of Artificial Sequence: Synthetic peptide
  Seed: KYDPAVRSL (TYRP1_HUMAN)
KRDPAVRSV

SEQ ID NO: 172014 - protein, 9 aa, Artificial Sequence
  Description of Artificial Sequence: Synthetic peptide
  Seed: FSHEGPAFL (TYRP1_HUMAN)
FVHEGPAFL

SEQ ID NO: 172015 - protein, 9 aa, Artificial Sequence
  Description of Artificial Sequence: Synthetic peptide
  Seed: RFFNRTCHC (TYRP1_HUMAN)
RIFNRTCHL

SEQ ID NO: 172016 - protein, 10 aa, Artificial Sequence
  Description of Artificial Sequence: Synthetic peptide
  Seed: YFVWTHYYSV (TYRP1_HUMAN)
YFVWTHYYSW

SEQ ID NO: 172017 - protein, 10 aa, Artificial Sequence
  Description of Artificial Sequence: Synthetic peptide
  Seed: TDAVFDEWLR (TYRP1_HUMAN)
TQAVFDEWLR

SEQ ID NO: 172018 - protein, 9 aa, Artificial Sequence
  Description of Artificial Sequence: Synthetic peptide
  Seed: RQCATVEAL (TYRP1_HUMAN)
RVCATVEAL

SEQ ID NO: 172019 - protein, 11 aa, Artificial Sequence
  Description of Artificial Sequence: Synthetic peptide
  Seed: FSHEGPAFLTW (TYRP1_HUMAN)
FPHEGPAFLTF

SEQ ID NO: 172020 - protein, 9 aa, Artificial Sequence
  Description of Artificial Sequence: Synthetic peptide
  Seed: SMDEANQPL (TYRP1_HUMAN)
SHDEANQPI

SEQ ID NO: 172021 - protein, 10 aa, Artificial Sequence
  Description of Artificial Sequence: Synthetic peptide
  Seed: RRYNADISTF (TYRP1_HUMAN)
RKYNADISTY

SEQ ID NO: 172022 - protein, 9 aa, Artificial Sequence
  Description of Artificial Sequence: Synthetic peptide
  Seed: KLLSLGCIF (TYRP1_HUMAN)
KQLSLGCIM

SEQ ID NO: 172023 - protein, 9 aa, Artificial Sequence
  Description of Artificial Sequence: Synthetic peptide
  Seed: MLQEPSFSL (TYRP1_HUMAN)
MVQEPSFSI

SEQ ID NO: 172024 - protein, 10 aa, Artificial Sequence
  Description of Artificial Sequence: Synthetic peptide
  Seed: STLISPNSVF (TYRP1_HUMAN)
SALISPNSVY

SEQ ID NO: 172025 - protein, 10 aa, Artificial Sequence
  Description of Artificial Sequence: Synthetic peptide
  Seed: GEVDFSHEGP (TYRP1_HUMAN)
GEVDFSHEGF

SEQ ID NO: 172026 - protein, 9 aa, Artificial Sequence
  Description of Artificial Sequence: Synthetic peptide
  Seed: KYDPAVRSL (TYRP1_HUMAN)
KNDPAVRSM

SEQ ID NO: 172027 - protein, 9 aa, Artificial Sequence
  Description of Artificial Sequence: Synthetic peptide
  Seed: SMDEANQPL (TYRP1_HUMAN)
SWDEANQPI

SEQ ID NO: 172028 - protein, 9 aa, Artificial Sequence
  Description of Artificial Sequence: Synthetic peptide
  Seed: SLHNLAHLF (TYRP1_HUMAN)
STHNLAHLY

SEQ ID NO: 172029 - protein, 10 aa, Artificial Sequence
  Description of Artificial Sequence: Synthetic peptide
  Seed: GTASYLIRAR (TYRP1_HUMAN)
GAASYLIRAK

SEQ ID NO: 172030 - protein, 11 aa, Artificial Sequence
  Description of Artificial Sequence: Synthetic peptide
  Seed: SLPYWNFATGK (TYRP1_HUMAN)
SLPYWNFATGR

SEQ ID NO: 172031 - protein, 10 aa, Artificial Sequence
  Description of Artificial Sequence: Synthetic peptide
  Seed: YNADISTFPL (TYRP1_HUMAN)
YLADISTFPC

SEQ ID NO: 172032 - protein, 9 aa, Artificial Sequence
  Description of Artificial Sequence: Synthetic peptide
  Seed: FENISIYNY (TYRP1_HUMAN)
FKNISIYNM

SEQ ID NO: 172033 - protein, 11 aa, Artificial Sequence
  Description of Artificial Sequence: Synthetic peptide
  Seed: REVWPLRFFNR (TYRP1_HUMAN)
RFVWPLRFFNR

SEQ ID NO: 172034 - protein, 10 aa, Artificial Sequence
  Description of Artificial Sequence: Synthetic peptide
  Seed: YNADISTFPL (TYRP1_HUMAN)
YLADISTFPS

SEQ ID NO: 172035 - protein, 9 aa, Artificial Sequence
  Description of Artificial Sequence: Synthetic peptide
  Seed: NADISTFPL (TYRP1_HUMAN)
NVDISTFPL

SEQ ID NO: 172036 - protein, 10 aa, Artificial Sequence
  Description of Artificial Sequence: Synthetic peptide
  Seed: TAPDNLGYTY (TYRP1_HUMAN)
TFPDNLGYTY

SEQ ID NO: 172037 - protein, 9 aa, Artificial Sequence
  Description of Artificial Sequence: Synthetic peptide
  Seed: AACDQRVLI (TYRP1_HUMAN)
AICDQRVLV

SEQ ID NO: 172038 - protein, 9 aa, Artificial Sequence
  Description of Artificial Sequence: Synthetic peptide
  Seed: FTDAVFDEW (TYRP1_HUMAN)
FMDAVFDEF

SEQ ID NO: 172039 - protein, 9 aa, Artificial Sequence
  Description of Artificial Sequence: Synthetic peptide
  Seed: GLFDTPPFY (TYRP1_HUMAN)
GIFDTPPFM

SEQ ID NO: 172040 - protein, 8 aa, Artificial Sequence
  Description of Artificial Sequence: Synthetic peptide
  Seed: YNADISTF (TYRP1_HUMAN)
YWADISTF

SEQ ID NO: 172041 - protein, 9 aa, Artificial Sequence
  Description of Artificial Sequence: Synthetic peptide
  Seed: HLSPNDPIF (TYRP1_HUMAN)
HMSPNDPIL

SEQ ID NO: 172042 - protein, 9 aa, Artificial Sequence
  Description of Artificial Sequence: Synthetic peptide
  Seed: KLLSLGCIF (TYRP1_HUMAN)
KELSLGCIM

SEQ ID NO: 172043 - protein, 9 aa, Artificial Sequence
  Description of Artificial Sequence: Synthetic peptide
  Seed: YTYEIQWPS (TYRP1_HUMAN)
YQYEIQWPY

SEQ ID NO: 172044 - protein, 8 aa, Artificial Sequence
  Description of Artificial Sequence: Synthetic peptide
  Seed: LISPNSVF (TYRP1_HUMAN)
LASPNSVL

SEQ ID NO: 172045 - protein, 10 aa, Artificial Sequence
  Description of Artificial Sequence: Synthetic peptide
  Seed: ADSRPHSPQY (TYRP1_HUMAN)
ASSRPHSPQW

SEQ ID NO: 172046 - protein, 10 aa, Artificial Sequence
  Description of Artificial Sequence: Synthetic peptide
  Seed: VALIFGTASY (TYRP1_HUMAN)
VSLIFGTASF

SEQ ID NO: 172047 - protein, 9 aa, Artificial Sequence
  Description of Artificial Sequence: Synthetic peptide
  Seed: YSNSTNSFR (TYRP1_HUMAN)
YYNSTNSFR

SEQ ID NO: 172048 - protein, 10 aa, Artificial Sequence
  Description of Artificial Sequence: Synthetic peptide
  Seed: LSPNDPIFVL (TYRP1_HUMAN)
LQPNDPIFVW

SEQ ID NO: 172049 - protein, 10 aa, Artificial Sequence
  Description of Artificial Sequence: Synthetic peptide
  Seed: SMDEANQPLL (TYRP1_HUMAN)
SSDEANQPLI

SEQ ID NO: 172050 - protein, 10 aa, Artificial Sequence
  Description of Artificial Sequence: Synthetic peptide
  Seed: KRTTHPLFVI (TYRP1_HUMAN)
KLTTHPLFVY

SEQ ID NO: 172051 - protein, 9 aa, Artificial Sequence
  Description of Artificial Sequence: Synthetic peptide
  Seed: GPDGNTPQF (TYRP1_HUMAN)
GVDGNTPQV

SEQ ID NO: 172052 - protein, 9 aa, Artificial Sequence
  Description of Artificial Sequence: Synthetic peptide
  Seed: SMDEANQPL (TYRP1_HUMAN)
SYDEANQPI

SEQ ID NO: 172053 - protein, 10 aa, Artificial Sequence
  Description of Artificial Sequence: Synthetic peptide
  Seed: KRTTHPLFVI (TYRP1_HUMAN)
KPTTHPLFVF

SEQ ID NO: 172054 - protein, 9 aa, Artificial Sequence
  Description of Artificial Sequence: Synthetic peptide
  Seed: MSAPKLLSL (TYRP1_HUMAN)
MWAPKLLSM

SEQ ID NO: 172055 - protein, 11 aa, Artificial Sequence
  Description of Artificial Sequence: Synthetic peptide
  Seed: MLQEPSFSLPY (TYRP1_HUMAN)
MLQEPSFSLPL

SEQ ID NO: 172056 - protein, 9 aa, Artificial Sequence
  Description of Artificial Sequence: Synthetic peptide
  Seed: YNYFVWTHY (TYRP1_HUMAN)
YLYFVWTHM

SEQ ID NO: 172057 - protein, 10 aa, Artificial Sequence
  Description of Artificial Sequence: Synthetic peptide
  Seed: YNMVPFWPPV (TYRP1_HUMAN)
YSMVPFWPPA

SEQ ID NO: 172058 - protein, 9 aa, Artificial Sequence
  Description of Artificial Sequence: Synthetic peptide
  Seed: ARAQFPRQC (TYRP1_HUMAN)
AAAQFPRQM

SEQ ID NO: 172059 - protein, 9 aa, Artificial Sequence
  Description of Artificial Sequence: Synthetic peptide
  Seed: RLPEPQDVA (TYRP1_HUMAN)
RQPEPQDVV

SEQ ID NO: 172060 - protein, 10 aa, Artificial Sequence
  Description of Artificial Sequence: Synthetic peptide
  Seed: RRYNADISTF (TYRP1_HUMAN)
RKYNADISTI

SEQ ID NO: 172061 - protein, 9 aa, Artificial Sequence
  Description of Artificial Sequence: Synthetic peptide
  Seed: RSLHNLAHL (TYRP1_HUMAN)
RGLHNLAHW

SEQ ID NO: 172062 - protein, 10 aa, Artificial Sequence
  Description of Artificial Sequence: Synthetic peptide
  Seed: FLTWHRYHLL (TYRP1_HUMAN)
FLTWHRYHLV

SEQ ID NO: 172063 - protein, 10 aa, Artificial Sequence
  Description of Artificial Sequence: Synthetic peptide
  Seed: RSLHNLAHLF (TYRP1_HUMAN)
RMLHNLAHLY

SEQ ID NO: 172064 - protein, 9 aa, Artificial Sequence
  Description of Artificial Sequence: Synthetic peptide
  Seed: NFDSTLISP (TYRP1_HUMAN)
NYDSTLISM

SEQ ID NO: 172065 - protein, 9 aa, Artificial Sequence
  Description of Artificial Sequence: Synthetic peptide
  Seed: NMVPFWPPV (TYRP1_HUMAN)
NQVPFWPPV

SEQ ID NO: 172066 - protein, 10 aa, Artificial Sequence
  Description of Artificial Sequence: Synthetic peptide
  Seed: THYYSVKKTF (TYRP1_HUMAN)
TQYYSVKKTY

SEQ ID NO: 172067 - protein, 9 aa, Artificial Sequence
  Description of Artificial Sequence: Synthetic peptide
  Seed: LTWHRYHLL (TYRP1_HUMAN)
LCWHRYHLW

SEQ ID NO: 172068 - protein, 9 aa, Artificial Sequence
  Description of Artificial Sequence: Synthetic peptide
  Seed: HEGPAFLTW (TYRP1_HUMAN)
HHGPAFLTF

SEQ ID NO: 172069 - protein, 9 aa, Artificial Sequence
  Description of Artificial Sequence: Synthetic peptide
  Seed: SFRNTVEGY (TYRP1_HUMAN)
SIRNTVEGY

SEQ ID NO: 172070 - protein, 9 aa, Artificial Sequence
  Description of Artificial Sequence: Synthetic peptide
  Seed: GLFDTPPFY (TYRP1_HUMAN)
GYFDTPPFM

SEQ ID NO: 172071 - protein, 9 aa, Artificial Sequence
  Description of Artificial Sequence: Synthetic peptide
  Seed: SPNDPIFVL (TYRP1_HUMAN)
SRNDPIFVA

SEQ ID NO: 172072 - protein, 10 aa, Artificial Sequence
  Description of Artificial Sequence: Synthetic peptide
  Seed: FVWTHYYSVK (TYRP1_HUMAN)
FMWTHYYSVC

SEQ ID NO: 172073 - protein, 9 aa, Artificial Sequence
  Description of Artificial Sequence: Synthetic peptide
  Seed: AVVGALLLV (TYRP1_HUMAN)
AVVGALLLR

SEQ ID NO: 172074 - protein, 9 aa, Artificial Sequence
  Description of Artificial Sequence: Synthetic peptide
  Seed: SPVSGPGTD (TYRP1_HUMAN)
SPVSGPGTL

SEQ ID NO: 172075 - protein, 9 aa, Artificial Sequence
  Description of Artificial Sequence: Synthetic peptide
  Seed: YTYEIQWPS (TYRP1_HUMAN)
YVYEIQWPV

SEQ ID NO: 172076 - protein, 10 aa, Artificial Sequence
  Description of Artificial Sequence: Synthetic peptide
  Seed: FVWTHYYSVK (TYRP1_HUMAN)
FLWTHYYSVS

SEQ ID NO: 172077 - protein, 9 aa, Artificial Sequence
  Description of Artificial Sequence: Synthetic peptide
  Seed: AQCLEVGLF (TYRP1_HUMAN)
AQCLEVGLY

SEQ ID NO: 172078 - protein, 10 aa, Artificial Sequence
  Description of Artificial Sequence: Synthetic peptide
  Seed: AVFDEWLRRY (TYRP1_HUMAN)
AIFDEWLRRY

SEQ ID NO: 172079 - protein, 10 aa, Artificial Sequence
  Description of Artificial Sequence: Synthetic peptide
  Seed: MVPFWPPVTN (TYRP1_HUMAN)
MEPFWPPVTY

SEQ ID NO: 172080 - protein, 10 aa, Artificial Sequence
  Description of Artificial Sequence: Synthetic peptide
  Seed: FLNGTGGQTH (TYRP1_HUMAN)
FGNGTGGQTF

SEQ ID NO: 172081 - protein, 10 aa, Artificial Sequence
  Description of Artificial Sequence: Synthetic peptide
  Seed: QCYAEEYEKL (TYRP1_HUMAN)
QNYAEEYEKF

SEQ ID NO: 172082 - protein, 10 aa, Artificial Sequence
  Description of Artificial Sequence: Synthetic peptide
  Seed: RSMDEANQPL (TYRP1_HUMAN)
RKMDEANQPL

SEQ ID NO: 172083 - protein, 10 aa, Artificial Sequence
  Description of Artificial Sequence: Synthetic peptide
  Seed: GNVARPMVQR (TYRP1_HUMAN)
GSVARPMVQK

SEQ ID NO: 172084 - protein, 9 aa, Artificial Sequence
  Description of Artificial Sequence: Synthetic peptide
  Seed: NYFVWTHYY (TYRP1_HUMAN)
NTFVWTHYF

SEQ ID NO: 172085 - protein, 9 aa, Artificial Sequence
  Description of Artificial Sequence: Synthetic peptide
  Seed: RYNADISTF (TYRP1_HUMAN)
RMNADISTM

SEQ ID NO: 172086 - protein, 10 aa, Artificial Sequence
  Description of Artificial Sequence: Synthetic peptide
  Seed: AVRSLHNLAH (TYRP1_HUMAN)
AMRSLHNLAK

SEQ ID NO: 172087 - protein, 10 aa, Artificial Sequence
  Description of Artificial Sequence: Synthetic peptide
  Seed: SQWRVVCDSL (TYRP1_HUMAN)
SQWRVVCDSV

SEQ ID NO: 172088 - protein, 9 aa, Artificial Sequence
  Description of Artificial Sequence: Synthetic peptide
  Seed: YLIRARRSM (TYRP1_HUMAN)
YYIRARRSV

SEQ ID NO: 172089 - protein, 9 aa, Artificial Sequence
  Description of Artificial Sequence: Synthetic peptide
  Seed: SFSLPYWNF (TYRP1_HUMAN)
SYSLPYWNV

SEQ ID NO: 172090 - protein, 9 aa, Artificial Sequence
  Description of Artificial Sequence: Synthetic peptide
  Seed: HEGPAFLTW (TYRP1_HUMAN)
HAGPAFLTA

SEQ ID NO: 172091 - protein, 9 aa, Artificial Sequence
  Description of Artificial Sequence: Synthetic peptide
  Seed: SMDEANQPL (TYRP1_HUMAN)
SIDEANQPV

SEQ ID NO: 172092 - protein, 11 aa, Artificial Sequence
  Description of Artificial Sequence: Synthetic peptide
  Seed: FVLLHTFTDAV (TYRP1_HUMAN)
FHLLHTFTDAL

SEQ ID NO: 172093 - protein, 9 aa, Artificial Sequence
  Description of Artificial Sequence: Synthetic peptide
  Seed: FSHEGPAFL (TYRP1_HUMAN)
FFHEGPAFY

SEQ ID NO: 172094 - protein, 10 aa, Artificial Sequence
  Description of Artificial Sequence: Synthetic peptide
  Seed: MAKRTTHPLF (TYRP1_HUMAN)
MHKRTTHPLY

SEQ ID NO: 172095 - protein, 9 aa, Artificial Sequence
  Description of Artificial Sequence: Synthetic peptide
  Seed: TEMFVTAPD (TYRP1_HUMAN)
TEMFVTAPM

SEQ ID NO: 172096 - protein, 9 aa, Artificial Sequence
  Description of Artificial Sequence: Synthetic peptide
  Seed: ENISIYNYF (TYRP1_HUMAN)
EIISIYNYF

SEQ ID NO: 172097 - protein, 9 aa, Artificial Sequence
  Description of Artificial Sequence: Synthetic peptide
  Seed: MAKRTTHPL (TYRP1_HUMAN)
MLKRTTHPA

SEQ ID NO: 172098 - protein, 10 aa, Artificial Sequence
  Description of Artificial Sequence: Synthetic peptide
  Seed: NISIYNYFVW (TYRP1_HUMAN)
NTSIYNYFVW

SEQ ID NO: 172099 - protein, 9 aa, Artificial Sequence
  Description of Artificial Sequence: Synthetic peptide
  Seed: KLQNPNQSV (TYRP1_HUMAN)
KAQNPNQSV

SEQ ID NO: 172100 - protein, 9 aa, Artificial Sequence
  Description of Artificial Sequence: Synthetic peptide
  Seed: STNSFRNTV (TYRP1_HUMAN)
STNSFRNTW

SEQ ID NO: 172101 - protein, 8 aa, Artificial Sequence
  Description of Artificial Sequence: Synthetic peptide
  Seed: SAPKLLSL (TYRP1_HUMAN)
SQPKLLSI

SEQ ID NO: 172102 - protein, 9 aa, Artificial Sequence
  Description of Artificial Sequence: Synthetic peptide
  Seed: NYFVWTHYY (TYRP1_HUMAN)
NPFVWTHYY

SEQ ID NO: 172103 - protein, 10 aa, Artificial Sequence
  Description of Artificial Sequence: Synthetic peptide
  Seed: AVRSLHNLAH (TYRP1_HUMAN)
AVRSLHNLAK

SEQ ID NO: 172104 - protein, 9 aa, Artificial Sequence
  Description of Artificial Sequence: Synthetic peptide
  Seed: RRYNADIST (TYRP1_HUMAN)
RRYNADISV

SEQ ID NO: 172105 - protein, 9 aa, Artificial Sequence
  Description of Artificial Sequence: Synthetic peptide
  Seed: RQCATVEAL (TYRP1_HUMAN)
RLCATVEAF

SEQ ID NO: 172106 - protein, 10 aa, Artificial Sequence
  Description of Artificial Sequence: Synthetic peptide
  Seed: FSVPEIIAIA (TYRP1_HUMAN)
FVVPEIIAIV

SEQ ID NO: 172107 - protein, 9 aa, Artificial Sequence
  Description of Artificial Sequence: Synthetic peptide
  Seed: RLPEPQDVA (TYRP1_HUMAN)
RMPEPQDVV

SEQ ID NO: 172108 - protein, 9 aa, Artificial Sequence
  Description of Artificial Sequence: Synthetic peptide
  Seed: AIAVVGALL (TYRP1_HUMAN)
AMAVVGALY

SEQ ID NO: 172109 - protein, 8 aa, Artificial Sequence
  Description of Artificial Sequence: Synthetic peptide
  Seed: YSNSTNSF (TYRP1_HUMAN)
YQNSTNSY

SEQ ID NO: 172110 - protein, 9 aa, Artificial Sequence
  Description of Artificial Sequence: Synthetic peptide
  Seed: DLMGSRSNF (TYRP1_HUMAN)
DTMGSRSNF

SEQ ID NO: 172111 - protein, 10 aa, Artificial Sequence
  Description of Artificial Sequence: Synthetic peptide
  Seed: IAVVGALLLV (TYRP1_HUMAN)
IWVVGALLLV

SEQ ID NO: 172112 - protein, 10 aa, Artificial Sequence
  Description of Artificial Sequence: Synthetic peptide
  Seed: MSAPKLLSLG (TYRP1_HUMAN)
MGAPKLLSLW

SEQ ID NO: 172113 - protein, 9 aa, Artificial Sequence
  Description of Artificial Sequence: Synthetic peptide
  Seed: YNYFVWTHY (TYRP1_HUMAN)
YMYFVWTHY

SEQ ID NO: 172114 - protein, 10 aa, Artificial Sequence
  Description of Artificial Sequence: Synthetic peptide
  Seed: EGPAFLTWHR (TYRP1_HUMAN)
EAPAFLTWHK

SEQ ID NO: 172115 - protein, 9 aa, Artificial Sequence
  Description of Artificial Sequence: Synthetic peptide
  Seed: AIAVVGALL (TYRP1_HUMAN)
AMAVVGALF

SEQ ID NO: 172116 - protein, 9 aa, Artificial Sequence
  Description of Artificial Sequence: Synthetic peptide
  Seed: AIAVVGALL (TYRP1_HUMAN)
AMAVVGALI

SEQ ID NO: 172117 - protein, 9 aa, Artificial Sequence
  Description of Artificial Sequence: Synthetic peptide
  Seed: RQCATVEAL (TYRP1_HUMAN)
RECATVEAW

SEQ ID NO: 172118 - protein, 9 aa, Artificial Sequence
  Description of Artificial Sequence: Synthetic peptide
  Seed: THPLFVIAT (TYRP1_HUMAN)
TRPLFVIAA

SEQ ID NO: 172119 - protein, 10 aa, Artificial Sequence
  Description of Artificial Sequence: Synthetic peptide
  Seed: LIFGTASYLI (TYRP1_HUMAN)
LWFGTASYLM

SEQ ID NO: 172120 - protein, 9 aa, Artificial Sequence
  Description of Artificial Sequence: Synthetic peptide
  Seed: RAQFPRQCA (TYRP1_HUMAN)
RSQFPRQCK

SEQ ID NO: 172121 - protein, 9 aa, Artificial Sequence
  Description of Artificial Sequence: Synthetic peptide
  Seed: RQCATVEAL (TYRP1_HUMAN)
RHCATVEAA

SEQ ID NO: 172122 - protein, 9 aa, Artificial Sequence
  Description of Artificial Sequence: Synthetic peptide
  Seed: VARPMVQRL (TYRP1_HUMAN)
VLRPMVQRW

SEQ ID NO: 172123 - protein, 9 aa, Artificial Sequence
  Description of Artificial Sequence: Synthetic peptide
  Seed: STNSFRNTV (TYRP1_HUMAN)
STNSFRNTF

SEQ ID NO: 172124 - protein, 10 aa, Artificial Sequence
  Description of Artificial Sequence: Synthetic peptide
  Seed: GKYDPAVRSL (TYRP1_HUMAN)
GAYDPAVRSL

SEQ ID NO: 172125 - protein, 9 aa, Artificial Sequence
  Description of Artificial Sequence: Synthetic peptide
  Seed: LSKEEKNHF (TYRP1_HUMAN)
LMKEEKNHF

SEQ ID NO: 172126 - protein, 9 aa, Artificial Sequence
  Description of Artificial Sequence: Synthetic peptide
  Seed: FSVPEIIAI (TYRP1_HUMAN)
FVVPEIIAA

SEQ ID NO: 172127 - protein, 11 aa, Artificial Sequence
  Description of Artificial Sequence: Synthetic peptide
  Seed: QEMLQEPSFSL (TYRP1_HUMAN)
QTMLQEPSFSV

SEQ ID NO: 172128 - protein, 11 aa, Artificial Sequence
  Description of Artificial Sequence: Synthetic peptide
  Seed: YNYFVWTHYYS (TYRP1_HUMAN)
YFYFVWTHYYY

SEQ ID NO: 172129 - protein, 11 aa, Artificial Sequence
  Description of Artificial Sequence: Synthetic peptide
  Seed: YNMVPFWPPVT (TYRP1_HUMAN)
YLMVPFWPPVR

SEQ ID NO: 172130 - protein, 10 aa, Artificial Sequence
  Description of Artificial Sequence: Synthetic peptide
  Seed: GLFDTPPFYS (TYRP1_HUMAN)
GMFDTPPFYL

SEQ ID NO: 172131 - protein, 9 aa, Artificial Sequence
  Description of Artificial Sequence: Synthetic peptide
  Seed: YLIRARRSM (TYRP1_HUMAN)
YPIRARRSL

SEQ ID NO: 172132 - protein, 10 aa, Artificial Sequence
  Description of Artificial Sequence: Synthetic peptide
  Seed: RSMDEANQPL (TYRP1_HUMAN)
RTMDEANQPY

SEQ ID NO: 172133 - protein, 9 aa, Artificial Sequence
  Description of Artificial Sequence: Synthetic peptide
  Seed: FSVPEIIAI (TYRP1_HUMAN)
FFVPEIIAM

SEQ ID NO: 172134 - protein, 10 aa, Artificial Sequence
  Description of Artificial Sequence: Synthetic peptide
  Seed: MAKRTTHPLF (TYRP1_HUMAN)
MPKRTTHPLQ

SEQ ID NO: 172135 - protein, 9 aa, Artificial Sequence
  Description of Artificial Sequence: Synthetic peptide
  Seed: LVALIFGTA (TYRP1_HUMAN)
LMALIFGTI

SEQ ID NO: 172136 - protein, 9 aa, Artificial Sequence
  Description of Artificial Sequence: Synthetic peptide
  Seed: FYSNSTNSF (TYRP1_HUMAN)
FPSNSTNSM

SEQ ID NO: 172137 - protein, 10 aa, Artificial Sequence
  Description of Artificial Sequence: Synthetic peptide
  Seed: LGPDGNTPQF (TYRP1_HUMAN)
LMPDGNTPQL

SEQ ID NO: 172138 - protein, 9 aa, Artificial Sequence
  Description of Artificial Sequence: Synthetic peptide
  Seed: RQCATVEAL (TYRP1_HUMAN)
RNCATVEAF

SEQ ID NO: 172139 - protein, 10 aa, Artificial Sequence
  Description of Artificial Sequence: Synthetic peptide
  Seed: VALIFGTASY (TYRP1_HUMAN)
VYLIFGTASY

SEQ ID NO: 172140 - protein, 9 aa, Artificial Sequence
  Description of Artificial Sequence: Synthetic peptide
  Seed: FSVPEIIAI (TYRP1_HUMAN)
FQVPEIIAT

SEQ ID NO: 172141 - protein, 9 aa, Artificial Sequence
  Description of Artificial Sequence: Synthetic peptide
  Seed: RAQFPRQCA (TYRP1_HUMAN)
RPQFPRQCV

SEQ ID NO: 172142 - protein, 10 aa, Artificial Sequence
  Description of Artificial Sequence: Synthetic peptide
  Seed: FVLLHTFTDA (TYRP1_HUMAN)
FNLLHTFTDV

SEQ ID NO: 172143 - protein, 10 aa, Artificial Sequence
  Description of Artificial Sequence: Synthetic peptide
  Seed: SVPEIIAIAV (TYRP1_HUMAN)
SMPEIIAIAI

SEQ ID NO: 172144 - protein, 10 aa, Artificial Sequence
  Description of Artificial Sequence: Synthetic peptide
  Seed: VALIFGTASY (TYRP1_HUMAN)
VCLIFGTASY

SEQ ID NO: 172145 - protein, 10 aa, Artificial Sequence
  Description of Artificial Sequence: Synthetic peptide
  Seed: GKYDPAVRSL (TYRP1_HUMAN)
GVYDPAVRSY

SEQ ID NO: 172146 - protein, 9 aa, Artificial Sequence
  Description of Artificial Sequence: Synthetic peptide
  Seed: IFGTASYLI (TYRP1_HUMAN)
IMGTASYLW

SEQ ID NO: 172147 - protein, 9 aa, Artificial Sequence
  Description of Artificial Sequence: Synthetic peptide
  Seed: IAVVGALLL (TYRP1_HUMAN)
IMVVGALLY

SEQ ID NO: 172148 - protein, 9 aa, Artificial Sequence
  Description of Artificial Sequence: Synthetic peptide
  Seed: NYFVWTHYY (TYRP1_HUMAN)
NWFVWTHYI

SEQ ID NO: 172149 - protein, 9 aa, Artificial Sequence
  Description of Artificial Sequence: Synthetic peptide
  Seed: RYHLLRLEK (TYRP1_HUMAN)
RMHLLRLEA

SEQ ID NO: 172150 - protein, 11 aa, Artificial Sequence
  Description of Artificial Sequence: Synthetic peptide
  Seed: TTHPLFVIATR (TYRP1_HUMAN)
TVHPLFVIATR

SEQ ID NO: 172151 - protein, 9 aa, Artificial Sequence
  Description of Artificial Sequence: Synthetic peptide
  Seed: HPLFVIATR (TYRP1_HUMAN)
HILFVIATK

SEQ ID NO: 172152 - protein, 9 aa, Artificial Sequence
  Description of Artificial Sequence: Synthetic peptide
  Seed: SMDEANQPL (TYRP1_HUMAN)
SNDEANQPV

SEQ ID NO: 172153 - protein, 11 aa, Artificial Sequence
  Description of Artificial Sequence: Synthetic peptide
  Seed: MFVTAPDNLGY (TYRP1_HUMAN)
MSVTAPDNLGF

SEQ ID NO: 172154 - protein, 9 aa, Artificial Sequence
  Description of Artificial Sequence: Synthetic peptide
  Seed: ENISIYNYF (TYRP1_HUMAN)
ESISIYNYF

SEQ ID NO: 172155 - protein, 10 aa, Artificial Sequence
  Description of Artificial Sequence: Synthetic peptide
  Seed: THPLFVIATR (TYRP1_HUMAN)
TLPLFVIATR

SEQ ID NO: 172156 - protein, 9 aa, Artificial Sequence
  Description of Artificial Sequence: Synthetic peptide
  Seed: MSAPKLLSL (TYRP1_HUMAN)
MCAPKLLSM

SEQ ID NO: 172157 - protein, 10 aa, Artificial Sequence
  Description of Artificial Sequence: Synthetic peptide
  Seed: WPPVTNTEMF (TYRP1_HUMAN)
WHPVTNTEMY

SEQ ID NO: 172158 - protein, 9 aa, Artificial Sequence
  Description of Artificial Sequence: Synthetic peptide
  Seed: FVRALDMAK (TYRP1_HUMAN)
FSRALDMAK

SEQ ID NO: 172159 - protein, 9 aa, Artificial Sequence
  Description of Artificial Sequence: Synthetic peptide
  Seed: FLNGTGGQT (TYRP1_HUMAN)
FMNGTGGQA

SEQ ID NO: 172160 - protein, 9 aa, Artificial Sequence
  Description of Artificial Sequence: Synthetic peptide
  Seed: RQCATVEAL (TYRP1_HUMAN)
RMCATVEAY

SEQ ID NO: 172161 - protein, 9 aa, Artificial Sequence
  Description of Artificial Sequence: Synthetic peptide
  Seed: ENAPIGHNR (TYRP1_HUMAN)
EWAPIGHNR

SEQ ID NO: 172162 - protein, 10 aa, Artificial Sequence
  Description of Artificial Sequence: Synthetic peptide
  Seed: QFENISIYNY (TYRP1_HUMAN)
QIENISIYNW

SEQ ID NO: 172163 - protein, 11 aa, Artificial Sequence
  Description of Artificial Sequence: Synthetic peptide
  Seed: CNSTEDGPIRR (TYRP1_HUMAN)
CVSTEDGPIRR

SEQ ID NO: 172164 - protein, 8 aa, Artificial Sequence
  Description of Artificial Sequence: Synthetic peptide
  Seed: ALLLVALI (TYRP1_HUMAN)
AQLLVALV

SEQ ID NO: 172165 - protein, 9 aa, Artificial Sequence
  Description of Artificial Sequence: Synthetic peptide
  Seed: MAKRTTHPL (TYRP1_HUMAN)
MSKRTTHPF

SEQ ID NO: 172166 - protein, 10 aa, Artificial Sequence
  Description of Artificial Sequence: Synthetic peptide
  Seed: YNMVPFWPPV (TYRP1_HUMAN)
YLMVPFWPPV

SEQ ID NO: 172167 - protein, 10 aa, Artificial Sequence
  Description of Artificial Sequence: Synthetic peptide
  Seed: ISIYNYFVWT (TYRP1_HUMAN)
ITIYNYFVWY

SEQ ID NO: 172168 - protein, 10 aa, Artificial Sequence
  Description of Artificial Sequence: Synthetic peptide
  Seed: RTTHPLFVIA (TYRP1_HUMAN)
RDTHPLFVIA

SEQ ID NO: 172169 - protein, 9 aa, Artificial Sequence
  Description of Artificial Sequence: Synthetic peptide
  Seed: LEVGLFDTP (TYRP1_HUMAN)
LEVGLFDTI

SEQ ID NO: 172170 - protein, 10 aa, Artificial Sequence
  Description of Artificial Sequence: Synthetic peptide
  Seed: RTTHPLFVIA (TYRP1_HUMAN)
RRTHPLFVIK

SEQ ID NO: 172171 - protein, 10 aa, Artificial Sequence
  Description of Artificial Sequence: Synthetic peptide
  Seed: SIYNYFVWTH (TYRP1_HUMAN)
SLYNYFVWTK

SEQ ID NO: 172172 - protein, 9 aa, Artificial Sequence
  Description of Artificial Sequence: Synthetic peptide
  Seed: GTASYLIRA (TYRP1_HUMAN)
GLASYLIRV

SEQ ID NO: 172173 - protein, 10 aa, Artificial Sequence
  Description of Artificial Sequence: Synthetic peptide
  Seed: SIYNYFVWTH (TYRP1_HUMAN)
SNYNYFVWTR

SEQ ID NO: 172174 - protein, 9 aa, Artificial Sequence
  Description of Artificial Sequence: Synthetic peptide
  Seed: SLPYWNFAT (TYRP1_HUMAN)
SVPYWNFAV

SEQ ID NO: 172175 - protein, 9 aa, Artificial Sequence
  Description of Artificial Sequence: Synthetic peptide
  Seed: VARPMVQRL (TYRP1_HUMAN)
VTRPMVQRW

SEQ ID NO: 172176 - protein, 9 aa, Artificial Sequence
  Description of Artificial Sequence: Synthetic peptide
  Seed: RYHLLRLEK (TYRP1_HUMAN)
RVHLLRLEY

SEQ ID NO: 172177 - protein, 9 aa, Artificial Sequence
  Description of Artificial Sequence: Synthetic peptide
  Seed: REFSVPEII (TYRP1_HUMAN)
RLFSVPEIF

SEQ ID NO: 172178 - protein, 9 aa, Artificial Sequence
  Description of Artificial Sequence: Synthetic peptide
  Seed: EGYSDPTGK (TYRP1_HUMAN)
EFYSDPTGR

SEQ ID NO: 172179 - protein, 9 aa, Artificial Sequence
  Description of Artificial Sequence: Synthetic peptide
  Seed: FSHEGPAFL (TYRP1_HUMAN)
FVHEGPAFY

SEQ ID NO: 172180 - protein, 10 aa, Artificial Sequence
  Description of Artificial Sequence: Synthetic peptide
  Seed: YFVWTHYYSV (TYRP1_HUMAN)
YVVWTHYYSL

SEQ ID NO: 172181 - protein, 10 aa, Artificial Sequence
  Description of Artificial Sequence: Synthetic peptide
  Seed: FSLPYWNFAT (TYRP1_HUMAN)
FCLPYWNFAI

SEQ ID NO: 172182 - protein, 9 aa, Artificial Sequence
  Description of Artificial Sequence: Synthetic peptide
  Seed: RFFNRTCHC (TYRP1_HUMAN)
RMFNRTCHK

SEQ ID NO: 172183 - protein, 9 aa, Artificial Sequence
  Description of Artificial Sequence: Synthetic peptide
  Seed: AQFPRQCAT (TYRP1_HUMAN)
AQFPRQCAV

SEQ ID NO: 172184 - protein, 10 aa, Artificial Sequence
  Description of Artificial Sequence: Synthetic peptide
  Seed: RTTHPLFVIA (TYRP1_HUMAN)
RRTHPLFVIA

SEQ ID NO: 172185 - protein, 9 aa, Artificial Sequence
  Description of Artificial Sequence: Synthetic peptide
  Seed: QCATVEALR (TYRP1_HUMAN)
QIATVEALR

SEQ ID NO: 172186 - protein, 9 aa, Artificial Sequence
  Description of Artificial Sequence: Synthetic peptide
  Seed: GLFDTPPFY (TYRP1_HUMAN)
GMFDTPPFW

SEQ ID NO: 172187 - protein, 10 aa, Artificial Sequence
  Description of Artificial Sequence: Synthetic peptide
  Seed: SPNSVFSQWR (TYRP1_HUMAN)
SMNSVFSQWR

SEQ ID NO: 172188 - protein, 10 aa, Artificial Sequence
  Description of Artificial Sequence: Synthetic peptide
  Seed: MAKRTTHPLF (TYRP1_HUMAN)
MTKRTTHPLF

SEQ ID NO: 172189 - protein, 8 aa, Artificial Sequence
  Description of Artificial Sequence: Synthetic peptide
  Seed: ACDQRVLI (TYRP1_HUMAN)
AIDQRVLI

SEQ ID NO: 172190 - protein, 10 aa, Artificial Sequence
  Description of Artificial Sequence: Synthetic peptide
  Seed: SPNDPIFVLL (TYRP1_HUMAN)
STNDPIFVLI

SEQ ID NO: 172191 - protein, 9 aa, Artificial Sequence
  Description of Artificial Sequence: Synthetic peptide
  Seed: VTAPDNLGY (TYRP1_HUMAN)
VSAPDNLGL

SEQ ID NO: 172192 - protein, 9 aa, Artificial Sequence
  Description of Artificial Sequence: Synthetic peptide
  Seed: LLSLGCIFF (TYRP1_HUMAN)
LSSLGCIFW

SEQ ID NO: 172193 - protein, 9 aa, Artificial Sequence
  Description of Artificial Sequence: Synthetic peptide
  Seed: SPNDPIFVL (TYRP1_HUMAN)
SGNDPIFVF

SEQ ID NO: 172194 - protein, 9 aa, Artificial Sequence
  Description of Artificial Sequence: Synthetic peptide
  Seed: RPMVQRLPE (TYRP1_HUMAN)
RVMVQRLPM

SEQ ID NO: 172195 - protein, 9 aa, Artificial Sequence
  Description of Artificial Sequence: Synthetic peptide
  Seed: VLLHTFTDA (TYRP1_HUMAN)
VTLHTFTDV

SEQ ID NO: 172196 - protein, 9 aa, Artificial Sequence
  Description of Artificial Sequence: Synthetic peptide
  Seed: YLIRARRSM (TYRP1_HUMAN)
YSIRARRSM

SEQ ID NO: 172197 - protein, 9 aa, Artificial Sequence
  Description of Artificial Sequence: Synthetic peptide
  Seed: YLIRARRSM (TYRP1_HUMAN)
YMIRARRSL

SEQ ID NO: 172198 - protein, 10 aa, Artificial Sequence
  Description of Artificial Sequence: Synthetic peptide
  Seed: FVWTHYYSVK (TYRP1_HUMAN)
FMWTHYYSVG

SEQ ID NO: 172199 - protein, 9 aa, Artificial Sequence
  Description of Artificial Sequence: Synthetic peptide
  Seed: MSAPKLLSL (TYRP1_HUMAN)
MTAPKLLSL

SEQ ID NO: 172200 - protein, 9 aa, Artificial Sequence
  Description of Artificial Sequence: Synthetic peptide
  Seed: RQCATVEAL (TYRP1_HUMAN)
RECATVEAA

SEQ ID NO: 172201 - protein, 9 aa, Artificial Sequence
  Description of Artificial Sequence: Synthetic peptide
  Seed: LQNPNQSVV (TYRP1_HUMAN)
LENPNQSVM

SEQ ID NO: 172202 - protein, 9 aa, Artificial Sequence
  Description of Artificial Sequence: Synthetic peptide
  Seed: CIFFPLLLF (TYRP1_HUMAN)
CAFFPLLLF

SEQ ID NO: 172203 - protein, 10 aa, Artificial Sequence
  Description of Artificial Sequence: Synthetic peptide
  Seed: FSLPYWNFAT (TYRP1_HUMAN)
FNLPYWNFAI

SEQ ID NO: 172204 - protein, 10 aa, Artificial Sequence
  Description of Artificial Sequence: Synthetic peptide
  Seed: LTWHRYHLLR (TYRP1_HUMAN)
LHWHRYHLLR

SEQ ID NO: 172205 - protein, 10 aa, Artificial Sequence
  Description of Artificial Sequence: Synthetic peptide
  Seed: EIIAIAVVGA (TYRP1_HUMAN)
ELIAIAVVGI

SEQ ID NO: 172206 - protein, 10 aa, Artificial Sequence
  Description of Artificial Sequence: Synthetic peptide
  Seed: EVWPLRFFNR (TYRP1_HUMAN)
ESWPLRFFNK

SEQ ID NO: 172207 - protein, 9 aa, Artificial Sequence
  Description of Artificial Sequence: Synthetic peptide
  Seed: VGLFDTPPF (TYRP1_HUMAN)
VTLFDTPPY

SEQ ID NO: 172208 - protein, 9 aa, Artificial Sequence
  Description of Artificial Sequence: Synthetic peptide
  Seed: YLIRARRSM (TYRP1_HUMAN)
YYIRARRSI

SEQ ID NO: 172209 - protein, 9 aa, Artificial Sequence
  Description of Artificial Sequence: Synthetic peptide
  Seed: FVWTHYYSV (TYRP1_HUMAN)
FPWTHYYSG

SEQ ID NO: 172210 - protein, 9 aa, Artificial Sequence
  Description of Artificial Sequence: Synthetic peptide
  Seed: RRYNADIST (TYRP1_HUMAN)
RYYNADISM

SEQ ID NO: 172211 - protein, 10 aa, Artificial Sequence
  Description of Artificial Sequence: Synthetic peptide
  Seed: YSVKKTFLGV (TYRP1_HUMAN)
YMVKKTFLGA

SEQ ID NO: 172212 - protein, 9 aa, Artificial Sequence
  Description of Artificial Sequence: Synthetic peptide
  Seed: LLSLGCIFF (TYRP1_HUMAN)
LQSLGCIFF

SEQ ID NO: 172213 - protein, 9 aa, Artificial Sequence
  Description of Artificial Sequence: Synthetic peptide
  Seed: SPNDPIFVL (TYRP1_HUMAN)
SMNDPIFVY

SEQ ID NO: 172214 - protein, 8 aa, Artificial Sequence
  Description of Artificial Sequence: Synthetic peptide
  Seed: YYSVKKTF (TYRP1_HUMAN)
YASVKKTM

SEQ ID NO: 172215 - protein, 9 aa, Artificial Sequence
  Description of Artificial Sequence: Synthetic peptide
  Seed: MSAPKLLSL (TYRP1_HUMAN)
MEAPKLLSF

SEQ ID NO: 172216 - protein, 10 aa, Artificial Sequence
  Description of Artificial Sequence: Synthetic peptide
  Seed: RSMDEANQPL (TYRP1_HUMAN)
RTMDEANQPM

SEQ ID NO: 172217 - protein, 9 aa, Artificial Sequence
  Description of Artificial Sequence: Synthetic peptide
  Seed: ALIFGTASY (TYRP1_HUMAN)
AKIFGTASW

SEQ ID NO: 172218 - protein, 9 aa, Artificial Sequence
  Description of Artificial Sequence: Synthetic peptide
  Seed: RRNPAGNVA (TYRP1_HUMAN)
RQNPAGNVF

SEQ ID NO: 172219 - protein, 9 aa, Artificial Sequence
  Description of Artificial Sequence: Synthetic peptide
  Seed: GYSDPTGKY (TYRP1_HUMAN)
GMSDPTGKF

SEQ ID NO: 172220 - protein, 9 aa, Artificial Sequence
  Description of Artificial Sequence: Synthetic peptide
  Seed: ACDQRVLIV (TYRP1_HUMAN)
AGDQRVLIL

SEQ ID NO: 172221 - protein, 10 aa, Artificial Sequence
  Description of Artificial Sequence: Synthetic peptide
  Seed: LIFGTASYLI (TYRP1_HUMAN)
LTFGTASYLL

SEQ ID NO: 172222 - protein, 10 aa, Artificial Sequence
  Description of Artificial Sequence: Synthetic peptide
  Seed: YFVWTHYYSV (TYRP1_HUMAN)
YMVWTHYYSF

SEQ ID NO: 172223 - protein, 10 aa, Artificial Sequence
  Description of Artificial Sequence: Synthetic peptide
  Seed: KRTTHPLFVI (TYRP1_HUMAN)
KMTTHPLFVF

SEQ ID NO: 172224 - protein, 9 aa, Artificial Sequence
  Description of Artificial Sequence: Synthetic peptide
  Seed: IYNYFVWTH (TYRP1_HUMAN)
IYNYFVWTY

SEQ ID NO: 172225 - protein, 8 aa, Artificial Sequence
  Description of Artificial Sequence: Synthetic peptide
  Seed: RQYNMVPF (TYRP1_HUMAN)
RSYNMVPF

SEQ ID NO: 172226 - protein, 9 aa, Artificial Sequence
  Description of Artificial Sequence: Synthetic peptide
  Seed: YNYFVWTHY (TYRP1_HUMAN)
YQYFVWTHY

SEQ ID NO: 172227 - protein, 9 aa, Artificial Sequence
  Description of Artificial Sequence: Synthetic peptide
  Seed: AVFDEWLRR (TYRP1_HUMAN)
AIFDEWLRY

SEQ ID NO: 172228 - protein, 9 aa, Artificial Sequence
  Description of Artificial Sequence: Synthetic peptide
  Seed: LLVALIFGT (TYRP1_HUMAN)
LQVALIFGT

SEQ ID NO: 172229 - protein, 9 aa, Artificial Sequence
  Description of Artificial Sequence: Synthetic peptide
  Seed: MAKRTTHPL (TYRP1_HUMAN)
MTKRTTHPK

SEQ ID NO: 172230 - protein, 10 aa, Artificial Sequence
  Description of Artificial Sequence: Synthetic peptide
  Seed: SLHNLAHLFL (TYRP1_HUMAN)
SLHNLAHLFV

SEQ ID NO: 172231 - protein, 9 aa, Artificial Sequence
  Description of Artificial Sequence: Synthetic peptide
  Seed: LPYWNFATG (TYRP1_HUMAN)
LPYWNFATY

SEQ ID NO: 172232 - protein, 9 aa, Artificial Sequence
  Description of Artificial Sequence: Synthetic peptide
  Seed: MSAPKLLSL (TYRP1_HUMAN)
MGAPKLLSY

SEQ ID NO: 172233 - protein, 9 aa, Artificial Sequence
  Description of Artificial Sequence: Synthetic peptide
  Seed: NADISTFPL (TYRP1_HUMAN)
NSDISTFPL

SEQ ID NO: 172234 - protein, 11 aa, Artificial Sequence
  Description of Artificial Sequence: Synthetic peptide
  Seed: VLLHTFTDAVF (TYRP1_HUMAN)
VQLHTFTDAVM

SEQ ID NO: 172235 - protein, 9 aa, Artificial Sequence
  Description of Artificial Sequence: Synthetic peptide
  Seed: MSAPKLLSL (TYRP1_HUMAN)
MGAPKLLSR

SEQ ID NO: 172236 - protein, 9 aa, Artificial Sequence
  Description of Artificial Sequence: Synthetic peptide
  Seed: AVFDEWLRR (TYRP1_HUMAN)
AFFDEWLRR

SEQ ID NO: 172237 - protein, 9 aa, Artificial Sequence
  Description of Artificial Sequence: Synthetic peptide
  Seed: RQCATVEAL (TYRP1_HUMAN)
RTCATVEAF

SEQ ID NO: 172238 - protein, 11 aa, Artificial Sequence
  Description of Artificial Sequence: Synthetic peptide
  Seed: VALIFGTASYL (TYRP1_HUMAN)
VLLIFGTASYL

SEQ ID NO: 172239 - protein, 10 aa, Artificial Sequence
  Description of Artificial Sequence: Synthetic peptide
  Seed: RRYNADISTF (TYRP1_HUMAN)
RMYNADISTH

SEQ ID NO: 172240 - protein, 9 aa, Artificial Sequence
  Description of Artificial Sequence: Synthetic peptide
  Seed: SRSNFDSTL (TYRP1_HUMAN)
SVSNFDSTY

SEQ ID NO: 172241 - protein, 9 aa, Artificial Sequence
  Description of Artificial Sequence: Synthetic peptide
  Seed: FTDAVFDEW (TYRP1_HUMAN)
FADAVFDEW

SEQ ID NO: 172242 - protein, 9 aa, Artificial Sequence
  Description of Artificial Sequence: Synthetic peptide
  Seed: SMDEANQPL (TYRP1_HUMAN)
SYDEANQPF

SEQ ID NO: 172243 - protein, 9 aa, Artificial Sequence
  Description of Artificial Sequence: Synthetic peptide
  Seed: NFDSTLISP (TYRP1_HUMAN)
NFDSTLISF

SEQ ID NO: 172244 - protein, 10 aa, Artificial Sequence
  Description of Artificial Sequence: Synthetic peptide
  Seed: ALIFGTASYL (TYRP1_HUMAN)
ATIFGTASYV

SEQ ID NO: 172245 - protein, 9 aa, Artificial Sequence
  Description of Artificial Sequence: Synthetic peptide
  Seed: MSAPKLLSL (TYRP1_HUMAN)
MIAPKLLSR

SEQ ID NO: 172246 - protein, 9 aa, Artificial Sequence
  Description of Artificial Sequence: Synthetic peptide
  Seed: FSVPEIIAI (TYRP1_HUMAN)
FSVPEIIAY

SEQ ID NO: 172247 - protein, 11 aa, Artificial Sequence
  Description of Artificial Sequence: Synthetic peptide
  Seed: MLQEPSFSLPY (TYRP1_HUMAN)
MLQEPSFSLPM

SEQ ID NO: 172248 - protein, 10 aa, Artificial Sequence
  Description of Artificial Sequence: Synthetic peptide
  Seed: SREFSVPEII (TYRP1_HUMAN)
SWEFSVPEIL

SEQ ID NO: 172249 - protein, 9 aa, Artificial Sequence
  Description of Artificial Sequence: Synthetic peptide
  Seed: VTAPDNLGY (TYRP1_HUMAN)
VTAPDNLGF

SEQ ID NO: 172250 - protein, 9 aa, Artificial Sequence
  Description of Artificial Sequence: Synthetic peptide
  Seed: TEMFVTAPD (TYRP1_HUMAN)
TEMFVTAPG

SEQ ID NO: 172251 - protein, 9 aa, Artificial Sequence
  Description of Artificial Sequence: Synthetic peptide
  Seed: DSRPHSPQY (TYRP1_HUMAN)
DARPHSPQY

SEQ ID NO: 172252 - protein, 11 aa, Artificial Sequence
  Description of Artificial Sequence: Synthetic peptide
  Seed: VTAPDNLGYTY (TYRP1_HUMAN)
VVAPDNLGYTF

SEQ ID NO: 172253 - protein, 10 aa, Artificial Sequence
  Description of Artificial Sequence: Synthetic peptide
  Seed: ADSRPHSPQY (TYRP1_HUMAN)
ASSRPHSPQV

SEQ ID NO: 172254 - protein, 10 aa, Artificial Sequence
  Description of Artificial Sequence: Synthetic peptide
  Seed: AVVGALLLVA (TYRP1_HUMAN)
ATVGALLLVV

SEQ ID NO: 172255 - protein, 9 aa, Artificial Sequence
  Description of Artificial Sequence: Synthetic peptide
  Seed: FLTWHRYHL (TYRP1_HUMAN)
FRTWHRYHV

SEQ ID NO: 172256 - protein, 9 aa, Artificial Sequence
  Description of Artificial Sequence: Synthetic peptide
  Seed: LIFGTASYL (TYRP1_HUMAN)
LIFGTASYM

SEQ ID NO: 172257 - protein, 10 aa, Artificial Sequence
  Description of Artificial Sequence: Synthetic peptide
  Seed: STLISPNSVF (TYRP1_HUMAN)
SILISPNSVF

SEQ ID NO: 172258 - protein, 9 aa, Artificial Sequence
  Description of Artificial Sequence: Synthetic peptide
  Seed: MLQEPSFSL (TYRP1_HUMAN)
MVQEPSFSY

SEQ ID NO: 172259 - protein, 9 aa, Artificial Sequence
  Description of Artificial Sequence: Synthetic peptide
  Seed: MLQEPSFSL (TYRP1_HUMAN)
MQQEPSFSR

SEQ ID NO: 172260 - protein, 9 aa, Artificial Sequence
  Description of Artificial Sequence: Synthetic peptide
  Seed: RAQFPRQCA (TYRP1_HUMAN)
RPQFPRQCM

SEQ ID NO: 172261 - protein, 11 aa, Artificial Sequence
  Description of Artificial Sequence: Synthetic peptide
  Seed: LISPNSVFSQW (TYRP1_HUMAN)
LYSPNSVFSQW

SEQ ID NO: 172262 - protein, 9 aa, Artificial Sequence
  Description of Artificial Sequence: Synthetic peptide
  Seed: VGLFDTPPF (TYRP1_HUMAN)
VHLFDTPPY

SEQ ID NO: 172263 - protein, 9 aa, Artificial Sequence
  Description of Artificial Sequence: Synthetic peptide
  Seed: SGRGRCEAV (TYRP1_HUMAN)
SPRGRCEAM

SEQ ID NO: 172264 - protein, 10 aa, Artificial Sequence
  Description of Artificial Sequence: Synthetic peptide
  Seed: RRYNADISTF (TYRP1_HUMAN)
RTYNADISTF

SEQ ID NO: 172265 - protein, 9 aa, Artificial Sequence
  Description of Artificial Sequence: Synthetic peptide
  Seed: RARRSMDEA (TYRP1_HUMAN)
RVRRSMDEG

SEQ ID NO: 172266 - protein, 9 aa, Artificial Sequence
  Description of Artificial Sequence: Synthetic peptide
  Seed: YTYEIQWPS (TYRP1_HUMAN)
YSYEIQWPR

SEQ ID NO: 172267 - protein, 10 aa, Artificial Sequence
  Description of Artificial Sequence: Synthetic peptide
  Seed: RRYNADISTF (TYRP1_HUMAN)
RHYNADISTI

SEQ ID NO: 172268 - protein, 10 aa, Artificial Sequence
  Description of Artificial Sequence: Synthetic peptide
  Seed: ANQPLLTDQY (TYRP1_HUMAN)
ATQPLLTDQY

SEQ ID NO: 172269 - protein, 10 aa, Artificial Sequence
  Description of Artificial Sequence: Synthetic peptide
  Seed: GKYDPAVRSL (TYRP1_HUMAN)
GMYDPAVRSF

SEQ ID NO: 172270 - protein, 9 aa, Artificial Sequence
  Description of Artificial Sequence: Synthetic peptide
  Seed: VPFWPPVTN (TYRP1_HUMAN)
VPFWPPVTM

SEQ ID NO: 172271 - protein, 8 aa, Artificial Sequence
  Description of Artificial Sequence: Synthetic peptide
  Seed: HPLFVIAT (TYRP1_HUMAN)
HPLFVIAA

SEQ ID NO: 172272 - protein, 9 aa, Artificial Sequence
  Description of Artificial Sequence: Synthetic peptide
  Seed: RQYNMVPFW (TYRP1_HUMAN)
RSYNMVPFV

SEQ ID NO: 172273 - protein, 9 aa, Artificial Sequence
  Description of Artificial Sequence: Synthetic peptide
  Seed: DLMGSRSNF (TYRP1_HUMAN)
DTMGSRSNR

SEQ ID NO: 172274 - protein, 11 aa, Artificial Sequence
  Description of Artificial Sequence: Synthetic peptide
  Seed: IYNYFVWTHYY (TYRP1_HUMAN)
IFNYFVWTHYF

SEQ ID NO: 172275 - protein, 9 aa, Artificial Sequence
  Description of Artificial Sequence: Synthetic peptide
  Seed: WPPVTNTEM (TYRP1_HUMAN)
WSPVTNTEL

SEQ ID NO: 172276 - protein, 10 aa, Artificial Sequence
  Description of Artificial Sequence: Synthetic peptide
  Seed: FSLPYWNFAT (TYRP1_HUMAN)
FSLPYWNFAV

SEQ ID NO: 172277 - protein, 10 aa, Artificial Sequence
  Description of Artificial Sequence: Synthetic peptide
  Seed: VVGALLLVAL (TYRP1_HUMAN)
VLGALLLVAV

SEQ ID NO: 172278 - protein, 9 aa, Artificial Sequence
  Description of Artificial Sequence: Synthetic peptide
  Seed: FSHEGPAFL (TYRP1_HUMAN)
FWHEGPAFY

SEQ ID NO: 172279 - protein, 9 aa, Artificial Sequence
  Description of Artificial Sequence: Synthetic peptide
  Seed: APIGHNRQY (TYRP1_HUMAN)
AQIGHNRQM

SEQ ID NO: 172280 - protein, 10 aa, Artificial Sequence
  Description of Artificial Sequence: Synthetic peptide
  Seed: DAVFDEWLRR (TYRP1_HUMAN)
DAVFDEWLRK

SEQ ID NO: 172281 - protein, 9 aa, Artificial Sequence
  Description of Artificial Sequence: Synthetic peptide
  Seed: HLSPNDPIF (TYRP1_HUMAN)
HTSPNDPIF

SEQ ID NO: 172282 - protein, 10 aa, Artificial Sequence
  Description of Artificial Sequence: Synthetic peptide
  Seed: FFPLLLFQQA (TYRP1_HUMAN)
FCPLLLFQQA

SEQ ID NO: 172283 - protein, 8 aa, Artificial Sequence
  Description of Artificial Sequence: Synthetic peptide
  Seed: LIRARRSM (TYRP1_HUMAN)
LMRARRSI

SEQ ID NO: 172284 - protein, 10 aa, Artificial Sequence
  Description of Artificial Sequence: Synthetic peptide
  Seed: DAVFDEWLRR (TYRP1_HUMAN)
DTVFDEWLRR

SEQ ID NO: 172285 - protein, 10 aa, Artificial Sequence
  Description of Artificial Sequence: Synthetic peptide
  Seed: RRYNADISTF (TYRP1_HUMAN)
RFYNADISTL

SEQ ID NO: 172286 - protein, 9 aa, Artificial Sequence
  Description of Artificial Sequence: Synthetic peptide
  Seed: VFDEWLRRY (TYRP1_HUMAN)
VQDEWLRRY

SEQ ID NO: 172287 - protein, 9 aa, Artificial Sequence
  Description of Artificial Sequence: Synthetic peptide
  Seed: CTDDLMGSR (TYRP1_HUMAN)
CLDDLMGSY

SEQ ID NO: 172288 - protein, 9 aa, Artificial Sequence
  Description of Artificial Sequence: Synthetic peptide
  Seed: FSVPEIIAI (TYRP1_HUMAN)
FFVPEIIAI

SEQ ID NO: 172289 - protein, 10 aa, Artificial Sequence
  Description of Artificial Sequence: Synthetic peptide
  Seed: AQFPRQCATV (TYRP1_HUMAN)
AQFPRQCATI

SEQ ID NO: 172290 - protein, 10 aa, Artificial Sequence
  Description of Artificial Sequence: Synthetic peptide
  Seed: FVTAPDNLGY (TYRP1_HUMAN)
FPTAPDNLGY

SEQ ID NO: 172291 - protein, 10 aa, Artificial Sequence
  Description of Artificial Sequence: Synthetic peptide
  Seed: LQEPSFSLPY (TYRP1_HUMAN)
LLEPSFSLPF

SEQ ID NO: 172292 - protein, 9 aa, Artificial Sequence
  Description of Artificial Sequence: Synthetic peptide
  Seed: DNLGYTYEI (TYRP1_HUMAN)
DTLGYTYEM

SEQ ID NO: 172293 - protein, 9 aa, Artificial Sequence
  Description of Artificial Sequence: Synthetic peptide
  Seed: TFPLENAPI (TYRP1_HUMAN)
TYPLENAPW

SEQ ID NO: 172294 - protein, 9 aa, Artificial Sequence
  Description of Artificial Sequence: Synthetic peptide
  Seed: RQYNMVPFW (TYRP1_HUMAN)
RRYNMVPFL

SEQ ID NO: 172295 - protein, 10 aa, Artificial Sequence
  Description of Artificial Sequence: Synthetic peptide
  Seed: FVWTHYYSVK (TYRP1_HUMAN)
FQWTHYYSVL

SEQ ID NO: 172296 - protein, 9 aa, Artificial Sequence
  Description of Artificial Sequence: Synthetic peptide
  Seed: RYNADISTF (TYRP1_HUMAN)
RWNADISTI

SEQ ID NO: 172297 - protein, 9 aa, Artificial Sequence
  Description of Artificial Sequence: Synthetic peptide
  Seed: SIYNYFVWT (TYRP1_HUMAN)
SLYNYFVWA

SEQ ID NO: 172298 - protein, 9 aa, Artificial Sequence
  Description of Artificial Sequence: Synthetic peptide
  Seed: TLISPNSVF (TYRP1_HUMAN)
TPISPNSVY

SEQ ID NO: 172299 - protein, 9 aa, Artificial Sequence
  Description of Artificial Sequence: Synthetic peptide
  Seed: SMDEANQPL (TYRP1_HUMAN)
SCDEANQPF

SEQ ID NO: 172300 - protein, 11 aa, Artificial Sequence
  Description of Artificial Sequence: Synthetic peptide
  Seed: SMDEANQPLLT (TYRP1_HUMAN)
SVDEANQPLLL

SEQ ID NO: 172301 - protein, 10 aa, Artificial Sequence
  Description of Artificial Sequence: Synthetic peptide
  Seed: FLNGTGGQTH (TYRP1_HUMAN)
FTNGTGGQTF

SEQ ID NO: 172302 - protein, 9 aa, Artificial Sequence
  Description of Artificial Sequence: Synthetic peptide
  Seed: WHRYHLLRL (TYRP1_HUMAN)
WFRYHLLRM

SEQ ID NO: 172303 - protein, 11 aa, Artificial Sequence
  Description of Artificial Sequence: Synthetic peptide
  Seed: FSHEGPAFLTW (TYRP1_HUMAN)
FVHEGPAFLTW

SEQ ID NO: 172304 - protein, 9 aa, Artificial Sequence
  Description of Artificial Sequence: Synthetic peptide
  Seed: MAKRTTHPL (TYRP1_HUMAN)
MQKRTTHPA

SEQ ID NO: 172305 - protein, 9 aa, Artificial Sequence
  Description of Artificial Sequence: Synthetic peptide
  Seed: LHNLAHLFL (TYRP1_HUMAN)
LKNLAHLFM

SEQ ID NO: 172306 - protein, 8 aa, Artificial Sequence
  Description of Artificial Sequence: Synthetic peptide
  Seed: YSNSTNSF (TYRP1_HUMAN)
YANSTNSF

SEQ ID NO: 172307 - protein, 10 aa, Artificial Sequence
  Description of Artificial Sequence: Synthetic peptide
  Seed: YNYFVWTHYY (TYRP1_HUMAN)
YNYFVWTHYL

SEQ ID NO: 172308 - protein, 9 aa, Artificial Sequence
  Description of Artificial Sequence: Synthetic peptide
  Seed: STNSFRNTV (TYRP1_HUMAN)
STNSFRNTL

SEQ ID NO: 172309 - protein, 11 aa, Artificial Sequence
  Description of Artificial Sequence: Synthetic peptide
  Seed: FLTWHRYHLLR (TYRP1_HUMAN)
FLTWHRYHLLV

SEQ ID NO: 172310 - protein, 9 aa, Artificial Sequence
  Description of Artificial Sequence: Synthetic peptide
  Seed: YLIRARRSM (TYRP1_HUMAN)
YGIRARRSM

SEQ ID NO: 172311 - protein, 10 aa, Artificial Sequence
  Description of Artificial Sequence: Synthetic peptide
  Seed: GLFDTPPFYS (TYRP1_HUMAN)
GIFDTPPFYV

SEQ ID NO: 172312 - protein, 9 aa, Artificial Sequence
  Description of Artificial Sequence: Synthetic peptide
  Seed: SGHNCGTCR (TYRP1_HUMAN)
SMHNCGTCR

SEQ ID NO: 172313 - protein, 9 aa, Artificial Sequence
  Description of Artificial Sequence: Synthetic peptide
  Seed: IIAIAVVGA (TYRP1_HUMAN)
ILAIAVVGM

SEQ ID NO: 172314 - protein, 9 aa, Artificial Sequence
  Description of Artificial Sequence: Synthetic peptide
  Seed: HLSPNDPIF (TYRP1_HUMAN)
HQSPNDPIM

SEQ ID NO: 172315 - protein, 9 aa, Artificial Sequence
  Description of Artificial Sequence: Synthetic peptide
  Seed: LTDQYQCYA (TYRP1_HUMAN)
LSDQYQCYY

SEQ ID NO: 172316 - protein, 9 aa, Artificial Sequence
  Description of Artificial Sequence: Synthetic peptide
  Seed: SFRNTVEGY (TYRP1_HUMAN)
SVRNTVEGF

SEQ ID NO: 172317 - protein, 10 aa, Artificial Sequence
  Description of Artificial Sequence: Synthetic peptide
  Seed: YSNSTNSFRN (TYRP1_HUMAN)
YINSTNSFRK

SEQ ID NO: 172318 - protein, 11 aa, Artificial Sequence
  Description of Artificial Sequence: Synthetic peptide
  Seed: LISPNSVFSQW (TYRP1_HUMAN)
LGSPNSVFSQW

SEQ ID NO: 172319 - protein, 9 aa, Artificial Sequence
  Description of Artificial Sequence: Synthetic peptide
  Seed: RTTHPLFVI (TYRP1_HUMAN)
RMTHPLFVW

SEQ ID NO: 172320 - protein, 9 aa, Artificial Sequence
  Description of Artificial Sequence: Synthetic peptide
  Seed: VARPMVQRL (TYRP1_HUMAN)
VQRPMVQRK

SEQ ID NO: 172321 - protein, 10 aa, Artificial Sequence
  Description of Artificial Sequence: Synthetic peptide
  Seed: LLLVALIFGT (TYRP1_HUMAN)
LPLVALIFGI

SEQ ID NO: 172322 - protein, 9 aa, Artificial Sequence
  Description of Artificial Sequence: Synthetic peptide
  Seed: MAKRTTHPL (TYRP1_HUMAN)
MYKRTTHPY

SEQ ID NO: 172323 - protein, 9 aa, Artificial Sequence
  Description of Artificial Sequence: Synthetic peptide
  Seed: MLQEPSFSL (TYRP1_HUMAN)
MPQEPSFSA

SEQ ID NO: 172324 - protein, 9 aa, Artificial Sequence
  Description of Artificial Sequence: Synthetic peptide
  Seed: NVARPMVQR (TYRP1_HUMAN)
NMARPMVQK

SEQ ID NO: 172325 - protein, 11 aa, Artificial Sequence
  Description of Artificial Sequence: Synthetic peptide
  Seed: REVWPLRFFNR (TYRP1_HUMAN)
RIVWPLRFFNR

SEQ ID NO: 172326 - protein, 8 aa, Artificial Sequence
  Description of Artificial Sequence: Synthetic peptide
  Seed: YSDPTGKY (TYRP1_HUMAN)
YNDPTGKF

SEQ ID NO: 172327 - protein, 8 aa, Artificial Sequence
  Description of Artificial Sequence: Synthetic peptide
  Seed: YSDPTGKY (TYRP1_HUMAN)
YFDPTGKL

SEQ ID NO: 172328 - protein, 11 aa, Artificial Sequence
  Description of Artificial Sequence: Synthetic peptide
  Seed: YFVWTHYYSVK (TYRP1_HUMAN)
YAVWTHYYSVK

SEQ ID NO: 172329 - protein, 9 aa, Artificial Sequence
  Description of Artificial Sequence: Synthetic peptide
  Seed: IAIAVVGAL (TYRP1_HUMAN)
IQIAVVGAI

SEQ ID NO: 172330 - protein, 9 aa, Artificial Sequence
  Description of Artificial Sequence: Synthetic peptide
  Seed: YLIRARRSM (TYRP1_HUMAN)
YKIRARRSY

SEQ ID NO: 172331 - protein, 9 aa, Artificial Sequence
  Description of Artificial Sequence: Synthetic peptide
  Seed: FSVPEIIAI (TYRP1_HUMAN)
FLVPEIIAT

SEQ ID NO: 172332 - protein, 9 aa, Artificial Sequence
  Description of Artificial Sequence: Synthetic peptide
  Seed: GPAFLTWHR (TYRP1_HUMAN)
GSAFLTWHR

SEQ ID NO: 172333 - protein, 10 aa, Artificial Sequence
  Description of Artificial Sequence: Synthetic peptide
  Seed: FWPPVTNTEM (TYRP1_HUMAN)
FQPPVTNTEY

SEQ ID NO: 172334 - protein, 9 aa, Artificial Sequence
  Description of Artificial Sequence: Synthetic peptide
  Seed: VARPMVQRL (TYRP1_HUMAN)
VIRPMVQRW

SEQ ID NO: 172335 - protein, 9 aa, Artificial Sequence
  Description of Artificial Sequence: Synthetic peptide
  Seed: MLQEPSFSL (TYRP1_HUMAN)
MMQEPSFSH

SEQ ID NO: 172336 - protein, 11 aa, Artificial Sequence
  Description of Artificial Sequence: Synthetic peptide
  Seed: VRSLHNLAHLF (TYRP1_HUMAN)
VVSLHNLAHLW

SEQ ID NO: 172337 - protein, 9 aa, Artificial Sequence
  Description of Artificial Sequence: Synthetic peptide
  Seed: NYFVWTHYY (TYRP1_HUMAN)
NQFVWTHYK

SEQ ID NO: 172338 - protein, 8 aa, Artificial Sequence
  Description of Artificial Sequence: Synthetic peptide
  Seed: YSDPTGKY (TYRP1_HUMAN)
YYDPTGKF

SEQ ID NO: 172339 - protein, 9 aa, Artificial Sequence
  Description of Artificial Sequence: Synthetic peptide
  Seed: MAKRTTHPL (TYRP1_HUMAN)
MLKRTTHPV

SEQ ID NO: 172340 - protein, 9 aa, Artificial Sequence
  Description of Artificial Sequence: Synthetic peptide
  Seed: VPFWPPVTN (TYRP1_HUMAN)
VPFWPPVTC

SEQ ID NO: 172341 - protein, 9 aa, Artificial Sequence
  Description of Artificial Sequence: Synthetic peptide
  Seed: FSHEGPAFL (TYRP1_HUMAN)
FTHEGPAFH

SEQ ID NO: 172342 - protein, 10 aa, Artificial Sequence
  Description of Artificial Sequence: Synthetic peptide
  Seed: DAVFDEWLRR (TYRP1_HUMAN)
DEVFDEWLRR

SEQ ID NO: 172343 - protein, 9 aa, Artificial Sequence
  Description of Artificial Sequence: Synthetic peptide
  Seed: SIYNYFVWT (TYRP1_HUMAN)
SAYNYFVWL

SEQ ID NO: 172344 - protein, 10 aa, Artificial Sequence
  Description of Artificial Sequence: Synthetic peptide
  Seed: GKYDPAVRSL (TYRP1_HUMAN)
GRYDPAVRSL

SEQ ID NO: 172345 - protein, 9 aa, Artificial Sequence
  Description of Artificial Sequence: Synthetic peptide
  Seed: LHNLAHLFL (TYRP1_HUMAN)
LLNLAHLFF

SEQ ID NO: 172346 - protein, 11 aa, Artificial Sequence
  Description of Artificial Sequence: Synthetic peptide
  Seed: IYNYFVWTHYY (TYRP1_HUMAN)
INNYFVWTHYY

SEQ ID NO: 172347 - protein, 9 aa, Artificial Sequence
  Description of Artificial Sequence: Synthetic peptide
  Seed: PNDPIFVLL (TYRP1_HUMAN)
PTDPIFVLM

SEQ ID NO: 172348 - protein, 9 aa, Artificial Sequence
  Description of Artificial Sequence: Synthetic peptide
  Seed: RQYNMVPFW (TYRP1_HUMAN)
RAYNMVPFF

SEQ ID NO: 172349 - protein, 9 aa, Artificial Sequence
  Description of Artificial Sequence: Synthetic peptide
  Seed: NYFVWTHYY (TYRP1_HUMAN)
NNFVWTHYK

SEQ ID NO: 172350 - protein, 9 aa, Artificial Sequence
  Description of Artificial Sequence: Synthetic peptide
  Seed: TTHPLFVIA (TYRP1_HUMAN)
TTHPLFVIK

SEQ ID NO: 172351 - protein, 9 aa, Artificial Sequence
  Description of Artificial Sequence: Synthetic peptide
  Seed: SFSLPYWNF (TYRP1_HUMAN)
STSLPYWNY

SEQ ID NO: 172352 - protein, 9 aa, Artificial Sequence
  Description of Artificial Sequence: Synthetic peptide
  Seed: YTYEIQWPS (TYRP1_HUMAN)
YGYEIQWPV

SEQ ID NO: 172353 - protein, 11 aa, Artificial Sequence
  Description of Artificial Sequence: Synthetic peptide
  Seed: VTAPDNLGYTY (TYRP1_HUMAN)
VTAPDNLGYTI

SEQ ID NO: 172354 - protein, 11 aa, Artificial Sequence
  Description of Artificial Sequence: Synthetic peptide
  Seed: VRSLHNLAHLF (TYRP1_HUMAN)
VKSLHNLAHLW

SEQ ID NO: 172355 - protein, 10 aa, Artificial Sequence
  Description of Artificial Sequence: Synthetic peptide
  Seed: FLNGTGGQTH (TYRP1_HUMAN)
FQNGTGGQTY

SEQ ID NO: 172356 - protein, 9 aa, Artificial Sequence
  Description of Artificial Sequence: Synthetic peptide
  Seed: LTDQYQCYA (TYRP1_HUMAN)
LLDQYQCYI

SEQ ID NO: 172357 - protein, 9 aa, Artificial Sequence
  Description of Artificial Sequence: Synthetic peptide
  Seed: VPFWPPVTN (TYRP1_HUMAN)
VAFWPPVTY

SEQ ID NO: 172358 - protein, 10 aa, Artificial Sequence
  Description of Artificial Sequence: Synthetic peptide
  Seed: YNYFVWTHYY (TYRP1_HUMAN)
YQYFVWTHYA

SEQ ID NO: 172359 - protein, 9 aa, Artificial Sequence
  Description of Artificial Sequence: Synthetic peptide
  Seed: SGHNCGTCR (TYRP1_HUMAN)
SAHNCGTCM

SEQ ID NO: 172360 - protein, 10 aa, Artificial Sequence
  Description of Artificial Sequence: Synthetic peptide
  Seed: FWPPVTNTEM (TYRP1_HUMAN)
FLPPVTNTEM

SEQ ID NO: 172361 - protein, 10 aa, Artificial Sequence
  Description of Artificial Sequence: Synthetic peptide
  Seed: FVLLHTFTDA (TYRP1_HUMAN)
FRLLHTFTDL

SEQ ID NO: 172362 - protein, 10 aa, Artificial Sequence
  Description of Artificial Sequence: Synthetic peptide
  Seed: AVRSLHNLAH (TYRP1_HUMAN)
ASRSLHNLAV

SEQ ID NO: 172363 - protein, 9 aa, Artificial Sequence
  Description of Artificial Sequence: Synthetic peptide
  Seed: FTDAVFDEW (TYRP1_HUMAN)
FSDAVFDEF

SEQ ID NO: 172364 - protein, 9 aa, Artificial Sequence
  Description of Artificial Sequence: Synthetic peptide
  Seed: TNTEMFVTA (TYRP1_HUMAN)
THTEMFVTT

SEQ ID NO: 172365 - protein, 10 aa, Artificial Sequence
  Description of Artificial Sequence: Synthetic peptide
  Seed: SREFSVPEII (TYRP1_HUMAN)
SFEFSVPEIL

SEQ ID NO: 172366 - protein, 9 aa, Artificial Sequence
  Description of Artificial Sequence: Synthetic peptide
  Seed: RAQFPRQCA (TYRP1_HUMAN)
RAQFPRQCY

SEQ ID NO: 172367 - protein, 8 aa, Artificial Sequence
  Description of Artificial Sequence: Synthetic peptide
  Seed: ADISTFPL (TYRP1_HUMAN)
AEISTFPV

SEQ ID NO: 172368 - protein, 9 aa, Artificial Sequence
  Description of Artificial Sequence: Synthetic peptide
  Seed: RQCATVEAL (TYRP1_HUMAN)
RSCATVEAW

SEQ ID NO: 172369 - protein, 9 aa, Artificial Sequence
  Description of Artificial Sequence: Synthetic peptide
  Seed: SIYNYFVWT (TYRP1_HUMAN)
SMYNYFVWA

SEQ ID NO: 172370 - protein, 10 aa, Artificial Sequence
  Description of Artificial Sequence: Synthetic peptide
  Seed: MVPFWPPVTN (TYRP1_HUMAN)
MMPFWPPVTY

SEQ ID NO: 172371 - protein, 9 aa, Artificial Sequence
  Description of Artificial Sequence: Synthetic peptide
  Seed: FPLENAPIG (TYRP1_HUMAN)
FTLENAPIM

SEQ ID NO: 172372 - protein, 9 aa, Artificial Sequence
  Description of Artificial Sequence: Synthetic peptide
  Seed: FSLPYWNFA (TYRP1_HUMAN)
FMLPYWNFF

SEQ ID NO: 172373 - protein, 9 aa, Artificial Sequence
  Description of Artificial Sequence: Synthetic peptide
  Seed: RYHLLRLEK (TYRP1_HUMAN)
RVHLLRLEI

SEQ ID NO: 172374 - protein, 10 aa, Artificial Sequence
  Description of Artificial Sequence: Synthetic peptide
  Seed: YNYFVWTHYY (TYRP1_HUMAN)
YHYFVWTHYI

SEQ ID NO: 172375 - protein, 9 aa, Artificial Sequence
  Description of Artificial Sequence: Synthetic peptide
  Seed: RQYNMVPFW (TYRP1_HUMAN)
RLYNMVPFF

SEQ ID NO: 172376 - protein, 9 aa, Artificial Sequence
  Description of Artificial Sequence: Synthetic peptide
  Seed: AACDQRVLI (TYRP1_HUMAN)
AQCDQRVLI

SEQ ID NO: 172377 - protein, 11 aa, Artificial Sequence
  Description of Artificial Sequence: Synthetic peptide
  Seed: FVLLHTFTDAV (TYRP1_HUMAN)
FWLLHTFTDAV

SEQ ID NO: 172378 - protein, 9 aa, Artificial Sequence
  Description of Artificial Sequence: Synthetic peptide
  Seed: FSLPYWNFA (TYRP1_HUMAN)
FLLPYWNFM

SEQ ID NO: 172379 - protein, 10 aa, Artificial Sequence
  Description of Artificial Sequence: Synthetic peptide
  Seed: AQFPRQCATV (TYRP1_HUMAN)
AEFPRQCATV

SEQ ID NO: 172380 - protein, 9 aa, Artificial Sequence
  Description of Artificial Sequence: Synthetic peptide
  Seed: KLQNPNQSV (TYRP1_HUMAN)
KQQNPNQSY

SEQ ID NO: 172381 - protein, 9 aa, Artificial Sequence
  Description of Artificial Sequence: Synthetic peptide
  Seed: MLQEPSFSL (TYRP1_HUMAN)
MFQEPSFSI

SEQ ID NO: 172382 - protein, 11 aa, Artificial Sequence
  Description of Artificial Sequence: Synthetic peptide
  Seed: FLNGTGGQTHL (TYRP1_HUMAN)
FINGTGGQTHL

SEQ ID NO: 172383 - protein, 9 aa, Artificial Sequence
  Description of Artificial Sequence: Synthetic peptide
  Seed: QCATVEALR (TYRP1_HUMAN)
QGATVEALR

SEQ ID NO: 172384 - protein, 9 aa, Artificial Sequence
  Description of Artificial Sequence: Synthetic peptide
  Seed: IIAIAVVGA (TYRP1_HUMAN)
IMAIAVVGA

SEQ ID NO: 172385 - protein, 9 aa, Artificial Sequence
  Description of Artificial Sequence: Synthetic peptide
  Seed: RTTHPLFVI (TYRP1_HUMAN)
RITHPLFVK

SEQ ID NO: 172386 - protein, 9 aa, Artificial Sequence
  Description of Artificial Sequence: Synthetic peptide
  Seed: VFDEWLRRY (TYRP1_HUMAN)
VIDEWLRRL

SEQ ID NO: 172387 - protein, 10 aa, Artificial Sequence
  Description of Artificial Sequence: Synthetic peptide
  Seed: FSLPYWNFAT (TYRP1_HUMAN)
FILPYWNFAI

SEQ ID NO: 172388 - protein, 9 aa, Artificial Sequence
  Description of Artificial Sequence: Synthetic peptide
  Seed: NISIYNYFV (TYRP1_HUMAN)
NLSIYNYFM

SEQ ID NO: 172389 - protein, 9 aa, Artificial Sequence
  Description of Artificial Sequence: Synthetic peptide
  Seed: FSLPYWNFA (TYRP1_HUMAN)
FPLPYWNFP

SEQ ID NO: 172390 - protein, 9 aa, Artificial Sequence
  Description of Artificial Sequence: Synthetic peptide
  Seed: RQCATVEAL (TYRP1_HUMAN)
RKCATVEAY

SEQ ID NO: 172391 - protein, 9 aa, Artificial Sequence
  Description of Artificial Sequence: Synthetic peptide
  Seed: VTAPDNLGY (TYRP1_HUMAN)
VMAPDNLGM

SEQ ID NO: 172392 - protein, 9 aa, Artificial Sequence
  Description of Artificial Sequence: Synthetic peptide
  Seed: MAKRTTHPL (TYRP1_HUMAN)
MNKRTTHPY

SEQ ID NO: 172393 - protein, 9 aa, Artificial Sequence
  Description of Artificial Sequence: Synthetic peptide
  Seed: ATRRSEEIL (TYRP1_HUMAN)
ASRRSEEIW

SEQ ID NO: 172394 - protein, 9 aa, Artificial Sequence
  Description of Artificial Sequence: Synthetic peptide
  Seed: RQCATVEAL (TYRP1_HUMAN)
RDCATVEAF

SEQ ID NO: 172395 - protein, 11 aa, Artificial Sequence
  Description of Artificial Sequence: Synthetic peptide
  Seed: AFLTWHRYHLL (TYRP1_HUMAN)
AMLTWHRYHLL

SEQ ID NO: 172396 - protein, 10 aa, Artificial Sequence
  Description of Artificial Sequence: Synthetic peptide
  Seed: LSLGCIFFPL (TYRP1_HUMAN)
LGLGCIFFPI

SEQ ID NO: 172397 - protein, 9 aa, Artificial Sequence
  Description of Artificial Sequence: Synthetic peptide
  Seed: ENISIYNYF (TYRP1_HUMAN)
EVISIYNYV

SEQ ID NO: 172398 - protein, 9 aa, Artificial Sequence
  Description of Artificial Sequence: Synthetic peptide
  Seed: HLSPNDPIF (TYRP1_HUMAN)
HISPNDPIY

SEQ ID NO: 172399 - protein, 11 aa, Artificial Sequence
  Description of Artificial Sequence: Synthetic peptide
  Seed: REVWPLRFFNR (TYRP1_HUMAN)
RTVWPLRFFNK

SEQ ID NO: 172400 - protein, 9 aa, Artificial Sequence
  Description of Artificial Sequence: Synthetic peptide
  Seed: SGHNCGTCR (TYRP1_HUMAN)
SIHNCGTCR

SEQ ID NO: 172401 - protein, 9 aa, Artificial Sequence
  Description of Artificial Sequence: Synthetic peptide
  Seed: RPMVQRLPE (TYRP1_HUMAN)
RPMVQRLPS

SEQ ID NO: 172402 - protein, 9 aa, Artificial Sequence
  Description of Artificial Sequence: Synthetic peptide
  Seed: FSVPEIIAI (TYRP1_HUMAN)
FMVPEIIAS

SEQ ID NO: 172403 - protein, 10 aa, Artificial Sequence
  Description of Artificial Sequence: Synthetic peptide
  Seed: LSLGCIFFPL (TYRP1_HUMAN)
LVLGCIFFPL

SEQ ID NO: 172404 - protein, 10 aa, Artificial Sequence
  Description of Artificial Sequence: Synthetic peptide
  Seed: EGPAFLTWHR (TYRP1_HUMAN)
EIPAFLTWHK

SEQ ID NO: 172405 - protein, 9 aa, Artificial Sequence
  Description of Artificial Sequence: Synthetic peptide
  Seed: REFSVPEII (TYRP1_HUMAN)
RTFSVPEIF

SEQ ID NO: 172406 - protein, 9 aa, Artificial Sequence
  Description of Artificial Sequence: Synthetic peptide
  Seed: LTWHRYHLL (TYRP1_HUMAN)
LTWHRYHLR

SEQ ID NO: 172407 - protein, 10 aa, Artificial Sequence
  Description of Artificial Sequence: Synthetic peptide
  Seed: YNYFVWTHYY (TYRP1_HUMAN)
YMYFVWTHYY

SEQ ID NO: 172408 - protein, 9 aa, Artificial Sequence
  Description of Artificial Sequence: Synthetic peptide
  Seed: HYYSVKKTF (TYRP1_HUMAN)
HVYSVKKTL

SEQ ID NO: 172409 - protein, 9 aa, Artificial Sequence
  Description of Artificial Sequence: Synthetic peptide
  Seed: SVPEIIAIA (TYRP1_HUMAN)
STPEIIAIF

SEQ ID NO: 172410 - protein, 9 aa, Artificial Sequence
  Description of Artificial Sequence: Synthetic peptide
  Seed: MAKRTTHPL (TYRP1_HUMAN)
MPKRTTHPW

SEQ ID NO: 172411 - protein, 9 aa, Artificial Sequence
  Description of Artificial Sequence: Synthetic peptide
  Seed: NFDSTLISP (TYRP1_HUMAN)
NMDSTLISL

SEQ ID NO: 172412 - protein, 9 aa, Artificial Sequence
  Description of Artificial Sequence: Synthetic peptide
  Seed: LVALIFGTA (TYRP1_HUMAN)
LPALIFGTI

SEQ ID NO: 172413 - protein, 10 aa, Artificial Sequence
  Description of Artificial Sequence: Synthetic peptide
  Seed: LLLVALIFGT (TYRP1_HUMAN)
LGLVALIFGL

SEQ ID NO: 172414 - protein, 9 aa, Artificial Sequence
  Description of Artificial Sequence: Synthetic peptide
  Seed: YLIRARRSM (TYRP1_HUMAN)
YYIRARRSF

SEQ ID NO: 172415 - protein, 9 aa, Artificial Sequence
  Description of Artificial Sequence: Synthetic peptide
  Seed: WPPVTNTEM (TYRP1_HUMAN)
WMPVTNTEF

SEQ ID NO: 172416 - protein, 9 aa, Artificial Sequence
  Description of Artificial Sequence: Synthetic peptide
  Seed: EEKNHFVRA (TYRP1_HUMAN)
EEKNHFVRF

SEQ ID NO: 172417 - protein, 9 aa, Artificial Sequence
  Description of Artificial Sequence: Synthetic peptide
  Seed: VARPMVQRL (TYRP1_HUMAN)
VTRPMVQRL

SEQ ID NO: 172418 - protein, 9 aa, Artificial Sequence
  Description of Artificial Sequence: Synthetic peptide
  Seed: TLISPNSVF (TYRP1_HUMAN)
TRISPNSVY

SEQ ID NO: 172419 - protein, 10 aa, Artificial Sequence
  Description of Artificial Sequence: Synthetic peptide
  Seed: LENAPIGHNR (TYRP1_HUMAN)
LINAPIGHNR

SEQ ID NO: 172420 - protein, 10 aa, Artificial Sequence
  Description of Artificial Sequence: Synthetic peptide
  Seed: RSLHNLAHLF (TYRP1_HUMAN)
RMLHNLAHLF

SEQ ID NO: 172421 - protein, 10 aa, Artificial Sequence
  Description of Artificial Sequence: Synthetic peptide
  Seed: FSLPYWNFAT (TYRP1_HUMAN)
FMLPYWNFAC

SEQ ID NO: 172422 - protein, 9 aa, Artificial Sequence
  Description of Artificial Sequence: Synthetic peptide
  Seed: LIFGTASYL (TYRP1_HUMAN)
LTFGTASYV

SEQ ID NO: 172423 - protein, 10 aa, Artificial Sequence
  Description of Artificial Sequence: Synthetic peptide
  Seed: MLQEPSFSLP (TYRP1_HUMAN)
MMQEPSFSLE

SEQ ID NO: 172424 - protein, 10 aa, Artificial Sequence
  Description of Artificial Sequence: Synthetic peptide
  Seed: LLHTFTDAVF (TYRP1_HUMAN)
LRHTFTDAVF

SEQ ID NO: 172425 - protein, 10 aa, Artificial Sequence
  Description of Artificial Sequence: Synthetic peptide
  Seed: NLAHLFLNGT (TYRP1_HUMAN)
NMAHLFLNGL

SEQ ID NO: 172426 - protein, 8 aa, Artificial Sequence
  Description of Artificial Sequence: Synthetic peptide
  Seed: LIRARRSM (TYRP1_HUMAN)
LARARRSL

SEQ ID NO: 172427 - protein, 11 aa, Artificial Sequence
  Description of Artificial Sequence: Synthetic peptide
  Seed: MFVTAPDNLGY (TYRP1_HUMAN)
MAVTAPDNLGF

SEQ ID NO: 172428 - protein, 9 aa, Artificial Sequence
  Description of Artificial Sequence: Synthetic peptide
  Seed: FSHEGPAFL (TYRP1_HUMAN)
FFHEGPAFL

SEQ ID NO: 172429 - protein, 9 aa, Artificial Sequence
  Description of Artificial Sequence: Synthetic peptide
  Seed: APKLLSLGC (TYRP1_HUMAN)
APKLLSLGI

SEQ ID NO: 172430 - protein, 9 aa, Artificial Sequence
  Description of Artificial Sequence: Synthetic peptide
  Seed: MCCPDLSPV (TYRP1_HUMAN)
MICPDLSPL

SEQ ID NO: 172431 - protein, 11 aa, Artificial Sequence
  Description of Artificial Sequence: Synthetic peptide
  Seed: LISPNSVFSQW (TYRP1_HUMAN)
LNSPNSVFSQW

SEQ ID NO: 172432 - protein, 11 aa, Artificial Sequence
  Description of Artificial Sequence: Synthetic peptide
  Seed: FWPPVTNTEMF (TYRP1_HUMAN)
FPPPVTNTEMW

SEQ ID NO: 172433 - protein, 10 aa, Artificial Sequence
  Description of Artificial Sequence: Synthetic peptide
  Seed: MVPFWPPVTN (TYRP1_HUMAN)
MSPFWPPVTM

SEQ ID NO: 172434 - protein, 9 aa, Artificial Sequence
  Description of Artificial Sequence: Synthetic peptide
  Seed: MLQEPSFSL (TYRP1_HUMAN)
MAQEPSFSI

SEQ ID NO: 172435 - protein, 9 aa, Artificial Sequence
  Description of Artificial Sequence: Synthetic peptide
  Seed: RSNFDSTLI (TYRP1_HUMAN)
RANFDSTLL

SEQ ID NO: 172436 - protein, 11 aa, Artificial Sequence
  Description of Artificial Sequence: Synthetic peptide
  Seed: SIYNYFVWTHY (TYRP1_HUMAN)
SFYNYFVWTHY

SEQ ID NO: 172437 - protein, 9 aa, Artificial Sequence
  Description of Artificial Sequence: Synthetic peptide
  Seed: KLQNPNQSV (TYRP1_HUMAN)
KMQNPNQSK

SEQ ID NO: 172438 - protein, 9 aa, Artificial Sequence
  Description of Artificial Sequence: Synthetic peptide
  Seed: SMDEANQPL (TYRP1_HUMAN)
SFDEANQPF

SEQ ID NO: 172439 - protein, 9 aa, Artificial Sequence
  Description of Artificial Sequence: Synthetic peptide
  Seed: FLTWHRYHL (TYRP1_HUMAN)
FSTWHRYHV

SEQ ID NO: 172440 - protein, 9 aa, Artificial Sequence
  Description of Artificial Sequence: Synthetic peptide
  Seed: RQYNMVPFW (TYRP1_HUMAN)
RVYNMVPFL

SEQ ID NO: 172441 - protein, 9 aa, Artificial Sequence
  Description of Artificial Sequence: Synthetic peptide
  Seed: REFSVPEII (TYRP1_HUMAN)
RMFSVPEIY

SEQ ID NO: 172442 - protein, 9 aa, Artificial Sequence
  Description of Artificial Sequence: Synthetic peptide
  Seed: TFPLENAPI (TYRP1_HUMAN)
TLPLENAPL

SEQ ID NO: 172443 - protein, 10 aa, Artificial Sequence
  Description of Artificial Sequence: Synthetic peptide
  Seed: WPPVTNTEMF (TYRP1_HUMAN)
WKPVTNTEMY

SEQ ID NO: 172444 - protein, 10 aa, Artificial Sequence
  Description of Artificial Sequence: Synthetic peptide
  Seed: FVWTHYYSVK (TYRP1_HUMAN)
FFWTHYYSVR

SEQ ID NO: 172445 - protein, 9 aa, Artificial Sequence
  Description of Artificial Sequence: Synthetic peptide
  Seed: MFVTAPDNL (TYRP1_HUMAN)
MYVTAPDNY

SEQ ID NO: 172446 - protein, 9 aa, Artificial Sequence
  Description of Artificial Sequence: Synthetic peptide
  Seed: MAKRTTHPL (TYRP1_HUMAN)
MSKRTTHPG

SEQ ID NO: 172447 - protein, 9 aa, Artificial Sequence
  Description of Artificial Sequence: Synthetic peptide
  Seed: FTDAVFDEW (TYRP1_HUMAN)
FCDAVFDEL

SEQ ID NO: 172448 - protein, 9 aa, Artificial Sequence
  Description of Artificial Sequence: Synthetic peptide
  Seed: FYSNSTNSF (TYRP1_HUMAN)
FYSNSTNSL

SEQ ID NO: 172449 - protein, 9 aa, Artificial Sequence
  Description of Artificial Sequence: Synthetic peptide
  Seed: RQCATVEAL (TYRP1_HUMAN)
RACATVEAL

SEQ ID NO: 172450 - protein, 10 aa, Artificial Sequence
  Description of Artificial Sequence: Synthetic peptide
  Seed: RSMDEANQPL (TYRP1_HUMAN)
RNMDEANQPV

SEQ ID NO: 172451 - protein, 9 aa, Artificial Sequence
  Description of Artificial Sequence: Synthetic peptide
  Seed: RPHSPQYPH (TYRP1_HUMAN)
RPHSPQYPM

SEQ ID NO: 172452 - protein, 10 aa, Artificial Sequence
  Description of Artificial Sequence: Synthetic peptide
  Seed: SLHNLAHLFL (TYRP1_HUMAN)
SMHNLAHLFV

SEQ ID NO: 172453 - protein, 10 aa, Artificial Sequence
  Description of Artificial Sequence: Synthetic peptide
  Seed: FVLLHTFTDA (TYRP1_HUMAN)
FVLLHTFTDL

SEQ ID NO: 172454 - protein, 9 aa, Artificial Sequence
  Description of Artificial Sequence: Synthetic peptide
  Seed: SPNSVFSQW (TYRP1_HUMAN)
SPNSVFSQF

SEQ ID NO: 172455 - protein, 9 aa, Artificial Sequence
  Description of Artificial Sequence: Synthetic peptide
  Seed: LVALIFGTA (TYRP1_HUMAN)
LPALIFGTA

SEQ ID NO: 172456 - protein, 9 aa, Artificial Sequence
  Description of Artificial Sequence: Synthetic peptide
  Seed: IAIAVVGAL (TYRP1_HUMAN)
IQIAVVGAM

SEQ ID NO: 172457 - protein, 9 aa, Artificial Sequence
  Description of Artificial Sequence: Synthetic peptide
  Seed: LTDQYQCYA (TYRP1_HUMAN)
LIDQYQCYM

SEQ ID NO: 172458 - protein, 11 aa, Artificial Sequence
  Description of Artificial Sequence: Synthetic peptide
  Seed: FWPPVTNTEMF (TYRP1_HUMAN)
FKPPVTNTEMY

SEQ ID NO: 172459 - protein, 9 aa, Artificial Sequence
  Description of Artificial Sequence: Synthetic peptide
  Seed: VFDEWLRRY (TYRP1_HUMAN)
VMDEWLRRW

SEQ ID NO: 172460 - protein, 9 aa, Artificial Sequence
  Description of Artificial Sequence: Synthetic peptide
  Seed: GLFDTPPFY (TYRP1_HUMAN)
GMFDTPPFK

SEQ ID NO: 172461 - protein, 10 aa, Artificial Sequence
  Description of Artificial Sequence: Synthetic peptide
  Seed: YNADISTFPL (TYRP1_HUMAN)
YEADISTFPM

SEQ ID NO: 172462 - protein, 9 aa, Artificial Sequence
  Description of Artificial Sequence: Synthetic peptide
  Seed: MAKRTTHPL (TYRP1_HUMAN)
MLKRTTHPM

SEQ ID NO: 172463 - protein, 10 aa, Artificial Sequence
  Description of Artificial Sequence: Synthetic peptide
  Seed: YNADISTFPL (TYRP1_HUMAN)
YQADISTFPY

SEQ ID NO: 172464 - protein, 10 aa, Artificial Sequence
  Description of Artificial Sequence: Synthetic peptide
  Seed: HLSPNDPIFV (TYRP1_HUMAN)
HSSPNDPIFL

SEQ ID NO: 172465 - protein, 10 aa, Artificial Sequence
  Description of Artificial Sequence: Synthetic peptide
  Seed: MAKRTTHPLF (TYRP1_HUMAN)
MPKRTTHPLI

SEQ ID NO: 172466 - protein, 9 aa, Artificial Sequence
  Description of Artificial Sequence: Synthetic peptide
  Seed: VFDEWLRRY (TYRP1_HUMAN)
VADEWLRRV

SEQ ID NO: 172467 - protein, 9 aa, Artificial Sequence
  Description of Artificial Sequence: Synthetic peptide
  Seed: FSVPEIIAI (TYRP1_HUMAN)
FTVPEIIAT

SEQ ID NO: 172468 - protein, 9 aa, Artificial Sequence
  Description of Artificial Sequence: Synthetic peptide
  Seed: RFFNRTCHC (TYRP1_HUMAN)
RGFNRTCHK

SEQ ID NO: 172469 - protein, 10 aa, Artificial Sequence
  Description of Artificial Sequence: Synthetic peptide
  Seed: VALIFGTASY (TYRP1_HUMAN)
VVLIFGTASY

SEQ ID NO: 172470 - protein, 8 aa, Artificial Sequence
  Description of Artificial Sequence: Synthetic peptide
  Seed: YSDPTGKY (TYRP1_HUMAN)
YGDPTGKL

SEQ ID NO: 172471 - protein, 9 aa, Artificial Sequence
  Description of Artificial Sequence: Synthetic peptide
  Seed: TLISPNSVF (TYRP1_HUMAN)
TYISPNSVM

SEQ ID NO: 172472 - protein, 8 aa, Artificial Sequence
  Description of Artificial Sequence: Synthetic peptide
  Seed: FSHEGPAF (TYRP1_HUMAN)
FLHEGPAL

SEQ ID NO: 172473 - protein, 9 aa, Artificial Sequence
  Description of Artificial Sequence: Synthetic peptide
  Seed: CIFFPLLLF (TYRP1_HUMAN)
CFFFPLLLY

SEQ ID NO: 172474 - protein, 10 aa, Artificial Sequence
  Description of Artificial Sequence: Synthetic peptide
  Seed: RRYNADISTF (TYRP1_HUMAN)
RRYNADISTL

SEQ ID NO: 172475 - protein, 10 aa, Artificial Sequence
  Description of Artificial Sequence: Synthetic peptide
  Seed: YFVWTHYYSV (TYRP1_HUMAN)
YTVWTHYYSI

SEQ ID NO: 172476 - protein, 11 aa, Artificial Sequence
  Description of Artificial Sequence: Synthetic peptide
  Seed: VTAPDNLGYTY (TYRP1_HUMAN)
VTAPDNLGYTR

SEQ ID NO: 172477 - protein, 11 aa, Artificial Sequence
  Description of Artificial Sequence: Synthetic peptide
  Seed: FWPPVTNTEMF (TYRP1_HUMAN)
FEPPVTNTEMW

SEQ ID NO: 172478 - protein, 9 aa, Artificial Sequence
  Description of Artificial Sequence: Synthetic peptide
  Seed: SIYNYFVWT (TYRP1_HUMAN)
SIYNYFVWA

SEQ ID NO: 172479 - protein, 11 aa, Artificial Sequence
  Description of Artificial Sequence: Synthetic peptide
  Seed: NTPQFENISIY (TYRP1_HUMAN)
NRPQFENISIF

SEQ ID NO: 172480 - protein, 9 aa, Artificial Sequence
  Description of Artificial Sequence: Synthetic peptide
  Seed: LFQQARAQF (TYRP1_HUMAN)
LVQQARAQY

SEQ ID NO: 172481 - protein, 9 aa, Artificial Sequence
  Description of Artificial Sequence: Synthetic peptide
  Seed: RARRSMDEA (TYRP1_HUMAN)
RGRRSMDEK

SEQ ID NO: 172482 - protein, 10 aa, Artificial Sequence
  Description of Artificial Sequence: Synthetic peptide
  Seed: YNMVPFWPPV (TYRP1_HUMAN)
YQMVPFWPPA

SEQ ID NO: 172483 - protein, 10 aa, Artificial Sequence
  Description of Artificial Sequence: Synthetic peptide
  Seed: ALIFGTASYL (TYRP1_HUMAN)
AFIFGTASYF

SEQ ID NO: 172484 - protein, 9 aa, Artificial Sequence
  Description of Artificial Sequence: Synthetic peptide
  Seed: LPYWNFATG (TYRP1_HUMAN)
LVYWNFATM

SEQ ID NO: 172485 - protein, 10 aa, Artificial Sequence
  Description of Artificial Sequence: Synthetic peptide
  Seed: STFPLENAPI (TYRP1_HUMAN)
SVFPLENAPL

SEQ ID NO: 172486 - protein, 10 aa, Artificial Sequence
  Description of Artificial Sequence: Synthetic peptide
  Seed: SPNSVFSQWR (TYRP1_HUMAN)
STNSVFSQWR

SEQ ID NO: 172487 - protein, 9 aa, Artificial Sequence
  Description of Artificial Sequence: Synthetic peptide
  Seed: LTWHRYHLL (TYRP1_HUMAN)
LLWHRYHLM

SEQ ID NO: 172488 - protein, 10 aa, Artificial Sequence
  Description of Artificial Sequence: Synthetic peptide
  Seed: LENAPIGHNR (TYRP1_HUMAN)
LVNAPIGHNK

SEQ ID NO: 172489 - protein, 9 aa, Artificial Sequence
  Description of Artificial Sequence: Synthetic peptide
  Seed: RYNADISTF (TYRP1_HUMAN)
RWNADISTM

SEQ ID NO: 172490 - protein, 10 aa, Artificial Sequence
  Description of Artificial Sequence: Synthetic peptide
  Seed: LQEPSFSLPY (TYRP1_HUMAN)
LAEPSFSLPY

SEQ ID NO: 172491 - protein, 9 aa, Artificial Sequence
  Description of Artificial Sequence: Synthetic peptide
  Seed: YLIRARRSM (TYRP1_HUMAN)
YFIRARRSV

SEQ ID NO: 172492 - protein, 9 aa, Artificial Sequence
  Description of Artificial Sequence: Synthetic peptide
  Seed: RRYNADIST (TYRP1_HUMAN)
RYYNADISY

SEQ ID NO: 172493 - protein, 9 aa, Artificial Sequence
  Description of Artificial Sequence: Synthetic peptide
  Seed: VARPMVQRL (TYRP1_HUMAN)
VIRPMVQRK

SEQ ID NO: 172494 - protein, 9 aa, Artificial Sequence
  Description of Artificial Sequence: Synthetic peptide
  Seed: HEGPAFLTW (TYRP1_HUMAN)
HLGPAFLTY

SEQ ID NO: 172495 - protein, 9 aa, Artificial Sequence
  Description of Artificial Sequence: Synthetic peptide
  Seed: ENAPIGHNR (TYRP1_HUMAN)
ELAPIGHNK

SEQ ID NO: 172496 - protein, 9 aa, Artificial Sequence
  Description of Artificial Sequence: Synthetic peptide
  Seed: LIFGTASYL (TYRP1_HUMAN)
LQFGTASYH

SEQ ID NO: 172497 - protein, 10 aa, Artificial Sequence
  Description of Artificial Sequence: Synthetic peptide
  Seed: RSMDEANQPL (TYRP1_HUMAN)
REMDEANQPM

SEQ ID NO: 172498 - protein, 10 aa, Artificial Sequence
  Description of Artificial Sequence: Synthetic peptide
  Seed: WPPVTNTEMF (TYRP1_HUMAN)
WGPVTNTEMY

SEQ ID NO: 172499 - protein, 9 aa, Artificial Sequence
  Description of Artificial Sequence: Synthetic peptide
  Seed: NYFVWTHYY (TYRP1_HUMAN)
NGFVWTHYK

SEQ ID NO: 172500 - protein, 8 aa, Artificial Sequence
  Description of Artificial Sequence: Synthetic peptide
  Seed: FSHEGPAF (TYRP1_HUMAN)
FQHEGPAM

SEQ ID NO: 172501 - protein, 10 aa, Artificial Sequence
  Description of Artificial Sequence: Synthetic peptide
  Seed: MLQEPSFSLP (TYRP1_HUMAN)
MMQEPSFSLN

SEQ ID NO: 172502 - protein, 9 aa, Artificial Sequence
  Description of Artificial Sequence: Synthetic peptide
  Seed: FSVPEIIAI (TYRP1_HUMAN)
FVVPEIIAL

SEQ ID NO: 172503 - protein, 9 aa, Artificial Sequence
  Description of Artificial Sequence: Synthetic peptide
  Seed: TPQFENISI (TYRP1_HUMAN)
TPQFENISW

SEQ ID NO: 172504 - protein, 9 aa, Artificial Sequence
  Description of Artificial Sequence: Synthetic peptide
  Seed: KLLSLGCIF (TYRP1_HUMAN)
KHLSLGCIY

SEQ ID NO: 172505 - protein, 10 aa, Artificial Sequence
  Description of Artificial Sequence: Synthetic peptide
  Seed: FVLLHTFTDA (TYRP1_HUMAN)
FSLLHTFTDV

SEQ ID NO: 172506 - protein, 10 aa, Artificial Sequence
  Description of Artificial Sequence: Synthetic peptide
  Seed: YNADISTFPL (TYRP1_HUMAN)
YFADISTFPI

SEQ ID NO: 172507 - protein, 9 aa, Artificial Sequence
  Description of Artificial Sequence: Synthetic peptide
  Seed: LGYTYEIQW (TYRP1_HUMAN)
LTYTYEIQY

SEQ ID NO: 172508 - protein, 9 aa, Artificial Sequence
  Description of Artificial Sequence: Synthetic peptide
  Seed: LIFGTASYL (TYRP1_HUMAN)
LQFGTASYI

SEQ ID NO: 172509 - protein, 9 aa, Artificial Sequence
  Description of Artificial Sequence: Synthetic peptide
  Seed: KYDPAVRSL (TYRP1_HUMAN)
KWDPAVRSV

SEQ ID NO: 172510 - protein, 10 aa, Artificial Sequence
  Description of Artificial Sequence: Synthetic peptide
  Seed: STFPLENAPI (TYRP1_HUMAN)
STFPLENAPY

SEQ ID NO: 172511 - protein, 10 aa, Artificial Sequence
  Description of Artificial Sequence: Synthetic peptide
  Seed: HDGRDDREVW (TYRP1_HUMAN)
HEGRDDREVW

SEQ ID NO: 172512 - protein, 10 aa, Artificial Sequence
  Description of Artificial Sequence: Synthetic peptide
  Seed: THYYSVKKTF (TYRP1_HUMAN)
TRYYSVKKTF

SEQ ID NO: 172513 - protein, 11 aa, Artificial Sequence
  Description of Artificial Sequence: Synthetic peptide
  Seed: RSMDEANQPLL (TYRP1_HUMAN)
RMMDEANQPLL

SEQ ID NO: 172514 - protein, 10 aa, Artificial Sequence
  Description of Artificial Sequence: Synthetic peptide
  Seed: LGPDGNTPQF (TYRP1_HUMAN)
LGPDGNTPQW

SEQ ID NO: 172515 - protein, 9 aa, Artificial Sequence
  Description of Artificial Sequence: Synthetic peptide
  Seed: SPNSVFSQW (TYRP1_HUMAN)
STNSVFSQY

SEQ ID NO: 172516 - protein, 10 aa, Artificial Sequence
  Description of Artificial Sequence: Synthetic peptide
  Seed: RVVCDSLEDY (TYRP1_HUMAN)
RSVCDSLEDF

SEQ ID NO: 172517 - protein, 9 aa, Artificial Sequence
  Description of Artificial Sequence: Synthetic peptide
  Seed: RTCHCNGNF (TYRP1_HUMAN)
RICHCNGNY

SEQ ID NO: 172518 - protein, 9 aa, Artificial Sequence
  Description of Artificial Sequence: Synthetic peptide
  Seed: SGRGRCEAV (TYRP1_HUMAN)
SMRGRCEAF

SEQ ID NO: 172519 - protein, 10 aa, Artificial Sequence
  Description of Artificial Sequence: Synthetic peptide
  Seed: FLNGTGGQTH (TYRP1_HUMAN)
FPNGTGGQTF

SEQ ID NO: 172520 - protein, 10 aa, Artificial Sequence
  Description of Artificial Sequence: Synthetic peptide
  Seed: MVPFWPPVTN (TYRP1_HUMAN)
MDPFWPPVTY

SEQ ID NO: 172521 - protein, 10 aa, Artificial Sequence
  Description of Artificial Sequence: Synthetic peptide
  Seed: YEIQWPSREF (TYRP1_HUMAN)
YEIQWPSREM

SEQ ID NO: 172522 - protein, 10 aa, Artificial Sequence
  Description of Artificial Sequence: Synthetic peptide
  Seed: MAKRTTHPLF (TYRP1_HUMAN)
MIKRTTHPLY

SEQ ID NO: 172523 - protein, 9 aa, Artificial Sequence
  Description of Artificial Sequence: Synthetic peptide
  Seed: FVWTHYYSV (TYRP1_HUMAN)
FQWTHYYSV

SEQ ID NO: 172524 - protein, 11 aa, Artificial Sequence
  Description of Artificial Sequence: Synthetic peptide
  Seed: FVLLHTFTDAV (TYRP1_HUMAN)
FRLLHTFTDAL

SEQ ID NO: 172525 - protein, 9 aa, Artificial Sequence
  Description of Artificial Sequence: Synthetic peptide
  Seed: NYFVWTHYY (TYRP1_HUMAN)
NHFVWTHYY

SEQ ID NO: 172526 - protein, 9 aa, Artificial Sequence
  Description of Artificial Sequence: Synthetic peptide
  Seed: SGHNCGTCR (TYRP1_HUMAN)
SLHNCGTCR

SEQ ID NO: 172527 - protein, 10 aa, Artificial Sequence
  Description of Artificial Sequence: Synthetic peptide
  Seed: ALIFGTASYL (TYRP1_HUMAN)
AQIFGTASYK

SEQ ID NO: 172528 - protein, 9 aa, Artificial Sequence
  Description of Artificial Sequence: Synthetic peptide
  Seed: DEANQPLLT (TYRP1_HUMAN)
DEANQPLLA

SEQ ID NO: 172529 - protein, 9 aa, Artificial Sequence
  Description of Artificial Sequence: Synthetic peptide
  Seed: GLFDTPPFY (TYRP1_HUMAN)
GYFDTPPFF

SEQ ID NO: 172530 - protein, 9 aa, Artificial Sequence
  Description of Artificial Sequence: Synthetic peptide
  Seed: SVKKTFLGV (TYRP1_HUMAN)
SLKKTFLGL

SEQ ID NO: 172531 - protein, 9 aa, Artificial Sequence
  Description of Artificial Sequence: Synthetic peptide
  Seed: LTWHRYHLL (TYRP1_HUMAN)
LYWHRYHLF

SEQ ID NO: 172532 - protein, 9 aa, Artificial Sequence
  Description of Artificial Sequence: Synthetic peptide
  Seed: SLHNLAHLF (TYRP1_HUMAN)
SFHNLAHLY

SEQ ID NO: 172533 - protein, 8 aa, Artificial Sequence
  Description of Artificial Sequence: Synthetic peptide
  Seed: SVPEIIAI (TYRP1_HUMAN)
SAPEIIAM

SEQ ID NO: 172534 - protein, 9 aa, Artificial Sequence
  Description of Artificial Sequence: Synthetic peptide
  Seed: YLIRARRSM (TYRP1_HUMAN)
YTIRARRSL

SEQ ID NO: 172535 - protein, 9 aa, Artificial Sequence
  Description of Artificial Sequence: Synthetic peptide
  Seed: FSHEGPAFL (TYRP1_HUMAN)
FIHEGPAFI

SEQ ID NO: 172536 - protein, 10 aa, Artificial Sequence
  Description of Artificial Sequence: Synthetic peptide
  Seed: RSMDEANQPL (TYRP1_HUMAN)
RAMDEANQPY

SEQ ID NO: 172537 - protein, 10 aa, Artificial Sequence
  Description of Artificial Sequence: Synthetic peptide
  Seed: RSLHNLAHLF (TYRP1_HUMAN)
RMLHNLAHLM

SEQ ID NO: 172538 - protein, 9 aa, Artificial Sequence
  Description of Artificial Sequence: Synthetic peptide
  Seed: RQCATVEAL (TYRP1_HUMAN)
RACATVEAI

SEQ ID NO: 172539 - protein, 9 aa, Artificial Sequence
  Description of Artificial Sequence: Synthetic peptide
  Seed: AIAVVGALL (TYRP1_HUMAN)
ALAVVGALA

SEQ ID NO: 172540 - protein, 11 aa, Artificial Sequence
  Description of Artificial Sequence: Synthetic peptide
  Seed: EILGPDGNTPQ (TYRP1_HUMAN)
EALGPDGNTPR

SEQ ID NO: 172541 - protein, 8 aa, Artificial Sequence
  Description of Artificial Sequence: Synthetic peptide
  Seed: RQYNMVPF (TYRP1_HUMAN)
RRYNMVPL

SEQ ID NO: 172542 - protein, 9 aa, Artificial Sequence
  Description of Artificial Sequence: Synthetic peptide
  Seed: LQNPNQSVV (TYRP1_HUMAN)
LMNPNQSVI

SEQ ID NO: 172543 - protein, 9 aa, Artificial Sequence
  Description of Artificial Sequence: Synthetic peptide
  Seed: QCATVEALR (TYRP1_HUMAN)
QTATVEALR

SEQ ID NO: 172544 - protein, 9 aa, Artificial Sequence
  Description of Artificial Sequence: Synthetic peptide
  Seed: CTDDLMGSR (TYRP1_HUMAN)
CSDDLMGSY

SEQ ID NO: 172545 - protein, 10 aa, Artificial Sequence
  Description of Artificial Sequence: Synthetic peptide
  Seed: ADSRPHSPQY (TYRP1_HUMAN)
AESRPHSPQW

SEQ ID NO: 172546 - protein, 9 aa, Artificial Sequence
  Description of Artificial Sequence: Synthetic peptide
  Seed: SLGCIFFPL (TYRP1_HUMAN)
SMGCIFFPI

SEQ ID NO: 172547 - protein, 11 aa, Artificial Sequence
  Description of Artificial Sequence: Synthetic peptide
  Seed: FLNGTGGQTHL (TYRP1_HUMAN)
FLNGTGGQTHV

SEQ ID NO: 172548 - protein, 11 aa, Artificial Sequence
  Description of Artificial Sequence: Synthetic peptide
  Seed: RRSMDEANQPL (TYRP1_HUMAN)
RMSMDEANQPV

SEQ ID NO: 172549 - protein, 9 aa, Artificial Sequence
  Description of Artificial Sequence: Synthetic peptide
  Seed: HPLFVIATR (TYRP1_HUMAN)
HLLFVIATK

SEQ ID NO: 172550 - protein, 10 aa, Artificial Sequence
  Description of Artificial Sequence: Synthetic peptide
  Seed: YEIQWPSREF (TYRP1_HUMAN)
YEIQWPSREW

SEQ ID NO: 172551 - protein, 8 aa, Artificial Sequence
  Description of Artificial Sequence: Synthetic peptide
  Seed: YYSVKKTF (TYRP1_HUMAN)
YASVKKTF

SEQ ID NO: 172552 - protein, 9 aa, Artificial Sequence
  Description of Artificial Sequence: Synthetic peptide
  Seed: YYSVKKTFL (TYRP1_HUMAN)
YASVKKTFL

SEQ ID NO: 172553 - protein, 11 aa, Artificial Sequence
  Description of Artificial Sequence: Synthetic peptide
  Seed: LTWHRYHLLRL (TYRP1_HUMAN)
LSWHRYHLLRW

SEQ ID NO: 172554 - protein, 11 aa, Artificial Sequence
  Description of Artificial Sequence: Synthetic peptide
  Seed: LFQQARAQFPR (TYRP1_HUMAN)
LYQQARAQFPR

SEQ ID NO: 172555 - protein, 10 aa, Artificial Sequence
  Description of Artificial Sequence: Synthetic peptide
  Seed: YNMVPFWPPV (TYRP1_HUMAN)
YNMVPFWPPL

SEQ ID NO: 172556 - protein, 9 aa, Artificial Sequence
  Description of Artificial Sequence: Synthetic peptide
  Seed: ISIYNYFVW (TYRP1_HUMAN)
IEIYNYFVF

SEQ ID NO: 172557 - protein, 10 aa, Artificial Sequence
  Description of Artificial Sequence: Synthetic peptide
  Seed: YNMVPFWPPV (TYRP1_HUMAN)
YRMVPFWPPL

SEQ ID NO: 172558 - protein, 9 aa, Artificial Sequence
  Description of Artificial Sequence: Synthetic peptide
  Seed: GPDGNTPQF (TYRP1_HUMAN)
GYDGNTPQY

SEQ ID NO: 172559 - protein, 9 aa, Artificial Sequence
  Description of Artificial Sequence: Synthetic peptide
  Seed: FVWTHYYSV (TYRP1_HUMAN)
FGWTHYYSF

SEQ ID NO: 172560 - protein, 9 aa, Artificial Sequence
  Description of Artificial Sequence: Synthetic peptide
  Seed: VPFWPPVTN (TYRP1_HUMAN)
VPFWPPVTV

SEQ ID NO: 172561 - protein, 10 aa, Artificial Sequence
  Description of Artificial Sequence: Synthetic peptide
  Seed: STFPLENAPI (TYRP1_HUMAN)
SLFPLENAPI

SEQ ID NO: 172562 - protein, 9 aa, Artificial Sequence
  Description of Artificial Sequence: Synthetic peptide
  Seed: RPMVQRLPE (TYRP1_HUMAN)
RAMVQRLPF

SEQ ID NO: 172563 - protein, 10 aa, Artificial Sequence
  Description of Artificial Sequence: Synthetic peptide
  Seed: FSLPYWNFAT (TYRP1_HUMAN)
FNLPYWNFAA

SEQ ID NO: 172564 - protein, 9 aa, Artificial Sequence
  Description of Artificial Sequence: Synthetic peptide
  Seed: TLISPNSVF (TYRP1_HUMAN)
TMISPNSVW

SEQ ID NO: 172565 - protein, 9 aa, Artificial Sequence
  Description of Artificial Sequence: Synthetic peptide
  Seed: TNTEMFVTA (TYRP1_HUMAN)
THTEMFVTC

SEQ ID NO: 172566 - protein, 9 aa, Artificial Sequence
  Description of Artificial Sequence: Synthetic peptide
  Seed: TTHPLFVIA (TYRP1_HUMAN)
TLHPLFVIV

SEQ ID NO: 172567 - protein, 10 aa, Artificial Sequence
  Description of Artificial Sequence: Synthetic peptide
  Seed: QFENISIYNY (TYRP1_HUMAN)
QDENISIYNW

SEQ ID NO: 172568 - protein, 9 aa, Artificial Sequence
  Description of Artificial Sequence: Synthetic peptide
  Seed: VFDEWLRRY (TYRP1_HUMAN)
VADEWLRRF

SEQ ID NO: 172569 - protein, 9 aa, Artificial Sequence
  Description of Artificial Sequence: Synthetic peptide
  Seed: RPGWRGAAC (TYRP1_HUMAN)
RIGWRGAAM

SEQ ID NO: 172570 - protein, 11 aa, Artificial Sequence
  Description of Artificial Sequence: Synthetic peptide
  Seed: MFVTAPDNLGY (TYRP1_HUMAN)
MQVTAPDNLGY

SEQ ID NO: 172571 - protein, 9 aa, Artificial Sequence
  Description of Artificial Sequence: Synthetic peptide
  Seed: HLSPNDPIF (TYRP1_HUMAN)
HQSPNDPIV

SEQ ID NO: 172572 - protein, 9 aa, Artificial Sequence
  Description of Artificial Sequence: Synthetic peptide
  Seed: RGRCEAVTA (TYRP1_HUMAN)
RVRCEAVTA

SEQ ID NO: 172573 - protein, 10 aa, Artificial Sequence
  Description of Artificial Sequence: Synthetic peptide
  Seed: STFPLENAPI (TYRP1_HUMAN)
SVFPLENAPI

SEQ ID NO: 172574 - protein, 10 aa, Artificial Sequence
  Description of Artificial Sequence: Synthetic peptide
  Seed: TDAVFDEWLR (TYRP1_HUMAN)
TSAVFDEWLR

SEQ ID NO: 172575 - protein, 11 aa, Artificial Sequence
  Description of Artificial Sequence: Synthetic peptide
  Seed: REFSVPEIIAI (TYRP1_HUMAN)
REFSVPEIIAY

SEQ ID NO: 172576 - protein, 10 aa, Artificial Sequence
  Description of Artificial Sequence: Synthetic peptide
  Seed: RRYNADISTF (TYRP1_HUMAN)
RGYNADISTF

SEQ ID NO: 172577 - protein, 9 aa, Artificial Sequence
  Description of Artificial Sequence: Synthetic peptide
  Seed: VFDEWLRRY (TYRP1_HUMAN)
VFDEWLRRV

SEQ ID NO: 172578 - protein, 10 aa, Artificial Sequence
  Description of Artificial Sequence: Synthetic peptide
  Seed: FQQARAQFPR (TYRP1_HUMAN)
FTQARAQFPR

SEQ ID NO: 172579 - protein, 9 aa, Artificial Sequence
  Description of Artificial Sequence: Synthetic peptide
  Seed: KLLSLGCIF (TYRP1_HUMAN)
KSLSLGCIY

SEQ ID NO: 172580 - protein, 9 aa, Artificial Sequence
  Description of Artificial Sequence: Synthetic peptide
  Seed: QCATVEALR (TYRP1_HUMAN)
QYATVEALR

SEQ ID NO: 172581 - protein, 9 aa, Artificial Sequence
  Description of Artificial Sequence: Synthetic peptide
  Seed: YNYFVWTHY (TYRP1_HUMAN)
YSYFVWTHL

SEQ ID NO: 172582 - protein, 9 aa, Artificial Sequence
  Description of Artificial Sequence: Synthetic peptide
  Seed: KLLSLGCIF (TYRP1_HUMAN)
KALSLGCIW

SEQ ID NO: 172583 - protein, 9 aa, Artificial Sequence
  Description of Artificial Sequence: Synthetic peptide
  Seed: RTTHPLFVI (TYRP1_HUMAN)
RGTHPLFVY

SEQ ID NO: 172584 - protein, 9 aa, Artificial Sequence
  Description of Artificial Sequence: Synthetic peptide
  Seed: SLGCIFFPL (TYRP1_HUMAN)
SMGCIFFPT

SEQ ID NO: 172585 - protein, 10 aa, Artificial Sequence
  Description of Artificial Sequence: Synthetic peptide
  Seed: EVWPLRFFNR (TYRP1_HUMAN)
EAWPLRFFNR

SEQ ID NO: 172586 - protein, 10 aa, Artificial Sequence
  Description of Artificial Sequence: Synthetic peptide
  Seed: NYFVWTHYYS (TYRP1_HUMAN)
NFFVWTHYYY

SEQ ID NO: 172587 - protein, 9 aa, Artificial Sequence
  Description of Artificial Sequence: Synthetic peptide
  Seed: LEKDMQEML (TYRP1_HUMAN)
LEKDMQEMA

SEQ ID NO: 172588 - protein, 9 aa, Artificial Sequence
  Description of Artificial Sequence: Synthetic peptide
  Seed: QRLPEPQDV (TYRP1_HUMAN)
QHLPEPQDA

SEQ ID NO: 172589 - protein, 11 aa, Artificial Sequence
  Description of Artificial Sequence: Synthetic peptide
  Seed: RRYNADISTFP (TYRP1_HUMAN)
RRYNADISTFK

SEQ ID NO: 172590 - protein, 10 aa, Artificial Sequence
  Description of Artificial Sequence: Synthetic peptide
  Seed: RSMDEANQPL (TYRP1_HUMAN)
RHMDEANQPM

SEQ ID NO: 172591 - protein, 9 aa, Artificial Sequence
  Description of Artificial Sequence: Synthetic peptide
  Seed: VGLFDTPPF (TYRP1_HUMAN)
VPLFDTPPF

SEQ ID NO: 172592 - protein, 10 aa, Artificial Sequence
  Description of Artificial Sequence: Synthetic peptide
  Seed: LLLVALIFGT (TYRP1_HUMAN)
LTLVALIFGL

SEQ ID NO: 172593 - protein, 10 aa, Artificial Sequence
  Description of Artificial Sequence: Synthetic peptide
  Seed: MSAPKLLSLG (TYRP1_HUMAN)
MSAPKLLSLW

SEQ ID NO: 172594 - protein, 9 aa, Artificial Sequence
  Description of Artificial Sequence: Synthetic peptide
  Seed: FSLPYWNFA (TYRP1_HUMAN)
FTLPYWNFL

SEQ ID NO: 172595 - protein, 10 aa, Artificial Sequence
  Description of Artificial Sequence: Synthetic peptide
  Seed: MQEMLQEPSF (TYRP1_HUMAN)
MGEMLQEPSW

SEQ ID NO: 172596 - protein, 9 aa, Artificial Sequence
  Description of Artificial Sequence: Synthetic peptide
  Seed: TPQFENISI (TYRP1_HUMAN)
TPQFENISY

SEQ ID NO: 172597 - protein, 8 aa, Artificial Sequence
  Description of Artificial Sequence: Synthetic peptide
  Seed: FSHEGPAF (TYRP1_HUMAN)
FMHEGPAY

SEQ ID NO: 172598 - protein, 9 aa, Artificial Sequence
  Description of Artificial Sequence: Synthetic peptide
  Seed: RARRSMDEA (TYRP1_HUMAN)
RVRRSMDES

SEQ ID NO: 172599 - protein, 9 aa, Artificial Sequence
  Description of Artificial Sequence: Synthetic peptide
  Seed: RQCATVEAL (TYRP1_HUMAN)
RRCATVEAI

SEQ ID NO: 172600 - protein, 10 aa, Artificial Sequence
  Description of Artificial Sequence: Synthetic peptide
  Seed: LLLVALIFGT (TYRP1_HUMAN)
LKLVALIFGV

SEQ ID NO: 172601 - protein, 9 aa, Artificial Sequence
  Description of Artificial Sequence: Synthetic peptide
  Seed: RSLHNLAHL (TYRP1_HUMAN)
RTLHNLAHY

SEQ ID NO: 172602 - protein, 9 aa, Artificial Sequence
  Description of Artificial Sequence: Synthetic peptide
  Seed: REVWPLRFF (TYRP1_HUMAN)
RKVWPLRFF

SEQ ID NO: 172603 - protein, 9 aa, Artificial Sequence
  Description of Artificial Sequence: Synthetic peptide
  Seed: SLHNLAHLF (TYRP1_HUMAN)
SIHNLAHLR

SEQ ID NO: 172604 - protein, 10 aa, Artificial Sequence
  Description of Artificial Sequence: Synthetic peptide
  Seed: LSPNDPIFVL (TYRP1_HUMAN)
LSPNDPIFVW

SEQ ID NO: 172605 - protein, 9 aa, Artificial Sequence
  Description of Artificial Sequence: Synthetic peptide
  Seed: HEGPAFLTW (TYRP1_HUMAN)
HVGPAFLTF

SEQ ID NO: 172606 - protein, 9 aa, Artificial Sequence
  Description of Artificial Sequence: Synthetic peptide
  Seed: HYYSVKKTF (TYRP1_HUMAN)
HIYSVKKTL

SEQ ID NO: 172607 - protein, 11 aa, Artificial Sequence
  Description of Artificial Sequence: Synthetic peptide
  Seed: LVALIFGTASY (TYRP1_HUMAN)
LVALIFGTASF

SEQ ID NO: 172608 - protein, 9 aa, Artificial Sequence
  Description of Artificial Sequence: Synthetic peptide
  Seed: AVVGALLLV (TYRP1_HUMAN)
ATVGALLLI

SEQ ID NO: 172609 - protein, 10 aa, Artificial Sequence
  Description of Artificial Sequence: Synthetic peptide
  Seed: RVVCDSLEDY (TYRP1_HUMAN)
RQVCDSLEDM

SEQ ID NO: 172610 - protein, 11 aa, Artificial Sequence
  Description of Artificial Sequence: Synthetic peptide
  Seed: ILGPDGNTPQF (TYRP1_HUMAN)
IQGPDGNTPQW

SEQ ID NO: 172611 - protein, 8 aa, Artificial Sequence
  Description of Artificial Sequence: Synthetic peptide
  Seed: FSHEGPAF (TYRP1_HUMAN)
FYHEGPAM

SEQ ID NO: 172612 - protein, 9 aa, Artificial Sequence
  Description of Artificial Sequence: Synthetic peptide
  Seed: ACDQRVLIV (TYRP1_HUMAN)
ARDQRVLIL

SEQ ID NO: 172613 - protein, 9 aa, Artificial Sequence
  Description of Artificial Sequence: Synthetic peptide
  Seed: HLSPNDPIF (TYRP1_HUMAN)
HASPNDPIM

SEQ ID NO: 172614 - protein, 9 aa, Artificial Sequence
  Description of Artificial Sequence: Synthetic peptide
  Seed: TLISPNSVF (TYRP1_HUMAN)
TYISPNSVI

SEQ ID NO: 172615 - protein, 11 aa, Artificial Sequence
  Description of Artificial Sequence: Synthetic peptide
  Seed: RLPEPQDVAQC (TYRP1_HUMAN)
RQPEPQDVAQV

SEQ ID NO: 172616 - protein, 11 aa, Artificial Sequence
  Description of Artificial Sequence: Synthetic peptide
  Seed: VGQESFGEVDF (TYRP1_HUMAN)
VSQESFGEVDW

SEQ ID NO: 172617 - protein, 10 aa, Artificial Sequence
  Description of Artificial Sequence: Synthetic peptide
  Seed: KRTTHPLFVI (TYRP1_HUMAN)
KYTTHPLFVY

SEQ ID NO: 172618 - protein, 9 aa, Artificial Sequence
  Description of Artificial Sequence: Synthetic peptide
  Seed: DNLGYTYEI (TYRP1_HUMAN)
DILGYTYEV

SEQ ID NO: 172619 - protein, 9 aa, Artificial Sequence
  Description of Artificial Sequence: Synthetic peptide
  Seed: RRNPAGNVA (TYRP1_HUMAN)
RSNPAGNVL

SEQ ID NO: 172620 - protein, 10 aa, Artificial Sequence
  Description of Artificial Sequence: Synthetic peptide
  Seed: SMDEANQPLL (TYRP1_HUMAN)
SADEANQPLF

SEQ ID NO: 172621 - protein, 9 aa, Artificial Sequence
  Description of Artificial Sequence: Synthetic peptide
  Seed: ISIYNYFVW (TYRP1_HUMAN)
IRIYNYFVF

SEQ ID NO: 172622 - protein, 10 aa, Artificial Sequence
  Description of Artificial Sequence: Synthetic peptide
  Seed: REFSVPEIIA (TYRP1_HUMAN)
REFSVPEIIL

SEQ ID NO: 172623 - protein, 9 aa, Artificial Sequence
  Description of Artificial Sequence: Synthetic peptide
  Seed: STNSFRNTV (TYRP1_HUMAN)
SVNSFRNTV

SEQ ID NO: 172624 - protein, 9 aa, Artificial Sequence
  Description of Artificial Sequence: Synthetic peptide
  Seed: FSHEGPAFL (TYRP1_HUMAN)
FMHEGPAFT

SEQ ID NO: 172625 - protein, 9 aa, Artificial Sequence
  Description of Artificial Sequence: Synthetic peptide
  Seed: ASYLIRARR (TYRP1_HUMAN)
AQYLIRARR

SEQ ID NO: 172626 - protein, 10 aa, Artificial Sequence
  Description of Artificial Sequence: Synthetic peptide
  Seed: EIIAIAVVGA (TYRP1_HUMAN)
EVIAIAVVGV

SEQ ID NO: 172627 - protein, 9 aa, Artificial Sequence
  Description of Artificial Sequence: Synthetic peptide
  Seed: MCCPDLSPV (TYRP1_HUMAN)
MQCPDLSPV

SEQ ID NO: 172628 - protein, 10 aa, Artificial Sequence
  Description of Artificial Sequence: Synthetic peptide
  Seed: NSTEDGPIRR (TYRP1_HUMAN)
NTTEDGPIRY

SEQ ID NO: 172629 - protein, 8 aa, Artificial Sequence
  Description of Artificial Sequence: Synthetic peptide
  Seed: FSHEGPAF (TYRP1_HUMAN)
FTHEGPAI

SEQ ID NO: 172630 - protein, 10 aa, Artificial Sequence
  Description of Artificial Sequence: Synthetic peptide
  Seed: RRYNADISTF (TYRP1_HUMAN)
RVYNADISTY

SEQ ID NO: 172631 - protein, 9 aa, Artificial Sequence
  Description of Artificial Sequence: Synthetic peptide
  Seed: RTCHCNGNF (TYRP1_HUMAN)
RVCHCNGNW

SEQ ID NO: 172632 - protein, 9 aa, Artificial Sequence
  Description of Artificial Sequence: Synthetic peptide
  Seed: VPFWPPVTN (TYRP1_HUMAN)
VPFWPPVTA

SEQ ID NO: 172633 - protein, 10 aa, Artificial Sequence
  Description of Artificial Sequence: Synthetic peptide
  Seed: YFVWTHYYSV (TYRP1_HUMAN)
YIVWTHYYSA

SEQ ID NO: 172634 - protein, 9 aa, Artificial Sequence
  Description of Artificial Sequence: Synthetic peptide
  Seed: YTYEIQWPS (TYRP1_HUMAN)
YIYEIQWPK

SEQ ID NO: 172635 - protein, 9 aa, Artificial Sequence
  Description of Artificial Sequence: Synthetic peptide
  Seed: AVVGALLLV (TYRP1_HUMAN)
AQVGALLLI

SEQ ID NO: 172636 - protein, 9 aa, Artificial Sequence
  Description of Artificial Sequence: Synthetic peptide
  Seed: YTYEIQWPS (TYRP1_HUMAN)
YMYEIQWPK

SEQ ID NO: 172637 - protein, 10 aa, Artificial Sequence
  Description of Artificial Sequence: Synthetic peptide
  Seed: FWPPVTNTEM (TYRP1_HUMAN)
FPPPVTNTEY

SEQ ID NO: 172638 - protein, 9 aa, Artificial Sequence
  Description of Artificial Sequence: Synthetic peptide
  Seed: LLVALIFGT (TYRP1_HUMAN)
LLVALIFGA

SEQ ID NO: 172639 - protein, 9 aa, Artificial Sequence
  Description of Artificial Sequence: Synthetic peptide
  Seed: ISIYNYFVW (TYRP1_HUMAN)
IHIYNYFVM

SEQ ID NO: 172640 - protein, 10 aa, Artificial Sequence
  Description of Artificial Sequence: Synthetic peptide
  Seed: RTTHPLFVIA (TYRP1_HUMAN)
RCTHPLFVIK

SEQ ID NO: 172641 - protein, 10 aa, Artificial Sequence
  Description of Artificial Sequence: Synthetic peptide
  Seed: YNYFVWTHYY (TYRP1_HUMAN)
YIYFVWTHYV

SEQ ID NO: 172642 - protein, 9 aa, Artificial Sequence
  Description of Artificial Sequence: Synthetic peptide
  Seed: RQCATVEAL (TYRP1_HUMAN)
RLCATVEAA

SEQ ID NO: 172643 - protein, 9 aa, Artificial Sequence
  Description of Artificial Sequence: Synthetic peptide
  Seed: FSHEGPAFL (TYRP1_HUMAN)
FGHEGPAFI

SEQ ID NO: 172644 - protein, 9 aa, Artificial Sequence
  Description of Artificial Sequence: Synthetic peptide
  Seed: LIFGTASYL (TYRP1_HUMAN)
LLFGTASYM

SEQ ID NO: 172645 - protein, 9 aa, Artificial Sequence
  Description of Artificial Sequence: Synthetic peptide
  Seed: HEGPAFLTW (TYRP1_HUMAN)
HLGPAFLTL

SEQ ID NO: 172646 - protein, 9 aa, Artificial Sequence
  Description of Artificial Sequence: Synthetic peptide
  Seed: AVFDEWLRR (TYRP1_HUMAN)
AAFDEWLRM

SEQ ID NO: 172647 - protein, 9 aa, Artificial Sequence
  Description of Artificial Sequence: Synthetic peptide
  Seed: FSHEGPAFL (TYRP1_HUMAN)
FAHEGPAFI

SEQ ID NO: 172648 - protein, 10 aa, Artificial Sequence
  Description of Artificial Sequence: Synthetic peptide
  Seed: LSPNDPIFVL (TYRP1_HUMAN)
LTPNDPIFVF

SEQ ID NO: 172649 - protein, 9 aa, Artificial Sequence
  Description of Artificial Sequence: Synthetic peptide
  Seed: DNLGYTYEI (TYRP1_HUMAN)
DALGYTYEA

SEQ ID NO: 172650 - protein, 10 aa, Artificial Sequence
  Description of Artificial Sequence: Synthetic peptide
  Seed: STFPLENAPI (TYRP1_HUMAN)
STFPLENAPL

SEQ ID NO: 172651 - protein, 9 aa, Artificial Sequence
  Description of Artificial Sequence: Synthetic peptide
  Seed: RSLHNLAHL (TYRP1_HUMAN)
RALHNLAHK

SEQ ID NO: 172652 - protein, 9 aa, Artificial Sequence
  Description of Artificial Sequence: Synthetic peptide
  Seed: RSNFDSTLI (TYRP1_HUMAN)
RVNFDSTLF

SEQ ID NO: 172653 - protein, 10 aa, Artificial Sequence
  Description of Artificial Sequence: Synthetic peptide
  Seed: MLQEPSFSLP (TYRP1_HUMAN)
MLQEPSFSLL

SEQ ID NO: 172654 - protein, 11 aa, Artificial Sequence
  Description of Artificial Sequence: Synthetic peptide
  Seed: IYNYFVWTHYY (TYRP1_HUMAN)
ISNYFVWTHYL

SEQ ID NO: 172655 - protein, 10 aa, Artificial Sequence
  Description of Artificial Sequence: Synthetic peptide
  Seed: YNYFVWTHYY (TYRP1_HUMAN)
YKYFVWTHYV

SEQ ID NO: 172656 - protein, 8 aa, Artificial Sequence
  Description of Artificial Sequence: Synthetic peptide
  Seed: RPMVQRLP (TYRP1_HUMAN)
RPMVQRLL

SEQ ID NO: 172657 - protein, 10 aa, Artificial Sequence
  Description of Artificial Sequence: Synthetic peptide
  Seed: MVPFWPPVTN (TYRP1_HUMAN)
MDPFWPPVTF

SEQ ID NO: 172658 - protein, 11 aa, Artificial Sequence
  Description of Artificial Sequence: Synthetic peptide
  Seed: RSMDEANQPLL (TYRP1_HUMAN)
RVMDEANQPLI

SEQ ID NO: 172659 - protein, 10 aa, Artificial Sequence
  Description of Artificial Sequence: Synthetic peptide
  Seed: MSAPKLLSLG (TYRP1_HUMAN)
MIAPKLLSLW

SEQ ID NO: 172660 - protein, 9 aa, Artificial Sequence
  Description of Artificial Sequence: Synthetic peptide
  Seed: RQYNMVPFW (TYRP1_HUMAN)
RFYNMVPFF

SEQ ID NO: 172661 - protein, 10 aa, Artificial Sequence
  Description of Artificial Sequence: Synthetic peptide
  Seed: GKYDPAVRSL (TYRP1_HUMAN)
GTYDPAVRSF

SEQ ID NO: 172662 - protein, 10 aa, Artificial Sequence
  Description of Artificial Sequence: Synthetic peptide
  Seed: GKYDPAVRSL (TYRP1_HUMAN)
GYYDPAVRSL

SEQ ID NO: 172663 - protein, 9 aa, Artificial Sequence
  Description of Artificial Sequence: Synthetic peptide
  Seed: LPEPQDVAQ (TYRP1_HUMAN)
LPEPQDVAY

SEQ ID NO: 172664 - protein, 10 aa, Artificial Sequence
  Description of Artificial Sequence: Synthetic peptide
  Seed: YEIQWPSREF (TYRP1_HUMAN)
YEIQWPSREI

SEQ ID NO: 172665 - protein, 8 aa, Artificial Sequence
  Description of Artificial Sequence: Synthetic peptide
  Seed: YSDPTGKY (TYRP1_HUMAN)
YSDPTGKL

SEQ ID NO: 172666 - protein, 10 aa, Artificial Sequence
  Description of Artificial Sequence: Synthetic peptide
  Seed: HPLFVIATRR (TYRP1_HUMAN)
HILFVIATRK

SEQ ID NO: 172667 - protein, 9 aa, Artificial Sequence
  Description of Artificial Sequence: Synthetic peptide
  Seed: RTTHPLFVI (TYRP1_HUMAN)
RITHPLFVI

SEQ ID NO: 172668 - protein, 10 aa, Artificial Sequence
  Description of Artificial Sequence: Synthetic peptide
  Seed: MLQEPSFSLP (TYRP1_HUMAN)
MLQEPSFSLT

SEQ ID NO: 172669 - protein, 9 aa, Artificial Sequence
  Description of Artificial Sequence: Synthetic peptide
  Seed: TLISPNSVF (TYRP1_HUMAN)
TLISPNSVM

SEQ ID NO: 172670 - protein, 10 aa, Artificial Sequence
  Description of Artificial Sequence: Synthetic peptide
  Seed: IIAIAVVGAL (TYRP1_HUMAN)
IVAIAVVGAV

SEQ ID NO: 172671 - protein, 9 aa, Artificial Sequence
  Description of Artificial Sequence: Synthetic peptide
  Seed: LVALIFGTA (TYRP1_HUMAN)
LLALIFGTI

SEQ ID NO: 172672 - protein, 9 aa, Artificial Sequence
  Description of Artificial Sequence: Synthetic peptide
  Seed: RPGWRGAAC (TYRP1_HUMAN)
RPGWRGAAM

SEQ ID NO: 172673 - protein, 9 aa, Artificial Sequence
  Description of Artificial Sequence: Synthetic peptide
  Seed: IAIAVVGAL (TYRP1_HUMAN)
ILIAVVGAY

SEQ ID NO: 172674 - protein, 9 aa, Artificial Sequence
  Description of Artificial Sequence: Synthetic peptide
  Seed: NSVFSQWRV (TYRP1_HUMAN)
NTVFSQWRL

SEQ ID NO: 172675 - protein, 9 aa, Artificial Sequence
  Description of Artificial Sequence: Synthetic peptide
  Seed: LIFGTASYL (TYRP1_HUMAN)
LLFGTASYK

SEQ ID NO: 172676 - protein, 9 aa, Artificial Sequence
  Description of Artificial Sequence: Synthetic peptide
  Seed: AVRSLHNLA (TYRP1_HUMAN)
AQRSLHNLK

SEQ ID NO: 172677 - protein, 9 aa, Artificial Sequence
  Description of Artificial Sequence: Synthetic peptide
  Seed: RLEKDMQEM (TYRP1_HUMAN)
RQEKDMQEL

SEQ ID NO: 172678 - protein, 11 aa, Artificial Sequence
  Description of Artificial Sequence: Synthetic peptide
  Seed: LIFGTASYLIR (TYRP1_HUMAN)
LSFGTASYLIR

SEQ ID NO: 172679 - protein, 9 aa, Artificial Sequence
  Description of Artificial Sequence: Synthetic peptide
  Seed: LVALIFGTA (TYRP1_HUMAN)
LMALIFGTT

SEQ ID NO: 172680 - protein, 9 aa, Artificial Sequence
  Description of Artificial Sequence: Synthetic peptide
  Seed: FSVPEIIAI (TYRP1_HUMAN)
FIVPEIIAA

SEQ ID NO: 172681 - protein, 10 aa, Artificial Sequence
  Description of Artificial Sequence: Synthetic peptide
  Seed: FVWTHYYSVK (TYRP1_HUMAN)
FYWTHYYSVR

SEQ ID NO: 172682 - protein, 9 aa, Artificial Sequence
  Description of Artificial Sequence: Synthetic peptide
  Seed: RYNADISTF (TYRP1_HUMAN)
RMNADISTY

SEQ ID NO: 172683 - protein, 10 aa, Artificial Sequence
  Description of Artificial Sequence: Synthetic peptide
  Seed: LLFQQARAQF (TYRP1_HUMAN)
LIFQQARAQY

SEQ ID NO: 172684 - protein, 10 aa, Artificial Sequence
  Description of Artificial Sequence: Synthetic peptide
  Seed: LGPDGNTPQF (TYRP1_HUMAN)
LHPDGNTPQW

SEQ ID NO: 172685 - protein, 9 aa, Artificial Sequence
  Description of Artificial Sequence: Synthetic peptide
  Seed: SLGCIFFPL (TYRP1_HUMAN)
SLGCIFFPM

SEQ ID NO: 172686 - protein, 10 aa, Artificial Sequence
  Description of Artificial Sequence: Synthetic peptide
  Seed: FVLLHTFTDA (TYRP1_HUMAN)
FILLHTFTDA

SEQ ID NO: 172687 - protein, 11 aa, Artificial Sequence
  Description of Artificial Sequence: Synthetic peptide
  Seed: SLEDYDTLGTL (TYRP1_HUMAN)
SMEDYDTLGTV

SEQ ID NO: 172688 - protein, 9 aa, Artificial Sequence
  Description of Artificial Sequence: Synthetic peptide
  Seed: VLLHTFTDA (TYRP1_HUMAN)
VMLHTFTDI

SEQ ID NO: 172689 - protein, 11 aa, Artificial Sequence
  Description of Artificial Sequence: Synthetic peptide
  Seed: REVWPLRFFNR (TYRP1_HUMAN)
RAVWPLRFFNK

SEQ ID NO: 172690 - protein, 11 aa, Artificial Sequence
  Description of Artificial Sequence: Synthetic peptide
  Seed: IYNYFVWTHYY (TYRP1_HUMAN)
IWNYFVWTHYI

SEQ ID NO: 172691 - protein, 9 aa, Artificial Sequence
  Description of Artificial Sequence: Synthetic peptide
  Seed: FVWTHYYSV (TYRP1_HUMAN)
FFWTHYYSI

SEQ ID NO: 172692 - protein, 9 aa, Artificial Sequence
  Description of Artificial Sequence: Synthetic peptide
  Seed: AQFPRQCAT (TYRP1_HUMAN)
AKFPRQCAM

SEQ ID NO: 172693 - protein, 9 aa, Artificial Sequence
  Description of Artificial Sequence: Synthetic peptide
  Seed: LPYWNFATG (TYRP1_HUMAN)
LAYWNFATA

SEQ ID NO: 172694 - protein, 9 aa, Artificial Sequence
  Description of Artificial Sequence: Synthetic peptide
  Seed: MSAPKLLSL (TYRP1_HUMAN)
MLAPKLLSK

SEQ ID NO: 172695 - protein, 10 aa, Artificial Sequence
  Description of Artificial Sequence: Synthetic peptide
  Seed: RRYNADISTF (TYRP1_HUMAN)
RLYNADISTM

SEQ ID NO: 172696 - protein, 10 aa, Artificial Sequence
  Description of Artificial Sequence: Synthetic peptide
  Seed: LSPNDPIFVL (TYRP1_HUMAN)
LRPNDPIFVF

SEQ ID NO: 172697 - protein, 11 aa, Artificial Sequence
  Description of Artificial Sequence: Synthetic peptide
  Seed: TVEGYSDPTGK (TYRP1_HUMAN)
TTEGYSDPTGY

SEQ ID NO: 172698 - protein, 10 aa, Artificial Sequence
  Description of Artificial Sequence: Synthetic peptide
  Seed: EGPAFLTWHR (TYRP1_HUMAN)
EVPAFLTWHK

SEQ ID NO: 172699 - protein, 10 aa, Artificial Sequence
  Description of Artificial Sequence: Synthetic peptide
  Seed: YNYFVWTHYY (TYRP1_HUMAN)
YYYFVWTHYI

SEQ ID NO: 172700 - protein, 9 aa, Artificial Sequence
  Description of Artificial Sequence: Synthetic peptide
  Seed: AQFPRQCAT (TYRP1_HUMAN)
AIFPRQCAM

SEQ ID NO: 172701 - protein, 10 aa, Artificial Sequence
  Description of Artificial Sequence: Synthetic peptide
  Seed: RSLHNLAHLF (TYRP1_HUMAN)
RYLHNLAHLV

SEQ ID NO: 172702 - protein, 10 aa, Artificial Sequence
  Description of Artificial Sequence: Synthetic peptide
  Seed: LPYWNFATGK (TYRP1_HUMAN)
LIYWNFATGR

SEQ ID NO: 172703 - protein, 10 aa, Artificial Sequence
  Description of Artificial Sequence: Synthetic peptide
  Seed: GKYDPAVRSL (TYRP1_HUMAN)
GIYDPAVRSF

SEQ ID NO: 172704 - protein, 9 aa, Artificial Sequence
  Description of Artificial Sequence: Synthetic peptide
  Seed: FSLPYWNFA (TYRP1_HUMAN)
FLLPYWNFA

SEQ ID NO: 172705 - protein, 11 aa, Artificial Sequence
  Description of Artificial Sequence: Synthetic peptide
  Seed: IYNYFVWTHYY (TYRP1_HUMAN)
ICNYFVWTHYL

SEQ ID NO: 172706 - protein, 10 aa, Artificial Sequence
  Description of Artificial Sequence: Synthetic peptide
  Seed: MLQEPSFSLP (TYRP1_HUMAN)
MMQEPSFSLT

SEQ ID NO: 172707 - protein, 10 aa, Artificial Sequence
  Description of Artificial Sequence: Synthetic peptide
  Seed: MVPFWPPVTN (TYRP1_HUMAN)
MQPFWPPVTL

SEQ ID NO: 172708 - protein, 9 aa, Artificial Sequence
  Description of Artificial Sequence: Synthetic peptide
  Seed: NYFVWTHYY (TYRP1_HUMAN)
NIFVWTHYK

SEQ ID NO: 172709 - protein, 9 aa, Artificial Sequence
  Description of Artificial Sequence: Synthetic peptide
  Seed: RQYNMVPFW (TYRP1_HUMAN)
RAYNMVPFW

SEQ ID NO: 172710 - protein, 9 aa, Artificial Sequence
  Description of Artificial Sequence: Synthetic peptide
  Seed: RPGWRGAAC (TYRP1_HUMAN)
RPGWRGAAP

SEQ ID NO: 172711 - protein, 9 aa, Artificial Sequence
  Description of Artificial Sequence: Synthetic peptide
  Seed: LEVGLFDTP (TYRP1_HUMAN)
LEVGLFDTL

SEQ ID NO: 172712 - protein, 11 aa, Artificial Sequence
  Description of Artificial Sequence: Synthetic peptide
  Seed: HLSPNDPIFVL (TYRP1_HUMAN)
HASPNDPIFVL

SEQ ID NO: 172713 - protein, 9 aa, Artificial Sequence
  Description of Artificial Sequence: Synthetic peptide
  Seed: FLGVGQESF (TYRP1_HUMAN)
FFGVGQESY

SEQ ID NO: 172714 - protein, 9 aa, Artificial Sequence
  Description of Artificial Sequence: Synthetic peptide
  Seed: REFSVPEII (TYRP1_HUMAN)
RHFSVPEIL

SEQ ID NO: 172715 - protein, 9 aa, Artificial Sequence
  Description of Artificial Sequence: Synthetic peptide
  Seed: VFDEWLRRY (TYRP1_HUMAN)
VLDEWLRRF

SEQ ID NO: 172716 - protein, 10 aa, Artificial Sequence
  Description of Artificial Sequence: Synthetic peptide
  Seed: TPQFENISIY (TYRP1_HUMAN)
TCQFENISIF

SEQ ID NO: 172717 - protein, 9 aa, Artificial Sequence
  Description of Artificial Sequence: Synthetic peptide
  Seed: RQYNMVPFW (TYRP1_HUMAN)
REYNMVPFM

SEQ ID NO: 172718 - protein, 10 aa, Artificial Sequence
  Description of Artificial Sequence: Synthetic peptide
  Seed: IYNYFVWTHY (TYRP1_HUMAN)
IMNYFVWTHY

SEQ ID NO: 172719 - protein, 9 aa, Artificial Sequence
  Description of Artificial Sequence: Synthetic peptide
  Seed: KYDPAVRSL (TYRP1_HUMAN)
KFDPAVRSF

SEQ ID NO: 172720 - protein, 10 aa, Artificial Sequence
  Description of Artificial Sequence: Synthetic peptide
  Seed: ENISIYNYFV (TYRP1_HUMAN)
EQISIYNYFV

SEQ ID NO: 172721 - protein, 9 aa, Artificial Sequence
  Description of Artificial Sequence: Synthetic peptide
  Seed: IAVVGALLL (TYRP1_HUMAN)
IPVVGALLV

SEQ ID NO: 172722 - protein, 9 aa, Artificial Sequence
  Description of Artificial Sequence: Synthetic peptide
  Seed: VPFWPPVTN (TYRP1_HUMAN)
VPFWPPVTS

SEQ ID NO: 172723 - protein, 9 aa, Artificial Sequence
  Description of Artificial Sequence: Synthetic peptide
  Seed: HPLFVIATR (TYRP1_HUMAN)
HPLFVIATT

SEQ ID NO: 172724 - protein, 10 aa, Artificial Sequence
  Description of Artificial Sequence: Synthetic peptide
  Seed: GTCRPGWRGA (TYRP1_HUMAN)
GSCRPGWRGK

SEQ ID NO: 172725 - protein, 10 aa, Artificial Sequence
  Description of Artificial Sequence: Synthetic peptide
  Seed: SPNDPIFVLL (TYRP1_HUMAN)
SPNDPIFVLF

SEQ ID NO: 172726 - protein, 10 aa, Artificial Sequence
  Description of Artificial Sequence: Synthetic peptide
  Seed: FSLPYWNFAT (TYRP1_HUMAN)
FMLPYWNFAA

SEQ ID NO: 172727 - protein, 9 aa, Artificial Sequence
  Description of Artificial Sequence: Synthetic peptide
  Seed: QCATVEALR (TYRP1_HUMAN)
QIATVEALK

SEQ ID NO: 172728 - protein, 9 aa, Artificial Sequence
  Description of Artificial Sequence: Synthetic peptide
  Seed: FSHEGPAFL (TYRP1_HUMAN)
FTHEGPAFM

SEQ ID NO: 172729 - protein, 9 aa, Artificial Sequence
  Description of Artificial Sequence: Synthetic peptide
  Seed: NMVPFWPPV (TYRP1_HUMAN)
NWVPFWPPF

SEQ ID NO: 172730 - protein, 9 aa, Artificial Sequence
  Description of Artificial Sequence: Synthetic peptide
  Seed: LLVALIFGT (TYRP1_HUMAN)
LIVALIFGV

SEQ ID NO: 172731 - protein, 10 aa, Artificial Sequence
  Description of Artificial Sequence: Synthetic peptide
  Seed: DVAQCLEVGL (TYRP1_HUMAN)
DTAQCLEVGI

SEQ ID NO: 172732 - protein, 9 aa, Artificial Sequence
  Description of Artificial Sequence: Synthetic peptide
  Seed: LTDQYQCYA (TYRP1_HUMAN)
LVDQYQCYY

SEQ ID NO: 172733 - protein, 10 aa, Artificial Sequence
  Description of Artificial Sequence: Synthetic peptide
  Seed: LSPNDPIFVL (TYRP1_HUMAN)
LWPNDPIFVY

SEQ ID NO: 172734 - protein, 9 aa, Artificial Sequence
  Description of Artificial Sequence: Synthetic peptide
  Seed: SPNDPIFVL (TYRP1_HUMAN)
SHNDPIFVW

SEQ ID NO: 172735 - protein, 10 aa, Artificial Sequence
  Description of Artificial Sequence: Synthetic peptide
  Seed: SLHNLAHLFL (TYRP1_HUMAN)
SVHNLAHLFV

SEQ ID NO: 172736 - protein, 10 aa, Artificial Sequence
  Description of Artificial Sequence: Synthetic peptide
  Seed: SQWRVVCDSL (TYRP1_HUMAN)
SMWRVVCDSA

SEQ ID NO: 172737 - protein, 10 aa, Artificial Sequence
  Description of Artificial Sequence: Synthetic peptide
  Seed: MSAPKLLSLG (TYRP1_HUMAN)
MSAPKLLSLF

SEQ ID NO: 172738 - protein, 9 aa, Artificial Sequence
  Description of Artificial Sequence: Synthetic peptide
  Seed: RGAACDQRV (TYRP1_HUMAN)
RIAACDQRV

SEQ ID NO: 172739 - protein, 10 aa, Artificial Sequence
  Description of Artificial Sequence: Synthetic peptide
  Seed: YNYFVWTHYY (TYRP1_HUMAN)
YKYFVWTHYM

SEQ ID NO: 172740 - protein, 10 aa, Artificial Sequence
  Description of Artificial Sequence: Synthetic peptide
  Seed: RSLHNLAHLF (TYRP1_HUMAN)
RTLHNLAHLY

SEQ ID NO: 172741 - protein, 10 aa, Artificial Sequence
  Description of Artificial Sequence: Synthetic peptide
  Seed: STFPLENAPI (TYRP1_HUMAN)
SIFPLENAPL

SEQ ID NO: 172742 - protein, 9 aa, Artificial Sequence
  Description of Artificial Sequence: Synthetic peptide
  Seed: FLTWHRYHL (TYRP1_HUMAN)
FITWHRYHV

SEQ ID NO: 172743 - protein, 10 aa, Artificial Sequence
  Description of Artificial Sequence: Synthetic peptide
  Seed: FWPPVTNTEM (TYRP1_HUMAN)
FWPPVTNTEL

SEQ ID NO: 172744 - protein, 9 aa, Artificial Sequence
  Description of Artificial Sequence: Synthetic peptide
  Seed: LLVALIFGT (TYRP1_HUMAN)
LQVALIFGA

SEQ ID NO: 172745 - protein, 9 aa, Artificial Sequence
  Description of Artificial Sequence: Synthetic peptide
  Seed: MSAPKLLSL (TYRP1_HUMAN)
MIAPKLLSW

SEQ ID NO: 172746 - protein, 9 aa, Artificial Sequence
  Description of Artificial Sequence: Synthetic peptide
  Seed: TADSRPHSP (TYRP1_HUMAN)
TIDSRPHSL

SEQ ID NO: 172747 - protein, 9 aa, Artificial Sequence
  Description of Artificial Sequence: Synthetic peptide
  Seed: SLPYWNFAT (TYRP1_HUMAN)
SIPYWNFAI

SEQ ID NO: 172748 - protein, 10 aa, Artificial Sequence
  Description of Artificial Sequence: Synthetic peptide
  Seed: ADSRPHSPQY (TYRP1_HUMAN)
AMSRPHSPQA

SEQ ID NO: 172749 - protein, 10 aa, Artificial Sequence
  Description of Artificial Sequence: Synthetic peptide
  Seed: TPQFENISIY (TYRP1_HUMAN)
TAQFENISIM

SEQ ID NO: 172750 - protein, 10 aa, Artificial Sequence
  Description of Artificial Sequence: Synthetic peptide
  Seed: ADSRPHSPQY (TYRP1_HUMAN)
AASRPHSPQA

SEQ ID NO: 172751 - protein, 9 aa, Artificial Sequence
  Description of Artificial Sequence: Synthetic peptide
  Seed: RTTHPLFVI (TYRP1_HUMAN)
RSTHPLFVM

SEQ ID NO: 172752 - protein, 8 aa, Artificial Sequence
  Description of Artificial Sequence: Synthetic peptide
  Seed: VPFWPPVT (TYRP1_HUMAN)
VPFWPPVV

SEQ ID NO: 172753 - protein, 10 aa, Artificial Sequence
  Description of Artificial Sequence: Synthetic peptide
  Seed: ALIFGTASYL (TYRP1_HUMAN)
AQIFGTASYI

SEQ ID NO: 172754 - protein, 10 aa, Artificial Sequence
  Description of Artificial Sequence: Synthetic peptide
  Seed: LQEPSFSLPY (TYRP1_HUMAN)
LREPSFSLPF

SEQ ID NO: 172755 - protein, 10 aa, Artificial Sequence
  Description of Artificial Sequence: Synthetic peptide
  Seed: SMDEANQPLL (TYRP1_HUMAN)
SSDEANQPLV

SEQ ID NO: 172756 - protein, 11 aa, Artificial Sequence
  Description of Artificial Sequence: Synthetic peptide
  Seed: RSLHNLAHLFL (TYRP1_HUMAN)
RSLHNLAHLFW

SEQ ID NO: 172757 - protein, 10 aa, Artificial Sequence
  Description of Artificial Sequence: Synthetic peptide
  Seed: FGTASYLIRA (TYRP1_HUMAN)
FMTASYLIRV

SEQ ID NO: 172758 - protein, 9 aa, Artificial Sequence
  Description of Artificial Sequence: Synthetic peptide
  Seed: TLISPNSVF (TYRP1_HUMAN)
TSISPNSVL

SEQ ID NO: 172759 - protein, 9 aa, Artificial Sequence
  Description of Artificial Sequence: Synthetic peptide
  Seed: QEPSFSLPY (TYRP1_HUMAN)
QEPSFSLPW

SEQ ID NO: 172760 - protein, 10 aa, Artificial Sequence
  Description of Artificial Sequence: Synthetic peptide
  Seed: SREFSVPEII (TYRP1_HUMAN)
SEEFSVPEIA

SEQ ID NO: 172761 - protein, 9 aa, Artificial Sequence
  Description of Artificial Sequence: Synthetic peptide
  Seed: ARAQFPRQC (TYRP1_HUMAN)
ASAQFPRQL

SEQ ID NO: 172762 - protein, 9 aa, Artificial Sequence
  Description of Artificial Sequence: Synthetic peptide
  Seed: AVVGALLLV (TYRP1_HUMAN)
AMVGALLLI

SEQ ID NO: 172763 - protein, 9 aa, Artificial Sequence
  Description of Artificial Sequence: Synthetic peptide
  Seed: QQARAQFPR (TYRP1_HUMAN)
QIARAQFPK

SEQ ID NO: 172764 - protein, 10 aa, Artificial Sequence
  Description of Artificial Sequence: Synthetic peptide
  Seed: YNYFVWTHYY (TYRP1_HUMAN)
YGYFVWTHYF

SEQ ID NO: 172765 - protein, 8 aa, Artificial Sequence
  Description of Artificial Sequence: Synthetic peptide
  Seed: ACDQRVLI (TYRP1_HUMAN)
ATDQRVLV

SEQ ID NO: 172766 - protein, 11 aa, Artificial Sequence
  Description of Artificial Sequence: Synthetic peptide
  Seed: IYNYFVWTHYY (TYRP1_HUMAN)
IINYFVWTHYF

SEQ ID NO: 172767 - protein, 9 aa, Artificial Sequence
  Description of Artificial Sequence: Synthetic peptide
  Seed: AQFPRQCAT (TYRP1_HUMAN)
AQFPRQCAM

SEQ ID NO: 172768 - protein, 9 aa, Artificial Sequence
  Description of Artificial Sequence: Synthetic peptide
  Seed: RTTHPLFVI (TYRP1_HUMAN)
RQTHPLFVM

SEQ ID NO: 172769 - protein, 8 aa, Artificial Sequence
  Description of Artificial Sequence: Synthetic peptide
  Seed: YYSVKKTF (TYRP1_HUMAN)
YYSVKKTY

SEQ ID NO: 172770 - protein, 9 aa, Artificial Sequence
  Description of Artificial Sequence: Synthetic peptide
  Seed: DQRVLIVRR (TYRP1_HUMAN)
DVRVLIVRR

SEQ ID NO: 172771 - protein, 9 aa, Artificial Sequence
  Description of Artificial Sequence: Synthetic peptide
  Seed: KYDPAVRSL (TYRP1_HUMAN)
KTDPAVRSI

SEQ ID NO: 172772 - protein, 9 aa, Artificial Sequence
  Description of Artificial Sequence: Synthetic peptide
  Seed: STNSFRNTV (TYRP1_HUMAN)
SLNSFRNTV

SEQ ID NO: 172773 - protein, 9 aa, Artificial Sequence
  Description of Artificial Sequence: Synthetic peptide
  Seed: VLIVRRNLL (TYRP1_HUMAN)
VYIVRRNLF

SEQ ID NO: 172774 - protein, 9 aa, Artificial Sequence
  Description of Artificial Sequence: Synthetic peptide
  Seed: HEGPAFLTW (TYRP1_HUMAN)
HIGPAFLTF

SEQ ID NO: 172775 - protein, 9 aa, Artificial Sequence
  Description of Artificial Sequence: Synthetic peptide
  Seed: YLIRARRSM (TYRP1_HUMAN)
YSIRARRSL

SEQ ID NO: 172776 - protein, 9 aa, Artificial Sequence
  Description of Artificial Sequence: Synthetic peptide
  Seed: SLHNLAHLF (TYRP1_HUMAN)
SMHNLAHLI

SEQ ID NO: 172777 - protein, 11 aa, Artificial Sequence
  Description of Artificial Sequence: Synthetic peptide
  Seed: REFSVPEIIAI (TYRP1_HUMAN)
RAFSVPEIIAW

SEQ ID NO: 172778 - protein, 10 aa, Artificial Sequence
  Description of Artificial Sequence: Synthetic peptide
  Seed: YTYEIQWPSR (TYRP1_HUMAN)
YFYEIQWPSR

SEQ ID NO: 172779 - protein, 9 aa, Artificial Sequence
  Description of Artificial Sequence: Synthetic peptide
  Seed: FENISIYNY (TYRP1_HUMAN)
FKNISIYNY

SEQ ID NO: 172780 - protein, 10 aa, Artificial Sequence
  Description of Artificial Sequence: Synthetic peptide
  Seed: EIIAIAVVGA (TYRP1_HUMAN)
ELIAIAVVGV

SEQ ID NO: 172781 - protein, 10 aa, Artificial Sequence
  Description of Artificial Sequence: Synthetic peptide
  Seed: GLFDTPPFYS (TYRP1_HUMAN)
GTFDTPPFYV

SEQ ID NO: 172782 - protein, 9 aa, Artificial Sequence
  Description of Artificial Sequence: Synthetic peptide
  Seed: NYFVWTHYY (TYRP1_HUMAN)
NYFVWTHYR

SEQ ID NO: 172783 - protein, 9 aa, Artificial Sequence
  Description of Artificial Sequence: Synthetic peptide
  Seed: SVPEIIAIA (TYRP1_HUMAN)
SVPEIIAIR

SEQ ID NO: 172784 - protein, 10 aa, Artificial Sequence
  Description of Artificial Sequence: Synthetic peptide
  Seed: RRYNADISTF (TYRP1_HUMAN)
RCYNADISTI

SEQ ID NO: 172785 - protein, 10 aa, Artificial Sequence
  Description of Artificial Sequence: Synthetic peptide
  Seed: LIFGTASYLI (TYRP1_HUMAN)
LDFGTASYLF

SEQ ID NO: 172786 - protein, 11 aa, Artificial Sequence
  Description of Artificial Sequence: Synthetic peptide
  Seed: NYFVWTHYYSV (TYRP1_HUMAN)
NLFVWTHYYSL

SEQ ID NO: 172787 - protein, 9 aa, Artificial Sequence
  Description of Artificial Sequence: Synthetic peptide
  Seed: RTCHCNGNF (TYRP1_HUMAN)
RSCHCNGNW

SEQ ID NO: 172788 - protein, 9 aa, Artificial Sequence
  Description of Artificial Sequence: Synthetic peptide
  Seed: MSAPKLLSL (TYRP1_HUMAN)
MYAPKLLSL

SEQ ID NO: 172789 - protein, 9 aa, Artificial Sequence
  Description of Artificial Sequence: Synthetic peptide
  Seed: REVWPLRFF (TYRP1_HUMAN)
REVWPLRFV

SEQ ID NO: 172790 - protein, 10 aa, Artificial Sequence
  Description of Artificial Sequence: Synthetic peptide
  Seed: YNMVPFWPPV (TYRP1_HUMAN)
YEMVPFWPPV

SEQ ID NO: 172791 - protein, 10 aa, Artificial Sequence
  Description of Artificial Sequence: Synthetic peptide
  Seed: FWPPVTNTEM (TYRP1_HUMAN)
FCPPVTNTEM

SEQ ID NO: 172792 - protein, 9 aa, Artificial Sequence
  Description of Artificial Sequence: Synthetic peptide
  Seed: AVRSLHNLA (TYRP1_HUMAN)
AVRSLHNLL

SEQ ID NO: 172793 - protein, 10 aa, Artificial Sequence
  Description of Artificial Sequence: Synthetic peptide
  Seed: FSLPYWNFAT (TYRP1_HUMAN)
FLLPYWNFAM

SEQ ID NO: 172794 - protein, 11 aa, Artificial Sequence
  Description of Artificial Sequence: Synthetic peptide
  Seed: FVLLHTFTDAV (TYRP1_HUMAN)
FSLLHTFTDAV

SEQ ID NO: 172795 - protein, 11 aa, Artificial Sequence
  Description of Artificial Sequence: Synthetic peptide
  Seed: REFSVPEIIAI (TYRP1_HUMAN)
RMFSVPEIIAL

SEQ ID NO: 172796 - protein, 10 aa, Artificial Sequence
  Description of Artificial Sequence: Synthetic peptide
  Seed: RRYNADISTF (TYRP1_HUMAN)
RNYNADISTY

SEQ ID NO: 172797 - protein, 9 aa, Artificial Sequence
  Description of Artificial Sequence: Synthetic peptide
  Seed: AVVGALLLV (TYRP1_HUMAN)
AAVGALLLR

SEQ ID NO: 172798 - protein, 9 aa, Artificial Sequence
  Description of Artificial Sequence: Synthetic peptide
  Seed: TWHRYHLLR (TYRP1_HUMAN)
TFHRYHLLR

SEQ ID NO: 172799 - protein, 9 aa, Artificial Sequence
  Description of Artificial Sequence: Synthetic peptide
  Seed: FYSNSTNSF (TYRP1_HUMAN)
FVSNSTNSY

SEQ ID NO: 172800 - protein, 10 aa, Artificial Sequence
  Description of Artificial Sequence: Synthetic peptide
  Seed: FWPPVTNTEM (TYRP1_HUMAN)
FVPPVTNTEL

SEQ ID NO: 172801 - protein, 9 aa, Artificial Sequence
  Description of Artificial Sequence: Synthetic peptide
  Seed: LPYWNFATG (TYRP1_HUMAN)
LSYWNFATY

SEQ ID NO: 172802 - protein, 9 aa, Artificial Sequence
  Description of Artificial Sequence: Synthetic peptide
  Seed: MLQEPSFSL (TYRP1_HUMAN)
MMQEPSFSS

SEQ ID NO: 172803 - protein, 9 aa, Artificial Sequence
  Description of Artificial Sequence: Synthetic peptide
  Seed: TWHRYHLLR (TYRP1_HUMAN)
TMHRYHLLR

SEQ ID NO: 172804 - protein, 10 aa, Artificial Sequence
  Description of Artificial Sequence: Synthetic peptide
  Seed: ADSRPHSPQY (TYRP1_HUMAN)
AMSRPHSPQV

SEQ ID NO: 172805 - protein, 9 aa, Artificial Sequence
  Description of Artificial Sequence: Synthetic peptide
  Seed: SVKKTFLGV (TYRP1_HUMAN)
SAKKTFLGY

SEQ ID NO: 172806 - protein, 9 aa, Artificial Sequence
  Description of Artificial Sequence: Synthetic peptide
  Seed: LIFGTASYL (TYRP1_HUMAN)
LQFGTASYW

SEQ ID NO: 172807 - protein, 9 aa, Artificial Sequence
  Description of Artificial Sequence: Synthetic peptide
  Seed: AFLTWHRYH (TYRP1_HUMAN)
AYLTWHRYR

SEQ ID NO: 172808 - protein, 9 aa, Artificial Sequence
  Description of Artificial Sequence: Synthetic peptide
  Seed: APIGHNRQY (TYRP1_HUMAN)
APIGHNRQL

SEQ ID NO: 172809 - protein, 9 aa, Artificial Sequence
  Description of Artificial Sequence: Synthetic peptide
  Seed: SMDEANQPL (TYRP1_HUMAN)
SRDEANQPL

SEQ ID NO: 172810 - protein, 9 aa, Artificial Sequence
  Description of Artificial Sequence: Synthetic peptide
  Seed: HYYSVKKTF (TYRP1_HUMAN)
HHYSVKKTL

SEQ ID NO: 172811 - protein, 9 aa, Artificial Sequence
  Description of Artificial Sequence: Synthetic peptide
  Seed: HPLFVIATR (TYRP1_HUMAN)
HTLFVIATK

SEQ ID NO: 172812 - protein, 9 aa, Artificial Sequence
  Description of Artificial Sequence: Synthetic peptide
  Seed: RRNPAGNVA (TYRP1_HUMAN)
RFNPAGNVL

SEQ ID NO: 172813 - protein, 9 aa, Artificial Sequence
  Description of Artificial Sequence: Synthetic peptide
  Seed: VFDEWLRRY (TYRP1_HUMAN)
VMDEWLRRL

SEQ ID NO: 172814 - protein, 9 aa, Artificial Sequence
  Description of Artificial Sequence: Synthetic peptide
  Seed: FVWTHYYSV (TYRP1_HUMAN)
FQWTHYYSY

SEQ ID NO: 172815 - protein, 9 aa, Artificial Sequence
  Description of Artificial Sequence: Synthetic peptide
  Seed: AQFPRQCAT (TYRP1_HUMAN)
AFFPRQCAY

SEQ ID NO: 172816 - protein, 9 aa, Artificial Sequence
  Description of Artificial Sequence: Synthetic peptide
  Seed: FSLPYWNFA (TYRP1_HUMAN)
FSLPYWNFV

SEQ ID NO: 172817 - protein, 9 aa, Artificial Sequence
  Description of Artificial Sequence: Synthetic peptide
  Seed: AVVGALLLV (TYRP1_HUMAN)
ALVGALLLI

SEQ ID NO: 172818 - protein, 10 aa, Artificial Sequence
  Description of Artificial Sequence: Synthetic peptide
  Seed: SQWRVVCDSL (TYRP1_HUMAN)
SRWRVVCDSF

SEQ ID NO: 172819 - protein, 9 aa, Artificial Sequence
  Description of Artificial Sequence: Synthetic peptide
  Seed: LSPNDPIFV (TYRP1_HUMAN)
LVPNDPIFL

SEQ ID NO: 172820 - protein, 9 aa, Artificial Sequence
  Description of Artificial Sequence: Synthetic peptide
  Seed: QCATVEALR (TYRP1_HUMAN)
QTATVEALY

SEQ ID NO: 172821 - protein, 10 aa, Artificial Sequence
  Description of Artificial Sequence: Synthetic peptide
  Seed: YNYFVWTHYY (TYRP1_HUMAN)
YDYFVWTHYR

SEQ ID NO: 172822 - protein, 9 aa, Artificial Sequence
  Description of Artificial Sequence: Synthetic peptide
  Seed: HLSPNDPIF (TYRP1_HUMAN)
HHSPNDPIY

SEQ ID NO: 172823 - protein, 11 aa, Artificial Sequence
  Description of Artificial Sequence: Synthetic peptide
  Seed: YNYFVWTHYYS (TYRP1_HUMAN)
YMYFVWTHYYW

SEQ ID NO: 172824 - protein, 8 aa, Artificial Sequence
  Description of Artificial Sequence: Synthetic peptide
  Seed: ALLLVALI (TYRP1_HUMAN)
AQLLVALI

SEQ ID NO: 172825 - protein, 11 aa, Artificial Sequence
  Description of Artificial Sequence: Synthetic peptide
  Seed: IYNYFVWTHYY (TYRP1_HUMAN)
IYNYFVWTHYM

SEQ ID NO: 172826 - protein, 10 aa, Artificial Sequence
  Description of Artificial Sequence: Synthetic peptide
  Seed: LSLGCIFFPL (TYRP1_HUMAN)
LFLGCIFFPV

SEQ ID NO: 172827 - protein, 10 aa, Artificial Sequence
  Description of Artificial Sequence: Synthetic peptide
  Seed: YNYFVWTHYY (TYRP1_HUMAN)
YFYFVWTHYN

SEQ ID NO: 172828 - protein, 10 aa, Artificial Sequence
  Description of Artificial Sequence: Synthetic peptide
  Seed: HPLFVIATRR (TYRP1_HUMAN)
HSLFVIATRR

SEQ ID NO: 172829 - protein, 9 aa, Artificial Sequence
  Description of Artificial Sequence: Synthetic peptide
  Seed: AKRTTHPLF (TYRP1_HUMAN)
ALRTTHPLF

SEQ ID NO: 172830 - protein, 9 aa, Artificial Sequence
  Description of Artificial Sequence: Synthetic peptide
  Seed: FVWTHYYSV (TYRP1_HUMAN)
FVWTHYYSI

SEQ ID NO: 172831 - protein, 9 aa, Artificial Sequence
  Description of Artificial Sequence: Synthetic peptide
  Seed: SVPEIIAIA (TYRP1_HUMAN)
SLPEIIAIV

SEQ ID NO: 172832 - protein, 11 aa, Artificial Sequence
  Description of Artificial Sequence: Synthetic peptide
  Seed: YFVWTHYYSVK (TYRP1_HUMAN)
YSVWTHYYSVK

SEQ ID NO: 172833 - protein, 9 aa, Artificial Sequence
  Description of Artificial Sequence: Synthetic peptide
  Seed: QQARAQFPR (TYRP1_HUMAN)
QIARAQFPR

SEQ ID NO: 172834 - protein, 10 aa, Artificial Sequence
  Description of Artificial Sequence: Synthetic peptide
  Seed: FQQARAQFPR (TYRP1_HUMAN)
FMQARAQFPR

SEQ ID NO: 172835 - protein, 9 aa, Artificial Sequence
  Description of Artificial Sequence: Synthetic peptide
  Seed: STLISPNSV (TYRP1_HUMAN)
SQLISPNSL

SEQ ID NO: 172836 - protein, 9 aa, Artificial Sequence
  Description of Artificial Sequence: Synthetic peptide
  Seed: SLHNLAHLF (TYRP1_HUMAN)
SYHNLAHLF

SEQ ID NO: 172837 - protein, 9 aa, Artificial Sequence
  Description of Artificial Sequence: Synthetic peptide
  Seed: MSAPKLLSL (TYRP1_HUMAN)
MKAPKLLSY

SEQ ID NO: 172838 - protein, 9 aa, Artificial Sequence
  Description of Artificial Sequence: Synthetic peptide
  Seed: ACDQRVLIV (TYRP1_HUMAN)
AYDQRVLII

SEQ ID NO: 172839 - protein, 10 aa, Artificial Sequence
  Description of Artificial Sequence: Synthetic peptide
  Seed: MLQEPSFSLP (TYRP1_HUMAN)
MMQEPSFSLA

SEQ ID NO: 172840 - protein, 10 aa, Artificial Sequence
  Description of Artificial Sequence: Synthetic peptide
  Seed: TASYLIRARR (TYRP1_HUMAN)
TFSYLIRARR

SEQ ID NO: 172841 - protein, 11 aa, Artificial Sequence
  Description of Artificial Sequence: Synthetic peptide
  Seed: YNYFVWTHYYS (TYRP1_HUMAN)
YFYFVWTHYYE

SEQ ID NO: 172842 - protein, 8 aa, Artificial Sequence
  Description of Artificial Sequence: Synthetic peptide
  Seed: LEKDMQEM (TYRP1_HUMAN)
LEKDMQEL

SEQ ID NO: 172843 - protein, 9 aa, Artificial Sequence
  Description of Artificial Sequence: Synthetic peptide
  Seed: HPLFVIATR (TYRP1_HUMAN)
HALFVIATR

SEQ ID NO: 172844 - protein, 9 aa, Artificial Sequence
  Description of Artificial Sequence: Synthetic peptide
  Seed: LQNPNQSVV (TYRP1_HUMAN)
LANPNQSVL

SEQ ID NO: 172845 - protein, 10 aa, Artificial Sequence
  Description of Artificial Sequence: Synthetic peptide
  Seed: LGPDGNTPQF (TYRP1_HUMAN)
LKPDGNTPQY

SEQ ID NO: 172846 - protein, 9 aa, Artificial Sequence
  Description of Artificial Sequence: Synthetic peptide
  Seed: ENISIYNYF (TYRP1_HUMAN)
EVISIYNYM

SEQ ID NO: 172847 - protein, 10 aa, Artificial Sequence
  Description of Artificial Sequence: Synthetic peptide
  Seed: TTHPLFVIAT (TYRP1_HUMAN)
TVHPLFVIAV

SEQ ID NO: 172848 - protein, 9 aa, Artificial Sequence
  Description of Artificial Sequence: Synthetic peptide
  Seed: REFSVPEII (TYRP1_HUMAN)
RMFSVPEIV

SEQ ID NO: 172849 - protein, 10 aa, Artificial Sequence
  Description of Artificial Sequence: Synthetic peptide
  Seed: FSLPYWNFAT (TYRP1_HUMAN)
FQLPYWNFAI

SEQ ID NO: 172850 - protein, 11 aa, Artificial Sequence
  Description of Artificial Sequence: Synthetic peptide
  Seed: FVLLHTFTDAV (TYRP1_HUMAN)
FCLLHTFTDAL

SEQ ID NO: 172851 - protein, 11 aa, Artificial Sequence
  Description of Artificial Sequence: Synthetic peptide
  Seed: RYNADISTFPL (TYRP1_HUMAN)
RFNADISTFPF

SEQ ID NO: 172852 - protein, 10 aa, Artificial Sequence
  Description of Artificial Sequence: Synthetic peptide
  Seed: IAVVGALLLV (TYRP1_HUMAN)
IMVVGALLLI

SEQ ID NO: 172853 - protein, 8 aa, Artificial Sequence
  Description of Artificial Sequence: Synthetic peptide
  Seed: FSHEGPAF (TYRP1_HUMAN)
FTHEGPAM

SEQ ID NO: 172854 - protein, 10 aa, Artificial Sequence
  Description of Artificial Sequence: Synthetic peptide
  Seed: GLFDTPPFYS (TYRP1_HUMAN)
GIFDTPPFYM

SEQ ID NO: 172855 - protein, 11 aa, Artificial Sequence
  Description of Artificial Sequence: Synthetic peptide
  Seed: QYNMVPFWPPV (TYRP1_HUMAN)
QLNMVPFWPPV

SEQ ID NO: 172856 - protein, 9 aa, Artificial Sequence
  Description of Artificial Sequence: Synthetic peptide
  Seed: FYSNSTNSF (TYRP1_HUMAN)
FLSNSTNSF

SEQ ID NO: 172857 - protein, 9 aa, Artificial Sequence
  Description of Artificial Sequence: Synthetic peptide
  Seed: GTASYLIRA (TYRP1_HUMAN)
GMASYLIRA

SEQ ID NO: 172858 - protein, 10 aa, Artificial Sequence
  Description of Artificial Sequence: Synthetic peptide
  Seed: THPLFVIATR (TYRP1_HUMAN)
TSPLFVIATK

SEQ ID NO: 172859 - protein, 10 aa, Artificial Sequence
  Description of Artificial Sequence: Synthetic peptide
  Seed: YNYFVWTHYY (TYRP1_HUMAN)
YVYFVWTHYL

SEQ ID NO: 172860 - protein, 9 aa, Artificial Sequence
  Description of Artificial Sequence: Synthetic peptide
  Seed: AFLTWHRYH (TYRP1_HUMAN)
ATLTWHRYR

SEQ ID NO: 172861 - protein, 9 aa, Artificial Sequence
  Description of Artificial Sequence: Synthetic peptide
  Seed: LQNPNQSVV (TYRP1_HUMAN)
LMNPNQSVL

SEQ ID NO: 172862 - protein, 9 aa, Artificial Sequence
  Description of Artificial Sequence: Synthetic peptide
  Seed: FSLPYWNFA (TYRP1_HUMAN)
FLLPYWNFS

SEQ ID NO: 172863 - protein, 9 aa, Artificial Sequence
  Description of Artificial Sequence: Synthetic peptide
  Seed: LTDQYQCYA (TYRP1_HUMAN)
LGDQYQCYL

SEQ ID NO: 172864 - protein, 9 aa, Artificial Sequence
  Description of Artificial Sequence: Synthetic peptide
  Seed: LIFGTASYL (TYRP1_HUMAN)
LSFGTASYI

SEQ ID NO: 172865 - protein, 9 aa, Artificial Sequence
  Description of Artificial Sequence: Synthetic peptide
  Seed: WHRYHLLRL (TYRP1_HUMAN)
WRRYHLLRL

SEQ ID NO: 172866 - protein, 10 aa, Artificial Sequence
  Description of Artificial Sequence: Synthetic peptide
  Seed: YFVWTHYYSV (TYRP1_HUMAN)
YYVWTHYYSY

SEQ ID NO: 172867 - protein, 9 aa, Artificial Sequence
  Description of Artificial Sequence: Synthetic peptide
  Seed: YTYEIQWPS (TYRP1_HUMAN)
YIYEIQWPV

SEQ ID NO: 172868 - protein, 8 aa, Artificial Sequence
  Description of Artificial Sequence: Synthetic peptide
  Seed: LIFGTASY (TYRP1_HUMAN)
LMFGTASF

SEQ ID NO: 172869 - protein, 9 aa, Artificial Sequence
  Description of Artificial Sequence: Synthetic peptide
  Seed: TADSRPHSP (TYRP1_HUMAN)
TQDSRPHSF

SEQ ID NO: 172870 - protein, 10 aa, Artificial Sequence
  Description of Artificial Sequence: Synthetic peptide
  Seed: FQQARAQFPR (TYRP1_HUMAN)
FAQARAQFPR

SEQ ID NO: 172871 - protein, 9 aa, Artificial Sequence
  Description of Artificial Sequence: Synthetic peptide
  Seed: VFDEWLRRY (TYRP1_HUMAN)
VMDEWLRRM

SEQ ID NO: 172872 - protein, 10 aa, Artificial Sequence
  Description of Artificial Sequence: Synthetic peptide
  Seed: VDFSHEGPAF (TYRP1_HUMAN)
VVFSHEGPAY

SEQ ID NO: 172873 - protein, 10 aa, Artificial Sequence
  Description of Artificial Sequence: Synthetic peptide
  Seed: KLLSLGCIFF (TYRP1_HUMAN)
KILSLGCIFW

SEQ ID NO: 172874 - protein, 10 aa, Artificial Sequence
  Description of Artificial Sequence: Synthetic peptide
  Seed: MAKRTTHPLF (TYRP1_HUMAN)
MPKRTTHPLF

SEQ ID NO: 172875 - protein, 9 aa, Artificial Sequence
  Description of Artificial Sequence: Synthetic peptide
  Seed: SLHNLAHLF (TYRP1_HUMAN)
SMHNLAHLM

SEQ ID NO: 172876 - protein, 9 aa, Artificial Sequence
  Description of Artificial Sequence: Synthetic peptide
  Seed: SFSLPYWNF (TYRP1_HUMAN)
SYSLPYWNI

SEQ ID NO: 172877 - protein, 8 aa, Artificial Sequence
  Description of Artificial Sequence: Synthetic peptide
  Seed: SAPKLLSL (TYRP1_HUMAN)
SFPKLLSL

SEQ ID NO: 172878 - protein, 9 aa, Artificial Sequence
  Description of Artificial Sequence: Synthetic peptide
  Seed: NADISTFPL (TYRP1_HUMAN)
NSDISTFPY

SEQ ID NO: 172879 - protein, 10 aa, Artificial Sequence
  Description of Artificial Sequence: Synthetic peptide
  Seed: AEEYEKLQNP (TYRP1_HUMAN)
AEEYEKLQNV

SEQ ID NO: 172880 - protein, 9 aa, Artificial Sequence
  Description of Artificial Sequence: Synthetic peptide
  Seed: SMDEANQPL (TYRP1_HUMAN)
SMDEANQPF

SEQ ID NO: 172881 - protein, 9 aa, Artificial Sequence
  Description of Artificial Sequence: Synthetic peptide
  Seed: STNSFRNTV (TYRP1_HUMAN)
SGNSFRNTM

SEQ ID NO: 172882 - protein, 9 aa, Artificial Sequence
  Description of Artificial Sequence: Synthetic peptide
  Seed: YTYEIQWPS (TYRP1_HUMAN)
YAYEIQWPM

SEQ ID NO: 172883 - protein, 10 aa, Artificial Sequence
  Description of Artificial Sequence: Synthetic peptide
  Seed: MAKRTTHPLF (TYRP1_HUMAN)
MPKRTTHPLY

SEQ ID NO: 172884 - protein, 11 aa, Artificial Sequence
  Description of Artificial Sequence: Synthetic peptide
  Seed: NYFVWTHYYSV (TYRP1_HUMAN)
NLFVWTHYYSI

SEQ ID NO: 172885 - protein, 9 aa, Artificial Sequence
  Description of Artificial Sequence: Synthetic peptide
  Seed: DDREVWPLR (TYRP1_HUMAN)
DAREVWPLR

SEQ ID NO: 172886 - protein, 9 aa, Artificial Sequence
  Description of Artificial Sequence: Synthetic peptide
  Seed: NYFVWTHYY (TYRP1_HUMAN)
NDFVWTHYY

SEQ ID NO: 172887 - protein, 10 aa, Artificial Sequence
  Description of Artificial Sequence: Synthetic peptide
  Seed: FGTASYLIRA (TYRP1_HUMAN)
FQTASYLIRV

SEQ ID NO: 172888 - protein, 9 aa, Artificial Sequence
  Description of Artificial Sequence: Synthetic peptide
  Seed: VWPLRFFNR (TYRP1_HUMAN)
VLPLRFFNR

SEQ ID NO: 172889 - protein, 10 aa, Artificial Sequence
  Description of Artificial Sequence: Synthetic peptide
  Seed: FWPPVTNTEM (TYRP1_HUMAN)
FVPPVTNTEV

SEQ ID NO: 172890 - protein, 10 aa, Artificial Sequence
  Description of Artificial Sequence: Synthetic peptide
  Seed: EMLQEPSFSL (TYRP1_HUMAN)
EWLQEPSFSV

SEQ ID NO: 172891 - protein, 10 aa, Artificial Sequence
  Description of Artificial Sequence: Synthetic peptide
  Seed: LSLGCIFFPL (TYRP1_HUMAN)
LMLGCIFFPI

SEQ ID NO: 172892 - protein, 9 aa, Artificial Sequence
  Description of Artificial Sequence: Synthetic peptide
  Seed: NFDSTLISP (TYRP1_HUMAN)
NFDSTLISM

SEQ ID NO: 172893 - protein, 9 aa, Artificial Sequence
  Description of Artificial Sequence: Synthetic peptide
  Seed: RRNPAGNVA (TYRP1_HUMAN)
RANPAGNVL

SEQ ID NO: 172894 - protein, 9 aa, Artificial Sequence
  Description of Artificial Sequence: Synthetic peptide
  Seed: RQCATVEAL (TYRP1_HUMAN)
RTCATVEAI

SEQ ID NO: 172895 - protein, 9 aa, Artificial Sequence
  Description of Artificial Sequence: Synthetic peptide
  Seed: YSNSTNSFR (TYRP1_HUMAN)
YTNSTNSFY

SEQ ID NO: 172896 - protein, 11 aa, Artificial Sequence
  Description of Artificial Sequence: Synthetic peptide
  Seed: RRSMDEANQPL (TYRP1_HUMAN)
RTSMDEANQPV

SEQ ID NO: 172897 - protein, 10 aa, Artificial Sequence
  Description of Artificial Sequence: Synthetic peptide
  Seed: NMVPFWPPVT (TYRP1_HUMAN)
NLVPFWPPVL

SEQ ID NO: 172898 - protein, 9 aa, Artificial Sequence
  Description of Artificial Sequence: Synthetic peptide
  Seed: KYDPAVRSL (TYRP1_HUMAN)
KFDPAVRSC

SEQ ID NO: 172899 - protein, 9 aa, Artificial Sequence
  Description of Artificial Sequence: Synthetic peptide
  Seed: RFFNRTCHC (TYRP1_HUMAN)
RVFNRTCHG

SEQ ID NO: 172900 - protein, 9 aa, Artificial Sequence
  Description of Artificial Sequence: Synthetic peptide
  Seed: RQYNMVPFW (TYRP1_HUMAN)
RYYNMVPFW

SEQ ID NO: 172901 - protein, 9 aa, Artificial Sequence
  Description of Artificial Sequence: Synthetic peptide
  Seed: RARRSMDEA (TYRP1_HUMAN)
RLRRSMDEV

SEQ ID NO: 172902 - protein, 10 aa, Artificial Sequence
  Description of Artificial Sequence: Synthetic peptide
  Seed: KRTTHPLFVI (TYRP1_HUMAN)
KDTTHPLFVY

SEQ ID NO: 172903 - protein, 11 aa, Artificial Sequence
  Description of Artificial Sequence: Synthetic peptide
  Seed: RRYNADISTFP (TYRP1_HUMAN)
RYYNADISTFV

SEQ ID NO: 172904 - protein, 9 aa, Artificial Sequence
  Description of Artificial Sequence: Synthetic peptide
  Seed: RFFNRTCHC (TYRP1_HUMAN)
RFFNRTCHK

SEQ ID NO: 172905 - protein, 10 aa, Artificial Sequence
  Description of Artificial Sequence: Synthetic peptide
  Seed: TWHRYHLLRL (TYRP1_HUMAN)
TYHRYHLLRL

SEQ ID NO: 172906 - protein, 10 aa, Artificial Sequence
  Description of Artificial Sequence: Synthetic peptide
  Seed: FLNGTGGQTH (TYRP1_HUMAN)
FANGTGGQTY

SEQ ID NO: 172907 - protein, 10 aa, Artificial Sequence
  Description of Artificial Sequence: Synthetic peptide
  Seed: FSLPYWNFAT (TYRP1_HUMAN)
FLLPYWNFAF

SEQ ID NO: 172908 - protein, 9 aa, Artificial Sequence
  Description of Artificial Sequence: Synthetic peptide
  Seed: DLMGSRSNF (TYRP1_HUMAN)
DIMGSRSNW

SEQ ID NO: 172909 - protein, 10 aa, Artificial Sequence
  Description of Artificial Sequence: Synthetic peptide
  Seed: HRYHLLRLEK (TYRP1_HUMAN)
HRYHLLRLEM

SEQ ID NO: 172910 - protein, 9 aa, Artificial Sequence
  Description of Artificial Sequence: Synthetic peptide
  Seed: HEGPAFLTW (TYRP1_HUMAN)
HDGPAFLTV

SEQ ID NO: 172911 - protein, 9 aa, Artificial Sequence
  Description of Artificial Sequence: Synthetic peptide
  Seed: LTDQYQCYA (TYRP1_HUMAN)
LTDQYQCYV

SEQ ID NO: 172912 - protein, 9 aa, Artificial Sequence
  Description of Artificial Sequence: Synthetic peptide
  Seed: LFQQARAQF (TYRP1_HUMAN)
LAQQARAQL

SEQ ID NO: 172913 - protein, 10 aa, Artificial Sequence
  Description of Artificial Sequence: Synthetic peptide
  Seed: EIIAIAVVGA (TYRP1_HUMAN)
EMIAIAVVGV

SEQ ID NO: 172914 - protein, 10 aa, Artificial Sequence
  Description of Artificial Sequence: Synthetic peptide
  Seed: RSLHNLAHLF (TYRP1_HUMAN)
RYLHNLAHLI

SEQ ID NO: 172915 - protein, 9 aa, Artificial Sequence
  Description of Artificial Sequence: Synthetic peptide
  Seed: KLQNPNQSV (TYRP1_HUMAN)
KQQNPNQSV

SEQ ID NO: 172916 - protein, 9 aa, Artificial Sequence
  Description of Artificial Sequence: Synthetic peptide
  Seed: PNDPIFVLL (TYRP1_HUMAN)
PWDPIFVLM

SEQ ID NO: 172917 - protein, 8 aa, Artificial Sequence
  Description of Artificial Sequence: Synthetic peptide
  Seed: YDPAVRSL (TYRP1_HUMAN)
YSPAVRSF

SEQ ID NO: 172918 - protein, 11 aa, Artificial Sequence
  Description of Artificial Sequence: Synthetic peptide
  Seed: REVWPLRFFNR (TYRP1_HUMAN)
RWVWPLRFFNR

SEQ ID NO: 172919 - protein, 10 aa, Artificial Sequence
  Description of Artificial Sequence: Synthetic peptide
  Seed: LPYWNFATGK (TYRP1_HUMAN)
LCYWNFATGR

SEQ ID NO: 172920 - protein, 11 aa, Artificial Sequence
  Description of Artificial Sequence: Synthetic peptide
  Seed: RRYNADISTFP (TYRP1_HUMAN)
RYYNADISTFQ

SEQ ID NO: 172921 - protein, 9 aa, Artificial Sequence
  Description of Artificial Sequence: Synthetic peptide
  Seed: VTAPDNLGY (TYRP1_HUMAN)
VAAPDNLGK

SEQ ID NO: 172922 - protein, 9 aa, Artificial Sequence
  Description of Artificial Sequence: Synthetic peptide
  Seed: QEMLQEPSF (TYRP1_HUMAN)
QQMLQEPSL

SEQ ID NO: 172923 - protein, 10 aa, Artificial Sequence
  Description of Artificial Sequence: Synthetic peptide
  Seed: YNYFVWTHYY (TYRP1_HUMAN)
YTYFVWTHYQ

SEQ ID NO: 172924 - protein, 9 aa, Artificial Sequence
  Description of Artificial Sequence: Synthetic peptide
  Seed: SPNDPIFVL (TYRP1_HUMAN)
SRNDPIFVF

SEQ ID NO: 172925 - protein, 9 aa, Artificial Sequence
  Description of Artificial Sequence: Synthetic peptide
  Seed: MAKRTTHPL (TYRP1_HUMAN)
MSKRTTHPT

SEQ ID NO: 172926 - protein, 9 aa, Artificial Sequence
  Description of Artificial Sequence: Synthetic peptide
  Seed: FLTWHRYHL (TYRP1_HUMAN)
FSTWHRYHF

SEQ ID NO: 172927 - protein, 9 aa, Artificial Sequence
  Description of Artificial Sequence: Synthetic peptide
  Seed: FENISIYNY (TYRP1_HUMAN)
FKNISIYNF

SEQ ID NO: 172928 - protein, 11 aa, Artificial Sequence
  Description of Artificial Sequence: Synthetic peptide
  Seed: YNYFVWTHYYS (TYRP1_HUMAN)
YYYFVWTHYYF

SEQ ID NO: 172929 - protein, 8 aa, Artificial Sequence
  Description of Artificial Sequence: Synthetic peptide
  Seed: LIRARRSM (TYRP1_HUMAN)
LIRARRSL

SEQ ID NO: 172930 - protein, 9 aa, Artificial Sequence
  Description of Artificial Sequence: Synthetic peptide
  Seed: LFQQARAQF (TYRP1_HUMAN)
LYQQARAQM

SEQ ID NO: 172931 - protein, 9 aa, Artificial Sequence
  Description of Artificial Sequence: Synthetic peptide
  Seed: VFDEWLRRY (TYRP1_HUMAN)
VFDEWLRRL

SEQ ID NO: 172932 - protein, 10 aa, Artificial Sequence
  Description of Artificial Sequence: Synthetic peptide
  Seed: EGPAFLTWHR (TYRP1_HUMAN)
EFPAFLTWHR

SEQ ID NO: 172933 - protein, 11 aa, Artificial Sequence
  Description of Artificial Sequence: Synthetic peptide
  Seed: QEMLQEPSFSL (TYRP1_HUMAN)
QEMLQEPSFSF

SEQ ID NO: 172934 - protein, 10 aa, Artificial Sequence
  Description of Artificial Sequence: Synthetic peptide
  Seed: TFTDAVFDEW (TYRP1_HUMAN)
TTTDAVFDEW

SEQ ID NO: 172935 - protein, 9 aa, Artificial Sequence
  Description of Artificial Sequence: Synthetic peptide
  Seed: AVRSLHNLA (TYRP1_HUMAN)
ATRSLHNLF

SEQ ID NO: 172936 - protein, 9 aa, Artificial Sequence
  Description of Artificial Sequence: Synthetic peptide
  Seed: YTYEIQWPS (TYRP1_HUMAN)
YLYEIQWPF

SEQ ID NO: 172937 - protein, 10 aa, Artificial Sequence
  Description of Artificial Sequence: Synthetic peptide
  Seed: KRTTHPLFVI (TYRP1_HUMAN)
KFTTHPLFVY

SEQ ID NO: 172938 - protein, 9 aa, Artificial Sequence
  Description of Artificial Sequence: Synthetic peptide
  Seed: MSAPKLLSL (TYRP1_HUMAN)
MTAPKLLSI

SEQ ID NO: 172939 - protein, 9 aa, Artificial Sequence
  Description of Artificial Sequence: Synthetic peptide
  Seed: TTHPLFVIA (TYRP1_HUMAN)
TSHPLFVII

SEQ ID NO: 172940 - protein, 9 aa, Artificial Sequence
  Description of Artificial Sequence: Synthetic peptide
  Seed: FVWTHYYSV (TYRP1_HUMAN)
FPWTHYYSL

SEQ ID NO: 172941 - protein, 10 aa, Artificial Sequence
  Description of Artificial Sequence: Synthetic peptide
  Seed: FVTAPDNLGY (TYRP1_HUMAN)
FFTAPDNLGW

SEQ ID NO: 172942 - protein, 9 aa, Artificial Sequence
  Description of Artificial Sequence: Synthetic peptide
  Seed: RSLHNLAHL (TYRP1_HUMAN)
RQLHNLAHW

SEQ ID NO: 172943 - protein, 9 aa, Artificial Sequence
  Description of Artificial Sequence: Synthetic peptide
  Seed: SMDEANQPL (TYRP1_HUMAN)
SYDEANQPL

SEQ ID NO: 172944 - protein, 10 aa, Artificial Sequence
  Description of Artificial Sequence: Synthetic peptide
  Seed: TASYLIRARR (TYRP1_HUMAN)
TYSYLIRARR

SEQ ID NO: 172945 - protein, 10 aa, Artificial Sequence
  Description of Artificial Sequence: Synthetic peptide
  Seed: GKYDPAVRSL (TYRP1_HUMAN)
GSYDPAVRSY

SEQ ID NO: 172946 - protein, 11 aa, Artificial Sequence
  Description of Artificial Sequence: Synthetic peptide
  Seed: LVALIFGTASY (TYRP1_HUMAN)
LIALIFGTASY

SEQ ID NO: 172947 - protein, 10 aa, Artificial Sequence
  Description of Artificial Sequence: Synthetic peptide
  Seed: IAIAVVGALL (TYRP1_HUMAN)
ISIAVVGALF

SEQ ID NO: 172948 - protein, 9 aa, Artificial Sequence
  Description of Artificial Sequence: Synthetic peptide
  Seed: STNSFRNTV (TYRP1_HUMAN)
SLNSFRNTW

SEQ ID NO: 172949 - protein, 9 aa, Artificial Sequence
  Description of Artificial Sequence: Synthetic peptide
  Seed: AQFPRQCAT (TYRP1_HUMAN)
ALFPRQCAF

SEQ ID NO: 172950 - protein, 9 aa, Artificial Sequence
  Description of Artificial Sequence: Synthetic peptide
  Seed: RFFNRTCHC (TYRP1_HUMAN)
RVFNRTCHK

SEQ ID NO: 172951 - protein, 9 aa, Artificial Sequence
  Description of Artificial Sequence: Synthetic peptide
  Seed: LGCIFFPLL (TYRP1_HUMAN)
LMCIFFPLL

SEQ ID NO: 172952 - protein, 10 aa, Artificial Sequence
  Description of Artificial Sequence: Synthetic peptide
  Seed: TFLGVGQESF (TYRP1_HUMAN)
TYLGVGQESY

SEQ ID NO: 172953 - protein, 9 aa, Artificial Sequence
  Description of Artificial Sequence: Synthetic peptide
  Seed: FVWTHYYSV (TYRP1_HUMAN)
FAWTHYYSI

SEQ ID NO: 172954 - protein, 10 aa, Artificial Sequence
  Description of Artificial Sequence: Synthetic peptide
  Seed: KRTTHPLFVI (TYRP1_HUMAN)
KITTHPLFVW

SEQ ID NO: 172955 - protein, 10 aa, Artificial Sequence
  Description of Artificial Sequence: Synthetic peptide
  Seed: KLQNPNQSVV (TYRP1_HUMAN)
KLQNPNQSVF

SEQ ID NO: 172956 - protein, 10 aa, Artificial Sequence
  Description of Artificial Sequence: Synthetic peptide
  Seed: GLFDTPPFYS (TYRP1_HUMAN)
GMFDTPPFYT

SEQ ID NO: 172957 - protein, 9 aa, Artificial Sequence
  Description of Artificial Sequence: Synthetic peptide
  Seed: RPGWRGAAC (TYRP1_HUMAN)
RPGWRGAAW

SEQ ID NO: 172958 - protein, 9 aa, Artificial Sequence
  Description of Artificial Sequence: Synthetic peptide
  Seed: APIGHNRQY (TYRP1_HUMAN)
AAIGHNRQH

SEQ ID NO: 172959 - protein, 9 aa, Artificial Sequence
  Description of Artificial Sequence: Synthetic peptide
  Seed: GLFDTPPFY (TYRP1_HUMAN)
GAFDTPPFF

SEQ ID NO: 172960 - protein, 10 aa, Artificial Sequence
  Description of Artificial Sequence: Synthetic peptide
  Seed: LSPNDPIFVL (TYRP1_HUMAN)
LFPNDPIFVW

SEQ ID NO: 172961 - protein, 9 aa, Artificial Sequence
  Description of Artificial Sequence: Synthetic peptide
  Seed: VTAPDNLGY (TYRP1_HUMAN)
VPAPDNLGF

SEQ ID NO: 172962 - protein, 8 aa, Artificial Sequence
  Description of Artificial Sequence: Synthetic peptide
  Seed: ACDQRVLI (TYRP1_HUMAN)
ASDQRVLI

SEQ ID NO: 172963 - protein, 10 aa, Artificial Sequence
  Description of Artificial Sequence: Synthetic peptide
  Seed: ALIFGTASYL (TYRP1_HUMAN)
AAIFGTASYF

SEQ ID NO: 172964 - protein, 9 aa, Artificial Sequence
  Description of Artificial Sequence: Synthetic peptide
  Seed: GPDGNTPQF (TYRP1_HUMAN)
GLDGNTPQI

SEQ ID NO: 172965 - protein, 11 aa, Artificial Sequence
  Description of Artificial Sequence: Synthetic peptide
  Seed: LISPNSVFSQW (TYRP1_HUMAN)
LQSPNSVFSQL

SEQ ID NO: 172966 - protein, 9 aa, Artificial Sequence
  Description of Artificial Sequence: Synthetic peptide
  Seed: LIFGTASYL (TYRP1_HUMAN)
LFFGTASYI

SEQ ID NO: 172967 - protein, 10 aa, Artificial Sequence
  Description of Artificial Sequence: Synthetic peptide
  Seed: VALIFGTASY (TYRP1_HUMAN)
VMLIFGTASM

SEQ ID NO: 172968 - protein, 9 aa, Artificial Sequence
  Description of Artificial Sequence: Synthetic peptide
  Seed: FGTASYLIR (TYRP1_HUMAN)
FYTASYLIR

SEQ ID NO: 172969 - protein, 10 aa, Artificial Sequence
  Description of Artificial Sequence: Synthetic peptide
  Seed: VALIFGTASY (TYRP1_HUMAN)
VVLIFGTASF

SEQ ID NO: 172970 - protein, 10 aa, Artificial Sequence
  Description of Artificial Sequence: Synthetic peptide
  Seed: YNMVPFWPPV (TYRP1_HUMAN)
YCMVPFWPPV

SEQ ID NO: 172971 - protein, 10 aa, Artificial Sequence
  Description of Artificial Sequence: Synthetic peptide
  Seed: ADSRPHSPQY (TYRP1_HUMAN)
AKSRPHSPQV

SEQ ID NO: 172972 - protein, 9 aa, Artificial Sequence
  Description of Artificial Sequence: Synthetic peptide
  Seed: STNSFRNTV (TYRP1_HUMAN)
SQNSFRNTV

SEQ ID NO: 172973 - protein, 10 aa, Artificial Sequence
  Description of Artificial Sequence: Synthetic peptide
  Seed: FWPPVTNTEM (TYRP1_HUMAN)
FLPPVTNTEL

SEQ ID NO: 172974 - protein, 10 aa, Artificial Sequence
  Description of Artificial Sequence: Synthetic peptide
  Seed: QEPSFSLPYW (TYRP1_HUMAN)
QYPSFSLPYW

SEQ ID NO: 172975 - protein, 11 aa, Artificial Sequence
  Description of Artificial Sequence: Synthetic peptide
  Seed: HEGPAFLTWHR (TYRP1_HUMAN)
HIGPAFLTWHR

SEQ ID NO: 172976 - protein, 9 aa, Artificial Sequence
  Description of Artificial Sequence: Synthetic peptide
  Seed: RRNPAGNVA (TYRP1_HUMAN)
RRNPAGNVM

SEQ ID NO: 172977 - protein, 10 aa, Artificial Sequence
  Description of Artificial Sequence: Synthetic peptide
  Seed: TAPDNLGYTY (TYRP1_HUMAN)
TWPDNLGYTY

SEQ ID NO: 172978 - protein, 9 aa, Artificial Sequence
  Description of Artificial Sequence: Synthetic peptide
  Seed: HLSPNDPIF (TYRP1_HUMAN)
HKSPNDPIF

SEQ ID NO: 172979 - protein, 11 aa, Artificial Sequence
  Description of Artificial Sequence: Synthetic peptide
  Seed: REFSVPEIIAI (TYRP1_HUMAN)
RMFSVPEIIAY

SEQ ID NO: 172980 - protein, 10 aa, Artificial Sequence
  Description of Artificial Sequence: Synthetic peptide
  Seed: FVLLHTFTDA (TYRP1_HUMAN)
FCLLHTFTDL

SEQ ID NO: 172981 - protein, 9 aa, Artificial Sequence
  Description of Artificial Sequence: Synthetic peptide
  Seed: STLISPNSV (TYRP1_HUMAN)
SVLISPNSF

SEQ ID NO: 172982 - protein, 9 aa, Artificial Sequence
  Description of Artificial Sequence: Synthetic peptide
  Seed: FVWTHYYSV (TYRP1_HUMAN)
FAWTHYYSF

SEQ ID NO: 172983 - protein, 10 aa, Artificial Sequence
  Description of Artificial Sequence: Synthetic peptide
  Seed: ADSRPHSPQY (TYRP1_HUMAN)
ALSRPHSPQA

SEQ ID NO: 172984 - protein, 9 aa, Artificial Sequence
  Description of Artificial Sequence: Synthetic peptide
  Seed: YLIRARRSM (TYRP1_HUMAN)
YVIRARRSM

SEQ ID NO: 172985 - protein, 9 aa, Artificial Sequence
  Description of Artificial Sequence: Synthetic peptide
  Seed: SMDEANQPL (TYRP1_HUMAN)
SFDEANQPI

SEQ ID NO: 172986 - protein, 9 aa, Artificial Sequence
  Description of Artificial Sequence: Synthetic peptide
  Seed: RYNADISTF (TYRP1_HUMAN)
RSNADISTF

SEQ ID NO: 172987 - protein, 9 aa, Artificial Sequence
  Description of Artificial Sequence: Synthetic peptide
  Seed: SVPEIIAIA (TYRP1_HUMAN)
SQPEIIAIA

SEQ ID NO: 172988 - protein, 9 aa, Artificial Sequence
  Description of Artificial Sequence: Synthetic peptide
  Seed: TEMFVTAPD (TYRP1_HUMAN)
TEMFVTAPL

SEQ ID NO: 172989 - protein, 9 aa, Artificial Sequence
  Description of Artificial Sequence: Synthetic peptide
  Seed: NYFVWTHYY (TYRP1_HUMAN)
NEFVWTHYY

SEQ ID NO: 172990 - protein, 9 aa, Artificial Sequence
  Description of Artificial Sequence: Synthetic peptide
  Seed: FSLPYWNFA (TYRP1_HUMAN)
FMLPYWNFV

SEQ ID NO: 172991 - protein, 10 aa, Artificial Sequence
  Description of Artificial Sequence: Synthetic peptide
  Seed: YEIQWPSREF (TYRP1_HUMAN)
YHIQWPSREF

SEQ ID NO: 172992 - protein, 9 aa, Artificial Sequence
  Description of Artificial Sequence: Synthetic peptide
  Seed: YLIRARRSM (TYRP1_HUMAN)
YQIRARRSV

SEQ ID NO: 172993 - protein, 9 aa, Artificial Sequence
  Description of Artificial Sequence: Synthetic peptide
  Seed: HYYSVKKTF (TYRP1_HUMAN)
HGYSVKKTF

SEQ ID NO: 172994 - protein, 10 aa, Artificial Sequence
  Description of Artificial Sequence: Synthetic peptide
  Seed: FSLPYWNFAT (TYRP1_HUMAN)
FWLPYWNFAM

SEQ ID NO: 172995 - protein, 9 aa, Artificial Sequence
  Description of Artificial Sequence: Synthetic peptide
  Seed: REFSVPEII (TYRP1_HUMAN)
RQFSVPEIF

SEQ ID NO: 172996 - protein, 9 aa, Artificial Sequence
  Description of Artificial Sequence: Synthetic peptide
  Seed: YTYEIQWPS (TYRP1_HUMAN)
YPYEIQWPK

SEQ ID NO: 172997 - protein, 9 aa, Artificial Sequence
  Description of Artificial Sequence: Synthetic peptide
  Seed: FSVPEIIAI (TYRP1_HUMAN)
FNVPEIIAY

SEQ ID NO: 172998 - protein, 11 aa, Artificial Sequence
  Description of Artificial Sequence: Synthetic peptide
  Seed: LISPNSVFSQW (TYRP1_HUMAN)
LVSPNSVFSQF

SEQ ID NO: 172999 - protein, 9 aa, Artificial Sequence
  Description of Artificial Sequence: Synthetic peptide
  Seed: ENAPIGHNR (TYRP1_HUMAN)
EIAPIGHNM

SEQ ID NO: 173000 - protein, 9 aa, Artificial Sequence
  Description of Artificial Sequence: Synthetic peptide
  Seed: LTWHRYHLL (TYRP1_HUMAN)
LMWHRYHLT

SEQ ID NO: 173001 - protein, 10 aa, Artificial Sequence
  Description of Artificial Sequence: Synthetic peptide
  Seed: FSVPEIIAIA (TYRP1_HUMAN)
FDVPEIIAIV

SEQ ID NO: 173002 - protein, 9 aa, Artificial Sequence
  Description of Artificial Sequence: Synthetic peptide
  Seed: FSHEGPAFL (TYRP1_HUMAN)
FIHEGPAFV

SEQ ID NO: 173003 - protein, 11 aa, Artificial Sequence
  Description of Artificial Sequence: Synthetic peptide
  Seed: TDAVFDEWLRR (TYRP1_HUMAN)
TVAVFDEWLRR

SEQ ID NO: 173004 - protein, 9 aa, Artificial Sequence
  Description of Artificial Sequence: Synthetic peptide
  Seed: FSLPYWNFA (TYRP1_HUMAN)
FLLPYWNFL

SEQ ID NO: 173005 - protein, 10 aa, Artificial Sequence
  Description of Artificial Sequence: Synthetic peptide
  Seed: RSMDEANQPL (TYRP1_HUMAN)
RWMDEANQPI

SEQ ID NO: 173006 - protein, 10 aa, Artificial Sequence
  Description of Artificial Sequence: Synthetic peptide
  Seed: FENISIYNYF (TYRP1_HUMAN)
FENISIYNYW

SEQ ID NO: 173007 - protein, 9 aa, Artificial Sequence
  Description of Artificial Sequence: Synthetic peptide
  Seed: FLTWHRYHL (TYRP1_HUMAN)
FPTWHRYHM

SEQ ID NO: 173008 - protein, 10 aa, Artificial Sequence
  Description of Artificial Sequence: Synthetic peptide
  Seed: FGTASYLIRA (TYRP1_HUMAN)
FLTASYLIRA

SEQ ID NO: 173009 - protein, 10 aa, Artificial Sequence
  Description of Artificial Sequence: Synthetic peptide
  Seed: FGTASYLIRA (TYRP1_HUMAN)
FQTASYLIRA

SEQ ID NO: 173010 - protein, 10 aa, Artificial Sequence
  Description of Artificial Sequence: Synthetic peptide
  Seed: LSLGCIFFPL (TYRP1_HUMAN)
LQLGCIFFPI

SEQ ID NO: 173011 - protein, 9 aa, Artificial Sequence
  Description of Artificial Sequence: Synthetic peptide
  Seed: MLQEPSFSL (TYRP1_HUMAN)
MGQEPSFSY

SEQ ID NO: 173012 - protein, 9 aa, Artificial Sequence
  Description of Artificial Sequence: Synthetic peptide
  Seed: HYYSVKKTF (TYRP1_HUMAN)
HYYSVKKTW

SEQ ID NO: 173013 - protein, 9 aa, Artificial Sequence
  Description of Artificial Sequence: Synthetic peptide
  Seed: MLQEPSFSL (TYRP1_HUMAN)
MRQEPSFSI

SEQ ID NO: 173014 - protein, 11 aa, Artificial Sequence
  Description of Artificial Sequence: Synthetic peptide
  Seed: REFSVPEIIAI (TYRP1_HUMAN)
RMFSVPEIIAW

SEQ ID NO: 173015 - protein, 10 aa, Artificial Sequence
  Description of Artificial Sequence: Synthetic peptide
  Seed: YSVKKTFLGV (TYRP1_HUMAN)
YVVKKTFLGV

SEQ ID NO: 173016 - protein, 10 aa, Artificial Sequence
  Description of Artificial Sequence: Synthetic peptide
  Seed: FVTAPDNLGY (TYRP1_HUMAN)
FRTAPDNLGW

SEQ ID NO: 173017 - protein, 9 aa, Artificial Sequence
  Description of Artificial Sequence: Synthetic peptide
  Seed: KLQNPNQSV (TYRP1_HUMAN)
KAQNPNQSL

SEQ ID NO: 173018 - protein, 9 aa, Artificial Sequence
  Description of Artificial Sequence: Synthetic peptide
  Seed: RYNADISTF (TYRP1_HUMAN)
RQNADISTI

SEQ ID NO: 173019 - protein, 9 aa, Artificial Sequence
  Description of Artificial Sequence: Synthetic peptide
  Seed: IAIAVVGAL (TYRP1_HUMAN)
IVIAVVGAL

SEQ ID NO: 173020 - protein, 9 aa, Artificial Sequence
  Description of Artificial Sequence: Synthetic peptide
  Seed: AIAVVGALL (TYRP1_HUMAN)
ALAVVGALF

SEQ ID NO: 173021 - protein, 9 aa, Artificial Sequence
  Description of Artificial Sequence: Synthetic peptide
  Seed: TFPLENAPI (TYRP1_HUMAN)
TYPLENAPM

SEQ ID NO: 173022 - protein, 9 aa, Artificial Sequence
  Description of Artificial Sequence: Synthetic peptide
  Seed: MSAPKLLSL (TYRP1_HUMAN)
MVAPKLLSV

SEQ ID NO: 173023 - protein, 10 aa, Artificial Sequence
  Description of Artificial Sequence: Synthetic peptide
  Seed: SPNDPIFVLL (TYRP1_HUMAN)
SVNDPIFVLL

SEQ ID NO: 173024 - protein, 9 aa, Artificial Sequence
  Description of Artificial Sequence: Synthetic peptide
  Seed: LHNLAHLFL (TYRP1_HUMAN)
LMNLAHLFL

SEQ ID NO: 173025 - protein, 9 aa, Artificial Sequence
  Description of Artificial Sequence: Synthetic peptide
  Seed: SLHNLAHLF (TYRP1_HUMAN)
SAHNLAHLY

SEQ ID NO: 173026 - protein, 9 aa, Artificial Sequence
  Description of Artificial Sequence: Synthetic peptide
  Seed: LQNPNQSVV (TYRP1_HUMAN)
LMNPNQSVM

SEQ ID NO: 173027 - protein, 10 aa, Artificial Sequence
  Description of Artificial Sequence: Synthetic peptide
  Seed: WPPVTNTEMF (TYRP1_HUMAN)
WWPVTNTEMW

SEQ ID NO: 173028 - protein, 10 aa, Artificial Sequence
  Description of Artificial Sequence: Synthetic peptide
  Seed: AVFDEWLRRY (TYRP1_HUMAN)
AIFDEWLRRR

SEQ ID NO: 173029 - protein, 9 aa, Artificial Sequence
  Description of Artificial Sequence: Synthetic peptide
  Seed: YTYEIQWPS (TYRP1_HUMAN)
YIYEIQWPF

SEQ ID NO: 173030 - protein, 9 aa, Artificial Sequence
  Description of Artificial Sequence: Synthetic peptide
  Seed: SPNDPIFVL (TYRP1_HUMAN)
SRNDPIFVL

SEQ ID NO: 173031 - protein, 10 aa, Artificial Sequence
  Description of Artificial Sequence: Synthetic peptide
  Seed: RSMDEANQPL (TYRP1_HUMAN)
RNMDEANQPL

SEQ ID NO: 173032 - protein, 10 aa, Artificial Sequence
  Description of Artificial Sequence: Synthetic peptide
  Seed: RSLHNLAHLF (TYRP1_HUMAN)
RRLHNLAHLY

SEQ ID NO: 173033 - protein, 9 aa, Artificial Sequence
  Description of Artificial Sequence: Synthetic peptide
  Seed: MSAPKLLSL (TYRP1_HUMAN)
MTAPKLLSV

SEQ ID NO: 173034 - protein, 11 aa, Artificial Sequence
  Description of Artificial Sequence: Synthetic peptide
  Seed: YNYFVWTHYYS (TYRP1_HUMAN)
YMYFVWTHYYH

SEQ ID NO: 173035 - protein, 9 aa, Artificial Sequence
  Description of Artificial Sequence: Synthetic peptide
  Seed: YNYFVWTHY (TYRP1_HUMAN)
YVYFVWTHR

SEQ ID NO: 173036 - protein, 9 aa, Artificial Sequence
  Description of Artificial Sequence: Synthetic peptide
  Seed: NYFVWTHYY (TYRP1_HUMAN)
NRFVWTHYV

SEQ ID NO: 173037 - protein, 9 aa, Artificial Sequence
  Description of Artificial Sequence: Synthetic peptide
  Seed: WHRYHLLRL (TYRP1_HUMAN)
WYRYHLLRM

SEQ ID NO: 173038 - protein, 9 aa, Artificial Sequence
  Description of Artificial Sequence: Synthetic peptide
  Seed: MSAPKLLSL (TYRP1_HUMAN)
MNAPKLLSM

SEQ ID NO: 173039 - protein, 9 aa, Artificial Sequence
  Description of Artificial Sequence: Synthetic peptide
  Seed: KLQNPNQSV (TYRP1_HUMAN)
KLQNPNQSF

SEQ ID NO: 173040 - protein, 10 aa, Artificial Sequence
  Description of Artificial Sequence: Synthetic peptide
  Seed: VGLFDTPPFY (TYRP1_HUMAN)
VSLFDTPPFY

SEQ ID NO: 173041 - protein, 10 aa, Artificial Sequence
  Description of Artificial Sequence: Synthetic peptide
  Seed: SIYNYFVWTH (TYRP1_HUMAN)
SYYNYFVWTR

SEQ ID NO: 173042 - protein, 11 aa, Artificial Sequence
  Description of Artificial Sequence: Synthetic peptide
  Seed: YNMVPFWPPVT (TYRP1_HUMAN)
YLMVPFWPPVL

SEQ ID NO: 173043 - protein, 10 aa, Artificial Sequence
  Description of Artificial Sequence: Synthetic peptide
  Seed: YNADISTFPL (TYRP1_HUMAN)
YVADISTFPI

SEQ ID NO: 173044 - protein, 9 aa, Artificial Sequence
  Description of Artificial Sequence: Synthetic peptide
  Seed: HYYSVKKTF (TYRP1_HUMAN)
HTYSVKKTV

SEQ ID NO: 173045 - protein, 9 aa, Artificial Sequence
  Description of Artificial Sequence: Synthetic peptide
  Seed: IVRRNLLDL (TYRP1_HUMAN)
IVRRNLLDK

SEQ ID NO: 173046 - protein, 10 aa, Artificial Sequence
  Description of Artificial Sequence: Synthetic peptide
  Seed: RRYNADISTF (TYRP1_HUMAN)
RDYNADISTL

SEQ ID NO: 173047 - protein, 9 aa, Artificial Sequence
  Description of Artificial Sequence: Synthetic peptide
  Seed: NISIYNYFV (TYRP1_HUMAN)
NMSIYNYFM

SEQ ID NO: 173048 - protein, 11 aa, Artificial Sequence
  Description of Artificial Sequence: Synthetic peptide
  Seed: KTFLGVGQESF (TYRP1_HUMAN)
KLFLGVGQESW

SEQ ID NO: 173049 - protein, 9 aa, Artificial Sequence
  Description of Artificial Sequence: Synthetic peptide
  Seed: FSHEGPAFL (TYRP1_HUMAN)
FMHEGPAFC

SEQ ID NO: 173050 - protein, 11 aa, Artificial Sequence
  Description of Artificial Sequence: Synthetic peptide
  Seed: MSAPKLLSLGC (TYRP1_HUMAN)
MAAPKLLSLGF

SEQ ID NO: 173051 - protein, 9 aa, Artificial Sequence
  Description of Artificial Sequence: Synthetic peptide
  Seed: CIFFPLLLF (TYRP1_HUMAN)
CYFFPLLLY

SEQ ID NO: 173052 - protein, 9 aa, Artificial Sequence
  Description of Artificial Sequence: Synthetic peptide
  Seed: TASYLIRAR (TYRP1_HUMAN)
TTSYLIRAR

SEQ ID NO: 173053 - protein, 9 aa, Artificial Sequence
  Description of Artificial Sequence: Synthetic peptide
  Seed: AACDQRVLI (TYRP1_HUMAN)
AMCDQRVLI

SEQ ID NO: 173054 - protein, 10 aa, Artificial Sequence
  Description of Artificial Sequence: Synthetic peptide
  Seed: EGYSDPTGKY (TYRP1_HUMAN)
ETYSDPTGKK

SEQ ID NO: 173055 - protein, 10 aa, Artificial Sequence
  Description of Artificial Sequence: Synthetic peptide
  Seed: YNYFVWTHYY (TYRP1_HUMAN)
YSYFVWTHYK

SEQ ID NO: 173056 - protein, 10 aa, Artificial Sequence
  Description of Artificial Sequence: Synthetic peptide
  Seed: YNADISTFPL (TYRP1_HUMAN)
YVADISTFPL

SEQ ID NO: 173057 - protein, 9 aa, Artificial Sequence
  Description of Artificial Sequence: Synthetic peptide
  Seed: SGRGRCEAV (TYRP1_HUMAN)
SMRGRCEAA

SEQ ID NO: 173058 - protein, 9 aa, Artificial Sequence
  Description of Artificial Sequence: Synthetic peptide
  Seed: NFDSTLISP (TYRP1_HUMAN)
NFDSTLISL

SEQ ID NO: 173059 - protein, 11 aa, Artificial Sequence
  Description of Artificial Sequence: Synthetic peptide
  Seed: RRYNADISTFP (TYRP1_HUMAN)
RYYNADISTFY

SEQ ID NO: 173060 - protein, 10 aa, Artificial Sequence
  Description of Artificial Sequence: Synthetic peptide
  Seed: AQFPRQCATV (TYRP1_HUMAN)
AVFPRQCATV

SEQ ID NO: 173061 - protein, 9 aa, Artificial Sequence
  Description of Artificial Sequence: Synthetic peptide
  Seed: VFDEWLRRY (TYRP1_HUMAN)
VFDEWLRRW

SEQ ID NO: 173062 - protein, 9 aa, Artificial Sequence
  Description of Artificial Sequence: Synthetic peptide
  Seed: RPHSPQYPH (TYRP1_HUMAN)
RPHSPQYPT

SEQ ID NO: 173063 - protein, 9 aa, Artificial Sequence
  Description of Artificial Sequence: Synthetic peptide
  Seed: FYSNSTNSF (TYRP1_HUMAN)
FRSNSTNSY

SEQ ID NO: 173064 - protein, 9 aa, Artificial Sequence
  Description of Artificial Sequence: Synthetic peptide
  Seed: GLFDTPPFY (TYRP1_HUMAN)
GAFDTPPFM

SEQ ID NO: 173065 - protein, 9 aa, Artificial Sequence
  Description of Artificial Sequence: Synthetic peptide
  Seed: FLGVGQESF (TYRP1_HUMAN)
FMGVGQESL

SEQ ID NO: 173066 - protein, 9 aa, Artificial Sequence
  Description of Artificial Sequence: Synthetic peptide
  Seed: SVKKTFLGV (TYRP1_HUMAN)
SPKKTFLGI

SEQ ID NO: 173067 - protein, 11 aa, Artificial Sequence
  Description of Artificial Sequence: Synthetic peptide
  Seed: HLSPNDPIFVL (TYRP1_HUMAN)
HLSPNDPIFVV

SEQ ID NO: 173068 - protein, 9 aa, Artificial Sequence
  Description of Artificial Sequence: Synthetic peptide
  Seed: RFFNRTCHC (TYRP1_HUMAN)
RVFNRTCHL

SEQ ID NO: 173069 - protein, 9 aa, Artificial Sequence
  Description of Artificial Sequence: Synthetic peptide
  Seed: NSVFSQWRV (TYRP1_HUMAN)
NLVFSQWRV

SEQ ID NO: 173070 - protein, 10 aa, Artificial Sequence
  Description of Artificial Sequence: Synthetic peptide
  Seed: LIFGTASYLI (TYRP1_HUMAN)
LLFGTASYLT

SEQ ID NO: 173071 - protein, 9 aa, Artificial Sequence
  Description of Artificial Sequence: Synthetic peptide
  Seed: YLIRARRSM (TYRP1_HUMAN)
YFIRARRSF

SEQ ID NO: 173072 - protein, 11 aa, Artificial Sequence
  Description of Artificial Sequence: Synthetic peptide
  Seed: YNMVPFWPPVT (TYRP1_HUMAN)
YQMVPFWPPVQ

SEQ ID NO: 173073 - protein, 11 aa, Artificial Sequence
  Description of Artificial Sequence: Synthetic peptide
  Seed: RLPEPQDVAQC (TYRP1_HUMAN)
RMPEPQDVAQL

SEQ ID NO: 173074 - protein, 9 aa, Artificial Sequence
  Description of Artificial Sequence: Synthetic peptide
  Seed: SFSLPYWNF (TYRP1_HUMAN)
SWSLPYWNW

SEQ ID NO: 173075 - protein, 9 aa, Artificial Sequence
  Description of Artificial Sequence: Synthetic peptide
  Seed: QEPSFSLPY (TYRP1_HUMAN)
QIPSFSLPY

SEQ ID NO: 173076 - protein, 10 aa, Artificial Sequence
  Description of Artificial Sequence: Synthetic peptide
  Seed: LLHTFTDAVF (TYRP1_HUMAN)
LKHTFTDAVY

SEQ ID NO: 173077 - protein, 10 aa, Artificial Sequence
  Description of Artificial Sequence: Synthetic peptide
  Seed: YNADISTFPL (TYRP1_HUMAN)
YCADISTFPV

SEQ ID NO: 173078 - protein, 9 aa, Artificial Sequence
  Description of Artificial Sequence: Synthetic peptide
  Seed: GLFDTPPFY (TYRP1_HUMAN)
GMFDTPPFM

SEQ ID NO: 173079 - protein, 9 aa, Artificial Sequence
  Description of Artificial Sequence: Synthetic peptide
  Seed: APIGHNRQY (TYRP1_HUMAN)
AMIGHNRQM

SEQ ID NO: 173080 - protein, 10 aa, Artificial Sequence
  Description of Artificial Sequence: Synthetic peptide
  Seed: SPVSGPGTDR (TYRP1_HUMAN)
STVSGPGTDR

SEQ ID NO: 173081 - protein, 9 aa, Artificial Sequence
  Description of Artificial Sequence: Synthetic peptide
  Seed: HEGPAFLTW (TYRP1_HUMAN)
HPGPAFLTF

SEQ ID NO: 173082 - protein, 9 aa, Artificial Sequence
  Description of Artificial Sequence: Synthetic peptide
  Seed: SVPEIIAIA (TYRP1_HUMAN)
SIPEIIAIF

SEQ ID NO: 173083 - protein, 9 aa, Artificial Sequence
  Description of Artificial Sequence: Synthetic peptide
  Seed: RLEKDMQEM (TYRP1_HUMAN)
RQEKDMQEF

SEQ ID NO: 173084 - protein, 9 aa, Artificial Sequence
  Description of Artificial Sequence: Synthetic peptide
  Seed: LPYWNFATG (TYRP1_HUMAN)
LVYWNFATF

SEQ ID NO: 173085 - protein, 9 aa, Artificial Sequence
  Description of Artificial Sequence: Synthetic peptide
  Seed: FSVPEIIAI (TYRP1_HUMAN)
FRVPEIIAM

SEQ ID NO: 173086 - protein, 9 aa, Artificial Sequence
  Description of Artificial Sequence: Synthetic peptide
  Seed: NADISTFPL (TYRP1_HUMAN)
NLDISTFPM

SEQ ID NO: 173087 - protein, 10 aa, Artificial Sequence
  Description of Artificial Sequence: Synthetic peptide
  Seed: LSPNDPIFVL (TYRP1_HUMAN)
LIPNDPIFVF

SEQ ID NO: 173088 - protein, 9 aa, Artificial Sequence
  Description of Artificial Sequence: Synthetic peptide
  Seed: RTTHPLFVI (TYRP1_HUMAN)
RLTHPLFVM

SEQ ID NO: 173089 - protein, 10 aa, Artificial Sequence
  Description of Artificial Sequence: Synthetic peptide
  Seed: FTDAVFDEWL (TYRP1_HUMAN)
FSDAVFDEWY

SEQ ID NO: 173090 - protein, 9 aa, Artificial Sequence
  Description of Artificial Sequence: Synthetic peptide
  Seed: THPLFVIAT (TYRP1_HUMAN)
THPLFVIAL

SEQ ID NO: 173091 - protein, 10 aa, Artificial Sequence
  Description of Artificial Sequence: Synthetic peptide
  Seed: DAVFDEWLRR (TYRP1_HUMAN)
DRVFDEWLRR

SEQ ID NO: 173092 - protein, 9 aa, Artificial Sequence
  Description of Artificial Sequence: Synthetic peptide
  Seed: RGRCEAVTA (TYRP1_HUMAN)
RVRCEAVTG

SEQ ID NO: 173093 - protein, 9 aa, Artificial Sequence
  Description of Artificial Sequence: Synthetic peptide
  Seed: GALLLVALI (TYRP1_HUMAN)
GQLLLVALV

SEQ ID NO: 173094 - protein, 9 aa, Artificial Sequence
  Description of Artificial Sequence: Synthetic peptide
  Seed: VCDICTDDL (TYRP1_HUMAN)
VIDICTDDM

SEQ ID NO: 173095 - protein, 9 aa, Artificial Sequence
  Description of Artificial Sequence: Synthetic peptide
  Seed: FSVPEIIAI (TYRP1_HUMAN)
FQVPEIIAL

SEQ ID NO: 173096 - protein, 10 aa, Artificial Sequence
  Description of Artificial Sequence: Synthetic peptide
  Seed: YNMVPFWPPV (TYRP1_HUMAN)
YIMVPFWPPV

SEQ ID NO: 173097 - protein, 10 aa, Artificial Sequence
  Description of Artificial Sequence: Synthetic peptide
  Seed: EDYDTLGTLC (TYRP1_HUMAN)
EEYDTLGTLL

SEQ ID NO: 173098 - protein, 10 aa, Artificial Sequence
  Description of Artificial Sequence: Synthetic peptide
  Seed: YSVKKTFLGV (TYRP1_HUMAN)
YLVKKTFLGI

SEQ ID NO: 173099 - protein, 11 aa, Artificial Sequence
  Description of Artificial Sequence: Synthetic peptide
  Seed: VGQESFGEVDF (TYRP1_HUMAN)
VTQESFGEVDW

SEQ ID NO: 173100 - protein, 11 aa, Artificial Sequence
  Description of Artificial Sequence: Synthetic peptide
  Seed: RLPEPQDVAQC (TYRP1_HUMAN)
RLPEPQDVAQL

SEQ ID NO: 173101 - protein, 10 aa, Artificial Sequence
  Description of Artificial Sequence: Synthetic peptide
  Seed: YNMVPFWPPV (TYRP1_HUMAN)
YLMVPFWPPC

SEQ ID NO: 173102 - protein, 10 aa, Artificial Sequence
  Description of Artificial Sequence: Synthetic peptide
  Seed: YNADISTFPL (TYRP1_HUMAN)
YMADISTFPS

SEQ ID NO: 173103 - protein, 10 aa, Artificial Sequence
  Description of Artificial Sequence: Synthetic peptide
  Seed: RTTHPLFVIA (TYRP1_HUMAN)
RSTHPLFVIK

SEQ ID NO: 173104 - protein, 9 aa, Artificial Sequence
  Description of Artificial Sequence: Synthetic peptide
  Seed: VGLFDTPPF (TYRP1_HUMAN)
VALFDTPPL

SEQ ID NO: 173105 - protein, 9 aa, Artificial Sequence
  Description of Artificial Sequence: Synthetic peptide
  Seed: HYYSVKKTF (TYRP1_HUMAN)
HIYSVKKTY

SEQ ID NO: 173106 - protein, 11 aa, Artificial Sequence
  Description of Artificial Sequence: Synthetic peptide
  Seed: RRYNADISTFP (TYRP1_HUMAN)
RWYNADISTFI

SEQ ID NO: 173107 - protein, 10 aa, Artificial Sequence
  Description of Artificial Sequence: Synthetic peptide
  Seed: KRTTHPLFVI (TYRP1_HUMAN)
KHTTHPLFVW

SEQ ID NO: 173108 - protein, 9 aa, Artificial Sequence
  Description of Artificial Sequence: Synthetic peptide
  Seed: GTASYLIRA (TYRP1_HUMAN)
GTASYLIRI

SEQ ID NO: 173109 - protein, 10 aa, Artificial Sequence
  Description of Artificial Sequence: Synthetic peptide
  Seed: LSLGCIFFPL (TYRP1_HUMAN)
LWLGCIFFPL

SEQ ID NO: 173110 - protein, 10 aa, Artificial Sequence
  Description of Artificial Sequence: Synthetic peptide
  Seed: VGLFDTPPFY (TYRP1_HUMAN)
VCLFDTPPFK

SEQ ID NO: 173111 - protein, 11 aa, Artificial Sequence
  Description of Artificial Sequence: Synthetic peptide
  Seed: FSHEGPAFLTW (TYRP1_HUMAN)
FAHEGPAFLTM

SEQ ID NO: 173112 - protein, 9 aa, Artificial Sequence
  Description of Artificial Sequence: Synthetic peptide
  Seed: HRYHLLRLE (TYRP1_HUMAN)
HRYHLLRLL

SEQ ID NO: 173113 - protein, 9 aa, Artificial Sequence
  Description of Artificial Sequence: Synthetic peptide
  Seed: HLSPNDPIF (TYRP1_HUMAN)
HLSPNDPIY

SEQ ID NO: 173114 - protein, 10 aa, Artificial Sequence
  Description of Artificial Sequence: Synthetic peptide
  Seed: ADSRPHSPQY (TYRP1_HUMAN)
AHSRPHSPQK

SEQ ID NO: 173115 - protein, 10 aa, Artificial Sequence
  Description of Artificial Sequence: Synthetic peptide
  Seed: NSFRNTVEGY (TYRP1_HUMAN)
NAFRNTVEGY

SEQ ID NO: 173116 - protein, 9 aa, Artificial Sequence
  Description of Artificial Sequence: Synthetic peptide
  Seed: YTYEIQWPS (TYRP1_HUMAN)
YFYEIQWPM

SEQ ID NO: 173117 - protein, 9 aa, Artificial Sequence
  Description of Artificial Sequence: Synthetic peptide
  Seed: RTCHCNGNF (TYRP1_HUMAN)
RVCHCNGNY

SEQ ID NO: 173118 - protein, 10 aa, Artificial Sequence
  Description of Artificial Sequence: Synthetic peptide
  Seed: MVPFWPPVTN (TYRP1_HUMAN)
MVPFWPPVTF

SEQ ID NO: 173119 - protein, 9 aa, Artificial Sequence
  Description of Artificial Sequence: Synthetic peptide
  Seed: QYQCYAEEY (TYRP1_HUMAN)
QYQCYAEEW

SEQ ID NO: 173120 - protein, 10 aa, Artificial Sequence
  Description of Artificial Sequence: Synthetic peptide
  Seed: MLQEPSFSLP (TYRP1_HUMAN)
MLQEPSFSLD

SEQ ID NO: 173121 - protein, 9 aa, Artificial Sequence
  Description of Artificial Sequence: Synthetic peptide
  Seed: LSPNDPIFV (TYRP1_HUMAN)
LTPNDPIFL

SEQ ID NO: 173122 - protein, 9 aa, Artificial Sequence
  Description of Artificial Sequence: Synthetic peptide
  Seed: LQNPNQSVV (TYRP1_HUMAN)
LTNPNQSVF

SEQ ID NO: 173123 - protein, 9 aa, Artificial Sequence
  Description of Artificial Sequence: Synthetic peptide
  Seed: VGALLLVAL (TYRP1_HUMAN)
VMALLLVAI

SEQ ID NO: 173124 - protein, 9 aa, Artificial Sequence
  Description of Artificial Sequence: Synthetic peptide
  Seed: IAVVGALLL (TYRP1_HUMAN)
ITVVGALLM

SEQ ID NO: 173125 - protein, 9 aa, Artificial Sequence
  Description of Artificial Sequence: Synthetic peptide
  Seed: MAKRTTHPL (TYRP1_HUMAN)
MWKRTTHPY

SEQ ID NO: 173126 - protein, 10 aa, Artificial Sequence
  Description of Artificial Sequence: Synthetic peptide
  Seed: YNMVPFWPPV (TYRP1_HUMAN)
YIMVPFWPPA

SEQ ID NO: 173127 - protein, 9 aa, Artificial Sequence
  Description of Artificial Sequence: Synthetic peptide
  Seed: KLLSLGCIF (TYRP1_HUMAN)
KYLSLGCIW

SEQ ID NO: 173128 - protein, 9 aa, Artificial Sequence
  Description of Artificial Sequence: Synthetic peptide
  Seed: RPGWRGAAC (TYRP1_HUMAN)
RPGWRGAAI

SEQ ID NO: 173129 - protein, 8 aa, Artificial Sequence
  Description of Artificial Sequence: Synthetic peptide
  Seed: YSDPTGKY (TYRP1_HUMAN)
YVDPTGKV

SEQ ID NO: 173130 - protein, 9 aa, Artificial Sequence
  Description of Artificial Sequence: Synthetic peptide
  Seed: FPLENAPIG (TYRP1_HUMAN)
FMLENAPIM

SEQ ID NO: 173131 - protein, 9 aa, Artificial Sequence
  Description of Artificial Sequence: Synthetic peptide
  Seed: IAIAVVGAL (TYRP1_HUMAN)
IGIAVVGAY

SEQ ID NO: 173132 - protein, 9 aa, Artificial Sequence
  Description of Artificial Sequence: Synthetic peptide
  Seed: YSNSTNSFR (TYRP1_HUMAN)
YVNSTNSFL

SEQ ID NO: 173133 - protein, 10 aa, Artificial Sequence
  Description of Artificial Sequence: Synthetic peptide
  Seed: FVTAPDNLGY (TYRP1_HUMAN)
FWTAPDNLGW

SEQ ID NO: 173134 - protein, 10 aa, Artificial Sequence
  Description of Artificial Sequence: Synthetic peptide
  Seed: IYNYFVWTHY (TYRP1_HUMAN)
IWNYFVWTHW

SEQ ID NO: 173135 - protein, 9 aa, Artificial Sequence
  Description of Artificial Sequence: Synthetic peptide
  Seed: VPFWPPVTN (TYRP1_HUMAN)
VPFWPPVTT

SEQ ID NO: 173136 - protein, 9 aa, Artificial Sequence
  Description of Artificial Sequence: Synthetic peptide
  Seed: MCCPDLSPV (TYRP1_HUMAN)
MVCPDLSPM

SEQ ID NO: 173137 - protein, 10 aa, Artificial Sequence
  Description of Artificial Sequence: Synthetic peptide
  Seed: NISIYNYFVW (TYRP1_HUMAN)
NWSIYNYFVW

SEQ ID NO: 173138 - protein, 9 aa, Artificial Sequence
  Description of Artificial Sequence: Synthetic peptide
  Seed: FVWTHYYSV (TYRP1_HUMAN)
FAWTHYYSL

SEQ ID NO: 173139 - protein, 11 aa, Artificial Sequence
  Description of Artificial Sequence: Synthetic peptide
  Seed: YNYFVWTHYYS (TYRP1_HUMAN)
YHYFVWTHYYY

SEQ ID NO: 173140 - protein, 11 aa, Artificial Sequence
  Description of Artificial Sequence: Synthetic peptide
  Seed: HLSPNDPIFVL (TYRP1_HUMAN)
HYSPNDPIFVY

SEQ ID NO: 173141 - protein, 9 aa, Artificial Sequence
  Description of Artificial Sequence: Synthetic peptide
  Seed: LHNLAHLFL (TYRP1_HUMAN)
LHNLAHLFY

SEQ ID NO: 173142 - protein, 10 aa, Artificial Sequence
  Description of Artificial Sequence: Synthetic peptide
  Seed: WPPVTNTEMF (TYRP1_HUMAN)
WCPVTNTEMY

SEQ ID NO: 173143 - protein, 11 aa, Artificial Sequence
  Description of Artificial Sequence: Synthetic peptide
  Seed: RSMDEANQPLL (TYRP1_HUMAN)
RMMDEANQPLI

SEQ ID NO: 173144 - protein, 10 aa, Artificial Sequence
  Description of Artificial Sequence: Synthetic peptide
  Seed: ALIFGTASYL (TYRP1_HUMAN)
AMIFGTASYL

SEQ ID NO: 173145 - protein, 10 aa, Artificial Sequence
  Description of Artificial Sequence: Synthetic peptide
  Seed: HNRQYNMVPF (TYRP1_HUMAN)
HQRQYNMVPY

SEQ ID NO: 173146 - protein, 9 aa, Artificial Sequence
  Description of Artificial Sequence: Synthetic peptide
  Seed: AVVGALLLV (TYRP1_HUMAN)
AVVGALLLK

SEQ ID NO: 173147 - protein, 10 aa, Artificial Sequence
  Description of Artificial Sequence: Synthetic peptide
  Seed: SLGCIFFPLL (TYRP1_HUMAN)
SMGCIFFPLA

SEQ ID NO: 173148 - protein, 9 aa, Artificial Sequence
  Description of Artificial Sequence: Synthetic peptide
  Seed: YTYEIQWPS (TYRP1_HUMAN)
YQYEIQWPV

SEQ ID NO: 173149 - protein, 9 aa, Artificial Sequence
  Description of Artificial Sequence: Synthetic peptide
  Seed: LEKDMQEML (TYRP1_HUMAN)
LQKDMQEMF

SEQ ID NO: 173150 - protein, 10 aa, Artificial Sequence
  Description of Artificial Sequence: Synthetic peptide
  Seed: FVLLHTFTDA (TYRP1_HUMAN)
FHLLHTFTDL

SEQ ID NO: 173151 - protein, 9 aa, Artificial Sequence
  Description of Artificial Sequence: Synthetic peptide
  Seed: RARRSMDEA (TYRP1_HUMAN)
RTRRSMDEV

SEQ ID NO: 173152 - protein, 10 aa, Artificial Sequence
  Description of Artificial Sequence: Synthetic peptide
  Seed: RRYNADISTF (TYRP1_HUMAN)
RYYNADISTY

SEQ ID NO: 173153 - protein, 10 aa, Artificial Sequence
  Description of Artificial Sequence: Synthetic peptide
  Seed: YNADISTFPL (TYRP1_HUMAN)
YTADISTFPM

SEQ ID NO: 173154 - protein, 10 aa, Artificial Sequence
  Description of Artificial Sequence: Synthetic peptide
  Seed: YNYFVWTHYY (TYRP1_HUMAN)
YTYFVWTHYW

SEQ ID NO: 173155 - protein, 10 aa, Artificial Sequence
  Description of Artificial Sequence: Synthetic peptide
  Seed: FGTASYLIRA (TYRP1_HUMAN)
FLTASYLIRV

SEQ ID NO: 173156 - protein, 10 aa, Artificial Sequence
  Description of Artificial Sequence: Synthetic peptide
  Seed: THYYSVKKTF (TYRP1_HUMAN)
TLYYSVKKTF

SEQ ID NO: 173157 - protein, 8 aa, Artificial Sequence
  Description of Artificial Sequence: Synthetic peptide
  Seed: YNADISTF (TYRP1_HUMAN)
YAADISTL

SEQ ID NO: 173158 - protein, 10 aa, Artificial Sequence
  Description of Artificial Sequence: Synthetic peptide
  Seed: EGPAFLTWHR (TYRP1_HUMAN)
ELPAFLTWHK

SEQ ID NO: 173159 - protein, 9 aa, Artificial Sequence
  Description of Artificial Sequence: Synthetic peptide
  Seed: LLDLSKEEK (TYRP1_HUMAN)
LADLSKEEL

SEQ ID NO: 173160 - protein, 11 aa, Artificial Sequence
  Description of Artificial Sequence: Synthetic peptide
  Seed: FENISIYNYFV (TYRP1_HUMAN)
FMNISIYNYFL

SEQ ID NO: 173161 - protein, 10 aa, Artificial Sequence
  Description of Artificial Sequence: Synthetic peptide
  Seed: RSLHNLAHLF (TYRP1_HUMAN)
RKLHNLAHLF

SEQ ID NO: 173162 - protein, 9 aa, Artificial Sequence
  Description of Artificial Sequence: Synthetic peptide
  Seed: DNLGYTYEI (TYRP1_HUMAN)
DSLGYTYEA

SEQ ID NO: 173163 - protein, 8 aa, Artificial Sequence
  Description of Artificial Sequence: Synthetic peptide
  Seed: YSDPTGKY (TYRP1_HUMAN)
YQDPTGKV

SEQ ID NO: 173164 - protein, 9 aa, Artificial Sequence
  Description of Artificial Sequence: Synthetic peptide
  Seed: ASYLIRARR (TYRP1_HUMAN)
ASYLIRARK

SEQ ID NO: 173165 - protein, 10 aa, Artificial Sequence
  Description of Artificial Sequence: Synthetic peptide
  Seed: EVWPLRFFNR (TYRP1_HUMAN)
ELWPLRFFNK

SEQ ID NO: 173166 - protein, 9 aa, Artificial Sequence
  Description of Artificial Sequence: Synthetic peptide
  Seed: RQCATVEAL (TYRP1_HUMAN)
RACATVEAV

SEQ ID NO: 173167 - protein, 10 aa, Artificial Sequence
  Description of Artificial Sequence: Synthetic peptide
  Seed: VPFWPPVTNT (TYRP1_HUMAN)
VPFWPPVTNI

SEQ ID NO: 173168 - protein, 11 aa, Artificial Sequence
  Description of Artificial Sequence: Synthetic peptide
  Seed: LVALIFGTASY (TYRP1_HUMAN)
LLALIFGTASY

SEQ ID NO: 173169 - protein, 9 aa, Artificial Sequence
  Description of Artificial Sequence: Synthetic peptide
  Seed: RGRCEAVTA (TYRP1_HUMAN)
RSRCEAVTR

SEQ ID NO: 173170 - protein, 10 aa, Artificial Sequence
  Description of Artificial Sequence: Synthetic peptide
  Seed: EIIAIAVVGA (TYRP1_HUMAN)
EHIAIAVVGI

SEQ ID NO: 173171 - protein, 10 aa, Artificial Sequence
  Description of Artificial Sequence: Synthetic peptide
  Seed: RSLHNLAHLF (TYRP1_HUMAN)
RQLHNLAHLW

SEQ ID NO: 173172 - protein, 9 aa, Artificial Sequence
  Description of Artificial Sequence: Synthetic peptide
  Seed: SFSLPYWNF (TYRP1_HUMAN)
SMSLPYWNF

SEQ ID NO: 173173 - protein, 11 aa, Artificial Sequence
  Description of Artificial Sequence: Synthetic peptide
  Seed: SLPYWNFATGK (TYRP1_HUMAN)
SAPYWNFATGR

SEQ ID NO: 173174 - protein, 10 aa, Artificial Sequence
  Description of Artificial Sequence: Synthetic peptide
  Seed: AFLTWHRYHL (TYRP1_HUMAN)
AQLTWHRYHV

SEQ ID NO: 173175 - protein, 10 aa, Artificial Sequence
  Description of Artificial Sequence: Synthetic peptide
  Seed: YNMVPFWPPV (TYRP1_HUMAN)
YYMVPFWPPI

SEQ ID NO: 173176 - protein, 9 aa, Artificial Sequence
  Description of Artificial Sequence: Synthetic peptide
  Seed: DNLGYTYEI (TYRP1_HUMAN)
DVLGYTYEM

SEQ ID NO: 173177 - protein, 9 aa, Artificial Sequence
  Description of Artificial Sequence: Synthetic peptide
  Seed: LIFGTASYL (TYRP1_HUMAN)
LAFGTASYV

SEQ ID NO: 173178 - protein, 10 aa, Artificial Sequence
  Description of Artificial Sequence: Synthetic peptide
  Seed: FSVPEIIAIA (TYRP1_HUMAN)
FQVPEIIAIA

SEQ ID NO: 173179 - protein, 10 aa, Artificial Sequence
  Description of Artificial Sequence: Synthetic peptide
  Seed: AEEYEKLQNP (TYRP1_HUMAN)
AEEYEKLQNA

SEQ ID NO: 173180 - protein, 10 aa, Artificial Sequence
  Description of Artificial Sequence: Synthetic peptide
  Seed: RSMDEANQPL (TYRP1_HUMAN)
RVMDEANQPF

SEQ ID NO: 173181 - protein, 10 aa, Artificial Sequence
  Description of Artificial Sequence: Synthetic peptide
  Seed: MAKRTTHPLF (TYRP1_HUMAN)
MPKRTTHPLC

SEQ ID NO: 173182 - protein, 10 aa, Artificial Sequence
  Description of Artificial Sequence: Synthetic peptide
  Seed: NLAHLFLNGT (TYRP1_HUMAN)
NIAHLFLNGV

SEQ ID NO: 173183 - protein, 10 aa, Artificial Sequence
  Description of Artificial Sequence: Synthetic peptide
  Seed: YEIQWPSREF (TYRP1_HUMAN)
YEIQWPSREV

SEQ ID NO: 173184 - protein, 9 aa, Artificial Sequence
  Description of Artificial Sequence: Synthetic peptide
  Seed: AVFDEWLRR (TYRP1_HUMAN)
AQFDEWLRK

SEQ ID NO: 173185 - protein, 9 aa, Artificial Sequence
  Description of Artificial Sequence: Synthetic peptide
  Seed: ACDQRVLIV (TYRP1_HUMAN)
AFDQRVLIM

SEQ ID NO: 173186 - protein, 9 aa, Artificial Sequence
  Description of Artificial Sequence: Synthetic peptide
  Seed: FPRQCATVE (TYRP1_HUMAN)
FIRQCATVY

SEQ ID NO: 173187 - protein, 9 aa, Artificial Sequence
  Description of Artificial Sequence: Synthetic peptide
  Seed: APIGHNRQY (TYRP1_HUMAN)
ARIGHNRQI

SEQ ID NO: 173188 - protein, 9 aa, Artificial Sequence
  Description of Artificial Sequence: Synthetic peptide
  Seed: HEGPAFLTW (TYRP1_HUMAN)
HHGPAFLTI

SEQ ID NO: 173189 - protein, 10 aa, Artificial Sequence
  Description of Artificial Sequence: Synthetic peptide
  Seed: HPLFVIATRR (TYRP1_HUMAN)
HILFVIATRR

SEQ ID NO: 173190 - protein, 11 aa, Artificial Sequence
  Description of Artificial Sequence: Synthetic peptide
  Seed: YYSVKKTFLGV (TYRP1_HUMAN)
YYSVKKTFLGF

SEQ ID NO: 173191 - protein, 9 aa, Artificial Sequence
  Description of Artificial Sequence: Synthetic peptide
  Seed: MLQEPSFSL (TYRP1_HUMAN)
MVQEPSFSA

SEQ ID NO: 173192 - protein, 11 aa, Artificial Sequence
  Description of Artificial Sequence: Synthetic peptide
  Seed: LIFGTASYLIR (TYRP1_HUMAN)
LTFGTASYLIK

SEQ ID NO: 173193 - protein, 9 aa, Artificial Sequence
  Description of Artificial Sequence: Synthetic peptide
  Seed: NYFVWTHYY (TYRP1_HUMAN)
NAFVWTHYF

SEQ ID NO: 173194 - protein, 9 aa, Artificial Sequence
  Description of Artificial Sequence: Synthetic peptide
  Seed: VARPMVQRL (TYRP1_HUMAN)
VARPMVQRY

SEQ ID NO: 173195 - protein, 11 aa, Artificial Sequence
  Description of Artificial Sequence: Synthetic peptide
  Seed: FLNGTGGQTHL (TYRP1_HUMAN)
FYNGTGGQTHL

SEQ ID NO: 173196 - protein, 9 aa, Artificial Sequence
  Description of Artificial Sequence: Synthetic peptide
  Seed: MDEANQPLL (TYRP1_HUMAN)
MAEANQPLM

SEQ ID NO: 173197 - protein, 8 aa, Artificial Sequence
  Description of Artificial Sequence: Synthetic peptide
  Seed: FSHEGPAF (TYRP1_HUMAN)
FSHEGPAV

SEQ ID NO: 173198 - protein, 9 aa, Artificial Sequence
  Description of Artificial Sequence: Synthetic peptide
  Seed: FTDAVFDEW (TYRP1_HUMAN)
FFDAVFDEM

SEQ ID NO: 173199 - protein, 11 aa, Artificial Sequence
  Description of Artificial Sequence: Synthetic peptide
  Seed: HLSPNDPIFVL (TYRP1_HUMAN)
HRSPNDPIFVY

SEQ ID NO: 173200 - protein, 10 aa, Artificial Sequence
  Description of Artificial Sequence: Synthetic peptide
  Seed: STLISPNSVF (TYRP1_HUMAN)
STLISPNSVY

SEQ ID NO: 173201 - protein, 8 aa, Artificial Sequence
  Description of Artificial Sequence: Synthetic peptide
  Seed: SIYNYFVW (TYRP1_HUMAN)
STYNYFVW

SEQ ID NO: 173202 - protein, 9 aa, Artificial Sequence
  Description of Artificial Sequence: Synthetic peptide
  Seed: FLTWHRYHL (TYRP1_HUMAN)
FYTWHRYHF

SEQ ID NO: 173203 - protein, 10 aa, Artificial Sequence
  Description of Artificial Sequence: Synthetic peptide
  Seed: FGTASYLIRA (TYRP1_HUMAN)
FPTASYLIRI

SEQ ID NO: 173204 - protein, 10 aa, Artificial Sequence
  Description of Artificial Sequence: Synthetic peptide
  Seed: RSLHNLAHLF (TYRP1_HUMAN)
RFLHNLAHLY

SEQ ID NO: 173205 - protein, 10 aa, Artificial Sequence
  Description of Artificial Sequence: Synthetic peptide
  Seed: LSPNDPIFVL (TYRP1_HUMAN)
LQPNDPIFVY

SEQ ID NO: 173206 - protein, 10 aa, Artificial Sequence
  Description of Artificial Sequence: Synthetic peptide
  Seed: FSLPYWNFAT (TYRP1_HUMAN)
FDLPYWNFAV

SEQ ID NO: 173207 - protein, 9 aa, Artificial Sequence
  Description of Artificial Sequence: Synthetic peptide
  Seed: IATRRSEEI (TYRP1_HUMAN)
IATRRSEEF

SEQ ID NO: 173208 - protein, 11 aa, Artificial Sequence
  Description of Artificial Sequence: Synthetic peptide
  Seed: LVALIFGTASY (TYRP1_HUMAN)
LKALIFGTASY

SEQ ID NO: 173209 - protein, 11 aa, Artificial Sequence
  Description of Artificial Sequence: Synthetic peptide
  Seed: REFSVPEIIAI (TYRP1_HUMAN)
RDFSVPEIIAF

SEQ ID NO: 173210 - protein, 9 aa, Artificial Sequence
  Description of Artificial Sequence: Synthetic peptide
  Seed: VGLFDTPPF (TYRP1_HUMAN)
VSLFDTPPF

SEQ ID NO: 173211 - protein, 9 aa, Artificial Sequence
  Description of Artificial Sequence: Synthetic peptide
  Seed: REFSVPEII (TYRP1_HUMAN)
RHFSVPEIV

SEQ ID NO: 173212 - protein, 9 aa, Artificial Sequence
  Description of Artificial Sequence: Synthetic peptide
  Seed: AQFPRQCAT (TYRP1_HUMAN)
AQFPRQCAY

SEQ ID NO: 173213 - protein, 10 aa, Artificial Sequence
  Description of Artificial Sequence: Synthetic peptide
  Seed: EFSVPEIIAI (TYRP1_HUMAN)
EMSVPEIIAV

SEQ ID NO: 173214 - protein, 10 aa, Artificial Sequence
  Description of Artificial Sequence: Synthetic peptide
  Seed: EFSVPEIIAI (TYRP1_HUMAN)
EISVPEIIAV

SEQ ID NO: 173215 - protein, 10 aa, Artificial Sequence
  Description of Artificial Sequence: Synthetic peptide
  Seed: FGTASYLIRA (TYRP1_HUMAN)
FWTASYLIRI

SEQ ID NO: 173216 - protein, 10 aa, Artificial Sequence
  Description of Artificial Sequence: Synthetic peptide
  Seed: WPPVTNTEMF (TYRP1_HUMAN)
WNPVTNTEMY

SEQ ID NO: 173217 - protein, 10 aa, Artificial Sequence
  Description of Artificial Sequence: Synthetic peptide
  Seed: MVPFWPPVTN (TYRP1_HUMAN)
MMPFWPPVTF

SEQ ID NO: 173218 - protein, 9 aa, Artificial Sequence
  Description of Artificial Sequence: Synthetic peptide
  Seed: ACDQRVLIV (TYRP1_HUMAN)
AIDQRVLIL

SEQ ID NO: 173219 - protein, 9 aa, Artificial Sequence
  Description of Artificial Sequence: Synthetic peptide
  Seed: LIFGTASYL (TYRP1_HUMAN)
LNFGTASYY

SEQ ID NO: 173220 - protein, 10 aa, Artificial Sequence
  Description of Artificial Sequence: Synthetic peptide
  Seed: SMDEANQPLL (TYRP1_HUMAN)
SGDEANQPLL

SEQ ID NO: 173221 - protein, 9 aa, Artificial Sequence
  Description of Artificial Sequence: Synthetic peptide
  Seed: RQCATVEAL (TYRP1_HUMAN)
RHCATVEAI

SEQ ID NO: 173222 - protein, 10 aa, Artificial Sequence
  Description of Artificial Sequence: Synthetic peptide
  Seed: MQEMLQEPSF (TYRP1_HUMAN)
MVEMLQEPSW

SEQ ID NO: 173223 - protein, 9 aa, Artificial Sequence
  Description of Artificial Sequence: Synthetic peptide
  Seed: MAKRTTHPL (TYRP1_HUMAN)
MSKRTTHPA

SEQ ID NO: 173224 - protein, 9 aa, Artificial Sequence
  Description of Artificial Sequence: Synthetic peptide
  Seed: VFDEWLRRY (TYRP1_HUMAN)
VSDEWLRRY

SEQ ID NO: 173225 - protein, 9 aa, Artificial Sequence
  Description of Artificial Sequence: Synthetic peptide
  Seed: SLHNLAHLF (TYRP1_HUMAN)
SQHNLAHLF

SEQ ID NO: 173226 - protein, 9 aa, Artificial Sequence
  Description of Artificial Sequence: Synthetic peptide
  Seed: FYSNSTNSF (TYRP1_HUMAN)
FLSNSTNSY

SEQ ID NO: 173227 - protein, 10 aa, Artificial Sequence
  Description of Artificial Sequence: Synthetic peptide
  Seed: FVWTHYYSVK (TYRP1_HUMAN)
FLWTHYYSVH

SEQ ID NO: 173228 - protein, 9 aa, Artificial Sequence
  Description of Artificial Sequence: Synthetic peptide
  Seed: VWPLRFFNR (TYRP1_HUMAN)
VVPLRFFNR

SEQ ID NO: 173229 - protein, 9 aa, Artificial Sequence
  Description of Artificial Sequence: Synthetic peptide
  Seed: MSAPKLLSL (TYRP1_HUMAN)
MDAPKLLSF

SEQ ID NO: 173230 - protein, 9 aa, Artificial Sequence
  Description of Artificial Sequence: Synthetic peptide
  Seed: MSAPKLLSL (TYRP1_HUMAN)
MVAPKLLSW

SEQ ID NO: 173231 - protein, 9 aa, Artificial Sequence
  Description of Artificial Sequence: Synthetic peptide
  Seed: LFQQARAQF (TYRP1_HUMAN)
LAQQARAQF

SEQ ID NO: 173232 - protein, 9 aa, Artificial Sequence
  Description of Artificial Sequence: Synthetic peptide
  Seed: SVFSQWRVV (TYRP1_HUMAN)
SQFSQWRVI

SEQ ID NO: 173233 - protein, 9 aa, Artificial Sequence
  Description of Artificial Sequence: Synthetic peptide
  Seed: LVALIFGTA (TYRP1_HUMAN)
LLALIFGTL

SEQ ID NO: 173234 - protein, 9 aa, Artificial Sequence
  Description of Artificial Sequence: Synthetic peptide
  Seed: RPHSPQYPH (TYRP1_HUMAN)
RPHSPQYPC

SEQ ID NO: 173235 - protein, 9 aa, Artificial Sequence
  Description of Artificial Sequence: Synthetic peptide
  Seed: YTYEIQWPS (TYRP1_HUMAN)
YTYEIQWPQ

SEQ ID NO: 173236 - protein, 9 aa, Artificial Sequence
  Description of Artificial Sequence: Synthetic peptide
  Seed: FLGVGQESF (TYRP1_HUMAN)
FFGVGQESL

SEQ ID NO: 173237 - protein, 10 aa, Artificial Sequence
  Description of Artificial Sequence: Synthetic peptide
  Seed: AVFDEWLRRY (TYRP1_HUMAN)
AVFDEWLRRF

SEQ ID NO: 173238 - protein, 10 aa, Artificial Sequence
  Description of Artificial Sequence: Synthetic peptide
  Seed: IAIAVVGALL (TYRP1_HUMAN)
IAIAVVGALW

SEQ ID NO: 173239 - protein, 10 aa, Artificial Sequence
  Description of Artificial Sequence: Synthetic peptide
  Seed: RRYNADISTF (TYRP1_HUMAN)
RAYNADISTY

SEQ ID NO: 173240 - protein, 9 aa, Artificial Sequence
  Description of Artificial Sequence: Synthetic peptide
  Seed: FSVPEIIAI (TYRP1_HUMAN)
FIVPEIIAI

SEQ ID NO: 173241 - protein, 10 aa, Artificial Sequence
  Description of Artificial Sequence: Synthetic peptide
  Seed: SMDEANQPLL (TYRP1_HUMAN)
SMDEANQPLM

SEQ ID NO: 173242 - protein, 10 aa, Artificial Sequence
  Description of Artificial Sequence: Synthetic peptide
  Seed: SMDEANQPLL (TYRP1_HUMAN)
SYDEANQPLF

SEQ ID NO: 173243 - protein, 10 aa, Artificial Sequence
  Description of Artificial Sequence: Synthetic peptide
  Seed: DAVFDEWLRR (TYRP1_HUMAN)
DPVFDEWLRR

SEQ ID NO: 173244 - protein, 9 aa, Artificial Sequence
  Description of Artificial Sequence: Synthetic peptide
  Seed: FSHEGPAFL (TYRP1_HUMAN)
FLHEGPAFA

SEQ ID NO: 173245 - protein, 10 aa, Artificial Sequence
  Description of Artificial Sequence: Synthetic peptide
  Seed: TPQFENISIY (TYRP1_HUMAN)
TSQFENISIF

SEQ ID NO: 173246 - protein, 11 aa, Artificial Sequence
  Description of Artificial Sequence: Synthetic peptide
  Seed: REFSVPEIIAI (TYRP1_HUMAN)
REFSVPEIIAW

SEQ ID NO: 173247 - protein, 10 aa, Artificial Sequence
  Description of Artificial Sequence: Synthetic peptide
  Seed: NISIYNYFVW (TYRP1_HUMAN)
NGSIYNYFVW

SEQ ID NO: 173248 - protein, 10 aa, Artificial Sequence
  Description of Artificial Sequence: Synthetic peptide
  Seed: LSLGCIFFPL (TYRP1_HUMAN)
LPLGCIFFPI

SEQ ID NO: 173249 - protein, 8 aa, Artificial Sequence
  Description of Artificial Sequence: Synthetic peptide
  Seed: FSHEGPAF (TYRP1_HUMAN)
FGHEGPAM

SEQ ID NO: 173250 - protein, 10 aa, Artificial Sequence
  Description of Artificial Sequence: Synthetic peptide
  Seed: RRYNADISTF (TYRP1_HUMAN)
RRYNADISTW

SEQ ID NO: 173251 - protein, 10 aa, Artificial Sequence
  Description of Artificial Sequence: Synthetic peptide
  Seed: LIFGTASYLI (TYRP1_HUMAN)
LPFGTASYLF

SEQ ID NO: 173252 - protein, 9 aa, Artificial Sequence
  Description of Artificial Sequence: Synthetic peptide
  Seed: MSAPKLLSL (TYRP1_HUMAN)
MNAPKLLSF

SEQ ID NO: 173253 - protein, 10 aa, Artificial Sequence
  Description of Artificial Sequence: Synthetic peptide
  Seed: ALIFGTASYL (TYRP1_HUMAN)
AMIFGTASYP

SEQ ID NO: 173254 - protein, 9 aa, Artificial Sequence
  Description of Artificial Sequence: Synthetic peptide
  Seed: FYSNSTNSF (TYRP1_HUMAN)
FPSNSTNSF

SEQ ID NO: 173255 - protein, 9 aa, Artificial Sequence
  Description of Artificial Sequence: Synthetic peptide
  Seed: NADISTFPL (TYRP1_HUMAN)
NFDISTFPL

SEQ ID NO: 173256 - protein, 9 aa, Artificial Sequence
  Description of Artificial Sequence: Synthetic peptide
  Seed: GTASYLIRA (TYRP1_HUMAN)
GVASYLIRL

SEQ ID NO: 173257 - protein, 9 aa, Artificial Sequence
  Description of Artificial Sequence: Synthetic peptide
  Seed: MAKRTTHPL (TYRP1_HUMAN)
MQKRTTHPV

SEQ ID NO: 173258 - protein, 9 aa, Artificial Sequence
  Description of Artificial Sequence: Synthetic peptide
  Seed: LTWHRYHLL (TYRP1_HUMAN)
LPWHRYHLL

SEQ ID NO: 173259 - protein, 9 aa, Artificial Sequence
  Description of Artificial Sequence: Synthetic peptide
  Seed: RSLHNLAHL (TYRP1_HUMAN)
RCLHNLAHW

SEQ ID NO: 173260 - protein, 9 aa, Artificial Sequence
  Description of Artificial Sequence: Synthetic peptide
  Seed: TLISPNSVF (TYRP1_HUMAN)
TIISPNSVL

SEQ ID NO: 173261 - protein, 9 aa, Artificial Sequence
  Description of Artificial Sequence: Synthetic peptide
  Seed: REFSVPEII (TYRP1_HUMAN)
RRFSVPEII

SEQ ID NO: 173262 - protein, 9 aa, Artificial Sequence
  Description of Artificial Sequence: Synthetic peptide
  Seed: MLQEPSFSL (TYRP1_HUMAN)
MTQEPSFSW

SEQ ID NO: 173263 - protein, 11 aa, Artificial Sequence
  Description of Artificial Sequence: Synthetic peptide
  Seed: YSDPTGKYDPA (TYRP1_HUMAN)
YTDPTGKYDPI

SEQ ID NO: 173264 - protein, 9 aa, Artificial Sequence
  Description of Artificial Sequence: Synthetic peptide
  Seed: MLQEPSFSL (TYRP1_HUMAN)
MHQEPSFSL

SEQ ID NO: 173265 - protein, 9 aa, Artificial Sequence
  Description of Artificial Sequence: Synthetic peptide
  Seed: LTDQYQCYA (TYRP1_HUMAN)
LIDQYQCYV

SEQ ID NO: 173266 - protein, 9 aa, Artificial Sequence
  Description of Artificial Sequence: Synthetic peptide
  Seed: TLISPNSVF (TYRP1_HUMAN)
TMISPNSVF

SEQ ID NO: 173267 - protein, 10 aa, Artificial Sequence
  Description of Artificial Sequence: Synthetic peptide
  Seed: LLLVALIFGT (TYRP1_HUMAN)
LLLVALIFGL

SEQ ID NO: 173268 - protein, 9 aa, Artificial Sequence
  Description of Artificial Sequence: Synthetic peptide
  Seed: SVKKTFLGV (TYRP1_HUMAN)
STKKTFLGA

SEQ ID NO: 173269 - protein, 9 aa, Artificial Sequence
  Description of Artificial Sequence: Synthetic peptide
  Seed: TLISPNSVF (TYRP1_HUMAN)
TYISPNSVV

SEQ ID NO: 173270 - protein, 9 aa, Artificial Sequence
  Description of Artificial Sequence: Synthetic peptide
  Seed: SPNSVFSQW (TYRP1_HUMAN)
SPNSVFSQA

SEQ ID NO: 173271 - protein, 9 aa, Artificial Sequence
  Description of Artificial Sequence: Synthetic peptide
  Seed: EIQWPSREF (TYRP1_HUMAN)
ETQWPSREK

SEQ ID NO: 173272 - protein, 9 aa, Artificial Sequence
  Description of Artificial Sequence: Synthetic peptide
  Seed: SVPEIIAIA (TYRP1_HUMAN)
SYPEIIAIL

SEQ ID NO: 173273 - protein, 9 aa, Artificial Sequence
  Description of Artificial Sequence: Synthetic peptide
  Seed: AVRSLHNLA (TYRP1_HUMAN)
AIRSLHNLL

SEQ ID NO: 173274 - protein, 10 aa, Artificial Sequence
  Description of Artificial Sequence: Synthetic peptide
  Seed: FLNGTGGQTH (TYRP1_HUMAN)
FVNGTGGQTY

SEQ ID NO: 173275 - protein, 9 aa, Artificial Sequence
  Description of Artificial Sequence: Synthetic peptide
  Seed: LQNPNQSVV (TYRP1_HUMAN)
LTNPNQSVM

SEQ ID NO: 173276 - protein, 9 aa, Artificial Sequence
  Description of Artificial Sequence: Synthetic peptide
  Seed: EKNHFVRAL (TYRP1_HUMAN)
ERNHFVRAL

SEQ ID NO: 173277 - protein, 10 aa, Artificial Sequence
  Description of Artificial Sequence: Synthetic peptide
  Seed: FVLLHTFTDA (TYRP1_HUMAN)
FTLLHTFTDL

SEQ ID NO: 173278 - protein, 10 aa, Artificial Sequence
  Description of Artificial Sequence: Synthetic peptide
  Seed: FVLLHTFTDA (TYRP1_HUMAN)
FMLLHTFTDL

SEQ ID NO: 173279 - protein, 10 aa, Artificial Sequence
  Description of Artificial Sequence: Synthetic peptide
  Seed: EMLQEPSFSL (TYRP1_HUMAN)
ETLQEPSFSV

SEQ ID NO: 173280 - protein, 9 aa, Artificial Sequence
  Description of Artificial Sequence: Synthetic peptide
  Seed: RSLHNLAHL (TYRP1_HUMAN)
RVLHNLAHV

SEQ ID NO: 173281 - protein, 10 aa, Artificial Sequence
  Description of Artificial Sequence: Synthetic peptide
  Seed: AVVGALLLVA (TYRP1_HUMAN)
AVVGALLLVI

SEQ ID NO: 173282 - protein, 10 aa, Artificial Sequence
  Description of Artificial Sequence: Synthetic peptide
  Seed: AQFPRQCATV (TYRP1_HUMAN)
AMFPRQCATY

SEQ ID NO: 173283 - protein, 11 aa, Artificial Sequence
  Description of Artificial Sequence: Synthetic peptide
  Seed: LRRYNADISTF (TYRP1_HUMAN)
LYRYNADISTF

SEQ ID NO: 173284 - protein, 9 aa, Artificial Sequence
  Description of Artificial Sequence: Synthetic peptide
  Seed: ENAPIGHNR (TYRP1_HUMAN)
EVAPIGHNV

SEQ ID NO: 173285 - protein, 9 aa, Artificial Sequence
  Description of Artificial Sequence: Synthetic peptide
  Seed: FSVPEIIAI (TYRP1_HUMAN)
FAVPEIIAM

SEQ ID NO: 173286 - protein, 9 aa, Artificial Sequence
  Description of Artificial Sequence: Synthetic peptide
  Seed: KRTTHPLFV (TYRP1_HUMAN)
KRTTHPLFM

SEQ ID NO: 173287 - protein, 10 aa, Artificial Sequence
  Description of Artificial Sequence: Synthetic peptide
  Seed: FVTAPDNLGY (TYRP1_HUMAN)
FKTAPDNLGF

SEQ ID NO: 173288 - protein, 9 aa, Artificial Sequence
  Description of Artificial Sequence: Synthetic peptide
  Seed: ENAPIGHNR (TYRP1_HUMAN)
ECAPIGHNR

SEQ ID NO: 173289 - protein, 9 aa, Artificial Sequence
  Description of Artificial Sequence: Synthetic peptide
  Seed: NFDSTLISP (TYRP1_HUMAN)
NVDSTLISL

SEQ ID NO: 173290 - protein, 9 aa, Artificial Sequence
  Description of Artificial Sequence: Synthetic peptide
  Seed: FSHEGPAFL (TYRP1_HUMAN)
FIHEGPAFH

SEQ ID NO: 173291 - protein, 10 aa, Artificial Sequence
  Description of Artificial Sequence: Synthetic peptide
  Seed: FGTASYLIRA (TYRP1_HUMAN)
FTTASYLIRI

SEQ ID NO: 173292 - protein, 10 aa, Artificial Sequence
  Description of Artificial Sequence: Synthetic peptide
  Seed: RTTHPLFVIA (TYRP1_HUMAN)
RWTHPLFVIK

SEQ ID NO: 173293 - protein, 10 aa, Artificial Sequence
  Description of Artificial Sequence: Synthetic peptide
  Seed: FLNGTGGQTH (TYRP1_HUMAN)
FTNGTGGQTM

SEQ ID NO: 173294 - protein, 10 aa, Artificial Sequence
  Description of Artificial Sequence: Synthetic peptide
  Seed: FVTAPDNLGY (TYRP1_HUMAN)
FNTAPDNLGF

SEQ ID NO: 173295 - protein, 9 aa, Artificial Sequence
  Description of Artificial Sequence: Synthetic peptide
  Seed: HEGPAFLTW (TYRP1_HUMAN)
HEGPAFLTY

SEQ ID NO: 173296 - protein, 10 aa, Artificial Sequence
  Description of Artificial Sequence: Synthetic peptide
  Seed: KYDPAVRSLH (TYRP1_HUMAN)
KWDPAVRSLY

SEQ ID NO: 173297 - protein, 10 aa, Artificial Sequence
  Description of Artificial Sequence: Synthetic peptide
  Seed: NISIYNYFVW (TYRP1_HUMAN)
NFSIYNYFVW

SEQ ID NO: 173298 - protein, 9 aa, Artificial Sequence
  Description of Artificial Sequence: Synthetic peptide
  Seed: KLQNPNQSV (TYRP1_HUMAN)
KMQNPNQSV

SEQ ID NO: 173299 - protein, 10 aa, Artificial Sequence
  Description of Artificial Sequence: Synthetic peptide
  Seed: SMDEANQPLL (TYRP1_HUMAN)
SADEANQPLI

SEQ ID NO: 173300 - protein, 9 aa, Artificial Sequence
  Description of Artificial Sequence: Synthetic peptide
  Seed: MAKRTTHPL (TYRP1_HUMAN)
MTKRTTHPT

SEQ ID NO: 173301 - protein, 9 aa, Artificial Sequence
  Description of Artificial Sequence: Synthetic peptide
  Seed: VARPMVQRL (TYRP1_HUMAN)
VMRPMVQRK

SEQ ID NO: 173302 - protein, 9 aa, Artificial Sequence
  Description of Artificial Sequence: Synthetic peptide
  Seed: SVPEIIAIA (TYRP1_HUMAN)
SGPEIIAIL

SEQ ID NO: 173303 - protein, 10 aa, Artificial Sequence
  Description of Artificial Sequence: Synthetic peptide
  Seed: AQFPRQCATV (TYRP1_HUMAN)
AHFPRQCATY

SEQ ID NO: 173304 - protein, 9 aa, Artificial Sequence
  Description of Artificial Sequence: Synthetic peptide
  Seed: MLQEPSFSL (TYRP1_HUMAN)
MMQEPSFSR

SEQ ID NO: 173305 - protein, 9 aa, Artificial Sequence
  Description of Artificial Sequence: Synthetic peptide
  Seed: SVFSQWRVV (TYRP1_HUMAN)
SAFSQWRVK

SEQ ID NO: 173306 - protein, 9 aa, Artificial Sequence
  Description of Artificial Sequence: Synthetic peptide
  Seed: RARRSMDEA (TYRP1_HUMAN)
RIRRSMDEL

SEQ ID NO: 173307 - protein, 10 aa, Artificial Sequence
  Description of Artificial Sequence: Synthetic peptide
  Seed: FVTAPDNLGY (TYRP1_HUMAN)
FMTAPDNLGW

SEQ ID NO: 173308 - protein, 9 aa, Artificial Sequence
  Description of Artificial Sequence: Synthetic peptide
  Seed: MLQEPSFSL (TYRP1_HUMAN)
MVQEPSFSM

SEQ ID NO: 173309 - protein, 9 aa, Artificial Sequence
  Description of Artificial Sequence: Synthetic peptide
  Seed: VARPMVQRL (TYRP1_HUMAN)
VARPMVQRF

SEQ ID NO: 173310 - protein, 10 aa, Artificial Sequence
  Description of Artificial Sequence: Synthetic peptide
  Seed: EVWPLRFFNR (TYRP1_HUMAN)
EFWPLRFFNR

SEQ ID NO: 173311 - protein, 9 aa, Artificial Sequence
  Description of Artificial Sequence: Synthetic peptide
  Seed: QEMLQEPSF (TYRP1_HUMAN)
QVMLQEPSF

SEQ ID NO: 173312 - protein, 10 aa, Artificial Sequence
  Description of Artificial Sequence: Synthetic peptide
  Seed: TASYLIRARR (TYRP1_HUMAN)
TSSYLIRARK

SEQ ID NO: 173313 - protein, 9 aa, Artificial Sequence
  Description of Artificial Sequence: Synthetic peptide
  Seed: YTYEIQWPS (TYRP1_HUMAN)
YQYEIQWPP

SEQ ID NO: 173314 - protein, 9 aa, Artificial Sequence
  Description of Artificial Sequence: Synthetic peptide
  Seed: APIGHNRQY (TYRP1_HUMAN)
AFIGHNRQY

SEQ ID NO: 173315 - protein, 9 aa, Artificial Sequence
  Description of Artificial Sequence: Synthetic peptide
  Seed: FLGVGQESF (TYRP1_HUMAN)
FTGVGQESL

SEQ ID NO: 173316 - protein, 10 aa, Artificial Sequence
  Description of Artificial Sequence: Synthetic peptide
  Seed: FVLLHTFTDA (TYRP1_HUMAN)
FLLLHTFTDM

SEQ ID NO: 173317 - protein, 9 aa, Artificial Sequence
  Description of Artificial Sequence: Synthetic peptide
  Seed: FYSNSTNSF (TYRP1_HUMAN)
FSSNSTNSY

SEQ ID NO: 173318 - protein, 9 aa, Artificial Sequence
  Description of Artificial Sequence: Synthetic peptide
  Seed: ENAPIGHNR (TYRP1_HUMAN)
EAAPIGHNR

SEQ ID NO: 173319 - protein, 11 aa, Artificial Sequence
  Description of Artificial Sequence: Synthetic peptide
  Seed: FPLLLFQQARA (TYRP1_HUMAN)
FLLLLFQQARV

SEQ ID NO: 173320 - protein, 9 aa, Artificial Sequence
  Description of Artificial Sequence: Synthetic peptide
  Seed: YTYEIQWPS (TYRP1_HUMAN)
YLYEIQWPR

SEQ ID NO: 173321 - protein, 9 aa, Artificial Sequence
  Description of Artificial Sequence: Synthetic peptide
  Seed: ENAPIGHNR (TYRP1_HUMAN)
EIAPIGHNL

SEQ ID NO: 173322 - protein, 9 aa, Artificial Sequence
  Description of Artificial Sequence: Synthetic peptide
  Seed: LHTFTDAVF (TYRP1_HUMAN)
LVTFTDAVF

SEQ ID NO: 173323 - protein, 9 aa, Artificial Sequence
  Description of Artificial Sequence: Synthetic peptide
  Seed: GALLLVALI (TYRP1_HUMAN)
GMLLLVALL

SEQ ID NO: 173324 - protein, 11 aa, Artificial Sequence
  Description of Artificial Sequence: Synthetic peptide
  Seed: ILGPDGNTPQF (TYRP1_HUMAN)
IYGPDGNTPQF

SEQ ID NO: 173325 - protein, 9 aa, Artificial Sequence
  Description of Artificial Sequence: Synthetic peptide
  Seed: ACDQRVLIV (TYRP1_HUMAN)
AIDQRVLIF

SEQ ID NO: 173326 - protein, 9 aa, Artificial Sequence
  Description of Artificial Sequence: Synthetic peptide
  Seed: VARPMVQRL (TYRP1_HUMAN)
VFRPMVQRL

SEQ ID NO: 173327 - protein, 9 aa, Artificial Sequence
  Description of Artificial Sequence: Synthetic peptide
  Seed: ISIYNYFVW (TYRP1_HUMAN)
IQIYNYFVH

SEQ ID NO: 173328 - protein, 9 aa, Artificial Sequence
  Description of Artificial Sequence: Synthetic peptide
  Seed: VFDEWLRRY (TYRP1_HUMAN)
VLDEWLRRL

SEQ ID NO: 173329 - protein, 9 aa, Artificial Sequence
  Description of Artificial Sequence: Synthetic peptide
  Seed: FSVPEIIAI (TYRP1_HUMAN)
FGVPEIIAV

SEQ ID NO: 173330 - protein, 11 aa, Artificial Sequence
  Description of Artificial Sequence: Synthetic peptide
  Seed: HTFTDAVFDEW (TYRP1_HUMAN)
HAFTDAVFDEW

SEQ ID NO: 173331 - protein, 10 aa, Artificial Sequence
  Description of Artificial Sequence: Synthetic peptide
  Seed: THLSPNDPIF (TYRP1_HUMAN)
THLSPNDPIM

SEQ ID NO: 173332 - protein, 11 aa, Artificial Sequence
  Description of Artificial Sequence: Synthetic peptide
  Seed: VCDSLEDYDTL (TYRP1_HUMAN)
VADSLEDYDTF

SEQ ID NO: 173333 - protein, 9 aa, Artificial Sequence
  Description of Artificial Sequence: Synthetic peptide
  Seed: APDNLGYTY (TYRP1_HUMAN)
AYDNLGYTM

SEQ ID NO: 173334 - protein, 9 aa, Artificial Sequence
  Description of Artificial Sequence: Synthetic peptide
  Seed: FLGVGQESF (TYRP1_HUMAN)
FVGVGQESY

SEQ ID NO: 173335 - protein, 9 aa, Artificial Sequence
  Description of Artificial Sequence: Synthetic peptide
  Seed: FSVPEIIAI (TYRP1_HUMAN)
FVVPEIIAI

SEQ ID NO: 173336 - protein, 9 aa, Artificial Sequence
  Description of Artificial Sequence: Synthetic peptide
  Seed: TFPLENAPI (TYRP1_HUMAN)
TMPLENAPL

SEQ ID NO: 173337 - protein, 9 aa, Artificial Sequence
  Description of Artificial Sequence: Synthetic peptide
  Seed: YNYFVWTHY (TYRP1_HUMAN)
YAYFVWTHK

SEQ ID NO: 173338 - protein, 9 aa, Artificial Sequence
  Description of Artificial Sequence: Synthetic peptide
  Seed: YTYEIQWPS (TYRP1_HUMAN)
YQYEIQWPA

SEQ ID NO: 173339 - protein, 9 aa, Artificial Sequence
  Description of Artificial Sequence: Synthetic peptide
  Seed: AACDQRVLI (TYRP1_HUMAN)
ASCDQRVLV

SEQ ID NO: 173340 - protein, 10 aa, Artificial Sequence
  Description of Artificial Sequence: Synthetic peptide
  Seed: TWHRYHLLRL (TYRP1_HUMAN)
TWHRYHLLRF

SEQ ID NO: 173341 - protein, 9 aa, Artificial Sequence
  Description of Artificial Sequence: Synthetic peptide
  Seed: LTDQYQCYA (TYRP1_HUMAN)
LADQYQCYI

SEQ ID NO: 173342 - protein, 9 aa, Artificial Sequence
  Description of Artificial Sequence: Synthetic peptide
  Seed: RPMVQRLPE (TYRP1_HUMAN)
RAMVQRLPI

SEQ ID NO: 173343 - protein, 9 aa, Artificial Sequence
  Description of Artificial Sequence: Synthetic peptide
  Seed: YYSVKKTFL (TYRP1_HUMAN)
YFSVKKTFY

SEQ ID NO: 173344 - protein, 10 aa, Artificial Sequence
  Description of Artificial Sequence: Synthetic peptide
  Seed: MSAPKLLSLG (TYRP1_HUMAN)
MSAPKLLSLL

SEQ ID NO: 173345 - protein, 10 aa, Artificial Sequence
  Description of Artificial Sequence: Synthetic peptide
  Seed: FVTAPDNLGY (TYRP1_HUMAN)
FATAPDNLGW

SEQ ID NO: 173346 - protein, 10 aa, Artificial Sequence
  Description of Artificial Sequence: Synthetic peptide
  Seed: HPLFVIATRR (TYRP1_HUMAN)
HTLFVIATRS

SEQ ID NO: 173347 - protein, 10 aa, Artificial Sequence
  Description of Artificial Sequence: Synthetic peptide
  Seed: VALIFGTASY (TYRP1_HUMAN)
VRLIFGTASY

SEQ ID NO: 173348 - protein, 9 aa, Artificial Sequence
  Description of Artificial Sequence: Synthetic peptide
  Seed: KLLSLGCIF (TYRP1_HUMAN)
KYLSLGCII

SEQ ID NO: 173349 - protein, 9 aa, Artificial Sequence
  Description of Artificial Sequence: Synthetic peptide
  Seed: QRLPEPQDV (TYRP1_HUMAN)
QHLPEPQDF

SEQ ID NO: 173350 - protein, 9 aa, Artificial Sequence
  Description of Artificial Sequence: Synthetic peptide
  Seed: AVVGALLLV (TYRP1_HUMAN)
AQVGALLLA

SEQ ID NO: 173351 - protein, 9 aa, Artificial Sequence
  Description of Artificial Sequence: Synthetic peptide
  Seed: YNYFVWTHY (TYRP1_HUMAN)
YTYFVWTHI

SEQ ID NO: 173352 - protein, 9 aa, Artificial Sequence
  Description of Artificial Sequence: Synthetic peptide
  Seed: HPLFVIATR (TYRP1_HUMAN)
HPLFVIATI

SEQ ID NO: 173353 - protein, 9 aa, Artificial Sequence
  Description of Artificial Sequence: Synthetic peptide
  Seed: FSHEGPAFL (TYRP1_HUMAN)
FRHEGPAFY

SEQ ID NO: 173354 - protein, 10 aa, Artificial Sequence
  Description of Artificial Sequence: Synthetic peptide
  Seed: LGPDGNTPQF (TYRP1_HUMAN)
LVPDGNTPQF

SEQ ID NO: 173355 - protein, 9 aa, Artificial Sequence
  Description of Artificial Sequence: Synthetic peptide
  Seed: DAVFDEWLR (TYRP1_HUMAN)
DMVFDEWLR

SEQ ID NO: 173356 - protein, 9 aa, Artificial Sequence
  Description of Artificial Sequence: Synthetic peptide
  Seed: TWHRYHLLR (TYRP1_HUMAN)
TVHRYHLLK

SEQ ID NO: 173357 - protein, 9 aa, Artificial Sequence
  Description of Artificial Sequence: Synthetic peptide
  Seed: IVRRNLLDL (TYRP1_HUMAN)
IQRRNLLDY

SEQ ID NO: 173358 - protein, 10 aa, Artificial Sequence
  Description of Artificial Sequence: Synthetic peptide
  Seed: RRYNADISTF (TYRP1_HUMAN)
RHYNADISTF

SEQ ID NO: 173359 - protein, 10 aa, Artificial Sequence
  Description of Artificial Sequence: Synthetic peptide
  Seed: TDAVFDEWLR (TYRP1_HUMAN)
TWAVFDEWLR

SEQ ID NO: 173360 - protein, 9 aa, Artificial Sequence
  Description of Artificial Sequence: Synthetic peptide
  Seed: SFRNTVEGY (TYRP1_HUMAN)
SLRNTVEGY

SEQ ID NO: 173361 - protein, 9 aa, Artificial Sequence
  Description of Artificial Sequence: Synthetic peptide
  Seed: RYHLLRLEK (TYRP1_HUMAN)
RQHLLRLER

SEQ ID NO: 173362 - protein, 9 aa, Artificial Sequence
  Description of Artificial Sequence: Synthetic peptide
  Seed: SMDEANQPL (TYRP1_HUMAN)
SLDEANQPL

SEQ ID NO: 173363 - protein, 8 aa, Artificial Sequence
  Description of Artificial Sequence: Synthetic peptide
  Seed: LIFGTASY (TYRP1_HUMAN)
LQFGTASY

SEQ ID NO: 173364 - protein, 9 aa, Artificial Sequence
  Description of Artificial Sequence: Synthetic peptide
  Seed: SLGCIFFPL (TYRP1_HUMAN)
SQGCIFFPI

SEQ ID NO: 173365 - protein, 9 aa, Artificial Sequence
  Description of Artificial Sequence: Synthetic peptide
  Seed: NYFVWTHYY (TYRP1_HUMAN)
NGFVWTHYR

SEQ ID NO: 173366 - protein, 10 aa, Artificial Sequence
  Description of Artificial Sequence: Synthetic peptide
  Seed: ISPNSVFSQW (TYRP1_HUMAN)
IHPNSVFSQW

SEQ ID NO: 173367 - protein, 9 aa, Artificial Sequence
  Description of Artificial Sequence: Synthetic peptide
  Seed: MSAPKLLSL (TYRP1_HUMAN)
MIAPKLLSY

SEQ ID NO: 173368 - protein, 9 aa, Artificial Sequence
  Description of Artificial Sequence: Synthetic peptide
  Seed: ACDQRVLIV (TYRP1_HUMAN)
AQDQRVLIL

SEQ ID NO: 173369 - protein, 9 aa, Artificial Sequence
  Description of Artificial Sequence: Synthetic peptide
  Seed: ACDQRVLIV (TYRP1_HUMAN)
AIDQRVLII

SEQ ID NO: 173370 - protein, 10 aa, Artificial Sequence
  Description of Artificial Sequence: Synthetic peptide
  Seed: LIFGTASYLI (TYRP1_HUMAN)
LMFGTASYLI

SEQ ID NO: 173371 - protein, 10 aa, Artificial Sequence
  Description of Artificial Sequence: Synthetic peptide
  Seed: RTTHPLFVIA (TYRP1_HUMAN)
RITHPLFVIK

SEQ ID NO: 173372 - protein, 9 aa, Artificial Sequence
  Description of Artificial Sequence: Synthetic peptide
  Seed: YTYEIQWPS (TYRP1_HUMAN)
YCYEIQWPR

SEQ ID NO: 173373 - protein, 11 aa, Artificial Sequence
  Description of Artificial Sequence: Synthetic peptide
  Seed: MLQEPSFSLPY (TYRP1_HUMAN)
MPQEPSFSLPM

SEQ ID NO: 173374 - protein, 9 aa, Artificial Sequence
  Description of Artificial Sequence: Synthetic peptide
  Seed: MSAPKLLSL (TYRP1_HUMAN)
MLAPKLLST

SEQ ID NO: 173375 - protein, 11 aa, Artificial Sequence
  Description of Artificial Sequence: Synthetic peptide
  Seed: QFENISIYNYF (TYRP1_HUMAN)
QYENISIYNYW

SEQ ID NO: 173376 - protein, 10 aa, Artificial Sequence
  Description of Artificial Sequence: Synthetic peptide
  Seed: RRYNADISTF (TYRP1_HUMAN)
RQYNADISTF

SEQ ID NO: 173377 - protein, 10 aa, Artificial Sequence
  Description of Artificial Sequence: Synthetic peptide
  Seed: GTASYLIRAR (TYRP1_HUMAN)
GVASYLIRAK

SEQ ID NO: 173378 - protein, 9 aa, Artificial Sequence
  Description of Artificial Sequence: Synthetic peptide
  Seed: KYDPAVRSL (TYRP1_HUMAN)
KVDPAVRSM

SEQ ID NO: 173379 - protein, 9 aa, Artificial Sequence
  Description of Artificial Sequence: Synthetic peptide
  Seed: STNSFRNTV (TYRP1_HUMAN)
SMNSFRNTK

SEQ ID NO: 173380 - protein, 9 aa, Artificial Sequence
  Description of Artificial Sequence: Synthetic peptide
  Seed: SPNDPIFVL (TYRP1_HUMAN)
SPNDPIFVY

SEQ ID NO: 173381 - protein, 9 aa, Artificial Sequence
  Description of Artificial Sequence: Synthetic peptide
  Seed: SLHNLAHLF (TYRP1_HUMAN)
SFHNLAHLW

SEQ ID NO: 173382 - protein, 11 aa, Artificial Sequence
  Description of Artificial Sequence: Synthetic peptide
  Seed: MLQEPSFSLPY (TYRP1_HUMAN)
MAQEPSFSLPF

SEQ ID NO: 173383 - protein, 9 aa, Artificial Sequence
  Description of Artificial Sequence: Synthetic peptide
  Seed: TTHPLFVIA (TYRP1_HUMAN)
TMHPLFVIA

SEQ ID NO: 173384 - protein, 9 aa, Artificial Sequence
  Description of Artificial Sequence: Synthetic peptide
  Seed: FVWTHYYSV (TYRP1_HUMAN)
FRWTHYYSF

SEQ ID NO: 173385 - protein, 10 aa, Artificial Sequence
  Description of Artificial Sequence: Synthetic peptide
  Seed: LSLGCIFFPL (TYRP1_HUMAN)
LKLGCIFFPL

SEQ ID NO: 173386 - protein, 9 aa, Artificial Sequence
  Description of Artificial Sequence: Synthetic peptide
  Seed: FVWTHYYSV (TYRP1_HUMAN)
FIWTHYYSV

SEQ ID NO: 173387 - protein, 9 aa, Artificial Sequence
  Description of Artificial Sequence: Synthetic peptide
  Seed: DSRPHSPQY (TYRP1_HUMAN)
DSRPHSPQK

SEQ ID NO: 173388 - protein, 10 aa, Artificial Sequence
  Description of Artificial Sequence: Synthetic peptide
  Seed: FSVPEIIAIA (TYRP1_HUMAN)
FLVPEIIAII

SEQ ID NO: 173389 - protein, 10 aa, Artificial Sequence
  Description of Artificial Sequence: Synthetic peptide
  Seed: LIFGTASYLI (TYRP1_HUMAN)
LSFGTASYLV

SEQ ID NO: 173390 - protein, 10 aa, Artificial Sequence
  Description of Artificial Sequence: Synthetic peptide
  Seed: YNYFVWTHYY (TYRP1_HUMAN)
YWYFVWTHYM

SEQ ID NO: 173391 - protein, 9 aa, Artificial Sequence
  Description of Artificial Sequence: Synthetic peptide
  Seed: YTYEIQWPS (TYRP1_HUMAN)
YMYEIQWPN

SEQ ID NO: 173392 - protein, 9 aa, Artificial Sequence
  Description of Artificial Sequence: Synthetic peptide
  Seed: TADSRPHSP (TYRP1_HUMAN)
TTDSRPHSC

SEQ ID NO: 173393 - protein, 10 aa, Artificial Sequence
  Description of Artificial Sequence: Synthetic peptide
  Seed: SPNDPIFVLL (TYRP1_HUMAN)
SMNDPIFVLL

SEQ ID NO: 173394 - protein, 9 aa, Artificial Sequence
  Description of Artificial Sequence: Synthetic peptide
  Seed: LIFGTASYL (TYRP1_HUMAN)
LMFGTASYT

SEQ ID NO: 173395 - protein, 10 aa, Artificial Sequence
  Description of Artificial Sequence: Synthetic peptide
  Seed: NLLDLSKEEK (TYRP1_HUMAN)
NTLDLSKEER

SEQ ID NO: 173396 - protein, 9 aa, Artificial Sequence
  Description of Artificial Sequence: Synthetic peptide
  Seed: KYDPAVRSL (TYRP1_HUMAN)
KADPAVRSA

SEQ ID NO: 173397 - protein, 10 aa, Artificial Sequence
  Description of Artificial Sequence: Synthetic peptide
  Seed: VDFSHEGPAF (TYRP1_HUMAN)
VSFSHEGPAM

SEQ ID NO: 173398 - protein, 9 aa, Artificial Sequence
  Description of Artificial Sequence: Synthetic peptide
  Seed: APIGHNRQY (TYRP1_HUMAN)
AVIGHNRQM

SEQ ID NO: 173399 - protein, 10 aa, Artificial Sequence
  Description of Artificial Sequence: Synthetic peptide
  Seed: FWPPVTNTEM (TYRP1_HUMAN)
FAPPVTNTEF

SEQ ID NO: 173400 - protein, 10 aa, Artificial Sequence
  Description of Artificial Sequence: Synthetic peptide
  Seed: FGTASYLIRA (TYRP1_HUMAN)
FDTASYLIRI

SEQ ID NO: 173401 - protein, 10 aa, Artificial Sequence
  Description of Artificial Sequence: Synthetic peptide
  Seed: EGYSDPTGKY (TYRP1_HUMAN)
EAYSDPTGKR

SEQ ID NO: 173402 - protein, 11 aa, Artificial Sequence
  Description of Artificial Sequence: Synthetic peptide
  Seed: IAIAVVGALLL (TYRP1_HUMAN)
ITIAVVGALLW

SEQ ID NO: 173403 - protein, 10 aa, Artificial Sequence
  Description of Artificial Sequence: Synthetic peptide
  Seed: NTPQFENISI (TYRP1_HUMAN)
NTPQFENISV

SEQ ID NO: 173404 - protein, 10 aa, Artificial Sequence
  Description of Artificial Sequence: Synthetic peptide
  Seed: YNADISTFPL (TYRP1_HUMAN)
YGADISTFPL

SEQ ID NO: 173405 - protein, 10 aa, Artificial Sequence
  Description of Artificial Sequence: Synthetic peptide
  Seed: VDFSHEGPAF (TYRP1_HUMAN)
VLFSHEGPAY

SEQ ID NO: 173406 - protein, 9 aa, Artificial Sequence
  Description of Artificial Sequence: Synthetic peptide
  Seed: GLFDTPPFY (TYRP1_HUMAN)
GIFDTPPFW

SEQ ID NO: 173407 - protein, 9 aa, Artificial Sequence
  Description of Artificial Sequence: Synthetic peptide
  Seed: IFGTASYLI (TYRP1_HUMAN)
IWGTASYLL

SEQ ID NO: 173408 - protein, 10 aa, Artificial Sequence
  Description of Artificial Sequence: Synthetic peptide
  Seed: YTYEIQWPSR (TYRP1_HUMAN)
YQYEIQWPSR

SEQ ID NO: 173409 - protein, 10 aa, Artificial Sequence
  Description of Artificial Sequence: Synthetic peptide
  Seed: HRYHLLRLEK (TYRP1_HUMAN)
HGYHLLRLER

SEQ ID NO: 173410 - protein, 10 aa, Artificial Sequence
  Description of Artificial Sequence: Synthetic peptide
  Seed: YSVKKTFLGV (TYRP1_HUMAN)
YMVKKTFLGI

SEQ ID NO: 173411 - protein, 9 aa, Artificial Sequence
  Description of Artificial Sequence: Synthetic peptide
  Seed: FSHEGPAFL (TYRP1_HUMAN)
FPHEGPAFL

SEQ ID NO: 173412 - protein, 9 aa, Artificial Sequence
  Description of Artificial Sequence: Synthetic peptide
  Seed: RQYNMVPFW (TYRP1_HUMAN)
RTYNMVPFY

SEQ ID NO: 173413 - protein, 10 aa, Artificial Sequence
  Description of Artificial Sequence: Synthetic peptide
  Seed: SPNDPIFVLL (TYRP1_HUMAN)
SSNDPIFVLY

SEQ ID NO: 173414 - protein, 9 aa, Artificial Sequence
  Description of Artificial Sequence: Synthetic peptide
  Seed: LIFGTASYL (TYRP1_HUMAN)
LQFGTASYL

SEQ ID NO: 173415 - protein, 10 aa, Artificial Sequence
  Description of Artificial Sequence: Synthetic peptide
  Seed: IAVVGALLLV (TYRP1_HUMAN)
IMVVGALLLL

SEQ ID NO: 173416 - protein, 9 aa, Artificial Sequence
  Description of Artificial Sequence: Synthetic peptide
  Seed: GLFDTPPFY (TYRP1_HUMAN)
GYFDTPPFY

SEQ ID NO: 173417 - protein, 11 aa, Artificial Sequence
  Description of Artificial Sequence: Synthetic peptide
  Seed: YNMVPFWPPVT (TYRP1_HUMAN)
YQMVPFWPPVG

SEQ ID NO: 173418 - protein, 9 aa, Artificial Sequence
  Description of Artificial Sequence: Synthetic peptide
  Seed: MAKRTTHPL (TYRP1_HUMAN)
MWKRTTHPK

SEQ ID NO: 173419 - protein, 9 aa, Artificial Sequence
  Description of Artificial Sequence: Synthetic peptide
  Seed: IAIAVVGAL (TYRP1_HUMAN)
IIIAVVGAM

SEQ ID NO: 173420 - protein, 9 aa, Artificial Sequence
  Description of Artificial Sequence: Synthetic peptide
  Seed: QEPSFSLPY (TYRP1_HUMAN)
QFPSFSLPY

SEQ ID NO: 173421 - protein, 9 aa, Artificial Sequence
  Description of Artificial Sequence: Synthetic peptide
  Seed: YNYFVWTHY (TYRP1_HUMAN)
YQYFVWTHH

SEQ ID NO: 173422 - protein, 11 aa, Artificial Sequence
  Description of Artificial Sequence: Synthetic peptide
  Seed: YNMVPFWPPVT (TYRP1_HUMAN)
YMMVPFWPPVQ

SEQ ID NO: 173423 - protein, 10 aa, Artificial Sequence
  Description of Artificial Sequence: Synthetic peptide
  Seed: LTWHRYHLLR (TYRP1_HUMAN)
LNWHRYHLLR

SEQ ID NO: 173424 - protein, 9 aa, Artificial Sequence
  Description of Artificial Sequence: Synthetic peptide
  Seed: HYYSVKKTF (TYRP1_HUMAN)
HAYSVKKTL

SEQ ID NO: 173425 - protein, 9 aa, Artificial Sequence
  Description of Artificial Sequence: Synthetic peptide
  Seed: FYSNSTNSF (TYRP1_HUMAN)
FRSNSTNSF

SEQ ID NO: 173426 - protein, 10 aa, Artificial Sequence
  Description of Artificial Sequence: Synthetic peptide
  Seed: EVWPLRFFNR (TYRP1_HUMAN)
EQWPLRFFNR

SEQ ID NO: 173427 - protein, 9 aa, Artificial Sequence
  Description of Artificial Sequence: Synthetic peptide
  Seed: VARPMVQRL (TYRP1_HUMAN)
VNRPMVQRW

SEQ ID NO: 173428 - protein, 9 aa, Artificial Sequence
  Description of Artificial Sequence: Synthetic peptide
  Seed: MAKRTTHPL (TYRP1_HUMAN)
MMKRTTHPL

SEQ ID NO: 173429 - protein, 9 aa, Artificial Sequence
  Description of Artificial Sequence: Synthetic peptide
  Seed: RFFNRTCHC (TYRP1_HUMAN)
RMFNRTCHM

SEQ ID NO: 173430 - protein, 9 aa, Artificial Sequence
  Description of Artificial Sequence: Synthetic peptide
  Seed: GEVDFSHEG (TYRP1_HUMAN)
GDVDFSHEW

SEQ ID NO: 173431 - protein, 9 aa, Artificial Sequence
  Description of Artificial Sequence: Synthetic peptide
  Seed: TNTEMFVTA (TYRP1_HUMAN)
THTEMFVTI

SEQ ID NO: 173432 - protein, 9 aa, Artificial Sequence
  Description of Artificial Sequence: Synthetic peptide
  Seed: REFSVPEII (TYRP1_HUMAN)
RQFSVPEII

SEQ ID NO: 173433 - protein, 9 aa, Artificial Sequence
  Description of Artificial Sequence: Synthetic peptide
  Seed: FLTWHRYHL (TYRP1_HUMAN)
FATWHRYHF

SEQ ID NO: 173434 - protein, 10 aa, Artificial Sequence
  Description of Artificial Sequence: Synthetic peptide
  Seed: TDAVFDEWLR (TYRP1_HUMAN)
TLAVFDEWLR

SEQ ID NO: 173435 - protein, 9 aa, Artificial Sequence
  Description of Artificial Sequence: Synthetic peptide
  Seed: TAPDNLGYT (TYRP1_HUMAN)
TGPDNLGYL

SEQ ID NO: 173436 - protein, 9 aa, Artificial Sequence
  Description of Artificial Sequence: Synthetic peptide
  Seed: SVFSQWRVV (TYRP1_HUMAN)
SFFSQWRVK

SEQ ID NO: 173437 - protein, 9 aa, Artificial Sequence
  Description of Artificial Sequence: Synthetic peptide
  Seed: LLHTFTDAV (TYRP1_HUMAN)
LQHTFTDAL

SEQ ID NO: 173438 - protein, 9 aa, Artificial Sequence
  Description of Artificial Sequence: Synthetic peptide
  Seed: HEGPAFLTW (TYRP1_HUMAN)
HDGPAFLTI

SEQ ID NO: 173439 - protein, 8 aa, Artificial Sequence
  Description of Artificial Sequence: Synthetic peptide
  Seed: YSNSTNSF (TYRP1_HUMAN)
YANSTNSM

SEQ ID NO: 173440 - protein, 10 aa, Artificial Sequence
  Description of Artificial Sequence: Synthetic peptide
  Seed: RRNPAGNVAR (TYRP1_HUMAN)
RRNPAGNVAF

SEQ ID NO: 173441 - protein, 9 aa, Artificial Sequence
  Description of Artificial Sequence: Synthetic peptide
  Seed: FLGVGQESF (TYRP1_HUMAN)
FSGVGQESM

SEQ ID NO: 173442 - protein, 9 aa, Artificial Sequence
  Description of Artificial Sequence: Synthetic peptide
  Seed: FYSNSTNSF (TYRP1_HUMAN)
FASNSTNSW

SEQ ID NO: 173443 - protein, 9 aa, Artificial Sequence
  Description of Artificial Sequence: Synthetic peptide
  Seed: MLQEPSFSL (TYRP1_HUMAN)
MVQEPSFSK

SEQ ID NO: 173444 - protein, 9 aa, Artificial Sequence
  Description of Artificial Sequence: Synthetic peptide
  Seed: FSVPEIIAI (TYRP1_HUMAN)
FPVPEIIAY

SEQ ID NO: 173445 - protein, 10 aa, Artificial Sequence
  Description of Artificial Sequence: Synthetic peptide
  Seed: SREFSVPEII (TYRP1_HUMAN)
SQEFSVPEIL

SEQ ID NO: 173446 - protein, 10 aa, Artificial Sequence
  Description of Artificial Sequence: Synthetic peptide
  Seed: YNYFVWTHYY (TYRP1_HUMAN)
YPYFVWTHYL

SEQ ID NO: 173447 - protein, 11 aa, Artificial Sequence
  Description of Artificial Sequence: Synthetic peptide
  Seed: YYSVKKTFLGV (TYRP1_HUMAN)
YYSVKKTFLGW

SEQ ID NO: 173448 - protein, 9 aa, Artificial Sequence
  Description of Artificial Sequence: Synthetic peptide
  Seed: RQCATVEAL (TYRP1_HUMAN)
RVCATVEAI

SEQ ID NO: 173449 - protein, 10 aa, Artificial Sequence
  Description of Artificial Sequence: Synthetic peptide
  Seed: AQFPRQCATV (TYRP1_HUMAN)
AMFPRQCATA

SEQ ID NO: 173450 - protein, 9 aa, Artificial Sequence
  Description of Artificial Sequence: Synthetic peptide
  Seed: LQNPNQSVV (TYRP1_HUMAN)
LRNPNQSVM

SEQ ID NO: 173451 - protein, 9 aa, Artificial Sequence
  Description of Artificial Sequence: Synthetic peptide
  Seed: IIAIAVVGA (TYRP1_HUMAN)
IQAIAVVGI

SEQ ID NO: 173452 - protein, 10 aa, Artificial Sequence
  Description of Artificial Sequence: Synthetic peptide
  Seed: FLTWHRYHLL (TYRP1_HUMAN)
FMTWHRYHLV

SEQ ID NO: 173453 - protein, 9 aa, Artificial Sequence
  Description of Artificial Sequence: Synthetic peptide
  Seed: NMVPFWPPV (TYRP1_HUMAN)
NFVPFWPPM

SEQ ID NO: 173454 - protein, 9 aa, Artificial Sequence
  Description of Artificial Sequence: Synthetic peptide
  Seed: KYDPAVRSL (TYRP1_HUMAN)
KPDPAVRSL

SEQ ID NO: 173455 - protein, 9 aa, Artificial Sequence
  Description of Artificial Sequence: Synthetic peptide
  Seed: ISIYNYFVW (TYRP1_HUMAN)
IPIYNYFVF

SEQ ID NO: 173456 - protein, 9 aa, Artificial Sequence
  Description of Artificial Sequence: Synthetic peptide
  Seed: AACDQRVLI (TYRP1_HUMAN)
AVCDQRVLW

SEQ ID NO: 173457 - protein, 9 aa, Artificial Sequence
  Description of Artificial Sequence: Synthetic peptide
  Seed: AVVGALLLV (TYRP1_HUMAN)
AAVGALLLL

SEQ ID NO: 173458 - protein, 9 aa, Artificial Sequence
  Description of Artificial Sequence: Synthetic peptide
  Seed: RSLHNLAHL (TYRP1_HUMAN)
RLLHNLAHI

SEQ ID NO: 173459 - protein, 10 aa, Artificial Sequence
  Description of Artificial Sequence: Synthetic peptide
  Seed: SLGCIFFPLL (TYRP1_HUMAN)
SMGCIFFPLV

SEQ ID NO: 173460 - protein, 9 aa, Artificial Sequence
  Description of Artificial Sequence: Synthetic peptide
  Seed: YYSVKKTFL (TYRP1_HUMAN)
YRSVKKTFM

SEQ ID NO: 173461 - protein, 10 aa, Artificial Sequence
  Description of Artificial Sequence: Synthetic peptide
  Seed: FVLLHTFTDA (TYRP1_HUMAN)
FSLLHTFTDL

SEQ ID NO: 173462 - protein, 10 aa, Artificial Sequence
  Description of Artificial Sequence: Synthetic peptide
  Seed: FGTASYLIRA (TYRP1_HUMAN)
FCTASYLIRI

SEQ ID NO: 173463 - protein, 9 aa, Artificial Sequence
  Description of Artificial Sequence: Synthetic peptide
  Seed: MLQEPSFSL (TYRP1_HUMAN)
MTQEPSFSR

SEQ ID NO: 173464 - protein, 9 aa, Artificial Sequence
  Description of Artificial Sequence: Synthetic peptide
  Seed: QCATVEALR (TYRP1_HUMAN)
QAATVEALK

SEQ ID NO: 173465 - protein, 9 aa, Artificial Sequence
  Description of Artificial Sequence: Synthetic peptide
  Seed: IAIAVVGAL (TYRP1_HUMAN)
IHIAVVGAF

SEQ ID NO: 173466 - protein, 9 aa, Artificial Sequence
  Description of Artificial Sequence: Synthetic peptide
  Seed: GTASYLIRA (TYRP1_HUMAN)
GTASYLIRV

SEQ ID NO: 173467 - protein, 9 aa, Artificial Sequence
  Description of Artificial Sequence: Synthetic peptide
  Seed: RQYNMVPFW (TYRP1_HUMAN)
RKYNMVPFL

SEQ ID NO: 173468 - protein, 9 aa, Artificial Sequence
  Description of Artificial Sequence: Synthetic peptide
  Seed: TADSRPHSP (TYRP1_HUMAN)
TLDSRPHSL

SEQ ID NO: 173469 - protein, 9 aa, Artificial Sequence
  Description of Artificial Sequence: Synthetic peptide
  Seed: FLTWHRYHL (TYRP1_HUMAN)
FLTWHRYHM

SEQ ID NO: 173470 - protein, 9 aa, Artificial Sequence
  Description of Artificial Sequence: Synthetic peptide
  Seed: FLTWHRYHL (TYRP1_HUMAN)
FTTWHRYHI

SEQ ID NO: 173471 - protein, 11 aa, Artificial Sequence
  Description of Artificial Sequence: Synthetic peptide
  Seed: RSMDEANQPLL (TYRP1_HUMAN)
RIMDEANQPLI

SEQ ID NO: 173472 - protein, 11 aa, Artificial Sequence
  Description of Artificial Sequence: Synthetic peptide
  Seed: RRYNADISTFP (TYRP1_HUMAN)
RYYNADISTFI

SEQ ID NO: 173473 - protein, 10 aa, Artificial Sequence
  Description of Artificial Sequence: Synthetic peptide
  Seed: LLLVALIFGT (TYRP1_HUMAN)
LELVALIFGV

SEQ ID NO: 173474 - protein, 9 aa, Artificial Sequence
  Description of Artificial Sequence: Synthetic peptide
  Seed: RQCATVEAL (TYRP1_HUMAN)
RICATVEAM

SEQ ID NO: 173475 - protein, 10 aa, Artificial Sequence
  Description of Artificial Sequence: Synthetic peptide
  Seed: FSVPEIIAIA (TYRP1_HUMAN)
FQVPEIIAII

SEQ ID NO: 173476 - protein, 11 aa, Artificial Sequence
  Description of Artificial Sequence: Synthetic peptide
  Seed: TVEGYSDPTGK (TYRP1_HUMAN)
TMEGYSDPTGY

SEQ ID NO: 173477 - protein, 9 aa, Artificial Sequence
  Description of Artificial Sequence: Synthetic peptide
  Seed: CIFFPLLLF (TYRP1_HUMAN)
CQFFPLLLY

SEQ ID NO: 173478 - protein, 9 aa, Artificial Sequence
  Description of Artificial Sequence: Synthetic peptide
  Seed: SLGCIFFPL (TYRP1_HUMAN)
SLGCIFFPW

SEQ ID NO: 173479 - protein, 10 aa, Artificial Sequence
  Description of Artificial Sequence: Synthetic peptide
  Seed: YNYFVWTHYY (TYRP1_HUMAN)
YTYFVWTHYI

SEQ ID NO: 173480 - protein, 10 aa, Artificial Sequence
  Description of Artificial Sequence: Synthetic peptide
  Seed: LIFGTASYLI (TYRP1_HUMAN)
LLFGTASYLM

SEQ ID NO: 173481 - protein, 11 aa, Artificial Sequence
  Description of Artificial Sequence: Synthetic peptide
  Seed: VRSLHNLAHLF (TYRP1_HUMAN)
VTSLHNLAHLF

SEQ ID NO: 173482 - protein, 9 aa, Artificial Sequence
  Description of Artificial Sequence: Synthetic peptide
  Seed: RTTHPLFVI (TYRP1_HUMAN)
RMTHPLFVM

SEQ ID NO: 173483 - protein, 9 aa, Artificial Sequence
  Description of Artificial Sequence: Synthetic peptide
  Seed: MLQEPSFSL (TYRP1_HUMAN)
MYQEPSFSM

SEQ ID NO: 173484 - protein, 9 aa, Artificial Sequence
  Description of Artificial Sequence: Synthetic peptide
  Seed: FSHEGPAFL (TYRP1_HUMAN)
FPHEGPAFM

SEQ ID NO: 173485 - protein, 9 aa, Artificial Sequence
  Description of Artificial Sequence: Synthetic peptide
  Seed: LEKDMQEML (TYRP1_HUMAN)
LHKDMQEMF

SEQ ID NO: 173486 - protein, 11 aa, Artificial Sequence
  Description of Artificial Sequence: Synthetic peptide
  Seed: RSMDEANQPLL (TYRP1_HUMAN)
RSMDEANQPLM

SEQ ID NO: 173487 - protein, 11 aa, Artificial Sequence
  Description of Artificial Sequence: Synthetic peptide
  Seed: AGNVARPMVQR (TYRP1_HUMAN)
AVNVARPMVQK

SEQ ID NO: 173488 - protein, 10 aa, Artificial Sequence
  Description of Artificial Sequence: Synthetic peptide
  Seed: FPLENAPIGH (TYRP1_HUMAN)
FALENAPIGY

SEQ ID NO: 173489 - protein, 10 aa, Artificial Sequence
  Description of Artificial Sequence: Synthetic peptide
  Seed: FWPPVTNTEM (TYRP1_HUMAN)
FAPPVTNTEL

SEQ ID NO: 173490 - protein, 9 aa, Artificial Sequence
  Description of Artificial Sequence: Synthetic peptide
  Seed: LGCIFFPLL (TYRP1_HUMAN)
LMCIFFPLV

SEQ ID NO: 173491 - protein, 10 aa, Artificial Sequence
  Description of Artificial Sequence: Synthetic peptide
  Seed: RSMDEANQPL (TYRP1_HUMAN)
RMMDEANQPV

SEQ ID NO: 173492 - protein, 10 aa, Artificial Sequence
  Description of Artificial Sequence: Synthetic peptide
  Seed: ENISIYNYFV (TYRP1_HUMAN)
EPISIYNYFV

SEQ ID NO: 173493 - protein, 9 aa, Artificial Sequence
  Description of Artificial Sequence: Synthetic peptide
  Seed: QCATVEALR (TYRP1_HUMAN)
QMATVEALK

SEQ ID NO: 173494 - protein, 10 aa, Artificial Sequence
  Description of Artificial Sequence: Synthetic peptide
  Seed: FSLPYWNFAT (TYRP1_HUMAN)
FILPYWNFAM

SEQ ID NO: 173495 - protein, 9 aa, Artificial Sequence
  Description of Artificial Sequence: Synthetic peptide
  Seed: LGYTYEIQW (TYRP1_HUMAN)
LTYTYEIQM

SEQ ID NO: 173496 - protein, 9 aa, Artificial Sequence
  Description of Artificial Sequence: Synthetic peptide
  Seed: ACDQRVLIV (TYRP1_HUMAN)
AWDQRVLIV

SEQ ID NO: 173497 - protein, 9 aa, Artificial Sequence
  Description of Artificial Sequence: Synthetic peptide
  Seed: FLTWHRYHL (TYRP1_HUMAN)
FPTWHRYHL

SEQ ID NO: 173498 - protein, 10 aa, Artificial Sequence
  Description of Artificial Sequence: Synthetic peptide
  Seed: FVLLHTFTDA (TYRP1_HUMAN)
FYLLHTFTDL

SEQ ID NO: 173499 - protein, 9 aa, Artificial Sequence
  Description of Artificial Sequence: Synthetic peptide
  Seed: FYSNSTNSF (TYRP1_HUMAN)
FTSNSTNSY

SEQ ID NO: 173500 - protein, 10 aa, Artificial Sequence
  Description of Artificial Sequence: Synthetic peptide
  Seed: FQQARAQFPR (TYRP1_HUMAN)
FKQARAQFPR

SEQ ID NO: 173501 - protein, 9 aa, Artificial Sequence
  Description of Artificial Sequence: Synthetic peptide
  Seed: CTDDLMGSR (TYRP1_HUMAN)
CTDDLMGSY

SEQ ID NO: 173502 - protein, 10 aa, Artificial Sequence
  Description of Artificial Sequence: Synthetic peptide
  Seed: REFSVPEIIA (TYRP1_HUMAN)
REFSVPEIIM

SEQ ID NO: 173503 - protein, 11 aa, Artificial Sequence
  Description of Artificial Sequence: Synthetic peptide
  Seed: REVWPLRFFNR (TYRP1_HUMAN)
RLVWPLRFFNK

SEQ ID NO: 173504 - protein, 9 aa, Artificial Sequence
  Description of Artificial Sequence: Synthetic peptide
  Seed: RGRCEAVTA (TYRP1_HUMAN)
RGRCEAVTK

SEQ ID NO: 173505 - protein, 9 aa, Artificial Sequence
  Description of Artificial Sequence: Synthetic peptide
  Seed: NRQYNMVPF (TYRP1_HUMAN)
NWQYNMVPL

SEQ ID NO: 173506 - protein, 9 aa, Artificial Sequence
  Description of Artificial Sequence: Synthetic peptide
  Seed: SVPEIIAIA (TYRP1_HUMAN)
STPEIIAII

SEQ ID NO: 173507 - protein, 9 aa, Artificial Sequence
  Description of Artificial Sequence: Synthetic peptide
  Seed: SEEILGPDG (TYRP1_HUMAN)
SEEILGPDI

SEQ ID NO: 173508 - protein, 10 aa, Artificial Sequence
  Description of Artificial Sequence: Synthetic peptide
  Seed: ALIFGTASYL (TYRP1_HUMAN)
AQIFGTASYF

SEQ ID NO: 173509 - protein, 9 aa, Artificial Sequence
  Description of Artificial Sequence: Synthetic peptide
  Seed: QWPSREFSV (TYRP1_HUMAN)
QYPSREFSL

SEQ ID NO: 173510 - protein, 9 aa, Artificial Sequence
  Description of Artificial Sequence: Synthetic peptide
  Seed: SVPEIIAIA (TYRP1_HUMAN)
SCPEIIAIM

SEQ ID NO: 173511 - protein, 9 aa, Artificial Sequence
  Description of Artificial Sequence: Synthetic peptide
  Seed: FVWTHYYSV (TYRP1_HUMAN)
FAWTHYYSA

SEQ ID NO: 173512 - protein, 9 aa, Artificial Sequence
  Description of Artificial Sequence: Synthetic peptide
  Seed: FYSNSTNSF (TYRP1_HUMAN)
FGSNSTNSF

SEQ ID NO: 173513 - protein, 9 aa, Artificial Sequence
  Description of Artificial Sequence: Synthetic peptide
  Seed: LEKDMQEML (TYRP1_HUMAN)
LEKDMQEMF

SEQ ID NO: 173514 - protein, 9 aa, Artificial Sequence
  Description of Artificial Sequence: Synthetic peptide
  Seed: TADSRPHSP (TYRP1_HUMAN)
TNDSRPHSL

SEQ ID NO: 173515 - protein, 9 aa, Artificial Sequence
  Description of Artificial Sequence: Synthetic peptide
  Seed: FVWTHYYSV (TYRP1_HUMAN)
FVWTHYYSM

SEQ ID NO: 173516 - protein, 10 aa, Artificial Sequence
  Description of Artificial Sequence: Synthetic peptide
  Seed: LPYWNFATGK (TYRP1_HUMAN)
LRYWNFATGR

SEQ ID NO: 173517 - protein, 10 aa, Artificial Sequence
  Description of Artificial Sequence: Synthetic peptide
  Seed: GPAFLTWHRY (TYRP1_HUMAN)
GFAFLTWHRY

SEQ ID NO: 173518 - protein, 11 aa, Artificial Sequence
  Description of Artificial Sequence: Synthetic peptide
  Seed: LRRYNADISTF (TYRP1_HUMAN)
LLRYNADISTF

SEQ ID NO: 173519 - protein, 11 aa, Artificial Sequence
  Description of Artificial Sequence: Synthetic peptide
  Seed: CNSTEDGPIRR (TYRP1_HUMAN)
CTSTEDGPIRY

SEQ ID NO: 173520 - protein, 9 aa, Artificial Sequence
  Description of Artificial Sequence: Synthetic peptide
  Seed: SGHNCGTCR (TYRP1_HUMAN)
SAHNCGTCL

SEQ ID NO: 173521 - protein, 9 aa, Artificial Sequence
  Description of Artificial Sequence: Synthetic peptide
  Seed: YNYFVWTHY (TYRP1_HUMAN)
YYYFVWTHY

SEQ ID NO: 173522 - protein, 9 aa, Artificial Sequence
  Description of Artificial Sequence: Synthetic peptide
  Seed: SVFSQWRVV (TYRP1_HUMAN)
SSFSQWRVY

SEQ ID NO: 173523 - protein, 9 aa, Artificial Sequence
  Description of Artificial Sequence: Synthetic peptide
  Seed: VTAPDNLGY (TYRP1_HUMAN)
VAAPDNLGR

SEQ ID NO: 173524 - protein, 10 aa, Artificial Sequence
  Description of Artificial Sequence: Synthetic peptide
  Seed: FYSNSTNSFR (TYRP1_HUMAN)
FYSNSTNSFF

SEQ ID NO: 173525 - protein, 9 aa, Artificial Sequence
  Description of Artificial Sequence: Synthetic peptide
  Seed: SMDEANQPL (TYRP1_HUMAN)
SIDEANQPI

SEQ ID NO: 173526 - protein, 11 aa, Artificial Sequence
  Description of Artificial Sequence: Synthetic peptide
  Seed: YNYFVWTHYYS (TYRP1_HUMAN)
YFYFVWTHYYI

SEQ ID NO: 173527 - protein, 10 aa, Artificial Sequence
  Description of Artificial Sequence: Synthetic peptide
  Seed: ALIFGTASYL (TYRP1_HUMAN)
ATIFGTASYK

SEQ ID NO: 173528 - protein, 10 aa, Artificial Sequence
  Description of Artificial Sequence: Synthetic peptide
  Seed: MAKRTTHPLF (TYRP1_HUMAN)
MSKRTTHPLY

SEQ ID NO: 173529 - protein, 10 aa, Artificial Sequence
  Description of Artificial Sequence: Synthetic peptide
  Seed: TPQFENISIY (TYRP1_HUMAN)
TKQFENISIY

SEQ ID NO: 173530 - protein, 9 aa, Artificial Sequence
  Description of Artificial Sequence: Synthetic peptide
  Seed: EEYEKLQNP (TYRP1_HUMAN)
EEYEKLQNI

SEQ ID NO: 173531 - protein, 10 aa, Artificial Sequence
  Description of Artificial Sequence: Synthetic peptide
  Seed: RSLHNLAHLF (TYRP1_HUMAN)
RFLHNLAHLW

SEQ ID NO: 173532 - protein, 10 aa, Artificial Sequence
  Description of Artificial Sequence: Synthetic peptide
  Seed: IYNYFVWTHY (TYRP1_HUMAN)
IYNYFVWTHW

SEQ ID NO: 173533 - protein, 11 aa, Artificial Sequence
  Description of Artificial Sequence: Synthetic peptide
  Seed: VTAPDNLGYTY (TYRP1_HUMAN)
VFAPDNLGYTY

SEQ ID NO: 173534 - protein, 9 aa, Artificial Sequence
  Description of Artificial Sequence: Synthetic peptide
  Seed: AFLTWHRYH (TYRP1_HUMAN)
AQLTWHRYK

SEQ ID NO: 173535 - protein, 10 aa, Artificial Sequence
  Description of Artificial Sequence: Synthetic peptide
  Seed: HFVRALDMAK (TYRP1_HUMAN)
HVVRALDMAK

SEQ ID NO: 173536 - protein, 9 aa, Artificial Sequence
  Description of Artificial Sequence: Synthetic peptide
  Seed: SKEEKNHFV (TYRP1_HUMAN)
SFEEKNHFM

SEQ ID NO: 173537 - protein, 9 aa, Artificial Sequence
  Description of Artificial Sequence: Synthetic peptide
  Seed: NHFVRALDM (TYRP1_HUMAN)
NRFVRALDL

SEQ ID NO: 173538 - protein, 9 aa, Artificial Sequence
  Description of Artificial Sequence: Synthetic peptide
  Seed: YLIRARRSM (TYRP1_HUMAN)
YMIRARRSY

SEQ ID NO: 173539 - protein, 9 aa, Artificial Sequence
  Description of Artificial Sequence: Synthetic peptide
  Seed: STLISPNSV (TYRP1_HUMAN)
SALISPNSF

SEQ ID NO: 173540 - protein, 11 aa, Artificial Sequence
  Description of Artificial Sequence: Synthetic peptide
  Seed: IYNYFVWTHYY (TYRP1_HUMAN)
IDNYFVWTHYL

SEQ ID NO: 173541 - protein, 10 aa, Artificial Sequence
  Description of Artificial Sequence: Synthetic peptide
  Seed: SLGCIFFPLL (TYRP1_HUMAN)
SMGCIFFPLL

SEQ ID NO: 173542 - protein, 9 aa, Artificial Sequence
  Description of Artificial Sequence: Synthetic peptide
  Seed: STNSFRNTV (TYRP1_HUMAN)
SVNSFRNTY

SEQ ID NO: 173543 - protein, 9 aa, Artificial Sequence
  Description of Artificial Sequence: Synthetic peptide
  Seed: EKNHFVRAL (TYRP1_HUMAN)
EHNHFVRAL

SEQ ID NO: 173544 - protein, 9 aa, Artificial Sequence
  Description of Artificial Sequence: Synthetic peptide
  Seed: IAIAVVGAL (TYRP1_HUMAN)
IEIAVVGAY

SEQ ID NO: 173545 - protein, 9 aa, Artificial Sequence
  Description of Artificial Sequence: Synthetic peptide
  Seed: SMDEANQPL (TYRP1_HUMAN)
SGDEANQPF

SEQ ID NO: 173546 - protein, 9 aa, Artificial Sequence
  Description of Artificial Sequence: Synthetic peptide
  Seed: FSVPEIIAI (TYRP1_HUMAN)
FWVPEIIAM

SEQ ID NO: 173547 - protein, 9 aa, Artificial Sequence
  Description of Artificial Sequence: Synthetic peptide
  Seed: VTAPDNLGY (TYRP1_HUMAN)
VVAPDNLGF

SEQ ID NO: 173548 - protein, 11 aa, Artificial Sequence
  Description of Artificial Sequence: Synthetic peptide
  Seed: FLNGTGGQTHL (TYRP1_HUMAN)
FVNGTGGQTHY

SEQ ID NO: 173549 - protein, 11 aa, Artificial Sequence
  Description of Artificial Sequence: Synthetic peptide
  Seed: LRRYNADISTF (TYRP1_HUMAN)
LTRYNADISTF

SEQ ID NO: 173550 - protein, 10 aa, Artificial Sequence
  Description of Artificial Sequence: Synthetic peptide
  Seed: TPQFENISIY (TYRP1_HUMAN)
TNQFENISIY

SEQ ID NO: 173551 - protein, 9 aa, Artificial Sequence
  Description of Artificial Sequence: Synthetic peptide
  Seed: GSRSNFDST (TYRP1_HUMAN)
GIRSNFDSK

SEQ ID NO: 173552 - protein, 9 aa, Artificial Sequence
  Description of Artificial Sequence: Synthetic peptide
  Seed: FPLENAPIG (TYRP1_HUMAN)
FSLENAPIF

SEQ ID NO: 173553 - protein, 10 aa, Artificial Sequence
  Description of Artificial Sequence: Synthetic peptide
  Seed: LLHTFTDAVF (TYRP1_HUMAN)
LLHTFTDAVL

SEQ ID NO: 173554 - protein, 9 aa, Artificial Sequence
  Description of Artificial Sequence: Synthetic peptide
  Seed: ENISIYNYF (TYRP1_HUMAN)
ETISIYNYY

SEQ ID NO: 173555 - protein, 10 aa, Artificial Sequence
  Description of Artificial Sequence: Synthetic peptide
  Seed: IQWPSREFSV (TYRP1_HUMAN)
IMWPSREFSA

SEQ ID NO: 173556 - protein, 11 aa, Artificial Sequence
  Description of Artificial Sequence: Synthetic peptide
  Seed: YNYFVWTHYYS (TYRP1_HUMAN)
YTYFVWTHYYF

SEQ ID NO: 173557 - protein, 10 aa, Artificial Sequence
  Description of Artificial Sequence: Synthetic peptide
  Seed: EIIAIAVVGA (TYRP1_HUMAN)
EYIAIAVVGI

SEQ ID NO: 173558 - protein, 10 aa, Artificial Sequence
  Description of Artificial Sequence: Synthetic peptide
  Seed: MQEMLQEPSF (TYRP1_HUMAN)
MQEMLQEPSM

SEQ ID NO: 173559 - protein, 10 aa, Artificial Sequence
  Description of Artificial Sequence: Synthetic peptide
  Seed: ADSRPHSPQY (TYRP1_HUMAN)
APSRPHSPQV

SEQ ID NO: 173560 - protein, 10 aa, Artificial Sequence
  Description of Artificial Sequence: Synthetic peptide
  Seed: FLNGTGGQTH (TYRP1_HUMAN)
FMNGTGGQTL

SEQ ID NO: 173561 - protein, 10 aa, Artificial Sequence
  Description of Artificial Sequence: Synthetic peptide
  Seed: GKYDPAVRSL (TYRP1_HUMAN)
GKYDPAVRSY

SEQ ID NO: 173562 - protein, 9 aa, Artificial Sequence
  Description of Artificial Sequence: Synthetic peptide
  Seed: DAVFDEWLR (TYRP1_HUMAN)
DSVFDEWLK

SEQ ID NO: 173563 - protein, 9 aa, Artificial Sequence
  Description of Artificial Sequence: Synthetic peptide
  Seed: RSLHNLAHL (TYRP1_HUMAN)
RMLHNLAHK

SEQ ID NO: 173564 - protein, 11 aa, Artificial Sequence
  Description of Artificial Sequence: Synthetic peptide
  Seed: AGNVARPMVQR (TYRP1_HUMAN)
AKNVARPMVQK

SEQ ID NO: 173565 - protein, 11 aa, Artificial Sequence
  Description of Artificial Sequence: Synthetic peptide
  Seed: LISPNSVFSQW (TYRP1_HUMAN)
LFSPNSVFSQW

SEQ ID NO: 173566 - protein, 9 aa, Artificial Sequence
  Description of Artificial Sequence: Synthetic peptide
  Seed: REVWPLRFF (TYRP1_HUMAN)
RKVWPLRFM

SEQ ID NO: 173567 - protein, 10 aa, Artificial Sequence
  Description of Artificial Sequence: Synthetic peptide
  Seed: AVFDEWLRRY (TYRP1_HUMAN)
ASFDEWLRRY

SEQ ID NO: 173568 - protein, 10 aa, Artificial Sequence
  Description of Artificial Sequence: Synthetic peptide
  Seed: YNMVPFWPPV (TYRP1_HUMAN)
YYMVPFWPPM

SEQ ID NO: 173569 - protein, 9 aa, Artificial Sequence
  Description of Artificial Sequence: Synthetic peptide
  Seed: SLGCIFFPL (TYRP1_HUMAN)
SMGCIFFPC

SEQ ID NO: 173570 - protein, 9 aa, Artificial Sequence
  Description of Artificial Sequence: Synthetic peptide
  Seed: DAVFDEWLR (TYRP1_HUMAN)
DVVFDEWLR

SEQ ID NO: 173571 - protein, 8 aa, Artificial Sequence
  Description of Artificial Sequence: Synthetic peptide
  Seed: GPIRRNPA (TYRP1_HUMAN)
GPIRRNPL

SEQ ID NO: 173572 - protein, 10 aa, Artificial Sequence
  Description of Artificial Sequence: Synthetic peptide
  Seed: LSLGCIFFPL (TYRP1_HUMAN)
LYLGCIFFPV

SEQ ID NO: 173573 - protein, 9 aa, Artificial Sequence
  Description of Artificial Sequence: Synthetic peptide
  Seed: MSAPKLLSL (TYRP1_HUMAN)
MPAPKLLSC

SEQ ID NO: 173574 - protein, 9 aa, Artificial Sequence
  Description of Artificial Sequence: Synthetic peptide
  Seed: NMVPFWPPV (TYRP1_HUMAN)
NFVPFWPPF

SEQ ID NO: 173575 - protein, 9 aa, Artificial Sequence
  Description of Artificial Sequence: Synthetic peptide
  Seed: YNYFVWTHY (TYRP1_HUMAN)
YTYFVWTHL

SEQ ID NO: 173576 - protein, 9 aa, Artificial Sequence
  Description of Artificial Sequence: Synthetic peptide
  Seed: KLLSLGCIF (TYRP1_HUMAN)
KTLSLGCIY

SEQ ID NO: 173577 - protein, 9 aa, Artificial Sequence
  Description of Artificial Sequence: Synthetic peptide
  Seed: DEWLRRYNA (TYRP1_HUMAN)
DEWLRRYNL

SEQ ID NO: 173578 - protein, 11 aa, Artificial Sequence
  Description of Artificial Sequence: Synthetic peptide
  Seed: YNMVPFWPPVT (TYRP1_HUMAN)
YIMVPFWPPVR

SEQ ID NO: 173579 - protein, 8 aa, Artificial Sequence
  Description of Artificial Sequence: Synthetic peptide
  Seed: YSNSTNSF (TYRP1_HUMAN)
YSNSTNSL

SEQ ID NO: 173580 - protein, 11 aa, Artificial Sequence
  Description of Artificial Sequence: Synthetic peptide
  Seed: FPLLLFQQARA (TYRP1_HUMAN)
FVLLLFQQARV

SEQ ID NO: 173581 - protein, 10 aa, Artificial Sequence
  Description of Artificial Sequence: Synthetic peptide
  Seed: GSRSNFDSTL (TYRP1_HUMAN)
GVRSNFDSTK

SEQ ID NO: 173582 - protein, 9 aa, Artificial Sequence
  Description of Artificial Sequence: Synthetic peptide
  Seed: AVRSLHNLA (TYRP1_HUMAN)
AIRSLHNLM

SEQ ID NO: 173583 - protein, 11 aa, Artificial Sequence
  Description of Artificial Sequence: Synthetic peptide
  Seed: MFVTAPDNLGY (TYRP1_HUMAN)
MEVTAPDNLGF

SEQ ID NO: 173584 - protein, 10 aa, Artificial Sequence
  Description of Artificial Sequence: Synthetic peptide
  Seed: YNMVPFWPPV (TYRP1_HUMAN)
YVMVPFWPPI

SEQ ID NO: 173585 - protein, 9 aa, Artificial Sequence
  Description of Artificial Sequence: Synthetic peptide
  Seed: SRSNFDSTL (TYRP1_HUMAN)
SHSNFDSTM

SEQ ID NO: 173586 - protein, 9 aa, Artificial Sequence
  Description of Artificial Sequence: Synthetic peptide
  Seed: SLHNLAHLF (TYRP1_HUMAN)
SKHNLAHLF

SEQ ID NO: 173587 - protein, 10 aa, Artificial Sequence
  Description of Artificial Sequence: Synthetic peptide
  Seed: ALIFGTASYL (TYRP1_HUMAN)
AMIFGTASYS

SEQ ID NO: 173588 - protein, 10 aa, Artificial Sequence
  Description of Artificial Sequence: Synthetic peptide
  Seed: GPAFLTWHRY (TYRP1_HUMAN)
GWAFLTWHRY

SEQ ID NO: 173589 - protein, 10 aa, Artificial Sequence
  Description of Artificial Sequence: Synthetic peptide
  Seed: MVPFWPPVTN (TYRP1_HUMAN)
MDPFWPPVTL

SEQ ID NO: 173590 - protein, 9 aa, Artificial Sequence
  Description of Artificial Sequence: Synthetic peptide
  Seed: FVWTHYYSV (TYRP1_HUMAN)
FTWTHYYSL

SEQ ID NO: 173591 - protein, 9 aa, Artificial Sequence
  Description of Artificial Sequence: Synthetic peptide
  Seed: RSNFDSTLI (TYRP1_HUMAN)
RQNFDSTLW

SEQ ID NO: 173592 - protein, 8 aa, Artificial Sequence
  Description of Artificial Sequence: Synthetic peptide
  Seed: ACDQRVLI (TYRP1_HUMAN)
AWDQRVLL

SEQ ID NO: 173593 - protein, 11 aa, Artificial Sequence
  Description of Artificial Sequence: Synthetic peptide
  Seed: VCDSLEDYDTL (TYRP1_HUMAN)
VFDSLEDYDTL

SEQ ID NO: 173594 - protein, 9 aa, Artificial Sequence
  Description of Artificial Sequence: Synthetic peptide
  Seed: QYQCYAEEY (TYRP1_HUMAN)
QMQCYAEEY

SEQ ID NO: 173595 - protein, 10 aa, Artificial Sequence
  Description of Artificial Sequence: Synthetic peptide
  Seed: AVVGALLLVA (TYRP1_HUMAN)
AMVGALLLVA

SEQ ID NO: 173596 - protein, 9 aa, Artificial Sequence
  Description of Artificial Sequence: Synthetic peptide
  Seed: DLMGSRSNF (TYRP1_HUMAN)
DIMGSRSNF

SEQ ID NO: 173597 - protein, 9 aa, Artificial Sequence
  Description of Artificial Sequence: Synthetic peptide
  Seed: GPDGNTPQF (TYRP1_HUMAN)
GGDGNTPQF

SEQ ID NO: 173598 - protein, 10 aa, Artificial Sequence
  Description of Artificial Sequence: Synthetic peptide
  Seed: YNADISTFPL (TYRP1_HUMAN)
YTADISTFPV

SEQ ID NO: 173599 - protein, 9 aa, Artificial Sequence
  Description of Artificial Sequence: Synthetic peptide
  Seed: LGYTYEIQW (TYRP1_HUMAN)
LIYTYEIQW

SEQ ID NO: 173600 - protein, 9 aa, Artificial Sequence
  Description of Artificial Sequence: Synthetic peptide
  Seed: MLQEPSFSL (TYRP1_HUMAN)
MSQEPSFSV

SEQ ID NO: 173601 - protein, 9 aa, Artificial Sequence
  Description of Artificial Sequence: Synthetic peptide
  Seed: FSVPEIIAI (TYRP1_HUMAN)
FYVPEIIAL

SEQ ID NO: 173602 - protein, 9 aa, Artificial Sequence
  Description of Artificial Sequence: Synthetic peptide
  Seed: ACDQRVLIV (TYRP1_HUMAN)
AFDQRVLIC

SEQ ID NO: 173603 - protein, 9 aa, Artificial Sequence
  Description of Artificial Sequence: Synthetic peptide
  Seed: LTDQYQCYA (TYRP1_HUMAN)
LLDQYQCYL

SEQ ID NO: 173604 - protein, 9 aa, Artificial Sequence
  Description of Artificial Sequence: Synthetic peptide
  Seed: SPNDPIFVL (TYRP1_HUMAN)
SFNDPIFVY

SEQ ID NO: 173605 - protein, 10 aa, Artificial Sequence
  Description of Artificial Sequence: Synthetic peptide
  Seed: EFSVPEIIAI (TYRP1_HUMAN)
ETSVPEIIAV

SEQ ID NO: 173606 - protein, 9 aa, Artificial Sequence
  Description of Artificial Sequence: Synthetic peptide
  Seed: ACDQRVLIV (TYRP1_HUMAN)
ALDQRVLIV

SEQ ID NO: 173607 - protein, 9 aa, Artificial Sequence
  Description of Artificial Sequence: Synthetic peptide
  Seed: ISIYNYFVW (TYRP1_HUMAN)
IEIYNYFVM

SEQ ID NO: 173608 - protein, 10 aa, Artificial Sequence
  Description of Artificial Sequence: Synthetic peptide
  Seed: ALIFGTASYL (TYRP1_HUMAN)
AMIFGTASYE

SEQ ID NO: 173609 - protein, 9 aa, Artificial Sequence
  Description of Artificial Sequence: Synthetic peptide
  Seed: MSAPKLLSL (TYRP1_HUMAN)
MMAPKLLST

SEQ ID NO: 173610 - protein, 10 aa, Artificial Sequence
  Description of Artificial Sequence: Synthetic peptide
  Seed: YNYFVWTHYY (TYRP1_HUMAN)
YVYFVWTHYI

SEQ ID NO: 173611 - protein, 9 aa, Artificial Sequence
  Description of Artificial Sequence: Synthetic peptide
  Seed: ENAPIGHNR (TYRP1_HUMAN)
EVAPIGHNL

SEQ ID NO: 173612 - protein, 9 aa, Artificial Sequence
  Description of Artificial Sequence: Synthetic peptide
  Seed: DLMGSRSNF (TYRP1_HUMAN)
DAMGSRSNY

SEQ ID NO: 173613 - protein, 9 aa, Artificial Sequence
  Description of Artificial Sequence: Synthetic peptide
  Seed: RLEKDMQEM (TYRP1_HUMAN)
RQEKDMQEW

SEQ ID NO: 173614 - protein, 9 aa, Artificial Sequence
  Description of Artificial Sequence: Synthetic peptide
  Seed: MLQEPSFSL (TYRP1_HUMAN)
MPQEPSFSY

SEQ ID NO: 173615 - protein, 9 aa, Artificial Sequence
  Description of Artificial Sequence: Synthetic peptide
  Seed: SPNDPIFVL (TYRP1_HUMAN)
STNDPIFVL

SEQ ID NO: 173616 - protein, 9 aa, Artificial Sequence
  Description of Artificial Sequence: Synthetic peptide
  Seed: MSAPKLLSL (TYRP1_HUMAN)
MTAPKLLSA

SEQ ID NO: 173617 - protein, 9 aa, Artificial Sequence
  Description of Artificial Sequence: Synthetic peptide
  Seed: AFLTWHRYH (TYRP1_HUMAN)
AMLTWHRYK

SEQ ID NO: 173618 - protein, 9 aa, Artificial Sequence
  Description of Artificial Sequence: Synthetic peptide
  Seed: NISIYNYFV (TYRP1_HUMAN)
NMSIYNYFL

SEQ ID NO: 173619 - protein, 9 aa, Artificial Sequence
  Description of Artificial Sequence: Synthetic peptide
  Seed: FVWTHYYSV (TYRP1_HUMAN)
FIWTHYYSF

SEQ ID NO: 173620 - protein, 9 aa, Artificial Sequence
  Description of Artificial Sequence: Synthetic peptide
  Seed: TASYLIRAR (TYRP1_HUMAN)
TTSYLIRAK

SEQ ID NO: 173621 - protein, 10 aa, Artificial Sequence
  Description of Artificial Sequence: Synthetic peptide
  Seed: FYSNSTNSFR (TYRP1_HUMAN)
FHSNSTNSFK

SEQ ID NO: 173622 - protein, 9 aa, Artificial Sequence
  Description of Artificial Sequence: Synthetic peptide
  Seed: LQNPNQSVV (TYRP1_HUMAN)
LKNPNQSVL

SEQ ID NO: 173623 - protein, 10 aa, Artificial Sequence
  Description of Artificial Sequence: Synthetic peptide
  Seed: RRYNADISTF (TYRP1_HUMAN)
REYNADISTI

SEQ ID NO: 173624 - protein, 9 aa, Artificial Sequence
  Description of Artificial Sequence: Synthetic peptide
  Seed: RSLHNLAHL (TYRP1_HUMAN)
RMLHNLAHW

SEQ ID NO: 173625 - protein, 9 aa, Artificial Sequence
  Description of Artificial Sequence: Synthetic peptide
  Seed: AKRTTHPLF (TYRP1_HUMAN)
AIRTTHPLY

SEQ ID NO: 173626 - protein, 9 aa, Artificial Sequence
  Description of Artificial Sequence: Synthetic peptide
  Seed: SLHNLAHLF (TYRP1_HUMAN)
SQHNLAHLV

SEQ ID NO: 173627 - protein, 9 aa, Artificial Sequence
  Description of Artificial Sequence: Synthetic peptide
  Seed: YYSVKKTFL (TYRP1_HUMAN)
YRSVKKTFL

SEQ ID NO: 173628 - protein, 10 aa, Artificial Sequence
  Description of Artificial Sequence: Synthetic peptide
  Seed: FYSNSTNSFR (TYRP1_HUMAN)
FYSNSTNSFL

SEQ ID NO: 173629 - protein, 10 aa, Artificial Sequence
  Description of Artificial Sequence: Synthetic peptide
  Seed: YFVWTHYYSV (TYRP1_HUMAN)
YYVWTHYYSV

SEQ ID NO: 173630 - protein, 9 aa, Artificial Sequence
  Description of Artificial Sequence: Synthetic peptide
  Seed: VGLFDTPPF (TYRP1_HUMAN)
VKLFDTPPM

SEQ ID NO: 173631 - protein, 9 aa, Artificial Sequence
  Description of Artificial Sequence: Synthetic peptide
  Seed: SREFSVPEI (TYRP1_HUMAN)
SHEFSVPEA

SEQ ID NO: 173632 - protein, 8 aa, Artificial Sequence
  Description of Artificial Sequence: Synthetic peptide
  Seed: YSNSTNSF (TYRP1_HUMAN)
YWNSTNSL

SEQ ID NO: 173633 - protein, 8 aa, Artificial Sequence
  Description of Artificial Sequence: Synthetic peptide
  Seed: RQYNMVPF (TYRP1_HUMAN)
RKYNMVPY

SEQ ID NO: 173634 - protein, 10 aa, Artificial Sequence
  Description of Artificial Sequence: Synthetic peptide
  Seed: LENAPIGHNR (TYRP1_HUMAN)
LFNAPIGHNR

SEQ ID NO: 173635 - protein, 9 aa, Artificial Sequence
  Description of Artificial Sequence: Synthetic peptide
  Seed: STNSFRNTV (TYRP1_HUMAN)
SVNSFRNTM

SEQ ID NO: 173636 - protein, 10 aa, Artificial Sequence
  Description of Artificial Sequence: Synthetic peptide
  Seed: SMDEANQPLL (TYRP1_HUMAN)
SLDEANQPLY

SEQ ID NO: 173637 - protein, 10 aa, Artificial Sequence
  Description of Artificial Sequence: Synthetic peptide
  Seed: ATVEALRSGM (TYRP1_HUMAN)
ATVEALRSGY

SEQ ID NO: 173638 - protein, 10 aa, Artificial Sequence
  Description of Artificial Sequence: Synthetic peptide
  Seed: ALIFGTASYL (TYRP1_HUMAN)
AGIFGTASYY

SEQ ID NO: 173639 - protein, 9 aa, Artificial Sequence
  Description of Artificial Sequence: Synthetic peptide
  Seed: MLQEPSFSL (TYRP1_HUMAN)
MGQEPSFSW

SEQ ID NO: 173640 - protein, 11 aa, Artificial Sequence
  Description of Artificial Sequence: Synthetic peptide
  Seed: FLNGTGGQTHL (TYRP1_HUMAN)
FSNGTGGQTHL

SEQ ID NO: 173641 - protein, 8 aa, Artificial Sequence
  Description of Artificial Sequence: Synthetic peptide
  Seed: LIFGTASY (TYRP1_HUMAN)
LLFGTASF

SEQ ID NO: 173642 - protein, 9 aa, Artificial Sequence
  Description of Artificial Sequence: Synthetic peptide
  Seed: SPNDPIFVL (TYRP1_HUMAN)
SHNDPIFVT

SEQ ID NO: 173643 - protein, 9 aa, Artificial Sequence
  Description of Artificial Sequence: Synthetic peptide
  Seed: DQRVLIVRR (TYRP1_HUMAN)
DIRVLIVRR

SEQ ID NO: 173644 - protein, 9 aa, Artificial Sequence
  Description of Artificial Sequence: Synthetic peptide
  Seed: IAVVGALLL (TYRP1_HUMAN)
IPVVGALLM

SEQ ID NO: 173645 - protein, 10 aa, Artificial Sequence
  Description of Artificial Sequence: Synthetic peptide
  Seed: VDFSHEGPAF (TYRP1_HUMAN)
VEFSHEGPAF

SEQ ID NO: 173646 - protein, 9 aa, Artificial Sequence
  Description of Artificial Sequence: Synthetic peptide
  Seed: VGLFDTPPF (TYRP1_HUMAN)
VALFDTPPY

SEQ ID NO: 173647 - protein, 9 aa, Artificial Sequence
  Description of Artificial Sequence: Synthetic peptide
  Seed: RPMVQRLPE (TYRP1_HUMAN)
RMMVQRLPL

SEQ ID NO: 173648 - protein, 11 aa, Artificial Sequence
  Description of Artificial Sequence: Synthetic peptide
  Seed: FWPPVTNTEMF (TYRP1_HUMAN)
FDPPVTNTEMY

SEQ ID NO: 173649 - protein, 9 aa, Artificial Sequence
  Description of Artificial Sequence: Synthetic peptide
  Seed: FSHEGPAFL (TYRP1_HUMAN)
FTHEGPAFY

SEQ ID NO: 173650 - protein, 9 aa, Artificial Sequence
  Description of Artificial Sequence: Synthetic peptide
  Seed: FLNGTGGQT (TYRP1_HUMAN)
FQNGTGGQV

SEQ ID NO: 173651 - protein, 10 aa, Artificial Sequence
  Description of Artificial Sequence: Synthetic peptide
  Seed: MAKRTTHPLF (TYRP1_HUMAN)
MEKRTTHPLY

SEQ ID NO: 173652 - protein, 10 aa, Artificial Sequence
  Description of Artificial Sequence: Synthetic peptide
  Seed: YNYFVWTHYY (TYRP1_HUMAN)
YLYFVWTHYF

SEQ ID NO: 173653 - protein, 9 aa, Artificial Sequence
  Description of Artificial Sequence: Synthetic peptide
  Seed: IVRRNLLDL (TYRP1_HUMAN)
ILRRNLLDY

SEQ ID NO: 173654 - protein, 9 aa, Artificial Sequence
  Description of Artificial Sequence: Synthetic peptide
  Seed: NADISTFPL (TYRP1_HUMAN)
NLDISTFPL

SEQ ID NO: 173655 - protein, 9 aa, Artificial Sequence
  Description of Artificial Sequence: Synthetic peptide
  Seed: VTAPDNLGY (TYRP1_HUMAN)
VSAPDNLGY

SEQ ID NO: 173656 - protein, 9 aa, Artificial Sequence
  Description of Artificial Sequence: Synthetic peptide
  Seed: LIFGTASYL (TYRP1_HUMAN)
LIFGTASYV

SEQ ID NO: 173657 - protein, 9 aa, Artificial Sequence
  Description of Artificial Sequence: Synthetic peptide
  Seed: TADSRPHSP (TYRP1_HUMAN)
TIDSRPHSI

SEQ ID NO: 173658 - protein, 10 aa, Artificial Sequence
  Description of Artificial Sequence: Synthetic peptide
  Seed: STLISPNSVF (TYRP1_HUMAN)
SYLISPNSVY

SEQ ID NO: 173659 - protein, 9 aa, Artificial Sequence
  Description of Artificial Sequence: Synthetic peptide
  Seed: AACDQRVLI (TYRP1_HUMAN)
AMCDQRVLW

SEQ ID NO: 173660 - protein, 9 aa, Artificial Sequence
  Description of Artificial Sequence: Synthetic peptide
  Seed: FLGVGQESF (TYRP1_HUMAN)
FIGVGQESV

SEQ ID NO: 173661 - protein, 9 aa, Artificial Sequence
  Description of Artificial Sequence: Synthetic peptide
  Seed: STNSFRNTV (TYRP1_HUMAN)
SANSFRNTM

SEQ ID NO: 173662 - protein, 10 aa, Artificial Sequence
  Description of Artificial Sequence: Synthetic peptide
  Seed: FLNGTGGQTH (TYRP1_HUMAN)
FLNGTGGQTF

SEQ ID NO: 173663 - protein, 9 aa, Artificial Sequence
  Description of Artificial Sequence: Synthetic peptide
  Seed: FYSNSTNSF (TYRP1_HUMAN)
FTSNSTNSL

SEQ ID NO: 173664 - protein, 9 aa, Artificial Sequence
  Description of Artificial Sequence: Synthetic peptide
  Seed: FLGVGQESF (TYRP1_HUMAN)
FLGVGQESI

SEQ ID NO: 173665 - protein, 9 aa, Artificial Sequence
  Description of Artificial Sequence: Synthetic peptide
  Seed: QQARAQFPR (TYRP1_HUMAN)
QMARAQFPK

SEQ ID NO: 173666 - protein, 11 aa, Artificial Sequence
  Description of Artificial Sequence: Synthetic peptide
  Seed: RSMDEANQPLL (TYRP1_HUMAN)
RVMDEANQPLW

SEQ ID NO: 173667 - protein, 9 aa, Artificial Sequence
  Description of Artificial Sequence: Synthetic peptide
  Seed: KYDPAVRSL (TYRP1_HUMAN)
KQDPAVRSM

SEQ ID NO: 173668 - protein, 9 aa, Artificial Sequence
  Description of Artificial Sequence: Synthetic peptide
  Seed: KYDPAVRSL (TYRP1_HUMAN)
KMDPAVRSW

SEQ ID NO: 173669 - protein, 9 aa, Artificial Sequence
  Description of Artificial Sequence: Synthetic peptide
  Seed: VARPMVQRL (TYRP1_HUMAN)
VQRPMVQRY

SEQ ID NO: 173670 - protein, 9 aa, Artificial Sequence
  Description of Artificial Sequence: Synthetic peptide
  Seed: RVLIVRRNL (TYRP1_HUMAN)
RPLIVRRNL

SEQ ID NO: 173671 - protein, 10 aa, Artificial Sequence
  Description of Artificial Sequence: Synthetic peptide
  Seed: IAIAVVGALL (TYRP1_HUMAN)
ISIAVVGALM

SEQ ID NO: 173672 - protein, 10 aa, Artificial Sequence
  Description of Artificial Sequence: Synthetic peptide
  Seed: KRTTHPLFVI (TYRP1_HUMAN)
KDTTHPLFVF

SEQ ID NO: 173673 - protein, 9 aa, Artificial Sequence
  Description of Artificial Sequence: Synthetic peptide
  Seed: MAKRTTHPL (TYRP1_HUMAN)
MMKRTTHPI

SEQ ID NO: 173674 - protein, 9 aa, Artificial Sequence
  Description of Artificial Sequence: Synthetic peptide
  Seed: IVRRNLLDL (TYRP1_HUMAN)
IPRRNLLDM

SEQ ID NO: 173675 - protein, 9 aa, Artificial Sequence
  Description of Artificial Sequence: Synthetic peptide
  Seed: SPNDPIFVL (TYRP1_HUMAN)
SLNDPIFVV

SEQ ID NO: 173676 - protein, 9 aa, Artificial Sequence
  Description of Artificial Sequence: Synthetic peptide
  Seed: RRYNADIST (TYRP1_HUMAN)
RRYNADISI

SEQ ID NO: 173677 - protein, 9 aa, Artificial Sequence
  Description of Artificial Sequence: Synthetic peptide
  Seed: RRYNADIST (TYRP1_HUMAN)
RRYNADISR

SEQ ID NO: 173678 - protein, 10 aa, Artificial Sequence
  Description of Artificial Sequence: Synthetic peptide
  Seed: RSMDEANQPL (TYRP1_HUMAN)
RQMDEANQPY

SEQ ID NO: 173679 - protein, 9 aa, Artificial Sequence
  Description of Artificial Sequence: Synthetic peptide
  Seed: VTAPDNLGY (TYRP1_HUMAN)
VIAPDNLGW

SEQ ID NO: 173680 - protein, 9 aa, Artificial Sequence
  Description of Artificial Sequence: Synthetic peptide
  Seed: RFFNRTCHC (TYRP1_HUMAN)
RYFNRTCHL

SEQ ID NO: 173681 - protein, 10 aa, Artificial Sequence
  Description of Artificial Sequence: Synthetic peptide
  Seed: FYSNSTNSFR (TYRP1_HUMAN)
FFSNSTNSFK

SEQ ID NO: 173682 - protein, 10 aa, Artificial Sequence
  Description of Artificial Sequence: Synthetic peptide
  Seed: ISPNSVFSQW (TYRP1_HUMAN)
ITPNSVFSQY

SEQ ID NO: 173683 - protein, 9 aa, Artificial Sequence
  Description of Artificial Sequence: Synthetic peptide
  Seed: SRSNFDSTL (TYRP1_HUMAN)
SLSNFDSTM

SEQ ID NO: 173684 - protein, 9 aa, Artificial Sequence
  Description of Artificial Sequence: Synthetic peptide
  Seed: AQFPRQCAT (TYRP1_HUMAN)
AQFPRQCAW

SEQ ID NO: 173685 - protein, 10 aa, Artificial Sequence
  Description of Artificial Sequence: Synthetic peptide
  Seed: RYNADISTFP (TYRP1_HUMAN)
RYNADISTFL

SEQ ID NO: 173686 - protein, 9 aa, Artificial Sequence
  Description of Artificial Sequence: Synthetic peptide
  Seed: ACDQRVLIV (TYRP1_HUMAN)
AYDQRVLIV

SEQ ID NO: 173687 - protein, 10 aa, Artificial Sequence
  Description of Artificial Sequence: Synthetic peptide
  Seed: LLLVALIFGT (TYRP1_HUMAN)
LTLVALIFGV

SEQ ID NO: 173688 - protein, 9 aa, Artificial Sequence
  Description of Artificial Sequence: Synthetic peptide
  Seed: LTDQYQCYA (TYRP1_HUMAN)
LTDQYQCYF

SEQ ID NO: 173689 - protein, 10 aa, Artificial Sequence
  Description of Artificial Sequence: Synthetic peptide
  Seed: FLNGTGGQTH (TYRP1_HUMAN)
FANGTGGQTL

SEQ ID NO: 173690 - protein, 9 aa, Artificial Sequence
  Description of Artificial Sequence: Synthetic peptide
  Seed: RQCATVEAL (TYRP1_HUMAN)
RYCATVEAY

SEQ ID NO: 173691 - protein, 10 aa, Artificial Sequence
  Description of Artificial Sequence: Synthetic peptide
  Seed: LTWHRYHLLR (TYRP1_HUMAN)
LYWHRYHLLK

SEQ ID NO: 173692 - protein, 10 aa, Artificial Sequence
  Description of Artificial Sequence: Synthetic peptide
  Seed: AQFPRQCATV (TYRP1_HUMAN)
AMFPRQCATM

SEQ ID NO: 173693 - protein, 10 aa, Artificial Sequence
  Description of Artificial Sequence: Synthetic peptide
  Seed: IAVVGALLLV (TYRP1_HUMAN)
IMVVGALLLA

SEQ ID NO: 173694 - protein, 9 aa, Artificial Sequence
  Description of Artificial Sequence: Synthetic peptide
  Seed: STNSFRNTV (TYRP1_HUMAN)
STNSFRNTA

SEQ ID NO: 173695 - protein, 9 aa, Artificial Sequence
  Description of Artificial Sequence: Synthetic peptide
  Seed: AVVGALLLV (TYRP1_HUMAN)
AQVGALLLF

SEQ ID NO: 173696 - protein, 10 aa, Artificial Sequence
  Description of Artificial Sequence: Synthetic peptide
  Seed: SIYNYFVWTH (TYRP1_HUMAN)
SGYNYFVWTK

SEQ ID NO: 173697 - protein, 9 aa, Artificial Sequence
  Description of Artificial Sequence: Synthetic peptide
  Seed: VCDICTDDL (TYRP1_HUMAN)
VYDICTDDF

SEQ ID NO: 173698 - protein, 9 aa, Artificial Sequence
  Description of Artificial Sequence: Synthetic peptide
  Seed: YTYEIQWPS (TYRP1_HUMAN)
YLYEIQWPQ

SEQ ID NO: 173699 - protein, 10 aa, Artificial Sequence
  Description of Artificial Sequence: Synthetic peptide
  Seed: MSAPKLLSLG (TYRP1_HUMAN)
MRAPKLLSLW

SEQ ID NO: 173700 - protein, 9 aa, Artificial Sequence
  Description of Artificial Sequence: Synthetic peptide
  Seed: YTYEIQWPS (TYRP1_HUMAN)
YIYEIQWPI

SEQ ID NO: 173701 - protein, 10 aa, Artificial Sequence
  Description of Artificial Sequence: Synthetic peptide
  Seed: LLHTFTDAVF (TYRP1_HUMAN)
LHHTFTDAVY

SEQ ID NO: 173702 - protein, 9 aa, Artificial Sequence
  Description of Artificial Sequence: Synthetic peptide
  Seed: FSVPEIIAI (TYRP1_HUMAN)
FRVPEIIAI

SEQ ID NO: 173703 - protein, 10 aa, Artificial Sequence
  Description of Artificial Sequence: Synthetic peptide
  Seed: NYFVWTHYYS (TYRP1_HUMAN)
NMFVWTHYYV

SEQ ID NO: 173704 - protein, 10 aa, Artificial Sequence
  Description of Artificial Sequence: Synthetic peptide
  Seed: TFLGVGQESF (TYRP1_HUMAN)
TYLGVGQESL

SEQ ID NO: 173705 - protein, 9 aa, Artificial Sequence
  Description of Artificial Sequence: Synthetic peptide
  Seed: FLGVGQESF (TYRP1_HUMAN)
FLGVGQESV

SEQ ID NO: 173706 - protein, 10 aa, Artificial Sequence
  Description of Artificial Sequence: Synthetic peptide
  Seed: YNMVPFWPPV (TYRP1_HUMAN)
YQMVPFWPPM

SEQ ID NO: 173707 - protein, 9 aa, Artificial Sequence
  Description of Artificial Sequence: Synthetic peptide
  Seed: RPMVQRLPE (TYRP1_HUMAN)
RPMVQRLPG

SEQ ID NO: 173708 - protein, 10 aa, Artificial Sequence
  Description of Artificial Sequence: Synthetic peptide
  Seed: TDAVFDEWLR (TYRP1_HUMAN)
TIAVFDEWLR

SEQ ID NO: 173709 - protein, 9 aa, Artificial Sequence
  Description of Artificial Sequence: Synthetic peptide
  Seed: VVCDSLEDY (TYRP1_HUMAN)
VPCDSLEDF

SEQ ID NO: 173710 - protein, 9 aa, Artificial Sequence
  Description of Artificial Sequence: Synthetic peptide
  Seed: SVKKTFLGV (TYRP1_HUMAN)
SPKKTFLGM

SEQ ID NO: 173711 - protein, 10 aa, Artificial Sequence
  Description of Artificial Sequence: Synthetic peptide
  Seed: FTDAVFDEWL (TYRP1_HUMAN)
FLDAVFDEWI

SEQ ID NO: 173712 - protein, 10 aa, Artificial Sequence
  Description of Artificial Sequence: Synthetic peptide
  Seed: YNYFVWTHYY (TYRP1_HUMAN)
YVYFVWTHYH

SEQ ID NO: 173713 - protein, 10 aa, Artificial Sequence
  Description of Artificial Sequence: Synthetic peptide
  Seed: FSLPYWNFAT (TYRP1_HUMAN)
FSLPYWNFAA

SEQ ID NO: 173714 - protein, 10 aa, Artificial Sequence
  Description of Artificial Sequence: Synthetic peptide
  Seed: ATVEALRSGM (TYRP1_HUMAN)
AMVEALRSGV

SEQ ID NO: 173715 - protein, 10 aa, Artificial Sequence
  Description of Artificial Sequence: Synthetic peptide
  Seed: MSAPKLLSLG (TYRP1_HUMAN)
MSAPKLLSLY

SEQ ID NO: 173716 - protein, 9 aa, Artificial Sequence
  Description of Artificial Sequence: Synthetic peptide
  Seed: FSHEGPAFL (TYRP1_HUMAN)
FSHEGPAFM

SEQ ID NO: 173717 - protein, 9 aa, Artificial Sequence
  Description of Artificial Sequence: Synthetic peptide
  Seed: LHNLAHLFL (TYRP1_HUMAN)
LENLAHLFY

SEQ ID NO: 173718 - protein, 9 aa, Artificial Sequence
  Description of Artificial Sequence: Synthetic peptide
  Seed: RLPEPQDVA (TYRP1_HUMAN)
RLPEPQDVV

SEQ ID NO: 173719 - protein, 9 aa, Artificial Sequence
  Description of Artificial Sequence: Synthetic peptide
  Seed: TFPLENAPI (TYRP1_HUMAN)
TMPLENAPM

SEQ ID NO: 173720 - protein, 8 aa, Artificial Sequence
  Description of Artificial Sequence: Synthetic peptide
  Seed: WPSREFSV (TYRP1_HUMAN)
WPSREFSL

SEQ ID NO: 173721 - protein, 10 aa, Artificial Sequence
  Description of Artificial Sequence: Synthetic peptide
  Seed: LGPDGNTPQF (TYRP1_HUMAN)
LSPDGNTPQW

SEQ ID NO: 173722 - protein, 9 aa, Artificial Sequence
  Description of Artificial Sequence: Synthetic peptide
  Seed: RYNADISTF (TYRP1_HUMAN)
RFNADISTM

SEQ ID NO: 173723 - protein, 9 aa, Artificial Sequence
  Description of Artificial Sequence: Synthetic peptide
  Seed: FVWTHYYSV (TYRP1_HUMAN)
FPWTHYYSV

SEQ ID NO: 173724 - protein, 8 aa, Artificial Sequence
  Description of Artificial Sequence: Synthetic peptide
  Seed: YNADISTF (TYRP1_HUMAN)
YYADISTF

SEQ ID NO: 173725 - protein, 10 aa, Artificial Sequence
  Description of Artificial Sequence: Synthetic peptide
  Seed: KYDPAVRSLH (TYRP1_HUMAN)
KIDPAVRSLY

SEQ ID NO: 173726 - protein, 9 aa, Artificial Sequence
  Description of Artificial Sequence: Synthetic peptide
  Seed: RQYNMVPFW (TYRP1_HUMAN)
RYYNMVPFM

SEQ ID NO: 173727 - protein, 10 aa, Artificial Sequence
  Description of Artificial Sequence: Synthetic peptide
  Seed: DVAQCLEVGL (TYRP1_HUMAN)
DAAQCLEVGR

SEQ ID NO: 173728 - protein, 11 aa, Artificial Sequence
  Description of Artificial Sequence: Synthetic peptide
  Seed: REFSVPEIIAI (TYRP1_HUMAN)
RTFSVPEIIAY

SEQ ID NO: 173729 - protein, 9 aa, Artificial Sequence
  Description of Artificial Sequence: Synthetic peptide
  Seed: MSAPKLLSL (TYRP1_HUMAN)
MIAPKLLSL

SEQ ID NO: 173730 - protein, 9 aa, Artificial Sequence
  Description of Artificial Sequence: Synthetic peptide
  Seed: IAIAVVGAL (TYRP1_HUMAN)
IMIAVVGAF

SEQ ID NO: 173731 - protein, 10 aa, Artificial Sequence
  Description of Artificial Sequence: Synthetic peptide
  Seed: MVPFWPPVTN (TYRP1_HUMAN)
MHPFWPPVTF

SEQ ID NO: 173732 - protein, 10 aa, Artificial Sequence
  Description of Artificial Sequence: Synthetic peptide
  Seed: FWPPVTNTEM (TYRP1_HUMAN)
FFPPVTNTEV

SEQ ID NO: 173733 - protein, 11 aa, Artificial Sequence
  Description of Artificial Sequence: Synthetic peptide
  Seed: YSDPTGKYDPA (TYRP1_HUMAN)
YMDPTGKYDPL

SEQ ID NO: 173734 - protein, 9 aa, Artificial Sequence
  Description of Artificial Sequence: Synthetic peptide
  Seed: LGYTYEIQW (TYRP1_HUMAN)
LVYTYEIQF

SEQ ID NO: 173735 - protein, 10 aa, Artificial Sequence
  Description of Artificial Sequence: Synthetic peptide
  Seed: YFVWTHYYSV (TYRP1_HUMAN)
YKVWTHYYSV

SEQ ID NO: 173736 - protein, 10 aa, Artificial Sequence
  Description of Artificial Sequence: Synthetic peptide
  Seed: LGPDGNTPQF (TYRP1_HUMAN)
LDPDGNTPQY

SEQ ID NO: 173737 - protein, 10 aa, Artificial Sequence
  Description of Artificial Sequence: Synthetic peptide
  Seed: RRYNADISTF (TYRP1_HUMAN)
RQYNADISTI

SEQ ID NO: 173738 - protein, 9 aa, Artificial Sequence
  Description of Artificial Sequence: Synthetic peptide
  Seed: YLIRARRSM (TYRP1_HUMAN)
YVIRARRSF

SEQ ID NO: 173739 - protein, 10 aa, Artificial Sequence
  Description of Artificial Sequence: Synthetic peptide
  Seed: LSPNDPIFVL (TYRP1_HUMAN)
LYPNDPIFVY

SEQ ID NO: 173740 - protein, 9 aa, Artificial Sequence
  Description of Artificial Sequence: Synthetic peptide
  Seed: NYFVWTHYY (TYRP1_HUMAN)
NMFVWTHYM

SEQ ID NO: 173741 - protein, 10 aa, Artificial Sequence
  Description of Artificial Sequence: Synthetic peptide
  Seed: SLGCIFFPLL (TYRP1_HUMAN)
SLGCIFFPLA

SEQ ID NO: 173742 - protein, 9 aa, Artificial Sequence
  Description of Artificial Sequence: Synthetic peptide
  Seed: MAKRTTHPL (TYRP1_HUMAN)
MCKRTTHPK

SEQ ID NO: 173743 - protein, 11 aa, Artificial Sequence
  Description of Artificial Sequence: Synthetic peptide
  Seed: RSMDEANQPLL (TYRP1_HUMAN)
RTMDEANQPLL

SEQ ID NO: 173744 - protein, 10 aa, Artificial Sequence
  Description of Artificial Sequence: Synthetic peptide
  Seed: VGLFDTPPFY (TYRP1_HUMAN)
VMLFDTPPFF

SEQ ID NO: 173745 - protein, 9 aa, Artificial Sequence
  Description of Artificial Sequence: Synthetic peptide
  Seed: VGLFDTPPF (TYRP1_HUMAN)
VVLFDTPPF

SEQ ID NO: 173746 - protein, 9 aa, Artificial Sequence
  Description of Artificial Sequence: Synthetic peptide
  Seed: KYDPAVRSL (TYRP1_HUMAN)
KIDPAVRSY

SEQ ID NO: 173747 - protein, 10 aa, Artificial Sequence
  Description of Artificial Sequence: Synthetic peptide
  Seed: STLISPNSVF (TYRP1_HUMAN)
SQLISPNSVY

SEQ ID NO: 173748 - protein, 10 aa, Artificial Sequence
  Description of Artificial Sequence: Synthetic peptide
  Seed: SVPEIIAIAV (TYRP1_HUMAN)
SQPEIIAIAV

SEQ ID NO: 173749 - protein, 9 aa, Artificial Sequence
  Description of Artificial Sequence: Synthetic peptide
  Seed: QYQCYAEEY (TYRP1_HUMAN)
QFQCYAEEY

SEQ ID NO: 173750 - protein, 9 aa, Artificial Sequence
  Description of Artificial Sequence: Synthetic peptide
  Seed: VFDEWLRRY (TYRP1_HUMAN)
VADEWLRRL

SEQ ID NO: 173751 - protein, 9 aa, Artificial Sequence
  Description of Artificial Sequence: Synthetic peptide
  Seed: GLFDTPPFY (TYRP1_HUMAN)
GTFDTPPFK

SEQ ID NO: 173752 - protein, 9 aa, Artificial Sequence
  Description of Artificial Sequence: Synthetic peptide
  Seed: DSRPHSPQY (TYRP1_HUMAN)
DARPHSPQK

SEQ ID NO: 173753 - protein, 9 aa, Artificial Sequence
  Description of Artificial Sequence: Synthetic peptide
  Seed: TTHPLFVIA (TYRP1_HUMAN)
TPHPLFVIM

SEQ ID NO: 173754 - protein, 11 aa, Artificial Sequence
  Description of Artificial Sequence: Synthetic peptide
  Seed: FVLLHTFTDAV (TYRP1_HUMAN)
FLLLHTFTDAV

SEQ ID NO: 173755 - protein, 9 aa, Artificial Sequence
  Description of Artificial Sequence: Synthetic peptide
  Seed: SLHNLAHLF (TYRP1_HUMAN)
SSHNLAHLL

SEQ ID NO: 173756 - protein, 9 aa, Artificial Sequence
  Description of Artificial Sequence: Synthetic peptide
  Seed: SLPYWNFAT (TYRP1_HUMAN)
SIPYWNFAA

SEQ ID NO: 173757 - protein, 8 aa, Artificial Sequence
  Description of Artificial Sequence: Synthetic peptide
  Seed: YSDPTGKY (TYRP1_HUMAN)
YMDPTGKI

SEQ ID NO: 173758 - protein, 9 aa, Artificial Sequence
  Description of Artificial Sequence: Synthetic peptide
  Seed: VGLFDTPPF (TYRP1_HUMAN)
VVLFDTPPW

SEQ ID NO: 173759 - protein, 9 aa, Artificial Sequence
  Description of Artificial Sequence: Synthetic peptide
  Seed: AACDQRVLI (TYRP1_HUMAN)
AQCDQRVLV

SEQ ID NO: 173760 - protein, 9 aa, Artificial Sequence
  Description of Artificial Sequence: Synthetic peptide
  Seed: SLHNLAHLF (TYRP1_HUMAN)
SWHNLAHLY

SEQ ID NO: 173761 - protein, 8 aa, Artificial Sequence
  Description of Artificial Sequence: Synthetic peptide
  Seed: YFVWTHYY (TYRP1_HUMAN)
YFVWTHYF

SEQ ID NO: 173762 - protein, 10 aa, Artificial Sequence
  Description of Artificial Sequence: Synthetic peptide
  Seed: FSLPYWNFAT (TYRP1_HUMAN)
FYLPYWNFAA

SEQ ID NO: 173763 - protein, 9 aa, Artificial Sequence
  Description of Artificial Sequence: Synthetic peptide
  Seed: MLQEPSFSL (TYRP1_HUMAN)
MTQEPSFSM

SEQ ID NO: 173764 - protein, 11 aa, Artificial Sequence
  Description of Artificial Sequence: Synthetic peptide
  Seed: QEMLQEPSFSL (TYRP1_HUMAN)
QYMLQEPSFSV

SEQ ID NO: 173765 - protein, 9 aa, Artificial Sequence
  Description of Artificial Sequence: Synthetic peptide
  Seed: TTHPLFVIA (TYRP1_HUMAN)
TAHPLFVIV

SEQ ID NO: 173766 - protein, 9 aa, Artificial Sequence
  Description of Artificial Sequence: Synthetic peptide
  Seed: FSHEGPAFL (TYRP1_HUMAN)
FIHEGPAFY

SEQ ID NO: 173767 - protein, 9 aa, Artificial Sequence
  Description of Artificial Sequence: Synthetic peptide
  Seed: GLFDTPPFY (TYRP1_HUMAN)
GTFDTPPFV

SEQ ID NO: 173768 - protein, 10 aa, Artificial Sequence
  Description of Artificial Sequence: Synthetic peptide
  Seed: GPAFLTWHRY (TYRP1_HUMAN)
GSAFLTWHRY

SEQ ID NO: 173769 - protein, 10 aa, Artificial Sequence
  Description of Artificial Sequence: Synthetic peptide
  Seed: SHEGPAFLTW (TYRP1_HUMAN)
SGEGPAFLTW

SEQ ID NO: 173770 - protein, 9 aa, Artificial Sequence
  Description of Artificial Sequence: Synthetic peptide
  Seed: AQFPRQCAT (TYRP1_HUMAN)
AHFPRQCAY

SEQ ID NO: 173771 - protein, 9 aa, Artificial Sequence
  Description of Artificial Sequence: Synthetic peptide
  Seed: AKRTTHPLF (TYRP1_HUMAN)
AMRTTHPLM

SEQ ID NO: 173772 - protein, 9 aa, Artificial Sequence
  Description of Artificial Sequence: Synthetic peptide
  Seed: LIFGTASYL (TYRP1_HUMAN)
LGFGTASYW

SEQ ID NO: 173773 - protein, 10 aa, Artificial Sequence
  Description of Artificial Sequence: Synthetic peptide
  Seed: THYYSVKKTF (TYRP1_HUMAN)
TYYYSVKKTM

SEQ ID NO: 173774 - protein, 11 aa, Artificial Sequence
  Description of Artificial Sequence: Synthetic peptide
  Seed: AGNVARPMVQR (TYRP1_HUMAN)
APNVARPMVQK

SEQ ID NO: 173775 - protein, 9 aa, Artificial Sequence
  Description of Artificial Sequence: Synthetic peptide
  Seed: DDREVWPLR (TYRP1_HUMAN)
DQREVWPLR

SEQ ID NO: 173776 - protein, 9 aa, Artificial Sequence
  Description of Artificial Sequence: Synthetic peptide
  Seed: LLSLGCIFF (TYRP1_HUMAN)
LFSLGCIFY

SEQ ID NO: 173777 - protein, 10 aa, Artificial Sequence
  Description of Artificial Sequence: Synthetic peptide
  Seed: YNMVPFWPPV (TYRP1_HUMAN)
YYMVPFWPPV

SEQ ID NO: 173778 - protein, 9 aa, Artificial Sequence
  Description of Artificial Sequence: Synthetic peptide
  Seed: LLHTFTDAV (TYRP1_HUMAN)
LIHTFTDAV

SEQ ID NO: 173779 - protein, 9 aa, Artificial Sequence
  Description of Artificial Sequence: Synthetic peptide
  Seed: YTYEIQWPS (TYRP1_HUMAN)
YVYEIQWPM

SEQ ID NO: 173780 - protein, 9 aa, Artificial Sequence
  Description of Artificial Sequence: Synthetic peptide
  Seed: FVWTHYYSV (TYRP1_HUMAN)
FLWTHYYSM

SEQ ID NO: 173781 - protein, 9 aa, Artificial Sequence
  Description of Artificial Sequence: Synthetic peptide
  Seed: ACDQRVLIV (TYRP1_HUMAN)
AWDQRVLIL

SEQ ID NO: 173782 - protein, 9 aa, Artificial Sequence
  Description of Artificial Sequence: Synthetic peptide
  Seed: RFFNRTCHC (TYRP1_HUMAN)
RVFNRTCHI

SEQ ID NO: 173783 - protein, 10 aa, Artificial Sequence
  Description of Artificial Sequence: Synthetic peptide
  Seed: RYNADISTFP (TYRP1_HUMAN)
RYNADISTFI

SEQ ID NO: 173784 - protein, 9 aa, Artificial Sequence
  Description of Artificial Sequence: Synthetic peptide
  Seed: VGQESFGEV (TYRP1_HUMAN)
VMQESFGEL

SEQ ID NO: 173785 - protein, 9 aa, Artificial Sequence
  Description of Artificial Sequence: Synthetic peptide
  Seed: ISIYNYFVW (TYRP1_HUMAN)
IWIYNYFVM

SEQ ID NO: 173786 - protein, 10 aa, Artificial Sequence
  Description of Artificial Sequence: Synthetic peptide
  Seed: RRYNADISTF (TYRP1_HUMAN)
RIYNADISTY

SEQ ID NO: 173787 - protein, 10 aa, Artificial Sequence
  Description of Artificial Sequence: Synthetic peptide
  Seed: RSLHNLAHLF (TYRP1_HUMAN)
RLLHNLAHLY

SEQ ID NO: 173788 - protein, 9 aa, Artificial Sequence
  Description of Artificial Sequence: Synthetic peptide
  Seed: KLLSLGCIF (TYRP1_HUMAN)
KALSLGCIF

SEQ ID NO: 173789 - protein, 10 aa, Artificial Sequence
  Description of Artificial Sequence: Synthetic peptide
  Seed: GNVARPMVQR (TYRP1_HUMAN)
GEVARPMVQK

SEQ ID NO: 173790 - protein, 8 aa, Artificial Sequence
  Description of Artificial Sequence: Synthetic peptide
  Seed: LIFGTASY (TYRP1_HUMAN)
LAFGTASY

SEQ ID NO: 173791 - protein, 9 aa, Artificial Sequence
  Description of Artificial Sequence: Synthetic peptide
  Seed: NFDSTLISP (TYRP1_HUMAN)
NGDSTLISL

SEQ ID NO: 173792 - protein, 10 aa, Artificial Sequence
  Description of Artificial Sequence: Synthetic peptide
  Seed: LPYWNFATGK (TYRP1_HUMAN)
LFYWNFATGK

SEQ ID NO: 173793 - protein, 10 aa, Artificial Sequence
  Description of Artificial Sequence: Synthetic peptide
  Seed: HPLFVIATRR (TYRP1_HUMAN)
HYLFVIATRR

SEQ ID NO: 173794 - protein, 9 aa, Artificial Sequence
  Description of Artificial Sequence: Synthetic peptide
  Seed: THLSPNDPI (TYRP1_HUMAN)
THLSPNDPF

SEQ ID NO: 173795 - protein, 8 aa, Artificial Sequence
  Description of Artificial Sequence: Synthetic peptide
  Seed: RQYNMVPF (TYRP1_HUMAN)
REYNMVPI

SEQ ID NO: 173796 - protein, 9 aa, Artificial Sequence
  Description of Artificial Sequence: Synthetic peptide
  Seed: FSHEGPAFL (TYRP1_HUMAN)
FVHEGPAFM

SEQ ID NO: 173797 - protein, 9 aa, Artificial Sequence
  Description of Artificial Sequence: Synthetic peptide
  Seed: RFFNRTCHC (TYRP1_HUMAN)
RTFNRTCHR

SEQ ID NO: 173798 - protein, 9 aa, Artificial Sequence
  Description of Artificial Sequence: Synthetic peptide
  Seed: YNYFVWTHY (TYRP1_HUMAN)
YEYFVWTHY

SEQ ID NO: 173799 - protein, 9 aa, Artificial Sequence
  Description of Artificial Sequence: Synthetic peptide
  Seed: MLQEPSFSL (TYRP1_HUMAN)
MTQEPSFSA

SEQ ID NO: 173800 - protein, 9 aa, Artificial Sequence
  Description of Artificial Sequence: Synthetic peptide
  Seed: ALIFGTASY (TYRP1_HUMAN)
AQIFGTASL

SEQ ID NO: 173801 - protein, 10 aa, Artificial Sequence
  Description of Artificial Sequence: Synthetic peptide
  Seed: FVLLHTFTDA (TYRP1_HUMAN)
FMLLHTFTDM

SEQ ID NO: 173802 - protein, 9 aa, Artificial Sequence
  Description of Artificial Sequence: Synthetic peptide
  Seed: RQCATVEAL (TYRP1_HUMAN)
RACATVEAF

SEQ ID NO: 173803 - protein, 9 aa, Artificial Sequence
  Description of Artificial Sequence: Synthetic peptide
  Seed: RSNFDSTLI (TYRP1_HUMAN)
RSNFDSTLK

SEQ ID NO: 173804 - protein, 9 aa, Artificial Sequence
  Description of Artificial Sequence: Synthetic peptide
  Seed: LTWHRYHLL (TYRP1_HUMAN)
LTWHRYHLM

SEQ ID NO: 173805 - protein, 10 aa, Artificial Sequence
  Description of Artificial Sequence: Synthetic peptide
  Seed: YSNSTNSFRN (TYRP1_HUMAN)
YSNSTNSFRR

SEQ ID NO: 173806 - protein, 9 aa, Artificial Sequence
  Description of Artificial Sequence: Synthetic peptide
  Seed: SVKKTFLGV (TYRP1_HUMAN)
STKKTFLGI

SEQ ID NO: 173807 - protein, 10 aa, Artificial Sequence
  Description of Artificial Sequence: Synthetic peptide
  Seed: FYSNSTNSFR (TYRP1_HUMAN)
FHSNSTNSFR

SEQ ID NO: 173808 - protein, 11 aa, Artificial Sequence
  Description of Artificial Sequence: Synthetic peptide
  Seed: FLTWHRYHLLR (TYRP1_HUMAN)
FFTWHRYHLLR

SEQ ID NO: 173809 - protein, 10 aa, Artificial Sequence
  Description of Artificial Sequence: Synthetic peptide
  Seed: TPQFENISIY (TYRP1_HUMAN)
TDQFENISIF

SEQ ID NO: 173810 - protein, 10 aa, Artificial Sequence
  Description of Artificial Sequence: Synthetic peptide
  Seed: TASYLIRARR (TYRP1_HUMAN)
TESYLIRARR

SEQ ID NO: 173811 - protein, 10 aa, Artificial Sequence
  Description of Artificial Sequence: Synthetic peptide
  Seed: TFTDAVFDEW (TYRP1_HUMAN)
TFTDAVFDEF

SEQ ID NO: 173812 - protein, 10 aa, Artificial Sequence
  Description of Artificial Sequence: Synthetic peptide
  Seed: IQWPSREFSV (TYRP1_HUMAN)
ILWPSREFSL

SEQ ID NO: 173813 - protein, 9 aa, Artificial Sequence
  Description of Artificial Sequence: Synthetic peptide
  Seed: ALIFGTASY (TYRP1_HUMAN)
AFIFGTASL

SEQ ID NO: 173814 - protein, 10 aa, Artificial Sequence
  Description of Artificial Sequence: Synthetic peptide
  Seed: THYYSVKKTF (TYRP1_HUMAN)
TIYYSVKKTF

SEQ ID NO: 173815 - protein, 9 aa, Artificial Sequence
  Description of Artificial Sequence: Synthetic peptide
  Seed: FVWTHYYSV (TYRP1_HUMAN)
FQWTHYYSL

SEQ ID NO: 173816 - protein, 10 aa, Artificial Sequence
  Description of Artificial Sequence: Synthetic peptide
  Seed: NYFVWTHYYS (TYRP1_HUMAN)
NMFVWTHYYK

SEQ ID NO: 173817 - protein, 11 aa, Artificial Sequence
  Description of Artificial Sequence: Synthetic peptide
  Seed: AGNVARPMVQR (TYRP1_HUMAN)
AQNVARPMVQK

SEQ ID NO: 173818 - protein, 10 aa, Artificial Sequence
  Description of Artificial Sequence: Synthetic peptide
  Seed: YNADISTFPL (TYRP1_HUMAN)
YAADISTFPT

SEQ ID NO: 173819 - protein, 9 aa, Artificial Sequence
  Description of Artificial Sequence: Synthetic peptide
  Seed: MLQEPSFSL (TYRP1_HUMAN)
MHQEPSFSI

SEQ ID NO: 173820 - protein, 10 aa, Artificial Sequence
  Description of Artificial Sequence: Synthetic peptide
  Seed: YSNSTNSFRN (TYRP1_HUMAN)
YSNSTNSFRK

SEQ ID NO: 173821 - protein, 9 aa, Artificial Sequence
  Description of Artificial Sequence: Synthetic peptide
  Seed: KYDPAVRSL (TYRP1_HUMAN)
KLDPAVRSI

SEQ ID NO: 173822 - protein, 10 aa, Artificial Sequence
  Description of Artificial Sequence: Synthetic peptide
  Seed: RRYNADISTF (TYRP1_HUMAN)
RDYNADISTF

SEQ ID NO: 173823 - protein, 10 aa, Artificial Sequence
  Description of Artificial Sequence: Synthetic peptide
  Seed: GKYDPAVRSL (TYRP1_HUMAN)
GIYDPAVRSY

SEQ ID NO: 173824 - protein, 10 aa, Artificial Sequence
  Description of Artificial Sequence: Synthetic peptide
  Seed: RRYNADISTF (TYRP1_HUMAN)
RHYNADISTY

SEQ ID NO: 173825 - protein, 9 aa, Artificial Sequence
  Description of Artificial Sequence: Synthetic peptide
  Seed: YTYEIQWPS (TYRP1_HUMAN)
YWYEIQWPM

SEQ ID NO: 173826 - protein, 10 aa, Artificial Sequence
  Description of Artificial Sequence: Synthetic peptide
  Seed: SQWRVVCDSL (TYRP1_HUMAN)
SLWRVVCDSI

SEQ ID NO: 173827 - protein, 10 aa, Artificial Sequence
  Description of Artificial Sequence: Synthetic peptide
  Seed: GLFDTPPFYS (TYRP1_HUMAN)
GQFDTPPFYI

SEQ ID NO: 173828 - protein, 10 aa, Artificial Sequence
  Description of Artificial Sequence: Synthetic peptide
  Seed: NVARPMVQRL (TYRP1_HUMAN)
NTARPMVQRV

SEQ ID NO: 173829 - protein, 9 aa, Artificial Sequence
  Description of Artificial Sequence: Synthetic peptide
  Seed: STNSFRNTV (TYRP1_HUMAN)
SINSFRNTL

SEQ ID NO: 173830 - protein, 9 aa, Artificial Sequence
  Description of Artificial Sequence: Synthetic peptide
  Seed: REFSVPEII (TYRP1_HUMAN)
RTFSVPEIY

SEQ ID NO: 173831 - protein, 9 aa, Artificial Sequence
  Description of Artificial Sequence: Synthetic peptide
  Seed: LFQQARAQF (TYRP1_HUMAN)
LYQQARAQL

SEQ ID NO: 173832 - protein, 9 aa, Artificial Sequence
  Description of Artificial Sequence: Synthetic peptide
  Seed: HEGPAFLTW (TYRP1_HUMAN)
HAGPAFLTL

SEQ ID NO: 173833 - protein, 9 aa, Artificial Sequence
  Description of Artificial Sequence: Synthetic peptide
  Seed: LIFGTASYL (TYRP1_HUMAN)
LAFGTASYF

SEQ ID NO: 173834 - protein, 11 aa, Artificial Sequence
  Description of Artificial Sequence: Synthetic peptide
  Seed: RRSMDEANQPL (TYRP1_HUMAN)
RASMDEANQPV

SEQ ID NO: 173835 - protein, 9 aa, Artificial Sequence
  Description of Artificial Sequence: Synthetic peptide
  Seed: AIAVVGALL (TYRP1_HUMAN)
AAAVVGALM

SEQ ID NO: 173836 - protein, 9 aa, Artificial Sequence
  Description of Artificial Sequence: Synthetic peptide
  Seed: NYFVWTHYY (TYRP1_HUMAN)
NLFVWTHYK

SEQ ID NO: 173837 - protein, 10 aa, Artificial Sequence
  Description of Artificial Sequence: Synthetic peptide
  Seed: FLTWHRYHLL (TYRP1_HUMAN)
FFTWHRYHLV

SEQ ID NO: 173838 - protein, 9 aa, Artificial Sequence
  Description of Artificial Sequence: Synthetic peptide
  Seed: LLVALIFGT (TYRP1_HUMAN)
LLVALIFGV

SEQ ID NO: 173839 - protein, 10 aa, Artificial Sequence
  Description of Artificial Sequence: Synthetic peptide
  Seed: MAKRTTHPLF (TYRP1_HUMAN)
MQKRTTHPLY

SEQ ID NO: 173840 - protein, 9 aa, Artificial Sequence
  Description of Artificial Sequence: Synthetic peptide
  Seed: RPGWRGAAC (TYRP1_HUMAN)
RPGWRGAAL

SEQ ID NO: 173841 - protein, 9 aa, Artificial Sequence
  Description of Artificial Sequence: Synthetic peptide
  Seed: AACDQRVLI (TYRP1_HUMAN)
ALCDQRVLI

SEQ ID NO: 173842 - protein, 10 aa, Artificial Sequence
  Description of Artificial Sequence: Synthetic peptide
  Seed: FWPPVTNTEM (TYRP1_HUMAN)
FQPPVTNTEL

SEQ ID NO: 173843 - protein, 10 aa, Artificial Sequence
  Description of Artificial Sequence: Synthetic peptide
  Seed: LIFGTASYLI (TYRP1_HUMAN)
LFFGTASYLW

SEQ ID NO: 173844 - protein, 10 aa, Artificial Sequence
  Description of Artificial Sequence: Synthetic peptide
  Seed: RSLHNLAHLF (TYRP1_HUMAN)
RWLHNLAHLL

SEQ ID NO: 173845 - protein, 9 aa, Artificial Sequence
  Description of Artificial Sequence: Synthetic peptide
  Seed: LQNPNQSVV (TYRP1_HUMAN)
LVNPNQSVL

SEQ ID NO: 173846 - protein, 10 aa, Artificial Sequence
  Description of Artificial Sequence: Synthetic peptide
  Seed: ALIFGTASYL (TYRP1_HUMAN)
AMIFGTASYN

SEQ ID NO: 173847 - protein, 10 aa, Artificial Sequence
  Description of Artificial Sequence: Synthetic peptide
  Seed: ALIFGTASYL (TYRP1_HUMAN)
AKIFGTASYY

SEQ ID NO: 173848 - protein, 10 aa, Artificial Sequence
  Description of Artificial Sequence: Synthetic peptide
  Seed: DAVFDEWLRR (TYRP1_HUMAN)
DVVFDEWLRR

SEQ ID NO: 173849 - protein, 9 aa, Artificial Sequence
  Description of Artificial Sequence: Synthetic peptide
  Seed: FLTWHRYHL (TYRP1_HUMAN)
FWTWHRYHM

SEQ ID NO: 173850 - protein, 11 aa, Artificial Sequence
  Description of Artificial Sequence: Synthetic peptide
  Seed: ILGPDGNTPQF (TYRP1_HUMAN)
IAGPDGNTPQW

SEQ ID NO: 173851 - protein, 10 aa, Artificial Sequence
  Description of Artificial Sequence: Synthetic peptide
  Seed: DAVFDEWLRR (TYRP1_HUMAN)
DSVFDEWLRK

SEQ ID NO: 173852 - protein, 9 aa, Artificial Sequence
  Description of Artificial Sequence: Synthetic peptide
  Seed: VLIVRRNLL (TYRP1_HUMAN)
VFIVRRNLM

SEQ ID NO: 173853 - protein, 11 aa, Artificial Sequence
  Description of Artificial Sequence: Synthetic peptide
  Seed: FLNGTGGQTHL (TYRP1_HUMAN)
FTNGTGGQTHY

SEQ ID NO: 173854 - protein, 9 aa, Artificial Sequence
  Description of Artificial Sequence: Synthetic peptide
  Seed: LTWHRYHLL (TYRP1_HUMAN)
LIWHRYHLY

SEQ ID NO: 173855 - protein, 10 aa, Artificial Sequence
  Description of Artificial Sequence: Synthetic peptide
  Seed: THYYSVKKTF (TYRP1_HUMAN)
TKYYSVKKTY

SEQ ID NO: 173856 - protein, 9 aa, Artificial Sequence
  Description of Artificial Sequence: Synthetic peptide
  Seed: FSVPEIIAI (TYRP1_HUMAN)
FCVPEIIAY

SEQ ID NO: 173857 - protein, 9 aa, Artificial Sequence
  Description of Artificial Sequence: Synthetic peptide
  Seed: QCATVEALR (TYRP1_HUMAN)
QMATVEALR

SEQ ID NO: 173858 - protein, 10 aa, Artificial Sequence
  Description of Artificial Sequence: Synthetic peptide
  Seed: FSLPYWNFAT (TYRP1_HUMAN)
FQLPYWNFAT

SEQ ID NO: 173859 - protein, 9 aa, Artificial Sequence
  Description of Artificial Sequence: Synthetic peptide
  Seed: ALIFGTASY (TYRP1_HUMAN)
AQIFGTASI

SEQ ID NO: 173860 - protein, 9 aa, Artificial Sequence
  Description of Artificial Sequence: Synthetic peptide
  Seed: AVFDEWLRR (TYRP1_HUMAN)
AWFDEWLRY

SEQ ID NO: 173861 - protein, 9 aa, Artificial Sequence
  Description of Artificial Sequence: Synthetic peptide
  Seed: SPNDPIFVL (TYRP1_HUMAN)
SPNDPIFVT

SEQ ID NO: 173862 - protein, 10 aa, Artificial Sequence
  Description of Artificial Sequence: Synthetic peptide
  Seed: MLQEPSFSLP (TYRP1_HUMAN)
MLQEPSFSLH

SEQ ID NO: 173863 - protein, 9 aa, Artificial Sequence
  Description of Artificial Sequence: Synthetic peptide
  Seed: HEGPAFLTW (TYRP1_HUMAN)
HVGPAFLTM

SEQ ID NO: 173864 - protein, 10 aa, Artificial Sequence
  Description of Artificial Sequence: Synthetic peptide
  Seed: FSLPYWNFAT (TYRP1_HUMAN)
FQLPYWNFAL

SEQ ID NO: 173865 - protein, 11 aa, Artificial Sequence
  Description of Artificial Sequence: Synthetic peptide
  Seed: QEMLQEPSFSL (TYRP1_HUMAN)
QRMLQEPSFSI

SEQ ID NO: 173866 - protein, 11 aa, Artificial Sequence
  Description of Artificial Sequence: Synthetic peptide
  Seed: IYNYFVWTHYY (TYRP1_HUMAN)
IGNYFVWTHYF

SEQ ID NO: 173867 - protein, 9 aa, Artificial Sequence
  Description of Artificial Sequence: Synthetic peptide
  Seed: FVWTHYYSV (TYRP1_HUMAN)
FLWTHYYSG

SEQ ID NO: 173868 - protein, 10 aa, Artificial Sequence
  Description of Artificial Sequence: Synthetic peptide
  Seed: KLLSLGCIFF (TYRP1_HUMAN)
KALSLGCIFF

SEQ ID NO: 173869 - protein, 10 aa, Artificial Sequence
  Description of Artificial Sequence: Synthetic peptide
  Seed: MVPFWPPVTN (TYRP1_HUMAN)
MKPFWPPVTL

SEQ ID NO: 173870 - protein, 9 aa, Artificial Sequence
  Description of Artificial Sequence: Synthetic peptide
  Seed: HYYSVKKTF (TYRP1_HUMAN)
HAYSVKKTM

SEQ ID NO: 173871 - protein, 9 aa, Artificial Sequence
  Description of Artificial Sequence: Synthetic peptide
  Seed: YTYEIQWPS (TYRP1_HUMAN)
YLYEIQWPK

SEQ ID NO: 173872 - protein, 9 aa, Artificial Sequence
  Description of Artificial Sequence: Synthetic peptide
  Seed: KLQNPNQSV (TYRP1_HUMAN)
KMQNPNQSM

SEQ ID NO: 173873 - protein, 9 aa, Artificial Sequence
  Description of Artificial Sequence: Synthetic peptide
  Seed: FVWTHYYSV (TYRP1_HUMAN)
FLWTHYYSC

SEQ ID NO: 173874 - protein, 9 aa, Artificial Sequence
  Description of Artificial Sequence: Synthetic peptide
  Seed: SVPEIIAIA (TYRP1_HUMAN)
SVPEIIAII

SEQ ID NO: 173875 - protein, 10 aa, Artificial Sequence
  Description of Artificial Sequence: Synthetic peptide
  Seed: LTWHRYHLLR (TYRP1_HUMAN)
LLWHRYHLLK

SEQ ID NO: 173876 - protein, 9 aa, Artificial Sequence
  Description of Artificial Sequence: Synthetic peptide
  Seed: NYFVWTHYY (TYRP1_HUMAN)
NPFVWTHYM

SEQ ID NO: 173877 - protein, 11 aa, Artificial Sequence
  Description of Artificial Sequence: Synthetic peptide
  Seed: QEMLQEPSFSL (TYRP1_HUMAN)
QYMLQEPSFSI

SEQ ID NO: 173878 - protein, 10 aa, Artificial Sequence
  Description of Artificial Sequence: Synthetic peptide
  Seed: EVWPLRFFNR (TYRP1_HUMAN)
EFWPLRFFNK

SEQ ID NO: 173879 - protein, 9 aa, Artificial Sequence
  Description of Artificial Sequence: Synthetic peptide
  Seed: ACDQRVLIV (TYRP1_HUMAN)
ASDQRVLIM

SEQ ID NO: 173880 - protein, 10 aa, Artificial Sequence
  Description of Artificial Sequence: Synthetic peptide
  Seed: SMDEANQPLL (TYRP1_HUMAN)
SIDEANQPLF

SEQ ID NO: 173881 - protein, 9 aa, Artificial Sequence
  Description of Artificial Sequence: Synthetic peptide
  Seed: STNSFRNTV (TYRP1_HUMAN)
STNSFRNTK

SEQ ID NO: 173882 - protein, 9 aa, Artificial Sequence
  Description of Artificial Sequence: Synthetic peptide
  Seed: SLGCIFFPL (TYRP1_HUMAN)
SIGCIFFPM

SEQ ID NO: 173883 - protein, 9 aa, Artificial Sequence
  Description of Artificial Sequence: Synthetic peptide
  Seed: VGLFDTPPF (TYRP1_HUMAN)
VPLFDTPPM

SEQ ID NO: 173884 - protein, 9 aa, Artificial Sequence
  Description of Artificial Sequence: Synthetic peptide
  Seed: ENAPIGHNR (TYRP1_HUMAN)
EVAPIGHNH

SEQ ID NO: 173885 - protein, 9 aa, Artificial Sequence
  Description of Artificial Sequence: Synthetic peptide
  Seed: GTASYLIRA (TYRP1_HUMAN)
GIASYLIRI

SEQ ID NO: 173886 - protein, 11 aa, Artificial Sequence
  Description of Artificial Sequence: Synthetic peptide
  Seed: YYSVKKTFLGV (TYRP1_HUMAN)
YWSVKKTFLGF

SEQ ID NO: 173887 - protein, 11 aa, Artificial Sequence
  Description of Artificial Sequence: Synthetic peptide
  Seed: HLSPNDPIFVL (TYRP1_HUMAN)
HTSPNDPIFVL

SEQ ID NO: 173888 - protein, 9 aa, Artificial Sequence
  Description of Artificial Sequence: Synthetic peptide
  Seed: VCDICTDDL (TYRP1_HUMAN)
VADICTDDI

SEQ ID NO: 173889 - protein, 10 aa, Artificial Sequence
  Description of Artificial Sequence: Synthetic peptide
  Seed: KRTTHPLFVI (TYRP1_HUMAN)
KNTTHPLFVW

SEQ ID NO: 173890 - protein, 9 aa, Artificial Sequence
  Description of Artificial Sequence: Synthetic peptide
  Seed: AIAVVGALL (TYRP1_HUMAN)
ASAVVGALF

SEQ ID NO: 173891 - protein, 11 aa, Artificial Sequence
  Description of Artificial Sequence: Synthetic peptide
  Seed: LISPNSVFSQW (TYRP1_HUMAN)
LSSPNSVFSQY

SEQ ID NO: 173892 - protein, 9 aa, Artificial Sequence
  Description of Artificial Sequence: Synthetic peptide
  Seed: SLHNLAHLF (TYRP1_HUMAN)
SIHNLAHLV

SEQ ID NO: 173893 - protein, 10 aa, Artificial Sequence
  Description of Artificial Sequence: Synthetic peptide
  Seed: ALIFGTASYL (TYRP1_HUMAN)
AQIFGTASYG

SEQ ID NO: 173894 - protein, 10 aa, Artificial Sequence
  Description of Artificial Sequence: Synthetic peptide
  Seed: LLLVALIFGT (TYRP1_HUMAN)
LNLVALIFGI

SEQ ID NO: 173895 - protein, 9 aa, Artificial Sequence
  Description of Artificial Sequence: Synthetic peptide
  Seed: VTAPDNLGY (TYRP1_HUMAN)
VYAPDNLGY

SEQ ID NO: 173896 - protein, 11 aa, Artificial Sequence
  Description of Artificial Sequence: Synthetic peptide
  Seed: RRYNADISTFP (TYRP1_HUMAN)
RRYNADISTFM

SEQ ID NO: 173897 - protein, 9 aa, Artificial Sequence
  Description of Artificial Sequence: Synthetic peptide
  Seed: HEGPAFLTW (TYRP1_HUMAN)
HVGPAFLTY

SEQ ID NO: 173898 - protein, 9 aa, Artificial Sequence
  Description of Artificial Sequence: Synthetic peptide
  Seed: IAIAVVGAL (TYRP1_HUMAN)
IFIAVVGAF

SEQ ID NO: 173899 - protein, 8 aa, Artificial Sequence
  Description of Artificial Sequence: Synthetic peptide
  Seed: YDPAVRSL (TYRP1_HUMAN)
YTPAVRSM

SEQ ID NO: 173900 - protein, 9 aa, Artificial Sequence
  Description of Artificial Sequence: Synthetic peptide
  Seed: FYSNSTNSF (TYRP1_HUMAN)
FFSNSTNSV

SEQ ID NO: 173901 - protein, 8 aa, Artificial Sequence
  Description of Artificial Sequence: Synthetic peptide
  Seed: REFSVPEI (TYRP1_HUMAN)
REFSVPEM

SEQ ID NO: 173902 - protein, 10 aa, Artificial Sequence
  Description of Artificial Sequence: Synthetic peptide
  Seed: FFPLLLFQQA (TYRP1_HUMAN)
FYPLLLFQQA

SEQ ID NO: 173903 - protein, 10 aa, Artificial Sequence
  Description of Artificial Sequence: Synthetic peptide
  Seed: LSPNDPIFVL (TYRP1_HUMAN)
LYPNDPIFVF

SEQ ID NO: 173904 - protein, 11 aa, Artificial Sequence
  Description of Artificial Sequence: Synthetic peptide
  Seed: IYNYFVWTHYY (TYRP1_HUMAN)
IMNYFVWTHYL

SEQ ID NO: 173905 - protein, 9 aa, Artificial Sequence
  Description of Artificial Sequence: Synthetic peptide
  Seed: TLISPNSVF (TYRP1_HUMAN)
TFISPNSVM

SEQ ID NO: 173906 - protein, 10 aa, Artificial Sequence
  Description of Artificial Sequence: Synthetic peptide
  Seed: VLLHTFTDAV (TYRP1_HUMAN)
VMLHTFTDAI

SEQ ID NO: 173907 - protein, 10 aa, Artificial Sequence
  Description of Artificial Sequence: Synthetic peptide
  Seed: FYSNSTNSFR (TYRP1_HUMAN)
FVSNSTNSFK

SEQ ID NO: 173908 - protein, 10 aa, Artificial Sequence
  Description of Artificial Sequence: Synthetic peptide
  Seed: EGYSDPTGKY (TYRP1_HUMAN)
EVYSDPTGKY

SEQ ID NO: 173909 - protein, 9 aa, Artificial Sequence
  Description of Artificial Sequence: Synthetic peptide
  Seed: HEGPAFLTW (TYRP1_HUMAN)
HQGPAFLTV

SEQ ID NO: 173910 - protein, 10 aa, Artificial Sequence
  Description of Artificial Sequence: Synthetic peptide
  Seed: YSVKKTFLGV (TYRP1_HUMAN)
YLVKKTFLGA

SEQ ID NO: 173911 - protein, 9 aa, Artificial Sequence
  Description of Artificial Sequence: Synthetic peptide
  Seed: IAIAVVGAL (TYRP1_HUMAN)
IFIAVVGAY

SEQ ID NO: 173912 - protein, 10 aa, Artificial Sequence
  Description of Artificial Sequence: Synthetic peptide
  Seed: LIFGTASYLI (TYRP1_HUMAN)
LLFGTASYLI

SEQ ID NO: 173913 - protein, 11 aa, Artificial Sequence
  Description of Artificial Sequence: Synthetic peptide
  Seed: YNYFVWTHYYS (TYRP1_HUMAN)
YRYFVWTHYYY

SEQ ID NO: 173914 - protein, 8 aa, Artificial Sequence
  Description of Artificial Sequence: Synthetic peptide
  Seed: YSDPTGKY (TYRP1_HUMAN)
YNDPTGKM

SEQ ID NO: 173915 - protein, 10 aa, Artificial Sequence
  Description of Artificial Sequence: Synthetic peptide
  Seed: MLQEPSFSLP (TYRP1_HUMAN)
MMQEPSFSLS

SEQ ID NO: 173916 - protein, 10 aa, Artificial Sequence
  Description of Artificial Sequence: Synthetic peptide
  Seed: GEVDFSHEGP (TYRP1_HUMAN)
GEVDFSHEGT

SEQ ID NO: 173917 - protein, 10 aa, Artificial Sequence
  Description of Artificial Sequence: Synthetic peptide
  Seed: ISPNSVFSQW (TYRP1_HUMAN)
ITPNSVFSQF

SEQ ID NO: 173918 - protein, 10 aa, Artificial Sequence
  Description of Artificial Sequence: Synthetic peptide
  Seed: LPYWNFATGK (TYRP1_HUMAN)
LEYWNFATGR

SEQ ID NO: 173919 - protein, 9 aa, Artificial Sequence
  Description of Artificial Sequence: Synthetic peptide
  Seed: NYFVWTHYY (TYRP1_HUMAN)
NCFVWTHYY

SEQ ID NO: 173920 - protein, 9 aa, Artificial Sequence
  Description of Artificial Sequence: Synthetic peptide
  Seed: SIYNYFVWT (TYRP1_HUMAN)
SAYNYFVWV

SEQ ID NO: 173921 - protein, 10 aa, Artificial Sequence
  Description of Artificial Sequence: Synthetic peptide
  Seed: YNYFVWTHYY (TYRP1_HUMAN)
YEYFVWTHYL

SEQ ID NO: 173922 - protein, 9 aa, Artificial Sequence
  Description of Artificial Sequence: Synthetic peptide
  Seed: LFQQARAQF (TYRP1_HUMAN)
LYQQARAQW

SEQ ID NO: 173923 - protein, 9 aa, Artificial Sequence
  Description of Artificial Sequence: Synthetic peptide
  Seed: FSLPYWNFA (TYRP1_HUMAN)
FFLPYWNFV

SEQ ID NO: 173924 - protein, 9 aa, Artificial Sequence
  Description of Artificial Sequence: Synthetic peptide
  Seed: LTWHRYHLL (TYRP1_HUMAN)
LTWHRYHLW

SEQ ID NO: 173925 - protein, 10 aa, Artificial Sequence
  Description of Artificial Sequence: Synthetic peptide
  Seed: FLNGTGGQTH (TYRP1_HUMAN)
FINGTGGQTY

SEQ ID NO: 173926 - protein, 10 aa, Artificial Sequence
  Description of Artificial Sequence: Synthetic peptide
  Seed: FSVPEIIAIA (TYRP1_HUMAN)
FIVPEIIAIL

SEQ ID NO: 173927 - protein, 9 aa, Artificial Sequence
  Description of Artificial Sequence: Synthetic peptide
  Seed: YTYEIQWPS (TYRP1_HUMAN)
YVYEIQWPG

SEQ ID NO: 173928 - protein, 10 aa, Artificial Sequence
  Description of Artificial Sequence: Synthetic peptide
  Seed: YNYFVWTHYY (TYRP1_HUMAN)
YGYFVWTHYV

SEQ ID NO: 173929 - protein, 10 aa, Artificial Sequence
  Description of Artificial Sequence: Synthetic peptide
  Seed: FLTWHRYHLL (TYRP1_HUMAN)
FLTWHRYHLT

SEQ ID NO: 173930 - protein, 10 aa, Artificial Sequence
  Description of Artificial Sequence: Synthetic peptide
  Seed: WPPVTNTEMF (TYRP1_HUMAN)
WPPVTNTEMY

SEQ ID NO: 173931 - protein, 10 aa, Artificial Sequence
  Description of Artificial Sequence: Synthetic peptide
  Seed: ENISIYNYFV (TYRP1_HUMAN)
EVISIYNYFI

SEQ ID NO: 173932 - protein, 11 aa, Artificial Sequence
  Description of Artificial Sequence: Synthetic peptide
  Seed: QFENISIYNYF (TYRP1_HUMAN)
QYENISIYNYF

SEQ ID NO: 173933 - protein, 9 aa, Artificial Sequence
  Description of Artificial Sequence: Synthetic peptide
  Seed: TAPDNLGYT (TYRP1_HUMAN)
TVPDNLGYM

SEQ ID NO: 173934 - protein, 9 aa, Artificial Sequence
  Description of Artificial Sequence: Synthetic peptide
  Seed: ISIYNYFVW (TYRP1_HUMAN)
ISIYNYFVM

SEQ ID NO: 173935 - protein, 10 aa, Artificial Sequence
  Description of Artificial Sequence: Synthetic peptide
  Seed: YNYFVWTHYY (TYRP1_HUMAN)
YFYFVWTHYG

SEQ ID NO: 173936 - protein, 10 aa, Artificial Sequence
  Description of Artificial Sequence: Synthetic peptide
  Seed: RPMVQRLPEP (TYRP1_HUMAN)
RPMVQRLPEF

SEQ ID NO: 173937 - protein, 9 aa, Artificial Sequence
  Description of Artificial Sequence: Synthetic peptide
  Seed: DAVFDEWLR (TYRP1_HUMAN)
DFVFDEWLR

SEQ ID NO: 173938 - protein, 10 aa, Artificial Sequence
  Description of Artificial Sequence: Synthetic peptide
  Seed: KLQNPNQSVV (TYRP1_HUMAN)
KMQNPNQSVW

SEQ ID NO: 173939 - protein, 10 aa, Artificial Sequence
  Description of Artificial Sequence: Synthetic peptide
  Seed: FYSNSTNSFR (TYRP1_HUMAN)
FASNSTNSFR

SEQ ID NO: 173940 - protein, 9 aa, Artificial Sequence
  Description of Artificial Sequence: Synthetic peptide
  Seed: MAKRTTHPL (TYRP1_HUMAN)
MNKRTTHPF

SEQ ID NO: 173941 - protein, 9 aa, Artificial Sequence
  Description of Artificial Sequence: Synthetic peptide
  Seed: PNDPIFVLL (TYRP1_HUMAN)
PFDPIFVLF

SEQ ID NO: 173942 - protein, 9 aa, Artificial Sequence
  Description of Artificial Sequence: Synthetic peptide
  Seed: MLQEPSFSL (TYRP1_HUMAN)
MSQEPSFSI

SEQ ID NO: 173943 - protein, 10 aa, Artificial Sequence
  Description of Artificial Sequence: Synthetic peptide
  Seed: AVVGALLLVA (TYRP1_HUMAN)
AVVGALLLVL

SEQ ID NO: 173944 - protein, 9 aa, Artificial Sequence
  Description of Artificial Sequence: Synthetic peptide
  Seed: LSPNDPIFV (TYRP1_HUMAN)
LMPNDPIFL

SEQ ID NO: 173945 - protein, 10 aa, Artificial Sequence
  Description of Artificial Sequence: Synthetic peptide
  Seed: YNADISTFPL (TYRP1_HUMAN)
YTADISTFPI

SEQ ID NO: 173946 - protein, 10 aa, Artificial Sequence
  Description of Artificial Sequence: Synthetic peptide
  Seed: EEKNHFVRAL (TYRP1_HUMAN)
EEKNHFVRAW

SEQ ID NO: 173947 - protein, 9 aa, Artificial Sequence
  Description of Artificial Sequence: Synthetic peptide
  Seed: FPLENAPIG (TYRP1_HUMAN)
FPLENAPIV

SEQ ID NO: 173948 - protein, 10 aa, Artificial Sequence
  Description of Artificial Sequence: Synthetic peptide
  Seed: LSLGCIFFPL (TYRP1_HUMAN)
LDLGCIFFPI

SEQ ID NO: 173949 - protein, 9 aa, Artificial Sequence
  Description of Artificial Sequence: Synthetic peptide
  Seed: AQFPRQCAT (TYRP1_HUMAN)
AEFPRQCAM

SEQ ID NO: 173950 - protein, 9 aa, Artificial Sequence
  Description of Artificial Sequence: Synthetic peptide
  Seed: LEVGLFDTP (TYRP1_HUMAN)
LEVGLFDTF

SEQ ID NO: 173951 - protein, 10 aa, Artificial Sequence
  Description of Artificial Sequence: Synthetic peptide
  Seed: FVWTHYYSVK (TYRP1_HUMAN)
FLWTHYYSVD

SEQ ID NO: 173952 - protein, 9 aa, Artificial Sequence
  Description of Artificial Sequence: Synthetic peptide
  Seed: RVLIVRRNL (TYRP1_HUMAN)
RTLIVRRNS

SEQ ID NO: 173953 - protein, 9 aa, Artificial Sequence
  Description of Artificial Sequence: Synthetic peptide
  Seed: LTWHRYHLL (TYRP1_HUMAN)
LWWHRYHLF

SEQ ID NO: 173954 - protein, 11 aa, Artificial Sequence
  Description of Artificial Sequence: Synthetic peptide
  Seed: YTYEIQWPSRE (TYRP1_HUMAN)
YYYEIQWPSRR

SEQ ID NO: 173955 - protein, 10 aa, Artificial Sequence
  Description of Artificial Sequence: Synthetic peptide
  Seed: AVRSLHNLAH (TYRP1_HUMAN)
AQRSLHNLAK

SEQ ID NO: 173956 - protein, 10 aa, Artificial Sequence
  Description of Artificial Sequence: Synthetic peptide
  Seed: LLLVALIFGT (TYRP1_HUMAN)
LCLVALIFGL

SEQ ID NO: 173957 - protein, 9 aa, Artificial Sequence
  Description of Artificial Sequence: Synthetic peptide
  Seed: NVARPMVQR (TYRP1_HUMAN)
NAARPMVQR

SEQ ID NO: 173958 - protein, 9 aa, Artificial Sequence
  Description of Artificial Sequence: Synthetic peptide
  Seed: RQYNMVPFW (TYRP1_HUMAN)
RRYNMVPFI

SEQ ID NO: 173959 - protein, 11 aa, Artificial Sequence
  Description of Artificial Sequence: Synthetic peptide
  Seed: HLSPNDPIFVL (TYRP1_HUMAN)
HQSPNDPIFVM

SEQ ID NO: 173960 - protein, 10 aa, Artificial Sequence
  Description of Artificial Sequence: Synthetic peptide
  Seed: QCYAEEYEKL (TYRP1_HUMAN)
QFYAEEYEKF

SEQ ID NO: 173961 - protein, 9 aa, Artificial Sequence
  Description of Artificial Sequence: Synthetic peptide
  Seed: SVKKTFLGV (TYRP1_HUMAN)
SQKKTFLGK

SEQ ID NO: 173962 - protein, 11 aa, Artificial Sequence
  Description of Artificial Sequence: Synthetic peptide
  Seed: YNMVPFWPPVT (TYRP1_HUMAN)
YYMVPFWPPVV

SEQ ID NO: 173963 - protein, 10 aa, Artificial Sequence
  Description of Artificial Sequence: Synthetic peptide
  Seed: KLLSLGCIFF (TYRP1_HUMAN)
KTLSLGCIFY

SEQ ID NO: 173964 - protein, 9 aa, Artificial Sequence
  Description of Artificial Sequence: Synthetic peptide
  Seed: SRSNFDSTL (TYRP1_HUMAN)
SRSNFDSTM

SEQ ID NO: 173965 - protein, 11 aa, Artificial Sequence
  Description of Artificial Sequence: Synthetic peptide
  Seed: EILGPDGNTPQ (TYRP1_HUMAN)
EMLGPDGNTPR

SEQ ID NO: 173966 - protein, 9 aa, Artificial Sequence
  Description of Artificial Sequence: Synthetic peptide
  Seed: LSPNDPIFV (TYRP1_HUMAN)
LMPNDPIFI

SEQ ID NO: 173967 - protein, 11 aa, Artificial Sequence
  Description of Artificial Sequence: Synthetic peptide
  Seed: SLPYWNFATGK (TYRP1_HUMAN)
SQPYWNFATGR

SEQ ID NO: 173968 - protein, 10 aa, Artificial Sequence
  Description of Artificial Sequence: Synthetic peptide
  Seed: FWPPVTNTEM (TYRP1_HUMAN)
FMPPVTNTEL

SEQ ID NO: 173969 - protein, 10 aa, Artificial Sequence
  Description of Artificial Sequence: Synthetic peptide
  Seed: FSVPEIIAIA (TYRP1_HUMAN)
FQVPEIIAIV

SEQ ID NO: 173970 - protein, 9 aa, Artificial Sequence
  Description of Artificial Sequence: Synthetic peptide
  Seed: YLIRARRSM (TYRP1_HUMAN)
YIIRARRSM

SEQ ID NO: 173971 - protein, 8 aa, Artificial Sequence
  Description of Artificial Sequence: Synthetic peptide
  Seed: YSDPTGKY (TYRP1_HUMAN)
YIDPTGKF

SEQ ID NO: 173972 - protein, 8 aa, Artificial Sequence
  Description of Artificial Sequence: Synthetic peptide
  Seed: IFFPLLLF (TYRP1_HUMAN)
IIFPLLLY

SEQ ID NO: 173973 - protein, 9 aa, Artificial Sequence
  Description of Artificial Sequence: Synthetic peptide
  Seed: MLQEPSFSL (TYRP1_HUMAN)
MLQEPSFSM

SEQ ID NO: 173974 - protein, 9 aa, Artificial Sequence
  Description of Artificial Sequence: Synthetic peptide
  Seed: RSLHNLAHL (TYRP1_HUMAN)
RSLHNLAHY

SEQ ID NO: 173975 - protein, 10 aa, Artificial Sequence
  Description of Artificial Sequence: Synthetic peptide
  Seed: FVWTHYYSVK (TYRP1_HUMAN)
FMWTHYYSVP

SEQ ID NO: 173976 - protein, 9 aa, Artificial Sequence
  Description of Artificial Sequence: Synthetic peptide
  Seed: FGTASYLIR (TYRP1_HUMAN)
FITASYLIR

SEQ ID NO: 173977 - protein, 9 aa, Artificial Sequence
  Description of Artificial Sequence: Synthetic peptide
  Seed: FPLLLFQQA (TYRP1_HUMAN)
FPLLLFQQY

SEQ ID NO: 173978 - protein, 9 aa, Artificial Sequence
  Description of Artificial Sequence: Synthetic peptide
  Seed: AVFDEWLRR (TYRP1_HUMAN)
AAFDEWLRK

SEQ ID NO: 173979 - protein, 10 aa, Artificial Sequence
  Description of Artificial Sequence: Synthetic peptide
  Seed: FYSNSTNSFR (TYRP1_HUMAN)
FNSNSTNSFK

SEQ ID NO: 173980 - protein, 9 aa, Artificial Sequence
  Description of Artificial Sequence: Synthetic peptide
  Seed: QWPSREFSV (TYRP1_HUMAN)
QWPSREFSW

SEQ ID NO: 173981 - protein, 9 aa, Artificial Sequence
  Description of Artificial Sequence: Synthetic peptide
  Seed: DSLEDYDTL (TYRP1_HUMAN)
DTLEDYDTL

SEQ ID NO: 173982 - protein, 10 aa, Artificial Sequence
  Description of Artificial Sequence: Synthetic peptide
  Seed: LLVALIFGTA (TYRP1_HUMAN)
LMVALIFGTI

SEQ ID NO: 173983 - protein, 10 aa, Artificial Sequence
  Description of Artificial Sequence: Synthetic peptide
  Seed: MAKRTTHPLF (TYRP1_HUMAN)
MLKRTTHPLY

SEQ ID NO: 173984 - protein, 11 aa, Artificial Sequence
  Description of Artificial Sequence: Synthetic peptide
  Seed: EILGPDGNTPQ (TYRP1_HUMAN)
EMLGPDGNTPK

SEQ ID NO: 173985 - protein, 9 aa, Artificial Sequence
  Description of Artificial Sequence: Synthetic peptide
  Seed: HYYSVKKTF (TYRP1_HUMAN)
HNYSVKKTY

SEQ ID NO: 173986 - protein, 9 aa, Artificial Sequence
  Description of Artificial Sequence: Synthetic peptide
  Seed: YYSVKKTFL (TYRP1_HUMAN)
YSSVKKTFM

SEQ ID NO: 173987 - protein, 9 aa, Artificial Sequence
  Description of Artificial Sequence: Synthetic peptide
  Seed: SMDEANQPL (TYRP1_HUMAN)
SADEANQPM

SEQ ID NO: 173988 - protein, 11 aa, Artificial Sequence
  Description of Artificial Sequence: Synthetic peptide
  Seed: FVLLHTFTDAV (TYRP1_HUMAN)
FLLLHTFTDAA

SEQ ID NO: 173989 - protein, 10 aa, Artificial Sequence
  Description of Artificial Sequence: Synthetic peptide
  Seed: FTDAVFDEWL (TYRP1_HUMAN)
FIDAVFDEWV

SEQ ID NO: 173990 - protein, 9 aa, Artificial Sequence
  Description of Artificial Sequence: Synthetic peptide
  Seed: ISIYNYFVW (TYRP1_HUMAN)
IAIYNYFVL

SEQ ID NO: 173991 - protein, 9 aa, Artificial Sequence
  Description of Artificial Sequence: Synthetic peptide
  Seed: GPDGNTPQF (TYRP1_HUMAN)
GVDGNTPQM

SEQ ID NO: 173992 - protein, 9 aa, Artificial Sequence
  Description of Artificial Sequence: Synthetic peptide
  Seed: NHFVRALDM (TYRP1_HUMAN)
NHFVRALDY

SEQ ID NO: 173993 - protein, 9 aa, Artificial Sequence
  Description of Artificial Sequence: Synthetic peptide
  Seed: FSLPYWNFA (TYRP1_HUMAN)
FTLPYWNFM

SEQ ID NO: 173994 - protein, 8 aa, Artificial Sequence
  Description of Artificial Sequence: Synthetic peptide
  Seed: AQFPRQCA (TYRP1_HUMAN)
AQFPRQCI

SEQ ID NO: 173995 - protein, 11 aa, Artificial Sequence
  Description of Artificial Sequence: Synthetic peptide
  Seed: AIAVVGALLLV (TYRP1_HUMAN)
ALAVVGALLLV

SEQ ID NO: 173996 - protein, 10 aa, Artificial Sequence
  Description of Artificial Sequence: Synthetic peptide
  Seed: YNADISTFPL (TYRP1_HUMAN)
YVADISTFPT

SEQ ID NO: 173997 - protein, 9 aa, Artificial Sequence
  Description of Artificial Sequence: Synthetic peptide
  Seed: HYYSVKKTF (TYRP1_HUMAN)
HQYSVKKTM

SEQ ID NO: 173998 - protein, 10 aa, Artificial Sequence
  Description of Artificial Sequence: Synthetic peptide
  Seed: YNMVPFWPPV (TYRP1_HUMAN)
YVMVPFWPPT

SEQ ID NO: 173999 - protein, 10 aa, Artificial Sequence
  Description of Artificial Sequence: Synthetic peptide
  Seed: THPLFVIATR (TYRP1_HUMAN)
TMPLFVIATR

SEQ ID NO: 174000 - protein, 10 aa, Artificial Sequence
  Description of Artificial Sequence: Synthetic peptide
  Seed: GEVDFSHEGP (TYRP1_HUMAN)
GEVDFSHEGA

SEQ ID NO: 174001 - protein, 11 aa, Artificial Sequence
  Description of Artificial Sequence: Synthetic peptide
  Seed: EVWPLRFFNRT (TYRP1_HUMAN)
EFWPLRFFNRR

SEQ ID NO: 174002 - protein, 10 aa, Artificial Sequence
  Description of Artificial Sequence: Synthetic peptide
  Seed: GNVARPMVQR (TYRP1_HUMAN)
GYVARPMVQK

SEQ ID NO: 174003 - protein, 11 aa, Artificial Sequence
  Description of Artificial Sequence: Synthetic peptide
  Seed: LIFGTASYLIR (TYRP1_HUMAN)
LFFGTASYLIR

SEQ ID NO: 174004 - protein, 9 aa, Artificial Sequence
  Description of Artificial Sequence: Synthetic peptide
  Seed: SPNSVFSQW (TYRP1_HUMAN)
SENSVFSQM

SEQ ID NO: 174005 - protein, 11 aa, Artificial Sequence
  Description of Artificial Sequence: Synthetic peptide
  Seed: GTASYLIRARR (TYRP1_HUMAN)
GTASYLIRARK

SEQ ID NO: 174006 - protein, 9 aa, Artificial Sequence
  Description of Artificial Sequence: Synthetic peptide
  Seed: MSAPKLLSL (TYRP1_HUMAN)
MTAPKLLSK

SEQ ID NO: 174007 - protein, 9 aa, Artificial Sequence
  Description of Artificial Sequence: Synthetic peptide
  Seed: HPLFVIATR (TYRP1_HUMAN)
HPLFVIATS

SEQ ID NO: 174008 - protein, 9 aa, Artificial Sequence
  Description of Artificial Sequence: Synthetic peptide
  Seed: NMVPFWPPV (TYRP1_HUMAN)
NMVPFWPPM

SEQ ID NO: 174009 - protein, 9 aa, Artificial Sequence
  Description of Artificial Sequence: Synthetic peptide
  Seed: RSLHNLAHL (TYRP1_HUMAN)
RQLHNLAHF

SEQ ID NO: 174010 - protein, 9 aa, Artificial Sequence
  Description of Artificial Sequence: Synthetic peptide
  Seed: AACDQRVLI (TYRP1_HUMAN)
AACDQRVLV

SEQ ID NO: 174011 - protein, 10 aa, Artificial Sequence
  Description of Artificial Sequence: Synthetic peptide
  Seed: DAVFDEWLRR (TYRP1_HUMAN)
DIVFDEWLRR

SEQ ID NO: 174012 - protein, 9 aa, Artificial Sequence
  Description of Artificial Sequence: Synthetic peptide
  Seed: VARPMVQRL (TYRP1_HUMAN)
VYRPMVQRM

SEQ ID NO: 174013 - protein, 10 aa, Artificial Sequence
  Description of Artificial Sequence: Synthetic peptide
  Seed: WPLRFFNRTC (TYRP1_HUMAN)
WPLRFFNRTM

SEQ ID NO: 174014 - protein, 9 aa, Artificial Sequence
  Description of Artificial Sequence: Synthetic peptide
  Seed: IAVVGALLL (TYRP1_HUMAN)
ILVVGALLF

SEQ ID NO: 174015 - protein, 9 aa, Artificial Sequence
  Description of Artificial Sequence: Synthetic peptide
  Seed: LTDQYQCYA (TYRP1_HUMAN)
LSDQYQCYI

SEQ ID NO: 174016 - protein, 9 aa, Artificial Sequence
  Description of Artificial Sequence: Synthetic peptide
  Seed: RQCATVEAL (TYRP1_HUMAN)
RMCATVEAF

SEQ ID NO: 174017 - protein, 9 aa, Artificial Sequence
  Description of Artificial Sequence: Synthetic peptide
  Seed: YNYFVWTHY (TYRP1_HUMAN)
YIYFVWTHR

SEQ ID NO: 174018 - protein, 9 aa, Artificial Sequence
  Description of Artificial Sequence: Synthetic peptide
  Seed: MAKRTTHPL (TYRP1_HUMAN)
MVKRTTHPS

SEQ ID NO: 174019 - protein, 11 aa, Artificial Sequence
  Description of Artificial Sequence: Synthetic peptide
  Seed: EVWPLRFFNRT (TYRP1_HUMAN)
EFWPLRFFNRK

SEQ ID NO: 174020 - protein, 9 aa, Artificial Sequence
  Description of Artificial Sequence: Synthetic peptide
  Seed: FLTWHRYHL (TYRP1_HUMAN)
FRTWHRYHL

SEQ ID NO: 174021 - protein, 10 aa, Artificial Sequence
  Description of Artificial Sequence: Synthetic peptide
  Seed: FYSNSTNSFR (TYRP1_HUMAN)
FYSNSTNSFM

SEQ ID NO: 174022 - protein, 10 aa, Artificial Sequence
  Description of Artificial Sequence: Synthetic peptide
  Seed: HPLFVIATRR (TYRP1_HUMAN)
HTLFVIATRI

SEQ ID NO: 174023 - protein, 9 aa, Artificial Sequence
  Description of Artificial Sequence: Synthetic peptide
  Seed: QEMLQEPSF (TYRP1_HUMAN)
QKMLQEPSY

SEQ ID NO: 174024 - protein, 10 aa, Artificial Sequence
  Description of Artificial Sequence: Synthetic peptide
  Seed: RSMDEANQPL (TYRP1_HUMAN)
RKMDEANQPF

SEQ ID NO: 174025 - protein, 9 aa, Artificial Sequence
  Description of Artificial Sequence: Synthetic peptide
  Seed: ISIYNYFVW (TYRP1_HUMAN)
IAIYNYFVY

SEQ ID NO: 174026 - protein, 9 aa, Artificial Sequence
  Description of Artificial Sequence: Synthetic peptide
  Seed: RQYNMVPFW (TYRP1_HUMAN)
RQYNMVPFH

SEQ ID NO: 174027 - protein, 10 aa, Artificial Sequence
  Description of Artificial Sequence: Synthetic peptide
  Seed: YSNSTNSFRN (TYRP1_HUMAN)
YVNSTNSFRK

SEQ ID NO: 174028 - protein, 9 aa, Artificial Sequence
  Description of Artificial Sequence: Synthetic peptide
  Seed: RLEKDMQEM (TYRP1_HUMAN)
RIEKDMQEL

SEQ ID NO: 174029 - protein, 9 aa, Artificial Sequence
  Description of Artificial Sequence: Synthetic peptide
  Seed: KYDPAVRSL (TYRP1_HUMAN)
KQDPAVRSI

SEQ ID NO: 174030 - protein, 9 aa, Artificial Sequence
  Description of Artificial Sequence: Synthetic peptide
  Seed: FPLENAPIG (TYRP1_HUMAN)
FALENAPIY

SEQ ID NO: 174031 - protein, 11 aa, Artificial Sequence
  Description of Artificial Sequence: Synthetic peptide
  Seed: KEEKNHFVRAL (TYRP1_HUMAN)
KEEKNHFVRAF

SEQ ID NO: 174032 - protein, 9 aa, Artificial Sequence
  Description of Artificial Sequence: Synthetic peptide
  Seed: FTDAVFDEW (TYRP1_HUMAN)
FTDAVFDEI

SEQ ID NO: 174033 - protein, 9 aa, Artificial Sequence
  Description of Artificial Sequence: Synthetic peptide
  Seed: FSHEGPAFL (TYRP1_HUMAN)
FKHEGPAFF

SEQ ID NO: 174034 - protein, 9 aa, Artificial Sequence
  Description of Artificial Sequence: Synthetic peptide
  Seed: IAVVGALLL (TYRP1_HUMAN)
IKVVGALLL

SEQ ID NO: 174035 - protein, 9 aa, Artificial Sequence
  Description of Artificial Sequence: Synthetic peptide
  Seed: NRQYNMVPF (TYRP1_HUMAN)
NYQYNMVPY

SEQ ID NO: 174036 - protein, 9 aa, Artificial Sequence
  Description of Artificial Sequence: Synthetic peptide
  Seed: VLIVRRNLL (TYRP1_HUMAN)
VPIVRRNLL

SEQ ID NO: 174037 - protein, 10 aa, Artificial Sequence
  Description of Artificial Sequence: Synthetic peptide
  Seed: SMDEANQPLL (TYRP1_HUMAN)
SSDEANQPLL

SEQ ID NO: 174038 - protein, 9 aa, Artificial Sequence
  Description of Artificial Sequence: Synthetic peptide
  Seed: GLFDTPPFY (TYRP1_HUMAN)
GRFDTPPFY

SEQ ID NO: 174039 - protein, 9 aa, Artificial Sequence
  Description of Artificial Sequence: Synthetic peptide
  Seed: STNSFRNTV (TYRP1_HUMAN)
SSNSFRNTF

SEQ ID NO: 174040 - protein, 11 aa, Artificial Sequence
  Description of Artificial Sequence: Synthetic peptide
  Seed: FSHEGPAFLTW (TYRP1_HUMAN)
FGHEGPAFLTW

SEQ ID NO: 174041 - protein, 9 aa, Artificial Sequence
  Description of Artificial Sequence: Synthetic peptide
  Seed: IAVVGALLL (TYRP1_HUMAN)
IQVVGALLM

SEQ ID NO: 174042 - protein, 8 aa, Artificial Sequence
  Description of Artificial Sequence: Synthetic peptide
  Seed: YDPAVRSL (TYRP1_HUMAN)
YSPAVRSM

SEQ ID NO: 174043 - protein, 9 aa, Artificial Sequence
  Description of Artificial Sequence: Synthetic peptide
  Seed: NYFVWTHYY (TYRP1_HUMAN)
NTFVWTHYR

SEQ ID NO: 174044 - protein, 10 aa, Artificial Sequence
  Description of Artificial Sequence: Synthetic peptide
  Seed: FSLPYWNFAT (TYRP1_HUMAN)
FFLPYWNFAA

SEQ ID NO: 174045 - protein, 9 aa, Artificial Sequence
  Description of Artificial Sequence: Synthetic peptide
  Seed: YTYEIQWPS (TYRP1_HUMAN)
YLYEIQWPY

SEQ ID NO: 174046 - protein, 9 aa, Artificial Sequence
  Description of Artificial Sequence: Synthetic peptide
  Seed: KEEKNHFVR (TYRP1_HUMAN)
KEEKNHFVM

SEQ ID NO: 174047 - protein, 9 aa, Artificial Sequence
  Description of Artificial Sequence: Synthetic peptide
  Seed: LPYWNFATG (TYRP1_HUMAN)
LPYWNFATM

SEQ ID NO: 174048 - protein, 9 aa, Artificial Sequence
  Description of Artificial Sequence: Synthetic peptide
  Seed: YLIRARRSM (TYRP1_HUMAN)
YSIRARRSV

SEQ ID NO: 174049 - protein, 9 aa, Artificial Sequence
  Description of Artificial Sequence: Synthetic peptide
  Seed: PNDPIFVLL (TYRP1_HUMAN)
PADPIFVLI

SEQ ID NO: 174050 - protein, 9 aa, Artificial Sequence
  Description of Artificial Sequence: Synthetic peptide
  Seed: FVWTHYYSV (TYRP1_HUMAN)
FLWTHYYST

SEQ ID NO: 174051 - protein, 10 aa, Artificial Sequence
  Description of Artificial Sequence: Synthetic peptide
  Seed: ALIFGTASYL (TYRP1_HUMAN)
AQIFGTASYM

SEQ ID NO: 174052 - protein, 9 aa, Artificial Sequence
  Description of Artificial Sequence: Synthetic peptide
  Seed: SPNSVFSQW (TYRP1_HUMAN)
SENSVFSQL

SEQ ID NO: 174053 - protein, 9 aa, Artificial Sequence
  Description of Artificial Sequence: Synthetic peptide
  Seed: DQRVLIVRR (TYRP1_HUMAN)
DMRVLIVRR

SEQ ID NO: 174054 - protein, 9 aa, Artificial Sequence
  Description of Artificial Sequence: Synthetic peptide
  Seed: YTYEIQWPS (TYRP1_HUMAN)
YLYEIQWPL

SEQ ID NO: 174055 - protein, 11 aa, Artificial Sequence
  Description of Artificial Sequence: Synthetic peptide
  Seed: MLQEPSFSLPY (TYRP1_HUMAN)
MMQEPSFSLPF

SEQ ID NO: 174056 - protein, 8 aa, Artificial Sequence
  Description of Artificial Sequence: Synthetic peptide
  Seed: YSDPTGKY (TYRP1_HUMAN)
YGDPTGKI

SEQ ID NO: 174057 - protein, 10 aa, Artificial Sequence
  Description of Artificial Sequence: Synthetic peptide
  Seed: YNADISTFPL (TYRP1_HUMAN)
YLADISTFPT

SEQ ID NO: 174058 - protein, 9 aa, Artificial Sequence
  Description of Artificial Sequence: Synthetic peptide
  Seed: FSVPEIIAI (TYRP1_HUMAN)
FIVPEIIAT

SEQ ID NO: 174059 - protein, 9 aa, Artificial Sequence
  Description of Artificial Sequence: Synthetic peptide
  Seed: FVWTHYYSV (TYRP1_HUMAN)
FTWTHYYSM

SEQ ID NO: 174060 - protein, 9 aa, Artificial Sequence
  Description of Artificial Sequence: Synthetic peptide
  Seed: RPGWRGAAC (TYRP1_HUMAN)
RIGWRGAAL

SEQ ID NO: 174061 - protein, 9 aa, Artificial Sequence
  Description of Artificial Sequence: Synthetic peptide
  Seed: FLGVGQESF (TYRP1_HUMAN)
FFGVGQESM

SEQ ID NO: 174062 - protein, 10 aa, Artificial Sequence
  Description of Artificial Sequence: Synthetic peptide
  Seed: EIIAIAVVGA (TYRP1_HUMAN)
EFIAIAVVGI

SEQ ID NO: 174063 - protein, 9 aa, Artificial Sequence
  Description of Artificial Sequence: Synthetic peptide
  Seed: LFQQARAQF (TYRP1_HUMAN)
LQQQARAQL

SEQ ID NO: 174064 - protein, 9 aa, Artificial Sequence
  Description of Artificial Sequence: Synthetic peptide
  Seed: FYSNSTNSF (TYRP1_HUMAN)
FSSNSTNSM

SEQ ID NO: 174065 - protein, 11 aa, Artificial Sequence
  Description of Artificial Sequence: Synthetic peptide
  Seed: FWPPVTNTEMF (TYRP1_HUMAN)
FGPPVTNTEMY

SEQ ID NO: 174066 - protein, 10 aa, Artificial Sequence
  Description of Artificial Sequence: Synthetic peptide
  Seed: AFLTWHRYHL (TYRP1_HUMAN)
AMLTWHRYHI

SEQ ID NO: 174067 - protein, 10 aa, Artificial Sequence
  Description of Artificial Sequence: Synthetic peptide
  Seed: EGYSDPTGKY (TYRP1_HUMAN)
ELYSDPTGKK

SEQ ID NO: 174068 - protein, 11 aa, Artificial Sequence
  Description of Artificial Sequence: Synthetic peptide
  Seed: LISPNSVFSQW (TYRP1_HUMAN)
LCSPNSVFSQW

SEQ ID NO: 174069 - protein, 10 aa, Artificial Sequence
  Description of Artificial Sequence: Synthetic peptide
  Seed: LIFGTASYLI (TYRP1_HUMAN)
LAFGTASYLF

SEQ ID NO: 174070 - protein, 9 aa, Artificial Sequence
  Description of Artificial Sequence: Synthetic peptide
  Seed: LLVALIFGT (TYRP1_HUMAN)
LQVALIFGL

SEQ ID NO: 174071 - protein, 9 aa, Artificial Sequence
  Description of Artificial Sequence: Synthetic peptide
  Seed: REFSVPEII (TYRP1_HUMAN)
RRFSVPEIL

SEQ ID NO: 174072 - protein, 9 aa, Artificial Sequence
  Description of Artificial Sequence: Synthetic peptide
  Seed: VARPMVQRL (TYRP1_HUMAN)
VSRPMVQRW

SEQ ID NO: 174073 - protein, 10 aa, Artificial Sequence
  Description of Artificial Sequence: Synthetic peptide
  Seed: YNMVPFWPPV (TYRP1_HUMAN)
YGMVPFWPPL

SEQ ID NO: 174074 - protein, 9 aa, Artificial Sequence
  Description of Artificial Sequence: Synthetic peptide
  Seed: LTWHRYHLL (TYRP1_HUMAN)
LLWHRYHLY

SEQ ID NO: 174075 - protein, 9 aa, Artificial Sequence
  Description of Artificial Sequence: Synthetic peptide
  Seed: HLSPNDPIF (TYRP1_HUMAN)
HKSPNDPIY

SEQ ID NO: 174076 - protein, 10 aa, Artificial Sequence
  Description of Artificial Sequence: Synthetic peptide
  Seed: VDFSHEGPAF (TYRP1_HUMAN)
VAFSHEGPAF

SEQ ID NO: 174077 - protein, 9 aa, Artificial Sequence
  Description of Artificial Sequence: Synthetic peptide
  Seed: LIFGTASYL (TYRP1_HUMAN)
LVFGTASYF

SEQ ID NO: 174078 - protein, 11 aa, Artificial Sequence
  Description of Artificial Sequence: Synthetic peptide
  Seed: IYNYFVWTHYY (TYRP1_HUMAN)
IFNYFVWTHYL

SEQ ID NO: 174079 - protein, 9 aa, Artificial Sequence
  Description of Artificial Sequence: Synthetic peptide
  Seed: ISIYNYFVW (TYRP1_HUMAN)
ITIYNYFVW

SEQ ID NO: 174080 - protein, 9 aa, Artificial Sequence
  Description of Artificial Sequence: Synthetic peptide
  Seed: QEPSFSLPY (TYRP1_HUMAN)
QQPSFSLPF

SEQ ID NO: 174081 - protein, 11 aa, Artificial Sequence
  Description of Artificial Sequence: Synthetic peptide
  Seed: MGSRSNFDSTL (TYRP1_HUMAN)
MRSRSNFDSTL

SEQ ID NO: 174082 - protein, 9 aa, Artificial Sequence
  Description of Artificial Sequence: Synthetic peptide
  Seed: SVPEIIAIA (TYRP1_HUMAN)
SLPEIIAII

SEQ ID NO: 174083 - protein, 9 aa, Artificial Sequence
  Description of Artificial Sequence: Synthetic peptide
  Seed: ACDQRVLIV (TYRP1_HUMAN)
ATDQRVLII

SEQ ID NO: 174084 - protein, 10 aa, Artificial Sequence
  Description of Artificial Sequence: Synthetic peptide
  Seed: FSVPEIIAIA (TYRP1_HUMAN)
FIVPEIIAIM

SEQ ID NO: 174085 - protein, 10 aa, Artificial Sequence
  Description of Artificial Sequence: Synthetic peptide
  Seed: TAPDNLGYTY (TYRP1_HUMAN)
TLPDNLGYTY

SEQ ID NO: 174086 - protein, 9 aa, Artificial Sequence
  Description of Artificial Sequence: Synthetic peptide
  Seed: IAIAVVGAL (TYRP1_HUMAN)
ITIAVVGAL

SEQ ID NO: 174087 - protein, 10 aa, Artificial Sequence
  Description of Artificial Sequence: Synthetic peptide
  Seed: VGLFDTPPFY (TYRP1_HUMAN)
VWLFDTPPFY

SEQ ID NO: 174088 - protein, 10 aa, Artificial Sequence
  Description of Artificial Sequence: Synthetic peptide
  Seed: YNADISTFPL (TYRP1_HUMAN)
YGADISTFPM

SEQ ID NO: 174089 - protein, 9 aa, Artificial Sequence
  Description of Artificial Sequence: Synthetic peptide
  Seed: MLQEPSFSL (TYRP1_HUMAN)
MRQEPSFSF

SEQ ID NO: 174090 - protein, 9 aa, Artificial Sequence
  Description of Artificial Sequence: Synthetic peptide
  Seed: RVLIVRRNL (TYRP1_HUMAN)
RVLIVRRNF

SEQ ID NO: 174091 - protein, 10 aa, Artificial Sequence
  Description of Artificial Sequence: Synthetic peptide
  Seed: RRYNADISTF (TYRP1_HUMAN)
RKYNADISTW

SEQ ID NO: 174092 - protein, 9 aa, Artificial Sequence
  Description of Artificial Sequence: Synthetic peptide
  Seed: RSLHNLAHL (TYRP1_HUMAN)
RMLHNLAHF

SEQ ID NO: 174093 - protein, 10 aa, Artificial Sequence
  Description of Artificial Sequence: Synthetic peptide
  Seed: FWPPVTNTEM (TYRP1_HUMAN)
FRPPVTNTEF

SEQ ID NO: 174094 - protein, 11 aa, Artificial Sequence
  Description of Artificial Sequence: Synthetic peptide
  Seed: FPLLLFQQARA (TYRP1_HUMAN)
FWLLLFQQARV

SEQ ID NO: 174095 - protein, 10 aa, Artificial Sequence
  Description of Artificial Sequence: Synthetic peptide
  Seed: LGPDGNTPQF (TYRP1_HUMAN)
LIPDGNTPQM

SEQ ID NO: 174096 - protein, 9 aa, Artificial Sequence
  Description of Artificial Sequence: Synthetic peptide
  Seed: YLIRARRSM (TYRP1_HUMAN)
YAIRARRSY

SEQ ID NO: 174097 - protein, 9 aa, Artificial Sequence
  Description of Artificial Sequence: Synthetic peptide
  Seed: IAIAVVGAL (TYRP1_HUMAN)
IPIAVVGAP

SEQ ID NO: 174098 - protein, 11 aa, Artificial Sequence
  Description of Artificial Sequence: Synthetic peptide
  Seed: RSMDEANQPLL (TYRP1_HUMAN)
RLMDEANQPLF

SEQ ID NO: 174099 - protein, 10 aa, Artificial Sequence
  Description of Artificial Sequence: Synthetic peptide
  Seed: ADSRPHSPQY (TYRP1_HUMAN)
AASRPHSPQV

SEQ ID NO: 174100 - protein, 10 aa, Artificial Sequence
  Description of Artificial Sequence: Synthetic peptide
  Seed: LGPDGNTPQF (TYRP1_HUMAN)
LNPDGNTPQY

SEQ ID NO: 174101 - protein, 9 aa, Artificial Sequence
  Description of Artificial Sequence: Synthetic peptide
  Seed: FVWTHYYSV (TYRP1_HUMAN)
FMWTHYYSF

SEQ ID NO: 174102 - protein, 9 aa, Artificial Sequence
  Description of Artificial Sequence: Synthetic peptide
  Seed: HEGPAFLTW (TYRP1_HUMAN)
HHGPAFLTW

SEQ ID NO: 174103 - protein, 9 aa, Artificial Sequence
  Description of Artificial Sequence: Synthetic peptide
  Seed: IYNYFVWTH (TYRP1_HUMAN)
IFNYFVWTK

SEQ ID NO: 174104 - protein, 9 aa, Artificial Sequence
  Description of Artificial Sequence: Synthetic peptide
  Seed: SVKKTFLGV (TYRP1_HUMAN)
STKKTFLGK

SEQ ID NO: 174105 - protein, 10 aa, Artificial Sequence
  Description of Artificial Sequence: Synthetic peptide
  Seed: SHEGPAFLTW (TYRP1_HUMAN)
SSEGPAFLTW

SEQ ID NO: 174106 - protein, 9 aa, Artificial Sequence
  Description of Artificial Sequence: Synthetic peptide
  Seed: SPNDPIFVL (TYRP1_HUMAN)
SHNDPIFVY

SEQ ID NO: 174107 - protein, 9 aa, Artificial Sequence
  Description of Artificial Sequence: Synthetic peptide
  Seed: KLLSLGCIF (TYRP1_HUMAN)
KQLSLGCIV

SEQ ID NO: 174108 - protein, 10 aa, Artificial Sequence
  Description of Artificial Sequence: Synthetic peptide
  Seed: NYFVWTHYYS (TYRP1_HUMAN)
NFFVWTHYYT

SEQ ID NO: 174109 - protein, 9 aa, Artificial Sequence
  Description of Artificial Sequence: Synthetic peptide
  Seed: HEGPAFLTW (TYRP1_HUMAN)
HRGPAFLTL

SEQ ID NO: 174110 - protein, 8 aa, Artificial Sequence
  Description of Artificial Sequence: Synthetic peptide
  Seed: RQYNMVPF (TYRP1_HUMAN)
RQYNMVPI

SEQ ID NO: 174111 - protein, 9 aa, Artificial Sequence
  Description of Artificial Sequence: Synthetic peptide
  Seed: LTDQYQCYA (TYRP1_HUMAN)
LTDQYQCYY

SEQ ID NO: 174112 - protein, 9 aa, Artificial Sequence
  Description of Artificial Sequence: Synthetic peptide
  Seed: IYNYFVWTH (TYRP1_HUMAN)
IYNYFVWTM

SEQ ID NO: 174113 - protein, 10 aa, Artificial Sequence
  Description of Artificial Sequence: Synthetic peptide
  Seed: VGLFDTPPFY (TYRP1_HUMAN)
VFLFDTPPFY

SEQ ID NO: 174114 - protein, 9 aa, Artificial Sequence
  Description of Artificial Sequence: Synthetic peptide
  Seed: ISIYNYFVW (TYRP1_HUMAN)
IGIYNYFVF

SEQ ID NO: 174115 - protein, 9 aa, Artificial Sequence
  Description of Artificial Sequence: Synthetic peptide
  Seed: YTYEIQWPS (TYRP1_HUMAN)
YLYEIQWPN

SEQ ID NO: 174116 - protein, 9 aa, Artificial Sequence
  Description of Artificial Sequence: Synthetic peptide
  Seed: RQYNMVPFW (TYRP1_HUMAN)
RLYNMVPFW

SEQ ID NO: 174117 - protein, 9 aa, Artificial Sequence
  Description of Artificial Sequence: Synthetic peptide
  Seed: HLSPNDPIF (TYRP1_HUMAN)
HYSPNDPIY

SEQ ID NO: 174118 - protein, 11 aa, Artificial Sequence
  Description of Artificial Sequence: Synthetic peptide
  Seed: LSPNDPIFVLL (TYRP1_HUMAN)
LTPNDPIFVLW

SEQ ID NO: 174119 - protein, 9 aa, Artificial Sequence
  Description of Artificial Sequence: Synthetic peptide
  Seed: ALIFGTASY (TYRP1_HUMAN)
AFIFGTASM

SEQ ID NO: 174120 - protein, 9 aa, Artificial Sequence
  Description of Artificial Sequence: Synthetic peptide
  Seed: REFSVPEII (TYRP1_HUMAN)
RSFSVPEIV

SEQ ID NO: 174121 - protein, 9 aa, Artificial Sequence
  Description of Artificial Sequence: Synthetic peptide
  Seed: FTDAVFDEW (TYRP1_HUMAN)
FIDAVFDEL

SEQ ID NO: 174122 - protein, 10 aa, Artificial Sequence
  Description of Artificial Sequence: Synthetic peptide
  Seed: YNYFVWTHYY (TYRP1_HUMAN)
YMYFVWTHYS

SEQ ID NO: 174123 - protein, 8 aa, Artificial Sequence
  Description of Artificial Sequence: Synthetic peptide
  Seed: LFDTPPFY (TYRP1_HUMAN)
LFDTPPFV

SEQ ID NO: 174124 - protein, 9 aa, Artificial Sequence
  Description of Artificial Sequence: Synthetic peptide
  Seed: MLQEPSFSL (TYRP1_HUMAN)
MLQEPSFSW

SEQ ID NO: 174125 - protein, 9 aa, Artificial Sequence
  Description of Artificial Sequence: Synthetic peptide
  Seed: HYYSVKKTF (TYRP1_HUMAN)
HHYSVKKTF

SEQ ID NO: 174126 - protein, 9 aa, Artificial Sequence
  Description of Artificial Sequence: Synthetic peptide
  Seed: FVWTHYYSV (TYRP1_HUMAN)
FLWTHYYSK

SEQ ID NO: 174127 - protein, 9 aa, Artificial Sequence
  Description of Artificial Sequence: Synthetic peptide
  Seed: RVLIVRRNL (TYRP1_HUMAN)
RSLIVRRNK

SEQ ID NO: 174128 - protein, 9 aa, Artificial Sequence
  Description of Artificial Sequence: Synthetic peptide
  Seed: FSVPEIIAI (TYRP1_HUMAN)
FNVPEIIAM

SEQ ID NO: 174129 - protein, 10 aa, Artificial Sequence
  Description of Artificial Sequence: Synthetic peptide
  Seed: TAPDNLGYTY (TYRP1_HUMAN)
TYPDNLGYTL

SEQ ID NO: 174130 - protein, 9 aa, Artificial Sequence
  Description of Artificial Sequence: Synthetic peptide
  Seed: QCYAEEYEK (TYRP1_HUMAN)
QTYAEEYER

SEQ ID NO: 174131 - protein, 11 aa, Artificial Sequence
  Description of Artificial Sequence: Synthetic peptide
  Seed: FWPPVTNTEMF (TYRP1_HUMAN)
FLPPVTNTEMY

SEQ ID NO: 174132 - protein, 10 aa, Artificial Sequence
  Description of Artificial Sequence: Synthetic peptide
  Seed: FVTAPDNLGY (TYRP1_HUMAN)
FYTAPDNLGY

SEQ ID NO: 174133 - protein, 11 aa, Artificial Sequence
  Description of Artificial Sequence: Synthetic peptide
  Seed: EILGPDGNTPQ (TYRP1_HUMAN)
EILGPDGNTPK

SEQ ID NO: 174134 - protein, 8 aa, Artificial Sequence
  Description of Artificial Sequence: Synthetic peptide
  Seed: YSDPTGKY (TYRP1_HUMAN)
YTDPTGKF

SEQ ID NO: 174135 - protein, 10 aa, Artificial Sequence
  Description of Artificial Sequence: Synthetic peptide
  Seed: EVWPLRFFNR (TYRP1_HUMAN)
ESWPLRFFNR

SEQ ID NO: 174136 - protein, 9 aa, Artificial Sequence
  Description of Artificial Sequence: Synthetic peptide
  Seed: YTYEIQWPS (TYRP1_HUMAN)
YAYEIQWPR

SEQ ID NO: 174137 - protein, 11 aa, Artificial Sequence
  Description of Artificial Sequence: Synthetic peptide
  Seed: SIYNYFVWTHY (TYRP1_HUMAN)
SMYNYFVWTHY

SEQ ID NO: 174138 - protein, 9 aa, Artificial Sequence
  Description of Artificial Sequence: Synthetic peptide
  Seed: YLIRARRSM (TYRP1_HUMAN)
YIIRARRSY

SEQ ID NO: 174139 - protein, 10 aa, Artificial Sequence
  Description of Artificial Sequence: Synthetic peptide
  Seed: STFPLENAPI (TYRP1_HUMAN)
SIFPLENAPI

SEQ ID NO: 174140 - protein, 9 aa, Artificial Sequence
  Description of Artificial Sequence: Synthetic peptide
  Seed: VARPMVQRL (TYRP1_HUMAN)
VTRPMVQRY

SEQ ID NO: 174141 - protein, 9 aa, Artificial Sequence
  Description of Artificial Sequence: Synthetic peptide
  Seed: SIYNYFVWT (TYRP1_HUMAN)
SLYNYFVWC

SEQ ID NO: 174142 - protein, 10 aa, Artificial Sequence
  Description of Artificial Sequence: Synthetic peptide
  Seed: YTYEIQWPSR (TYRP1_HUMAN)
YTYEIQWPSY

SEQ ID NO: 174143 - protein, 9 aa, Artificial Sequence
  Description of Artificial Sequence: Synthetic peptide
  Seed: MSAPKLLSL (TYRP1_HUMAN)
MSAPKLLSR

SEQ ID NO: 174144 - protein, 9 aa, Artificial Sequence
  Description of Artificial Sequence: Synthetic peptide
  Seed: RSLHNLAHL (TYRP1_HUMAN)
RTLHNLAHR

SEQ ID NO: 174145 - protein, 9 aa, Artificial Sequence
  Description of Artificial Sequence: Synthetic peptide
  Seed: YTYEIQWPS (TYRP1_HUMAN)
YWYEIQWPV

SEQ ID NO: 174146 - protein, 11 aa, Artificial Sequence
  Description of Artificial Sequence: Synthetic peptide
  Seed: IYNYFVWTHYY (TYRP1_HUMAN)
IRNYFVWTHYF

SEQ ID NO: 174147 - protein, 10 aa, Artificial Sequence
  Description of Artificial Sequence: Synthetic peptide
  Seed: TFLGVGQESF (TYRP1_HUMAN)
TFLGVGQESY

SEQ ID NO: 174148 - protein, 9 aa, Artificial Sequence
  Description of Artificial Sequence: Synthetic peptide
  Seed: SIYNYFVWT (TYRP1_HUMAN)
SLYNYFVWT

SEQ ID NO: 174149 - protein, 8 aa, Artificial Sequence
  Description of Artificial Sequence: Synthetic peptide
  Seed: RPGWRGAA (TYRP1_HUMAN)
RPGWRGAM

SEQ ID NO: 174150 - protein, 9 aa, Artificial Sequence
  Description of Artificial Sequence: Synthetic peptide
  Seed: SVKKTFLGV (TYRP1_HUMAN)
SSKKTFLGF

SEQ ID NO: 174151 - protein, 9 aa, Artificial Sequence
  Description of Artificial Sequence: Synthetic peptide
  Seed: REFSVPEII (TYRP1_HUMAN)
RSFSVPEIF

SEQ ID NO: 174152 - protein, 10 aa, Artificial Sequence
  Description of Artificial Sequence: Synthetic peptide
  Seed: ENISIYNYFV (TYRP1_HUMAN)
EEISIYNYFV

SEQ ID NO: 174153 - protein, 9 aa, Artificial Sequence
  Description of Artificial Sequence: Synthetic peptide
  Seed: SLHNLAHLF (TYRP1_HUMAN)
SMHNLAHLR

SEQ ID NO: 174154 - protein, 9 aa, Artificial Sequence
  Description of Artificial Sequence: Synthetic peptide
  Seed: HPLFVIATR (TYRP1_HUMAN)
HMLFVIATR

SEQ ID NO: 174155 - protein, 10 aa, Artificial Sequence
  Description of Artificial Sequence: Synthetic peptide
  Seed: RTTHPLFVIA (TYRP1_HUMAN)
RPTHPLFVIA

SEQ ID NO: 174156 - protein, 10 aa, Artificial Sequence
  Description of Artificial Sequence: Synthetic peptide
  Seed: QCYAEEYEKL (TYRP1_HUMAN)
QEYAEEYEKF

SEQ ID NO: 174157 - protein, 10 aa, Artificial Sequence
  Description of Artificial Sequence: Synthetic peptide
  Seed: YNYFVWTHYY (TYRP1_HUMAN)
YHYFVWTHYF

SEQ ID NO: 174158 - protein, 9 aa, Artificial Sequence
  Description of Artificial Sequence: Synthetic peptide
  Seed: FVWTHYYSV (TYRP1_HUMAN)
FTWTHYYSV

SEQ ID NO: 174159 - protein, 9 aa, Artificial Sequence
  Description of Artificial Sequence: Synthetic peptide
  Seed: QEPSFSLPY (TYRP1_HUMAN)
QQPSFSLPM

SEQ ID NO: 174160 - protein, 9 aa, Artificial Sequence
  Description of Artificial Sequence: Synthetic peptide
  Seed: YNYFVWTHY (TYRP1_HUMAN)
YSYFVWTHY

SEQ ID NO: 174161 - protein, 8 aa, Artificial Sequence
  Description of Artificial Sequence: Synthetic peptide
  Seed: RQYNMVPF (TYRP1_HUMAN)
RHYNMVPY

SEQ ID NO: 174162 - protein, 10 aa, Artificial Sequence
  Description of Artificial Sequence: Synthetic peptide
  Seed: YNADISTFPL (TYRP1_HUMAN)
YQADISTFPT

SEQ ID NO: 174163 - protein, 10 aa, Artificial Sequence
  Description of Artificial Sequence: Synthetic peptide
  Seed: YFVWTHYYSV (TYRP1_HUMAN)
YQVWTHYYSI

SEQ ID NO: 174164 - protein, 9 aa, Artificial Sequence
  Description of Artificial Sequence: Synthetic peptide
  Seed: FSLPYWNFA (TYRP1_HUMAN)
FQLPYWNFC

SEQ ID NO: 174165 - protein, 10 aa, Artificial Sequence
  Description of Artificial Sequence: Synthetic peptide
  Seed: ISIYNYFVWT (TYRP1_HUMAN)
IAIYNYFVWW

SEQ ID NO: 174166 - protein, 9 aa, Artificial Sequence
  Description of Artificial Sequence: Synthetic peptide
  Seed: SLHNLAHLF (TYRP1_HUMAN)
SVHNLAHLK

SEQ ID NO: 174167 - protein, 11 aa, Artificial Sequence
  Description of Artificial Sequence: Synthetic peptide
  Seed: KEEKNHFVRAL (TYRP1_HUMAN)
KEEKNHFVRAW

SEQ ID NO: 174168 - protein, 10 aa, Artificial Sequence
  Description of Artificial Sequence: Synthetic peptide
  Seed: FSLPYWNFAT (TYRP1_HUMAN)
FCLPYWNFAA

SEQ ID NO: 174169 - protein, 9 aa, Artificial Sequence
  Description of Artificial Sequence: Synthetic peptide
  Seed: YLIRARRSM (TYRP1_HUMAN)
YAIRARRSI

SEQ ID NO: 174170 - protein, 9 aa, Artificial Sequence
  Description of Artificial Sequence: Synthetic peptide
  Seed: AVRSLHNLA (TYRP1_HUMAN)
ASRSLHNLV

SEQ ID NO: 174171 - protein, 9 aa, Artificial Sequence
  Description of Artificial Sequence: Synthetic peptide
  Seed: HYYSVKKTF (TYRP1_HUMAN)
HEYSVKKTF

SEQ ID NO: 174172 - protein, 10 aa, Artificial Sequence
  Description of Artificial Sequence: Synthetic peptide
  Seed: YNMVPFWPPV (TYRP1_HUMAN)
YCMVPFWPPL

SEQ ID NO: 174173 - protein, 9 aa, Artificial Sequence
  Description of Artificial Sequence: Synthetic peptide
  Seed: TLISPNSVF (TYRP1_HUMAN)
TTISPNSVM

SEQ ID NO: 174174 - protein, 10 aa, Artificial Sequence
  Description of Artificial Sequence: Synthetic peptide
  Seed: ISPNSVFSQW (TYRP1_HUMAN)
IFPNSVFSQW

SEQ ID NO: 174175 - protein, 9 aa, Artificial Sequence
  Description of Artificial Sequence: Synthetic peptide
  Seed: SPNSVFSQW (TYRP1_HUMAN)
SPNSVFSQV

SEQ ID NO: 174176 - protein, 10 aa, Artificial Sequence
  Description of Artificial Sequence: Synthetic peptide
  Seed: YNMVPFWPPV (TYRP1_HUMAN)
YWMVPFWPPL

SEQ ID NO: 174177 - protein, 9 aa, Artificial Sequence
  Description of Artificial Sequence: Synthetic peptide
  Seed: FSVPEIIAI (TYRP1_HUMAN)
FLVPEIIAC

SEQ ID NO: 174178 - protein, 11 aa, Artificial Sequence
  Description of Artificial Sequence: Synthetic peptide
  Seed: FVLLHTFTDAV (TYRP1_HUMAN)
FDLLHTFTDAV

SEQ ID NO: 174179 - protein, 10 aa, Artificial Sequence
  Description of Artificial Sequence: Synthetic peptide
  Seed: STFPLENAPI (TYRP1_HUMAN)
STFPLENAPA

SEQ ID NO: 174180 - protein, 9 aa, Artificial Sequence
  Description of Artificial Sequence: Synthetic peptide
  Seed: FLTWHRYHL (TYRP1_HUMAN)
FLTWHRYHA

SEQ ID NO: 174181 - protein, 10 aa, Artificial Sequence
  Description of Artificial Sequence: Synthetic peptide
  Seed: LSPNDPIFVL (TYRP1_HUMAN)
LQPNDPIFVF

SEQ ID NO: 174182 - protein, 9 aa, Artificial Sequence
  Description of Artificial Sequence: Synthetic peptide
  Seed: DLMGSRSNF (TYRP1_HUMAN)
DVMGSRSNR

SEQ ID NO: 174183 - protein, 11 aa, Artificial Sequence
  Description of Artificial Sequence: Synthetic peptide
  Seed: REFSVPEIIAI (TYRP1_HUMAN)
REFSVPEIIAM

SEQ ID NO: 174184 - protein, 10 aa, Artificial Sequence
  Description of Artificial Sequence: Synthetic peptide
  Seed: RSMDEANQPL (TYRP1_HUMAN)
RGMDEANQPL

SEQ ID NO: 174185 - protein, 9 aa, Artificial Sequence
  Description of Artificial Sequence: Synthetic peptide
  Seed: SLHNLAHLF (TYRP1_HUMAN)
STHNLAHLK

SEQ ID NO: 174186 - protein, 11 aa, Artificial Sequence
  Description of Artificial Sequence: Synthetic peptide
  Seed: MLQEPSFSLPY (TYRP1_HUMAN)
MMQEPSFSLPV

SEQ ID NO: 174187 - protein, 10 aa, Artificial Sequence
  Description of Artificial Sequence: Synthetic peptide
  Seed: MVPFWPPVTN (TYRP1_HUMAN)
MWPFWPPVTL

SEQ ID NO: 174188 - protein, 9 aa, Artificial Sequence
  Description of Artificial Sequence: Synthetic peptide
  Seed: AQFPRQCAT (TYRP1_HUMAN)
AVFPRQCAM

SEQ ID NO: 174189 - protein, 9 aa, Artificial Sequence
  Description of Artificial Sequence: Synthetic peptide
  Seed: RAQFPRQCA (TYRP1_HUMAN)
RTQFPRQCK

SEQ ID NO: 174190 - protein, 9 aa, Artificial Sequence
  Description of Artificial Sequence: Synthetic peptide
  Seed: FLTWHRYHL (TYRP1_HUMAN)
FPTWHRYHA

SEQ ID NO: 174191 - protein, 10 aa, Artificial Sequence
  Description of Artificial Sequence: Synthetic peptide
  Seed: KLLSLGCIFF (TYRP1_HUMAN)
KFLSLGCIFF

SEQ ID NO: 174192 - protein, 9 aa, Artificial Sequence
  Description of Artificial Sequence: Synthetic peptide
  Seed: ARAQFPRQC (TYRP1_HUMAN)
ARAQFPRQL

SEQ ID NO: 174193 - protein, 9 aa, Artificial Sequence
  Description of Artificial Sequence: Synthetic peptide
  Seed: QEMLQEPSF (TYRP1_HUMAN)
QEMLQEPSY

SEQ ID NO: 174194 - protein, 11 aa, Artificial Sequence
  Description of Artificial Sequence: Synthetic peptide
  Seed: RRYNADISTFP (TYRP1_HUMAN)
RIYNADISTFF

SEQ ID NO: 174195 - protein, 9 aa, Artificial Sequence
  Description of Artificial Sequence: Synthetic peptide
  Seed: STNSFRNTV (TYRP1_HUMAN)
STNSFRNTY

SEQ ID NO: 174196 - protein, 9 aa, Artificial Sequence
  Description of Artificial Sequence: Synthetic peptide
  Seed: APIGHNRQY (TYRP1_HUMAN)
APIGHNRQV

SEQ ID NO: 174197 - protein, 9 aa, Artificial Sequence
  Description of Artificial Sequence: Synthetic peptide
  Seed: REFSVPEII (TYRP1_HUMAN)
RIFSVPEIM

SEQ ID NO: 174198 - protein, 9 aa, Artificial Sequence
  Description of Artificial Sequence: Synthetic peptide
  Seed: RRNPAGNVA (TYRP1_HUMAN)
RYNPAGNVL

SEQ ID NO: 174199 - protein, 9 aa, Artificial Sequence
  Description of Artificial Sequence: Synthetic peptide
  Seed: MSAPKLLSL (TYRP1_HUMAN)
MYAPKLLSK

SEQ ID NO: 174200 - protein, 9 aa, Artificial Sequence
  Description of Artificial Sequence: Synthetic peptide
  Seed: SLHNLAHLF (TYRP1_HUMAN)
SRHNLAHLF

SEQ ID NO: 174201 - protein, 9 aa, Artificial Sequence
  Description of Artificial Sequence: Synthetic peptide
  Seed: HEGPAFLTW (TYRP1_HUMAN)
HQGPAFLTW

SEQ ID NO: 174202 - protein, 9 aa, Artificial Sequence
  Description of Artificial Sequence: Synthetic peptide
  Seed: MSAPKLLSL (TYRP1_HUMAN)
MSAPKLLSV

SEQ ID NO: 174203 - protein, 10 aa, Artificial Sequence
  Description of Artificial Sequence: Synthetic peptide
  Seed: RYNADISTFP (TYRP1_HUMAN)
RYNADISTFM

SEQ ID NO: 174204 - protein, 9 aa, Artificial Sequence
  Description of Artificial Sequence: Synthetic peptide
  Seed: KYDPAVRSL (TYRP1_HUMAN)
KEDPAVRSY

SEQ ID NO: 174205 - protein, 9 aa, Artificial Sequence
  Description of Artificial Sequence: Synthetic peptide
  Seed: SVKKTFLGV (TYRP1_HUMAN)
STKKTFLGR

SEQ ID NO: 174206 - protein, 10 aa, Artificial Sequence
  Description of Artificial Sequence: Synthetic peptide
  Seed: YNMVPFWPPV (TYRP1_HUMAN)
YQMVPFWPPL

SEQ ID NO: 174207 - protein, 9 aa, Artificial Sequence
  Description of Artificial Sequence: Synthetic peptide
  Seed: WPPVTNTEM (TYRP1_HUMAN)
WAPVTNTEM

SEQ ID NO: 174208 - protein, 9 aa, Artificial Sequence
  Description of Artificial Sequence: Synthetic peptide
  Seed: RRNLLDLSK (TYRP1_HUMAN)
RRNLLDLSA

SEQ ID NO: 174209 - protein, 9 aa, Artificial Sequence
  Description of Artificial Sequence: Synthetic peptide
  Seed: SVFSQWRVV (TYRP1_HUMAN)
SMFSQWRVL

SEQ ID NO: 174210 - protein, 9 aa, Artificial Sequence
  Description of Artificial Sequence: Synthetic peptide
  Seed: LPYWNFATG (TYRP1_HUMAN)
LPYWNFATH

SEQ ID NO: 174211 - protein, 9 aa, Artificial Sequence
  Description of Artificial Sequence: Synthetic peptide
  Seed: VVCDSLEDY (TYRP1_HUMAN)
VPCDSLEDY

SEQ ID NO: 174212 - protein, 9 aa, Artificial Sequence
  Description of Artificial Sequence: Synthetic peptide
  Seed: QYQCYAEEY (TYRP1_HUMAN)
QWQCYAEEF

SEQ ID NO: 174213 - protein, 9 aa, Artificial Sequence
  Description of Artificial Sequence: Synthetic peptide
  Seed: SVPEIIAIA (TYRP1_HUMAN)
SMPEIIAIA

SEQ ID NO: 174214 - protein, 10 aa, Artificial Sequence
  Description of Artificial Sequence: Synthetic peptide
  Seed: LIFGTASYLI (TYRP1_HUMAN)
LTFGTASYLA

SEQ ID NO: 174215 - protein, 9 aa, Artificial Sequence
  Description of Artificial Sequence: Synthetic peptide
  Seed: FPRQCATVE (TYRP1_HUMAN)
FIRQCATVL

SEQ ID NO: 174216 - protein, 10 aa, Artificial Sequence
  Description of Artificial Sequence: Synthetic peptide
  Seed: LSPNDPIFVL (TYRP1_HUMAN)
LGPNDPIFVY

SEQ ID NO: 174217 - protein, 9 aa, Artificial Sequence
  Description of Artificial Sequence: Synthetic peptide
  Seed: GPAFLTWHR (TYRP1_HUMAN)
GVAFLTWHK

SEQ ID NO: 174218 - protein, 9 aa, Artificial Sequence
  Description of Artificial Sequence: Synthetic peptide
  Seed: YTYEIQWPS (TYRP1_HUMAN)
YQYEIQWPM

SEQ ID NO: 174219 - protein, 9 aa, Artificial Sequence
  Description of Artificial Sequence: Synthetic peptide
  Seed: YTYEIQWPS (TYRP1_HUMAN)
YAYEIQWPS

SEQ ID NO: 174220 - protein, 10 aa, Artificial Sequence
  Description of Artificial Sequence: Synthetic peptide
  Seed: LLVALIFGTA (TYRP1_HUMAN)
LIVALIFGTV

SEQ ID NO: 174221 - protein, 10 aa, Artificial Sequence
  Description of Artificial Sequence: Synthetic peptide
  Seed: YNMVPFWPPV (TYRP1_HUMAN)
YFMVPFWPPA

SEQ ID NO: 174222 - protein, 10 aa, Artificial Sequence
  Description of Artificial Sequence: Synthetic peptide
  Seed: AVFDEWLRRY (TYRP1_HUMAN)
AVFDEWLRRW

SEQ ID NO: 174223 - protein, 9 aa, Artificial Sequence
  Description of Artificial Sequence: Synthetic peptide
  Seed: IAIAVVGAL (TYRP1_HUMAN)
IYIAVVGAY

SEQ ID NO: 174224 - protein, 11 aa, Artificial Sequence
  Description of Artificial Sequence: Synthetic peptide
  Seed: YNYFVWTHYYS (TYRP1_HUMAN)
YQYFVWTHYYY

SEQ ID NO: 174225 - protein, 8 aa, Artificial Sequence
  Description of Artificial Sequence: Synthetic peptide
  Seed: YSDPTGKY (TYRP1_HUMAN)
YADPTGKF

SEQ ID NO: 174226 - protein, 9 aa, Artificial Sequence
  Description of Artificial Sequence: Synthetic peptide
  Seed: RQCATVEAL (TYRP1_HUMAN)
RECATVEAI

SEQ ID NO: 174227 - protein, 9 aa, Artificial Sequence
  Description of Artificial Sequence: Synthetic peptide
  Seed: EEKNHFVRA (TYRP1_HUMAN)
EEKNHFVRI

SEQ ID NO: 174228 - protein, 9 aa, Artificial Sequence
  Description of Artificial Sequence: Synthetic peptide
  Seed: RQYNMVPFW (TYRP1_HUMAN)
RQYNMVPFI

SEQ ID NO: 174229 - protein, 9 aa, Artificial Sequence
  Description of Artificial Sequence: Synthetic peptide
  Seed: RYHLLRLEK (TYRP1_HUMAN)
RSHLLRLEI

SEQ ID NO: 174230 - protein, 10 aa, Artificial Sequence
  Description of Artificial Sequence: Synthetic peptide
  Seed: ADSRPHSPQY (TYRP1_HUMAN)
ATSRPHSPQF

SEQ ID NO: 174231 - protein, 9 aa, Artificial Sequence
  Description of Artificial Sequence: Synthetic peptide
  Seed: QEPSFSLPY (TYRP1_HUMAN)
QWPSFSLPY

SEQ ID NO: 174232 - protein, 10 aa, Artificial Sequence
  Description of Artificial Sequence: Synthetic peptide
  Seed: VALIFGTASY (TYRP1_HUMAN)
VELIFGTASF

SEQ ID NO: 174233 - protein, 9 aa, Artificial Sequence
  Description of Artificial Sequence: Synthetic peptide
  Seed: RQCATVEAL (TYRP1_HUMAN)
RECATVEAL

SEQ ID NO: 174234 - protein, 9 aa, Artificial Sequence
  Description of Artificial Sequence: Synthetic peptide
  Seed: MSAPKLLSL (TYRP1_HUMAN)
MMAPKLLSV

SEQ ID NO: 174235 - protein, 10 aa, Artificial Sequence
  Description of Artificial Sequence: Synthetic peptide
  Seed: LSPNDPIFVL (TYRP1_HUMAN)
LKPNDPIFVF

SEQ ID NO: 174236 - protein, 9 aa, Artificial Sequence
  Description of Artificial Sequence: Synthetic peptide
  Seed: AVVGALLLV (TYRP1_HUMAN)
ALVGALLLM

SEQ ID NO: 174237 - protein, 9 aa, Artificial Sequence
  Description of Artificial Sequence: Synthetic peptide
  Seed: ISIYNYFVW (TYRP1_HUMAN)
ISIYNYFVY

SEQ ID NO: 174238 - protein, 11 aa, Artificial Sequence
  Description of Artificial Sequence: Synthetic peptide
  Seed: YFVWTHYYSVK (TYRP1_HUMAN)
YIVWTHYYSVR

SEQ ID NO: 174239 - protein, 9 aa, Artificial Sequence
  Description of Artificial Sequence: Synthetic peptide
  Seed: RGAACDQRV (TYRP1_HUMAN)
RQAACDQRV

SEQ ID NO: 174240 - protein, 9 aa, Artificial Sequence
  Description of Artificial Sequence: Synthetic peptide
  Seed: STNSFRNTV (TYRP1_HUMAN)
SSNSFRNTY

SEQ ID NO: 174241 - protein, 11 aa, Artificial Sequence
  Description of Artificial Sequence: Synthetic peptide
  Seed: FSHEGPAFLTW (TYRP1_HUMAN)
FQHEGPAFLTL

SEQ ID NO: 174242 - protein, 11 aa, Artificial Sequence
  Description of Artificial Sequence: Synthetic peptide
  Seed: RSMDEANQPLL (TYRP1_HUMAN)
RQMDEANQPLM

SEQ ID NO: 174243 - protein, 9 aa, Artificial Sequence
  Description of Artificial Sequence: Synthetic peptide
  Seed: MAKRTTHPL (TYRP1_HUMAN)
MQKRTTHPY

SEQ ID NO: 174244 - protein, 10 aa, Artificial Sequence
  Description of Artificial Sequence: Synthetic peptide
  Seed: RSLHNLAHLF (TYRP1_HUMAN)
RYLHNLAHLW

SEQ ID NO: 174245 - protein, 9 aa, Artificial Sequence
  Description of Artificial Sequence: Synthetic peptide
  Seed: ISIYNYFVW (TYRP1_HUMAN)
ISIYNYFVL

SEQ ID NO: 174246 - protein, 8 aa, Artificial Sequence
  Description of Artificial Sequence: Synthetic peptide
  Seed: YSNSTNSF (TYRP1_HUMAN)
YYNSTNSM

SEQ ID NO: 174247 - protein, 9 aa, Artificial Sequence
  Description of Artificial Sequence: Synthetic peptide
  Seed: LQNPNQSVV (TYRP1_HUMAN)
LENPNQSVL

SEQ ID NO: 174248 - protein, 10 aa, Artificial Sequence
  Description of Artificial Sequence: Synthetic peptide
  Seed: VPFWPPVTNT (TYRP1_HUMAN)
VPFWPPVTNM

SEQ ID NO: 174249 - protein, 11 aa, Artificial Sequence
  Description of Artificial Sequence: Synthetic peptide
  Seed: REFSVPEIIAI (TYRP1_HUMAN)
REFSVPEIIAG

SEQ ID NO: 174250 - protein, 9 aa, Artificial Sequence
  Description of Artificial Sequence: Synthetic peptide
  Seed: LTWHRYHLL (TYRP1_HUMAN)
LSWHRYHLV

SEQ ID NO: 174251 - protein, 10 aa, Artificial Sequence
  Description of Artificial Sequence: Synthetic peptide
  Seed: YNYFVWTHYY (TYRP1_HUMAN)
YLYFVWTHYM

SEQ ID NO: 174252 - protein, 9 aa, Artificial Sequence
  Description of Artificial Sequence: Synthetic peptide
  Seed: QYQCYAEEY (TYRP1_HUMAN)
QMQCYAEEF

SEQ ID NO: 174253 - protein, 9 aa, Artificial Sequence
  Description of Artificial Sequence: Synthetic peptide
  Seed: RARRSMDEA (TYRP1_HUMAN)
RSRRSMDEK

SEQ ID NO: 174254 - protein, 9 aa, Artificial Sequence
  Description of Artificial Sequence: Synthetic peptide
  Seed: TAPDNLGYT (TYRP1_HUMAN)
TLPDNLGYM

SEQ ID NO: 174255 - protein, 9 aa, Artificial Sequence
  Description of Artificial Sequence: Synthetic peptide
  Seed: FSHEGPAFL (TYRP1_HUMAN)
FTHEGPAFL

SEQ ID NO: 174256 - protein, 9 aa, Artificial Sequence
  Description of Artificial Sequence: Synthetic peptide
  Seed: FPLENAPIG (TYRP1_HUMAN)
FTLENAPIF

SEQ ID NO: 174257 - protein, 9 aa, Artificial Sequence
  Description of Artificial Sequence: Synthetic peptide
  Seed: DLMGSRSNF (TYRP1_HUMAN)
DIMGSRSNR

SEQ ID NO: 174258 - protein, 9 aa, Artificial Sequence
  Description of Artificial Sequence: Synthetic peptide
  Seed: PIFVLLHTF (TYRP1_HUMAN)
PYFVLLHTI

SEQ ID NO: 174259 - protein, 9 aa, Artificial Sequence
  Description of Artificial Sequence: Synthetic peptide
  Seed: LGCIFFPLL (TYRP1_HUMAN)
LLCIFFPLV

SEQ ID NO: 174260 - protein, 9 aa, Artificial Sequence
  Description of Artificial Sequence: Synthetic peptide
  Seed: RQYNMVPFW (TYRP1_HUMAN)
RYYNMVPFL

SEQ ID NO: 174261 - protein, 10 aa, Artificial Sequence
  Description of Artificial Sequence: Synthetic peptide
  Seed: HYYSVKKTFL (TYRP1_HUMAN)
HFYSVKKTFF

SEQ ID NO: 174262 - protein, 11 aa, Artificial Sequence
  Description of Artificial Sequence: Synthetic peptide
  Seed: SIYNYFVWTHY (TYRP1_HUMAN)
SQYNYFVWTHM

SEQ ID NO: 174263 - protein, 9 aa, Artificial Sequence
  Description of Artificial Sequence: Synthetic peptide
  Seed: HPLFVIATR (TYRP1_HUMAN)
HYLFVIATR

SEQ ID NO: 174264 - protein, 9 aa, Artificial Sequence
  Description of Artificial Sequence: Synthetic peptide
  Seed: LIFGTASYL (TYRP1_HUMAN)
LLFGTASYY

SEQ ID NO: 174265 - protein, 9 aa, Artificial Sequence
  Description of Artificial Sequence: Synthetic peptide
  Seed: FSLPYWNFA (TYRP1_HUMAN)
FMLPYWNFS

SEQ ID NO: 174266 - protein, 10 aa, Artificial Sequence
  Description of Artificial Sequence: Synthetic peptide
  Seed: RSMDEANQPL (TYRP1_HUMAN)
RAMDEANQPV

SEQ ID NO: 174267 - protein, 9 aa, Artificial Sequence
  Description of Artificial Sequence: Synthetic peptide
  Seed: LPEPQDVAQ (TYRP1_HUMAN)
LAEPQDVAF

SEQ ID NO: 174268 - protein, 11 aa, Artificial Sequence
  Description of Artificial Sequence: Synthetic peptide
  Seed: VTAPDNLGYTY (TYRP1_HUMAN)
VGAPDNLGYTW

SEQ ID NO: 174269 - protein, 9 aa, Artificial Sequence
  Description of Artificial Sequence: Synthetic peptide
  Seed: NFDSTLISP (TYRP1_HUMAN)
NYDSTLISI

SEQ ID NO: 174270 - protein, 10 aa, Artificial Sequence
  Description of Artificial Sequence: Synthetic peptide
  Seed: SMDEANQPLL (TYRP1_HUMAN)
SVDEANQPLY

SEQ ID NO: 174271 - protein, 9 aa, Artificial Sequence
  Description of Artificial Sequence: Synthetic peptide
  Seed: FLGVGQESF (TYRP1_HUMAN)
FQGVGQESI

SEQ ID NO: 174272 - protein, 9 aa, Artificial Sequence
  Description of Artificial Sequence: Synthetic peptide
  Seed: MLQEPSFSL (TYRP1_HUMAN)
MTQEPSFSI

SEQ ID NO: 174273 - protein, 9 aa, Artificial Sequence
  Description of Artificial Sequence: Synthetic peptide
  Seed: GLFDTPPFY (TYRP1_HUMAN)
GLFDTPPFL

SEQ ID NO: 174274 - protein, 11 aa, Artificial Sequence
  Description of Artificial Sequence: Synthetic peptide
  Seed: REFSVPEIIAI (TYRP1_HUMAN)
RKFSVPEIIAF

SEQ ID NO: 174275 - protein, 9 aa, Artificial Sequence
  Description of Artificial Sequence: Synthetic peptide
  Seed: TEMFVTAPD (TYRP1_HUMAN)
TEMFVTAPT

SEQ ID NO: 174276 - protein, 9 aa, Artificial Sequence
  Description of Artificial Sequence: Synthetic peptide
  Seed: VARPMVQRL (TYRP1_HUMAN)
VRRPMVQRY

SEQ ID NO: 174277 - protein, 10 aa, Artificial Sequence
  Description of Artificial Sequence: Synthetic peptide
  Seed: FSLPYWNFAT (TYRP1_HUMAN)
FSLPYWNFAM

SEQ ID NO: 174278 - protein, 9 aa, Artificial Sequence
  Description of Artificial Sequence: Synthetic peptide
  Seed: SLGCIFFPL (TYRP1_HUMAN)
SMGCIFFPA

SEQ ID NO: 174279 - protein, 9 aa, Artificial Sequence
  Description of Artificial Sequence: Synthetic peptide
  Seed: APIGHNRQY (TYRP1_HUMAN)
AAIGHNRQV

SEQ ID NO: 174280 - protein, 10 aa, Artificial Sequence
  Description of Artificial Sequence: Synthetic peptide
  Seed: EMLQEPSFSL (TYRP1_HUMAN)
EFLQEPSFSM

SEQ ID NO: 174281 - protein, 10 aa, Artificial Sequence
  Description of Artificial Sequence: Synthetic peptide
  Seed: YNADISTFPL (TYRP1_HUMAN)
YSADISTFPT

SEQ ID NO: 174282 - protein, 9 aa, Artificial Sequence
  Description of Artificial Sequence: Synthetic peptide
  Seed: RARRSMDEA (TYRP1_HUMAN)
RMRRSMDEV

SEQ ID NO: 174283 - protein, 9 aa, Artificial Sequence
  Description of Artificial Sequence: Synthetic peptide
  Seed: RQYNMVPFW (TYRP1_HUMAN)
RQYNMVPFM

SEQ ID NO: 174284 - protein, 9 aa, Artificial Sequence
  Description of Artificial Sequence: Synthetic peptide
  Seed: GPDGNTPQF (TYRP1_HUMAN)
GGDGNTPQM

SEQ ID NO: 174285 - protein, 10 aa, Artificial Sequence
  Description of Artificial Sequence: Synthetic peptide
  Seed: HNRQYNMVPF (TYRP1_HUMAN)
HMRQYNMVPY

SEQ ID NO: 174286 - protein, 10 aa, Artificial Sequence
  Description of Artificial Sequence: Synthetic peptide
  Seed: AVFDEWLRRY (TYRP1_HUMAN)
AEFDEWLRRY

SEQ ID NO: 174287 - protein, 10 aa, Artificial Sequence
  Description of Artificial Sequence: Synthetic peptide
  Seed: TAPDNLGYTY (TYRP1_HUMAN)
TFPDNLGYTM

SEQ ID NO: 174288 - protein, 10 aa, Artificial Sequence
  Description of Artificial Sequence: Synthetic peptide
  Seed: STLISPNSVF (TYRP1_HUMAN)
SLLISPNSVY

SEQ ID NO: 174289 - protein, 9 aa, Artificial Sequence
  Description of Artificial Sequence: Synthetic peptide
  Seed: RVLIVRRNL (TYRP1_HUMAN)
RILIVRRNW

SEQ ID NO: 174290 - protein, 9 aa, Artificial Sequence
  Description of Artificial Sequence: Synthetic peptide
  Seed: YNYFVWTHY (TYRP1_HUMAN)
YTYFVWTHV

SEQ ID NO: 174291 - protein, 9 aa, Artificial Sequence
  Description of Artificial Sequence: Synthetic peptide
  Seed: AQFPRQCAT (TYRP1_HUMAN)
AGFPRQCAF

SEQ ID NO: 174292 - protein, 10 aa, Artificial Sequence
  Description of Artificial Sequence: Synthetic peptide
  Seed: WPPVTNTEMF (TYRP1_HUMAN)
WNPVTNTEMW

SEQ ID NO: 174293 - protein, 11 aa, Artificial Sequence
  Description of Artificial Sequence: Synthetic peptide
  Seed: RRYNADISTFP (TYRP1_HUMAN)
RWYNADISTFC

SEQ ID NO: 174294 - protein, 9 aa, Artificial Sequence
  Description of Artificial Sequence: Synthetic peptide
  Seed: HLSPNDPIF (TYRP1_HUMAN)
HHSPNDPIV

SEQ ID NO: 174295 - protein, 11 aa, Artificial Sequence
  Description of Artificial Sequence: Synthetic peptide
  Seed: YNYFVWTHYYS (TYRP1_HUMAN)
YKYFVWTHYYY

SEQ ID NO: 174296 - protein, 9 aa, Artificial Sequence
  Description of Artificial Sequence: Synthetic peptide
  Seed: WPSREFSVP (TYRP1_HUMAN)
WPSREFSVV

SEQ ID NO: 174297 - protein, 9 aa, Artificial Sequence
  Description of Artificial Sequence: Synthetic peptide
  Seed: KYDPAVRSL (TYRP1_HUMAN)
KMDPAVRSF

SEQ ID NO: 174298 - protein, 8 aa, Artificial Sequence
  Description of Artificial Sequence: Synthetic peptide
  Seed: ACDQRVLI (TYRP1_HUMAN)
AADQRVLM

SEQ ID NO: 174299 - protein, 9 aa, Artificial Sequence
  Description of Artificial Sequence: Synthetic peptide
  Seed: DNLGYTYEI (TYRP1_HUMAN)
DALGYTYEL

SEQ ID NO: 174300 - protein, 9 aa, Artificial Sequence
  Description of Artificial Sequence: Synthetic peptide
  Seed: RARRSMDEA (TYRP1_HUMAN)
RMRRSMDEA

SEQ ID NO: 174301 - protein, 9 aa, Artificial Sequence
  Description of Artificial Sequence: Synthetic peptide
  Seed: FLTWHRYHL (TYRP1_HUMAN)
FWTWHRYHF

SEQ ID NO: 174302 - protein, 9 aa, Artificial Sequence
  Description of Artificial Sequence: Synthetic peptide
  Seed: GEVDFSHEG (TYRP1_HUMAN)
GQVDFSHEL

SEQ ID NO: 174303 - protein, 9 aa, Artificial Sequence
  Description of Artificial Sequence: Synthetic peptide
  Seed: ALIFGTASY (TYRP1_HUMAN)
AQIFGTASY

SEQ ID NO: 174304 - protein, 9 aa, Artificial Sequence
  Description of Artificial Sequence: Synthetic peptide
  Seed: LFQQARAQF (TYRP1_HUMAN)
LKQQARAQM

SEQ ID NO: 174305 - protein, 11 aa, Artificial Sequence
  Description of Artificial Sequence: Synthetic peptide
  Seed: LIFGTASYLIR (TYRP1_HUMAN)
LYFGTASYLIR

SEQ ID NO: 174306 - protein, 9 aa, Artificial Sequence
  Description of Artificial Sequence: Synthetic peptide
  Seed: REFSVPEII (TYRP1_HUMAN)
RAFSVPEIY

SEQ ID NO: 174307 - protein, 9 aa, Artificial Sequence
  Description of Artificial Sequence: Synthetic peptide
  Seed: NMVPFWPPV (TYRP1_HUMAN)
NIVPFWPPI

SEQ ID NO: 174308 - protein, 10 aa, Artificial Sequence
  Description of Artificial Sequence: Synthetic peptide
  Seed: IQWPSREFSV (TYRP1_HUMAN)
IVWPSREFSV

SEQ ID NO: 174309 - protein, 9 aa, Artificial Sequence
  Description of Artificial Sequence: Synthetic peptide
  Seed: TLISPNSVF (TYRP1_HUMAN)
TIISPNSVY

SEQ ID NO: 174310 - protein, 9 aa, Artificial Sequence
  Description of Artificial Sequence: Synthetic peptide
  Seed: APIGHNRQY (TYRP1_HUMAN)
ASIGHNRQY

SEQ ID NO: 174311 - protein, 9 aa, Artificial Sequence
  Description of Artificial Sequence: Synthetic peptide
  Seed: FSLPYWNFA (TYRP1_HUMAN)
FQLPYWNFI

SEQ ID NO: 174312 - protein, 10 aa, Artificial Sequence
  Description of Artificial Sequence: Synthetic peptide
  Seed: YNYFVWTHYY (TYRP1_HUMAN)
YSYFVWTHYF

SEQ ID NO: 174313 - protein, 9 aa, Artificial Sequence
  Description of Artificial Sequence: Synthetic peptide
  Seed: VTAPDNLGY (TYRP1_HUMAN)
VTAPDNLGK

SEQ ID NO: 174314 - protein, 9 aa, Artificial Sequence
  Description of Artificial Sequence: Synthetic peptide
  Seed: MAKRTTHPL (TYRP1_HUMAN)
MVKRTTHPM

SEQ ID NO: 174315 - protein, 9 aa, Artificial Sequence
  Description of Artificial Sequence: Synthetic peptide
  Seed: FSHEGPAFL (TYRP1_HUMAN)
FAHEGPAFH

SEQ ID NO: 174316 - protein, 10 aa, Artificial Sequence
  Description of Artificial Sequence: Synthetic peptide
  Seed: FSLPYWNFAT (TYRP1_HUMAN)
FQLPYWNFAV

SEQ ID NO: 174317 - protein, 9 aa, Artificial Sequence
  Description of Artificial Sequence: Synthetic peptide
  Seed: VFDEWLRRY (TYRP1_HUMAN)
VSDEWLRRI

SEQ ID NO: 174318 - protein, 10 aa, Artificial Sequence
  Description of Artificial Sequence: Synthetic peptide
  Seed: YFVWTHYYSV (TYRP1_HUMAN)
YSVWTHYYSI

SEQ ID NO: 174319 - protein, 9 aa, Artificial Sequence
  Description of Artificial Sequence: Synthetic peptide
  Seed: MCCPDLSPV (TYRP1_HUMAN)
MSCPDLSPI

SEQ ID NO: 174320 - protein, 9 aa, Artificial Sequence
  Description of Artificial Sequence: Synthetic peptide
  Seed: YTYEIQWPS (TYRP1_HUMAN)
YYYEIQWPL

SEQ ID NO: 174321 - protein, 9 aa, Artificial Sequence
  Description of Artificial Sequence: Synthetic peptide
  Seed: HEGPAFLTW (TYRP1_HUMAN)
HPGPAFLTL

SEQ ID NO: 174322 - protein, 10 aa, Artificial Sequence
  Description of Artificial Sequence: Synthetic peptide
  Seed: GKYDPAVRSL (TYRP1_HUMAN)
GLYDPAVRSF

SEQ ID NO: 174323 - protein, 10 aa, Artificial Sequence
  Description of Artificial Sequence: Synthetic peptide
  Seed: RRYNADISTF (TYRP1_HUMAN)
RSYNADISTW

SEQ ID NO: 174324 - protein, 9 aa, Artificial Sequence
  Description of Artificial Sequence: Synthetic peptide
  Seed: LSPNDPIFV (TYRP1_HUMAN)
LMPNDPIFV

SEQ ID NO: 174325 - protein, 9 aa, Artificial Sequence
  Description of Artificial Sequence: Synthetic peptide
  Seed: YNYFVWTHY (TYRP1_HUMAN)
YRYFVWTHF

SEQ ID NO: 174326 - protein, 9 aa, Artificial Sequence
  Description of Artificial Sequence: Synthetic peptide
  Seed: HEGPAFLTW (TYRP1_HUMAN)
HSGPAFLTY

SEQ ID NO: 174327 - protein, 9 aa, Artificial Sequence
  Description of Artificial Sequence: Synthetic peptide
  Seed: IAIAVVGAL (TYRP1_HUMAN)
IIIAVVGAR

SEQ ID NO: 174328 - protein, 10 aa, Artificial Sequence
  Description of Artificial Sequence: Synthetic peptide
  Seed: ADSRPHSPQY (TYRP1_HUMAN)
AGSRPHSPQW

SEQ ID NO: 174329 - protein, 11 aa, Artificial Sequence
  Description of Artificial Sequence: Synthetic peptide
  Seed: MFVTAPDNLGY (TYRP1_HUMAN)
MKVTAPDNLGF

SEQ ID NO: 174330 - protein, 9 aa, Artificial Sequence
  Description of Artificial Sequence: Synthetic peptide
  Seed: AQFPRQCAT (TYRP1_HUMAN)
AEFPRQCAI

SEQ ID NO: 174331 - protein, 10 aa, Artificial Sequence
  Description of Artificial Sequence: Synthetic peptide
  Seed: NTVEGYSDPT (TYRP1_HUMAN)
NTVEGYSDPL

SEQ ID NO: 174332 - protein, 10 aa, Artificial Sequence
  Description of Artificial Sequence: Synthetic peptide
  Seed: YFVWTHYYSV (TYRP1_HUMAN)
YIVWTHYYSV

SEQ ID NO: 174333 - protein, 9 aa, Artificial Sequence
  Description of Artificial Sequence: Synthetic peptide
  Seed: QCYAEEYEK (TYRP1_HUMAN)
QAYAEEYEK

SEQ ID NO: 174334 - protein, 9 aa, Artificial Sequence
  Description of Artificial Sequence: Synthetic peptide
  Seed: IGHNRQYNM (TYRP1_HUMAN)
ISHNRQYNL

SEQ ID NO: 174335 - protein, 9 aa, Artificial Sequence
  Description of Artificial Sequence: Synthetic peptide
  Seed: MSAPKLLSL (TYRP1_HUMAN)
MGAPKLLSW

SEQ ID NO: 174336 - protein, 10 aa, Artificial Sequence
  Description of Artificial Sequence: Synthetic peptide
  Seed: EVWPLRFFNR (TYRP1_HUMAN)
EWWPLRFFNR

SEQ ID NO: 174337 - protein, 10 aa, Artificial Sequence
  Description of Artificial Sequence: Synthetic peptide
  Seed: MVPFWPPVTN (TYRP1_HUMAN)
MVPFWPPVTL

SEQ ID NO: 174338 - protein, 10 aa, Artificial Sequence
  Description of Artificial Sequence: Synthetic peptide
  Seed: RSMDEANQPL (TYRP1_HUMAN)
RFMDEANQPI

SEQ ID NO: 174339 - protein, 9 aa, Artificial Sequence
  Description of Artificial Sequence: Synthetic peptide
  Seed: FSVPEIIAI (TYRP1_HUMAN)
FPVPEIIAH

SEQ ID NO: 174340 - protein, 9 aa, Artificial Sequence
  Description of Artificial Sequence: Synthetic peptide
  Seed: LSKEEKNHF (TYRP1_HUMAN)
LLKEEKNHF

SEQ ID NO: 174341 - protein, 10 aa, Artificial Sequence
  Description of Artificial Sequence: Synthetic peptide
  Seed: MQEMLQEPSF (TYRP1_HUMAN)
MKEMLQEPSY

SEQ ID NO: 174342 - protein, 9 aa, Artificial Sequence
  Description of Artificial Sequence: Synthetic peptide
  Seed: RTTHPLFVI (TYRP1_HUMAN)
RATHPLFVV

SEQ ID NO: 174343 - protein, 9 aa, Artificial Sequence
  Description of Artificial Sequence: Synthetic peptide
  Seed: APIGHNRQY (TYRP1_HUMAN)
ALIGHNRQY

SEQ ID NO: 174344 - protein, 10 aa, Artificial Sequence
  Description of Artificial Sequence: Synthetic peptide
  Seed: ENISIYNYFV (TYRP1_HUMAN)
ERISIYNYFV

SEQ ID NO: 174345 - protein, 10 aa, Artificial Sequence
  Description of Artificial Sequence: Synthetic peptide
  Seed: MLQEPSFSLP (TYRP1_HUMAN)
MMQEPSFSLC

SEQ ID NO: 174346 - protein, 11 aa, Artificial Sequence
  Description of Artificial Sequence: Synthetic peptide
  Seed: RRYNADISTFP (TYRP1_HUMAN)
RKYNADISTFF

SEQ ID NO: 174347 - protein, 9 aa, Artificial Sequence
  Description of Artificial Sequence: Synthetic peptide
  Seed: FTDAVFDEW (TYRP1_HUMAN)
FVDAVFDEL

SEQ ID NO: 174348 - protein, 9 aa, Artificial Sequence
  Description of Artificial Sequence: Synthetic peptide
  Seed: LQNPNQSVV (TYRP1_HUMAN)
LFNPNQSVF

SEQ ID NO: 174349 - protein, 9 aa, Artificial Sequence
  Description of Artificial Sequence: Synthetic peptide
  Seed: LFDTPPFYS (TYRP1_HUMAN)
LMDTPPFYL

SEQ ID NO: 174350 - protein, 9 aa, Artificial Sequence
  Description of Artificial Sequence: Synthetic peptide
  Seed: LLSLGCIFF (TYRP1_HUMAN)
LTSLGCIFY

SEQ ID NO: 174351 - protein, 9 aa, Artificial Sequence
  Description of Artificial Sequence: Synthetic peptide
  Seed: YTYEIQWPS (TYRP1_HUMAN)
YSYEIQWPA

SEQ ID NO: 174352 - protein, 9 aa, Artificial Sequence
  Description of Artificial Sequence: Synthetic peptide
  Seed: TFPLENAPI (TYRP1_HUMAN)
TAPLENAPI

SEQ ID NO: 174353 - protein, 11 aa, Artificial Sequence
  Description of Artificial Sequence: Synthetic peptide
  Seed: YQCYAEEYEKL (TYRP1_HUMAN)
YWCYAEEYEKW

SEQ ID NO: 174354 - protein, 11 aa, Artificial Sequence
  Description of Artificial Sequence: Synthetic peptide
  Seed: RRYNADISTFP (TYRP1_HUMAN)
RWYNADISTFW

SEQ ID NO: 174355 - protein, 9 aa, Artificial Sequence
  Description of Artificial Sequence: Synthetic peptide
  Seed: FSVPEIIAI (TYRP1_HUMAN)
FIVPEIIAM

SEQ ID NO: 174356 - protein, 10 aa, Artificial Sequence
  Description of Artificial Sequence: Synthetic peptide
  Seed: FLTWHRYHLL (TYRP1_HUMAN)
FMTWHRYHLA

SEQ ID NO: 174357 - protein, 10 aa, Artificial Sequence
  Description of Artificial Sequence: Synthetic peptide
  Seed: MQEMLQEPSF (TYRP1_HUMAN)
MMEMLQEPSF

SEQ ID NO: 174358 - protein, 9 aa, Artificial Sequence
  Description of Artificial Sequence: Synthetic peptide
  Seed: YLIRARRSM (TYRP1_HUMAN)
YWIRARRSL

SEQ ID NO: 174359 - protein, 9 aa, Artificial Sequence
  Description of Artificial Sequence: Synthetic peptide
  Seed: FSVPEIIAI (TYRP1_HUMAN)
FQVPEIIAY

SEQ ID NO: 174360 - protein, 9 aa, Artificial Sequence
  Description of Artificial Sequence: Synthetic peptide
  Seed: SVKKTFLGV (TYRP1_HUMAN)
SSKKTFLGI

SEQ ID NO: 174361 - protein, 9 aa, Artificial Sequence
  Description of Artificial Sequence: Synthetic peptide
  Seed: LEKDMQEML (TYRP1_HUMAN)
LHKDMQEMI

SEQ ID NO: 174362 - protein, 9 aa, Artificial Sequence
  Description of Artificial Sequence: Synthetic peptide
  Seed: RSNFDSTLI (TYRP1_HUMAN)
RMNFDSTLK

SEQ ID NO: 174363 - protein, 8 aa, Artificial Sequence
  Description of Artificial Sequence: Synthetic peptide
  Seed: YSDPTGKY (TYRP1_HUMAN)
YYDPTGKY

SEQ ID NO: 174364 - protein, 9 aa, Artificial Sequence
  Description of Artificial Sequence: Synthetic peptide
  Seed: RSLHNLAHL (TYRP1_HUMAN)
RMLHNLAHM

SEQ ID NO: 174365 - protein, 10 aa, Artificial Sequence
  Description of Artificial Sequence: Synthetic peptide
  Seed: AFLTWHRYHL (TYRP1_HUMAN)
ALLTWHRYHV

SEQ ID NO: 174366 - protein, 10 aa, Artificial Sequence
  Description of Artificial Sequence: Synthetic peptide
  Seed: RSLHNLAHLF (TYRP1_HUMAN)
RFLHNLAHLF

SEQ ID NO: 174367 - protein, 10 aa, Artificial Sequence
  Description of Artificial Sequence: Synthetic peptide
  Seed: AQFPRQCATV (TYRP1_HUMAN)
AEFPRQCATL

SEQ ID NO: 174368 - protein, 9 aa, Artificial Sequence
  Description of Artificial Sequence: Synthetic peptide
  Seed: APIGHNRQY (TYRP1_HUMAN)
AAIGHNRQF

SEQ ID NO: 174369 - protein, 10 aa, Artificial Sequence
  Description of Artificial Sequence: Synthetic peptide
  Seed: ALIFGTASYL (TYRP1_HUMAN)
AMIFGTASYA

SEQ ID NO: 174370 - protein, 9 aa, Artificial Sequence
  Description of Artificial Sequence: Synthetic peptide
  Seed: SMDEANQPL (TYRP1_HUMAN)
SGDEANQPL

SEQ ID NO: 174371 - protein, 10 aa, Artificial Sequence
  Description of Artificial Sequence: Synthetic peptide
  Seed: EIIAIAVVGA (TYRP1_HUMAN)
ETIAIAVVGI

SEQ ID NO: 174372 - protein, 9 aa, Artificial Sequence
  Description of Artificial Sequence: Synthetic peptide
  Seed: SVPEIIAIA (TYRP1_HUMAN)
SQPEIIAIV

SEQ ID NO: 174373 - protein, 9 aa, Artificial Sequence
  Description of Artificial Sequence: Synthetic peptide
  Seed: STEDGPIRR (TYRP1_HUMAN)
STEDGPIRY

SEQ ID NO: 174374 - protein, 10 aa, Artificial Sequence
  Description of Artificial Sequence: Synthetic peptide
  Seed: ALIFGTASYL (TYRP1_HUMAN)
AYIFGTASYV

SEQ ID NO: 174375 - protein, 9 aa, Artificial Sequence
  Description of Artificial Sequence: Synthetic peptide
  Seed: YTYEIQWPS (TYRP1_HUMAN)
YQYEIQWPF

SEQ ID NO: 174376 - protein, 10 aa, Artificial Sequence
  Description of Artificial Sequence: Synthetic peptide
  Seed: KLLSLGCIFF (TYRP1_HUMAN)
KTLSLGCIFW

SEQ ID NO: 174377 - protein, 9 aa, Artificial Sequence
  Description of Artificial Sequence: Synthetic peptide
  Seed: AACDQRVLI (TYRP1_HUMAN)
AICDQRVLL

SEQ ID NO: 174378 - protein, 9 aa, Artificial Sequence
  Description of Artificial Sequence: Synthetic peptide
  Seed: IATRRSEEI (TYRP1_HUMAN)
IATRRSEEM

SEQ ID NO: 174379 - protein, 9 aa, Artificial Sequence
  Description of Artificial Sequence: Synthetic peptide
  Seed: SRSNFDSTL (TYRP1_HUMAN)
SMSNFDSTI

SEQ ID NO: 174380 - protein, 9 aa, Artificial Sequence
  Description of Artificial Sequence: Synthetic peptide
  Seed: AKRTTHPLF (TYRP1_HUMAN)
ALRTTHPLY

SEQ ID NO: 174381 - protein, 9 aa, Artificial Sequence
  Description of Artificial Sequence: Synthetic peptide
  Seed: QWPSREFSV (TYRP1_HUMAN)
QFPSREFSW

SEQ ID NO: 174382 - protein, 9 aa, Artificial Sequence
  Description of Artificial Sequence: Synthetic peptide
  Seed: VCDICTDDL (TYRP1_HUMAN)
VSDICTDDM

SEQ ID NO: 174383 - protein, 9 aa, Artificial Sequence
  Description of Artificial Sequence: Synthetic peptide
  Seed: DSRPHSPQY (TYRP1_HUMAN)
DMRPHSPQR

SEQ ID NO: 174384 - protein, 10 aa, Artificial Sequence
  Description of Artificial Sequence: Synthetic peptide
  Seed: EGYSDPTGKY (TYRP1_HUMAN)
EIYSDPTGKR

SEQ ID NO: 174385 - protein, 10 aa, Artificial Sequence
  Description of Artificial Sequence: Synthetic peptide
  Seed: FENISIYNYF (TYRP1_HUMAN)
FQNISIYNYF

SEQ ID NO: 174386 - protein, 10 aa, Artificial Sequence
  Description of Artificial Sequence: Synthetic peptide
  Seed: MVPFWPPVTN (TYRP1_HUMAN)
MTPFWPPVTM

SEQ ID NO: 174387 - protein, 9 aa, Artificial Sequence
  Description of Artificial Sequence: Synthetic peptide
  Seed: RQYNMVPFW (TYRP1_HUMAN)
RLYNMVPFL

SEQ ID NO: 174388 - protein, 10 aa, Artificial Sequence
  Description of Artificial Sequence: Synthetic peptide
  Seed: YEIQWPSREF (TYRP1_HUMAN)
YLIQWPSREY

SEQ ID NO: 174389 - protein, 11 aa, Artificial Sequence
  Description of Artificial Sequence: Synthetic peptide
  Seed: FVLLHTFTDAV (TYRP1_HUMAN)
FNLLHTFTDAV

SEQ ID NO: 174390 - protein, 10 aa, Artificial Sequence
  Description of Artificial Sequence: Synthetic peptide
  Seed: MAKRTTHPLF (TYRP1_HUMAN)
MVKRTTHPLY

SEQ ID NO: 174391 - protein, 9 aa, Artificial Sequence
  Description of Artificial Sequence: Synthetic peptide
  Seed: STNSFRNTV (TYRP1_HUMAN)
SFNSFRNTK

SEQ ID NO: 174392 - protein, 9 aa, Artificial Sequence
  Description of Artificial Sequence: Synthetic peptide
  Seed: RTCHCNGNF (TYRP1_HUMAN)
RQCHCNGNY

SEQ ID NO: 174393 - protein, 8 aa, Artificial Sequence
  Description of Artificial Sequence: Synthetic peptide
  Seed: RPGWRGAA (TYRP1_HUMAN)
RPGWRGAF

SEQ ID NO: 174394 - protein, 9 aa, Artificial Sequence
  Description of Artificial Sequence: Synthetic peptide
  Seed: YTYEIQWPS (TYRP1_HUMAN)
YNYEIQWPI

SEQ ID NO: 174395 - protein, 9 aa, Artificial Sequence
  Description of Artificial Sequence: Synthetic peptide
  Seed: AACDQRVLI (TYRP1_HUMAN)
AVCDQRVLL

SEQ ID NO: 174396 - protein, 9 aa, Artificial Sequence
  Description of Artificial Sequence: Synthetic peptide
  Seed: TFPLENAPI (TYRP1_HUMAN)
TAPLENAPF

SEQ ID NO: 174397 - protein, 10 aa, Artificial Sequence
  Description of Artificial Sequence: Synthetic peptide
  Seed: IAIAVVGALL (TYRP1_HUMAN)
IMIAVVGALV

SEQ ID NO: 174398 - protein, 9 aa, Artificial Sequence
  Description of Artificial Sequence: Synthetic peptide
  Seed: GLFDTPPFY (TYRP1_HUMAN)
GQFDTPPFL

SEQ ID NO: 174399 - protein, 9 aa, Artificial Sequence
  Description of Artificial Sequence: Synthetic peptide
  Seed: FSVPEIIAI (TYRP1_HUMAN)
FSVPEIIAF

SEQ ID NO: 174400 - protein, 9 aa, Artificial Sequence
  Description of Artificial Sequence: Synthetic peptide
  Seed: FPLENAPIG (TYRP1_HUMAN)
FALENAPIM

SEQ ID NO: 174401 - protein, 9 aa, Artificial Sequence
  Description of Artificial Sequence: Synthetic peptide
  Seed: FPLENAPIG (TYRP1_HUMAN)
FLLENAPIF

SEQ ID NO: 174402 - protein, 10 aa, Artificial Sequence
  Description of Artificial Sequence: Synthetic peptide
  Seed: FVTAPDNLGY (TYRP1_HUMAN)
FPTAPDNLGW

SEQ ID NO: 174403 - protein, 10 aa, Artificial Sequence
  Description of Artificial Sequence: Synthetic peptide
  Seed: YNYFVWTHYY (TYRP1_HUMAN)
YDYFVWTHYK

SEQ ID NO: 174404 - protein, 9 aa, Artificial Sequence
  Description of Artificial Sequence: Synthetic peptide
  Seed: RYNADISTF (TYRP1_HUMAN)
RRNADISTM

SEQ ID NO: 174405 - protein, 9 aa, Artificial Sequence
  Description of Artificial Sequence: Synthetic peptide
  Seed: RSLHNLAHL (TYRP1_HUMAN)
RVLHNLAHF

SEQ ID NO: 174406 - protein, 9 aa, Artificial Sequence
  Description of Artificial Sequence: Synthetic peptide
  Seed: FTDAVFDEW (TYRP1_HUMAN)
FGDAVFDEV

SEQ ID NO: 174407 - protein, 10 aa, Artificial Sequence
  Description of Artificial Sequence: Synthetic peptide
  Seed: STLISPNSVF (TYRP1_HUMAN)
SILISPNSVY

SEQ ID NO: 174408 - protein, 10 aa, Artificial Sequence
  Description of Artificial Sequence: Synthetic peptide
  Seed: FGTASYLIRA (TYRP1_HUMAN)
FHTASYLIRI

SEQ ID NO: 174409 - protein, 10 aa, Artificial Sequence
  Description of Artificial Sequence: Synthetic peptide
  Seed: FVLLHTFTDA (TYRP1_HUMAN)
FILLHTFTDL

SEQ ID NO: 174410 - protein, 9 aa, Artificial Sequence
  Description of Artificial Sequence: Synthetic peptide
  Seed: SLGCIFFPL (TYRP1_HUMAN)
SQGCIFFPV

SEQ ID NO: 174411 - protein, 10 aa, Artificial Sequence
  Description of Artificial Sequence: Synthetic peptide
  Seed: RRYNADISTF (TYRP1_HUMAN)
RFYNADISTF

SEQ ID NO: 174412 - protein, 9 aa, Artificial Sequence
  Description of Artificial Sequence: Synthetic peptide
  Seed: SMDEANQPL (TYRP1_HUMAN)
SQDEANQPY

SEQ ID NO: 174413 - protein, 10 aa, Artificial Sequence
  Description of Artificial Sequence: Synthetic peptide
  Seed: ADSRPHSPQY (TYRP1_HUMAN)
AKSRPHSPQA

SEQ ID NO: 174414 - protein, 10 aa, Artificial Sequence
  Description of Artificial Sequence: Synthetic peptide
  Seed: AVFDEWLRRY (TYRP1_HUMAN)
AYFDEWLRRR

SEQ ID NO: 174415 - protein, 9 aa, Artificial Sequence
  Description of Artificial Sequence: Synthetic peptide
  Seed: TWHRYHLLR (TYRP1_HUMAN)
TAHRYHLLR

SEQ ID NO: 174416 - protein, 9 aa, Artificial Sequence
  Description of Artificial Sequence: Synthetic peptide
  Seed: FTDAVFDEW (TYRP1_HUMAN)
FWDAVFDEI

SEQ ID NO: 174417 - protein, 9 aa, Artificial Sequence
  Description of Artificial Sequence: Synthetic peptide
  Seed: FYSNSTNSF (TYRP1_HUMAN)
FTSNSTNSM

SEQ ID NO: 174418 - protein, 9 aa, Artificial Sequence
  Description of Artificial Sequence: Synthetic peptide
  Seed: KYDPAVRSL (TYRP1_HUMAN)
KTDPAVRSL

SEQ ID NO: 174419 - protein, 9 aa, Artificial Sequence
  Description of Artificial Sequence: Synthetic peptide
  Seed: SVKKTFLGV (TYRP1_HUMAN)
SPKKTFLGL

SEQ ID NO: 174420 - protein, 9 aa, Artificial Sequence
  Description of Artificial Sequence: Synthetic peptide
  Seed: MSAPKLLSL (TYRP1_HUMAN)
MPAPKLLSF

SEQ ID NO: 174421 - protein, 9 aa, Artificial Sequence
  Description of Artificial Sequence: Synthetic peptide
  Seed: LHTFTDAVF (TYRP1_HUMAN)
LMTFTDAVM

SEQ ID NO: 174422 - protein, 11 aa, Artificial Sequence
  Description of Artificial Sequence: Synthetic peptide
  Seed: YNYFVWTHYYS (TYRP1_HUMAN)
YFYFVWTHYYA

SEQ ID NO: 174423 - protein, 10 aa, Artificial Sequence
  Description of Artificial Sequence: Synthetic peptide
  Seed: AVFDEWLRRY (TYRP1_HUMAN)
ALFDEWLRRW

SEQ ID NO: 174424 - protein, 10 aa, Artificial Sequence
  Description of Artificial Sequence: Synthetic peptide
  Seed: FSLPYWNFAT (TYRP1_HUMAN)
FALPYWNFAM

SEQ ID NO: 174425 - protein, 9 aa, Artificial Sequence
  Description of Artificial Sequence: Synthetic peptide
  Seed: CIFFPLLLF (TYRP1_HUMAN)
CSFFPLLLM

SEQ ID NO: 174426 - protein, 9 aa, Artificial Sequence
  Description of Artificial Sequence: Synthetic peptide
  Seed: FSVPEIIAI (TYRP1_HUMAN)
FAVPEIIAA

SEQ ID NO: 174427 - protein, 10 aa, Artificial Sequence
  Description of Artificial Sequence: Synthetic peptide
  Seed: EMLQEPSFSL (TYRP1_HUMAN)
EKLQEPSFSI

SEQ ID NO: 174428 - protein, 9 aa, Artificial Sequence
  Description of Artificial Sequence: Synthetic peptide
  Seed: CIFFPLLLF (TYRP1_HUMAN)
CTFFPLLLL

SEQ ID NO: 174429 - protein, 9 aa, Artificial Sequence
  Description of Artificial Sequence: Synthetic peptide
  Seed: GPDGNTPQF (TYRP1_HUMAN)
GQDGNTPQL

SEQ ID NO: 174430 - protein, 9 aa, Artificial Sequence
  Description of Artificial Sequence: Synthetic peptide
  Seed: YTYEIQWPS (TYRP1_HUMAN)
YFYEIQWPL

SEQ ID NO: 174431 - protein, 9 aa, Artificial Sequence
  Description of Artificial Sequence: Synthetic peptide
  Seed: RPMVQRLPE (TYRP1_HUMAN)
RSMVQRLPM

SEQ ID NO: 174432 - protein, 10 aa, Artificial Sequence
  Description of Artificial Sequence: Synthetic peptide
  Seed: LLFQQARAQF (TYRP1_HUMAN)
LVFQQARAQY

SEQ ID NO: 174433 - protein, 9 aa, Artificial Sequence
  Description of Artificial Sequence: Synthetic peptide
  Seed: LIFGTASYL (TYRP1_HUMAN)
LLFGTASYA

SEQ ID NO: 174434 - protein, 10 aa, Artificial Sequence
  Description of Artificial Sequence: Synthetic peptide
  Seed: RSLHNLAHLF (TYRP1_HUMAN)
RWLHNLAHLF

SEQ ID NO: 174435 - protein, 9 aa, Artificial Sequence
  Description of Artificial Sequence: Synthetic peptide
  Seed: FSVPEIIAI (TYRP1_HUMAN)
FDVPEIIAY

SEQ ID NO: 174436 - protein, 9 aa, Artificial Sequence
  Description of Artificial Sequence: Synthetic peptide
  Seed: TEMFVTAPD (TYRP1_HUMAN)
TEMFVTAPF

SEQ ID NO: 174437 - protein, 10 aa, Artificial Sequence
  Description of Artificial Sequence: Synthetic peptide
  Seed: YNADISTFPL (TYRP1_HUMAN)
YLADISTFPM

SEQ ID NO: 174438 - protein, 9 aa, Artificial Sequence
  Description of Artificial Sequence: Synthetic peptide
  Seed: ISIYNYFVW (TYRP1_HUMAN)
IPIYNYFVY

SEQ ID NO: 174439 - protein, 9 aa, Artificial Sequence
  Description of Artificial Sequence: Synthetic peptide
  Seed: FGTASYLIR (TYRP1_HUMAN)
FMTASYLIR

SEQ ID NO: 174440 - protein, 9 aa, Artificial Sequence
  Description of Artificial Sequence: Synthetic peptide
  Seed: LHTFTDAVF (TYRP1_HUMAN)
LMTFTDAVY

SEQ ID NO: 174441 - protein, 9 aa, Artificial Sequence
  Description of Artificial Sequence: Synthetic peptide
  Seed: ALIFGTASY (TYRP1_HUMAN)
AFIFGTASV

SEQ ID NO: 174442 - protein, 10 aa, Artificial Sequence
  Description of Artificial Sequence: Synthetic peptide
  Seed: RTTHPLFVIA (TYRP1_HUMAN)
RATHPLFVIK

SEQ ID NO: 174443 - protein, 10 aa, Artificial Sequence
  Description of Artificial Sequence: Synthetic peptide
  Seed: GLFDTPPFYS (TYRP1_HUMAN)
GMFDTPPFYA

SEQ ID NO: 174444 - protein, 10 aa, Artificial Sequence
  Description of Artificial Sequence: Synthetic peptide
  Seed: RSMDEANQPL (TYRP1_HUMAN)
RFMDEANQPL

SEQ ID NO: 174445 - protein, 9 aa, Artificial Sequence
  Description of Artificial Sequence: Synthetic peptide
  Seed: RTTHPLFVI (TYRP1_HUMAN)
RQTHPLFVY

SEQ ID NO: 174446 - protein, 9 aa, Artificial Sequence
  Description of Artificial Sequence: Synthetic peptide
  Seed: AFLTWHRYH (TYRP1_HUMAN)
AGLTWHRYR

SEQ ID NO: 174447 - protein, 9 aa, Artificial Sequence
  Description of Artificial Sequence: Synthetic peptide
  Seed: HLSPNDPIF (TYRP1_HUMAN)
HASPNDPIL

SEQ ID NO: 174448 - protein, 9 aa, Artificial Sequence
  Description of Artificial Sequence: Synthetic peptide
  Seed: GPDGNTPQF (TYRP1_HUMAN)
GADGNTPQI

SEQ ID NO: 174449 - protein, 9 aa, Artificial Sequence
  Description of Artificial Sequence: Synthetic peptide
  Seed: AVVGALLLV (TYRP1_HUMAN)
AAVGALLLV

SEQ ID NO: 174450 - protein, 11 aa, Artificial Sequence
  Description of Artificial Sequence: Synthetic peptide
  Seed: YNMVPFWPPVT (TYRP1_HUMAN)
YMMVPFWPPVD

SEQ ID NO: 174451 - protein, 11 aa, Artificial Sequence
  Description of Artificial Sequence: Synthetic peptide
  Seed: RSMDEANQPLL (TYRP1_HUMAN)
RQMDEANQPLI

SEQ ID NO: 174452 - protein, 9 aa, Artificial Sequence
  Description of Artificial Sequence: Synthetic peptide
  Seed: LPYWNFATG (TYRP1_HUMAN)
LCYWNFATY

SEQ ID NO: 174453 - protein, 9 aa, Artificial Sequence
  Description of Artificial Sequence: Synthetic peptide
  Seed: EDYDTLGTL (TYRP1_HUMAN)
EEYDTLGTF

SEQ ID NO: 174454 - protein, 9 aa, Artificial Sequence
  Description of Artificial Sequence: Synthetic peptide
  Seed: AVVGALLLV (TYRP1_HUMAN)
ATVGALLLM

SEQ ID NO: 174455 - protein, 9 aa, Artificial Sequence
  Description of Artificial Sequence: Synthetic peptide
  Seed: AVFDEWLRR (TYRP1_HUMAN)
AVFDEWLRY

SEQ ID NO: 174456 - protein, 10 aa, Artificial Sequence
  Description of Artificial Sequence: Synthetic peptide
  Seed: MVPFWPPVTN (TYRP1_HUMAN)
MWPFWPPVTM

SEQ ID NO: 174457 - protein, 10 aa, Artificial Sequence
  Description of Artificial Sequence: Synthetic peptide
  Seed: LLFQQARAQF (TYRP1_HUMAN)
LQFQQARAQF

SEQ ID NO: 174458 - protein, 9 aa, Artificial Sequence
  Description of Artificial Sequence: Synthetic peptide
  Seed: AVRSLHNLA (TYRP1_HUMAN)
AVRSLHNLG

SEQ ID NO: 174459 - protein, 9 aa, Artificial Sequence
  Description of Artificial Sequence: Synthetic peptide
  Seed: RVLIVRRNL (TYRP1_HUMAN)
RFLIVRRNA

SEQ ID NO: 174460 - protein, 10 aa, Artificial Sequence
  Description of Artificial Sequence: Synthetic peptide
  Seed: SMDEANQPLL (TYRP1_HUMAN)
STDEANQPLM

SEQ ID NO: 174461 - protein, 9 aa, Artificial Sequence
  Description of Artificial Sequence: Synthetic peptide
  Seed: RRYNADIST (TYRP1_HUMAN)
RRYNADISA

SEQ ID NO: 174462 - protein, 9 aa, Artificial Sequence
  Description of Artificial Sequence: Synthetic peptide
  Seed: SVFSQWRVV (TYRP1_HUMAN)
SLFSQWRVL

SEQ ID NO: 174463 - protein, 9 aa, Artificial Sequence
  Description of Artificial Sequence: Synthetic peptide
  Seed: SGHNCGTCR (TYRP1_HUMAN)
SSHNCGTCY

SEQ ID NO: 174464 - protein, 10 aa, Artificial Sequence
  Description of Artificial Sequence: Synthetic peptide
  Seed: FVLLHTFTDA (TYRP1_HUMAN)
FLLLHTFTDT

SEQ ID NO: 174465 - protein, 9 aa, Artificial Sequence
  Description of Artificial Sequence: Synthetic peptide
  Seed: AACDQRVLI (TYRP1_HUMAN)
ARCDQRVLL

SEQ ID NO: 174466 - protein, 10 aa, Artificial Sequence
  Description of Artificial Sequence: Synthetic peptide
  Seed: ENISIYNYFV (TYRP1_HUMAN)
ESISIYNYFI

SEQ ID NO: 174467 - protein, 9 aa, Artificial Sequence
  Description of Artificial Sequence: Synthetic peptide
  Seed: IIAIAVVGA (TYRP1_HUMAN)
IAAIAVVGV

SEQ ID NO: 174468 - protein, 9 aa, Artificial Sequence
  Description of Artificial Sequence: Synthetic peptide
  Seed: MAKRTTHPL (TYRP1_HUMAN)
MEKRTTHPF

SEQ ID NO: 174469 - protein, 9 aa, Artificial Sequence
  Description of Artificial Sequence: Synthetic peptide
  Seed: HRYHLLRLE (TYRP1_HUMAN)
HRYHLLRLK

SEQ ID NO: 174470 - protein, 9 aa, Artificial Sequence
  Description of Artificial Sequence: Synthetic peptide
  Seed: IVRRNLLDL (TYRP1_HUMAN)
IMRRNLLDK

SEQ ID NO: 174471 - protein, 9 aa, Artificial Sequence
  Description of Artificial Sequence: Synthetic peptide
  Seed: MFVTAPDNL (TYRP1_HUMAN)
MAVTAPDNM

SEQ ID NO: 174472 - protein, 10 aa, Artificial Sequence
  Description of Artificial Sequence: Synthetic peptide
  Seed: TFLGVGQESF (TYRP1_HUMAN)
TILGVGQESY

SEQ ID NO: 174473 - protein, 10 aa, Artificial Sequence
  Description of Artificial Sequence: Synthetic peptide
  Seed: ADSRPHSPQY (TYRP1_HUMAN)
AWSRPHSPQW

SEQ ID NO: 174474 - protein, 10 aa, Artificial Sequence
  Description of Artificial Sequence: Synthetic peptide
  Seed: LLLVALIFGT (TYRP1_HUMAN)
LILVALIFGV

SEQ ID NO: 174475 - protein, 10 aa, Artificial Sequence
  Description of Artificial Sequence: Synthetic peptide
  Seed: TPQFENISIY (TYRP1_HUMAN)
TQQFENISIF

SEQ ID NO: 174476 - protein, 9 aa, Artificial Sequence
  Description of Artificial Sequence: Synthetic peptide
  Seed: VTAPDNLGY (TYRP1_HUMAN)
VQAPDNLGM

SEQ ID NO: 174477 - protein, 9 aa, Artificial Sequence
  Description of Artificial Sequence: Synthetic peptide
  Seed: MLQEPSFSL (TYRP1_HUMAN)
MMQEPSFSC

SEQ ID NO: 174478 - protein, 8 aa, Artificial Sequence
  Description of Artificial Sequence: Synthetic peptide
  Seed: SAPKLLSL (TYRP1_HUMAN)
SYPKLLSM

SEQ ID NO: 174479 - protein, 9 aa, Artificial Sequence
  Description of Artificial Sequence: Synthetic peptide
  Seed: SPNSVFSQW (TYRP1_HUMAN)
SLNSVFSQW

SEQ ID NO: 174480 - protein, 10 aa, Artificial Sequence
  Description of Artificial Sequence: Synthetic peptide
  Seed: ENISIYNYFV (TYRP1_HUMAN)
EMISIYNYFV

SEQ ID NO: 174481 - protein, 9 aa, Artificial Sequence
  Description of Artificial Sequence: Synthetic peptide
  Seed: VGLFDTPPF (TYRP1_HUMAN)
VTLFDTPPF

SEQ ID NO: 174482 - protein, 11 aa, Artificial Sequence
  Description of Artificial Sequence: Synthetic peptide
  Seed: ILGPDGNTPQF (TYRP1_HUMAN)
IQGPDGNTPQL

SEQ ID NO: 174483 - protein, 10 aa, Artificial Sequence
  Description of Artificial Sequence: Synthetic peptide
  Seed: RQCATVEALR (TYRP1_HUMAN)
RTCATVEALK

SEQ ID NO: 174484 - protein, 9 aa, Artificial Sequence
  Description of Artificial Sequence: Synthetic peptide
  Seed: VVGALLLVA (TYRP1_HUMAN)
VQGALLLVV

SEQ ID NO: 174485 - protein, 10 aa, Artificial Sequence
  Description of Artificial Sequence: Synthetic peptide
  Seed: FSVPEIIAIA (TYRP1_HUMAN)
FLVPEIIAIC

SEQ ID NO: 174486 - protein, 9 aa, Artificial Sequence
  Description of Artificial Sequence: Synthetic peptide
  Seed: RQYNMVPFW (TYRP1_HUMAN)
RHYNMVPFM

SEQ ID NO: 174487 - protein, 10 aa, Artificial Sequence
  Description of Artificial Sequence: Synthetic peptide
  Seed: FVLLHTFTDA (TYRP1_HUMAN)
FCLLHTFTDI

SEQ ID NO: 174488 - protein, 9 aa, Artificial Sequence
  Description of Artificial Sequence: Synthetic peptide
  Seed: LTWHRYHLL (TYRP1_HUMAN)
LVWHRYHLW

SEQ ID NO: 174489 - protein, 9 aa, Artificial Sequence
  Description of Artificial Sequence: Synthetic peptide
  Seed: MSAPKLLSL (TYRP1_HUMAN)
MRAPKLLSL

SEQ ID NO: 174490 - protein, 9 aa, Artificial Sequence
  Description of Artificial Sequence: Synthetic peptide
  Seed: GTASYLIRA (TYRP1_HUMAN)
GVASYLIRV

SEQ ID NO: 174491 - protein, 10 aa, Artificial Sequence
  Description of Artificial Sequence: Synthetic peptide
  Seed: FSLPYWNFAT (TYRP1_HUMAN)
FGLPYWNFAL

SEQ ID NO: 174492 - protein, 9 aa, Artificial Sequence
  Description of Artificial Sequence: Synthetic peptide
  Seed: RYNADISTF (TYRP1_HUMAN)
RSNADISTY

SEQ ID NO: 174493 - protein, 9 aa, Artificial Sequence
  Description of Artificial Sequence: Synthetic peptide
  Seed: ARAQFPRQC (TYRP1_HUMAN)
ARAQFPRQV

SEQ ID NO: 174494 - protein, 9 aa, Artificial Sequence
  Description of Artificial Sequence: Synthetic peptide
  Seed: IVRRNLLDL (TYRP1_HUMAN)
IMRRNLLDF

SEQ ID NO: 174495 - protein, 10 aa, Artificial Sequence
  Description of Artificial Sequence: Synthetic peptide
  Seed: LGPDGNTPQF (TYRP1_HUMAN)
LMPDGNTPQF

SEQ ID NO: 174496 - protein, 9 aa, Artificial Sequence
  Description of Artificial Sequence: Synthetic peptide
  Seed: AVRSLHNLA (TYRP1_HUMAN)
ATRSLHNLV

SEQ ID NO: 174497 - protein, 10 aa, Artificial Sequence
  Description of Artificial Sequence: Synthetic peptide
  Seed: MQEMLQEPSF (TYRP1_HUMAN)
MFEMLQEPSW

SEQ ID NO: 174498 - protein, 9 aa, Artificial Sequence
  Description of Artificial Sequence: Synthetic peptide
  Seed: VARPMVQRL (TYRP1_HUMAN)
VMRPMVQRW

SEQ ID NO: 174499 - protein, 10 aa, Artificial Sequence
  Description of Artificial Sequence: Synthetic peptide
  Seed: YNADISTFPL (TYRP1_HUMAN)
YTADISTFPA

SEQ ID NO: 174500 - protein, 9 aa, Artificial Sequence
  Description of Artificial Sequence: Synthetic peptide
  Seed: SGHNCGTCR (TYRP1_HUMAN)
SYHNCGTCR

SEQ ID NO: 174501 - protein, 11 aa, Artificial Sequence
  Description of Artificial Sequence: Synthetic peptide
  Seed: LISPNSVFSQW (TYRP1_HUMAN)
LLSPNSVFSQW

SEQ ID NO: 174502 - protein, 10 aa, Artificial Sequence
  Description of Artificial Sequence: Synthetic peptide
  Seed: EGPAFLTWHR (TYRP1_HUMAN)
EMPAFLTWHK

SEQ ID NO: 174503 - protein, 10 aa, Artificial Sequence
  Description of Artificial Sequence: Synthetic peptide
  Seed: EMLQEPSFSL (TYRP1_HUMAN)
EFLQEPSFSV

SEQ ID NO: 174504 - protein, 9 aa, Artificial Sequence
  Description of Artificial Sequence: Synthetic peptide
  Seed: TWHRYHLLR (TYRP1_HUMAN)
TLHRYHLLR

SEQ ID NO: 174505 - protein, 10 aa, Artificial Sequence
  Description of Artificial Sequence: Synthetic peptide
  Seed: TFLGVGQESF (TYRP1_HUMAN)
TYLGVGQESI

SEQ ID NO: 174506 - protein, 8 aa, Artificial Sequence
  Description of Artificial Sequence: Synthetic peptide
  Seed: YDPAVRSL (TYRP1_HUMAN)
YAPAVRSY

SEQ ID NO: 174507 - protein, 10 aa, Artificial Sequence
  Description of Artificial Sequence: Synthetic peptide
  Seed: LPYWNFATGK (TYRP1_HUMAN)
LQYWNFATGR

SEQ ID NO: 174508 - protein, 10 aa, Artificial Sequence
  Description of Artificial Sequence: Synthetic peptide
  Seed: LQEPSFSLPY (TYRP1_HUMAN)
LLEPSFSLPY

SEQ ID NO: 174509 - protein, 9 aa, Artificial Sequence
  Description of Artificial Sequence: Synthetic peptide
  Seed: SLGCIFFPL (TYRP1_HUMAN)
SLGCIFFPT

SEQ ID NO: 174510 - protein, 10 aa, Artificial Sequence
  Description of Artificial Sequence: Synthetic peptide
  Seed: FSLPYWNFAT (TYRP1_HUMAN)
FVLPYWNFAT

SEQ ID NO: 174511 - protein, 10 aa, Artificial Sequence
  Description of Artificial Sequence: Synthetic peptide
  Seed: FWPPVTNTEM (TYRP1_HUMAN)
FFPPVTNTEY

SEQ ID NO: 174512 - protein, 9 aa, Artificial Sequence
  Description of Artificial Sequence: Synthetic peptide
  Seed: RAQFPRQCA (TYRP1_HUMAN)
RLQFPRQCK

SEQ ID NO: 174513 - protein, 11 aa, Artificial Sequence
  Description of Artificial Sequence: Synthetic peptide
  Seed: FLNGTGGQTHL (TYRP1_HUMAN)
FLNGTGGQTHY

SEQ ID NO: 174514 - protein, 10 aa, Artificial Sequence
  Description of Artificial Sequence: Synthetic peptide
  Seed: HPLFVIATRR (TYRP1_HUMAN)
HMLFVIATRR

SEQ ID NO: 174515 - protein, 10 aa, Artificial Sequence
  Description of Artificial Sequence: Synthetic peptide
  Seed: RSLHNLAHLF (TYRP1_HUMAN)
RVLHNLAHLW

SEQ ID NO: 174516 - protein, 9 aa, Artificial Sequence
  Description of Artificial Sequence: Synthetic peptide
  Seed: SLHNLAHLF (TYRP1_HUMAN)
SPHNLAHLY

SEQ ID NO: 174517 - protein, 9 aa, Artificial Sequence
  Description of Artificial Sequence: Synthetic peptide
  Seed: YSNSTNSFR (TYRP1_HUMAN)
YSNSTNSFF

SEQ ID NO: 174518 - protein, 9 aa, Artificial Sequence
  Description of Artificial Sequence: Synthetic peptide
  Seed: ALIFGTASY (TYRP1_HUMAN)
AMIFGTASF

SEQ ID NO: 174519 - protein, 9 aa, Artificial Sequence
  Description of Artificial Sequence: Synthetic peptide
  Seed: FSHEGPAFL (TYRP1_HUMAN)
FSHEGPAFH

SEQ ID NO: 174520 - protein, 10 aa, Artificial Sequence
  Description of Artificial Sequence: Synthetic peptide
  Seed: AVVGALLLVA (TYRP1_HUMAN)
AIVGALLLVV

SEQ ID NO: 174521 - protein, 11 aa, Artificial Sequence
  Description of Artificial Sequence: Synthetic peptide
  Seed: LEVGLFDTPPF (TYRP1_HUMAN)
LMVGLFDTPPF

SEQ ID NO: 174522 - protein, 9 aa, Artificial Sequence
  Description of Artificial Sequence: Synthetic peptide
  Seed: IAIAVVGAL (TYRP1_HUMAN)
IPIAVVGAF

SEQ ID NO: 174523 - protein, 10 aa, Artificial Sequence
  Description of Artificial Sequence: Synthetic peptide
  Seed: QCYAEEYEKL (TYRP1_HUMAN)
QCYAEEYEKF

SEQ ID NO: 174524 - protein, 10 aa, Artificial Sequence
  Description of Artificial Sequence: Synthetic peptide
  Seed: ADSRPHSPQY (TYRP1_HUMAN)
ARSRPHSPQI

SEQ ID NO: 174525 - protein, 10 aa, Artificial Sequence
  Description of Artificial Sequence: Synthetic peptide
  Seed: MSAPKLLSLG (TYRP1_HUMAN)
MAAPKLLSLW

SEQ ID NO: 174526 - protein, 11 aa, Artificial Sequence
  Description of Artificial Sequence: Synthetic peptide
  Seed: MFVTAPDNLGY (TYRP1_HUMAN)
MHVTAPDNLGF

SEQ ID NO: 174527 - protein, 10 aa, Artificial Sequence
  Description of Artificial Sequence: Synthetic peptide
  Seed: YNADISTFPL (TYRP1_HUMAN)
YMADISTFPL

SEQ ID NO: 174528 - protein, 9 aa, Artificial Sequence
  Description of Artificial Sequence: Synthetic peptide
  Seed: ALLLVALIF (TYRP1_HUMAN)
AQLLVALIY

SEQ ID NO: 174529 - protein, 9 aa, Artificial Sequence
  Description of Artificial Sequence: Synthetic peptide
  Seed: NYFVWTHYY (TYRP1_HUMAN)
NWFVWTHYR

SEQ ID NO: 174530 - protein, 8 aa, Artificial Sequence
  Description of Artificial Sequence: Synthetic peptide
  Seed: ADISTFPL (TYRP1_HUMAN)
AEISTFPL

SEQ ID NO: 174531 - protein, 9 aa, Artificial Sequence
  Description of Artificial Sequence: Synthetic peptide
  Seed: HPLFVIATR (TYRP1_HUMAN)
HPLFVIATM

SEQ ID NO: 174532 - protein, 9 aa, Artificial Sequence
  Description of Artificial Sequence: Synthetic peptide
  Seed: IAVVGALLL (TYRP1_HUMAN)
ISVVGALLF

SEQ ID NO: 174533 - protein, 10 aa, Artificial Sequence
  Description of Artificial Sequence: Synthetic peptide
  Seed: VGLFDTPPFY (TYRP1_HUMAN)
VRLFDTPPFK

SEQ ID NO: 174534 - protein, 9 aa, Artificial Sequence
  Description of Artificial Sequence: Synthetic peptide
  Seed: GEVDFSHEG (TYRP1_HUMAN)
GEVDFSHEV

SEQ ID NO: 174535 - protein, 9 aa, Artificial Sequence
  Description of Artificial Sequence: Synthetic peptide
  Seed: VLLHTFTDA (TYRP1_HUMAN)
VVLHTFTDV

SEQ ID NO: 174536 - protein, 11 aa, Artificial Sequence
  Description of Artificial Sequence: Synthetic peptide
  Seed: IYNYFVWTHYY (TYRP1_HUMAN)
ICNYFVWTHYY

SEQ ID NO: 174537 - protein, 9 aa, Artificial Sequence
  Description of Artificial Sequence: Synthetic peptide
  Seed: VARPMVQRL (TYRP1_HUMAN)
VTRPMVQRM

SEQ ID NO: 174538 - protein, 10 aa, Artificial Sequence
  Description of Artificial Sequence: Synthetic peptide
  Seed: LIFGTASYLI (TYRP1_HUMAN)
LQFGTASYLL

SEQ ID NO: 174539 - protein, 9 aa, Artificial Sequence
  Description of Artificial Sequence: Synthetic peptide
  Seed: FSVPEIIAI (TYRP1_HUMAN)
FTVPEIIAW

SEQ ID NO: 174540 - protein, 9 aa, Artificial Sequence
  Description of Artificial Sequence: Synthetic peptide
  Seed: RLEKDMQEM (TYRP1_HUMAN)
RQEKDMQEI

SEQ ID NO: 174541 - protein, 10 aa, Artificial Sequence
  Description of Artificial Sequence: Synthetic peptide
  Seed: RSMDEANQPL (TYRP1_HUMAN)
RGMDEANQPI

SEQ ID NO: 174542 - protein, 9 aa, Artificial Sequence
  Description of Artificial Sequence: Synthetic peptide
  Seed: VFDEWLRRY (TYRP1_HUMAN)
VVDEWLRRW

SEQ ID NO: 174543 - protein, 11 aa, Artificial Sequence
  Description of Artificial Sequence: Synthetic peptide
  Seed: YNYFVWTHYYS (TYRP1_HUMAN)
YFYFVWTHYYF

SEQ ID NO: 174544 - protein, 9 aa, Artificial Sequence
  Description of Artificial Sequence: Synthetic peptide
  Seed: RVLIVRRNL (TYRP1_HUMAN)
RYLIVRRNK

SEQ ID NO: 174545 - protein, 10 aa, Artificial Sequence
  Description of Artificial Sequence: Synthetic peptide
  Seed: AQFPRQCATV (TYRP1_HUMAN)
ALFPRQCATA

SEQ ID NO: 174546 - protein, 9 aa, Artificial Sequence
  Description of Artificial Sequence: Synthetic peptide
  Seed: FSVPEIIAI (TYRP1_HUMAN)
FTVPEIIAF

SEQ ID NO: 174547 - protein, 11 aa, Artificial Sequence
  Description of Artificial Sequence: Synthetic peptide
  Seed: EVWPLRFFNRT (TYRP1_HUMAN)
ELWPLRFFNRR

SEQ ID NO: 174548 - protein, 10 aa, Artificial Sequence
  Description of Artificial Sequence: Synthetic peptide
  Seed: ISPNSVFSQW (TYRP1_HUMAN)
IIPNSVFSQW

SEQ ID NO: 174549 - protein, 9 aa, Artificial Sequence
  Description of Artificial Sequence: Synthetic peptide
  Seed: SLPYWNFAT (TYRP1_HUMAN)
SLPYWNFAV

SEQ ID NO: 174550 - protein, 9 aa, Artificial Sequence
  Description of Artificial Sequence: Synthetic peptide
  Seed: IAIAVVGAL (TYRP1_HUMAN)
IEIAVVGAM

SEQ ID NO: 174551 - protein, 10 aa, Artificial Sequence
  Description of Artificial Sequence: Synthetic peptide
  Seed: ATVEALRSGM (TYRP1_HUMAN)
ATVEALRSGF

SEQ ID NO: 174552 - protein, 9 aa, Artificial Sequence
  Description of Artificial Sequence: Synthetic peptide
  Seed: VLLHTFTDA (TYRP1_HUMAN)
VLLHTFTDV

SEQ ID NO: 174553 - protein, 10 aa, Artificial Sequence
  Description of Artificial Sequence: Synthetic peptide
  Seed: VALIFGTASY (TYRP1_HUMAN)
VSLIFGTASY

SEQ ID NO: 174554 - protein, 9 aa, Artificial Sequence
  Description of Artificial Sequence: Synthetic peptide
  Seed: RTTHPLFVI (TYRP1_HUMAN)
RNTHPLFVW

SEQ ID NO: 174555 - protein, 9 aa, Artificial Sequence
  Description of Artificial Sequence: Synthetic peptide
  Seed: FVWTHYYSV (TYRP1_HUMAN)
FGWTHYYSV

SEQ ID NO: 174556 - protein, 9 aa, Artificial Sequence
  Description of Artificial Sequence: Synthetic peptide
  Seed: KYDPAVRSL (TYRP1_HUMAN)
KSDPAVRSL

SEQ ID NO: 174557 - protein, 9 aa, Artificial Sequence
  Description of Artificial Sequence: Synthetic peptide
  Seed: TLISPNSVF (TYRP1_HUMAN)
TVISPNSVY

SEQ ID NO: 174558 - protein, 9 aa, Artificial Sequence
  Description of Artificial Sequence: Synthetic peptide
  Seed: VPEIIAIAV (TYRP1_HUMAN)
VPEIIAIAL

SEQ ID NO: 174559 - protein, 10 aa, Artificial Sequence
  Description of Artificial Sequence: Synthetic peptide
  Seed: STLISPNSVF (TYRP1_HUMAN)
SKLISPNSVM

SEQ ID NO: 174560 - protein, 10 aa, Artificial Sequence
  Description of Artificial Sequence: Synthetic peptide
  Seed: RRYNADISTF (TYRP1_HUMAN)
RMYNADISTM

SEQ ID NO: 174561 - protein, 9 aa, Artificial Sequence
  Description of Artificial Sequence: Synthetic peptide
  Seed: LFDTPPFYS (TYRP1_HUMAN)
LADTPPFYL

SEQ ID NO: 174562 - protein, 10 aa, Artificial Sequence
  Description of Artificial Sequence: Synthetic peptide
  Seed: HLSPNDPIFV (TYRP1_HUMAN)
HLSPNDPIFF

SEQ ID NO: 174563 - protein, 10 aa, Artificial Sequence
  Description of Artificial Sequence: Synthetic peptide
  Seed: MQEMLQEPSF (TYRP1_HUMAN)
MAEMLQEPSW

SEQ ID NO: 174564 - protein, 11 aa, Artificial Sequence
  Description of Artificial Sequence: Synthetic peptide
  Seed: REFSVPEIIAI (TYRP1_HUMAN)
RNFSVPEIIAF

SEQ ID NO: 174565 - protein, 10 aa, Artificial Sequence
  Description of Artificial Sequence: Synthetic peptide
  Seed: ALIFGTASYL (TYRP1_HUMAN)
AHIFGTASYV

SEQ ID NO: 174566 - protein, 9 aa, Artificial Sequence
  Description of Artificial Sequence: Synthetic peptide
  Seed: AQFPRQCAT (TYRP1_HUMAN)
AEFPRQCAP

SEQ ID NO: 174567 - protein, 9 aa, Artificial Sequence
  Description of Artificial Sequence: Synthetic peptide
  Seed: EGYSDPTGK (TYRP1_HUMAN)
EAYSDPTGY

SEQ ID NO: 174568 - protein, 9 aa, Artificial Sequence
  Description of Artificial Sequence: Synthetic peptide
  Seed: LSKEEKNHF (TYRP1_HUMAN)
LVKEEKNHY

SEQ ID NO: 174569 - protein, 9 aa, Artificial Sequence
  Description of Artificial Sequence: Synthetic peptide
  Seed: SGRGRCEAV (TYRP1_HUMAN)
SLRGRCEAM

SEQ ID NO: 174570 - protein, 11 aa, Artificial Sequence
  Description of Artificial Sequence: Synthetic peptide
  Seed: FWPPVTNTEMF (TYRP1_HUMAN)
FEPPVTNTEMY

SEQ ID NO: 174571 - protein, 10 aa, Artificial Sequence
  Description of Artificial Sequence: Synthetic peptide
  Seed: FSVPEIIAIA (TYRP1_HUMAN)
FTVPEIIAIV

SEQ ID NO: 174572 - protein, 10 aa, Artificial Sequence
  Description of Artificial Sequence: Synthetic peptide
  Seed: RSMDEANQPL (TYRP1_HUMAN)
RLMDEANQPM

SEQ ID NO: 174573 - protein, 10 aa, Artificial Sequence
  Description of Artificial Sequence: Synthetic peptide
  Seed: ALIFGTASYL (TYRP1_HUMAN)
AMIFGTASYC

SEQ ID NO: 174574 - protein, 9 aa, Artificial Sequence
  Description of Artificial Sequence: Synthetic peptide
  Seed: IIAIAVVGA (TYRP1_HUMAN)
ILAIAVVGA

SEQ ID NO: 174575 - protein, 9 aa, Artificial Sequence
  Description of Artificial Sequence: Synthetic peptide
  Seed: RFFNRTCHC (TYRP1_HUMAN)
RTFNRTCHL

SEQ ID NO: 174576 - protein, 9 aa, Artificial Sequence
  Description of Artificial Sequence: Synthetic peptide
  Seed: IIAIAVVGA (TYRP1_HUMAN)
IIAIAVVGL

SEQ ID NO: 174577 - protein, 10 aa, Artificial Sequence
  Description of Artificial Sequence: Synthetic peptide
  Seed: YNYFVWTHYY (TYRP1_HUMAN)
YLYFVWTHYH

SEQ ID NO: 174578 - protein, 10 aa, Artificial Sequence
  Description of Artificial Sequence: Synthetic peptide
  Seed: RRYNADISTF (TYRP1_HUMAN)
RSYNADISTI

SEQ ID NO: 174579 - protein, 9 aa, Artificial Sequence
  Description of Artificial Sequence: Synthetic peptide
  Seed: QWRVVCDSL (TYRP1_HUMAN)
QYRVVCDSW

SEQ ID NO: 174580 - protein, 11 aa, Artificial Sequence
  Description of Artificial Sequence: Synthetic peptide
  Seed: SLPYWNFATGK (TYRP1_HUMAN)
SSPYWNFATGR

SEQ ID NO: 174581 - protein, 9 aa, Artificial Sequence
  Description of Artificial Sequence: Synthetic peptide
  Seed: ALIFGTASY (TYRP1_HUMAN)
ALIFGTASK

SEQ ID NO: 174582 - protein, 9 aa, Artificial Sequence
  Description of Artificial Sequence: Synthetic peptide
  Seed: SVKKTFLGV (TYRP1_HUMAN)
STKKTFLGY

SEQ ID NO: 174583 - protein, 9 aa, Artificial Sequence
  Description of Artificial Sequence: Synthetic peptide
  Seed: HEGPAFLTW (TYRP1_HUMAN)
HLGPAFLTW

SEQ ID NO: 174584 - protein, 9 aa, Artificial Sequence
  Description of Artificial Sequence: Synthetic peptide
  Seed: STLISPNSV (TYRP1_HUMAN)
SLLISPNSA

SEQ ID NO: 174585 - protein, 8 aa, Artificial Sequence
  Description of Artificial Sequence: Synthetic peptide
  Seed: YNADISTF (TYRP1_HUMAN)
YMADISTF

SEQ ID NO: 174586 - protein, 9 aa, Artificial Sequence
  Description of Artificial Sequence: Synthetic peptide
  Seed: FYSNSTNSF (TYRP1_HUMAN)
FQSNSTNSI

SEQ ID NO: 174587 - protein, 9 aa, Artificial Sequence
  Description of Artificial Sequence: Synthetic peptide
  Seed: VLIVRRNLL (TYRP1_HUMAN)
VFIVRRNLF

SEQ ID NO: 174588 - protein, 11 aa, Artificial Sequence
  Description of Artificial Sequence: Synthetic peptide
  Seed: HTFTDAVFDEW (TYRP1_HUMAN)
HTFTDAVFDEY

SEQ ID NO: 174589 - protein, 10 aa, Artificial Sequence
  Description of Artificial Sequence: Synthetic peptide
  Seed: IAIAVVGALL (TYRP1_HUMAN)
ILIAVVGALV

SEQ ID NO: 174590 - protein, 9 aa, Artificial Sequence
  Description of Artificial Sequence: Synthetic peptide
  Seed: RGRCEAVTA (TYRP1_HUMAN)
RMRCEAVTL

SEQ ID NO: 174591 - protein, 9 aa, Artificial Sequence
  Description of Artificial Sequence: Synthetic peptide
  Seed: RYHLLRLEK (TYRP1_HUMAN)
RTHLLRLEM

SEQ ID NO: 174592 - protein, 9 aa, Artificial Sequence
  Description of Artificial Sequence: Synthetic peptide
  Seed: VTAPDNLGY (TYRP1_HUMAN)
VPAPDNLGM

SEQ ID NO: 174593 - protein, 10 aa, Artificial Sequence
  Description of Artificial Sequence: Synthetic peptide
  Seed: ALIFGTASYL (TYRP1_HUMAN)
ARIFGTASYV

SEQ ID NO: 174594 - protein, 9 aa, Artificial Sequence
  Description of Artificial Sequence: Synthetic peptide
  Seed: AVVGALLLV (TYRP1_HUMAN)
ALVGALLLK

SEQ ID NO: 174595 - protein, 9 aa, Artificial Sequence
  Description of Artificial Sequence: Synthetic peptide
  Seed: FSLPYWNFA (TYRP1_HUMAN)
FPLPYWNFS

SEQ ID NO: 174596 - protein, 11 aa, Artificial Sequence
  Description of Artificial Sequence: Synthetic peptide
  Seed: VCDSLEDYDTL (TYRP1_HUMAN)
VADSLEDYDTM

SEQ ID NO: 174597 - protein, 10 aa, Artificial Sequence
  Description of Artificial Sequence: Synthetic peptide
  Seed: YNMVPFWPPV (TYRP1_HUMAN)
YAMVPFWPPL

SEQ ID NO: 174598 - protein, 10 aa, Artificial Sequence
  Description of Artificial Sequence: Synthetic peptide
  Seed: RSMDEANQPL (TYRP1_HUMAN)
RDMDEANQPV

SEQ ID NO: 174599 - protein, 9 aa, Artificial Sequence
  Description of Artificial Sequence: Synthetic peptide
  Seed: SMDEANQPL (TYRP1_HUMAN)
SFDEANQPM

SEQ ID NO: 174600 - protein, 9 aa, Artificial Sequence
  Description of Artificial Sequence: Synthetic peptide
  Seed: GEVDFSHEG (TYRP1_HUMAN)
GEVDFSHEY

SEQ ID NO: 174601 - protein, 10 aa, Artificial Sequence
  Description of Artificial Sequence: Synthetic peptide
  Seed: ADSRPHSPQY (TYRP1_HUMAN)
AESRPHSPQK

SEQ ID NO: 174602 - protein, 10 aa, Artificial Sequence
  Description of Artificial Sequence: Synthetic peptide
  Seed: LLHTFTDAVF (TYRP1_HUMAN)
LIHTFTDAVY

SEQ ID NO: 174603 - protein, 10 aa, Artificial Sequence
  Description of Artificial Sequence: Synthetic peptide
  Seed: VLLHTFTDAV (TYRP1_HUMAN)
VFLHTFTDAI

SEQ ID NO: 174604 - protein, 9 aa, Artificial Sequence
  Description of Artificial Sequence: Synthetic peptide
  Seed: FLGVGQESF (TYRP1_HUMAN)
FKGVGQESY

SEQ ID NO: 174605 - protein, 11 aa, Artificial Sequence
  Description of Artificial Sequence: Synthetic peptide
  Seed: FWPPVTNTEMF (TYRP1_HUMAN)
FTPPVTNTEMY

SEQ ID NO: 174606 - protein, 10 aa, Artificial Sequence
  Description of Artificial Sequence: Synthetic peptide
  Seed: EGYSDPTGKY (TYRP1_HUMAN)
EIYSDPTGKF

SEQ ID NO: 174607 - protein, 9 aa, Artificial Sequence
  Description of Artificial Sequence: Synthetic peptide
  Seed: HEGPAFLTW (TYRP1_HUMAN)
HGGPAFLTW

SEQ ID NO: 174608 - protein, 10 aa, Artificial Sequence
  Description of Artificial Sequence: Synthetic peptide
  Seed: AFLTWHRYHL (TYRP1_HUMAN)
AMLTWHRYHL

SEQ ID NO: 174609 - protein, 10 aa, Artificial Sequence
  Description of Artificial Sequence: Synthetic peptide
  Seed: HYYSVKKTFL (TYRP1_HUMAN)
HRYSVKKTFF

SEQ ID NO: 174610 - protein, 9 aa, Artificial Sequence
  Description of Artificial Sequence: Synthetic peptide
  Seed: HYYSVKKTF (TYRP1_HUMAN)
HWYSVKKTM

SEQ ID NO: 174611 - protein, 9 aa, Artificial Sequence
  Description of Artificial Sequence: Synthetic peptide
  Seed: RQYNMVPFW (TYRP1_HUMAN)
RRYNMVPFV

SEQ ID NO: 174612 - protein, 11 aa, Artificial Sequence
  Description of Artificial Sequence: Synthetic peptide
  Seed: IYNYFVWTHYY (TYRP1_HUMAN)
ILNYFVWTHYY

SEQ ID NO: 174613 - protein, 9 aa, Artificial Sequence
  Description of Artificial Sequence: Synthetic peptide
  Seed: MAKRTTHPL (TYRP1_HUMAN)
MAKRTTHPF

SEQ ID NO: 174614 - protein, 9 aa, Artificial Sequence
  Description of Artificial Sequence: Synthetic peptide
  Seed: QEPSFSLPY (TYRP1_HUMAN)
QAPSFSLPY

SEQ ID NO: 174615 - protein, 10 aa, Artificial Sequence
  Description of Artificial Sequence: Synthetic peptide
  Seed: STLISPNSVF (TYRP1_HUMAN)
SALISPNSVW

SEQ ID NO: 174616 - protein, 11 aa, Artificial Sequence
  Description of Artificial Sequence: Synthetic peptide
  Seed: EILGPDGNTPQ (TYRP1_HUMAN)
EALGPDGNTPK

SEQ ID NO: 174617 - protein, 9 aa, Artificial Sequence
  Description of Artificial Sequence: Synthetic peptide
  Seed: FSHEGPAFL (TYRP1_HUMAN)
FQHEGPAFM

SEQ ID NO: 174618 - protein, 10 aa, Artificial Sequence
  Description of Artificial Sequence: Synthetic peptide
  Seed: RSMDEANQPL (TYRP1_HUMAN)
RAMDEANQPF

SEQ ID NO: 174619 - protein, 10 aa, Artificial Sequence
  Description of Artificial Sequence: Synthetic peptide
  Seed: YEIQWPSREF (TYRP1_HUMAN)
YKIQWPSREM

SEQ ID NO: 174620 - protein, 9 aa, Artificial Sequence
  Description of Artificial Sequence: Synthetic peptide
  Seed: DNLGYTYEI (TYRP1_HUMAN)
DVLGYTYEI

SEQ ID NO: 174621 - protein, 11 aa, Artificial Sequence
  Description of Artificial Sequence: Synthetic peptide
  Seed: IYNYFVWTHYY (TYRP1_HUMAN)
IANYFVWTHYF

SEQ ID NO: 174622 - protein, 10 aa, Artificial Sequence
  Description of Artificial Sequence: Synthetic peptide
  Seed: GKYDPAVRSL (TYRP1_HUMAN)
GYYDPAVRSM

SEQ ID NO: 174623 - protein, 10 aa, Artificial Sequence
  Description of Artificial Sequence: Synthetic peptide
  Seed: RRYNADISTF (TYRP1_HUMAN)
RNYNADISTF

SEQ ID NO: 174624 - protein, 9 aa, Artificial Sequence
  Description of Artificial Sequence: Synthetic peptide
  Seed: YTYEIQWPS (TYRP1_HUMAN)
YCYEIQWPA

SEQ ID NO: 174625 - protein, 9 aa, Artificial Sequence
  Description of Artificial Sequence: Synthetic peptide
  Seed: MLQEPSFSL (TYRP1_HUMAN)
MLQEPSFSF

SEQ ID NO: 174626 - protein, 10 aa, Artificial Sequence
  Description of Artificial Sequence: Synthetic peptide
  Seed: QCYAEEYEKL (TYRP1_HUMAN)
QGYAEEYEKF

SEQ ID NO: 174627 - protein, 9 aa, Artificial Sequence
  Description of Artificial Sequence: Synthetic peptide
  Seed: SMDEANQPL (TYRP1_HUMAN)
SSDEANQPV

SEQ ID NO: 174628 - protein, 9 aa, Artificial Sequence
  Description of Artificial Sequence: Synthetic peptide
  Seed: KLLSLGCIF (TYRP1_HUMAN)
KLLSLGCIM

SEQ ID NO: 174629 - protein, 8 aa, Artificial Sequence
  Description of Artificial Sequence: Synthetic peptide
  Seed: YSNSTNSF (TYRP1_HUMAN)
YQNSTNSM

SEQ ID NO: 174630 - protein, 9 aa, Artificial Sequence
  Description of Artificial Sequence: Synthetic peptide
  Seed: NRQYNMVPF (TYRP1_HUMAN)
NYQYNMVPM

SEQ ID NO: 174631 - protein, 9 aa, Artificial Sequence
  Description of Artificial Sequence: Synthetic peptide
  Seed: IYNYFVWTH (TYRP1_HUMAN)
IYNYFVWTK

SEQ ID NO: 174632 - protein, 9 aa, Artificial Sequence
  Description of Artificial Sequence: Synthetic peptide
  Seed: LTWHRYHLL (TYRP1_HUMAN)
LMWHRYHLY

SEQ ID NO: 174633 - protein, 9 aa, Artificial Sequence
  Description of Artificial Sequence: Synthetic peptide
  Seed: RQYNMVPFW (TYRP1_HUMAN)
RNYNMVPFF

SEQ ID NO: 174634 - protein, 9 aa, Artificial Sequence
  Description of Artificial Sequence: Synthetic peptide
  Seed: FYSNSTNSF (TYRP1_HUMAN)
FFSNSTNSL

SEQ ID NO: 174635 - protein, 9 aa, Artificial Sequence
  Description of Artificial Sequence: Synthetic peptide
  Seed: MCCPDLSPV (TYRP1_HUMAN)
MLCPDLSPI

SEQ ID NO: 174636 - protein, 9 aa, Artificial Sequence
  Description of Artificial Sequence: Synthetic peptide
  Seed: TAPDNLGYT (TYRP1_HUMAN)
TTPDNLGYM

SEQ ID NO: 174637 - protein, 10 aa, Artificial Sequence
  Description of Artificial Sequence: Synthetic peptide
  Seed: MVPFWPPVTN (TYRP1_HUMAN)
MAPFWPPVTH

SEQ ID NO: 174638 - protein, 10 aa, Artificial Sequence
  Description of Artificial Sequence: Synthetic peptide
  Seed: YNADISTFPL (TYRP1_HUMAN)
YPADISTFPY

SEQ ID NO: 174639 - protein, 10 aa, Artificial Sequence
  Description of Artificial Sequence: Synthetic peptide
  Seed: TDAVFDEWLR (TYRP1_HUMAN)
TMAVFDEWLR

SEQ ID NO: 174640 - protein, 10 aa, Artificial Sequence
  Description of Artificial Sequence: Synthetic peptide
  Seed: YNMVPFWPPV (TYRP1_HUMAN)
YPMVPFWPPV

SEQ ID NO: 174641 - protein, 9 aa, Artificial Sequence
  Description of Artificial Sequence: Synthetic peptide
  Seed: ASYLIRARR (TYRP1_HUMAN)
AVYLIRARR

SEQ ID NO: 174642 - protein, 9 aa, Artificial Sequence
  Description of Artificial Sequence: Synthetic peptide
  Seed: HYYSVKKTF (TYRP1_HUMAN)
HAYSVKKTV

SEQ ID NO: 174643 - protein, 9 aa, Artificial Sequence
  Description of Artificial Sequence: Synthetic peptide
  Seed: RTCHCNGNF (TYRP1_HUMAN)
RTCHCNGNW

SEQ ID NO: 174644 - protein, 10 aa, Artificial Sequence
  Description of Artificial Sequence: Synthetic peptide
  Seed: LGPDGNTPQF (TYRP1_HUMAN)
LTPDGNTPQL

SEQ ID NO: 174645 - protein, 9 aa, Artificial Sequence
  Description of Artificial Sequence: Synthetic peptide
  Seed: FTDAVFDEW (TYRP1_HUMAN)
FQDAVFDEL

SEQ ID NO: 174646 - protein, 10 aa, Artificial Sequence
  Description of Artificial Sequence: Synthetic peptide
  Seed: YNYFVWTHYY (TYRP1_HUMAN)
YYYFVWTHYK

SEQ ID NO: 174647 - protein, 9 aa, Artificial Sequence
  Description of Artificial Sequence: Synthetic peptide
  Seed: DQRVLIVRR (TYRP1_HUMAN)
DWRVLIVRR

SEQ ID NO: 174648 - protein, 10 aa, Artificial Sequence
  Description of Artificial Sequence: Synthetic peptide
  Seed: LGPDGNTPQF (TYRP1_HUMAN)
LFPDGNTPQF

SEQ ID NO: 174649 - protein, 9 aa, Artificial Sequence
  Description of Artificial Sequence: Synthetic peptide
  Seed: FENISIYNY (TYRP1_HUMAN)
FVNISIYNY

SEQ ID NO: 174650 - protein, 10 aa, Artificial Sequence
  Description of Artificial Sequence: Synthetic peptide
  Seed: HLSPNDPIFV (TYRP1_HUMAN)
HASPNDPIFL

SEQ ID NO: 174651 - protein, 10 aa, Artificial Sequence
  Description of Artificial Sequence: Synthetic peptide
  Seed: YNYFVWTHYY (TYRP1_HUMAN)
YSYFVWTHYL

SEQ ID NO: 174652 - protein, 9 aa, Artificial Sequence
  Description of Artificial Sequence: Synthetic peptide
  Seed: RQCATVEAL (TYRP1_HUMAN)
RTCATVEAL

SEQ ID NO: 174653 - protein, 9 aa, Artificial Sequence
  Description of Artificial Sequence: Synthetic peptide
  Seed: RLEKDMQEM (TYRP1_HUMAN)
RVEKDMQEI

SEQ ID NO: 174654 - protein, 11 aa, Artificial Sequence
  Description of Artificial Sequence: Synthetic peptide
  Seed: REVWPLRFFNR (TYRP1_HUMAN)
RMVWPLRFFNK

SEQ ID NO: 174655 - protein, 11 aa, Artificial Sequence
  Description of Artificial Sequence: Synthetic peptide
  Seed: KTFLGVGQESF (TYRP1_HUMAN)
KSFLGVGQESY

SEQ ID NO: 174656 - protein, 11 aa, Artificial Sequence
  Description of Artificial Sequence: Synthetic peptide
  Seed: YNYFVWTHYYS (TYRP1_HUMAN)
YFYFVWTHYYL

SEQ ID NO: 174657 - protein, 9 aa, Artificial Sequence
  Description of Artificial Sequence: Synthetic peptide
  Seed: MLQEPSFSL (TYRP1_HUMAN)
MNQEPSFSF

SEQ ID NO: 174658 - protein, 10 aa, Artificial Sequence
  Description of Artificial Sequence: Synthetic peptide
  Seed: TFLGVGQESF (TYRP1_HUMAN)
TWLGVGQESF

SEQ ID NO: 174659 - protein, 9 aa, Artificial Sequence
  Description of Artificial Sequence: Synthetic peptide
  Seed: LTWHRYHLL (TYRP1_HUMAN)
LTWHRYHLV

SEQ ID NO: 174660 - protein, 10 aa, Artificial Sequence
  Description of Artificial Sequence: Synthetic peptide
  Seed: MVPFWPPVTN (TYRP1_HUMAN)
MQPFWPPVTM

SEQ ID NO: 174661 - protein, 9 aa, Artificial Sequence
  Description of Artificial Sequence: Synthetic peptide
  Seed: LTDQYQCYA (TYRP1_HUMAN)
LTDQYQCYM

SEQ ID NO: 174662 - protein, 10 aa, Artificial Sequence
  Description of Artificial Sequence: Synthetic peptide
  Seed: YNADISTFPL (TYRP1_HUMAN)
YLADISTFPV

SEQ ID NO: 174663 - protein, 11 aa, Artificial Sequence
  Description of Artificial Sequence: Synthetic peptide
  Seed: VTAPDNLGYTY (TYRP1_HUMAN)
VSAPDNLGYTY

SEQ ID NO: 174664 - protein, 9 aa, Artificial Sequence
  Description of Artificial Sequence: Synthetic peptide
  Seed: SIYNYFVWT (TYRP1_HUMAN)
SMYNYFVWI

SEQ ID NO: 174665 - protein, 9 aa, Artificial Sequence
  Description of Artificial Sequence: Synthetic peptide
  Seed: YTYEIQWPS (TYRP1_HUMAN)
YDYEIQWPV

SEQ ID NO: 174666 - protein, 10 aa, Artificial Sequence
  Description of Artificial Sequence: Synthetic peptide
  Seed: RRYNADISTF (TYRP1_HUMAN)
RWYNADISTW

SEQ ID NO: 174667 - protein, 10 aa, Artificial Sequence
  Description of Artificial Sequence: Synthetic peptide
  Seed: TDAVFDEWLR (TYRP1_HUMAN)
TYAVFDEWLR

SEQ ID NO: 174668 - protein, 10 aa, Artificial Sequence
  Description of Artificial Sequence: Synthetic peptide
  Seed: ALIFGTASYL (TYRP1_HUMAN)
AMIFGTASYH

SEQ ID NO: 174669 - protein, 10 aa, Artificial Sequence
  Description of Artificial Sequence: Synthetic peptide
  Seed: RSMDEANQPL (TYRP1_HUMAN)
RRMDEANQPI

SEQ ID NO: 174670 - protein, 9 aa, Artificial Sequence
  Description of Artificial Sequence: Synthetic peptide
  Seed: FSVPEIIAI (TYRP1_HUMAN)
FRVPEIIAV

SEQ ID NO: 174671 - protein, 10 aa, Artificial Sequence
  Description of Artificial Sequence: Synthetic peptide
  Seed: YFVWTHYYSV (TYRP1_HUMAN)
YMVWTHYYSI

SEQ ID NO: 174672 - protein, 9 aa, Artificial Sequence
  Description of Artificial Sequence: Synthetic peptide
  Seed: AKRTTHPLF (TYRP1_HUMAN)
AVRTTHPLY

SEQ ID NO: 174673 - protein, 10 aa, Artificial Sequence
  Description of Artificial Sequence: Synthetic peptide
  Seed: FGTASYLIRA (TYRP1_HUMAN)
FRTASYLIRI

SEQ ID NO: 174674 - protein, 9 aa, Artificial Sequence
  Description of Artificial Sequence: Synthetic peptide
  Seed: DNLGYTYEI (TYRP1_HUMAN)
DILGYTYEA

SEQ ID NO: 174675 - protein, 9 aa, Artificial Sequence
  Description of Artificial Sequence: Synthetic peptide
  Seed: TTHPLFVIA (TYRP1_HUMAN)
TMHPLFVIK

SEQ ID NO: 174676 - protein, 9 aa, Artificial Sequence
  Description of Artificial Sequence: Synthetic peptide
  Seed: FPLENAPIG (TYRP1_HUMAN)
FALENAPIV

SEQ ID NO: 174677 - protein, 9 aa, Artificial Sequence
  Description of Artificial Sequence: Synthetic peptide
  Seed: VARPMVQRL (TYRP1_HUMAN)
VYRPMVQRF

SEQ ID NO: 174678 - protein, 10 aa, Artificial Sequence
  Description of Artificial Sequence: Synthetic peptide
  Seed: MLQEPSFSLP (TYRP1_HUMAN)
MLQEPSFSLG

SEQ ID NO: 174679 - protein, 9 aa, Artificial Sequence
  Description of Artificial Sequence: Synthetic peptide
  Seed: FSLPYWNFA (TYRP1_HUMAN)
FQLPYWNFA

SEQ ID NO: 174680 - protein, 9 aa, Artificial Sequence
  Description of Artificial Sequence: Synthetic peptide
  Seed: RQCATVEAL (TYRP1_HUMAN)
RRCATVEAL

SEQ ID NO: 174681 - protein, 10 aa, Artificial Sequence
  Description of Artificial Sequence: Synthetic peptide
  Seed: YFVWTHYYSV (TYRP1_HUMAN)
YVVWTHYYSV

SEQ ID NO: 174682 - protein, 9 aa, Artificial Sequence
  Description of Artificial Sequence: Synthetic peptide
  Seed: FVWTHYYSV (TYRP1_HUMAN)
FTWTHYYSI

SEQ ID NO: 174683 - protein, 9 aa, Artificial Sequence
  Description of Artificial Sequence: Synthetic peptide
  Seed: VGLFDTPPF (TYRP1_HUMAN)
VQLFDTPPM

SEQ ID NO: 174684 - protein, 10 aa, Artificial Sequence
  Description of Artificial Sequence: Synthetic peptide
  Seed: STFPLENAPI (TYRP1_HUMAN)
SLFPLENAPL

SEQ ID NO: 174685 - protein, 9 aa, Artificial Sequence
  Description of Artificial Sequence: Synthetic peptide
  Seed: TLISPNSVF (TYRP1_HUMAN)
TAISPNSVH

SEQ ID NO: 174686 - protein, 10 aa, Artificial Sequence
  Description of Artificial Sequence: Synthetic peptide
  Seed: AVFDEWLRRY (TYRP1_HUMAN)
ASFDEWLRRR

SEQ ID NO: 174687 - protein, 10 aa, Artificial Sequence
  Description of Artificial Sequence: Synthetic peptide
  Seed: FYSNSTNSFR (TYRP1_HUMAN)
FTSNSTNSFK

SEQ ID NO: 174688 - protein, 9 aa, Artificial Sequence
  Description of Artificial Sequence: Synthetic peptide
  Seed: SLPYWNFAT (TYRP1_HUMAN)
SLPYWNFAL

SEQ ID NO: 174689 - protein, 10 aa, Artificial Sequence
  Description of Artificial Sequence: Synthetic peptide
  Seed: KRTTHPLFVI (TYRP1_HUMAN)
KTTTHPLFVY

SEQ ID NO: 174690 - protein, 10 aa, Artificial Sequence
  Description of Artificial Sequence: Synthetic peptide
  Seed: RRYNADISTF (TYRP1_HUMAN)
RNYNADISTI

SEQ ID NO: 174691 - protein, 9 aa, Artificial Sequence
  Description of Artificial Sequence: Synthetic peptide
  Seed: RGRCEAVTA (TYRP1_HUMAN)
RNRCEAVTK

SEQ ID NO: 174692 - protein, 9 aa, Artificial Sequence
  Description of Artificial Sequence: Synthetic peptide
  Seed: KYDPAVRSL (TYRP1_HUMAN)
KIDPAVRSW

SEQ ID NO: 174693 - protein, 9 aa, Artificial Sequence
  Description of Artificial Sequence: Synthetic peptide
  Seed: YTYEIQWPS (TYRP1_HUMAN)
YMYEIQWPD

SEQ ID NO: 174694 - protein, 9 aa, Artificial Sequence
  Description of Artificial Sequence: Synthetic peptide
  Seed: RRNPAGNVA (TYRP1_HUMAN)
RYNPAGNVF

SEQ ID NO: 174695 - protein, 8 aa, Artificial Sequence
  Description of Artificial Sequence: Synthetic peptide
  Seed: FSHEGPAF (TYRP1_HUMAN)
FWHEGPAM

SEQ ID NO: 174696 - protein, 10 aa, Artificial Sequence
  Description of Artificial Sequence: Synthetic peptide
  Seed: KLLSLGCIFF (TYRP1_HUMAN)
KLLSLGCIFI

SEQ ID NO: 174697 - protein, 9 aa, Artificial Sequence
  Description of Artificial Sequence: Synthetic peptide
  Seed: MAKRTTHPL (TYRP1_HUMAN)
MMKRTTHPM

SEQ ID NO: 174698 - protein, 10 aa, Artificial Sequence
  Description of Artificial Sequence: Synthetic peptide
  Seed: YNYFVWTHYY (TYRP1_HUMAN)
YQYFVWTHYF

SEQ ID NO: 174699 - protein, 9 aa, Artificial Sequence
  Description of Artificial Sequence: Synthetic peptide
  Seed: SFSLPYWNF (TYRP1_HUMAN)
SYSLPYWNW

SEQ ID NO: 174700 - protein, 10 aa, Artificial Sequence
  Description of Artificial Sequence: Synthetic peptide
  Seed: LENAPIGHNR (TYRP1_HUMAN)
LYNAPIGHNR

SEQ ID NO: 174701 - protein, 9 aa, Artificial Sequence
  Description of Artificial Sequence: Synthetic peptide
  Seed: MAKRTTHPL (TYRP1_HUMAN)
MLKRTTHPL

SEQ ID NO: 174702 - protein, 10 aa, Artificial Sequence
  Description of Artificial Sequence: Synthetic peptide
  Seed: FLTWHRYHLL (TYRP1_HUMAN)
FVTWHRYHLV

SEQ ID NO: 174703 - protein, 9 aa, Artificial Sequence
  Description of Artificial Sequence: Synthetic peptide
  Seed: ACDQRVLIV (TYRP1_HUMAN)
ALDQRVLIM

SEQ ID NO: 174704 - protein, 10 aa, Artificial Sequence
  Description of Artificial Sequence: Synthetic peptide
  Seed: EGYSDPTGKY (TYRP1_HUMAN)
EMYSDPTGKY

SEQ ID NO: 174705 - protein, 9 aa, Artificial Sequence
  Description of Artificial Sequence: Synthetic peptide
  Seed: FSVPEIIAI (TYRP1_HUMAN)
FYVPEIIAY

SEQ ID NO: 174706 - protein, 10 aa, Artificial Sequence
  Description of Artificial Sequence: Synthetic peptide
  Seed: AFLTWHRYHL (TYRP1_HUMAN)
AFLTWHRYHF

SEQ ID NO: 174707 - protein, 9 aa, Artificial Sequence
  Description of Artificial Sequence: Synthetic peptide
  Seed: YYSVKKTFL (TYRP1_HUMAN)
YSSVKKTFL

SEQ ID NO: 174708 - protein, 11 aa, Artificial Sequence
  Description of Artificial Sequence: Synthetic peptide
  Seed: HEGPAFLTWHR (TYRP1_HUMAN)
HTGPAFLTWHK

SEQ ID NO: 174709 - protein, 10 aa, Artificial Sequence
  Description of Artificial Sequence: Synthetic peptide
  Seed: AVVGALLLVA (TYRP1_HUMAN)
AQVGALLLVL

SEQ ID NO: 174710 - protein, 9 aa, Artificial Sequence
  Description of Artificial Sequence: Synthetic peptide
  Seed: AIAVVGALL (TYRP1_HUMAN)
AMAVVGALA

SEQ ID NO: 174711 - protein, 10 aa, Artificial Sequence
  Description of Artificial Sequence: Synthetic peptide
  Seed: AVVGALLLVA (TYRP1_HUMAN)
AMVGALLLVM

SEQ ID NO: 174712 - protein, 9 aa, Artificial Sequence
  Description of Artificial Sequence: Synthetic peptide
  Seed: ALIFGTASY (TYRP1_HUMAN)
AYIFGTASL

SEQ ID NO: 174713 - protein, 9 aa, Artificial Sequence
  Description of Artificial Sequence: Synthetic peptide
  Seed: RFFNRTCHC (TYRP1_HUMAN)
RYFNRTCHI

SEQ ID NO: 174714 - protein, 9 aa, Artificial Sequence
  Description of Artificial Sequence: Synthetic peptide
  Seed: RSLHNLAHL (TYRP1_HUMAN)
RILHNLAHV

SEQ ID NO: 174715 - protein, 11 aa, Artificial Sequence
  Description of Artificial Sequence: Synthetic peptide
  Seed: RRYNADISTFP (TYRP1_HUMAN)
RWYNADISTFQ

SEQ ID NO: 174716 - protein, 9 aa, Artificial Sequence
  Description of Artificial Sequence: Synthetic peptide
  Seed: SVFSQWRVV (TYRP1_HUMAN)
SMFSQWRVK

SEQ ID NO: 174717 - protein, 10 aa, Artificial Sequence
  Description of Artificial Sequence: Synthetic peptide
  Seed: ADSRPHSPQY (TYRP1_HUMAN)
ALSRPHSPQY

SEQ ID NO: 174718 - protein, 9 aa, Artificial Sequence
  Description of Artificial Sequence: Synthetic peptide
  Seed: KYDPAVRSL (TYRP1_HUMAN)
KVDPAVRSW

SEQ ID NO: 174719 - protein, 10 aa, Artificial Sequence
  Description of Artificial Sequence: Synthetic peptide
  Seed: FSVPEIIAIA (TYRP1_HUMAN)
FMVPEIIAIS

SEQ ID NO: 174720 - protein, 9 aa, Artificial Sequence
  Description of Artificial Sequence: Synthetic peptide
  Seed: FVWTHYYSV (TYRP1_HUMAN)
FMWTHYYSA

SEQ ID NO: 174721 - protein, 10 aa, Artificial Sequence
  Description of Artificial Sequence: Synthetic peptide
  Seed: IYNYFVWTHY (TYRP1_HUMAN)
ITNYFVWTHY

SEQ ID NO: 174722 - protein, 9 aa, Artificial Sequence
  Description of Artificial Sequence: Synthetic peptide
  Seed: ENISIYNYF (TYRP1_HUMAN)
EIISIYNYM

SEQ ID NO: 174723 - protein, 9 aa, Artificial Sequence
  Description of Artificial Sequence: Synthetic peptide
  Seed: AVFDEWLRR (TYRP1_HUMAN)
AVFDEWLRK

SEQ ID NO: 174724 - protein, 9 aa, Artificial Sequence
  Description of Artificial Sequence: Synthetic peptide
  Seed: RQYNMVPFW (TYRP1_HUMAN)
RSYNMVPFM

SEQ ID NO: 174725 - protein, 10 aa, Artificial Sequence
  Description of Artificial Sequence: Synthetic peptide
  Seed: FWPPVTNTEM (TYRP1_HUMAN)
FGPPVTNTEM

SEQ ID NO: 174726 - protein, 9 aa, Artificial Sequence
  Description of Artificial Sequence: Synthetic peptide
  Seed: MSAPKLLSL (TYRP1_HUMAN)
MSAPKLLSK

SEQ ID NO: 174727 - protein, 10 aa, Artificial Sequence
  Description of Artificial Sequence: Synthetic peptide
  Seed: RTTHPLFVIA (TYRP1_HUMAN)
RDTHPLFVIK

SEQ ID NO: 174728 - protein, 9 aa, Artificial Sequence
  Description of Artificial Sequence: Synthetic peptide
  Seed: NADISTFPL (TYRP1_HUMAN)
NPDISTFPM

SEQ ID NO: 174729 - protein, 9 aa, Artificial Sequence
  Description of Artificial Sequence: Synthetic peptide
  Seed: TAPDNLGYT (TYRP1_HUMAN)
TSPDNLGYM

SEQ ID NO: 174730 - protein, 9 aa, Artificial Sequence
  Description of Artificial Sequence: Synthetic peptide
  Seed: KYDPAVRSL (TYRP1_HUMAN)
KSDPAVRSW

SEQ ID NO: 174731 - protein, 10 aa, Artificial Sequence
  Description of Artificial Sequence: Synthetic peptide
  Seed: ALIFGTASYL (TYRP1_HUMAN)
AMIFGTASYR

SEQ ID NO: 174732 - protein, 10 aa, Artificial Sequence
  Description of Artificial Sequence: Synthetic peptide
  Seed: ALIFGTASYL (TYRP1_HUMAN)
AQIFGTASYV

SEQ ID NO: 174733 - protein, 9 aa, Artificial Sequence
  Description of Artificial Sequence: Synthetic peptide
  Seed: YTYEIQWPS (TYRP1_HUMAN)
YEYEIQWPM

SEQ ID NO: 174734 - protein, 9 aa, Artificial Sequence
  Description of Artificial Sequence: Synthetic peptide
  Seed: ACDQRVLIV (TYRP1_HUMAN)
AIDQRVLIV

SEQ ID NO: 174735 - protein, 9 aa, Artificial Sequence
  Description of Artificial Sequence: Synthetic peptide
  Seed: NADISTFPL (TYRP1_HUMAN)
NFDISTFPM

SEQ ID NO: 174736 - protein, 11 aa, Artificial Sequence
  Description of Artificial Sequence: Synthetic peptide
  Seed: QEMLQEPSFSL (TYRP1_HUMAN)
QEMLQEPSFSV

SEQ ID NO: 174737 - protein, 9 aa, Artificial Sequence
  Description of Artificial Sequence: Synthetic peptide
  Seed: IATRRSEEI (TYRP1_HUMAN)
ISTRRSEEF

SEQ ID NO: 174738 - protein, 9 aa, Artificial Sequence
  Description of Artificial Sequence: Synthetic peptide
  Seed: SGRGRCEAV (TYRP1_HUMAN)
SPRGRCEAL

SEQ ID NO: 174739 - protein, 11 aa, Artificial Sequence
  Description of Artificial Sequence: Synthetic peptide
  Seed: IYNYFVWTHYY (TYRP1_HUMAN)
IPNYFVWTHYF

SEQ ID NO: 174740 - protein, 9 aa, Artificial Sequence
  Description of Artificial Sequence: Synthetic peptide
  Seed: LFQQARAQF (TYRP1_HUMAN)
LQQQARAQF

SEQ ID NO: 174741 - protein, 9 aa, Artificial Sequence
  Description of Artificial Sequence: Synthetic peptide
  Seed: TADSRPHSP (TYRP1_HUMAN)
TWDSRPHSL

SEQ ID NO: 174742 - protein, 10 aa, Artificial Sequence
  Description of Artificial Sequence: Synthetic peptide
  Seed: ALIFGTASYL (TYRP1_HUMAN)
AMIFGTASYD

SEQ ID NO: 174743 - protein, 9 aa, Artificial Sequence
  Description of Artificial Sequence: Synthetic peptide
  Seed: TFPLENAPI (TYRP1_HUMAN)
TTPLENAPL

SEQ ID NO: 174744 - protein, 9 aa, Artificial Sequence
  Description of Artificial Sequence: Synthetic peptide
  Seed: DLMGSRSNF (TYRP1_HUMAN)
DAMGSRSNR

SEQ ID NO: 174745 - protein, 9 aa, Artificial Sequence
  Description of Artificial Sequence: Synthetic peptide
  Seed: APDNLGYTY (TYRP1_HUMAN)
APDNLGYTW

SEQ ID NO: 174746 - protein, 9 aa, Artificial Sequence
  Description of Artificial Sequence: Synthetic peptide
  Seed: HRYHLLRLE (TYRP1_HUMAN)
HRYHLLRLA

SEQ ID NO: 174747 - protein, 10 aa, Artificial Sequence
  Description of Artificial Sequence: Synthetic peptide
  Seed: FSLPYWNFAT (TYRP1_HUMAN)
FPLPYWNFAL

SEQ ID NO: 174748 - protein, 9 aa, Artificial Sequence
  Description of Artificial Sequence: Synthetic peptide
  Seed: NYFVWTHYY (TYRP1_HUMAN)
NIFVWTHYY

SEQ ID NO: 174749 - protein, 9 aa, Artificial Sequence
  Description of Artificial Sequence: Synthetic peptide
  Seed: FYSNSTNSF (TYRP1_HUMAN)
FHSNSTNSF

SEQ ID NO: 174750 - protein, 9 aa, Artificial Sequence
  Description of Artificial Sequence: Synthetic peptide
  Seed: FSHEGPAFL (TYRP1_HUMAN)
FMHEGPAFL

SEQ ID NO: 174751 - protein, 10 aa, Artificial Sequence
  Description of Artificial Sequence: Synthetic peptide
  Seed: KLLSLGCIFF (TYRP1_HUMAN)
KLLSLGCIFL

SEQ ID NO: 174752 - protein, 9 aa, Artificial Sequence
  Description of Artificial Sequence: Synthetic peptide
  Seed: YLIRARRSM (TYRP1_HUMAN)
YLIRARRSF

SEQ ID NO: 174753 - protein, 9 aa, Artificial Sequence
  Description of Artificial Sequence: Synthetic peptide
  Seed: MLQEPSFSL (TYRP1_HUMAN)
MSQEPSFSR

SEQ ID NO: 174754 - protein, 9 aa, Artificial Sequence
  Description of Artificial Sequence: Synthetic peptide
  Seed: HEGPAFLTW (TYRP1_HUMAN)
HGGPAFLTY

SEQ ID NO: 174755 - protein, 10 aa, Artificial Sequence
  Description of Artificial Sequence: Synthetic peptide
  Seed: YNMVPFWPPV (TYRP1_HUMAN)
YTMVPFWPPT

SEQ ID NO: 174756 - protein, 9 aa, Artificial Sequence
  Description of Artificial Sequence: Synthetic peptide
  Seed: FSLPYWNFA (TYRP1_HUMAN)
FLLPYWNFT

SEQ ID NO: 174757 - protein, 9 aa, Artificial Sequence
  Description of Artificial Sequence: Synthetic peptide
  Seed: KLQNPNQSV (TYRP1_HUMAN)
KLQNPNQSL

SEQ ID NO: 174758 - protein, 9 aa, Artificial Sequence
  Description of Artificial Sequence: Synthetic peptide
  Seed: LVALIFGTA (TYRP1_HUMAN)
LAALIFGTA

SEQ ID NO: 174759 - protein, 9 aa, Artificial Sequence
  Description of Artificial Sequence: Synthetic peptide
  Seed: ACDQRVLIV (TYRP1_HUMAN)
ATDQRVLIF

SEQ ID NO: 174760 - protein, 9 aa, Artificial Sequence
  Description of Artificial Sequence: Synthetic peptide
  Seed: LTWHRYHLL (TYRP1_HUMAN)
LVWHRYHLF

SEQ ID NO: 174761 - protein, 9 aa, Artificial Sequence
  Description of Artificial Sequence: Synthetic peptide
  Seed: HEGPAFLTW (TYRP1_HUMAN)
HEGPAFLTM

SEQ ID NO: 174762 - protein, 11 aa, Artificial Sequence
  Description of Artificial Sequence: Synthetic peptide
  Seed: RSMDEANQPLL (TYRP1_HUMAN)
RAMDEANQPLY

SEQ ID NO: 174763 - protein, 11 aa, Artificial Sequence
  Description of Artificial Sequence: Synthetic peptide
  Seed: FWPPVTNTEMF (TYRP1_HUMAN)
FVPPVTNTEMY

SEQ ID NO: 174764 - protein, 9 aa, Artificial Sequence
  Description of Artificial Sequence: Synthetic peptide
  Seed: TASYLIRAR (TYRP1_HUMAN)
TISYLIRAR

SEQ ID NO: 174765 - protein, 10 aa, Artificial Sequence
  Description of Artificial Sequence: Synthetic peptide
  Seed: LLVALIFGTA (TYRP1_HUMAN)
LQVALIFGTL

SEQ ID NO: 174766 - protein, 9 aa, Artificial Sequence
  Description of Artificial Sequence: Synthetic peptide
  Seed: LHNLAHLFL (TYRP1_HUMAN)
LSNLAHLFF

SEQ ID NO: 174767 - protein, 9 aa, Artificial Sequence
  Description of Artificial Sequence: Synthetic peptide
  Seed: MAKRTTHPL (TYRP1_HUMAN)
MMKRTTHPV

SEQ ID NO: 174768 - protein, 9 aa, Artificial Sequence
  Description of Artificial Sequence: Synthetic peptide
  Seed: FLNGTGGQT (TYRP1_HUMAN)
FVNGTGGQV

SEQ ID NO: 174769 - protein, 10 aa, Artificial Sequence
  Description of Artificial Sequence: Synthetic peptide
  Seed: LSPNDPIFVL (TYRP1_HUMAN)
LTPNDPIFVM

SEQ ID NO: 174770 - protein, 9 aa, Artificial Sequence
  Description of Artificial Sequence: Synthetic peptide
  Seed: SIYNYFVWT (TYRP1_HUMAN)
STYNYFVWL

SEQ ID NO: 174771 - protein, 11 aa, Artificial Sequence
  Description of Artificial Sequence: Synthetic peptide
  Seed: RRYNADISTFP (TYRP1_HUMAN)
RYYNADISTFW

SEQ ID NO: 174772 - protein, 9 aa, Artificial Sequence
  Description of Artificial Sequence: Synthetic peptide
  Seed: RRYNADIST (TYRP1_HUMAN)
RQYNADISF

SEQ ID NO: 174773 - protein, 9 aa, Artificial Sequence
  Description of Artificial Sequence: Synthetic peptide
  Seed: CYAEEYEKL (TYRP1_HUMAN)
CWAEEYEKF

SEQ ID NO: 174774 - protein, 9 aa, Artificial Sequence
  Description of Artificial Sequence: Synthetic peptide
  Seed: STLISPNSV (TYRP1_HUMAN)
SVLISPNSL

SEQ ID NO: 174775 - protein, 9 aa, Artificial Sequence
  Description of Artificial Sequence: Synthetic peptide
  Seed: YYSVKKTFL (TYRP1_HUMAN)
YTSVKKTFF

SEQ ID NO: 174776 - protein, 9 aa, Artificial Sequence
  Description of Artificial Sequence: Synthetic peptide
  Seed: AVRSLHNLA (TYRP1_HUMAN)
ATRSLHNLT

SEQ ID NO: 174777 - protein, 11 aa, Artificial Sequence
  Description of Artificial Sequence: Synthetic peptide
  Seed: SLPYWNFATGK (TYRP1_HUMAN)
STPYWNFATGR

SEQ ID NO: 174778 - protein, 9 aa, Artificial Sequence
  Description of Artificial Sequence: Synthetic peptide
  Seed: YNYFVWTHY (TYRP1_HUMAN)
YQYFVWTHW

SEQ ID NO: 174779 - protein, 9 aa, Artificial Sequence
  Description of Artificial Sequence: Synthetic peptide
  Seed: ENAPIGHNR (TYRP1_HUMAN)
ESAPIGHNY

SEQ ID NO: 174780 - protein, 10 aa, Artificial Sequence
  Description of Artificial Sequence: Synthetic peptide
  Seed: GKYDPAVRSL (TYRP1_HUMAN)
GTYDPAVRSY

SEQ ID NO: 174781 - protein, 11 aa, Artificial Sequence
  Description of Artificial Sequence: Synthetic peptide
  Seed: VTAPDNLGYTY (TYRP1_HUMAN)
VPAPDNLGYTW

SEQ ID NO: 174782 - protein, 10 aa, Artificial Sequence
  Description of Artificial Sequence: Synthetic peptide
  Seed: RSMDEANQPL (TYRP1_HUMAN)
RDMDEANQPI

SEQ ID NO: 174783 - protein, 10 aa, Artificial Sequence
  Description of Artificial Sequence: Synthetic peptide
  Seed: QFENISIYNY (TYRP1_HUMAN)
QYENISIYNW

SEQ ID NO: 174784 - protein, 10 aa, Artificial Sequence
  Description of Artificial Sequence: Synthetic peptide
  Seed: AVFDEWLRRY (TYRP1_HUMAN)
AMFDEWLRRW

SEQ ID NO: 174785 - protein, 11 aa, Artificial Sequence
  Description of Artificial Sequence: Synthetic peptide
  Seed: YNMVPFWPPVT (TYRP1_HUMAN)
YQMVPFWPPVT

SEQ ID NO: 174786 - protein, 9 aa, Artificial Sequence
  Description of Artificial Sequence: Synthetic peptide
  Seed: SPNSVFSQW (TYRP1_HUMAN)
SQNSVFSQM

SEQ ID NO: 174787 - protein, 10 aa, Artificial Sequence
  Description of Artificial Sequence: Synthetic peptide
  Seed: VGLFDTPPFY (TYRP1_HUMAN)
VMLFDTPPFK

SEQ ID NO: 174788 - protein, 10 aa, Artificial Sequence
  Description of Artificial Sequence: Synthetic peptide
  Seed: KRTTHPLFVI (TYRP1_HUMAN)
KKTTHPLFVW

SEQ ID NO: 174789 - protein, 9 aa, Artificial Sequence
  Description of Artificial Sequence: Synthetic peptide
  Seed: RYNADISTF (TYRP1_HUMAN)
RHNADISTY

SEQ ID NO: 174790 - protein, 10 aa, Artificial Sequence
  Description of Artificial Sequence: Synthetic peptide
  Seed: SREFSVPEII (TYRP1_HUMAN)
SMEFSVPEIL

SEQ ID NO: 174791 - protein, 9 aa, Artificial Sequence
  Description of Artificial Sequence: Synthetic peptide
  Seed: MDEANQPLL (TYRP1_HUMAN)
MEEANQPLA

SEQ ID NO: 174792 - protein, 9 aa, Artificial Sequence
  Description of Artificial Sequence: Synthetic peptide
  Seed: APDNLGYTY (TYRP1_HUMAN)
AYDNLGYTY

SEQ ID NO: 174793 - protein, 9 aa, Artificial Sequence
  Description of Artificial Sequence: Synthetic peptide
  Seed: YTYEIQWPS (TYRP1_HUMAN)
YLYEIQWPS

SEQ ID NO: 174794 - protein, 8 aa, Artificial Sequence
  Description of Artificial Sequence: Synthetic peptide
  Seed: YSDPTGKY (TYRP1_HUMAN)
YLDPTGKF

SEQ ID NO: 174795 - protein, 10 aa, Artificial Sequence
  Description of Artificial Sequence: Synthetic peptide
  Seed: IYNYFVWTHY (TYRP1_HUMAN)
IYNYFVWTHM

SEQ ID NO: 174796 - protein, 10 aa, Artificial Sequence
  Description of Artificial Sequence: Synthetic peptide
  Seed: KRTTHPLFVI (TYRP1_HUMAN)
KLTTHPLFVW

SEQ ID NO: 174797 - protein, 10 aa, Artificial Sequence
  Description of Artificial Sequence: Synthetic peptide
  Seed: TPQFENISIY (TYRP1_HUMAN)
TVQFENISIM

SEQ ID NO: 174798 - protein, 10 aa, Artificial Sequence
  Description of Artificial Sequence: Synthetic peptide
  Seed: LGPDGNTPQF (TYRP1_HUMAN)
LAPDGNTPQL

SEQ ID NO: 174799 - protein, 8 aa, Artificial Sequence
  Description of Artificial Sequence: Synthetic peptide
  Seed: FSHEGPAF (TYRP1_HUMAN)
FTHEGPAY

SEQ ID NO: 174800 - protein, 11 aa, Artificial Sequence
  Description of Artificial Sequence: Synthetic peptide
  Seed: FLNGTGGQTHL (TYRP1_HUMAN)
FVNGTGGQTHF

SEQ ID NO: 174801 - protein, 9 aa, Artificial Sequence
  Description of Artificial Sequence: Synthetic peptide
  Seed: LTWHRYHLL (TYRP1_HUMAN)
LIWHRYHLA

SEQ ID NO: 174802 - protein, 9 aa, Artificial Sequence
  Description of Artificial Sequence: Synthetic peptide
  Seed: FVWTHYYSV (TYRP1_HUMAN)
FIWTHYYSA

SEQ ID NO: 174803 - protein, 10 aa, Artificial Sequence
  Description of Artificial Sequence: Synthetic peptide
  Seed: FTDAVFDEWL (TYRP1_HUMAN)
FLDAVFDEWV

SEQ ID NO: 174804 - protein, 10 aa, Artificial Sequence
  Description of Artificial Sequence: Synthetic peptide
  Seed: FGTASYLIRA (TYRP1_HUMAN)
FTTASYLIRV

SEQ ID NO: 174805 - protein, 9 aa, Artificial Sequence
  Description of Artificial Sequence: Synthetic peptide
  Seed: YTYEIQWPS (TYRP1_HUMAN)
YIYEIQWPR

SEQ ID NO: 174806 - protein, 8 aa, Artificial Sequence
  Description of Artificial Sequence: Synthetic peptide
  Seed: ACDQRVLI (TYRP1_HUMAN)
AADQRVLI

SEQ ID NO: 174807 - protein, 9 aa, Artificial Sequence
  Description of Artificial Sequence: Synthetic peptide
  Seed: ISIYNYFVW (TYRP1_HUMAN)
IFIYNYFVM

SEQ ID NO: 174808 - protein, 10 aa, Artificial Sequence
  Description of Artificial Sequence: Synthetic peptide
  Seed: EFSVPEIIAI (TYRP1_HUMAN)
ESSVPEIIAV

SEQ ID NO: 174809 - protein, 10 aa, Artificial Sequence
  Description of Artificial Sequence: Synthetic peptide
  Seed: SIYNYFVWTH (TYRP1_HUMAN)
SWYNYFVWTR

SEQ ID NO: 174810 - protein, 9 aa, Artificial Sequence
  Description of Artificial Sequence: Synthetic peptide
  Seed: TLISPNSVF (TYRP1_HUMAN)
TMISPNSVY

SEQ ID NO: 174811 - protein, 10 aa, Artificial Sequence
  Description of Artificial Sequence: Synthetic peptide
  Seed: ADSRPHSPQY (TYRP1_HUMAN)
ADSRPHSPQW

SEQ ID NO: 174812 - protein, 9 aa, Artificial Sequence
  Description of Artificial Sequence: Synthetic peptide
  Seed: LLSLGCIFF (TYRP1_HUMAN)
LWSLGCIFY

SEQ ID NO: 174813 - protein, 9 aa, Artificial Sequence
  Description of Artificial Sequence: Synthetic peptide
  Seed: MSAPKLLSL (TYRP1_HUMAN)
MPAPKLLST

SEQ ID NO: 174814 - protein, 9 aa, Artificial Sequence
  Description of Artificial Sequence: Synthetic peptide
  Seed: LTWHRYHLL (TYRP1_HUMAN)
LQWHRYHLL

SEQ ID NO: 174815 - protein, 9 aa, Artificial Sequence
  Description of Artificial Sequence: Synthetic peptide
  Seed: CIFFPLLLF (TYRP1_HUMAN)
CSFFPLLLY

SEQ ID NO: 174816 - protein, 9 aa, Artificial Sequence
  Description of Artificial Sequence: Synthetic peptide
  Seed: HPLFVIATR (TYRP1_HUMAN)
HWLFVIATR

SEQ ID NO: 174817 - protein, 9 aa, Artificial Sequence
  Description of Artificial Sequence: Synthetic peptide
  Seed: SFRNTVEGY (TYRP1_HUMAN)
SYRNTVEGY

SEQ ID NO: 174818 - protein, 9 aa, Artificial Sequence
  Description of Artificial Sequence: Synthetic peptide
  Seed: SPNDPIFVL (TYRP1_HUMAN)
SINDPIFVV

SEQ ID NO: 174819 - protein, 10 aa, Artificial Sequence
  Description of Artificial Sequence: Synthetic peptide
  Seed: ADSRPHSPQY (TYRP1_HUMAN)
AYSRPHSPQV

SEQ ID NO: 174820 - protein, 10 aa, Artificial Sequence
  Description of Artificial Sequence: Synthetic peptide
  Seed: YFVWTHYYSV (TYRP1_HUMAN)
YQVWTHYYSA

SEQ ID NO: 174821 - protein, 9 aa, Artificial Sequence
  Description of Artificial Sequence: Synthetic peptide
  Seed: KLLSLGCIF (TYRP1_HUMAN)
KMLSLGCIY

SEQ ID NO: 174822 - protein, 9 aa, Artificial Sequence
  Description of Artificial Sequence: Synthetic peptide
  Seed: HEGPAFLTW (TYRP1_HUMAN)
HHGPAFLTY

SEQ ID NO: 174823 - protein, 9 aa, Artificial Sequence
  Description of Artificial Sequence: Synthetic peptide
  Seed: KLQNPNQSV (TYRP1_HUMAN)
KMQNPNQSR

SEQ ID NO: 174824 - protein, 9 aa, Artificial Sequence
  Description of Artificial Sequence: Synthetic peptide
  Seed: DSRPHSPQY (TYRP1_HUMAN)
DVRPHSPQY

SEQ ID NO: 174825 - protein, 9 aa, Artificial Sequence
  Description of Artificial Sequence: Synthetic peptide
  Seed: LIFGTASYL (TYRP1_HUMAN)
LTFGTASYK

SEQ ID NO: 174826 - protein, 9 aa, Artificial Sequence
  Description of Artificial Sequence: Synthetic peptide
  Seed: YTYEIQWPS (TYRP1_HUMAN)
YYYEIQWPI

SEQ ID NO: 174827 - protein, 9 aa, Artificial Sequence
  Description of Artificial Sequence: Synthetic peptide
  Seed: LTDQYQCYA (TYRP1_HUMAN)
LMDQYQCYM

SEQ ID NO: 174828 - protein, 9 aa, Artificial Sequence
  Description of Artificial Sequence: Synthetic peptide
  Seed: KLQNPNQSV (TYRP1_HUMAN)
KAQNPNQSY

SEQ ID NO: 174829 - protein, 9 aa, Artificial Sequence
  Description of Artificial Sequence: Synthetic peptide
  Seed: QDVAQCLEV (TYRP1_HUMAN)
QEVAQCLEM

SEQ ID NO: 174830 - protein, 10 aa, Artificial Sequence
  Description of Artificial Sequence: Synthetic peptide
  Seed: RRYNADISTF (TYRP1_HUMAN)
RDYNADISTI

SEQ ID NO: 174831 - protein, 10 aa, Artificial Sequence
  Description of Artificial Sequence: Synthetic peptide
  Seed: LGPDGNTPQF (TYRP1_HUMAN)
LWPDGNTPQY

SEQ ID NO: 174832 - protein, 9 aa, Artificial Sequence
  Description of Artificial Sequence: Synthetic peptide
  Seed: IAIAVVGAL (TYRP1_HUMAN)
IKIAVVGAI

SEQ ID NO: 174833 - protein, 9 aa, Artificial Sequence
  Description of Artificial Sequence: Synthetic peptide
  Seed: VFDEWLRRY (TYRP1_HUMAN)
VADEWLRRM

SEQ ID NO: 174834 - protein, 10 aa, Artificial Sequence
  Description of Artificial Sequence: Synthetic peptide
  Seed: RSMDEANQPL (TYRP1_HUMAN)
REMDEANQPI

SEQ ID NO: 174835 - protein, 9 aa, Artificial Sequence
  Description of Artificial Sequence: Synthetic peptide
  Seed: YSNSTNSFR (TYRP1_HUMAN)
YLNSTNSFR

SEQ ID NO: 174836 - protein, 9 aa, Artificial Sequence
  Description of Artificial Sequence: Synthetic peptide
  Seed: GPAFLTWHR (TYRP1_HUMAN)
GFAFLTWHR

SEQ ID NO: 174837 - protein, 9 aa, Artificial Sequence
  Description of Artificial Sequence: Synthetic peptide
  Seed: MSAPKLLSL (TYRP1_HUMAN)
MAAPKLLSH

SEQ ID NO: 174838 - protein, 9 aa, Artificial Sequence
  Description of Artificial Sequence: Synthetic peptide
  Seed: TADSRPHSP (TYRP1_HUMAN)
TVDSRPHSM

SEQ ID NO: 174839 - protein, 9 aa, Artificial Sequence
  Description of Artificial Sequence: Synthetic peptide
  Seed: HEGPAFLTW (TYRP1_HUMAN)
HGGPAFLTF

SEQ ID NO: 174840 - protein, 10 aa, Artificial Sequence
  Description of Artificial Sequence: Synthetic peptide
  Seed: WPLRFFNRTC (TYRP1_HUMAN)
WPLRFFNRTV

SEQ ID NO: 174841 - protein, 11 aa, Artificial Sequence
  Description of Artificial Sequence: Synthetic peptide
  Seed: SLEDYDTLGTL (TYRP1_HUMAN)
SLEDYDTLGTV

SEQ ID NO: 174842 - protein, 9 aa, Artificial Sequence
  Description of Artificial Sequence: Synthetic peptide
  Seed: VARPMVQRL (TYRP1_HUMAN)
VPRPMVQRL

SEQ ID NO: 174843 - protein, 11 aa, Artificial Sequence
  Description of Artificial Sequence: Synthetic peptide
  Seed: RSMDEANQPLL (TYRP1_HUMAN)
RLMDEANQPLL

SEQ ID NO: 174844 - protein, 9 aa, Artificial Sequence
  Description of Artificial Sequence: Synthetic peptide
  Seed: HLSPNDPIF (TYRP1_HUMAN)
HPSPNDPIL

SEQ ID NO: 174845 - protein, 9 aa, Artificial Sequence
  Description of Artificial Sequence: Synthetic peptide
  Seed: VFDEWLRRY (TYRP1_HUMAN)
VSDEWLRRW

SEQ ID NO: 174846 - protein, 9 aa, Artificial Sequence
  Description of Artificial Sequence: Synthetic peptide
  Seed: MSAPKLLSL (TYRP1_HUMAN)
MHAPKLLSM

SEQ ID NO: 174847 - protein, 9 aa, Artificial Sequence
  Description of Artificial Sequence: Synthetic peptide
  Seed: LPYWNFATG (TYRP1_HUMAN)
LPYWNFATA

SEQ ID NO: 174848 - protein, 9 aa, Artificial Sequence
  Description of Artificial Sequence: Synthetic peptide
  Seed: GLFDTPPFY (TYRP1_HUMAN)
GVFDTPPFW

SEQ ID NO: 174849 - protein, 9 aa, Artificial Sequence
  Description of Artificial Sequence: Synthetic peptide
  Seed: ASYLIRARR (TYRP1_HUMAN)
AMYLIRARR

SEQ ID NO: 174850 - protein, 10 aa, Artificial Sequence
  Description of Artificial Sequence: Synthetic peptide
  Seed: GTASYLIRAR (TYRP1_HUMAN)
GMASYLIRAR

SEQ ID NO: 174851 - protein, 8 aa, Artificial Sequence
  Description of Artificial Sequence: Synthetic peptide
  Seed: YSDPTGKY (TYRP1_HUMAN)
YVDPTGKL

SEQ ID NO: 174852 - protein, 9 aa, Artificial Sequence
  Description of Artificial Sequence: Synthetic peptide
  Seed: ALIFGTASY (TYRP1_HUMAN)
AFIFGTASF

SEQ ID NO: 174853 - protein, 11 aa, Artificial Sequence
  Description of Artificial Sequence: Synthetic peptide
  Seed: NYFVWTHYYSV (TYRP1_HUMAN)
NLFVWTHYYSV

SEQ ID NO: 174854 - protein, 8 aa, Artificial Sequence
  Description of Artificial Sequence: Synthetic peptide
  Seed: YSDPTGKY (TYRP1_HUMAN)
YIDPTGKI

SEQ ID NO: 174855 - protein, 11 aa, Artificial Sequence
  Description of Artificial Sequence: Synthetic peptide
  Seed: HEGPAFLTWHR (TYRP1_HUMAN)
HTGPAFLTWHR

SEQ ID NO: 174856 - protein, 9 aa, Artificial Sequence
  Description of Artificial Sequence: Synthetic peptide
  Seed: FSHEGPAFL (TYRP1_HUMAN)
FYHEGPAFL

SEQ ID NO: 174857 - protein, 9 aa, Artificial Sequence
  Description of Artificial Sequence: Synthetic peptide
  Seed: FSHEGPAFL (TYRP1_HUMAN)
FWHEGPAFI

SEQ ID NO: 174858 - protein, 10 aa, Artificial Sequence
  Description of Artificial Sequence: Synthetic peptide
  Seed: RRYNADISTF (TYRP1_HUMAN)
RTYNADISTW

SEQ ID NO: 174859 - protein, 10 aa, Artificial Sequence
  Description of Artificial Sequence: Synthetic peptide
  Seed: LLLVALIFGT (TYRP1_HUMAN)
LPLVALIFGV

SEQ ID NO: 174860 - protein, 11 aa, Artificial Sequence
  Description of Artificial Sequence: Synthetic peptide
  Seed: LISPNSVFSQW (TYRP1_HUMAN)
LTSPNSVFSQL

SEQ ID NO: 174861 - protein, 9 aa, Artificial Sequence
  Description of Artificial Sequence: Synthetic peptide
  Seed: VFDEWLRRY (TYRP1_HUMAN)
VNDEWLRRM

SEQ ID NO: 174862 - protein, 11 aa, Artificial Sequence
  Description of Artificial Sequence: Synthetic peptide
  Seed: FLNGTGGQTHL (TYRP1_HUMAN)
FTNGTGGQTHF

SEQ ID NO: 174863 - protein, 11 aa, Artificial Sequence
  Description of Artificial Sequence: Synthetic peptide
  Seed: HTFTDAVFDEW (TYRP1_HUMAN)
HMFTDAVFDEF

SEQ ID NO: 174864 - protein, 9 aa, Artificial Sequence
  Description of Artificial Sequence: Synthetic peptide
  Seed: VGALLLVAL (TYRP1_HUMAN)
VQALLLVAV

SEQ ID NO: 174865 - protein, 11 aa, Artificial Sequence
  Description of Artificial Sequence: Synthetic peptide
  Seed: QEMLQEPSFSL (TYRP1_HUMAN)
QKMLQEPSFSL

SEQ ID NO: 174866 - protein, 10 aa, Artificial Sequence
  Description of Artificial Sequence: Synthetic peptide
  Seed: RSLHNLAHLF (TYRP1_HUMAN)
RSLHNLAHLL

SEQ ID NO: 174867 - protein, 10 aa, Artificial Sequence
  Description of Artificial Sequence: Synthetic peptide
  Seed: VDFSHEGPAF (TYRP1_HUMAN)
VEFSHEGPAY

SEQ ID NO: 174868 - protein, 9 aa, Artificial Sequence
  Description of Artificial Sequence: Synthetic peptide
  Seed: REFSVPEII (TYRP1_HUMAN)
RSFSVPEIY

SEQ ID NO: 174869 - protein, 11 aa, Artificial Sequence
  Description of Artificial Sequence: Synthetic peptide
  Seed: VTAPDNLGYTY (TYRP1_HUMAN)
VMAPDNLGYTF

SEQ ID NO: 174870 - protein, 10 aa, Artificial Sequence
  Description of Artificial Sequence: Synthetic peptide
  Seed: FGTASYLIRA (TYRP1_HUMAN)
FMTASYLIRT

SEQ ID NO: 174871 - protein, 10 aa, Artificial Sequence
  Description of Artificial Sequence: Synthetic peptide
  Seed: KRTTHPLFVI (TYRP1_HUMAN)
KPTTHPLFVY

SEQ ID NO: 174872 - protein, 10 aa, Artificial Sequence
  Description of Artificial Sequence: Synthetic peptide
  Seed: RSMDEANQPL (TYRP1_HUMAN)
RHMDEANQPY

SEQ ID NO: 174873 - protein, 9 aa, Artificial Sequence
  Description of Artificial Sequence: Synthetic peptide
  Seed: IAVVGALLL (TYRP1_HUMAN)
IQVVGALLL

SEQ ID NO: 174874 - protein, 10 aa, Artificial Sequence
  Description of Artificial Sequence: Synthetic peptide
  Seed: YFVWTHYYSV (TYRP1_HUMAN)
YNVWTHYYSV

SEQ ID NO: 174875 - protein, 9 aa, Artificial Sequence
  Description of Artificial Sequence: Synthetic peptide
  Seed: SREFSVPEI (TYRP1_HUMAN)
SHEFSVPEL

SEQ ID NO: 174876 - protein, 9 aa, Artificial Sequence
  Description of Artificial Sequence: Synthetic peptide
  Seed: MCCPDLSPV (TYRP1_HUMAN)
MTCPDLSPM

SEQ ID NO: 174877 - protein, 9 aa, Artificial Sequence
  Description of Artificial Sequence: Synthetic peptide
  Seed: TFPLENAPI (TYRP1_HUMAN)
TIPLENAPM

SEQ ID NO: 174878 - protein, 10 aa, Artificial Sequence
  Description of Artificial Sequence: Synthetic peptide
  Seed: YTYEIQWPSR (TYRP1_HUMAN)
YIYEIQWPSK

SEQ ID NO: 174879 - protein, 9 aa, Artificial Sequence
  Description of Artificial Sequence: Synthetic peptide
  Seed: ACDQRVLIV (TYRP1_HUMAN)
ACDQRVLIM

SEQ ID NO: 174880 - protein, 10 aa, Artificial Sequence
  Description of Artificial Sequence: Synthetic peptide
  Seed: FSLPYWNFAT (TYRP1_HUMAN)
FSLPYWNFAL

SEQ ID NO: 174881 - protein, 8 aa, Artificial Sequence
  Description of Artificial Sequence: Synthetic peptide
  Seed: LIRARRSM (TYRP1_HUMAN)
LLRARRSL

SEQ ID NO: 174882 - protein, 9 aa, Artificial Sequence
  Description of Artificial Sequence: Synthetic peptide
  Seed: STLISPNSV (TYRP1_HUMAN)
SVLISPNSY

SEQ ID NO: 174883 - protein, 9 aa, Artificial Sequence
  Description of Artificial Sequence: Synthetic peptide
  Seed: VTAPDNLGY (TYRP1_HUMAN)
VPAPDNLGY

SEQ ID NO: 174884 - protein, 8 aa, Artificial Sequence
  Description of Artificial Sequence: Synthetic peptide
  Seed: YSDPTGKY (TYRP1_HUMAN)
YTDPTGKM

SEQ ID NO: 174885 - protein, 9 aa, Artificial Sequence
  Description of Artificial Sequence: Synthetic peptide
  Seed: EGYSDPTGK (TYRP1_HUMAN)
ETYSDPTGR

SEQ ID NO: 174886 - protein, 11 aa, Artificial Sequence
  Description of Artificial Sequence: Synthetic peptide
  Seed: REFSVPEIIAI (TYRP1_HUMAN)
RTFSVPEIIAW

SEQ ID NO: 174887 - protein, 10 aa, Artificial Sequence
  Description of Artificial Sequence: Synthetic peptide
  Seed: AVRSLHNLAH (TYRP1_HUMAN)
AVRSLHNLAI

SEQ ID NO: 174888 - protein, 10 aa, Artificial Sequence
  Description of Artificial Sequence: Synthetic peptide
  Seed: SPNSVFSQWR (TYRP1_HUMAN)
SGNSVFSQWR

SEQ ID NO: 174889 - protein, 10 aa, Artificial Sequence
  Description of Artificial Sequence: Synthetic peptide
  Seed: QEPSFSLPYW (TYRP1_HUMAN)
QTPSFSLPYW

SEQ ID NO: 174890 - protein, 10 aa, Artificial Sequence
  Description of Artificial Sequence: Synthetic peptide
  Seed: IAVVGALLLV (TYRP1_HUMAN)
IIVVGALLLV

SEQ ID NO: 174891 - protein, 9 aa, Artificial Sequence
  Description of Artificial Sequence: Synthetic peptide
  Seed: STNSFRNTV (TYRP1_HUMAN)
SSNSFRNTL

SEQ ID NO: 174892 - protein, 10 aa, Artificial Sequence
  Description of Artificial Sequence: Synthetic peptide
  Seed: NSFRNTVEGY (TYRP1_HUMAN)
NPFRNTVEGY

SEQ ID NO: 174893 - protein, 11 aa, Artificial Sequence
  Description of Artificial Sequence: Synthetic peptide
  Seed: VTAPDNLGYTY (TYRP1_HUMAN)
VTAPDNLGYTF

SEQ ID NO: 174894 - protein, 10 aa, Artificial Sequence
  Description of Artificial Sequence: Synthetic peptide
  Seed: FQQARAQFPR (TYRP1_HUMAN)
FCQARAQFPR

SEQ ID NO: 174895 - protein, 10 aa, Artificial Sequence
  Description of Artificial Sequence: Synthetic peptide
  Seed: EIIAIAVVGA (TYRP1_HUMAN)
ENIAIAVVGI

SEQ ID NO: 174896 - protein, 9 aa, Artificial Sequence
  Description of Artificial Sequence: Synthetic peptide
  Seed: TADSRPHSP (TYRP1_HUMAN)
TLDSRPHSI

SEQ ID NO: 174897 - protein, 10 aa, Artificial Sequence
  Description of Artificial Sequence: Synthetic peptide
  Seed: SMDEANQPLL (TYRP1_HUMAN)
SLDEANQPLV

SEQ ID NO: 174898 - protein, 9 aa, Artificial Sequence
  Description of Artificial Sequence: Synthetic peptide
  Seed: LEVGLFDTP (TYRP1_HUMAN)
LEVGLFDTM

SEQ ID NO: 174899 - protein, 9 aa, Artificial Sequence
  Description of Artificial Sequence: Synthetic peptide
  Seed: FSHEGPAFL (TYRP1_HUMAN)
FVHEGPAFA

SEQ ID NO: 174900 - protein, 9 aa, Artificial Sequence
  Description of Artificial Sequence: Synthetic peptide
  Seed: TTHPLFVIA (TYRP1_HUMAN)
TLHPLFVIL

SEQ ID NO: 174901 - protein, 10 aa, Artificial Sequence
  Description of Artificial Sequence: Synthetic peptide
  Seed: ADSRPHSPQY (TYRP1_HUMAN)
AFSRPHSPQV

SEQ ID NO: 174902 - protein, 10 aa, Artificial Sequence
  Description of Artificial Sequence: Synthetic peptide
  Seed: RLEKDMQEML (TYRP1_HUMAN)
RMEKDMQEML

SEQ ID NO: 174903 - protein, 10 aa, Artificial Sequence
  Description of Artificial Sequence: Synthetic peptide
  Seed: FGTASYLIRA (TYRP1_HUMAN)
FMTASYLIRI

SEQ ID NO: 174904 - protein, 10 aa, Artificial Sequence
  Description of Artificial Sequence: Synthetic peptide
  Seed: FSLPYWNFAT (TYRP1_HUMAN)
FDLPYWNFAM

SEQ ID NO: 174905 - protein, 9 aa, Artificial Sequence
  Description of Artificial Sequence: Synthetic peptide
  Seed: RSLHNLAHL (TYRP1_HUMAN)
RSLHNLAHF

SEQ ID NO: 174906 - protein, 9 aa, Artificial Sequence
  Description of Artificial Sequence: Synthetic peptide
  Seed: YNYFVWTHY (TYRP1_HUMAN)
YRYFVWTHL

SEQ ID NO: 174907 - protein, 9 aa, Artificial Sequence
  Description of Artificial Sequence: Synthetic peptide
  Seed: SLHNLAHLF (TYRP1_HUMAN)
STHNLAHLL

SEQ ID NO: 174908 - protein, 9 aa, Artificial Sequence
  Description of Artificial Sequence: Synthetic peptide
  Seed: HEGPAFLTW (TYRP1_HUMAN)
HQGPAFLTI

SEQ ID NO: 174909 - protein, 9 aa, Artificial Sequence
  Description of Artificial Sequence: Synthetic peptide
  Seed: MLQEPSFSL (TYRP1_HUMAN)
MTQEPSFSY

SEQ ID NO: 174910 - protein, 9 aa, Artificial Sequence
  Description of Artificial Sequence: Synthetic peptide
  Seed: FPRQCATVE (TYRP1_HUMAN)
FPRQCATVA

SEQ ID NO: 174911 - protein, 9 aa, Artificial Sequence
  Description of Artificial Sequence: Synthetic peptide
  Seed: LFDTPPFYS (TYRP1_HUMAN)
LWDTPPFYF

SEQ ID NO: 174912 - protein, 9 aa, Artificial Sequence
  Description of Artificial Sequence: Synthetic peptide
  Seed: FPRQCATVE (TYRP1_HUMAN)
FMRQCATVY

SEQ ID NO: 174913 - protein, 9 aa, Artificial Sequence
  Description of Artificial Sequence: Synthetic peptide
  Seed: FYSNSTNSF (TYRP1_HUMAN)
FRSNSTNSL

SEQ ID NO: 174914 - protein, 11 aa, Artificial Sequence
  Description of Artificial Sequence: Synthetic peptide
  Seed: YQCYAEEYEKL (TYRP1_HUMAN)
YTCYAEEYEKF

SEQ ID NO: 174915 - protein, 10 aa, Artificial Sequence
  Description of Artificial Sequence: Synthetic peptide
  Seed: YNYFVWTHYY (TYRP1_HUMAN)
YEYFVWTHYR

SEQ ID NO: 174916 - protein, 10 aa, Artificial Sequence
  Description of Artificial Sequence: Synthetic peptide
  Seed: EMLQEPSFSL (TYRP1_HUMAN)
EALQEPSFSV

SEQ ID NO: 174917 - protein, 11 aa, Artificial Sequence
  Description of Artificial Sequence: Synthetic peptide
  Seed: FSVPEIIAIAV (TYRP1_HUMAN)
FQVPEIIAIAV

SEQ ID NO: 174918 - protein, 9 aa, Artificial Sequence
  Description of Artificial Sequence: Synthetic peptide
  Seed: VTAPDNLGY (TYRP1_HUMAN)
VVAPDNLGW

SEQ ID NO: 174919 - protein, 10 aa, Artificial Sequence
  Description of Artificial Sequence: Synthetic peptide
  Seed: YFVWTHYYSV (TYRP1_HUMAN)
YAVWTHYYSV

SEQ ID NO: 174920 - protein, 10 aa, Artificial Sequence
  Description of Artificial Sequence: Synthetic peptide
  Seed: KYDPAVRSLH (TYRP1_HUMAN)
KFDPAVRSLY

SEQ ID NO: 174921 - protein, 10 aa, Artificial Sequence
  Description of Artificial Sequence: Synthetic peptide
  Seed: EMLQEPSFSL (TYRP1_HUMAN)
EVLQEPSFSI

SEQ ID NO: 174922 - protein, 9 aa, Artificial Sequence
  Description of Artificial Sequence: Synthetic peptide
  Seed: REVWPLRFF (TYRP1_HUMAN)
REVWPLRFW

SEQ ID NO: 174923 - protein, 9 aa, Artificial Sequence
  Description of Artificial Sequence: Synthetic peptide
  Seed: RPGWRGAAC (TYRP1_HUMAN)
RPGWRGAAS

SEQ ID NO: 174924 - protein, 9 aa, Artificial Sequence
  Description of Artificial Sequence: Synthetic peptide
  Seed: VGLFDTPPF (TYRP1_HUMAN)
VMLFDTPPL

SEQ ID NO: 174925 - protein, 9 aa, Artificial Sequence
  Description of Artificial Sequence: Synthetic peptide
  Seed: FSHEGPAFL (TYRP1_HUMAN)
FQHEGPAFV

SEQ ID NO: 174926 - protein, 11 aa, Artificial Sequence
  Description of Artificial Sequence: Synthetic peptide
  Seed: FLTWHRYHLLR (TYRP1_HUMAN)
FTTWHRYHLLR

SEQ ID NO: 174927 - protein, 10 aa, Artificial Sequence
  Description of Artificial Sequence: Synthetic peptide
  Seed: YNMVPFWPPV (TYRP1_HUMAN)
YMMVPFWPPC

SEQ ID NO: 174928 - protein, 11 aa, Artificial Sequence
  Description of Artificial Sequence: Synthetic peptide
  Seed: MLQEPSFSLPY (TYRP1_HUMAN)
MIQEPSFSLPY

SEQ ID NO: 174929 - protein, 10 aa, Artificial Sequence
  Description of Artificial Sequence: Synthetic peptide
  Seed: MLQEPSFSLP (TYRP1_HUMAN)
MLQEPSFSLQ

SEQ ID NO: 174930 - protein, 11 aa, Artificial Sequence
  Description of Artificial Sequence: Synthetic peptide
  Seed: YNMVPFWPPVT (TYRP1_HUMAN)
YQMVPFWPPVM

SEQ ID NO: 174931 - protein, 9 aa, Artificial Sequence
  Description of Artificial Sequence: Synthetic peptide
  Seed: LVALIFGTA (TYRP1_HUMAN)
LVALIFGTV

SEQ ID NO: 174932 - protein, 11 aa, Artificial Sequence
  Description of Artificial Sequence: Synthetic peptide
  Seed: MSAPKLLSLGC (TYRP1_HUMAN)
MSAPKLLSLGW

SEQ ID NO: 174933 - protein, 10 aa, Artificial Sequence
  Description of Artificial Sequence: Synthetic peptide
  Seed: GNVARPMVQR (TYRP1_HUMAN)
GIVARPMVQK

SEQ ID NO: 174934 - protein, 8 aa, Artificial Sequence
  Description of Artificial Sequence: Synthetic peptide
  Seed: IFFPLLLF (TYRP1_HUMAN)
IVFPLLLY

SEQ ID NO: 174935 - protein, 10 aa, Artificial Sequence
  Description of Artificial Sequence: Synthetic peptide
  Seed: RRYNADISTF (TYRP1_HUMAN)
RFYNADISTI

SEQ ID NO: 174936 - protein, 8 aa, Artificial Sequence
  Description of Artificial Sequence: Synthetic peptide
  Seed: FSHEGPAF (TYRP1_HUMAN)
FAHEGPAV

SEQ ID NO: 174937 - protein, 11 aa, Artificial Sequence
  Description of Artificial Sequence: Synthetic peptide
  Seed: RRSMDEANQPL (TYRP1_HUMAN)
RLSMDEANQPV

SEQ ID NO: 174938 - protein, 10 aa, Artificial Sequence
  Description of Artificial Sequence: Synthetic peptide
  Seed: LSPNDPIFVL (TYRP1_HUMAN)
LEPNDPIFVF

SEQ ID NO: 174939 - protein, 9 aa, Artificial Sequence
  Description of Artificial Sequence: Synthetic peptide
  Seed: LLVALIFGT (TYRP1_HUMAN)
LMVALIFGM

SEQ ID NO: 174940 - protein, 9 aa, Artificial Sequence
  Description of Artificial Sequence: Synthetic peptide
  Seed: RNPAGNVAR (TYRP1_HUMAN)
RMPAGNVAR

SEQ ID NO: 174941 - protein, 9 aa, Artificial Sequence
  Description of Artificial Sequence: Synthetic peptide
  Seed: KLQNPNQSV (TYRP1_HUMAN)
KAQNPNQSK

SEQ ID NO: 174942 - protein, 10 aa, Artificial Sequence
  Description of Artificial Sequence: Synthetic peptide
  Seed: FVLLHTFTDA (TYRP1_HUMAN)
FILLHTFTDI

SEQ ID NO: 174943 - protein, 9 aa, Artificial Sequence
  Description of Artificial Sequence: Synthetic peptide
  Seed: YLIRARRSM (TYRP1_HUMAN)
YNIRARRSF

SEQ ID NO: 174944 - protein, 9 aa, Artificial Sequence
  Description of Artificial Sequence: Synthetic peptide
  Seed: HPLFVIATR (TYRP1_HUMAN)
HILFVIATR

SEQ ID NO: 174945 - protein, 8 aa, Artificial Sequence
  Description of Artificial Sequence: Synthetic peptide
  Seed: ACDQRVLI (TYRP1_HUMAN)
AGDQRVLL

SEQ ID NO: 174946 - protein, 10 aa, Artificial Sequence
  Description of Artificial Sequence: Synthetic peptide
  Seed: SPNDPIFVLL (TYRP1_HUMAN)
SINDPIFVLL

SEQ ID NO: 174947 - protein, 9 aa, Artificial Sequence
  Description of Artificial Sequence: Synthetic peptide
  Seed: HYYSVKKTF (TYRP1_HUMAN)
HWYSVKKTL

SEQ ID NO: 174948 - protein, 9 aa, Artificial Sequence
  Description of Artificial Sequence: Synthetic peptide
  Seed: SLPYWNFAT (TYRP1_HUMAN)
SQPYWNFAL

SEQ ID NO: 174949 - protein, 9 aa, Artificial Sequence
  Description of Artificial Sequence: Synthetic peptide
  Seed: FYSNSTNSF (TYRP1_HUMAN)
FKSNSTNSM

SEQ ID NO: 174950 - protein, 9 aa, Artificial Sequence
  Description of Artificial Sequence: Synthetic peptide
  Seed: TTHPLFVIA (TYRP1_HUMAN)
TMHPLFVII

SEQ ID NO: 174951 - protein, 10 aa, Artificial Sequence
  Description of Artificial Sequence: Synthetic peptide
  Seed: TAPDNLGYTY (TYRP1_HUMAN)
TSPDNLGYTW

SEQ ID NO: 174952 - protein, 11 aa, Artificial Sequence
  Description of Artificial Sequence: Synthetic peptide
  Seed: FVLLHTFTDAV (TYRP1_HUMAN)
FALLHTFTDAL

SEQ ID NO: 174953 - protein, 10 aa, Artificial Sequence
  Description of Artificial Sequence: Synthetic peptide
  Seed: TFLGVGQESF (TYRP1_HUMAN)
TMLGVGQESF

SEQ ID NO: 174954 - protein, 10 aa, Artificial Sequence
  Description of Artificial Sequence: Synthetic peptide
  Seed: KRTTHPLFVI (TYRP1_HUMAN)
KSTTHPLFVY

SEQ ID NO: 174955 - protein, 10 aa, Artificial Sequence
  Description of Artificial Sequence: Synthetic peptide
  Seed: YEIQWPSREF (TYRP1_HUMAN)
YLIQWPSREF

SEQ ID NO: 174956 - protein, 9 aa, Artificial Sequence
  Description of Artificial Sequence: Synthetic peptide
  Seed: FSLPYWNFA (TYRP1_HUMAN)
FALPYWNFY

SEQ ID NO: 174957 - protein, 9 aa, Artificial Sequence
  Description of Artificial Sequence: Synthetic peptide
  Seed: LTWHRYHLL (TYRP1_HUMAN)
LNWHRYHLY

SEQ ID NO: 174958 - protein, 9 aa, Artificial Sequence
  Description of Artificial Sequence: Synthetic peptide
  Seed: LHTFTDAVF (TYRP1_HUMAN)
LQTFTDAVW

SEQ ID NO: 174959 - protein, 11 aa, Artificial Sequence
  Description of Artificial Sequence: Synthetic peptide
  Seed: YQCYAEEYEKL (TYRP1_HUMAN)
YWCYAEEYEKF

SEQ ID NO: 174960 - protein, 9 aa, Artificial Sequence
  Description of Artificial Sequence: Synthetic peptide
  Seed: RQYNMVPFW (TYRP1_HUMAN)
RIYNMVPFL

SEQ ID NO: 174961 - protein, 10 aa, Artificial Sequence
  Description of Artificial Sequence: Synthetic peptide
  Seed: STLISPNSVF (TYRP1_HUMAN)
SWLISPNSVY

SEQ ID NO: 174962 - protein, 9 aa, Artificial Sequence
  Description of Artificial Sequence: Synthetic peptide
  Seed: YTYEIQWPS (TYRP1_HUMAN)
YIYEIQWPS

SEQ ID NO: 174963 - protein, 11 aa, Artificial Sequence
  Description of Artificial Sequence: Synthetic peptide
  Seed: REFSVPEIIAI (TYRP1_HUMAN)
RVFSVPEIIAF

SEQ ID NO: 174964 - protein, 11 aa, Artificial Sequence
  Description of Artificial Sequence: Synthetic peptide
  Seed: YNMVPFWPPVT (TYRP1_HUMAN)
YIMVPFWPPVY

SEQ ID NO: 174965 - protein, 9 aa, Artificial Sequence
  Description of Artificial Sequence: Synthetic peptide
  Seed: RGRCEAVTA (TYRP1_HUMAN)
RIRCEAVTA

SEQ ID NO: 174966 - protein, 9 aa, Artificial Sequence
  Description of Artificial Sequence: Synthetic peptide
  Seed: EIQWPSREF (TYRP1_HUMAN)
ELQWPSRER

SEQ ID NO: 174967 - protein, 10 aa, Artificial Sequence
  Description of Artificial Sequence: Synthetic peptide
  Seed: IAVVGALLLV (TYRP1_HUMAN)
ITVVGALLLV

SEQ ID NO: 174968 - protein, 9 aa, Artificial Sequence
  Description of Artificial Sequence: Synthetic peptide
  Seed: PNDPIFVLL (TYRP1_HUMAN)
PFDPIFVLL

SEQ ID NO: 174969 - protein, 9 aa, Artificial Sequence
  Description of Artificial Sequence: Synthetic peptide
  Seed: NYFVWTHYY (TYRP1_HUMAN)
NFFVWTHYW

SEQ ID NO: 174970 - protein, 10 aa, Artificial Sequence
  Description of Artificial Sequence: Synthetic peptide
  Seed: FTDAVFDEWL (TYRP1_HUMAN)
FIDAVFDEWY

SEQ ID NO: 174971 - protein, 10 aa, Artificial Sequence
  Description of Artificial Sequence: Synthetic peptide
  Seed: NYFVWTHYYS (TYRP1_HUMAN)
NNFVWTHYYY

SEQ ID NO: 174972 - protein, 9 aa, Artificial Sequence
  Description of Artificial Sequence: Synthetic peptide
  Seed: MAKRTTHPL (TYRP1_HUMAN)
MQKRTTHPM

SEQ ID NO: 174973 - protein, 10 aa, Artificial Sequence
  Description of Artificial Sequence: Synthetic peptide
  Seed: STLISPNSVF (TYRP1_HUMAN)
SPLISPNSVY

SEQ ID NO: 174974 - protein, 9 aa, Artificial Sequence
  Description of Artificial Sequence: Synthetic peptide
  Seed: LFQQARAQF (TYRP1_HUMAN)
LKQQARAQF

SEQ ID NO: 174975 - protein, 10 aa, Artificial Sequence
  Description of Artificial Sequence: Synthetic peptide
  Seed: AVVGALLLVA (TYRP1_HUMAN)
AQVGALLLVI

SEQ ID NO: 174976 - protein, 9 aa, Artificial Sequence
  Description of Artificial Sequence: Synthetic peptide
  Seed: MSAPKLLSL (TYRP1_HUMAN)
MEAPKLLSY

SEQ ID NO: 174977 - protein, 9 aa, Artificial Sequence
  Description of Artificial Sequence: Synthetic peptide
  Seed: AQFPRQCAT (TYRP1_HUMAN)
ASFPRQCAY

SEQ ID NO: 174978 - protein, 10 aa, Artificial Sequence
  Description of Artificial Sequence: Synthetic peptide
  Seed: FSLPYWNFAT (TYRP1_HUMAN)
FYLPYWNFAM

SEQ ID NO: 174979 - protein, 10 aa, Artificial Sequence
  Description of Artificial Sequence: Synthetic peptide
  Seed: FYSNSTNSFR (TYRP1_HUMAN)
FYSNSTNSFW

SEQ ID NO: 174980 - protein, 9 aa, Artificial Sequence
  Description of Artificial Sequence: Synthetic peptide
  Seed: NISIYNYFV (TYRP1_HUMAN)
NASIYNYFV

SEQ ID NO: 174981 - protein, 9 aa, Artificial Sequence
  Description of Artificial Sequence: Synthetic peptide
  Seed: TLISPNSVF (TYRP1_HUMAN)
TFISPNSVY

SEQ ID NO: 174982 - protein, 9 aa, Artificial Sequence
  Description of Artificial Sequence: Synthetic peptide
  Seed: TASYLIRAR (TYRP1_HUMAN)
TFSYLIRAR

SEQ ID NO: 174983 - protein, 9 aa, Artificial Sequence
  Description of Artificial Sequence: Synthetic peptide
  Seed: SPVSGPGTD (TYRP1_HUMAN)
SPVSGPGTA

SEQ ID NO: 174984 - protein, 9 aa, Artificial Sequence
  Description of Artificial Sequence: Synthetic peptide
  Seed: NYFVWTHYY (TYRP1_HUMAN)
NSFVWTHYR

SEQ ID NO: 174985 - protein, 9 aa, Artificial Sequence
  Description of Artificial Sequence: Synthetic peptide
  Seed: SLGCIFFPL (TYRP1_HUMAN)
SMGCIFFPR

SEQ ID NO: 174986 - protein, 10 aa, Artificial Sequence
  Description of Artificial Sequence: Synthetic peptide
  Seed: LLHTFTDAVF (TYRP1_HUMAN)
LEHTFTDAVY

SEQ ID NO: 174987 - protein, 10 aa, Artificial Sequence
  Description of Artificial Sequence: Synthetic peptide
  Seed: TASYLIRARR (TYRP1_HUMAN)
TASYLIRARK

SEQ ID NO: 174988 - protein, 10 aa, Artificial Sequence
  Description of Artificial Sequence: Synthetic peptide
  Seed: NYFVWTHYYS (TYRP1_HUMAN)
NFFVWTHYYH

SEQ ID NO: 174989 - protein, 10 aa, Artificial Sequence
  Description of Artificial Sequence: Synthetic peptide
  Seed: NTVEGYSDPT (TYRP1_HUMAN)
NTVEGYSDPV

SEQ ID NO: 174990 - protein, 10 aa, Artificial Sequence
  Description of Artificial Sequence: Synthetic peptide
  Seed: RYNADISTFP (TYRP1_HUMAN)
RWNADISTFI

SEQ ID NO: 174991 - protein, 10 aa, Artificial Sequence
  Description of Artificial Sequence: Synthetic peptide
  Seed: STLISPNSVF (TYRP1_HUMAN)
SQLISPNSVF

SEQ ID NO: 174992 - protein, 9 aa, Artificial Sequence
  Description of Artificial Sequence: Synthetic peptide
  Seed: LGYTYEIQW (TYRP1_HUMAN)
LSYTYEIQW

SEQ ID NO: 174993 - protein, 9 aa, Artificial Sequence
  Description of Artificial Sequence: Synthetic peptide
  Seed: RQCATVEAL (TYRP1_HUMAN)
RVCATVEAW

SEQ ID NO: 174994 - protein, 9 aa, Artificial Sequence
  Description of Artificial Sequence: Synthetic peptide
  Seed: FTDAVFDEW (TYRP1_HUMAN)
FADAVFDEY

SEQ ID NO: 174995 - protein, 9 aa, Artificial Sequence
  Description of Artificial Sequence: Synthetic peptide
  Seed: YTYEIQWPS (TYRP1_HUMAN)
YYYEIQWPR

SEQ ID NO: 174996 - protein, 10 aa, Artificial Sequence
  Description of Artificial Sequence: Synthetic peptide
  Seed: RSMDEANQPL (TYRP1_HUMAN)
RHMDEANQPI

SEQ ID NO: 174997 - protein, 9 aa, Artificial Sequence
  Description of Artificial Sequence: Synthetic peptide
  Seed: MSAPKLLSL (TYRP1_HUMAN)
MFAPKLLSI

SEQ ID NO: 174998 - protein, 8 aa, Artificial Sequence
  Description of Artificial Sequence: Synthetic peptide
  Seed: YSNSTNSF (TYRP1_HUMAN)
YMNSTNSY

SEQ ID NO: 174999 - protein, 9 aa, Artificial Sequence
  Description of Artificial Sequence: Synthetic peptide
  Seed: YYSVKKTFL (TYRP1_HUMAN)
YSSVKKTFF

SEQ ID NO: 175000 - protein, 9 aa, Artificial Sequence
  Description of Artificial Sequence: Synthetic peptide
  Seed: RYHLLRLEK (TYRP1_HUMAN)
RSHLLRLES

SEQ ID NO: 175001 - protein, 10 aa, Artificial Sequence
  Description of Artificial Sequence: Synthetic peptide
  Seed: SLGCIFFPLL (TYRP1_HUMAN)
SVGCIFFPLV

SEQ ID NO: 175002 - protein, 9 aa, Artificial Sequence
  Description of Artificial Sequence: Synthetic peptide
  Seed: YTYEIQWPS (TYRP1_HUMAN)
YAYEIQWPA

SEQ ID NO: 175003 - protein, 9 aa, Artificial Sequence
  Description of Artificial Sequence: Synthetic peptide
  Seed: LTWHRYHLL (TYRP1_HUMAN)
LMWHRYHLC

SEQ ID NO: 175004 - protein, 11 aa, Artificial Sequence
  Description of Artificial Sequence: Synthetic peptide
  Seed: FSHEGPAFLTW (TYRP1_HUMAN)
FTHEGPAFLTW

SEQ ID NO: 175005 - protein, 10 aa, Artificial Sequence
  Description of Artificial Sequence: Synthetic peptide
  Seed: YNMVPFWPPV (TYRP1_HUMAN)
YLMVPFWPPI

SEQ ID NO: 175006 - protein, 10 aa, Artificial Sequence
  Description of Artificial Sequence: Synthetic peptide
  Seed: YNYFVWTHYY (TYRP1_HUMAN)
YDYFVWTHYL

SEQ ID NO: 175007 - protein, 10 aa, Artificial Sequence
  Description of Artificial Sequence: Synthetic peptide
  Seed: EMLQEPSFSL (TYRP1_HUMAN)
EILQEPSFSV

SEQ ID NO: 175008 - protein, 10 aa, Artificial Sequence
  Description of Artificial Sequence: Synthetic peptide
  Seed: FQQARAQFPR (TYRP1_HUMAN)
FWQARAQFPR

SEQ ID NO: 175009 - protein, 9 aa, Artificial Sequence
  Description of Artificial Sequence: Synthetic peptide
  Seed: YTYEIQWPS (TYRP1_HUMAN)
YMYEIQWPR

SEQ ID NO: 175010 - protein, 10 aa, Artificial Sequence
  Description of Artificial Sequence: Synthetic peptide
  Seed: IAVVGALLLV (TYRP1_HUMAN)
ILVVGALLLL

SEQ ID NO: 175011 - protein, 9 aa, Artificial Sequence
  Description of Artificial Sequence: Synthetic peptide
  Seed: AVFDEWLRR (TYRP1_HUMAN)
AMFDEWLRR

SEQ ID NO: 175012 - protein, 9 aa, Artificial Sequence
  Description of Artificial Sequence: Synthetic peptide
  Seed: AIAVVGALL (TYRP1_HUMAN)
ALAVVGALL

SEQ ID NO: 175013 - protein, 9 aa, Artificial Sequence
  Description of Artificial Sequence: Synthetic peptide
  Seed: LTDQYQCYA (TYRP1_HUMAN)
LSDQYQCYV

SEQ ID NO: 175014 - protein, 9 aa, Artificial Sequence
  Description of Artificial Sequence: Synthetic peptide
  Seed: RYHLLRLEK (TYRP1_HUMAN)
RYHLLRLER

SEQ ID NO: 175015 - protein, 9 aa, Artificial Sequence
  Description of Artificial Sequence: Synthetic peptide
  Seed: IAIAVVGAL (TYRP1_HUMAN)
IRIAVVGAF

SEQ ID NO: 175016 - protein, 8 aa, Artificial Sequence
  Description of Artificial Sequence: Synthetic peptide
  Seed: ADISTFPL (TYRP1_HUMAN)
AEISTFPI

SEQ ID NO: 175017 - protein, 10 aa, Artificial Sequence
  Description of Artificial Sequence: Synthetic peptide
  Seed: WPLRFFNRTC (TYRP1_HUMAN)
WPLRFFNRTL

SEQ ID NO: 175018 - protein, 9 aa, Artificial Sequence
  Description of Artificial Sequence: Synthetic peptide
  Seed: QEPSFSLPY (TYRP1_HUMAN)
QQPSFSLPY

SEQ ID NO: 175019 - protein, 10 aa, Artificial Sequence
  Description of Artificial Sequence: Synthetic peptide
  Seed: ISPNSVFSQW (TYRP1_HUMAN)
ICPNSVFSQW

SEQ ID NO: 175020 - protein, 9 aa, Artificial Sequence
  Description of Artificial Sequence: Synthetic peptide
  Seed: AQFPRQCAT (TYRP1_HUMAN)
ANFPRQCAY

SEQ ID NO: 175021 - protein, 11 aa, Artificial Sequence
  Description of Artificial Sequence: Synthetic peptide
  Seed: MAKRTTHPLFV (TYRP1_HUMAN)
MVKRTTHPLFK

SEQ ID NO: 175022 - protein, 9 aa, Artificial Sequence
  Description of Artificial Sequence: Synthetic peptide
  Seed: SFSLPYWNF (TYRP1_HUMAN)
SVSLPYWNY

SEQ ID NO: 175023 - protein, 9 aa, Artificial Sequence
  Description of Artificial Sequence: Synthetic peptide
  Seed: HPLFVIATR (TYRP1_HUMAN)
HTLFVIATR

SEQ ID NO: 175024 - protein, 9 aa, Artificial Sequence
  Description of Artificial Sequence: Synthetic peptide
  Seed: RGRCEAVTA (TYRP1_HUMAN)
RSRCEAVTA

SEQ ID NO: 175025 - protein, 10 aa, Artificial Sequence
  Description of Artificial Sequence: Synthetic peptide
  Seed: VGLFDTPPFY (TYRP1_HUMAN)
VSLFDTPPFK

SEQ ID NO: 175026 - protein, 11 aa, Artificial Sequence
  Description of Artificial Sequence: Synthetic peptide
  Seed: LQEPSFSLPYW (TYRP1_HUMAN)
LAEPSFSLPYW

SEQ ID NO: 175027 - protein, 10 aa, Artificial Sequence
  Description of Artificial Sequence: Synthetic peptide
  Seed: LPYWNFATGK (TYRP1_HUMAN)
LIYWNFATGK

SEQ ID NO: 175028 - protein, 10 aa, Artificial Sequence
  Description of Artificial Sequence: Synthetic peptide
  Seed: NLAHLFLNGT (TYRP1_HUMAN)
NMAHLFLNGV

SEQ ID NO: 175029 - protein, 9 aa, Artificial Sequence
  Description of Artificial Sequence: Synthetic peptide
  Seed: VDFSHEGPA (TYRP1_HUMAN)
VEFSHEGPI

SEQ ID NO: 175030 - protein, 10 aa, Artificial Sequence
  Description of Artificial Sequence: Synthetic peptide
  Seed: KYDPAVRSLH (TYRP1_HUMAN)
KMDPAVRSLY

SEQ ID NO: 175031 - protein, 9 aa, Artificial Sequence
  Description of Artificial Sequence: Synthetic peptide
  Seed: SIYNYFVWT (TYRP1_HUMAN)
SQYNYFVWV

SEQ ID NO: 175032 - protein, 8 aa, Artificial Sequence
  Description of Artificial Sequence: Synthetic peptide
  Seed: YSDPTGKY (TYRP1_HUMAN)
YWDPTGKL

SEQ ID NO: 175033 - protein, 10 aa, Artificial Sequence
  Description of Artificial Sequence: Synthetic peptide
  Seed: IQWPSREFSV (TYRP1_HUMAN)
IIWPSREFSV

SEQ ID NO: 175034 - protein, 9 aa, Artificial Sequence
  Description of Artificial Sequence: Synthetic peptide
  Seed: ISIYNYFVW (TYRP1_HUMAN)
IKIYNYFVI

SEQ ID NO: 175035 - protein, 9 aa, Artificial Sequence
  Description of Artificial Sequence: Synthetic peptide
  Seed: AVVGALLLV (TYRP1_HUMAN)
AQVGALLLV

SEQ ID NO: 175036 - protein, 10 aa, Artificial Sequence
  Description of Artificial Sequence: Synthetic peptide
  Seed: FQQARAQFPR (TYRP1_HUMAN)
FVQARAQFPK

SEQ ID NO: 175037 - protein, 9 aa, Artificial Sequence
  Description of Artificial Sequence: Synthetic peptide
  Seed: FSVPEIIAI (TYRP1_HUMAN)
FFVPEIIAV

SEQ ID NO: 175038 - protein, 8 aa, Artificial Sequence
  Description of Artificial Sequence: Synthetic peptide
  Seed: YSDPTGKY (TYRP1_HUMAN)
YGDPTGKM

SEQ ID NO: 175039 - protein, 9 aa, Artificial Sequence
  Description of Artificial Sequence: Synthetic peptide
  Seed: MAKRTTHPL (TYRP1_HUMAN)
MFKRTTHPA

SEQ ID NO: 175040 - protein, 9 aa, Artificial Sequence
  Description of Artificial Sequence: Synthetic peptide
  Seed: AQFPRQCAT (TYRP1_HUMAN)
AQFPRQCAI

SEQ ID NO: 175041 - protein, 9 aa, Artificial Sequence
  Description of Artificial Sequence: Synthetic peptide
  Seed: RAQFPRQCA (TYRP1_HUMAN)
RMQFPRQCA

SEQ ID NO: 175042 - protein, 9 aa, Artificial Sequence
  Description of Artificial Sequence: Synthetic peptide
  Seed: RFFNRTCHC (TYRP1_HUMAN)
RVFNRTCHS

SEQ ID NO: 175043 - protein, 9 aa, Artificial Sequence
  Description of Artificial Sequence: Synthetic peptide
  Seed: QWPSREFSV (TYRP1_HUMAN)
QYPSREFSI

SEQ ID NO: 175044 - protein, 9 aa, Artificial Sequence
  Description of Artificial Sequence: Synthetic peptide
  Seed: DSLEDYDTL (TYRP1_HUMAN)
DTLEDYDTY

SEQ ID NO: 175045 - protein, 9 aa, Artificial Sequence
  Description of Artificial Sequence: Synthetic peptide
  Seed: KYDPAVRSL (TYRP1_HUMAN)
KHDPAVRSY

SEQ ID NO: 175046 - protein, 10 aa, Artificial Sequence
  Description of Artificial Sequence: Synthetic peptide
  Seed: TEDGPIRRNP (TYRP1_HUMAN)
TEDGPIRRNA

SEQ ID NO: 175047 - protein, 9 aa, Artificial Sequence
  Description of Artificial Sequence: Synthetic peptide
  Seed: GLFDTPPFY (TYRP1_HUMAN)
GLFDTPPFF

SEQ ID NO: 175048 - protein, 9 aa, Artificial Sequence
  Description of Artificial Sequence: Synthetic peptide
  Seed: EGYSDPTGK (TYRP1_HUMAN)
ELYSDPTGK

SEQ ID NO: 175049 - protein, 9 aa, Artificial Sequence
  Description of Artificial Sequence: Synthetic peptide
  Seed: LQNPNQSVV (TYRP1_HUMAN)
LRNPNQSVL

SEQ ID NO: 175050 - protein, 10 aa, Artificial Sequence
  Description of Artificial Sequence: Synthetic peptide
  Seed: HLSPNDPIFV (TYRP1_HUMAN)
HMSPNDPIFL

SEQ ID NO: 175051 - protein, 9 aa, Artificial Sequence
  Description of Artificial Sequence: Synthetic peptide
  Seed: LHNLAHLFL (TYRP1_HUMAN)
LQNLAHLFL

SEQ ID NO: 175052 - protein, 9 aa, Artificial Sequence
  Description of Artificial Sequence: Synthetic peptide
  Seed: EGYSDPTGK (TYRP1_HUMAN)
EMYSDPTGR

SEQ ID NO: 175053 - protein, 10 aa, Artificial Sequence
  Description of Artificial Sequence: Synthetic peptide
  Seed: NSFRNTVEGY (TYRP1_HUMAN)
NTFRNTVEGW

SEQ ID NO: 175054 - protein, 9 aa, Artificial Sequence
  Description of Artificial Sequence: Synthetic peptide
  Seed: TPQFENISI (TYRP1_HUMAN)
TAQFENISF

SEQ ID NO: 175055 - protein, 10 aa, Artificial Sequence
  Description of Artificial Sequence: Synthetic peptide
  Seed: FVTAPDNLGY (TYRP1_HUMAN)
FYTAPDNLGF

SEQ ID NO: 175056 - protein, 10 aa, Artificial Sequence
  Description of Artificial Sequence: Synthetic peptide
  Seed: FVWTHYYSVK (TYRP1_HUMAN)
FIWTHYYSVI

SEQ ID NO: 175057 - protein, 11 aa, Artificial Sequence
  Description of Artificial Sequence: Synthetic peptide
  Seed: GYTYEIQWPSR (TYRP1_HUMAN)
GRTYEIQWPSR

SEQ ID NO: 175058 - protein, 10 aa, Artificial Sequence
  Description of Artificial Sequence: Synthetic peptide
  Seed: YNADISTFPL (TYRP1_HUMAN)
YQADISTFPI

SEQ ID NO: 175059 - protein, 9 aa, Artificial Sequence
  Description of Artificial Sequence: Synthetic peptide
  Seed: SRSNFDSTL (TYRP1_HUMAN)
SQSNFDSTL

SEQ ID NO: 175060 - protein, 9 aa, Artificial Sequence
  Description of Artificial Sequence: Synthetic peptide
  Seed: DNLGYTYEI (TYRP1_HUMAN)
DVLGYTYEA

SEQ ID NO: 175061 - protein, 10 aa, Artificial Sequence
  Description of Artificial Sequence: Synthetic peptide
  Seed: GLFDTPPFYS (TYRP1_HUMAN)
GAFDTPPFYL

SEQ ID NO: 175062 - protein, 8 aa, Artificial Sequence
  Description of Artificial Sequence: Synthetic peptide
  Seed: ACDQRVLI (TYRP1_HUMAN)
AYDQRVLF

SEQ ID NO: 175063 - protein, 9 aa, Artificial Sequence
  Description of Artificial Sequence: Synthetic peptide
  Seed: FLTWHRYHL (TYRP1_HUMAN)
FSTWHRYHL

SEQ ID NO: 175064 - protein, 10 aa, Artificial Sequence
  Description of Artificial Sequence: Synthetic peptide
  Seed: EVWPLRFFNR (TYRP1_HUMAN)
EHWPLRFFNR

SEQ ID NO: 175065 - protein, 10 aa, Artificial Sequence
  Description of Artificial Sequence: Synthetic peptide
  Seed: FQQARAQFPR (TYRP1_HUMAN)
FHQARAQFPR

SEQ ID NO: 175066 - protein, 10 aa, Artificial Sequence
  Description of Artificial Sequence: Synthetic peptide
  Seed: LQEPSFSLPY (TYRP1_HUMAN)
LSEPSFSLPY

SEQ ID NO: 175067 - protein, 10 aa, Artificial Sequence
  Description of Artificial Sequence: Synthetic peptide
  Seed: KRTTHPLFVI (TYRP1_HUMAN)
KKTTHPLFVF

SEQ ID NO: 175068 - protein, 9 aa, Artificial Sequence
  Description of Artificial Sequence: Synthetic peptide
  Seed: RSNFDSTLI (TYRP1_HUMAN)
RMNFDSTLW

SEQ ID NO: 175069 - protein, 10 aa, Artificial Sequence
  Description of Artificial Sequence: Synthetic peptide
  Seed: KLLSLGCIFF (TYRP1_HUMAN)
KLLSLGCIFV

SEQ ID NO: 175070 - protein, 9 aa, Artificial Sequence
  Description of Artificial Sequence: Synthetic peptide
  Seed: TLISPNSVF (TYRP1_HUMAN)
TTISPNSVL

SEQ ID NO: 175071 - protein, 9 aa, Artificial Sequence
  Description of Artificial Sequence: Synthetic peptide
  Seed: RSLHNLAHL (TYRP1_HUMAN)
RLLHNLAHF

SEQ ID NO: 175072 - protein, 9 aa, Artificial Sequence
  Description of Artificial Sequence: Synthetic peptide
  Seed: YLIRARRSM (TYRP1_HUMAN)
YYIRARRSW

SEQ ID NO: 175073 - protein, 11 aa, Artificial Sequence
  Description of Artificial Sequence: Synthetic peptide
  Seed: RLPEPQDVAQC (TYRP1_HUMAN)
RLPEPQDVAQV

SEQ ID NO: 175074 - protein, 10 aa, Artificial Sequence
  Description of Artificial Sequence: Synthetic peptide
  Seed: NSFRNTVEGY (TYRP1_HUMAN)
NMFRNTVEGY

SEQ ID NO: 175075 - protein, 10 aa, Artificial Sequence
  Description of Artificial Sequence: Synthetic peptide
  Seed: FQQARAQFPR (TYRP1_HUMAN)
FLQARAQFPR

SEQ ID NO: 175076 - protein, 9 aa, Artificial Sequence
  Description of Artificial Sequence: Synthetic peptide
  Seed: RQYNMVPFW (TYRP1_HUMAN)
RRYNMVPFS

SEQ ID NO: 175077 - protein, 10 aa, Artificial Sequence
  Description of Artificial Sequence: Synthetic peptide
  Seed: YNMVPFWPPV (TYRP1_HUMAN)
YDMVPFWPPV

SEQ ID NO: 175078 - protein, 9 aa, Artificial Sequence
  Description of Artificial Sequence: Synthetic peptide
  Seed: DREVWPLRF (TYRP1_HUMAN)
DHEVWPLRL

SEQ ID NO: 175079 - protein, 9 aa, Artificial Sequence
  Description of Artificial Sequence: Synthetic peptide
  Seed: KYDPAVRSL (TYRP1_HUMAN)
KQDPAVRSW

SEQ ID NO: 175080 - protein, 11 aa, Artificial Sequence
  Description of Artificial Sequence: Synthetic peptide
  Seed: RSMDEANQPLL (TYRP1_HUMAN)
RAMDEANQPLF

SEQ ID NO: 175081 - protein, 9 aa, Artificial Sequence
  Description of Artificial Sequence: Synthetic peptide
  Seed: KYDPAVRSL (TYRP1_HUMAN)
KTDPAVRSW

SEQ ID NO: 175082 - protein, 11 aa, Artificial Sequence
  Description of Artificial Sequence: Synthetic peptide
  Seed: RRYNADISTFP (TYRP1_HUMAN)
RYYNADISTFC

SEQ ID NO: 175083 - protein, 10 aa, Artificial Sequence
  Description of Artificial Sequence: Synthetic peptide
  Seed: FLNGTGGQTH (TYRP1_HUMAN)
FANGTGGQTH

SEQ ID NO: 175084 - protein, 10 aa, Artificial Sequence
  Description of Artificial Sequence: Synthetic peptide
  Seed: SRSNFDSTLI (TYRP1_HUMAN)
SRSNFDSTLF

SEQ ID NO: 175085 - protein, 9 aa, Artificial Sequence
  Description of Artificial Sequence: Synthetic peptide
  Seed: SLHNLAHLF (TYRP1_HUMAN)
SVHNLAHLL

SEQ ID NO: 175086 - protein, 10 aa, Artificial Sequence
  Description of Artificial Sequence: Synthetic peptide
  Seed: YNMVPFWPPV (TYRP1_HUMAN)
YHMVPFWPPL

SEQ ID NO: 175087 - protein, 11 aa, Artificial Sequence
  Description of Artificial Sequence: Synthetic peptide
  Seed: YNMVPFWPPVT (TYRP1_HUMAN)
YIMVPFWPPVG

SEQ ID NO: 175088 - protein, 10 aa, Artificial Sequence
  Description of Artificial Sequence: Synthetic peptide
  Seed: FWPPVTNTEM (TYRP1_HUMAN)
FFPPVTNTEM

SEQ ID NO: 175089 - protein, 10 aa, Artificial Sequence
  Description of Artificial Sequence: Synthetic peptide
  Seed: SMDEANQPLL (TYRP1_HUMAN)
SIDEANQPLL

SEQ ID NO: 175090 - protein, 9 aa, Artificial Sequence
  Description of Artificial Sequence: Synthetic peptide
  Seed: LFQQARAQF (TYRP1_HUMAN)
LFQQARAQW

SEQ ID NO: 175091 - protein, 11 aa, Artificial Sequence
  Description of Artificial Sequence: Synthetic peptide
  Seed: VALIFGTASYL (TYRP1_HUMAN)
VFLIFGTASYV

SEQ ID NO: 175092 - protein, 9 aa, Artificial Sequence
  Description of Artificial Sequence: Synthetic peptide
  Seed: LSKEEKNHF (TYRP1_HUMAN)
LVKEEKNHW

SEQ ID NO: 175093 - protein, 10 aa, Artificial Sequence
  Description of Artificial Sequence: Synthetic peptide
  Seed: EMLQEPSFSL (TYRP1_HUMAN)
EILQEPSFSL

SEQ ID NO: 175094 - protein, 9 aa, Artificial Sequence
  Description of Artificial Sequence: Synthetic peptide
  Seed: IAVVGALLL (TYRP1_HUMAN)
IRVVGALLL

SEQ ID NO: 175095 - protein, 10 aa, Artificial Sequence
  Description of Artificial Sequence: Synthetic peptide
  Seed: NYFVWTHYYS (TYRP1_HUMAN)
NIFVWTHYYY

SEQ ID NO: 175096 - protein, 9 aa, Artificial Sequence
  Description of Artificial Sequence: Synthetic peptide
  Seed: RVLIVRRNL (TYRP1_HUMAN)
RMLIVRRNF

SEQ ID NO: 175097 - protein, 8 aa, Artificial Sequence
  Description of Artificial Sequence: Synthetic peptide
  Seed: LIFGTASY (TYRP1_HUMAN)
LQFGTASL

SEQ ID NO: 175098 - protein, 10 aa, Artificial Sequence
  Description of Artificial Sequence: Synthetic peptide
  Seed: RSLHNLAHLF (TYRP1_HUMAN)
RLLHNLAHLF

SEQ ID NO: 175099 - protein, 10 aa, Artificial Sequence
  Description of Artificial Sequence: Synthetic peptide
  Seed: MVPFWPPVTN (TYRP1_HUMAN)
MDPFWPPVTM

SEQ ID NO: 175100 - protein, 10 aa, Artificial Sequence
  Description of Artificial Sequence: Synthetic peptide
  Seed: RRYNADISTF (TYRP1_HUMAN)
RWYNADISTL

SEQ ID NO: 175101 - protein, 9 aa, Artificial Sequence
  Description of Artificial Sequence: Synthetic peptide
  Seed: VLIVRRNLL (TYRP1_HUMAN)
VYIVRRNLL

SEQ ID NO: 175102 - protein, 9 aa, Artificial Sequence
  Description of Artificial Sequence: Synthetic peptide
  Seed: YLIRARRSM (TYRP1_HUMAN)
YVIRARRSL

SEQ ID NO: 175103 - protein, 10 aa, Artificial Sequence
  Description of Artificial Sequence: Synthetic peptide
  Seed: GKYDPAVRSL (TYRP1_HUMAN)
GSYDPAVRSF

SEQ ID NO: 175104 - protein, 10 aa, Artificial Sequence
  Description of Artificial Sequence: Synthetic peptide
  Seed: VGLFDTPPFY (TYRP1_HUMAN)
VTLFDTPPFY

SEQ ID NO: 175105 - protein, 8 aa, Artificial Sequence
  Description of Artificial Sequence: Synthetic peptide
  Seed: YSDPTGKY (TYRP1_HUMAN)
YFDPTGKI

SEQ ID NO: 175106 - protein, 10 aa, Artificial Sequence
  Description of Artificial Sequence: Synthetic peptide
  Seed: ISPNSVFSQW (TYRP1_HUMAN)
IAPNSVFSQW

SEQ ID NO: 175107 - protein, 9 aa, Artificial Sequence
  Description of Artificial Sequence: Synthetic peptide
  Seed: ISIYNYFVW (TYRP1_HUMAN)
IRIYNYFVY

SEQ ID NO: 175108 - protein, 10 aa, Artificial Sequence
  Description of Artificial Sequence: Synthetic peptide
  Seed: YNMVPFWPPV (TYRP1_HUMAN)
YLMVPFWPPT

SEQ ID NO: 175109 - protein, 9 aa, Artificial Sequence
  Description of Artificial Sequence: Synthetic peptide
  Seed: NMVPFWPPV (TYRP1_HUMAN)
NTVPFWPPM

SEQ ID NO: 175110 - protein, 9 aa, Artificial Sequence
  Description of Artificial Sequence: Synthetic peptide
  Seed: YLIRARRSM (TYRP1_HUMAN)
YSIRARRSI

SEQ ID NO: 175111 - protein, 9 aa, Artificial Sequence
  Description of Artificial Sequence: Synthetic peptide
  Seed: TADSRPHSP (TYRP1_HUMAN)
TCDSRPHSI

SEQ ID NO: 175112 - protein, 10 aa, Artificial Sequence
  Description of Artificial Sequence: Synthetic peptide
  Seed: LSLGCIFFPL (TYRP1_HUMAN)
LELGCIFFPL

SEQ ID NO: 175113 - protein, 9 aa, Artificial Sequence
  Description of Artificial Sequence: Synthetic peptide
  Seed: SLGCIFFPL (TYRP1_HUMAN)
SIGCIFFPR

SEQ ID NO: 175114 - protein, 9 aa, Artificial Sequence
  Description of Artificial Sequence: Synthetic peptide
  Seed: SVFSQWRVV (TYRP1_HUMAN)
SIFSQWRVW

SEQ ID NO: 175115 - protein, 11 aa, Artificial Sequence
  Description of Artificial Sequence: Synthetic peptide
  Seed: RSMDEANQPLL (TYRP1_HUMAN)
RTMDEANQPLY

SEQ ID NO: 175116 - protein, 9 aa, Artificial Sequence
  Description of Artificial Sequence: Synthetic peptide
  Seed: SPNSVFSQW (TYRP1_HUMAN)
SPNSVFSQL

SEQ ID NO: 175117 - protein, 8 aa, Artificial Sequence
  Description of Artificial Sequence: Synthetic peptide
  Seed: YSDPTGKY (TYRP1_HUMAN)
YSDPTGKI

SEQ ID NO: 175118 - protein, 9 aa, Artificial Sequence
  Description of Artificial Sequence: Synthetic peptide
  Seed: LIFGTASYL (TYRP1_HUMAN)
LMFGTASYV

SEQ ID NO: 175119 - protein, 9 aa, Artificial Sequence
  Description of Artificial Sequence: Synthetic peptide
  Seed: MLQEPSFSL (TYRP1_HUMAN)
MIQEPSFSM

SEQ ID NO: 175120 - protein, 9 aa, Artificial Sequence
  Description of Artificial Sequence: Synthetic peptide
  Seed: HPLFVIATR (TYRP1_HUMAN)
HVLFVIATR

SEQ ID NO: 175121 - protein, 10 aa, Artificial Sequence
  Description of Artificial Sequence: Synthetic peptide
  Seed: LLFQQARAQF (TYRP1_HUMAN)
LWFQQARAQF

SEQ ID NO: 175122 - protein, 10 aa, Artificial Sequence
  Description of Artificial Sequence: Synthetic peptide
  Seed: MVPFWPPVTN (TYRP1_HUMAN)
MPPFWPPVTM

SEQ ID NO: 175123 - protein, 10 aa, Artificial Sequence
  Description of Artificial Sequence: Synthetic peptide
  Seed: LSLGCIFFPL (TYRP1_HUMAN)
LFLGCIFFPL

SEQ ID NO: 175124 - protein, 9 aa, Artificial Sequence
  Description of Artificial Sequence: Synthetic peptide
  Seed: LIFGTASYL (TYRP1_HUMAN)
LTFGTASYL

SEQ ID NO: 175125 - protein, 9 aa, Artificial Sequence
  Description of Artificial Sequence: Synthetic peptide
  Seed: YNYFVWTHY (TYRP1_HUMAN)
YSYFVWTHF

SEQ ID NO: 175126 - protein, 10 aa, Artificial Sequence
  Description of Artificial Sequence: Synthetic peptide
  Seed: HNRQYNMVPF (TYRP1_HUMAN)
HARQYNMVPY

SEQ ID NO: 175127 - protein, 9 aa, Artificial Sequence
  Description of Artificial Sequence: Synthetic peptide
  Seed: FSHEGPAFL (TYRP1_HUMAN)
FTHEGPAFI

SEQ ID NO: 175128 - protein, 11 aa, Artificial Sequence
  Description of Artificial Sequence: Synthetic peptide
  Seed: YNYFVWTHYYS (TYRP1_HUMAN)
YYYFVWTHYYY

SEQ ID NO: 175129 - protein, 10 aa, Artificial Sequence
  Description of Artificial Sequence: Synthetic peptide
  Seed: FSLPYWNFAT (TYRP1_HUMAN)
FFLPYWNFAM

SEQ ID NO: 175130 - protein, 10 aa, Artificial Sequence
  Description of Artificial Sequence: Synthetic peptide
  Seed: KLLSLGCIFF (TYRP1_HUMAN)
KMLSLGCIFL

SEQ ID NO: 175131 - protein, 9 aa, Artificial Sequence
  Description of Artificial Sequence: Synthetic peptide
  Seed: LFDTPPFYS (TYRP1_HUMAN)
LYDTPPFYM

SEQ ID NO: 175132 - protein, 9 aa, Artificial Sequence
  Description of Artificial Sequence: Synthetic peptide
  Seed: NHFVRALDM (TYRP1_HUMAN)
NHFVRALDI

SEQ ID NO: 175133 - protein, 9 aa, Artificial Sequence
  Description of Artificial Sequence: Synthetic peptide
  Seed: GPDGNTPQF (TYRP1_HUMAN)
GFDGNTPQI

SEQ ID NO: 175134 - protein, 9 aa, Artificial Sequence
  Description of Artificial Sequence: Synthetic peptide
  Seed: RPGWRGAAC (TYRP1_HUMAN)
RAGWRGAAM

SEQ ID NO: 175135 - protein, 11 aa, Artificial Sequence
  Description of Artificial Sequence: Synthetic peptide
  Seed: ILGPDGNTPQF (TYRP1_HUMAN)
IVGPDGNTPQW

SEQ ID NO: 175136 - protein, 8 aa, Artificial Sequence
  Description of Artificial Sequence: Synthetic peptide
  Seed: REFSVPEI (TYRP1_HUMAN)
REFSVPEA

SEQ ID NO: 175137 - protein, 10 aa, Artificial Sequence
  Description of Artificial Sequence: Synthetic peptide
  Seed: FVTAPDNLGY (TYRP1_HUMAN)
FSTAPDNLGF

SEQ ID NO: 175138 - protein, 9 aa, Artificial Sequence
  Description of Artificial Sequence: Synthetic peptide
  Seed: QEMLQEPSF (TYRP1_HUMAN)
QQMLQEPSF

SEQ ID NO: 175139 - protein, 9 aa, Artificial Sequence
  Description of Artificial Sequence: Synthetic peptide
  Seed: RFFNRTCHC (TYRP1_HUMAN)
RFFNRTCHV

SEQ ID NO: 175140 - protein, 10 aa, Artificial Sequence
  Description of Artificial Sequence: Synthetic peptide
  Seed: HFVRALDMAK (TYRP1_HUMAN)
HSVRALDMAK

SEQ ID NO: 175141 - protein, 10 aa, Artificial Sequence
  Description of Artificial Sequence: Synthetic peptide
  Seed: RTTHPLFVIA (TYRP1_HUMAN)
RTTHPLFVIK

SEQ ID NO: 175142 - protein, 9 aa, Artificial Sequence
  Description of Artificial Sequence: Synthetic peptide
  Seed: KYDPAVRSL (TYRP1_HUMAN)
KADPAVRSY

SEQ ID NO: 175143 - protein, 9 aa, Artificial Sequence
  Description of Artificial Sequence: Synthetic peptide
  Seed: CYAEEYEKL (TYRP1_HUMAN)
CYAEEYEKI

SEQ ID NO: 175144 - protein, 9 aa, Artificial Sequence
  Description of Artificial Sequence: Synthetic peptide
  Seed: FVWTHYYSV (TYRP1_HUMAN)
FQWTHYYST

SEQ ID NO: 175145 - protein, 9 aa, Artificial Sequence
  Description of Artificial Sequence: Synthetic peptide
  Seed: SVFSQWRVV (TYRP1_HUMAN)
SMFSQWRVA

SEQ ID NO: 175146 - protein, 10 aa, Artificial Sequence
  Description of Artificial Sequence: Synthetic peptide
  Seed: EIIAIAVVGA (TYRP1_HUMAN)
EWIAIAVVGV

SEQ ID NO: 175147 - protein, 9 aa, Artificial Sequence
  Description of Artificial Sequence: Synthetic peptide
  Seed: GPDGNTPQF (TYRP1_HUMAN)
GVDGNTPQL

SEQ ID NO: 175148 - protein, 9 aa, Artificial Sequence
  Description of Artificial Sequence: Synthetic peptide
  Seed: VVGALLLVA (TYRP1_HUMAN)
VIGALLLVV

SEQ ID NO: 175149 - protein, 10 aa, Artificial Sequence
  Description of Artificial Sequence: Synthetic peptide
  Seed: VALIFGTASY (TYRP1_HUMAN)
VMLIFGTASF

SEQ ID NO: 175150 - protein, 9 aa, Artificial Sequence
  Description of Artificial Sequence: Synthetic peptide
  Seed: FSHEGPAFL (TYRP1_HUMAN)
FGHEGPAFV

SEQ ID NO: 175151 - protein, 11 aa, Artificial Sequence
  Description of Artificial Sequence: Synthetic peptide
  Seed: YNYFVWTHYYS (TYRP1_HUMAN)
YSYFVWTHYYY

SEQ ID NO: 175152 - protein, 10 aa, Artificial Sequence
  Description of Artificial Sequence: Synthetic peptide
  Seed: YNMVPFWPPV (TYRP1_HUMAN)
YDMVPFWPPA

SEQ ID NO: 175153 - protein, 9 aa, Artificial Sequence
  Description of Artificial Sequence: Synthetic peptide
  Seed: VFDEWLRRY (TYRP1_HUMAN)
VYDEWLRRM

SEQ ID NO: 175154 - protein, 9 aa, Artificial Sequence
  Description of Artificial Sequence: Synthetic peptide
  Seed: LLVALIFGT (TYRP1_HUMAN)
LVVALIFGA

SEQ ID NO: 175155 - protein, 11 aa, Artificial Sequence
  Description of Artificial Sequence: Synthetic peptide
  Seed: LVALIFGTASY (TYRP1_HUMAN)
LRALIFGTASY

SEQ ID NO: 175156 - protein, 9 aa, Artificial Sequence
  Description of Artificial Sequence: Synthetic peptide
  Seed: FSVPEIIAI (TYRP1_HUMAN)
FQVPEIIAA

SEQ ID NO: 175157 - protein, 11 aa, Artificial Sequence
  Description of Artificial Sequence: Synthetic peptide
  Seed: FLNGTGGQTHL (TYRP1_HUMAN)
FANGTGGQTHM

SEQ ID NO: 175158 - protein, 10 aa, Artificial Sequence
  Description of Artificial Sequence: Synthetic peptide
  Seed: ADSRPHSPQY (TYRP1_HUMAN)
AYSRPHSPQA

SEQ ID NO: 175159 - protein, 10 aa, Artificial Sequence
  Description of Artificial Sequence: Synthetic peptide
  Seed: RSLHNLAHLF (TYRP1_HUMAN)
RSLHNLAHLM

SEQ ID NO: 175160 - protein, 9 aa, Artificial Sequence
  Description of Artificial Sequence: Synthetic peptide
  Seed: ENAPIGHNR (TYRP1_HUMAN)
EIAPIGHNH

SEQ ID NO: 175161 - protein, 10 aa, Artificial Sequence
  Description of Artificial Sequence: Synthetic peptide
  Seed: TDAVFDEWLR (TYRP1_HUMAN)
TVAVFDEWLR

SEQ ID NO: 175162 - protein, 10 aa, Artificial Sequence
  Description of Artificial Sequence: Synthetic peptide
  Seed: RRYNADISTF (TYRP1_HUMAN)
RKYNADISTL

SEQ ID NO: 175163 - protein, 9 aa, Artificial Sequence
  Description of Artificial Sequence: Synthetic peptide
  Seed: APIGHNRQY (TYRP1_HUMAN)
AMIGHNRQF

SEQ ID NO: 175164 - protein, 10 aa, Artificial Sequence
  Description of Artificial Sequence: Synthetic peptide
  Seed: TPQFENISIY (TYRP1_HUMAN)
TRQFENISIF

SEQ ID NO: 175165 - protein, 9 aa, Artificial Sequence
  Description of Artificial Sequence: Synthetic peptide
  Seed: REFSVPEII (TYRP1_HUMAN)
RMFSVPEII

SEQ ID NO: 175166 - protein, 10 aa, Artificial Sequence
  Description of Artificial Sequence: Synthetic peptide
  Seed: LSPNDPIFVL (TYRP1_HUMAN)
LPPNDPIFVF

SEQ ID NO: 175167 - protein, 11 aa, Artificial Sequence
  Description of Artificial Sequence: Synthetic peptide
  Seed: LFQQARAQFPR (TYRP1_HUMAN)
LTQQARAQFPR

SEQ ID NO: 175168 - protein, 10 aa, Artificial Sequence
  Description of Artificial Sequence: Synthetic peptide
  Seed: GKYDPAVRSL (TYRP1_HUMAN)
GMYDPAVRSM

SEQ ID NO: 175169 - protein, 11 aa, Artificial Sequence
  Description of Artificial Sequence: Synthetic peptide
  Seed: YNYFVWTHYYS (TYRP1_HUMAN)
YMYFVWTHYYQ

SEQ ID NO: 175170 - protein, 9 aa, Artificial Sequence
  Description of Artificial Sequence: Synthetic peptide
  Seed: FTDAVFDEW (TYRP1_HUMAN)
FFDAVFDEI

SEQ ID NO: 175171 - protein, 9 aa, Artificial Sequence
  Description of Artificial Sequence: Synthetic peptide
  Seed: TLISPNSVF (TYRP1_HUMAN)
TQISPNSVM

SEQ ID NO: 175172 - protein, 11 aa, Artificial Sequence
  Description of Artificial Sequence: Synthetic peptide
  Seed: IYNYFVWTHYY (TYRP1_HUMAN)
IKNYFVWTHYY

SEQ ID NO: 175173 - protein, 10 aa, Artificial Sequence
  Description of Artificial Sequence: Synthetic peptide
  Seed: SHEGPAFLTW (TYRP1_HUMAN)
SHEGPAFLTI

SEQ ID NO: 175174 - protein, 9 aa, Artificial Sequence
  Description of Artificial Sequence: Synthetic peptide
  Seed: RTTHPLFVI (TYRP1_HUMAN)
RVTHPLFVY

SEQ ID NO: 175175 - protein, 9 aa, Artificial Sequence
  Description of Artificial Sequence: Synthetic peptide
  Seed: FLTWHRYHL (TYRP1_HUMAN)
FATWHRYHI

SEQ ID NO: 175176 - protein, 10 aa, Artificial Sequence
  Description of Artificial Sequence: Synthetic peptide
  Seed: RRYNADISTF (TYRP1_HUMAN)
RYYNADISTF

SEQ ID NO: 175177 - protein, 10 aa, Artificial Sequence
  Description of Artificial Sequence: Synthetic peptide
  Seed: FWPPVTNTEM (TYRP1_HUMAN)
FIPPVTNTEM

SEQ ID NO: 175178 - protein, 9 aa, Artificial Sequence
  Description of Artificial Sequence: Synthetic peptide
  Seed: SLHNLAHLF (TYRP1_HUMAN)
SQHNLAHLW

SEQ ID NO: 175179 - protein, 10 aa, Artificial Sequence
  Description of Artificial Sequence: Synthetic peptide
  Seed: TAPDNLGYTY (TYRP1_HUMAN)
TVPDNLGYTW

SEQ ID NO: 175180 - protein, 8 aa, Artificial Sequence
  Description of Artificial Sequence: Synthetic peptide
  Seed: ADISTFPL (TYRP1_HUMAN)
AEISTFPF

SEQ ID NO: 175181 - protein, 9 aa, Artificial Sequence
  Description of Artificial Sequence: Synthetic peptide
  Seed: ASYLIRARR (TYRP1_HUMAN)
AFYLIRARR

SEQ ID NO: 175182 - protein, 9 aa, Artificial Sequence
  Description of Artificial Sequence: Synthetic peptide
  Seed: LQNPNQSVV (TYRP1_HUMAN)
LLNPNQSVI

SEQ ID NO: 175183 - protein, 11 aa, Artificial Sequence
  Description of Artificial Sequence: Synthetic peptide
  Seed: FVLLHTFTDAV (TYRP1_HUMAN)
FNLLHTFTDAL

SEQ ID NO: 175184 - protein, 8 aa, Artificial Sequence
  Description of Artificial Sequence: Synthetic peptide
  Seed: FSHEGPAF (TYRP1_HUMAN)
FWHEGPAF

SEQ ID NO: 175185 - protein, 10 aa, Artificial Sequence
  Description of Artificial Sequence: Synthetic peptide
  Seed: ADSRPHSPQY (TYRP1_HUMAN)
ANSRPHSPQW

SEQ ID NO: 175186 - protein, 10 aa, Artificial Sequence
  Description of Artificial Sequence: Synthetic peptide
  Seed: FLTWHRYHLL (TYRP1_HUMAN)
FRTWHRYHLV

SEQ ID NO: 175187 - protein, 9 aa, Artificial Sequence
  Description of Artificial Sequence: Synthetic peptide
  Seed: SVFSQWRVV (TYRP1_HUMAN)
STFSQWRVL

SEQ ID NO: 175188 - protein, 10 aa, Artificial Sequence
  Description of Artificial Sequence: Synthetic peptide
  Seed: VALIFGTASY (TYRP1_HUMAN)
VALIFGTASM

SEQ ID NO: 175189 - protein, 10 aa, Artificial Sequence
  Description of Artificial Sequence: Synthetic peptide
  Seed: ENISIYNYFV (TYRP1_HUMAN)
EIISIYNYFI

SEQ ID NO: 175190 - protein, 9 aa, Artificial Sequence
  Description of Artificial Sequence: Synthetic peptide
  Seed: AIAVVGALL (TYRP1_HUMAN)
ATAVVGALL

SEQ ID NO: 175191 - protein, 9 aa, Artificial Sequence
  Description of Artificial Sequence: Synthetic peptide
  Seed: RQYNMVPFW (TYRP1_HUMAN)
RVYNMVPFM

SEQ ID NO: 175192 - protein, 9 aa, Artificial Sequence
  Description of Artificial Sequence: Synthetic peptide
  Seed: LLVALIFGT (TYRP1_HUMAN)
LLVALIFGL

SEQ ID NO: 175193 - protein, 10 aa, Artificial Sequence
  Description of Artificial Sequence: Synthetic peptide
  Seed: LIFGTASYLI (TYRP1_HUMAN)
LQFGTASYLF

SEQ ID NO: 175194 - protein, 10 aa, Artificial Sequence
  Description of Artificial Sequence: Synthetic peptide
  Seed: AFLTWHRYHL (TYRP1_HUMAN)
AMLTWHRYHV

SEQ ID NO: 175195 - protein, 8 aa, Artificial Sequence
  Description of Artificial Sequence: Synthetic peptide
  Seed: YSNSTNSF (TYRP1_HUMAN)
YFNSTNSL

SEQ ID NO: 175196 - protein, 10 aa, Artificial Sequence
  Description of Artificial Sequence: Synthetic peptide
  Seed: YNYFVWTHYY (TYRP1_HUMAN)
YWYFVWTHYK

SEQ ID NO: 175197 - protein, 9 aa, Artificial Sequence
  Description of Artificial Sequence: Synthetic peptide
  Seed: AVRSLHNLA (TYRP1_HUMAN)
APRSLHNLV

SEQ ID NO: 175198 - protein, 9 aa, Artificial Sequence
  Description of Artificial Sequence: Synthetic peptide
  Seed: LFDTPPFYS (TYRP1_HUMAN)
LWDTPPFYL

SEQ ID NO: 175199 - protein, 9 aa, Artificial Sequence
  Description of Artificial Sequence: Synthetic peptide
  Seed: STLISPNSV (TYRP1_HUMAN)
SMLISPNSL

SEQ ID NO: 175200 - protein, 9 aa, Artificial Sequence
  Description of Artificial Sequence: Synthetic peptide
  Seed: HEGPAFLTW (TYRP1_HUMAN)
HPGPAFLTM

SEQ ID NO: 175201 - protein, 9 aa, Artificial Sequence
  Description of Artificial Sequence: Synthetic peptide
  Seed: YTYEIQWPS (TYRP1_HUMAN)
YLYEIQWPV

SEQ ID NO: 175202 - protein, 8 aa, Artificial Sequence
  Description of Artificial Sequence: Synthetic peptide
  Seed: LIFGTASY (TYRP1_HUMAN)
LAFGTASF

SEQ ID NO: 175203 - protein, 9 aa, Artificial Sequence
  Description of Artificial Sequence: Synthetic peptide
  Seed: MAKRTTHPL (TYRP1_HUMAN)
MPKRTTHPC

SEQ ID NO: 175204 - protein, 9 aa, Artificial Sequence
  Description of Artificial Sequence: Synthetic peptide
  Seed: RYHLLRLEK (TYRP1_HUMAN)
RFHLLRLEK

SEQ ID NO: 175205 - protein, 9 aa, Artificial Sequence
  Description of Artificial Sequence: Synthetic peptide
  Seed: ACDQRVLIV (TYRP1_HUMAN)
AFDQRVLIV

SEQ ID NO: 175206 - protein, 9 aa, Artificial Sequence
  Description of Artificial Sequence: Synthetic peptide
  Seed: YTYEIQWPS (TYRP1_HUMAN)
YLYEIQWPT

SEQ ID NO: 175207 - protein, 9 aa, Artificial Sequence
  Description of Artificial Sequence: Synthetic peptide
  Seed: DNLGYTYEI (TYRP1_HUMAN)
DTLGYTYEL

SEQ ID NO: 175208 - protein, 11 aa, Artificial Sequence
  Description of Artificial Sequence: Synthetic peptide
  Seed: RLPEPQDVAQC (TYRP1_HUMAN)
RLPEPQDVAQF

SEQ ID NO: 175209 - protein, 9 aa, Artificial Sequence
  Description of Artificial Sequence: Synthetic peptide
  Seed: FYSNSTNSF (TYRP1_HUMAN)
FPSNSTNSW

SEQ ID NO: 175210 - protein, 11 aa, Artificial Sequence
  Description of Artificial Sequence: Synthetic peptide
  Seed: RRYNADISTFP (TYRP1_HUMAN)
RYYNADISTFN

SEQ ID NO: 175211 - protein, 9 aa, Artificial Sequence
  Description of Artificial Sequence: Synthetic peptide
  Seed: HYYSVKKTF (TYRP1_HUMAN)
HSYSVKKTV

SEQ ID NO: 175212 - protein, 10 aa, Artificial Sequence
  Description of Artificial Sequence: Synthetic peptide
  Seed: FGTASYLIRA (TYRP1_HUMAN)
FWTASYLIRV

SEQ ID NO: 175213 - protein, 9 aa, Artificial Sequence
  Description of Artificial Sequence: Synthetic peptide
  Seed: SLGCIFFPL (TYRP1_HUMAN)
SLGCIFFPV

SEQ ID NO: 175214 - protein, 10 aa, Artificial Sequence
  Description of Artificial Sequence: Synthetic peptide
  Seed: FLNGTGGQTH (TYRP1_HUMAN)
FINGTGGQTL

SEQ ID NO: 175215 - protein, 11 aa, Artificial Sequence
  Description of Artificial Sequence: Synthetic peptide
  Seed: LVALIFGTASY (TYRP1_HUMAN)
LTALIFGTASY

SEQ ID NO: 175216 - protein, 9 aa, Artificial Sequence
  Description of Artificial Sequence: Synthetic peptide
  Seed: SPNDPIFVL (TYRP1_HUMAN)
SRNDPIFVI

SEQ ID NO: 175217 - protein, 11 aa, Artificial Sequence
  Description of Artificial Sequence: Synthetic peptide
  Seed: VRSLHNLAHLF (TYRP1_HUMAN)
VSSLHNLAHLF

SEQ ID NO: 175218 - protein, 9 aa, Artificial Sequence
  Description of Artificial Sequence: Synthetic peptide
  Seed: ALIFGTASY (TYRP1_HUMAN)
AIIFGTASM

SEQ ID NO: 175219 - protein, 9 aa, Artificial Sequence
  Description of Artificial Sequence: Synthetic peptide
  Seed: MAKRTTHPL (TYRP1_HUMAN)
MVKRTTHPW

SEQ ID NO: 175220 - protein, 9 aa, Artificial Sequence
  Description of Artificial Sequence: Synthetic peptide
  Seed: TLISPNSVF (TYRP1_HUMAN)
TPISPNSVM

SEQ ID NO: 175221 - protein, 9 aa, Artificial Sequence
  Description of Artificial Sequence: Synthetic peptide
  Seed: RVLIVRRNL (TYRP1_HUMAN)
RMLIVRRNA

SEQ ID NO: 175222 - protein, 11 aa, Artificial Sequence
  Description of Artificial Sequence: Synthetic peptide
  Seed: RYNADISTFPL (TYRP1_HUMAN)
RYNADISTFPF

SEQ ID NO: 175223 - protein, 9 aa, Artificial Sequence
  Description of Artificial Sequence: Synthetic peptide
  Seed: LLLFQQARA (TYRP1_HUMAN)
LMLFQQARI

SEQ ID NO: 175224 - protein, 9 aa, Artificial Sequence
  Description of Artificial Sequence: Synthetic peptide
  Seed: LIFGTASYL (TYRP1_HUMAN)
LVFGTASYR

SEQ ID NO: 175225 - protein, 9 aa, Artificial Sequence
  Description of Artificial Sequence: Synthetic peptide
  Seed: YTYEIQWPS (TYRP1_HUMAN)
YTYEIQWPR

SEQ ID NO: 175226 - protein, 9 aa, Artificial Sequence
  Description of Artificial Sequence: Synthetic peptide
  Seed: AVFDEWLRR (TYRP1_HUMAN)
AAFDEWLRR

SEQ ID NO: 175227 - protein, 10 aa, Artificial Sequence
  Description of Artificial Sequence: Synthetic peptide
  Seed: NYFVWTHYYS (TYRP1_HUMAN)
NMFVWTHYYI

SEQ ID NO: 175228 - protein, 9 aa, Artificial Sequence
  Description of Artificial Sequence: Synthetic peptide
  Seed: SLGCIFFPL (TYRP1_HUMAN)
SAGCIFFPI

SEQ ID NO: 175229 - protein, 9 aa, Artificial Sequence
  Description of Artificial Sequence: Synthetic peptide
  Seed: NHFVRALDM (TYRP1_HUMAN)
NRFVRALDY

SEQ ID NO: 175230 - protein, 11 aa, Artificial Sequence
  Description of Artificial Sequence: Synthetic peptide
  Seed: YNMVPFWPPVT (TYRP1_HUMAN)
YIMVPFWPPVP

SEQ ID NO: 175231 - protein, 11 aa, Artificial Sequence
  Description of Artificial Sequence: Synthetic peptide
  Seed: TVEGYSDPTGK (TYRP1_HUMAN)
TIEGYSDPTGY

SEQ ID NO: 175232 - protein, 9 aa, Artificial Sequence
  Description of Artificial Sequence: Synthetic peptide
  Seed: SMDEANQPL (TYRP1_HUMAN)
SEDEANQPF

SEQ ID NO: 175233 - protein, 10 aa, Artificial Sequence
  Description of Artificial Sequence: Synthetic peptide
  Seed: YNADISTFPL (TYRP1_HUMAN)
YAADISTFPV

SEQ ID NO: 175234 - protein, 11 aa, Artificial Sequence
  Description of Artificial Sequence: Synthetic peptide
  Seed: EVWPLRFFNRT (TYRP1_HUMAN)
ESWPLRFFNRR

SEQ ID NO: 175235 - protein, 10 aa, Artificial Sequence
  Description of Artificial Sequence: Synthetic peptide
  Seed: YFVWTHYYSV (TYRP1_HUMAN)
YLVWTHYYSM

SEQ ID NO: 175236 - protein, 9 aa, Artificial Sequence
  Description of Artificial Sequence: Synthetic peptide
  Seed: RFFNRTCHC (TYRP1_HUMAN)
RLFNRTCHK

SEQ ID NO: 175237 - protein, 10 aa, Artificial Sequence
  Description of Artificial Sequence: Synthetic peptide
  Seed: THYYSVKKTF (TYRP1_HUMAN)
TYYYSVKKTL

SEQ ID NO: 175238 - protein, 10 aa, Artificial Sequence
  Description of Artificial Sequence: Synthetic peptide
  Seed: LENAPIGHNR (TYRP1_HUMAN)
LANAPIGHNL

SEQ ID NO: 175239 - protein, 11 aa, Artificial Sequence
  Description of Artificial Sequence: Synthetic peptide
  Seed: IYNYFVWTHYY (TYRP1_HUMAN)
ITNYFVWTHYF

SEQ ID NO: 175240 - protein, 9 aa, Artificial Sequence
  Description of Artificial Sequence: Synthetic peptide
  Seed: YTYEIQWPS (TYRP1_HUMAN)
YVYEIQWPC

SEQ ID NO: 175241 - protein, 9 aa, Artificial Sequence
  Description of Artificial Sequence: Synthetic peptide
  Seed: FSHEGPAFL (TYRP1_HUMAN)
FKHEGPAFM

SEQ ID NO: 175242 - protein, 10 aa, Artificial Sequence
  Description of Artificial Sequence: Synthetic peptide
  Seed: SIYNYFVWTH (TYRP1_HUMAN)
SRYNYFVWTR

SEQ ID NO: 175243 - protein, 10 aa, Artificial Sequence
  Description of Artificial Sequence: Synthetic peptide
  Seed: IAIAVVGALL (TYRP1_HUMAN)
IAIAVVGALY

SEQ ID NO: 175244 - protein, 9 aa, Artificial Sequence
  Description of Artificial Sequence: Synthetic peptide
  Seed: MDEANQPLL (TYRP1_HUMAN)
MEEANQPLL

SEQ ID NO: 175245 - protein, 9 aa, Artificial Sequence
  Description of Artificial Sequence: Synthetic peptide
  Seed: MSAPKLLSL (TYRP1_HUMAN)
MNAPKLLSR

SEQ ID NO: 175246 - protein, 10 aa, Artificial Sequence
  Description of Artificial Sequence: Synthetic peptide
  Seed: RQCATVEALR (TYRP1_HUMAN)
RACATVEALR

SEQ ID NO: 175247 - protein, 9 aa, Artificial Sequence
  Description of Artificial Sequence: Synthetic peptide
  Seed: LTWHRYHLL (TYRP1_HUMAN)
LWWHRYHLY

SEQ ID NO: 175248 - protein, 10 aa, Artificial Sequence
  Description of Artificial Sequence: Synthetic peptide
  Seed: RSMDEANQPL (TYRP1_HUMAN)
RAMDEANQPL

SEQ ID NO: 175249 - protein, 10 aa, Artificial Sequence
  Description of Artificial Sequence: Synthetic peptide
  Seed: YEIQWPSREF (TYRP1_HUMAN)
YEIQWPSREL

SEQ ID NO: 175250 - protein, 10 aa, Artificial Sequence
  Description of Artificial Sequence: Synthetic peptide
  Seed: VLLHTFTDAV (TYRP1_HUMAN)
VLLHTFTDAI

SEQ ID NO: 175251 - protein, 9 aa, Artificial Sequence
  Description of Artificial Sequence: Synthetic peptide
  Seed: RQYNMVPFW (TYRP1_HUMAN)
RSYNMVPFL

SEQ ID NO: 175252 - protein, 9 aa, Artificial Sequence
  Description of Artificial Sequence: Synthetic peptide
  Seed: YTYEIQWPS (TYRP1_HUMAN)
YCYEIQWPI

SEQ ID NO: 175253 - protein, 10 aa, Artificial Sequence
  Description of Artificial Sequence: Synthetic peptide
  Seed: HPLFVIATRR (TYRP1_HUMAN)
HTLFVIATRY

SEQ ID NO: 175254 - protein, 9 aa, Artificial Sequence
  Description of Artificial Sequence: Synthetic peptide
  Seed: NYFVWTHYY (TYRP1_HUMAN)
NGFVWTHYY

SEQ ID NO: 175255 - protein, 9 aa, Artificial Sequence
  Description of Artificial Sequence: Synthetic peptide
  Seed: MSAPKLLSL (TYRP1_HUMAN)
MVAPKLLSL

SEQ ID NO: 175256 - protein, 10 aa, Artificial Sequence
  Description of Artificial Sequence: Synthetic peptide
  Seed: VGLFDTPPFY (TYRP1_HUMAN)
VQLFDTPPFF

SEQ ID NO: 175257 - protein, 10 aa, Artificial Sequence
  Description of Artificial Sequence: Synthetic peptide
  Seed: FGTASYLIRA (TYRP1_HUMAN)
FATASYLIRV

SEQ ID NO: 175258 - protein, 10 aa, Artificial Sequence
  Description of Artificial Sequence: Synthetic peptide
  Seed: YNMVPFWPPV (TYRP1_HUMAN)
YLMVPFWPPF

SEQ ID NO: 175259 - protein, 10 aa, Artificial Sequence
  Description of Artificial Sequence: Synthetic peptide
  Seed: MLQEPSFSLP (TYRP1_HUMAN)
MLQEPSFSLN

SEQ ID NO: 175260 - protein, 9 aa, Artificial Sequence
  Description of Artificial Sequence: Synthetic peptide
  Seed: NMVPFWPPV (TYRP1_HUMAN)
NLVPFWPPI

SEQ ID NO: 175261 - protein, 9 aa, Artificial Sequence
  Description of Artificial Sequence: Synthetic peptide
  Seed: NMVPFWPPV (TYRP1_HUMAN)
NWVPFWPPM

SEQ ID NO: 175262 - protein, 9 aa, Artificial Sequence
  Description of Artificial Sequence: Synthetic peptide
  Seed: FTDAVFDEW (TYRP1_HUMAN)
FFDAVFDEL

SEQ ID NO: 175263 - protein, 9 aa, Artificial Sequence
  Description of Artificial Sequence: Synthetic peptide
  Seed: SVKKTFLGV (TYRP1_HUMAN)
SIKKTFLGV

SEQ ID NO: 175264 - protein, 10 aa, Artificial Sequence
  Description of Artificial Sequence: Synthetic peptide
  Seed: FVWTHYYSVK (TYRP1_HUMAN)
FMWTHYYSVY

SEQ ID NO: 175265 - protein, 10 aa, Artificial Sequence
  Description of Artificial Sequence: Synthetic peptide
  Seed: HRYHLLRLEK (TYRP1_HUMAN)
HSYHLLRLEK

SEQ ID NO: 175266 - protein, 9 aa, Artificial Sequence
  Description of Artificial Sequence: Synthetic peptide
  Seed: GEVDFSHEG (TYRP1_HUMAN)
GEVDFSHET

SEQ ID NO: 175267 - protein, 11 aa, Artificial Sequence
  Description of Artificial Sequence: Synthetic peptide
  Seed: QEMLQEPSFSL (TYRP1_HUMAN)
QEMLQEPSFSW

SEQ ID NO: 175268 - protein, 9 aa, Artificial Sequence
  Description of Artificial Sequence: Synthetic peptide
  Seed: REFSVPEII (TYRP1_HUMAN)
RDFSVPEIL

SEQ ID NO: 175269 - protein, 9 aa, Artificial Sequence
  Description of Artificial Sequence: Synthetic peptide
  Seed: RQYNMVPFW (TYRP1_HUMAN)
RWYNMVPFL

SEQ ID NO: 175270 - protein, 11 aa, Artificial Sequence
  Description of Artificial Sequence: Synthetic peptide
  Seed: MLQEPSFSLPY (TYRP1_HUMAN)
MMQEPSFSLPA

SEQ ID NO: 175271 - protein, 11 aa, Artificial Sequence
  Description of Artificial Sequence: Synthetic peptide
  Seed: RRYNADISTFP (TYRP1_HUMAN)
RRYNADISTFV

SEQ ID NO: 175272 - protein, 9 aa, Artificial Sequence
  Description of Artificial Sequence: Synthetic peptide
  Seed: SVPEIIAIA (TYRP1_HUMAN)
SMPEIIAIY

SEQ ID NO: 175273 - protein, 10 aa, Artificial Sequence
  Description of Artificial Sequence: Synthetic peptide
  Seed: RSLHNLAHLF (TYRP1_HUMAN)
RWLHNLAHLV

SEQ ID NO: 175274 - protein, 9 aa, Artificial Sequence
  Description of Artificial Sequence: Synthetic peptide
  Seed: RPGWRGAAC (TYRP1_HUMAN)
RPGWRGAAY

SEQ ID NO: 175275 - protein, 9 aa, Artificial Sequence
  Description of Artificial Sequence: Synthetic peptide
  Seed: FPRQCATVE (TYRP1_HUMAN)
FPRQCATVL

SEQ ID NO: 175276 - protein, 10 aa, Artificial Sequence
  Description of Artificial Sequence: Synthetic peptide
  Seed: YNADISTFPL (TYRP1_HUMAN)
YQADISTFPM

SEQ ID NO: 175277 - protein, 11 aa, Artificial Sequence
  Description of Artificial Sequence: Synthetic peptide
  Seed: REFSVPEIIAI (TYRP1_HUMAN)
RGFSVPEIIAF

SEQ ID NO: 175278 - protein, 10 aa, Artificial Sequence
  Description of Artificial Sequence: Synthetic peptide
  Seed: YFVWTHYYSV (TYRP1_HUMAN)
YCVWTHYYSV

SEQ ID NO: 175279 - protein, 11 aa, Artificial Sequence
  Description of Artificial Sequence: Synthetic peptide
  Seed: CNSTEDGPIRR (TYRP1_HUMAN)
CSSTEDGPIRY

SEQ ID NO: 175280 - protein, 9 aa, Artificial Sequence
  Description of Artificial Sequence: Synthetic peptide
  Seed: MDEANQPLL (TYRP1_HUMAN)
MEEANQPLF

SEQ ID NO: 175281 - protein, 11 aa, Artificial Sequence
  Description of Artificial Sequence: Synthetic peptide
  Seed: RLPEPQDVAQC (TYRP1_HUMAN)
RLPEPQDVAQI

SEQ ID NO: 175282 - protein, 11 aa, Artificial Sequence
  Description of Artificial Sequence: Synthetic peptide
  Seed: FPLLLFQQARA (TYRP1_HUMAN)
FELLLFQQARV

SEQ ID NO: 175283 - protein, 9 aa, Artificial Sequence
  Description of Artificial Sequence: Synthetic peptide
  Seed: AQCLEVGLF (TYRP1_HUMAN)
AQCLEVGLV

SEQ ID NO: 175284 - protein, 11 aa, Artificial Sequence
  Description of Artificial Sequence: Synthetic peptide
  Seed: HLSPNDPIFVL (TYRP1_HUMAN)
HLSPNDPIFVY

SEQ ID NO: 175285 - protein, 9 aa, Artificial Sequence
  Description of Artificial Sequence: Synthetic peptide
  Seed: LSPNDPIFV (TYRP1_HUMAN)
LVPNDPIFV

SEQ ID NO: 175286 - protein, 10 aa, Artificial Sequence
  Description of Artificial Sequence: Synthetic peptide
  Seed: NSFRNTVEGY (TYRP1_HUMAN)
NQFRNTVEGF

SEQ ID NO: 175287 - protein, 10 aa, Artificial Sequence
  Description of Artificial Sequence: Synthetic peptide
  Seed: NTVEGYSDPT (TYRP1_HUMAN)
NTVEGYSDPA

SEQ ID NO: 175288 - protein, 9 aa, Artificial Sequence
  Description of Artificial Sequence: Synthetic peptide
  Seed: RTTHPLFVI (TYRP1_HUMAN)
RSTHPLFVF

SEQ ID NO: 175289 - protein, 9 aa, Artificial Sequence
  Description of Artificial Sequence: Synthetic peptide
  Seed: ACDQRVLIV (TYRP1_HUMAN)
AQDQRVLIM

SEQ ID NO: 175290 - protein, 9 aa, Artificial Sequence
  Description of Artificial Sequence: Synthetic peptide
  Seed: SPNDPIFVL (TYRP1_HUMAN)
SANDPIFVF

SEQ ID NO: 175291 - protein, 9 aa, Artificial Sequence
  Description of Artificial Sequence: Synthetic peptide
  Seed: HYYSVKKTF (TYRP1_HUMAN)
HRYSVKKTF

SEQ ID NO: 175292 - protein, 9 aa, Artificial Sequence
  Description of Artificial Sequence: Synthetic peptide
  Seed: FSLPYWNFA (TYRP1_HUMAN)
FQLPYWNFF

SEQ ID NO: 175293 - protein, 9 aa, Artificial Sequence
  Description of Artificial Sequence: Synthetic peptide
  Seed: FSHEGPAFL (TYRP1_HUMAN)
FTHEGPAFK

SEQ ID NO: 175294 - protein, 9 aa, Artificial Sequence
  Description of Artificial Sequence: Synthetic peptide
  Seed: AVVGALLLV (TYRP1_HUMAN)
ALVGALLLV

SEQ ID NO: 175295 - protein, 9 aa, Artificial Sequence
  Description of Artificial Sequence: Synthetic peptide
  Seed: ENAPIGHNR (TYRP1_HUMAN)
ETAPIGHNK

SEQ ID NO: 175296 - protein, 9 aa, Artificial Sequence
  Description of Artificial Sequence: Synthetic peptide
  Seed: MLQEPSFSL (TYRP1_HUMAN)
MMQEPSFSM

SEQ ID NO: 175297 - protein, 10 aa, Artificial Sequence
  Description of Artificial Sequence: Synthetic peptide
  Seed: RSLHNLAHLF (TYRP1_HUMAN)
RWLHNLAHLI

SEQ ID NO: 175298 - protein, 9 aa, Artificial Sequence
  Description of Artificial Sequence: Synthetic peptide
  Seed: MLQEPSFSL (TYRP1_HUMAN)
MVQEPSFSL

SEQ ID NO: 175299 - protein, 9 aa, Artificial Sequence
  Description of Artificial Sequence: Synthetic peptide
  Seed: KLQNPNQSV (TYRP1_HUMAN)
KTQNPNQSK

SEQ ID NO: 175300 - protein, 9 aa, Artificial Sequence
  Description of Artificial Sequence: Synthetic peptide
  Seed: RQYNMVPFW (TYRP1_HUMAN)
RMYNMVPFM

SEQ ID NO: 175301 - protein, 9 aa, Artificial Sequence
  Description of Artificial Sequence: Synthetic peptide
  Seed: FLNGTGGQT (TYRP1_HUMAN)
FMNGTGGQI

SEQ ID NO: 175302 - protein, 9 aa, Artificial Sequence
  Description of Artificial Sequence: Synthetic peptide
  Seed: SREFSVPEI (TYRP1_HUMAN)
SHEFSVPEV

SEQ ID NO: 175303 - protein, 10 aa, Artificial Sequence
  Description of Artificial Sequence: Synthetic peptide
  Seed: YNADISTFPL (TYRP1_HUMAN)
YWADISTFPM

SEQ ID NO: 175304 - protein, 9 aa, Artificial Sequence
  Description of Artificial Sequence: Synthetic peptide
  Seed: FYSNSTNSF (TYRP1_HUMAN)
FQSNSTNSY

SEQ ID NO: 175305 - protein, 9 aa, Artificial Sequence
  Description of Artificial Sequence: Synthetic peptide
  Seed: LTWHRYHLL (TYRP1_HUMAN)
LIWHRYHLF

SEQ ID NO: 175306 - protein, 9 aa, Artificial Sequence
  Description of Artificial Sequence: Synthetic peptide
  Seed: RFFNRTCHC (TYRP1_HUMAN)
RYFNRTCHK

SEQ ID NO: 175307 - protein, 11 aa, Artificial Sequence
  Description of Artificial Sequence: Synthetic peptide
  Seed: YNYFVWTHYYS (TYRP1_HUMAN)
YMYFVWTHYYD

SEQ ID NO: 175308 - protein, 10 aa, Artificial Sequence
  Description of Artificial Sequence: Synthetic peptide
  Seed: RSLHNLAHLF (TYRP1_HUMAN)
RHLHNLAHLY

SEQ ID NO: 175309 - protein, 10 aa, Artificial Sequence
  Description of Artificial Sequence: Synthetic peptide
  Seed: ADSRPHSPQY (TYRP1_HUMAN)
ATSRPHSPQW

SEQ ID NO: 175310 - protein, 11 aa, Artificial Sequence
  Description of Artificial Sequence: Synthetic peptide
  Seed: YQCYAEEYEKL (TYRP1_HUMAN)
YPCYAEEYEKF

SEQ ID NO: 175311 - protein, 9 aa, Artificial Sequence
  Description of Artificial Sequence: Synthetic peptide
  Seed: LFQQARAQF (TYRP1_HUMAN)
LVQQARAQF

SEQ ID NO: 175312 - protein, 10 aa, Artificial Sequence
  Description of Artificial Sequence: Synthetic peptide
  Seed: SMDEANQPLL (TYRP1_HUMAN)
SQDEANQPLW

SEQ ID NO: 175313 - protein, 11 aa, Artificial Sequence
  Description of Artificial Sequence: Synthetic peptide
  Seed: RRSMDEANQPL (TYRP1_HUMAN)
RPSMDEANQPV

SEQ ID NO: 175314 - protein, 9 aa, Artificial Sequence
  Description of Artificial Sequence: Synthetic peptide
  Seed: REFSVPEII (TYRP1_HUMAN)
RHFSVPEIF

SEQ ID NO: 175315 - protein, 10 aa, Artificial Sequence
  Description of Artificial Sequence: Synthetic peptide
  Seed: ADSRPHSPQY (TYRP1_HUMAN)
ARSRPHSPQW

SEQ ID NO: 175316 - protein, 9 aa, Artificial Sequence
  Description of Artificial Sequence: Synthetic peptide
  Seed: SLHNLAHLF (TYRP1_HUMAN)
SKHNLAHLY

SEQ ID NO: 175317 - protein, 10 aa, Artificial Sequence
  Description of Artificial Sequence: Synthetic peptide
  Seed: MVPFWPPVTN (TYRP1_HUMAN)
MAPFWPPVTF

SEQ ID NO: 175318 - protein, 9 aa, Artificial Sequence
  Description of Artificial Sequence: Synthetic peptide
  Seed: QWPSREFSV (TYRP1_HUMAN)
QMPSREFSF

SEQ ID NO: 175319 - protein, 9 aa, Artificial Sequence
  Description of Artificial Sequence: Synthetic peptide
  Seed: KYDPAVRSL (TYRP1_HUMAN)
KFDPAVRSW

SEQ ID NO: 175320 - protein, 9 aa, Artificial Sequence
  Description of Artificial Sequence: Synthetic peptide
  Seed: SPNDPIFVL (TYRP1_HUMAN)
SLNDPIFVM

SEQ ID NO: 175321 - protein, 10 aa, Artificial Sequence
  Description of Artificial Sequence: Synthetic peptide
  Seed: TTHPLFVIAT (TYRP1_HUMAN)
TTHPLFVIAV

SEQ ID NO: 175322 - protein, 9 aa, Artificial Sequence
  Description of Artificial Sequence: Synthetic peptide
  Seed: KYDPAVRSL (TYRP1_HUMAN)
KIDPAVRSF

SEQ ID NO: 175323 - protein, 9 aa, Artificial Sequence
  Description of Artificial Sequence: Synthetic peptide
  Seed: VARPMVQRL (TYRP1_HUMAN)
VARPMVQRI

SEQ ID NO: 175324 - protein, 9 aa, Artificial Sequence
  Description of Artificial Sequence: Synthetic peptide
  Seed: SVKKTFLGV (TYRP1_HUMAN)
SSKKTFLGY

SEQ ID NO: 175325 - protein, 9 aa, Artificial Sequence
  Description of Artificial Sequence: Synthetic peptide
  Seed: QEMLQEPSF (TYRP1_HUMAN)
QMMLQEPSF

SEQ ID NO: 175326 - protein, 11 aa, Artificial Sequence
  Description of Artificial Sequence: Synthetic peptide
  Seed: FPRQCATVEAL (TYRP1_HUMAN)
FPRQCATVEAV

SEQ ID NO: 175327 - protein, 9 aa, Artificial Sequence
  Description of Artificial Sequence: Synthetic peptide
  Seed: LLVALIFGT (TYRP1_HUMAN)
LTVALIFGA

SEQ ID NO: 175328 - protein, 10 aa, Artificial Sequence
  Description of Artificial Sequence: Synthetic peptide
  Seed: TPQFENISIY (TYRP1_HUMAN)
TDQFENISIY

SEQ ID NO: 175329 - protein, 9 aa, Artificial Sequence
  Description of Artificial Sequence: Synthetic peptide
  Seed: FVWTHYYSV (TYRP1_HUMAN)
FLWTHYYSS

SEQ ID NO: 175330 - protein, 9 aa, Artificial Sequence
  Description of Artificial Sequence: Synthetic peptide
  Seed: IFGTASYLI (TYRP1_HUMAN)
IYGTASYLV

SEQ ID NO: 175331 - protein, 10 aa, Artificial Sequence
  Description of Artificial Sequence: Synthetic peptide
  Seed: FVWTHYYSVK (TYRP1_HUMAN)
FMWTHYYSVD

SEQ ID NO: 175332 - protein, 9 aa, Artificial Sequence
  Description of Artificial Sequence: Synthetic peptide
  Seed: LLVALIFGT (TYRP1_HUMAN)
LIVALIFGM

SEQ ID NO: 175333 - protein, 9 aa, Artificial Sequence
  Description of Artificial Sequence: Synthetic peptide
  Seed: VLIVRRNLL (TYRP1_HUMAN)
VAIVRRNLL

SEQ ID NO: 175334 - protein, 9 aa, Artificial Sequence
  Description of Artificial Sequence: Synthetic peptide
  Seed: VGQESFGEV (TYRP1_HUMAN)
VSQESFGEL

SEQ ID NO: 175335 - protein, 9 aa, Artificial Sequence
  Description of Artificial Sequence: Synthetic peptide
  Seed: SFRNTVEGY (TYRP1_HUMAN)
SMRNTVEGY

SEQ ID NO: 175336 - protein, 9 aa, Artificial Sequence
  Description of Artificial Sequence: Synthetic peptide
  Seed: AVRSLHNLA (TYRP1_HUMAN)
AIRSLHNLA

SEQ ID NO: 175337 - protein, 9 aa, Artificial Sequence
  Description of Artificial Sequence: Synthetic peptide
  Seed: IAVVGALLL (TYRP1_HUMAN)
IKVVGALLY

SEQ ID NO: 175338 - protein, 9 aa, Artificial Sequence
  Description of Artificial Sequence: Synthetic peptide
  Seed: YTYEIQWPS (TYRP1_HUMAN)
YMYEIQWPF

SEQ ID NO: 175339 - protein, 10 aa, Artificial Sequence
  Description of Artificial Sequence: Synthetic peptide
  Seed: LLFQQARAQF (TYRP1_HUMAN)
LMFQQARAQY

SEQ ID NO: 175340 - protein, 9 aa, Artificial Sequence
  Description of Artificial Sequence: Synthetic peptide
  Seed: RFFNRTCHC (TYRP1_HUMAN)
RMFNRTCHY

SEQ ID NO: 175341 - protein, 9 aa, Artificial Sequence
  Description of Artificial Sequence: Synthetic peptide
  Seed: DLMGSRSNF (TYRP1_HUMAN)
DIMGSRSNY

SEQ ID NO: 175342 - protein, 9 aa, Artificial Sequence
  Description of Artificial Sequence: Synthetic peptide
  Seed: LTWHRYHLL (TYRP1_HUMAN)
LMWHRYHLL

SEQ ID NO: 175343 - protein, 9 aa, Artificial Sequence
  Description of Artificial Sequence: Synthetic peptide
  Seed: HEGPAFLTW (TYRP1_HUMAN)
HEGPAFLTV

SEQ ID NO: 175344 - protein, 9 aa, Artificial Sequence
  Description of Artificial Sequence: Synthetic peptide
  Seed: DSRPHSPQY (TYRP1_HUMAN)
DIRPHSPQW

SEQ ID NO: 175345 - protein, 9 aa, Artificial Sequence
  Description of Artificial Sequence: Synthetic peptide
  Seed: RPMVQRLPE (TYRP1_HUMAN)
RPMVQRLPA

SEQ ID NO: 175346 - protein, 11 aa, Artificial Sequence
  Description of Artificial Sequence: Synthetic peptide
  Seed: REFSVPEIIAI (TYRP1_HUMAN)
RVFSVPEIIAW

SEQ ID NO: 175347 - protein, 9 aa, Artificial Sequence
  Description of Artificial Sequence: Synthetic peptide
  Seed: SLGCIFFPL (TYRP1_HUMAN)
STGCIFFPA

SEQ ID NO: 175348 - protein, 9 aa, Artificial Sequence
  Description of Artificial Sequence: Synthetic peptide
  Seed: YTYEIQWPS (TYRP1_HUMAN)
YMYEIQWPW

SEQ ID NO: 175349 - protein, 8 aa, Artificial Sequence
  Description of Artificial Sequence: Synthetic peptide
  Seed: LFDTPPFY (TYRP1_HUMAN)
LFDTPPFL

SEQ ID NO: 175350 - protein, 9 aa, Artificial Sequence
  Description of Artificial Sequence: Synthetic peptide
  Seed: CIFFPLLLF (TYRP1_HUMAN)
CQFFPLLLM

SEQ ID NO: 175351 - protein, 9 aa, Artificial Sequence
  Description of Artificial Sequence: Synthetic peptide
  Seed: LQNPNQSVV (TYRP1_HUMAN)
LANPNQSVY

SEQ ID NO: 175352 - protein, 9 aa, Artificial Sequence
  Description of Artificial Sequence: Synthetic peptide
  Seed: APIGHNRQY (TYRP1_HUMAN)
ARIGHNRQV

SEQ ID NO: 175353 - protein, 9 aa, Artificial Sequence
  Description of Artificial Sequence: Synthetic peptide
  Seed: TASYLIRAR (TYRP1_HUMAN)
TYSYLIRAR

SEQ ID NO: 175354 - protein, 9 aa, Artificial Sequence
  Description of Artificial Sequence: Synthetic peptide
  Seed: GPDGNTPQF (TYRP1_HUMAN)
GWDGNTPQV

SEQ ID NO: 175355 - protein, 10 aa, Artificial Sequence
  Description of Artificial Sequence: Synthetic peptide
  Seed: LLLVALIFGT (TYRP1_HUMAN)
LVLVALIFGI

SEQ ID NO: 175356 - protein, 11 aa, Artificial Sequence
  Description of Artificial Sequence: Synthetic peptide
  Seed: FSVPEIIAIAV (TYRP1_HUMAN)
FLVPEIIAIAV

SEQ ID NO: 175357 - protein, 9 aa, Artificial Sequence
  Description of Artificial Sequence: Synthetic peptide
  Seed: STNSFRNTV (TYRP1_HUMAN)
SSNSFRNTM

SEQ ID NO: 175358 - protein, 9 aa, Artificial Sequence
  Description of Artificial Sequence: Synthetic peptide
  Seed: WHRYHLLRL (TYRP1_HUMAN)
WQRYHLLRF

SEQ ID NO: 175359 - protein, 10 aa, Artificial Sequence
  Description of Artificial Sequence: Synthetic peptide
  Seed: YNADISTFPL (TYRP1_HUMAN)
YLADISTFPI

SEQ ID NO: 175360 - protein, 10 aa, Artificial Sequence
  Description of Artificial Sequence: Synthetic peptide
  Seed: YNADISTFPL (TYRP1_HUMAN)
YTADISTFPY

SEQ ID NO: 175361 - protein, 9 aa, Artificial Sequence
  Description of Artificial Sequence: Synthetic peptide
  Seed: RPMVQRLPE (TYRP1_HUMAN)
RTMVQRLPM

SEQ ID NO: 175362 - protein, 9 aa, Artificial Sequence
  Description of Artificial Sequence: Synthetic peptide
  Seed: FSVPEIIAI (TYRP1_HUMAN)
FMVPEIIAV

SEQ ID NO: 175363 - protein, 10 aa, Artificial Sequence
  Description of Artificial Sequence: Synthetic peptide
  Seed: ALIFGTASYL (TYRP1_HUMAN)
AFIFGTASYY

SEQ ID NO: 175364 - protein, 9 aa, Artificial Sequence
  Description of Artificial Sequence: Synthetic peptide
  Seed: RARRSMDEA (TYRP1_HUMAN)
RSRRSMDEA

SEQ ID NO: 175365 - protein, 9 aa, Artificial Sequence
  Description of Artificial Sequence: Synthetic peptide
  Seed: MLQEPSFSL (TYRP1_HUMAN)
MAQEPSFSV

SEQ ID NO: 175366 - protein, 11 aa, Artificial Sequence
  Description of Artificial Sequence: Synthetic peptide
  Seed: RSMDEANQPLL (TYRP1_HUMAN)
RVMDEANQPLM

SEQ ID NO: 175367 - protein, 9 aa, Artificial Sequence
  Description of Artificial Sequence: Synthetic peptide
  Seed: HYYSVKKTF (TYRP1_HUMAN)
HVYSVKKTF

SEQ ID NO: 175368 - protein, 10 aa, Artificial Sequence
  Description of Artificial Sequence: Synthetic peptide
  Seed: LLLVALIFGT (TYRP1_HUMAN)
LHLVALIFGI

SEQ ID NO: 175369 - protein, 11 aa, Artificial Sequence
  Description of Artificial Sequence: Synthetic peptide
  Seed: FPRQCATVEAL (TYRP1_HUMAN)
FPRQCATVEAY

SEQ ID NO: 175370 - protein, 9 aa, Artificial Sequence
  Description of Artificial Sequence: Synthetic peptide
  Seed: LHNLAHLFL (TYRP1_HUMAN)
LKNLAHLFY

SEQ ID NO: 175371 - protein, 9 aa, Artificial Sequence
  Description of Artificial Sequence: Synthetic peptide
  Seed: GPDGNTPQF (TYRP1_HUMAN)
GYDGNTPQM

SEQ ID NO: 175372 - protein, 10 aa, Artificial Sequence
  Description of Artificial Sequence: Synthetic peptide
  Seed: FLNGTGGQTH (TYRP1_HUMAN)
FENGTGGQTY

SEQ ID NO: 175373 - protein, 9 aa, Artificial Sequence
  Description of Artificial Sequence: Synthetic peptide
  Seed: YSNSTNSFR (TYRP1_HUMAN)
YLNSTNSFY

SEQ ID NO: 175374 - protein, 10 aa, Artificial Sequence
  Description of Artificial Sequence: Synthetic peptide
  Seed: LLHTFTDAVF (TYRP1_HUMAN)
LLHTFTDAVI

SEQ ID NO: 175375 - protein, 9 aa, Artificial Sequence
  Description of Artificial Sequence: Synthetic peptide
  Seed: DDREVWPLR (TYRP1_HUMAN)
DVREVWPLR

SEQ ID NO: 175376 - protein, 10 aa, Artificial Sequence
  Description of Artificial Sequence: Synthetic peptide
  Seed: VDFSHEGPAF (TYRP1_HUMAN)
VVFSHEGPAM

SEQ ID NO: 175377 - protein, 9 aa, Artificial Sequence
  Description of Artificial Sequence: Synthetic peptide
  Seed: RQCATVEAL (TYRP1_HUMAN)
RWCATVEAY

SEQ ID NO: 175378 - protein, 9 aa, Artificial Sequence
  Description of Artificial Sequence: Synthetic peptide
  Seed: TLISPNSVF (TYRP1_HUMAN)
TQISPNSVL

SEQ ID NO: 175379 - protein, 10 aa, Artificial Sequence
  Description of Artificial Sequence: Synthetic peptide
  Seed: KLLSLGCIFF (TYRP1_HUMAN)
KKLSLGCIFF

SEQ ID NO: 175380 - protein, 10 aa, Artificial Sequence
  Description of Artificial Sequence: Synthetic peptide
  Seed: WPPVTNTEMF (TYRP1_HUMAN)
WKPVTNTEMW

SEQ ID NO: 175381 - protein, 9 aa, Artificial Sequence
  Description of Artificial Sequence: Synthetic peptide
  Seed: DLMGSRSNF (TYRP1_HUMAN)
DTMGSRSNW

SEQ ID NO: 175382 - protein, 11 aa, Artificial Sequence
  Description of Artificial Sequence: Synthetic peptide
  Seed: IYNYFVWTHYY (TYRP1_HUMAN)
IQNYFVWTHYF

SEQ ID NO: 175383 - protein, 9 aa, Artificial Sequence
  Description of Artificial Sequence: Synthetic peptide
  Seed: TLISPNSVF (TYRP1_HUMAN)
TVISPNSVM

SEQ ID NO: 175384 - protein, 11 aa, Artificial Sequence
  Description of Artificial Sequence: Synthetic peptide
  Seed: RSMDEANQPLL (TYRP1_HUMAN)
RQMDEANQPLV

SEQ ID NO: 175385 - protein, 11 aa, Artificial Sequence
  Description of Artificial Sequence: Synthetic peptide
  Seed: QRLPEPQDVAQ (TYRP1_HUMAN)
QRLPEPQDVAL

SEQ ID NO: 175386 - protein, 9 aa, Artificial Sequence
  Description of Artificial Sequence: Synthetic peptide
  Seed: FVWTHYYSV (TYRP1_HUMAN)
FMWTHYYSS

SEQ ID NO: 175387 - protein, 9 aa, Artificial Sequence
  Description of Artificial Sequence: Synthetic peptide
  Seed: TWHRYHLLR (TYRP1_HUMAN)
TMHRYHLLK

SEQ ID NO: 175388 - protein, 9 aa, Artificial Sequence
  Description of Artificial Sequence: Synthetic peptide
  Seed: GPDGNTPQF (TYRP1_HUMAN)
GIDGNTPQV

SEQ ID NO: 175389 - protein, 9 aa, Artificial Sequence
  Description of Artificial Sequence: Synthetic peptide
  Seed: MSAPKLLSL (TYRP1_HUMAN)
MPAPKLLSS

SEQ ID NO: 175390 - protein, 10 aa, Artificial Sequence
  Description of Artificial Sequence: Synthetic peptide
  Seed: EIIAIAVVGA (TYRP1_HUMAN)
EEIAIAVVGV

SEQ ID NO: 175391 - protein, 10 aa, Artificial Sequence
  Description of Artificial Sequence: Synthetic peptide
  Seed: YFVWTHYYSV (TYRP1_HUMAN)
YKVWTHYYSI

SEQ ID NO: 175392 - protein, 11 aa, Artificial Sequence
  Description of Artificial Sequence: Synthetic peptide
  Seed: HLSPNDPIFVL (TYRP1_HUMAN)
HMSPNDPIFVF

SEQ ID NO: 175393 - protein, 9 aa, Artificial Sequence
  Description of Artificial Sequence: Synthetic peptide
  Seed: NVARPMVQR (TYRP1_HUMAN)
NSARPMVQK

SEQ ID NO: 175394 - protein, 10 aa, Artificial Sequence
  Description of Artificial Sequence: Synthetic peptide
  Seed: SHEGPAFLTW (TYRP1_HUMAN)
SYEGPAFLTW

SEQ ID NO: 175395 - protein, 9 aa, Artificial Sequence
  Description of Artificial Sequence: Synthetic peptide
  Seed: AVVGALLLV (TYRP1_HUMAN)
ALVGALLLA

SEQ ID NO: 175396 - protein, 11 aa, Artificial Sequence
  Description of Artificial Sequence: Synthetic peptide
  Seed: RSMDEANQPLL (TYRP1_HUMAN)
RSMDEANQPLF

SEQ ID NO: 175397 - protein, 10 aa, Artificial Sequence
  Description of Artificial Sequence: Synthetic peptide
  Seed: LLFQQARAQF (TYRP1_HUMAN)
LAFQQARAQY

SEQ ID NO: 175398 - protein, 9 aa, Artificial Sequence
  Description of Artificial Sequence: Synthetic peptide
  Seed: VPFWPPVTN (TYRP1_HUMAN)
VPFWPPVTI

SEQ ID NO: 175399 - protein, 10 aa, Artificial Sequence
  Description of Artificial Sequence: Synthetic peptide
  Seed: KRTTHPLFVI (TYRP1_HUMAN)
KYTTHPLFVF

SEQ ID NO: 175400 - protein, 9 aa, Artificial Sequence
  Description of Artificial Sequence: Synthetic peptide
  Seed: VTAPDNLGY (TYRP1_HUMAN)
VVAPDNLGY

SEQ ID NO: 175401 - protein, 11 aa, Artificial Sequence
  Description of Artificial Sequence: Synthetic peptide
  Seed: VTAPDNLGYTY (TYRP1_HUMAN)
VLAPDNLGYTW

SEQ ID NO: 175402 - protein, 11 aa, Artificial Sequence
  Description of Artificial Sequence: Synthetic peptide
  Seed: YSDPTGKYDPA (TYRP1_HUMAN)
YADPTGKYDPI

SEQ ID NO: 175403 - protein, 9 aa, Artificial Sequence
  Description of Artificial Sequence: Synthetic peptide
  Seed: SLGCIFFPL (TYRP1_HUMAN)
SVGCIFFPM

SEQ ID NO: 175404 - protein, 8 aa, Artificial Sequence
  Description of Artificial Sequence: Synthetic peptide
  Seed: SVPEIIAI (TYRP1_HUMAN)
STPEIIAL

SEQ ID NO: 175405 - protein, 9 aa, Artificial Sequence
  Description of Artificial Sequence: Synthetic peptide
  Seed: FPLENAPIG (TYRP1_HUMAN)
FPLENAPIY

SEQ ID NO: 175406 - protein, 9 aa, Artificial Sequence
  Description of Artificial Sequence: Synthetic peptide
  Seed: FSHEGPAFL (TYRP1_HUMAN)
FTHEGPAFV

SEQ ID NO: 175407 - protein, 11 aa, Artificial Sequence
  Description of Artificial Sequence: Synthetic peptide
  Seed: MFVTAPDNLGY (TYRP1_HUMAN)
MRVTAPDNLGF

SEQ ID NO: 175408 - protein, 10 aa, Artificial Sequence
  Description of Artificial Sequence: Synthetic peptide
  Seed: NLAHLFLNGT (TYRP1_HUMAN)
NLAHLFLNGI

SEQ ID NO: 175409 - protein, 9 aa, Artificial Sequence
  Description of Artificial Sequence: Synthetic peptide
  Seed: AACDQRVLI (TYRP1_HUMAN)
ATCDQRVLL

SEQ ID NO: 175410 - protein, 11 aa, Artificial Sequence
  Description of Artificial Sequence: Synthetic peptide
  Seed: REFSVPEIIAI (TYRP1_HUMAN)
REFSVPEIIAP

SEQ ID NO: 175411 - protein, 9 aa, Artificial Sequence
  Description of Artificial Sequence: Synthetic peptide
  Seed: RGRCEAVTA (TYRP1_HUMAN)
RARCEAVTV

SEQ ID NO: 175412 - protein, 10 aa, Artificial Sequence
  Description of Artificial Sequence: Synthetic peptide
  Seed: FSVPEIIAIA (TYRP1_HUMAN)
FLVPEIIAIS

SEQ ID NO: 175413 - protein, 9 aa, Artificial Sequence
  Description of Artificial Sequence: Synthetic peptide
  Seed: LIFGTASYL (TYRP1_HUMAN)
LYFGTASYM

SEQ ID NO: 175414 - protein, 9 aa, Artificial Sequence
  Description of Artificial Sequence: Synthetic peptide
  Seed: LTWHRYHLL (TYRP1_HUMAN)
LGWHRYHLY

SEQ ID NO: 175415 - protein, 9 aa, Artificial Sequence
  Description of Artificial Sequence: Synthetic peptide
  Seed: FYSNSTNSF (TYRP1_HUMAN)
FMSNSTNSY

SEQ ID NO: 175416 - protein, 9 aa, Artificial Sequence
  Description of Artificial Sequence: Synthetic peptide
  Seed: RQYNMVPFW (TYRP1_HUMAN)
RFYNMVPFY

SEQ ID NO: 175417 - protein, 9 aa, Artificial Sequence
  Description of Artificial Sequence: Synthetic peptide
  Seed: EEKNHFVRA (TYRP1_HUMAN)
EEKNHFVRL

SEQ ID NO: 175418 - protein, 10 aa, Artificial Sequence
  Description of Artificial Sequence: Synthetic peptide
  Seed: FPLENAPIGH (TYRP1_HUMAN)
FPLENAPIGF

SEQ ID NO: 175419 - protein, 9 aa, Artificial Sequence
  Description of Artificial Sequence: Synthetic peptide
  Seed: HYYSVKKTF (TYRP1_HUMAN)
HPYSVKKTY

SEQ ID NO: 175420 - protein, 9 aa, Artificial Sequence
  Description of Artificial Sequence: Synthetic peptide
  Seed: WHRYHLLRL (TYRP1_HUMAN)
WYRYHLLRL

SEQ ID NO: 175421 - protein, 9 aa, Artificial Sequence
  Description of Artificial Sequence: Synthetic peptide
  Seed: EIQWPSREF (TYRP1_HUMAN)
EVQWPSRER

SEQ ID NO: 175422 - protein, 8 aa, Artificial Sequence
  Description of Artificial Sequence: Synthetic peptide
  Seed: FSHEGPAF (TYRP1_HUMAN)
FYHEGPAF

SEQ ID NO: 175423 - protein, 9 aa, Artificial Sequence
  Description of Artificial Sequence: Synthetic peptide
  Seed: RQYNMVPFW (TYRP1_HUMAN)
RMYNMVPFY

SEQ ID NO: 175424 - protein, 10 aa, Artificial Sequence
  Description of Artificial Sequence: Synthetic peptide
  Seed: VDFSHEGPAF (TYRP1_HUMAN)
VEFSHEGPAL

SEQ ID NO: 175425 - protein, 10 aa, Artificial Sequence
  Description of Artificial Sequence: Synthetic peptide
  Seed: FWPPVTNTEM (TYRP1_HUMAN)
FRPPVTNTEM

SEQ ID NO: 175426 - protein, 9 aa, Artificial Sequence
  Description of Artificial Sequence: Synthetic peptide
  Seed: AIAVVGALL (TYRP1_HUMAN)
AAAVVGALV

SEQ ID NO: 175427 - protein, 10 aa, Artificial Sequence
  Description of Artificial Sequence: Synthetic peptide
  Seed: AVRSLHNLAH (TYRP1_HUMAN)
ATRSLHNLAS

SEQ ID NO: 175428 - protein, 9 aa, Artificial Sequence
  Description of Artificial Sequence: Synthetic peptide
  Seed: KYDPAVRSL (TYRP1_HUMAN)
KCDPAVRSV

SEQ ID NO: 175429 - protein, 9 aa, Artificial Sequence
  Description of Artificial Sequence: Synthetic peptide
  Seed: AVFDEWLRR (TYRP1_HUMAN)
AAFDEWLRL

SEQ ID NO: 175430 - protein, 10 aa, Artificial Sequence
  Description of Artificial Sequence: Synthetic peptide
  Seed: FQQARAQFPR (TYRP1_HUMAN)
FSQARAQFPK

SEQ ID NO: 175431 - protein, 9 aa, Artificial Sequence
  Description of Artificial Sequence: Synthetic peptide
  Seed: ACDQRVLIV (TYRP1_HUMAN)
AADQRVLIV

SEQ ID NO: 175432 - protein, 9 aa, Artificial Sequence
  Description of Artificial Sequence: Synthetic peptide
  Seed: FSHEGPAFL (TYRP1_HUMAN)
FGHEGPAFH

SEQ ID NO: 175433 - protein, 11 aa, Artificial Sequence
  Description of Artificial Sequence: Synthetic peptide
  Seed: YNYFVWTHYYS (TYRP1_HUMAN)
YAYFVWTHYYY

SEQ ID NO: 175434 - protein, 11 aa, Artificial Sequence
  Description of Artificial Sequence: Synthetic peptide
  Seed: YFVWTHYYSVK (TYRP1_HUMAN)
YTVWTHYYSVR

SEQ ID NO: 175435 - protein, 9 aa, Artificial Sequence
  Description of Artificial Sequence: Synthetic peptide
  Seed: LSKEEKNHF (TYRP1_HUMAN)
LAKEEKNHL

SEQ ID NO: 175436 - protein, 9 aa, Artificial Sequence
  Description of Artificial Sequence: Synthetic peptide
  Seed: TAPDNLGYT (TYRP1_HUMAN)
TTPDNLGYL

SEQ ID NO: 175437 - protein, 9 aa, Artificial Sequence
  Description of Artificial Sequence: Synthetic peptide
  Seed: TLISPNSVF (TYRP1_HUMAN)
TQISPNSVW

SEQ ID NO: 175438 - protein, 9 aa, Artificial Sequence
  Description of Artificial Sequence: Synthetic peptide
  Seed: KRTTHPLFV (TYRP1_HUMAN)
KRTTHPLFF

SEQ ID NO: 175439 - protein, 9 aa, Artificial Sequence
  Description of Artificial Sequence: Synthetic peptide
  Seed: AIAVVGALL (TYRP1_HUMAN)
AQAVVGALW

SEQ ID NO: 175440 - protein, 9 aa, Artificial Sequence
  Description of Artificial Sequence: Synthetic peptide
  Seed: GPDGNTPQF (TYRP1_HUMAN)
GGDGNTPQV

SEQ ID NO: 175441 - protein, 9 aa, Artificial Sequence
  Description of Artificial Sequence: Synthetic peptide
  Seed: LQNPNQSVV (TYRP1_HUMAN)
LHNPNQSVV

SEQ ID NO: 175442 - protein, 9 aa, Artificial Sequence
  Description of Artificial Sequence: Synthetic peptide
  Seed: REFSVPEII (TYRP1_HUMAN)
REFSVPEIC

SEQ ID NO: 175443 - protein, 9 aa, Artificial Sequence
  Description of Artificial Sequence: Synthetic peptide
  Seed: VFDEWLRRY (TYRP1_HUMAN)
VVDEWLRRI

SEQ ID NO: 175444 - protein, 9 aa, Artificial Sequence
  Description of Artificial Sequence: Synthetic peptide
  Seed: MSAPKLLSL (TYRP1_HUMAN)
MAAPKLLSK

SEQ ID NO: 175445 - protein, 10 aa, Artificial Sequence
  Description of Artificial Sequence: Synthetic peptide
  Seed: AVFDEWLRRY (TYRP1_HUMAN)
AMFDEWLRRR

SEQ ID NO: 175446 - protein, 10 aa, Artificial Sequence
  Description of Artificial Sequence: Synthetic peptide
  Seed: DVAQCLEVGL (TYRP1_HUMAN)
DMAQCLEVGR

SEQ ID NO: 175447 - protein, 9 aa, Artificial Sequence
  Description of Artificial Sequence: Synthetic peptide
  Seed: RFFNRTCHC (TYRP1_HUMAN)
RFFNRTCHA

SEQ ID NO: 175448 - protein, 10 aa, Artificial Sequence
  Description of Artificial Sequence: Synthetic peptide
  Seed: EFSVPEIIAI (TYRP1_HUMAN)
EASVPEIIAV

SEQ ID NO: 175449 - protein, 10 aa, Artificial Sequence
  Description of Artificial Sequence: Synthetic peptide
  Seed: YNYFVWTHYY (TYRP1_HUMAN)
YIYFVWTHYW

SEQ ID NO: 175450 - protein, 9 aa, Artificial Sequence
  Description of Artificial Sequence: Synthetic peptide
  Seed: REFSVPEII (TYRP1_HUMAN)
RSFSVPEIL

SEQ ID NO: 175451 - protein, 9 aa, Artificial Sequence
  Description of Artificial Sequence: Synthetic peptide
  Seed: LEVGLFDTP (TYRP1_HUMAN)
LEVGLFDTA

SEQ ID NO: 175452 - protein, 11 aa, Artificial Sequence
  Description of Artificial Sequence: Synthetic peptide
  Seed: YNYFVWTHYYS (TYRP1_HUMAN)
YMYFVWTHYYL

SEQ ID NO: 175453 - protein, 9 aa, Artificial Sequence
  Description of Artificial Sequence: Synthetic peptide
  Seed: AQFPRQCAT (TYRP1_HUMAN)
ALFPRQCAL

SEQ ID NO: 175454 - protein, 9 aa, Artificial Sequence
  Description of Artificial Sequence: Synthetic peptide
  Seed: FSVPEIIAI (TYRP1_HUMAN)
FIVPEIIAL

SEQ ID NO: 175455 - protein, 10 aa, Artificial Sequence
  Description of Artificial Sequence: Synthetic peptide
  Seed: YNYFVWTHYY (TYRP1_HUMAN)
YDYFVWTHYI

SEQ ID NO: 175456 - protein, 9 aa, Artificial Sequence
  Description of Artificial Sequence: Synthetic peptide
  Seed: FPLLLFQQA (TYRP1_HUMAN)
FALLLFQQF

SEQ ID NO: 175457 - protein, 8 aa, Artificial Sequence
  Description of Artificial Sequence: Synthetic peptide
  Seed: REFSVPEI (TYRP1_HUMAN)
REFSVPET

SEQ ID NO: 175458 - protein, 9 aa, Artificial Sequence
  Description of Artificial Sequence: Synthetic peptide
  Seed: AVRSLHNLA (TYRP1_HUMAN)
ASRSLHNLM

SEQ ID NO: 175459 - protein, 11 aa, Artificial Sequence
  Description of Artificial Sequence: Synthetic peptide
  Seed: YTYEIQWPSRE (TYRP1_HUMAN)
YTYEIQWPSRK

SEQ ID NO: 175460 - protein, 10 aa, Artificial Sequence
  Description of Artificial Sequence: Synthetic peptide
  Seed: NYFVWTHYYS (TYRP1_HUMAN)
NTFVWTHYYF

SEQ ID NO: 175461 - protein, 9 aa, Artificial Sequence
  Description of Artificial Sequence: Synthetic peptide
  Seed: LIFGTASYL (TYRP1_HUMAN)
LQFGTASYF

SEQ ID NO: 175462 - protein, 10 aa, Artificial Sequence
  Description of Artificial Sequence: Synthetic peptide
  Seed: FWPPVTNTEM (TYRP1_HUMAN)
FWPPVTNTEI

SEQ ID NO: 175463 - protein, 10 aa, Artificial Sequence
  Description of Artificial Sequence: Synthetic peptide
  Seed: SMDEANQPLL (TYRP1_HUMAN)
SFDEANQPLL

SEQ ID NO: 175464 - protein, 9 aa, Artificial Sequence
  Description of Artificial Sequence: Synthetic peptide
  Seed: LFQQARAQF (TYRP1_HUMAN)
LAQQARAQM

SEQ ID NO: 175465 - protein, 9 aa, Artificial Sequence
  Description of Artificial Sequence: Synthetic peptide
  Seed: LTWHRYHLL (TYRP1_HUMAN)
LLWHRYHLC

SEQ ID NO: 175466 - protein, 9 aa, Artificial Sequence
  Description of Artificial Sequence: Synthetic peptide
  Seed: VCDICTDDL (TYRP1_HUMAN)
VTDICTDDM

SEQ ID NO: 175467 - protein, 9 aa, Artificial Sequence
  Description of Artificial Sequence: Synthetic peptide
  Seed: APDNLGYTY (TYRP1_HUMAN)
ASDNLGYTY

SEQ ID NO: 175468 - protein, 10 aa, Artificial Sequence
  Description of Artificial Sequence: Synthetic peptide
  Seed: SPNDPIFVLL (TYRP1_HUMAN)
STNDPIFVLL

SEQ ID NO: 175469 - protein, 9 aa, Artificial Sequence
  Description of Artificial Sequence: Synthetic peptide
  Seed: ALIFGTASY (TYRP1_HUMAN)
AVIFGTASY

SEQ ID NO: 175470 - protein, 9 aa, Artificial Sequence
  Description of Artificial Sequence: Synthetic peptide
  Seed: RPGWRGAAC (TYRP1_HUMAN)
RPGWRGAAF

SEQ ID NO: 175471 - protein, 11 aa, Artificial Sequence
  Description of Artificial Sequence: Synthetic peptide
  Seed: YNMVPFWPPVT (TYRP1_HUMAN)
YQMVPFWPPVC

SEQ ID NO: 175472 - protein, 9 aa, Artificial Sequence
  Description of Artificial Sequence: Synthetic peptide
  Seed: AACDQRVLI (TYRP1_HUMAN)
ATCDQRVLW

SEQ ID NO: 175473 - protein, 11 aa, Artificial Sequence
  Description of Artificial Sequence: Synthetic peptide
  Seed: FVWTHYYSVKK (TYRP1_HUMAN)
FMWTHYYSVKR

SEQ ID NO: 175474 - protein, 9 aa, Artificial Sequence
  Description of Artificial Sequence: Synthetic peptide
  Seed: AQFPRQCAT (TYRP1_HUMAN)
AQFPRQCAH

SEQ ID NO: 175475 - protein, 10 aa, Artificial Sequence
  Description of Artificial Sequence: Synthetic peptide
  Seed: KRTTHPLFVI (TYRP1_HUMAN)
KSTTHPLFVW

SEQ ID NO: 175476 - protein, 9 aa, Artificial Sequence
  Description of Artificial Sequence: Synthetic peptide
  Seed: SVPEIIAIA (TYRP1_HUMAN)
SIPEIIAIY

SEQ ID NO: 175477 - protein, 10 aa, Artificial Sequence
  Description of Artificial Sequence: Synthetic peptide
  Seed: YNADISTFPL (TYRP1_HUMAN)
YAADISTFPF

SEQ ID NO: 175478 - protein, 10 aa, Artificial Sequence
  Description of Artificial Sequence: Synthetic peptide
  Seed: YSNSTNSFRN (TYRP1_HUMAN)
YTNSTNSFRK

SEQ ID NO: 175479 - protein, 9 aa, Artificial Sequence
  Description of Artificial Sequence: Synthetic peptide
  Seed: SLPYWNFAT (TYRP1_HUMAN)
SMPYWNFAL

SEQ ID NO: 175480 - protein, 10 aa, Artificial Sequence
  Description of Artificial Sequence: Synthetic peptide
  Seed: YEIQWPSREF (TYRP1_HUMAN)
YEIQWPSREY

SEQ ID NO: 175481 - protein, 8 aa, Artificial Sequence
  Description of Artificial Sequence: Synthetic peptide
  Seed: SAPKLLSL (TYRP1_HUMAN)
SAPKLLSM

SEQ ID NO: 175482 - protein, 9 aa, Artificial Sequence
  Description of Artificial Sequence: Synthetic peptide
  Seed: LLSLGCIFF (TYRP1_HUMAN)
LMSLGCIFY

SEQ ID NO: 175483 - protein, 10 aa, Artificial Sequence
  Description of Artificial Sequence: Synthetic peptide
  Seed: AVVGALLLVA (TYRP1_HUMAN)
AMVGALLLVV

SEQ ID NO: 175484 - protein, 9 aa, Artificial Sequence
  Description of Artificial Sequence: Synthetic peptide
  Seed: KYDPAVRSL (TYRP1_HUMAN)
KSDPAVRSC

SEQ ID NO: 175485 - protein, 9 aa, Artificial Sequence
  Description of Artificial Sequence: Synthetic peptide
  Seed: KLLSLGCIF (TYRP1_HUMAN)
KFLSLGCIF

SEQ ID NO: 175486 - protein, 10 aa, Artificial Sequence
  Description of Artificial Sequence: Synthetic peptide
  Seed: RLEKDMQEML (TYRP1_HUMAN)
RQEKDMQEMF

SEQ ID NO: 175487 - protein, 11 aa, Artificial Sequence
  Description of Artificial Sequence: Synthetic peptide
  Seed: ALIFGTASYLI (TYRP1_HUMAN)
ALIFGTASYLL

SEQ ID NO: 175488 - protein, 9 aa, Artificial Sequence
  Description of Artificial Sequence: Synthetic peptide
  Seed: DYDTLGTLC (TYRP1_HUMAN)
DFDTLGTLL

SEQ ID NO: 175489 - protein, 11 aa, Artificial Sequence
  Description of Artificial Sequence: Synthetic peptide
  Seed: RSMDEANQPLL (TYRP1_HUMAN)
RWMDEANQPLY

SEQ ID NO: 175490 - protein, 9 aa, Artificial Sequence
  Description of Artificial Sequence: Synthetic peptide
  Seed: FSVPEIIAI (TYRP1_HUMAN)
FPVPEIIAT

SEQ ID NO: 175491 - protein, 10 aa, Artificial Sequence
  Description of Artificial Sequence: Synthetic peptide
  Seed: STLISPNSVF (TYRP1_HUMAN)
SELISPNSVF

SEQ ID NO: 175492 - protein, 9 aa, Artificial Sequence
  Description of Artificial Sequence: Synthetic peptide
  Seed: VTAPDNLGY (TYRP1_HUMAN)
VVAPDNLGK

SEQ ID NO: 175493 - protein, 11 aa, Artificial Sequence
  Description of Artificial Sequence: Synthetic peptide
  Seed: VTAPDNLGYTY (TYRP1_HUMAN)
VMAPDNLGYTR

SEQ ID NO: 175494 - protein, 10 aa, Artificial Sequence
  Description of Artificial Sequence: Synthetic peptide
  Seed: MAKRTTHPLF (TYRP1_HUMAN)
MPKRTTHPLV

SEQ ID NO: 175495 - protein, 9 aa, Artificial Sequence
  Description of Artificial Sequence: Synthetic peptide
  Seed: RARRSMDEA (TYRP1_HUMAN)
RFRRSMDEK

SEQ ID NO: 175496 - protein, 9 aa, Artificial Sequence
  Description of Artificial Sequence: Synthetic peptide
  Seed: AVRSLHNLA (TYRP1_HUMAN)
AVRSLHNLY

SEQ ID NO: 175497 - protein, 9 aa, Artificial Sequence
  Description of Artificial Sequence: Synthetic peptide
  Seed: RARRSMDEA (TYRP1_HUMAN)
RVRRSMDEK

SEQ ID NO: 175498 - protein, 9 aa, Artificial Sequence
  Description of Artificial Sequence: Synthetic peptide
  Seed: SVPEIIAIA (TYRP1_HUMAN)
SGPEIIAIM

SEQ ID NO: 175499 - protein, 10 aa, Artificial Sequence
  Description of Artificial Sequence: Synthetic peptide
  Seed: YNADISTFPL (TYRP1_HUMAN)
YAADISTFPM

SEQ ID NO: 175500 - protein, 9 aa, Artificial Sequence
  Description of Artificial Sequence: Synthetic peptide
  Seed: NMVPFWPPV (TYRP1_HUMAN)
NYVPFWPPY

SEQ ID NO: 175501 - protein, 10 aa, Artificial Sequence
  Description of Artificial Sequence: Synthetic peptide
  Seed: AVFDEWLRRY (TYRP1_HUMAN)
AAFDEWLRRF

SEQ ID NO: 175502 - protein, 9 aa, Artificial Sequence
  Description of Artificial Sequence: Synthetic peptide
  Seed: MAKRTTHPL (TYRP1_HUMAN)
MGKRTTHPA

SEQ ID NO: 175503 - protein, 8 aa, Artificial Sequence
  Description of Artificial Sequence: Synthetic peptide
  Seed: YFVWTHYY (TYRP1_HUMAN)
YFVWTHYL

SEQ ID NO: 175504 - protein, 11 aa, Artificial Sequence
  Description of Artificial Sequence: Synthetic peptide
  Seed: IYNYFVWTHYY (TYRP1_HUMAN)
IRNYFVWTHYI

SEQ ID NO: 175505 - protein, 10 aa, Artificial Sequence
  Description of Artificial Sequence: Synthetic peptide
  Seed: IIAIAVVGAL (TYRP1_HUMAN)
IQAIAVVGAV

SEQ ID NO: 175506 - protein, 9 aa, Artificial Sequence
  Description of Artificial Sequence: Synthetic peptide
  Seed: FLTWHRYHL (TYRP1_HUMAN)
FLTWHRYHT

SEQ ID NO: 175507 - protein, 10 aa, Artificial Sequence
  Description of Artificial Sequence: Synthetic peptide
  Seed: SMDEANQPLL (TYRP1_HUMAN)
SWDEANQPLL

SEQ ID NO: 175508 - protein, 10 aa, Artificial Sequence
  Description of Artificial Sequence: Synthetic peptide
  Seed: LSPNDPIFVL (TYRP1_HUMAN)
LKPNDPIFVM

SEQ ID NO: 175509 - protein, 10 aa, Artificial Sequence
  Description of Artificial Sequence: Synthetic peptide
  Seed: YNMVPFWPPV (TYRP1_HUMAN)
YAMVPFWPPA

SEQ ID NO: 175510 - protein, 10 aa, Artificial Sequence
  Description of Artificial Sequence: Synthetic peptide
  Seed: NSTEDGPIRR (TYRP1_HUMAN)
NVTEDGPIRR

SEQ ID NO: 175511 - protein, 9 aa, Artificial Sequence
  Description of Artificial Sequence: Synthetic peptide
  Seed: AACDQRVLI (TYRP1_HUMAN)
ATCDQRVLV

SEQ ID NO: 175512 - protein, 10 aa, Artificial Sequence
  Description of Artificial Sequence: Synthetic peptide
  Seed: VGLFDTPPFY (TYRP1_HUMAN)
VILFDTPPFK

SEQ ID NO: 175513 - protein, 9 aa, Artificial Sequence
  Description of Artificial Sequence: Synthetic peptide
  Seed: VTAPDNLGY (TYRP1_HUMAN)
VTAPDNLGR

SEQ ID NO: 175514 - protein, 9 aa, Artificial Sequence
  Description of Artificial Sequence: Synthetic peptide
  Seed: ISIYNYFVW (TYRP1_HUMAN)
IYIYNYFVI

SEQ ID NO: 175515 - protein, 9 aa, Artificial Sequence
  Description of Artificial Sequence: Synthetic peptide
  Seed: MAKRTTHPL (TYRP1_HUMAN)
MSKRTTHPI

SEQ ID NO: 175516 - protein, 10 aa, Artificial Sequence
  Description of Artificial Sequence: Synthetic peptide
  Seed: YNYFVWTHYY (TYRP1_HUMAN)
YIYFVWTHYI

SEQ ID NO: 175517 - protein, 9 aa, Artificial Sequence
  Description of Artificial Sequence: Synthetic peptide
  Seed: EIQWPSREF (TYRP1_HUMAN)
EVQWPSREK

SEQ ID NO: 175518 - protein, 11 aa, Artificial Sequence
  Description of Artificial Sequence: Synthetic peptide
  Seed: MLQEPSFSLPY (TYRP1_HUMAN)
MSQEPSFSLPY

SEQ ID NO: 175519 - protein, 10 aa, Artificial Sequence
  Description of Artificial Sequence: Synthetic peptide
  Seed: SPNDPIFVLL (TYRP1_HUMAN)
SRNDPIFVLL

SEQ ID NO: 175520 - protein, 11 aa, Artificial Sequence
  Description of Artificial Sequence: Synthetic peptide
  Seed: FPLLLFQQARA (TYRP1_HUMAN)
FYLLLFQQARV

SEQ ID NO: 175521 - protein, 10 aa, Artificial Sequence
  Description of Artificial Sequence: Synthetic peptide
  Seed: AVRSLHNLAH (TYRP1_HUMAN)
ATRSLHNLAL

SEQ ID NO: 175522 - protein, 9 aa, Artificial Sequence
  Description of Artificial Sequence: Synthetic peptide
  Seed: KYDPAVRSL (TYRP1_HUMAN)
KVDPAVRSF

SEQ ID NO: 175523 - protein, 9 aa, Artificial Sequence
  Description of Artificial Sequence: Synthetic peptide
  Seed: TTHPLFVIA (TYRP1_HUMAN)
TVHPLFVIY

SEQ ID NO: 175524 - protein, 10 aa, Artificial Sequence
  Description of Artificial Sequence: Synthetic peptide
  Seed: NYFVWTHYYS (TYRP1_HUMAN)
NSFVWTHYYY

SEQ ID NO: 175525 - protein, 9 aa, Artificial Sequence
  Description of Artificial Sequence: Synthetic peptide
  Seed: MLQEPSFSL (TYRP1_HUMAN)
MQQEPSFSA

SEQ ID NO: 175526 - protein, 10 aa, Artificial Sequence
  Description of Artificial Sequence: Synthetic peptide
  Seed: ADSRPHSPQY (TYRP1_HUMAN)
AQSRPHSPQA

SEQ ID NO: 175527 - protein, 9 aa, Artificial Sequence
  Description of Artificial Sequence: Synthetic peptide
  Seed: MFVTAPDNL (TYRP1_HUMAN)
MYVTAPDNM

SEQ ID NO: 175528 - protein, 10 aa, Artificial Sequence
  Description of Artificial Sequence: Synthetic peptide
  Seed: IYNYFVWTHY (TYRP1_HUMAN)
ILNYFVWTHY

SEQ ID NO: 175529 - protein, 9 aa, Artificial Sequence
  Description of Artificial Sequence: Synthetic peptide
  Seed: DDREVWPLR (TYRP1_HUMAN)
DIREVWPLR

SEQ ID NO: 175530 - protein, 10 aa, Artificial Sequence
  Description of Artificial Sequence: Synthetic peptide
  Seed: LQEPSFSLPY (TYRP1_HUMAN)
LIEPSFSLPF

SEQ ID NO: 175531 - protein, 9 aa, Artificial Sequence
  Description of Artificial Sequence: Synthetic peptide
  Seed: IAIAVVGAL (TYRP1_HUMAN)
IAIAVVGAM

SEQ ID NO: 175532 - protein, 9 aa, Artificial Sequence
  Description of Artificial Sequence: Synthetic peptide
  Seed: IAIAVVGAL (TYRP1_HUMAN)
ITIAVVGAM

SEQ ID NO: 175533 - protein, 9 aa, Artificial Sequence
  Description of Artificial Sequence: Synthetic peptide
  Seed: LLLFQQARA (TYRP1_HUMAN)
LLLFQQARI

SEQ ID NO: 175534 - protein, 9 aa, Artificial Sequence
  Description of Artificial Sequence: Synthetic peptide
  Seed: TADSRPHSP (TYRP1_HUMAN)
TSDSRPHSM

SEQ ID NO: 175535 - protein, 9 aa, Artificial Sequence
  Description of Artificial Sequence: Synthetic peptide
  Seed: GTASYLIRA (TYRP1_HUMAN)
GLASYLIRM

SEQ ID NO: 175536 - protein, 9 aa, Artificial Sequence
  Description of Artificial Sequence: Synthetic peptide
  Seed: FVWTHYYSV (TYRP1_HUMAN)
FRWTHYYSL

SEQ ID NO: 175537 - protein, 11 aa, Artificial Sequence
  Description of Artificial Sequence: Synthetic peptide
  Seed: YSDPTGKYDPA (TYRP1_HUMAN)
YSDPTGKYDPL

SEQ ID NO: 175538 - protein, 9 aa, Artificial Sequence
  Description of Artificial Sequence: Synthetic peptide
  Seed: GPDGNTPQF (TYRP1_HUMAN)
GNDGNTPQL

SEQ ID NO: 175539 - protein, 10 aa, Artificial Sequence
  Description of Artificial Sequence: Synthetic peptide
  Seed: IAVVGALLLV (TYRP1_HUMAN)
IMVVGALLLV

SEQ ID NO: 175540 - protein, 10 aa, Artificial Sequence
  Description of Artificial Sequence: Synthetic peptide
  Seed: MVPFWPPVTN (TYRP1_HUMAN)
MRPFWPPVTL

SEQ ID NO: 175541 - protein, 9 aa, Artificial Sequence
  Description of Artificial Sequence: Synthetic peptide
  Seed: RQYNMVPFW (TYRP1_HUMAN)
REYNMVPFL

SEQ ID NO: 175542 - protein, 9 aa, Artificial Sequence
  Description of Artificial Sequence: Synthetic peptide
  Seed: LQNPNQSVV (TYRP1_HUMAN)
LENPNQSVP

SEQ ID NO: 175543 - protein, 9 aa, Artificial Sequence
  Description of Artificial Sequence: Synthetic peptide
  Seed: KYDPAVRSL (TYRP1_HUMAN)
KTDPAVRSV

SEQ ID NO: 175544 - protein, 10 aa, Artificial Sequence
  Description of Artificial Sequence: Synthetic peptide
  Seed: LTWHRYHLLR (TYRP1_HUMAN)
LMWHRYHLLR

SEQ ID NO: 175545 - protein, 10 aa, Artificial Sequence
  Description of Artificial Sequence: Synthetic peptide
  Seed: FVWTHYYSVK (TYRP1_HUMAN)
FLWTHYYSVQ

SEQ ID NO: 175546 - protein, 9 aa, Artificial Sequence
  Description of Artificial Sequence: Synthetic peptide
  Seed: FVRALDMAK (TYRP1_HUMAN)
FSRALDMAR

SEQ ID NO: 175547 - protein, 10 aa, Artificial Sequence
  Description of Artificial Sequence: Synthetic peptide
  Seed: MLQEPSFSLP (TYRP1_HUMAN)
MMQEPSFSLR

SEQ ID NO: 175548 - protein, 10 aa, Artificial Sequence
  Description of Artificial Sequence: Synthetic peptide
  Seed: YNMVPFWPPV (TYRP1_HUMAN)
YGMVPFWPPV

SEQ ID NO: 175549 - protein, 10 aa, Artificial Sequence
  Description of Artificial Sequence: Synthetic peptide
  Seed: LIFGTASYLI (TYRP1_HUMAN)
LNFGTASYLF

SEQ ID NO: 175550 - protein, 9 aa, Artificial Sequence
  Description of Artificial Sequence: Synthetic peptide
  Seed: RGRCEAVTA (TYRP1_HUMAN)
RIRCEAVTL

SEQ ID NO: 175551 - protein, 9 aa, Artificial Sequence
  Description of Artificial Sequence: Synthetic peptide
  Seed: AVRSLHNLA (TYRP1_HUMAN)
AVRSLHNLM

SEQ ID NO: 175552 - protein, 11 aa, Artificial Sequence
  Description of Artificial Sequence: Synthetic peptide
  Seed: LVALIFGTASY (TYRP1_HUMAN)
LPALIFGTASY

SEQ ID NO: 175553 - protein, 9 aa, Artificial Sequence
  Description of Artificial Sequence: Synthetic peptide
  Seed: YLIRARRSM (TYRP1_HUMAN)
YSIRARRSF

SEQ ID NO: 175554 - protein, 11 aa, Artificial Sequence
  Description of Artificial Sequence: Synthetic peptide
  Seed: NYFVWTHYYSV (TYRP1_HUMAN)
NYFVWTHYYSW

SEQ ID NO: 175555 - protein, 9 aa, Artificial Sequence
  Description of Artificial Sequence: Synthetic peptide
  Seed: EIQWPSREF (TYRP1_HUMAN)
ESQWPSRER

SEQ ID NO: 175556 - protein, 10 aa, Artificial Sequence
  Description of Artificial Sequence: Synthetic peptide
  Seed: YNYFVWTHYY (TYRP1_HUMAN)
YNYFVWTHYM

SEQ ID NO: 175557 - protein, 10 aa, Artificial Sequence
  Description of Artificial Sequence: Synthetic peptide
  Seed: FSLPYWNFAT (TYRP1_HUMAN)
FLLPYWNFAG

SEQ ID NO: 175558 - protein, 8 aa, Artificial Sequence
  Description of Artificial Sequence: Synthetic peptide
  Seed: LIFGTASY (TYRP1_HUMAN)
LQFGTASI

SEQ ID NO: 175559 - protein, 9 aa, Artificial Sequence
  Description of Artificial Sequence: Synthetic peptide
  Seed: AVRSLHNLA (TYRP1_HUMAN)
AMRSLHNLK

SEQ ID NO: 175560 - protein, 10 aa, Artificial Sequence
  Description of Artificial Sequence: Synthetic peptide
  Seed: FYSNSTNSFR (TYRP1_HUMAN)
FWSNSTNSFR

SEQ ID NO: 175561 - protein, 9 aa, Artificial Sequence
  Description of Artificial Sequence: Synthetic peptide
  Seed: SMDEANQPL (TYRP1_HUMAN)
SQDEANQPF

SEQ ID NO: 175562 - protein, 9 aa, Artificial Sequence
  Description of Artificial Sequence: Synthetic peptide
  Seed: HEGPAFLTW (TYRP1_HUMAN)
HTGPAFLTL

SEQ ID NO: 175563 - protein, 10 aa, Artificial Sequence
  Description of Artificial Sequence: Synthetic peptide
  Seed: KLLSLGCIFF (TYRP1_HUMAN)
KQLSLGCIFF

SEQ ID NO: 175564 - protein, 9 aa, Artificial Sequence
  Description of Artificial Sequence: Synthetic peptide
  Seed: RRNLLDLSK (TYRP1_HUMAN)
RRNLLDLSL

SEQ ID NO: 175565 - protein, 10 aa, Artificial Sequence
  Description of Artificial Sequence: Synthetic peptide
  Seed: VGLFDTPPFY (TYRP1_HUMAN)
VHLFDTPPFK

SEQ ID NO: 175566 - protein, 10 aa, Artificial Sequence
  Description of Artificial Sequence: Synthetic peptide
  Seed: RTCHCNGNFS (TYRP1_HUMAN)
RMCHCNGNFK

SEQ ID NO: 175567 - protein, 10 aa, Artificial Sequence
  Description of Artificial Sequence: Synthetic peptide
  Seed: LSPNDPIFVL (TYRP1_HUMAN)
LKPNDPIFVY

SEQ ID NO: 175568 - protein, 11 aa, Artificial Sequence
  Description of Artificial Sequence: Synthetic peptide
  Seed: FSHEGPAFLTW (TYRP1_HUMAN)
FPHEGPAFLTW

SEQ ID NO: 175569 - protein, 11 aa, Artificial Sequence
  Description of Artificial Sequence: Synthetic peptide
  Seed: LVALIFGTASY (TYRP1_HUMAN)
LSALIFGTASW

SEQ ID NO: 175570 - protein, 9 aa, Artificial Sequence
  Description of Artificial Sequence: Synthetic peptide
  Seed: AVVGALLLV (TYRP1_HUMAN)
AMVGALLLL

SEQ ID NO: 175571 - protein, 8 aa, Artificial Sequence
  Description of Artificial Sequence: Synthetic peptide
  Seed: FSHEGPAF (TYRP1_HUMAN)
FIHEGPAL

SEQ ID NO: 175572 - protein, 10 aa, Artificial Sequence
  Description of Artificial Sequence: Synthetic peptide
  Seed: FSVPEIIAIA (TYRP1_HUMAN)
FSVPEIIAIL

SEQ ID NO: 175573 - protein, 9 aa, Artificial Sequence
  Description of Artificial Sequence: Synthetic peptide
  Seed: FSHEGPAFL (TYRP1_HUMAN)
FLHEGPAFY

SEQ ID NO: 175574 - protein, 10 aa, Artificial Sequence
  Description of Artificial Sequence: Synthetic peptide
  Seed: FVLLHTFTDA (TYRP1_HUMAN)
FFLLHTFTDL

SEQ ID NO: 175575 - protein, 9 aa, Artificial Sequence
  Description of Artificial Sequence: Synthetic peptide
  Seed: RARRSMDEA (TYRP1_HUMAN)
RVRRSMDEY

SEQ ID NO: 175576 - protein, 10 aa, Artificial Sequence
  Description of Artificial Sequence: Synthetic peptide
  Seed: LGPDGNTPQF (TYRP1_HUMAN)
LYPDGNTPQW

SEQ ID NO: 175577 - protein, 9 aa, Artificial Sequence
  Description of Artificial Sequence: Synthetic peptide
  Seed: VCDICTDDL (TYRP1_HUMAN)
VYDICTDDV

SEQ ID NO: 175578 - protein, 9 aa, Artificial Sequence
  Description of Artificial Sequence: Synthetic peptide
  Seed: IAVVGALLL (TYRP1_HUMAN)
IMVVGALLM

SEQ ID NO: 175579 - protein, 11 aa, Artificial Sequence
  Description of Artificial Sequence: Synthetic peptide
  Seed: REFSVPEIIAI (TYRP1_HUMAN)
REFSVPEIIAA

SEQ ID NO: 175580 - protein, 10 aa, Artificial Sequence
  Description of Artificial Sequence: Synthetic peptide
  Seed: YNADISTFPL (TYRP1_HUMAN)
YHADISTFPF

SEQ ID NO: 175581 - protein, 9 aa, Artificial Sequence
  Description of Artificial Sequence: Synthetic peptide
  Seed: NYFVWTHYY (TYRP1_HUMAN)
NFFVWTHYY

SEQ ID NO: 175582 - protein, 9 aa, Artificial Sequence
  Description of Artificial Sequence: Synthetic peptide
  Seed: QCATVEALR (TYRP1_HUMAN)
QLATVEALR

SEQ ID NO: 175583 - protein, 9 aa, Artificial Sequence
  Description of Artificial Sequence: Synthetic peptide
  Seed: SPNDPIFVL (TYRP1_HUMAN)
SPNDPIFVV

SEQ ID NO: 175584 - protein, 10 aa, Artificial Sequence
  Description of Artificial Sequence: Synthetic peptide
  Seed: TPQFENISIY (TYRP1_HUMAN)
TNQFENISIF

SEQ ID NO: 175585 - protein, 10 aa, Artificial Sequence
  Description of Artificial Sequence: Synthetic peptide
  Seed: FSLPYWNFAT (TYRP1_HUMAN)
FMLPYWNFAT

SEQ ID NO: 175586 - protein, 10 aa, Artificial Sequence
  Description of Artificial Sequence: Synthetic peptide
  Seed: LGPDGNTPQF (TYRP1_HUMAN)
LIPDGNTPQW

SEQ ID NO: 175587 - protein, 9 aa, Artificial Sequence
  Description of Artificial Sequence: Synthetic peptide
  Seed: RFFNRTCHC (TYRP1_HUMAN)
RIFNRTCHK

SEQ ID NO: 175588 - protein, 9 aa, Artificial Sequence
  Description of Artificial Sequence: Synthetic peptide
  Seed: RSLHNLAHL (TYRP1_HUMAN)
RVLHNLAHR

SEQ ID NO: 175589 - protein, 9 aa, Artificial Sequence
  Description of Artificial Sequence: Synthetic peptide
  Seed: ALIFGTASY (TYRP1_HUMAN)
AIIFGTASY

SEQ ID NO: 175590 - protein, 10 aa, Artificial Sequence
  Description of Artificial Sequence: Synthetic peptide
  Seed: IIAIAVVGAL (TYRP1_HUMAN)
ILAIAVVGAI

SEQ ID NO: 175591 - protein, 10 aa, Artificial Sequence
  Description of Artificial Sequence: Synthetic peptide
  Seed: KRTTHPLFVI (TYRP1_HUMAN)
KSTTHPLFVF

SEQ ID NO: 175592 - protein, 9 aa, Artificial Sequence
  Description of Artificial Sequence: Synthetic peptide
  Seed: MAKRTTHPL (TYRP1_HUMAN)
MPKRTTHPG

SEQ ID NO: 175593 - protein, 10 aa, Artificial Sequence
  Description of Artificial Sequence: Synthetic peptide
  Seed: YNYFVWTHYY (TYRP1_HUMAN)
YKYFVWTHYI

SEQ ID NO: 175594 - protein, 10 aa, Artificial Sequence
  Description of Artificial Sequence: Synthetic peptide
  Seed: HLSPNDPIFV (TYRP1_HUMAN)
HMSPNDPIFF

SEQ ID NO: 175595 - protein, 8 aa, Artificial Sequence
  Description of Artificial Sequence: Synthetic peptide
  Seed: REFSVPEI (TYRP1_HUMAN)
RDFSVPEM

SEQ ID NO: 175596 - protein, 11 aa, Artificial Sequence
  Description of Artificial Sequence: Synthetic peptide
  Seed: YSDPTGKYDPA (TYRP1_HUMAN)
YADPTGKYDPL

SEQ ID NO: 175597 - protein, 9 aa, Artificial Sequence
  Description of Artificial Sequence: Synthetic peptide
  Seed: SLHNLAHLF (TYRP1_HUMAN)
SQHNLAHLM

SEQ ID NO: 175598 - protein, 10 aa, Artificial Sequence
  Description of Artificial Sequence: Synthetic peptide
  Seed: EVWPLRFFNR (TYRP1_HUMAN)
EMWPLRFFNR

SEQ ID NO: 175599 - protein, 9 aa, Artificial Sequence
  Description of Artificial Sequence: Synthetic peptide
  Seed: LLDLSKEEK (TYRP1_HUMAN)
LLDLSKEEY

SEQ ID NO: 175600 - protein, 9 aa, Artificial Sequence
  Description of Artificial Sequence: Synthetic peptide
  Seed: GYSDPTGKY (TYRP1_HUMAN)
GLSDPTGKY

SEQ ID NO: 175601 - protein, 9 aa, Artificial Sequence
  Description of Artificial Sequence: Synthetic peptide
  Seed: YSNSTNSFR (TYRP1_HUMAN)
YTNSTNSFM

SEQ ID NO: 175602 - protein, 9 aa, Artificial Sequence
  Description of Artificial Sequence: Synthetic peptide
  Seed: IAIAVVGAL (TYRP1_HUMAN)
IKIAVVGAY

SEQ ID NO: 175603 - protein, 9 aa, Artificial Sequence
  Description of Artificial Sequence: Synthetic peptide
  Seed: GSRSNFDST (TYRP1_HUMAN)
GSRSNFDSK

SEQ ID NO: 175604 - protein, 8 aa, Artificial Sequence
  Description of Artificial Sequence: Synthetic peptide
  Seed: IQWPSREF (TYRP1_HUMAN)
IAWPSREF

SEQ ID NO: 175605 - protein, 9 aa, Artificial Sequence
  Description of Artificial Sequence: Synthetic peptide
  Seed: MLQEPSFSL (TYRP1_HUMAN)
MLQEPSFST

SEQ ID NO: 175606 - protein, 11 aa, Artificial Sequence
  Description of Artificial Sequence: Synthetic peptide
  Seed: AGNVARPMVQR (TYRP1_HUMAN)
ASNVARPMVQK

SEQ ID NO: 175607 - protein, 9 aa, Artificial Sequence
  Description of Artificial Sequence: Synthetic peptide
  Seed: YSNSTNSFR (TYRP1_HUMAN)
YFNSTNSFR

SEQ ID NO: 175608 - protein, 10 aa, Artificial Sequence
  Description of Artificial Sequence: Synthetic peptide
  Seed: FWPPVTNTEM (TYRP1_HUMAN)
FHPPVTNTEF

SEQ ID NO: 175609 - protein, 9 aa, Artificial Sequence
  Description of Artificial Sequence: Synthetic peptide
  Seed: FVWTHYYSV (TYRP1_HUMAN)
FVWTHYYSA

SEQ ID NO: 175610 - protein, 9 aa, Artificial Sequence
  Description of Artificial Sequence: Synthetic peptide
  Seed: YTYEIQWPS (TYRP1_HUMAN)
YAYEIQWPY

SEQ ID NO: 175611 - protein, 9 aa, Artificial Sequence
  Description of Artificial Sequence: Synthetic peptide
  Seed: RVLIVRRNL (TYRP1_HUMAN)
RVLIVRRNK

SEQ ID NO: 175612 - protein, 11 aa, Artificial Sequence
  Description of Artificial Sequence: Synthetic peptide
  Seed: YNMVPFWPPVT (TYRP1_HUMAN)
YTMVPFWPPVL

SEQ ID NO: 175613 - protein, 9 aa, Artificial Sequence
  Description of Artificial Sequence: Synthetic peptide
  Seed: TADSRPHSP (TYRP1_HUMAN)
TGDSRPHSM

SEQ ID NO: 175614 - protein, 10 aa, Artificial Sequence
  Description of Artificial Sequence: Synthetic peptide
  Seed: TFLGVGQESF (TYRP1_HUMAN)
TLLGVGQESY

SEQ ID NO: 175615 - protein, 9 aa, Artificial Sequence
  Description of Artificial Sequence: Synthetic peptide
  Seed: SLHNLAHLF (TYRP1_HUMAN)
SKHNLAHLM

SEQ ID NO: 175616 - protein, 10 aa, Artificial Sequence
  Description of Artificial Sequence: Synthetic peptide
  Seed: FFPLLLFQQA (TYRP1_HUMAN)
FGPLLLFQQA

SEQ ID NO: 175617 - protein, 10 aa, Artificial Sequence
  Description of Artificial Sequence: Synthetic peptide
  Seed: FGTASYLIRA (TYRP1_HUMAN)
FHTASYLIRV

SEQ ID NO: 175618 - protein, 10 aa, Artificial Sequence
  Description of Artificial Sequence: Synthetic peptide
  Seed: NVARPMVQRL (TYRP1_HUMAN)
NVARPMVQRK

SEQ ID NO: 175619 - protein, 9 aa, Artificial Sequence
  Description of Artificial Sequence: Synthetic peptide
  Seed: IFGTASYLI (TYRP1_HUMAN)
IWGTASYLW

SEQ ID NO: 175620 - protein, 10 aa, Artificial Sequence
  Description of Artificial Sequence: Synthetic peptide
  Seed: MLQEPSFSLP (TYRP1_HUMAN)
MLQEPSFSLM

SEQ ID NO: 175621 - protein, 11 aa, Artificial Sequence
  Description of Artificial Sequence: Synthetic peptide
  Seed: SLPYWNFATGK (TYRP1_HUMAN)
SVPYWNFATGR

SEQ ID NO: 175622 - protein, 11 aa, Artificial Sequence
  Description of Artificial Sequence: Synthetic peptide
  Seed: YNMVPFWPPVT (TYRP1_HUMAN)
YLMVPFWPPVY

SEQ ID NO: 175623 - protein, 9 aa, Artificial Sequence
  Description of Artificial Sequence: Synthetic peptide
  Seed: LQNPNQSVV (TYRP1_HUMAN)
LKNPNQSVF

SEQ ID NO: 175624 - protein, 9 aa, Artificial Sequence
  Description of Artificial Sequence: Synthetic peptide
  Seed: KLLSLGCIF (TYRP1_HUMAN)
KSLSLGCIW

SEQ ID NO: 175625 - protein, 10 aa, Artificial Sequence
  Description of Artificial Sequence: Synthetic peptide
  Seed: FLTWHRYHLL (TYRP1_HUMAN)
FCTWHRYHLV

SEQ ID NO: 175626 - protein, 10 aa, Artificial Sequence
  Description of Artificial Sequence: Synthetic peptide
  Seed: IQWPSREFSV (TYRP1_HUMAN)
IMWPSREFSM

SEQ ID NO: 175627 - protein, 9 aa, Artificial Sequence
  Description of Artificial Sequence: Synthetic peptide
  Seed: ISIYNYFVW (TYRP1_HUMAN)
IQIYNYFVI

SEQ ID NO: 175628 - protein, 10 aa, Artificial Sequence
  Description of Artificial Sequence: Synthetic peptide
  Seed: RSMDEANQPL (TYRP1_HUMAN)
RLMDEANQPL

SEQ ID NO: 175629 - protein, 9 aa, Artificial Sequence
  Description of Artificial Sequence: Synthetic peptide
  Seed: FYSNSTNSF (TYRP1_HUMAN)
FKSNSTNSI

SEQ ID NO: 175630 - protein, 9 aa, Artificial Sequence
  Description of Artificial Sequence: Synthetic peptide
  Seed: ARAQFPRQC (TYRP1_HUMAN)
AAAQFPRQV

SEQ ID NO: 175631 - protein, 9 aa, Artificial Sequence
  Description of Artificial Sequence: Synthetic peptide
  Seed: DSRPHSPQY (TYRP1_HUMAN)
DTRPHSPQF

SEQ ID NO: 175632 - protein, 11 aa, Artificial Sequence
  Description of Artificial Sequence: Synthetic peptide
  Seed: RSMDEANQPLL (TYRP1_HUMAN)
RSMDEANQPLY

SEQ ID NO: 175633 - protein, 9 aa, Artificial Sequence
  Description of Artificial Sequence: Synthetic peptide
  Seed: GLFDTPPFY (TYRP1_HUMAN)
GIFDTPPFI

SEQ ID NO: 175634 - protein, 9 aa, Artificial Sequence
  Description of Artificial Sequence: Synthetic peptide
  Seed: ISIYNYFVW (TYRP1_HUMAN)
IIIYNYFVY

SEQ ID NO: 175635 - protein, 10 aa, Artificial Sequence
  Description of Artificial Sequence: Synthetic peptide
  Seed: LSPNDPIFVL (TYRP1_HUMAN)
LVPNDPIFVF

SEQ ID NO: 175636 - protein, 9 aa, Artificial Sequence
  Description of Artificial Sequence: Synthetic peptide
  Seed: AVVGALLLV (TYRP1_HUMAN)
ATVGALLLR

SEQ ID NO: 175637 - protein, 9 aa, Artificial Sequence
  Description of Artificial Sequence: Synthetic peptide
  Seed: LHNLAHLFL (TYRP1_HUMAN)
LANLAHLFF

SEQ ID NO: 175638 - protein, 10 aa, Artificial Sequence
  Description of Artificial Sequence: Synthetic peptide
  Seed: KLLSLGCIFF (TYRP1_HUMAN)
KYLSLGCIFL

SEQ ID NO: 175639 - protein, 9 aa, Artificial Sequence
  Description of Artificial Sequence: Synthetic peptide
  Seed: APKLLSLGC (TYRP1_HUMAN)
APKLLSLGL

SEQ ID NO: 175640 - protein, 9 aa, Artificial Sequence
  Description of Artificial Sequence: Synthetic peptide
  Seed: IAIAVVGAL (TYRP1_HUMAN)
IKIAVVGAM

SEQ ID NO: 175641 - protein, 9 aa, Artificial Sequence
  Description of Artificial Sequence: Synthetic peptide
  Seed: YTYEIQWPS (TYRP1_HUMAN)
YPYEIQWPI

SEQ ID NO: 175642 - protein, 9 aa, Artificial Sequence
  Description of Artificial Sequence: Synthetic peptide
  Seed: KYDPAVRSL (TYRP1_HUMAN)
KEDPAVRSL

SEQ ID NO: 175643 - protein, 11 aa, Artificial Sequence
  Description of Artificial Sequence: Synthetic peptide
  Seed: LVALIFGTASY (TYRP1_HUMAN)
LCALIFGTASY

SEQ ID NO: 175644 - protein, 9 aa, Artificial Sequence
  Description of Artificial Sequence: Synthetic peptide
  Seed: AVVGALLLV (TYRP1_HUMAN)
AAVGALLLI

SEQ ID NO: 175645 - protein, 10 aa, Artificial Sequence
  Description of Artificial Sequence: Synthetic peptide
  Seed: EVWPLRFFNR (TYRP1_HUMAN)
EYWPLRFFNK

SEQ ID NO: 175646 - protein, 9 aa, Artificial Sequence
  Description of Artificial Sequence: Synthetic peptide
  Seed: YYSVKKTFL (TYRP1_HUMAN)
YYSVKKTFM

SEQ ID NO: 175647 - protein, 8 aa, Artificial Sequence
  Description of Artificial Sequence: Synthetic peptide
  Seed: GLFDTPPF (TYRP1_HUMAN)
GQFDTPPY

SEQ ID NO: 175648 - protein, 9 aa, Artificial Sequence
  Description of Artificial Sequence: Synthetic peptide
  Seed: IAIAVVGAL (TYRP1_HUMAN)
ITIAVVGAY

SEQ ID NO: 175649 - protein, 10 aa, Artificial Sequence
  Description of Artificial Sequence: Synthetic peptide
  Seed: FSLPYWNFAT (TYRP1_HUMAN)
FKLPYWNFAM

SEQ ID NO: 175650 - protein, 9 aa, Artificial Sequence
  Description of Artificial Sequence: Synthetic peptide
  Seed: LIFGTASYL (TYRP1_HUMAN)
LYFGTASYL

SEQ ID NO: 175651 - protein, 9 aa, Artificial Sequence
  Description of Artificial Sequence: Synthetic peptide
  Seed: MLQEPSFSL (TYRP1_HUMAN)
MMQEPSFSI

SEQ ID NO: 175652 - protein, 10 aa, Artificial Sequence
  Description of Artificial Sequence: Synthetic peptide
  Seed: NTVEGYSDPT (TYRP1_HUMAN)
NTVEGYSDPI

SEQ ID NO: 175653 - protein, 9 aa, Artificial Sequence
  Description of Artificial Sequence: Synthetic peptide
  Seed: VGLFDTPPF (TYRP1_HUMAN)
VMLFDTPPF

SEQ ID NO: 175654 - protein, 10 aa, Artificial Sequence
  Description of Artificial Sequence: Synthetic peptide
  Seed: VDFSHEGPAF (TYRP1_HUMAN)
VIFSHEGPAF

SEQ ID NO: 175655 - protein, 9 aa, Artificial Sequence
  Description of Artificial Sequence: Synthetic peptide
  Seed: RYHLLRLEK (TYRP1_HUMAN)
RQHLLRLEK

SEQ ID NO: 175656 - protein, 9 aa, Artificial Sequence
  Description of Artificial Sequence: Synthetic peptide
  Seed: DEWLRRYNA (TYRP1_HUMAN)
DEWLRRYNF

SEQ ID NO: 175657 - protein, 11 aa, Artificial Sequence
  Description of Artificial Sequence: Synthetic peptide
  Seed: REVWPLRFFNR (TYRP1_HUMAN)
RGVWPLRFFNR

SEQ ID NO: 175658 - protein, 9 aa, Artificial Sequence
  Description of Artificial Sequence: Synthetic peptide
  Seed: DSRPHSPQY (TYRP1_HUMAN)
DQRPHSPQF

SEQ ID NO: 175659 - protein, 9 aa, Artificial Sequence
  Description of Artificial Sequence: Synthetic peptide
  Seed: LTWHRYHLL (TYRP1_HUMAN)
LYWHRYHLY

SEQ ID NO: 175660 - protein, 9 aa, Artificial Sequence
  Description of Artificial Sequence: Synthetic peptide
  Seed: FPLENAPIG (TYRP1_HUMAN)
FFLENAPIY

SEQ ID NO: 175661 - protein, 10 aa, Artificial Sequence
  Description of Artificial Sequence: Synthetic peptide
  Seed: RSMDEANQPL (TYRP1_HUMAN)
RNMDEANQPI

SEQ ID NO: 175662 - protein, 9 aa, Artificial Sequence
  Description of Artificial Sequence: Synthetic peptide
  Seed: KYDPAVRSL (TYRP1_HUMAN)
KTDPAVRSF

SEQ ID NO: 175663 - protein, 9 aa, Artificial Sequence
  Description of Artificial Sequence: Synthetic peptide
  Seed: QQARAQFPR (TYRP1_HUMAN)
QVARAQFPR

SEQ ID NO: 175664 - protein, 9 aa, Artificial Sequence
  Description of Artificial Sequence: Synthetic peptide
  Seed: ACDQRVLIV (TYRP1_HUMAN)
ATDQRVLIL

SEQ ID NO: 175665 - protein, 9 aa, Artificial Sequence
  Description of Artificial Sequence: Synthetic peptide
  Seed: LQNPNQSVV (TYRP1_HUMAN)
LYNPNQSVF

SEQ ID NO: 175666 - protein, 9 aa, Artificial Sequence
  Description of Artificial Sequence: Synthetic peptide
  Seed: FTDAVFDEW (TYRP1_HUMAN)
FCDAVFDEI

SEQ ID NO: 175667 - protein, 9 aa, Artificial Sequence
  Description of Artificial Sequence: Synthetic peptide
  Seed: YLIRARRSM (TYRP1_HUMAN)
YYIRARRSM

SEQ ID NO: 175668 - protein, 8 aa, Artificial Sequence
  Description of Artificial Sequence: Synthetic peptide
  Seed: ACDQRVLI (TYRP1_HUMAN)
ATDQRVLM

SEQ ID NO: 175669 - protein, 11 aa, Artificial Sequence
  Description of Artificial Sequence: Synthetic peptide
  Seed: SLPYWNFATGK (TYRP1_HUMAN)
SCPYWNFATGR

SEQ ID NO: 175670 - protein, 11 aa, Artificial Sequence
  Description of Artificial Sequence: Synthetic peptide
  Seed: ALIFGTASYLI (TYRP1_HUMAN)
AMIFGTASYLL

SEQ ID NO: 175671 - protein, 9 aa, Artificial Sequence
  Description of Artificial Sequence: Synthetic peptide
  Seed: FLTWHRYHL (TYRP1_HUMAN)
FYTWHRYHV

SEQ ID NO: 175672 - protein, 9 aa, Artificial Sequence
  Description of Artificial Sequence: Synthetic peptide
  Seed: KYDPAVRSL (TYRP1_HUMAN)
KNDPAVRSF

SEQ ID NO: 175673 - protein, 9 aa, Artificial Sequence
  Description of Artificial Sequence: Synthetic peptide
  Seed: TADSRPHSP (TYRP1_HUMAN)
TADSRPHSI

SEQ ID NO: 175674 - protein, 9 aa, Artificial Sequence
  Description of Artificial Sequence: Synthetic peptide
  Seed: RYNADISTF (TYRP1_HUMAN)
RKNADISTM

SEQ ID NO: 175675 - protein, 10 aa, Artificial Sequence
  Description of Artificial Sequence: Synthetic peptide
  Seed: RSMDEANQPL (TYRP1_HUMAN)
RGMDEANQPV

SEQ ID NO: 175676 - protein, 10 aa, Artificial Sequence
  Description of Artificial Sequence: Synthetic peptide
  Seed: LGPDGNTPQF (TYRP1_HUMAN)
LYPDGNTPQM

SEQ ID NO: 175677 - protein, 9 aa, Artificial Sequence
  Description of Artificial Sequence: Synthetic peptide
  Seed: SLGCIFFPL (TYRP1_HUMAN)
SSGCIFFPR

SEQ ID NO: 175678 - protein, 10 aa, Artificial Sequence
  Description of Artificial Sequence: Synthetic peptide
  Seed: TAPDNLGYTY (TYRP1_HUMAN)
TFPDNLGYTL

SEQ ID NO: 175679 - protein, 9 aa, Artificial Sequence
  Description of Artificial Sequence: Synthetic peptide
  Seed: GLFDTPPFY (TYRP1_HUMAN)
GQFDTPPFI

SEQ ID NO: 175680 - protein, 9 aa, Artificial Sequence
  Description of Artificial Sequence: Synthetic peptide
  Seed: AIAVVGALL (TYRP1_HUMAN)
ALAVVGALV

SEQ ID NO: 175681 - protein, 11 aa, Artificial Sequence
  Description of Artificial Sequence: Synthetic peptide
  Seed: LVALIFGTASY (TYRP1_HUMAN)
LNALIFGTASY

SEQ ID NO: 175682 - protein, 9 aa, Artificial Sequence
  Description of Artificial Sequence: Synthetic peptide
  Seed: SMDEANQPL (TYRP1_HUMAN)
SQDEANQPM

SEQ ID NO: 175683 - protein, 10 aa, Artificial Sequence
  Description of Artificial Sequence: Synthetic peptide
  Seed: ADSRPHSPQY (TYRP1_HUMAN)
AQSRPHSPQF

SEQ ID NO: 175684 - protein, 9 aa, Artificial Sequence
  Description of Artificial Sequence: Synthetic peptide
  Seed: NMVPFWPPV (TYRP1_HUMAN)
NMVPFWPPI

SEQ ID NO: 175685 - protein, 11 aa, Artificial Sequence
  Description of Artificial Sequence: Synthetic peptide
  Seed: YSDPTGKYDPA (TYRP1_HUMAN)
YSDPTGKYDPM

SEQ ID NO: 175686 - protein, 9 aa, Artificial Sequence
  Description of Artificial Sequence: Synthetic peptide
  Seed: NYFVWTHYY (TYRP1_HUMAN)
NHFVWTHYR

SEQ ID NO: 175687 - protein, 9 aa, Artificial Sequence
  Description of Artificial Sequence: Synthetic peptide
  Seed: HYYSVKKTF (TYRP1_HUMAN)
HQYSVKKTY

SEQ ID NO: 175688 - protein, 10 aa, Artificial Sequence
  Description of Artificial Sequence: Synthetic peptide
  Seed: QCYAEEYEKL (TYRP1_HUMAN)
QYYAEEYEKW

SEQ ID NO: 175689 - protein, 10 aa, Artificial Sequence
  Description of Artificial Sequence: Synthetic peptide
  Seed: YFVWTHYYSV (TYRP1_HUMAN)
YYVWTHYYSI

SEQ ID NO: 175690 - protein, 9 aa, Artificial Sequence
  Description of Artificial Sequence: Synthetic peptide
  Seed: SLHNLAHLF (TYRP1_HUMAN)
SVHNLAHLV

SEQ ID NO: 175691 - protein, 10 aa, Artificial Sequence
  Description of Artificial Sequence: Synthetic peptide
  Seed: YNADISTFPL (TYRP1_HUMAN)
YSADISTFPV

SEQ ID NO: 175692 - protein, 10 aa, Artificial Sequence
  Description of Artificial Sequence: Synthetic peptide
  Seed: RSMDEANQPL (TYRP1_HUMAN)
RLMDEANQPF

SEQ ID NO: 175693 - protein, 9 aa, Artificial Sequence
  Description of Artificial Sequence: Synthetic peptide
  Seed: RVLIVRRNL (TYRP1_HUMAN)
RPLIVRRNF

SEQ ID NO: 175694 - protein, 9 aa, Artificial Sequence
  Description of Artificial Sequence: Synthetic peptide
  Seed: DQRVLIVRR (TYRP1_HUMAN)
DFRVLIVRR

SEQ ID NO: 175695 - protein, 9 aa, Artificial Sequence
  Description of Artificial Sequence: Synthetic peptide
  Seed: AVRSLHNLA (TYRP1_HUMAN)
ATRSLHNLI

SEQ ID NO: 175696 - protein, 9 aa, Artificial Sequence
  Description of Artificial Sequence: Synthetic peptide
  Seed: LFDTPPFYS (TYRP1_HUMAN)
LFDTPPFYV

SEQ ID NO: 175697 - protein, 9 aa, Artificial Sequence
  Description of Artificial Sequence: Synthetic peptide
  Seed: AQFPRQCAT (TYRP1_HUMAN)
AKFPRQCAI

SEQ ID NO: 175698 - protein, 9 aa, Artificial Sequence
  Description of Artificial Sequence: Synthetic peptide
  Seed: FTDAVFDEW (TYRP1_HUMAN)
FADAVFDEM

SEQ ID NO: 175699 - protein, 9 aa, Artificial Sequence
  Description of Artificial Sequence: Synthetic peptide
  Seed: KYDPAVRSL (TYRP1_HUMAN)
KVDPAVRSY

SEQ ID NO: 175700 - protein, 9 aa, Artificial Sequence
  Description of Artificial Sequence: Synthetic peptide
  Seed: IAIAVVGAL (TYRP1_HUMAN)
ILIAVVGAV

SEQ ID NO: 175701 - protein, 11 aa, Artificial Sequence
  Description of Artificial Sequence: Synthetic peptide
  Seed: VRSLHNLAHLF (TYRP1_HUMAN)
VFSLHNLAHLW

SEQ ID NO: 175702 - protein, 9 aa, Artificial Sequence
  Description of Artificial Sequence: Synthetic peptide
  Seed: AVRSLHNLA (TYRP1_HUMAN)
ATRSLHNLS

SEQ ID NO: 175703 - protein, 10 aa, Artificial Sequence
  Description of Artificial Sequence: Synthetic peptide
  Seed: HLSPNDPIFV (TYRP1_HUMAN)
HMSPNDPIFW

SEQ ID NO: 175704 - protein, 9 aa, Artificial Sequence
  Description of Artificial Sequence: Synthetic peptide
  Seed: SVPEIIAIA (TYRP1_HUMAN)
SFPEIIAIL

SEQ ID NO: 175705 - protein, 9 aa, Artificial Sequence
  Description of Artificial Sequence: Synthetic peptide
  Seed: RFFNRTCHC (TYRP1_HUMAN)
RTFNRTCHT

SEQ ID NO: 175706 - protein, 9 aa, Artificial Sequence
  Description of Artificial Sequence: Synthetic peptide
  Seed: APIGHNRQY (TYRP1_HUMAN)
ARIGHNRQF

SEQ ID NO: 175707 - protein, 11 aa, Artificial Sequence
  Description of Artificial Sequence: Synthetic peptide
  Seed: REFSVPEIIAI (TYRP1_HUMAN)
RTFSVPEIIAM

SEQ ID NO: 175708 - protein, 9 aa, Artificial Sequence
  Description of Artificial Sequence: Synthetic peptide
  Seed: STNSFRNTV (TYRP1_HUMAN)
SQNSFRNTK

SEQ ID NO: 175709 - protein, 10 aa, Artificial Sequence
  Description of Artificial Sequence: Synthetic peptide
  Seed: YNYFVWTHYY (TYRP1_HUMAN)
YCYFVWTHYY

SEQ ID NO: 175710 - protein, 9 aa, Artificial Sequence
  Description of Artificial Sequence: Synthetic peptide
  Seed: RTTHPLFVI (TYRP1_HUMAN)
RSTHPLFVK

SEQ ID NO: 175711 - protein, 9 aa, Artificial Sequence
  Description of Artificial Sequence: Synthetic peptide
  Seed: LIFGTASYL (TYRP1_HUMAN)
LSFGTASYF

SEQ ID NO: 175712 - protein, 9 aa, Artificial Sequence
  Description of Artificial Sequence: Synthetic peptide
  Seed: SVKKTFLGV (TYRP1_HUMAN)
SMKKTFLGV

SEQ ID NO: 175713 - protein, 11 aa, Artificial Sequence
  Description of Artificial Sequence: Synthetic peptide
  Seed: SMDEANQPLLT (TYRP1_HUMAN)
SLDEANQPLLL

SEQ ID NO: 175714 - protein, 9 aa, Artificial Sequence
  Description of Artificial Sequence: Synthetic peptide
  Seed: RTTHPLFVI (TYRP1_HUMAN)
RATHPLFVM

SEQ ID NO: 175715 - protein, 9 aa, Artificial Sequence
  Description of Artificial Sequence: Synthetic peptide
  Seed: ISIYNYFVW (TYRP1_HUMAN)
INIYNYFVF

SEQ ID NO: 175716 - protein, 10 aa, Artificial Sequence
  Description of Artificial Sequence: Synthetic peptide
  Seed: VDFSHEGPAF (TYRP1_HUMAN)
VQFSHEGPAF

SEQ ID NO: 175717 - protein, 9 aa, Artificial Sequence
  Description of Artificial Sequence: Synthetic peptide
  Seed: YTYEIQWPS (TYRP1_HUMAN)
YQYEIQWPS

SEQ ID NO: 175718 - protein, 11 aa, Artificial Sequence
  Description of Artificial Sequence: Synthetic peptide
  Seed: MLQEPSFSLPY (TYRP1_HUMAN)
MWQEPSFSLPY

SEQ ID NO: 175719 - protein, 9 aa, Artificial Sequence
  Description of Artificial Sequence: Synthetic peptide
  Seed: SPNDPIFVL (TYRP1_HUMAN)
SYNDPIFVY

SEQ ID NO: 175720 - protein, 10 aa, Artificial Sequence
  Description of Artificial Sequence: Synthetic peptide
  Seed: EIIAIAVVGA (TYRP1_HUMAN)
EPIAIAVVGI

SEQ ID NO: 175721 - protein, 10 aa, Artificial Sequence
  Description of Artificial Sequence: Synthetic peptide
  Seed: FSLPYWNFAT (TYRP1_HUMAN)
FILPYWNFAA

SEQ ID NO: 175722 - protein, 9 aa, Artificial Sequence
  Description of Artificial Sequence: Synthetic peptide
  Seed: RQYNMVPFW (TYRP1_HUMAN)
RLYNMVPFM

SEQ ID NO: 175723 - protein, 9 aa, Artificial Sequence
  Description of Artificial Sequence: Synthetic peptide
  Seed: HPLFVIATR (TYRP1_HUMAN)
HNLFVIATR

SEQ ID NO: 175724 - protein, 10 aa, Artificial Sequence
  Description of Artificial Sequence: Synthetic peptide
  Seed: THLSPNDPIF (TYRP1_HUMAN)
TQLSPNDPIY

SEQ ID NO: 175725 - protein, 11 aa, Artificial Sequence
  Description of Artificial Sequence: Synthetic peptide
  Seed: VALIFGTASYL (TYRP1_HUMAN)
VYLIFGTASYV

SEQ ID NO: 175726 - protein, 9 aa, Artificial Sequence
  Description of Artificial Sequence: Synthetic peptide
  Seed: TAPDNLGYT (TYRP1_HUMAN)
TIPDNLGYF

SEQ ID NO: 175727 - protein, 9 aa, Artificial Sequence
  Description of Artificial Sequence: Synthetic peptide
  Seed: SMDEANQPL (TYRP1_HUMAN)
SNDEANQPF

SEQ ID NO: 175728 - protein, 11 aa, Artificial Sequence
  Description of Artificial Sequence: Synthetic peptide
  Seed: RLPEPQDVAQC (TYRP1_HUMAN)
RLPEPQDVAQW

SEQ ID NO: 175729 - protein, 9 aa, Artificial Sequence
  Description of Artificial Sequence: Synthetic peptide
  Seed: MSAPKLLSL (TYRP1_HUMAN)
MQAPKLLSK

SEQ ID NO: 175730 - protein, 10 aa, Artificial Sequence
  Description of Artificial Sequence: Synthetic peptide
  Seed: KEEKNHFVRA (TYRP1_HUMAN)
KEEKNHFVRL

SEQ ID NO: 175731 - protein, 9 aa, Artificial Sequence
  Description of Artificial Sequence: Synthetic peptide
  Seed: YNYFVWTHY (TYRP1_HUMAN)
YAYFVWTHM

SEQ ID NO: 175732 - protein, 9 aa, Artificial Sequence
  Description of Artificial Sequence: Synthetic peptide
  Seed: KLQNPNQSV (TYRP1_HUMAN)
KLQNPNQSW

SEQ ID NO: 175733 - protein, 10 aa, Artificial Sequence
  Description of Artificial Sequence: Synthetic peptide
  Seed: IAVVGALLLV (TYRP1_HUMAN)
ILVVGALLLV

SEQ ID NO: 175734 - protein, 11 aa, Artificial Sequence
  Description of Artificial Sequence: Synthetic peptide
  Seed: SMDEANQPLLT (TYRP1_HUMAN)
SLDEANQPLLM

SEQ ID NO: 175735 - protein, 10 aa, Artificial Sequence
  Description of Artificial Sequence: Synthetic peptide
  Seed: RSMDEANQPL (TYRP1_HUMAN)
RSMDEANQPY

SEQ ID NO: 175736 - protein, 10 aa, Artificial Sequence
  Description of Artificial Sequence: Synthetic peptide
  Seed: RSLHNLAHLF (TYRP1_HUMAN)
RQLHNLAHLY

SEQ ID NO: 175737 - protein, 9 aa, Artificial Sequence
  Description of Artificial Sequence: Synthetic peptide
  Seed: RARRSMDEA (TYRP1_HUMAN)
RTRRSMDEF

SEQ ID NO: 175738 - protein, 9 aa, Artificial Sequence
  Description of Artificial Sequence: Synthetic peptide
  Seed: DSLEDYDTL (TYRP1_HUMAN)
DTLEDYDTW

SEQ ID NO: 175739 - protein, 9 aa, Artificial Sequence
  Description of Artificial Sequence: Synthetic peptide
  Seed: MSAPKLLSL (TYRP1_HUMAN)
MTAPKLLSR

SEQ ID NO: 175740 - protein, 10 aa, Artificial Sequence
  Description of Artificial Sequence: Synthetic peptide
  Seed: IAVVGALLLV (TYRP1_HUMAN)
ILVVGALLLI

SEQ ID NO: 175741 - protein, 9 aa, Artificial Sequence
  Description of Artificial Sequence: Synthetic peptide
  Seed: MDEANQPLL (TYRP1_HUMAN)
MTEANQPLM

SEQ ID NO: 175742 - protein, 9 aa, Artificial Sequence
  Description of Artificial Sequence: Synthetic peptide
  Seed: AQFPRQCAT (TYRP1_HUMAN)
AIFPRQCAY

SEQ ID NO: 175743 - protein, 10 aa, Artificial Sequence
  Description of Artificial Sequence: Synthetic peptide
  Seed: AVFDEWLRRY (TYRP1_HUMAN)
AIFDEWLRRW

SEQ ID NO: 175744 - protein, 9 aa, Artificial Sequence
  Description of Artificial Sequence: Synthetic peptide
  Seed: ACDQRVLIV (TYRP1_HUMAN)
AMDQRVLIV

SEQ ID NO: 175745 - protein, 8 aa, Artificial Sequence
  Description of Artificial Sequence: Synthetic peptide
  Seed: FSHEGPAF (TYRP1_HUMAN)
FAHEGPAY

SEQ ID NO: 175746 - protein, 9 aa, Artificial Sequence
  Description of Artificial Sequence: Synthetic peptide
  Seed: EEYEKLQNP (TYRP1_HUMAN)
EEYEKLQNL

SEQ ID NO: 175747 - protein, 9 aa, Artificial Sequence
  Description of Artificial Sequence: Synthetic peptide
  Seed: APDNLGYTY (TYRP1_HUMAN)
ARDNLGYTM

SEQ ID NO: 175748 - protein, 10 aa, Artificial Sequence
  Description of Artificial Sequence: Synthetic peptide
  Seed: LLFQQARAQF (TYRP1_HUMAN)
LQFQQARAQY

SEQ ID NO: 175749 - protein, 8 aa, Artificial Sequence
  Description of Artificial Sequence: Synthetic peptide
  Seed: SAPKLLSL (TYRP1_HUMAN)
SYPKLLSL

SEQ ID NO: 175750 - protein, 9 aa, Artificial Sequence
  Description of Artificial Sequence: Synthetic peptide
  Seed: MLQEPSFSL (TYRP1_HUMAN)
MAQEPSFSY

SEQ ID NO: 175751 - protein, 9 aa, Artificial Sequence
  Description of Artificial Sequence: Synthetic peptide
  Seed: EEYEKLQNP (TYRP1_HUMAN)
EQYEKLQNL

SEQ ID NO: 175752 - protein, 10 aa, Artificial Sequence
  Description of Artificial Sequence: Synthetic peptide
  Seed: SREFSVPEII (TYRP1_HUMAN)
SGEFSVPEIL

SEQ ID NO: 175753 - protein, 9 aa, Artificial Sequence
  Description of Artificial Sequence: Synthetic peptide
  Seed: FTDAVFDEW (TYRP1_HUMAN)
FYDAVFDEM

SEQ ID NO: 175754 - protein, 10 aa, Artificial Sequence
  Description of Artificial Sequence: Synthetic peptide
  Seed: LTWHRYHLLR (TYRP1_HUMAN)
LVWHRYHLLR

SEQ ID NO: 175755 - protein, 9 aa, Artificial Sequence
  Description of Artificial Sequence: Synthetic peptide
  Seed: LFQQARAQF (TYRP1_HUMAN)
LMQQARAQM

SEQ ID NO: 175756 - protein, 11 aa, Artificial Sequence
  Description of Artificial Sequence: Synthetic peptide
  Seed: FWPPVTNTEMF (TYRP1_HUMAN)
FRPPVTNTEMY

SEQ ID NO: 175757 - protein, 9 aa, Artificial Sequence
  Description of Artificial Sequence: Synthetic peptide
  Seed: KLQNPNQSV (TYRP1_HUMAN)
KVQNPNQSY

SEQ ID NO: 175758 - protein, 9 aa, Artificial Sequence
  Description of Artificial Sequence: Synthetic peptide
  Seed: TNTEMFVTA (TYRP1_HUMAN)
THTEMFVTA

SEQ ID NO: 175759 - protein, 9 aa, Artificial Sequence
  Description of Artificial Sequence: Synthetic peptide
  Seed: AQFPRQCAT (TYRP1_HUMAN)
AHFPRQCAF

SEQ ID NO: 175760 - protein, 10 aa, Artificial Sequence
  Description of Artificial Sequence: Synthetic peptide
  Seed: FVTAPDNLGY (TYRP1_HUMAN)
FGTAPDNLGW

SEQ ID NO: 175761 - protein, 9 aa, Artificial Sequence
  Description of Artificial Sequence: Synthetic peptide
  Seed: FSVPEIIAI (TYRP1_HUMAN)
FQVPEIIAI

SEQ ID NO: 175762 - protein, 10 aa, Artificial Sequence
  Description of Artificial Sequence: Synthetic peptide
  Seed: MVPFWPPVTN (TYRP1_HUMAN)
MCPFWPPVTY

SEQ ID NO: 175763 - protein, 9 aa, Artificial Sequence
  Description of Artificial Sequence: Synthetic peptide
  Seed: RYNADISTF (TYRP1_HUMAN)
RNNADISTY

SEQ ID NO: 175764 - protein, 9 aa, Artificial Sequence
  Description of Artificial Sequence: Synthetic peptide
  Seed: TLISPNSVF (TYRP1_HUMAN)
TAISPNSVV

SEQ ID NO: 175765 - protein, 11 aa, Artificial Sequence
  Description of Artificial Sequence: Synthetic peptide
  Seed: LRRYNADISTF (TYRP1_HUMAN)
LGRYNADISTF

SEQ ID NO: 175766 - protein, 9 aa, Artificial Sequence
  Description of Artificial Sequence: Synthetic peptide
  Seed: IAIAVVGAL (TYRP1_HUMAN)
IMIAVVGAA

SEQ ID NO: 175767 - protein, 10 aa, Artificial Sequence
  Description of Artificial Sequence: Synthetic peptide
  Seed: RSMDEANQPL (TYRP1_HUMAN)
RDMDEANQPL

SEQ ID NO: 175768 - protein, 10 aa, Artificial Sequence
  Description of Artificial Sequence: Synthetic peptide
  Seed: LSLGCIFFPL (TYRP1_HUMAN)
LQLGCIFFPM

SEQ ID NO: 175769 - protein, 9 aa, Artificial Sequence
  Description of Artificial Sequence: Synthetic peptide
  Seed: VLLHTFTDA (TYRP1_HUMAN)
VMLHTFTDL

SEQ ID NO: 175770 - protein, 9 aa, Artificial Sequence
  Description of Artificial Sequence: Synthetic peptide
  Seed: RNPAGNVAR (TYRP1_HUMAN)
RTPAGNVAR

SEQ ID NO: 175771 - protein, 10 aa, Artificial Sequence
  Description of Artificial Sequence: Synthetic peptide
  Seed: MQEMLQEPSF (TYRP1_HUMAN)
MREMLQEPSW

SEQ ID NO: 175772 - protein, 10 aa, Artificial Sequence
  Description of Artificial Sequence: Synthetic peptide
  Seed: FVLLHTFTDA (TYRP1_HUMAN)
FDLLHTFTDI

SEQ ID NO: 175773 - protein, 11 aa, Artificial Sequence
  Description of Artificial Sequence: Synthetic peptide
  Seed: FLNGTGGQTHL (TYRP1_HUMAN)
FINGTGGQTHF

SEQ ID NO: 175774 - protein, 9 aa, Artificial Sequence
  Description of Artificial Sequence: Synthetic peptide
  Seed: LTDQYQCYA (TYRP1_HUMAN)
LLDQYQCYM

SEQ ID NO: 175775 - protein, 9 aa, Artificial Sequence
  Description of Artificial Sequence: Synthetic peptide
  Seed: YNYFVWTHY (TYRP1_HUMAN)
YAYFVWTHL

SEQ ID NO: 175776 - protein, 9 aa, Artificial Sequence
  Description of Artificial Sequence: Synthetic peptide
  Seed: VARPMVQRL (TYRP1_HUMAN)
VTRPMVQRK

SEQ ID NO: 175777 - protein, 10 aa, Artificial Sequence
  Description of Artificial Sequence: Synthetic peptide
  Seed: FYSNSTNSFR (TYRP1_HUMAN)
FGSNSTNSFR

SEQ ID NO: 175778 - protein, 10 aa, Artificial Sequence
  Description of Artificial Sequence: Synthetic peptide
  Seed: FVLLHTFTDA (TYRP1_HUMAN)
FMLLHTFTDA

SEQ ID NO: 175779 - protein, 10 aa, Artificial Sequence
  Description of Artificial Sequence: Synthetic peptide
  Seed: YNYFVWTHYY (TYRP1_HUMAN)
YEYFVWTHYF

SEQ ID NO: 175780 - protein, 10 aa, Artificial Sequence
  Description of Artificial Sequence: Synthetic peptide
  Seed: SMDEANQPLL (TYRP1_HUMAN)
SSDEANQPLY

SEQ ID NO: 175781 - protein, 9 aa, Artificial Sequence
  Description of Artificial Sequence: Synthetic peptide
  Seed: SPNDPIFVL (TYRP1_HUMAN)
SVNDPIFVI

SEQ ID NO: 175782 - protein, 9 aa, Artificial Sequence
  Description of Artificial Sequence: Synthetic peptide
  Seed: SLGCIFFPL (TYRP1_HUMAN)
STGCIFFPL

SEQ ID NO: 175783 - protein, 9 aa, Artificial Sequence
  Description of Artificial Sequence: Synthetic peptide
  Seed: GLFDTPPFY (TYRP1_HUMAN)
GAFDTPPFV

SEQ ID NO: 175784 - protein, 9 aa, Artificial Sequence
  Description of Artificial Sequence: Synthetic peptide
  Seed: VARPMVQRL (TYRP1_HUMAN)
VRRPMVQRV

SEQ ID NO: 175785 - protein, 9 aa, Artificial Sequence
  Description of Artificial Sequence: Synthetic peptide
  Seed: HYYSVKKTF (TYRP1_HUMAN)
HRYSVKKTL

SEQ ID NO: 175786 - protein, 9 aa, Artificial Sequence
  Description of Artificial Sequence: Synthetic peptide
  Seed: ACDQRVLIV (TYRP1_HUMAN)
AGDQRVLIV

SEQ ID NO: 175787 - protein, 9 aa, Artificial Sequence
  Description of Artificial Sequence: Synthetic peptide
  Seed: LIFGTASYL (TYRP1_HUMAN)
LFFGTASYF

SEQ ID NO: 175788 - protein, 8 aa, Artificial Sequence
  Description of Artificial Sequence: Synthetic peptide
  Seed: LFDTPPFY (TYRP1_HUMAN)
LWDTPPFM

SEQ ID NO: 175789 - protein, 9 aa, Artificial Sequence
  Description of Artificial Sequence: Synthetic peptide
  Seed: STLISPNSV (TYRP1_HUMAN)
SLLISPNSV

SEQ ID NO: 175790 - protein, 9 aa, Artificial Sequence
  Description of Artificial Sequence: Synthetic peptide
  Seed: EGYSDPTGK (TYRP1_HUMAN)
EMYSDPTGK

SEQ ID NO: 175791 - protein, 9 aa, Artificial Sequence
  Description of Artificial Sequence: Synthetic peptide
  Seed: RFFNRTCHC (TYRP1_HUMAN)
RMFNRTCHL

SEQ ID NO: 175792 - protein, 9 aa, Artificial Sequence
  Description of Artificial Sequence: Synthetic peptide
  Seed: QCATVEALR (TYRP1_HUMAN)
QFATVEALR

SEQ ID NO: 175793 - protein, 9 aa, Artificial Sequence
  Description of Artificial Sequence: Synthetic peptide
  Seed: SPNDPIFVL (TYRP1_HUMAN)
SHNDPIFVM

SEQ ID NO: 175794 - protein, 9 aa, Artificial Sequence
  Description of Artificial Sequence: Synthetic peptide
  Seed: AIAVVGALL (TYRP1_HUMAN)
ASAVVGALY

SEQ ID NO: 175795 - protein, 10 aa, Artificial Sequence
  Description of Artificial Sequence: Synthetic peptide
  Seed: EGPAFLTWHR (TYRP1_HUMAN)
EAPAFLTWHR

SEQ ID NO: 175796 - protein, 9 aa, Artificial Sequence
  Description of Artificial Sequence: Synthetic peptide
  Seed: TFPLENAPI (TYRP1_HUMAN)
TLPLENAPM

SEQ ID NO: 175797 - protein, 9 aa, Artificial Sequence
  Description of Artificial Sequence: Synthetic peptide
  Seed: VCDICTDDL (TYRP1_HUMAN)
VMDICTDDM

SEQ ID NO: 175798 - protein, 9 aa, Artificial Sequence
  Description of Artificial Sequence: Synthetic peptide
  Seed: RGRCEAVTA (TYRP1_HUMAN)
RWRCEAVTK

SEQ ID NO: 175799 - protein, 10 aa, Artificial Sequence
  Description of Artificial Sequence: Synthetic peptide
  Seed: LLFQQARAQF (TYRP1_HUMAN)
LMFQQARAQF

SEQ ID NO: 175800 - protein, 9 aa, Artificial Sequence
  Description of Artificial Sequence: Synthetic peptide
  Seed: MLQEPSFSL (TYRP1_HUMAN)
MYQEPSFSI

SEQ ID NO: 175801 - protein, 9 aa, Artificial Sequence
  Description of Artificial Sequence: Synthetic peptide
  Seed: RYHLLRLEK (TYRP1_HUMAN)
RTHLLRLER

SEQ ID NO: 175802 - protein, 9 aa, Artificial Sequence
  Description of Artificial Sequence: Synthetic peptide
  Seed: YTYEIQWPS (TYRP1_HUMAN)
YFYEIQWPA

SEQ ID NO: 175803 - protein, 9 aa, Artificial Sequence
  Description of Artificial Sequence: Synthetic peptide
  Seed: STNSFRNTV (TYRP1_HUMAN)
SLNSFRNTA

SEQ ID NO: 175804 - protein, 9 aa, Artificial Sequence
  Description of Artificial Sequence: Synthetic peptide
  Seed: ACDQRVLIV (TYRP1_HUMAN)
AWDQRVLII

SEQ ID NO: 175805 - protein, 9 aa, Artificial Sequence
  Description of Artificial Sequence: Synthetic peptide
  Seed: REFSVPEII (TYRP1_HUMAN)
REFSVPEIW

SEQ ID NO: 175806 - protein, 11 aa, Artificial Sequence
  Description of Artificial Sequence: Synthetic peptide
  Seed: AGNVARPMVQR (TYRP1_HUMAN)
AINVARPMVQK

SEQ ID NO: 175807 - protein, 10 aa, Artificial Sequence
  Description of Artificial Sequence: Synthetic peptide
  Seed: SVPEIIAIAV (TYRP1_HUMAN)
SLPEIIAIAM

SEQ ID NO: 175808 - protein, 9 aa, Artificial Sequence
  Description of Artificial Sequence: Synthetic peptide
  Seed: ISIYNYFVW (TYRP1_HUMAN)
IHIYNYFVW

SEQ ID NO: 175809 - protein, 9 aa, Artificial Sequence
  Description of Artificial Sequence: Synthetic peptide
  Seed: NISIYNYFV (TYRP1_HUMAN)
NISIYNYFL

SEQ ID NO: 175810 - protein, 9 aa, Artificial Sequence
  Description of Artificial Sequence: Synthetic peptide
  Seed: SLHNLAHLF (TYRP1_HUMAN)
SMHNLAHLV

SEQ ID NO: 175811 - protein, 9 aa, Artificial Sequence
  Description of Artificial Sequence: Synthetic peptide
  Seed: STEDGPIRR (TYRP1_HUMAN)
SVEDGPIRY

SEQ ID NO: 175812 - protein, 9 aa, Artificial Sequence
  Description of Artificial Sequence: Synthetic peptide
  Seed: LIFGTASYL (TYRP1_HUMAN)
LWFGTASYM

SEQ ID NO: 175813 - protein, 9 aa, Artificial Sequence
  Description of Artificial Sequence: Synthetic peptide
  Seed: NADISTFPL (TYRP1_HUMAN)
NTDISTFPL

SEQ ID NO: 175814 - protein, 10 aa, Artificial Sequence
  Description of Artificial Sequence: Synthetic peptide
  Seed: HNRQYNMVPF (TYRP1_HUMAN)
HKRQYNMVPF

SEQ ID NO: 175815 - protein, 10 aa, Artificial Sequence
  Description of Artificial Sequence: Synthetic peptide
  Seed: LENAPIGHNR (TYRP1_HUMAN)
LVNAPIGHNR

SEQ ID NO: 175816 - protein, 9 aa, Artificial Sequence
  Description of Artificial Sequence: Synthetic peptide
  Seed: HLSPNDPIF (TYRP1_HUMAN)
HQSPNDPIY

SEQ ID NO: 175817 - protein, 9 aa, Artificial Sequence
  Description of Artificial Sequence: Synthetic peptide
  Seed: SGHNCGTCR (TYRP1_HUMAN)
STHNCGTCK

SEQ ID NO: 175818 - protein, 10 aa, Artificial Sequence
  Description of Artificial Sequence: Synthetic peptide
  Seed: ADSRPHSPQY (TYRP1_HUMAN)
APSRPHSPQA

SEQ ID NO: 175819 - protein, 10 aa, Artificial Sequence
  Description of Artificial Sequence: Synthetic peptide
  Seed: ENISIYNYFV (TYRP1_HUMAN)
EAISIYNYFL

SEQ ID NO: 175820 - protein, 9 aa, Artificial Sequence
  Description of Artificial Sequence: Synthetic peptide
  Seed: ENAPIGHNR (TYRP1_HUMAN)
EWAPIGHNK

SEQ ID NO: 175821 - protein, 9 aa, Artificial Sequence
  Description of Artificial Sequence: Synthetic peptide
  Seed: ACDQRVLIV (TYRP1_HUMAN)
AYDQRVLIF

SEQ ID NO: 175822 - protein, 9 aa, Artificial Sequence
  Description of Artificial Sequence: Synthetic peptide
  Seed: AVVGALLLV (TYRP1_HUMAN)
AVVGALLLF

SEQ ID NO: 175823 - protein, 9 aa, Artificial Sequence
  Description of Artificial Sequence: Synthetic peptide
  Seed: HPLFVIATR (TYRP1_HUMAN)
HALFVIATK

SEQ ID NO: 175824 - protein, 10 aa, Artificial Sequence
  Description of Artificial Sequence: Synthetic peptide
  Seed: TPQFENISIY (TYRP1_HUMAN)
TSQFENISIY

SEQ ID NO: 175825 - protein, 10 aa, Artificial Sequence
  Description of Artificial Sequence: Synthetic peptide
  Seed: MVPFWPPVTN (TYRP1_HUMAN)
MCPFWPPVTL

SEQ ID NO: 175826 - protein, 9 aa, Artificial Sequence
  Description of Artificial Sequence: Synthetic peptide
  Seed: MLQEPSFSL (TYRP1_HUMAN)
MMQEPSFSW

SEQ ID NO: 175827 - protein, 10 aa, Artificial Sequence
  Description of Artificial Sequence: Synthetic peptide
  Seed: GNVARPMVQR (TYRP1_HUMAN)
GDVARPMVQR

SEQ ID NO: 175828 - protein, 9 aa, Artificial Sequence
  Description of Artificial Sequence: Synthetic peptide
  Seed: GLFDTPPFY (TYRP1_HUMAN)
GVFDTPPFL

SEQ ID NO: 175829 - protein, 9 aa, Artificial Sequence
  Description of Artificial Sequence: Synthetic peptide
  Seed: AVFDEWLRR (TYRP1_HUMAN)
ALFDEWLRK

SEQ ID NO: 175830 - protein, 11 aa, Artificial Sequence
  Description of Artificial Sequence: Synthetic peptide
  Seed: NTPQFENISIY (TYRP1_HUMAN)
NMPQFENISIF

SEQ ID NO: 175831 - protein, 10 aa, Artificial Sequence
  Description of Artificial Sequence: Synthetic peptide
  Seed: FSVPEIIAIA (TYRP1_HUMAN)
FQVPEIIAIM

SEQ ID NO: 175832 - protein, 10 aa, Artificial Sequence
  Description of Artificial Sequence: Synthetic peptide
  Seed: YNMVPFWPPV (TYRP1_HUMAN)
YAMVPFWPPM

SEQ ID NO: 175833 - protein, 10 aa, Artificial Sequence
  Description of Artificial Sequence: Synthetic peptide
  Seed: YFVWTHYYSV (TYRP1_HUMAN)
YAVWTHYYSI

SEQ ID NO: 175834 - protein, 10 aa, Artificial Sequence
  Description of Artificial Sequence: Synthetic peptide
  Seed: SIYNYFVWTH (TYRP1_HUMAN)
SHYNYFVWTK

SEQ ID NO: 175835 - protein, 10 aa, Artificial Sequence
  Description of Artificial Sequence: Synthetic peptide
  Seed: WPPVTNTEMF (TYRP1_HUMAN)
WHPVTNTEMW

SEQ ID NO: 175836 - protein, 10 aa, Artificial Sequence
  Description of Artificial Sequence: Synthetic peptide
  Seed: LGPDGNTPQF (TYRP1_HUMAN)
LIPDGNTPQL

SEQ ID NO: 175837 - protein, 9 aa, Artificial Sequence
  Description of Artificial Sequence: Synthetic peptide
  Seed: IAVVGALLL (TYRP1_HUMAN)
ISVVGALLV

SEQ ID NO: 175838 - protein, 9 aa, Artificial Sequence
  Description of Artificial Sequence: Synthetic peptide
  Seed: VTAPDNLGY (TYRP1_HUMAN)
VWAPDNLGY

SEQ ID NO: 175839 - protein, 9 aa, Artificial Sequence
  Description of Artificial Sequence: Synthetic peptide
  Seed: LLLFQQARA (TYRP1_HUMAN)
LMLFQQARV

SEQ ID NO: 175840 - protein, 9 aa, Artificial Sequence
  Description of Artificial Sequence: Synthetic peptide
  Seed: MAKRTTHPL (TYRP1_HUMAN)
MFKRTTHPM

SEQ ID NO: 175841 - protein, 11 aa, Artificial Sequence
  Description of Artificial Sequence: Synthetic peptide
  Seed: ALIFGTASYLI (TYRP1_HUMAN)
AMIFGTASYLV

SEQ ID NO: 175842 - protein, 9 aa, Artificial Sequence
  Description of Artificial Sequence: Synthetic peptide
  Seed: NADISTFPL (TYRP1_HUMAN)
NWDISTFPL

SEQ ID NO: 175843 - protein, 9 aa, Artificial Sequence
  Description of Artificial Sequence: Synthetic peptide
  Seed: IFGTASYLI (TYRP1_HUMAN)
IWGTASYLV

SEQ ID NO: 175844 - protein, 9 aa, Artificial Sequence
  Description of Artificial Sequence: Synthetic peptide
  Seed: AVVGALLLV (TYRP1_HUMAN)
AAVGALLLW

SEQ ID NO: 175845 - protein, 11 aa, Artificial Sequence
  Description of Artificial Sequence: Synthetic peptide
  Seed: YTYEIQWPSRE (TYRP1_HUMAN)
YVYEIQWPSRK

SEQ ID NO: 175846 - protein, 10 aa, Artificial Sequence
  Description of Artificial Sequence: Synthetic peptide
  Seed: YEIQWPSREF (TYRP1_HUMAN)
YAIQWPSREF

SEQ ID NO: 175847 - protein, 11 aa, Artificial Sequence
  Description of Artificial Sequence: Synthetic peptide
  Seed: SMDEANQPLLT (TYRP1_HUMAN)
SLDEANQPLLV

SEQ ID NO: 175848 - protein, 9 aa, Artificial Sequence
  Description of Artificial Sequence: Synthetic peptide
  Seed: ALIFGTASY (TYRP1_HUMAN)
ASIFGTASY

SEQ ID NO: 175849 - protein, 10 aa, Artificial Sequence
  Description of Artificial Sequence: Synthetic peptide
  Seed: EIIAIAVVGA (TYRP1_HUMAN)
EAIAIAVVGV

SEQ ID NO: 175850 - protein, 10 aa, Artificial Sequence
  Description of Artificial Sequence: Synthetic peptide
  Seed: HNRQYNMVPF (TYRP1_HUMAN)
HLRQYNMVPY

SEQ ID NO: 175851 - protein, 9 aa, Artificial Sequence
  Description of Artificial Sequence: Synthetic peptide
  Seed: RQCATVEAL (TYRP1_HUMAN)
RVCATVEAM

SEQ ID NO: 175852 - protein, 10 aa, Artificial Sequence
  Description of Artificial Sequence: Synthetic peptide
  Seed: LSPNDPIFVL (TYRP1_HUMAN)
LLPNDPIFVF

SEQ ID NO: 175853 - protein, 10 aa, Artificial Sequence
  Description of Artificial Sequence: Synthetic peptide
  Seed: LSLGCIFFPL (TYRP1_HUMAN)
LLLGCIFFPM

SEQ ID NO: 175854 - protein, 9 aa, Artificial Sequence
  Description of Artificial Sequence: Synthetic peptide
  Seed: SIYNYFVWT (TYRP1_HUMAN)
SSYNYFVWV

SEQ ID NO: 175855 - protein, 9 aa, Artificial Sequence
  Description of Artificial Sequence: Synthetic peptide
  Seed: SPNSVFSQW (TYRP1_HUMAN)
SGNSVFSQW

SEQ ID NO: 175856 - protein, 9 aa, Artificial Sequence
  Description of Artificial Sequence: Synthetic peptide
  Seed: FYSNSTNSF (TYRP1_HUMAN)
FSSNSTNSV

SEQ ID NO: 175857 - protein, 9 aa, Artificial Sequence
  Description of Artificial Sequence: Synthetic peptide
  Seed: IFGTASYLI (TYRP1_HUMAN)
IWGTASYLF

SEQ ID NO: 175858 - protein, 9 aa, Artificial Sequence
  Description of Artificial Sequence: Synthetic peptide
  Seed: MLQEPSFSL (TYRP1_HUMAN)
MLQEPSFSK

SEQ ID NO: 175859 - protein, 10 aa, Artificial Sequence
  Description of Artificial Sequence: Synthetic peptide
  Seed: AVFDEWLRRY (TYRP1_HUMAN)
ALFDEWLRRF

SEQ ID NO: 175860 - protein, 9 aa, Artificial Sequence
  Description of Artificial Sequence: Synthetic peptide
  Seed: MSAPKLLSL (TYRP1_HUMAN)
MPAPKLLSW

SEQ ID NO: 175861 - protein, 10 aa, Artificial Sequence
  Description of Artificial Sequence: Synthetic peptide
  Seed: RSMDEANQPL (TYRP1_HUMAN)
RIMDEANQPV

SEQ ID NO: 175862 - protein, 9 aa, Artificial Sequence
  Description of Artificial Sequence: Synthetic peptide
  Seed: SPNSVFSQW (TYRP1_HUMAN)
SMNSVFSQF

SEQ ID NO: 175863 - protein, 9 aa, Artificial Sequence
  Description of Artificial Sequence: Synthetic peptide
  Seed: APDNLGYTY (TYRP1_HUMAN)
AFDNLGYTY

SEQ ID NO: 175864 - protein, 10 aa, Artificial Sequence
  Description of Artificial Sequence: Synthetic peptide
  Seed: GLFDTPPFYS (TYRP1_HUMAN)
GLFDTPPFYC

SEQ ID NO: 175865 - protein, 9 aa, Artificial Sequence
  Description of Artificial Sequence: Synthetic peptide
  Seed: LGYTYEIQW (TYRP1_HUMAN)
LTYTYEIQW

SEQ ID NO: 175866 - protein, 10 aa, Artificial Sequence
  Description of Artificial Sequence: Synthetic peptide
  Seed: SPVSGPGTDR (TYRP1_HUMAN)
SVVSGPGTDK

SEQ ID NO: 175867 - protein, 10 aa, Artificial Sequence
  Description of Artificial Sequence: Synthetic peptide
  Seed: KYDPAVRSLH (TYRP1_HUMAN)
KVDPAVRSLY

SEQ ID NO: 175868 - protein, 9 aa, Artificial Sequence
  Description of Artificial Sequence: Synthetic peptide
  Seed: MAKRTTHPL (TYRP1_HUMAN)
MMKRTTHPY

SEQ ID NO: 175869 - protein, 9 aa, Artificial Sequence
  Description of Artificial Sequence: Synthetic peptide
  Seed: HYYSVKKTF (TYRP1_HUMAN)
HFYSVKKTM

SEQ ID NO: 175870 - protein, 11 aa, Artificial Sequence
  Description of Artificial Sequence: Synthetic peptide
  Seed: REFSVPEIIAI (TYRP1_HUMAN)
REFSVPEIIAT

SEQ ID NO: 175871 - protein, 9 aa, Artificial Sequence
  Description of Artificial Sequence: Synthetic peptide
  Seed: MAKRTTHPL (TYRP1_HUMAN)
MRKRTTHPL

SEQ ID NO: 175872 - protein, 9 aa, Artificial Sequence
  Description of Artificial Sequence: Synthetic peptide
  Seed: FTDAVFDEW (TYRP1_HUMAN)
FTDAVFDEY

SEQ ID NO: 175873 - protein, 10 aa, Artificial Sequence
  Description of Artificial Sequence: Synthetic peptide
  Seed: LLLVALIFGT (TYRP1_HUMAN)
LMLVALIFGI

SEQ ID NO: 175874 - protein, 10 aa, Artificial Sequence
  Description of Artificial Sequence: Synthetic peptide
  Seed: LSPNDPIFVL (TYRP1_HUMAN)
LNPNDPIFVM

SEQ ID NO: 175875 - protein, 9 aa, Artificial Sequence
  Description of Artificial Sequence: Synthetic peptide
  Seed: GYSDPTGKY (TYRP1_HUMAN)
GMSDPTGKY

SEQ ID NO: 175876 - protein, 10 aa, Artificial Sequence
  Description of Artificial Sequence: Synthetic peptide
  Seed: LSLGCIFFPL (TYRP1_HUMAN)
LNLGCIFFPL

SEQ ID NO: 175877 - protein, 9 aa, Artificial Sequence
  Description of Artificial Sequence: Synthetic peptide
  Seed: YYSVKKTFL (TYRP1_HUMAN)
YYSVKKTFF

SEQ ID NO: 175878 - protein, 9 aa, Artificial Sequence
  Description of Artificial Sequence: Synthetic peptide
  Seed: RGAACDQRV (TYRP1_HUMAN)
RIAACDQRI

SEQ ID NO: 175879 - protein, 10 aa, Artificial Sequence
  Description of Artificial Sequence: Synthetic peptide
  Seed: GNVARPMVQR (TYRP1_HUMAN)
GAVARPMVQK

SEQ ID NO: 175880 - protein, 10 aa, Artificial Sequence
  Description of Artificial Sequence: Synthetic peptide
  Seed: GLFDTPPFYS (TYRP1_HUMAN)
GMFDTPPFYF

SEQ ID NO: 175881 - protein, 10 aa, Artificial Sequence
  Description of Artificial Sequence: Synthetic peptide
  Seed: YEIQWPSREF (TYRP1_HUMAN)
YKIQWPSREY

SEQ ID NO: 175882 - protein, 9 aa, Artificial Sequence
  Description of Artificial Sequence: Synthetic peptide
  Seed: FSHEGPAFL (TYRP1_HUMAN)
FYHEGPAFY

SEQ ID NO: 175883 - protein, 10 aa, Artificial Sequence
  Description of Artificial Sequence: Synthetic peptide
  Seed: LTWHRYHLLR (TYRP1_HUMAN)
LIWHRYHLLK

SEQ ID NO: 175884 - protein, 9 aa, Artificial Sequence
  Description of Artificial Sequence: Synthetic peptide
  Seed: TADSRPHSP (TYRP1_HUMAN)
TFDSRPHSI

SEQ ID NO: 175885 - protein, 9 aa, Artificial Sequence
  Description of Artificial Sequence: Synthetic peptide
  Seed: AVRSLHNLA (TYRP1_HUMAN)
ASRSLHNLA

SEQ ID NO: 175886 - protein, 9 aa, Artificial Sequence
  Description of Artificial Sequence: Synthetic peptide
  Seed: ENAPIGHNR (TYRP1_HUMAN)
EYAPIGHNR

SEQ ID NO: 175887 - protein, 10 aa, Artificial Sequence
  Description of Artificial Sequence: Synthetic peptide
  Seed: ADSRPHSPQY (TYRP1_HUMAN)
AKSRPHSPQK

SEQ ID NO: 175888 - protein, 9 aa, Artificial Sequence
  Description of Artificial Sequence: Synthetic peptide
  Seed: LIFGTASYL (TYRP1_HUMAN)
LLFGTASYL

SEQ ID NO: 175889 - protein, 9 aa, Artificial Sequence
  Description of Artificial Sequence: Synthetic peptide
  Seed: VGLFDTPPF (TYRP1_HUMAN)
VQLFDTPPY

SEQ ID NO: 175890 - protein, 9 aa, Artificial Sequence
  Description of Artificial Sequence: Synthetic peptide
  Seed: IYNYFVWTH (TYRP1_HUMAN)
IQNYFVWTR

SEQ ID NO: 175891 - protein, 11 aa, Artificial Sequence
  Description of Artificial Sequence: Synthetic peptide
  Seed: RLPEPQDVAQC (TYRP1_HUMAN)
RQPEPQDVAQF

SEQ ID NO: 175892 - protein, 9 aa, Artificial Sequence
  Description of Artificial Sequence: Synthetic peptide
  Seed: SIYNYFVWT (TYRP1_HUMAN)
SLYNYFVWL

SEQ ID NO: 175893 - protein, 9 aa, Artificial Sequence
  Description of Artificial Sequence: Synthetic peptide
  Seed: FLGVGQESF (TYRP1_HUMAN)
FVGVGQESM

SEQ ID NO: 175894 - protein, 9 aa, Artificial Sequence
  Description of Artificial Sequence: Synthetic peptide
  Seed: LQNPNQSVV (TYRP1_HUMAN)
LKNPNQSVY

SEQ ID NO: 175895 - protein, 8 aa, Artificial Sequence
  Description of Artificial Sequence: Synthetic peptide
  Seed: KNHFVRAL (TYRP1_HUMAN)
KQHFVRAI

SEQ ID NO: 175896 - protein, 9 aa, Artificial Sequence
  Description of Artificial Sequence: Synthetic peptide
  Seed: FSHEGPAFL (TYRP1_HUMAN)
FNHEGPAFY

SEQ ID NO: 175897 - protein, 10 aa, Artificial Sequence
  Description of Artificial Sequence: Synthetic peptide
  Seed: YNADISTFPL (TYRP1_HUMAN)
YLADISTFPF

SEQ ID NO: 175898 - protein, 10 aa, Artificial Sequence
  Description of Artificial Sequence: Synthetic peptide
  Seed: YFVWTHYYSV (TYRP1_HUMAN)
YWVWTHYYSF

SEQ ID NO: 175899 - protein, 9 aa, Artificial Sequence
  Description of Artificial Sequence: Synthetic peptide
  Seed: VTAPDNLGY (TYRP1_HUMAN)
VIAPDNLGF

SEQ ID NO: 175900 - protein, 11 aa, Artificial Sequence
  Description of Artificial Sequence: Synthetic peptide
  Seed: YNYFVWTHYYS (TYRP1_HUMAN)
YMYFVWTHYYK

SEQ ID NO: 175901 - protein, 9 aa, Artificial Sequence
  Description of Artificial Sequence: Synthetic peptide
  Seed: IAIAVVGAL (TYRP1_HUMAN)
IEIAVVGAF

SEQ ID NO: 175902 - protein, 9 aa, Artificial Sequence
  Description of Artificial Sequence: Synthetic peptide
  Seed: FLTWHRYHL (TYRP1_HUMAN)
FYTWHRYHM

SEQ ID NO: 175903 - protein, 9 aa, Artificial Sequence
  Description of Artificial Sequence: Synthetic peptide
  Seed: RAQFPRQCA (TYRP1_HUMAN)
RVQFPRQCV

SEQ ID NO: 175904 - protein, 10 aa, Artificial Sequence
  Description of Artificial Sequence: Synthetic peptide
  Seed: VALIFGTASY (TYRP1_HUMAN)
VILIFGTASY

SEQ ID NO: 175905 - protein, 9 aa, Artificial Sequence
  Description of Artificial Sequence: Synthetic peptide
  Seed: APDNLGYTY (TYRP1_HUMAN)
AQDNLGYTF

SEQ ID NO: 175906 - protein, 9 aa, Artificial Sequence
  Description of Artificial Sequence: Synthetic peptide
  Seed: RRYNADIST (TYRP1_HUMAN)
RRYNADISF

SEQ ID NO: 175907 - protein, 10 aa, Artificial Sequence
  Description of Artificial Sequence: Synthetic peptide
  Seed: FVWTHYYSVK (TYRP1_HUMAN)
FIWTHYYSVK

SEQ ID NO: 175908 - protein, 10 aa, Artificial Sequence
  Description of Artificial Sequence: Synthetic peptide
  Seed: AQFPRQCATV (TYRP1_HUMAN)
ALFPRQCATV

SEQ ID NO: 175909 - protein, 10 aa, Artificial Sequence
  Description of Artificial Sequence: Synthetic peptide
  Seed: RTTHPLFVIA (TYRP1_HUMAN)
RYTHPLFVIA

SEQ ID NO: 175910 - protein, 9 aa, Artificial Sequence
  Description of Artificial Sequence: Synthetic peptide
  Seed: FVWTHYYSV (TYRP1_HUMAN)
FAWTHYYSR

SEQ ID NO: 175911 - protein, 10 aa, Artificial Sequence
  Description of Artificial Sequence: Synthetic peptide
  Seed: FGTASYLIRA (TYRP1_HUMAN)
FNTASYLIRI

SEQ ID NO: 175912 - protein, 9 aa, Artificial Sequence
  Description of Artificial Sequence: Synthetic peptide
  Seed: TLISPNSVF (TYRP1_HUMAN)
TLISPNSVY

SEQ ID NO: 175913 - protein, 9 aa, Artificial Sequence
  Description of Artificial Sequence: Synthetic peptide
  Seed: REFSVPEII (TYRP1_HUMAN)
RVFSVPEIY

SEQ ID NO: 175914 - protein, 9 aa, Artificial Sequence
  Description of Artificial Sequence: Synthetic peptide
  Seed: WHRYHLLRL (TYRP1_HUMAN)
WKRYHLLRM

SEQ ID NO: 175915 - protein, 9 aa, Artificial Sequence
  Description of Artificial Sequence: Synthetic peptide
  Seed: YLIRARRSM (TYRP1_HUMAN)
YEIRARRSM

SEQ ID NO: 175916 - protein, 9 aa, Artificial Sequence
  Description of Artificial Sequence: Synthetic peptide
  Seed: HYYSVKKTF (TYRP1_HUMAN)
HRYSVKKTI

SEQ ID NO: 175917 - protein, 9 aa, Artificial Sequence
  Description of Artificial Sequence: Synthetic peptide
  Seed: LSKEEKNHF (TYRP1_HUMAN)
LQKEEKNHF

SEQ ID NO: 175918 - protein, 10 aa, Artificial Sequence
  Description of Artificial Sequence: Synthetic peptide
  Seed: PSFSLPYWNF (TYRP1_HUMAN)
PYFSLPYWNI

SEQ ID NO: 175919 - protein, 10 aa, Artificial Sequence
  Description of Artificial Sequence: Synthetic peptide
  Seed: SMDEANQPLL (TYRP1_HUMAN)
SVDEANQPLV

SEQ ID NO: 175920 - protein, 11 aa, Artificial Sequence
  Description of Artificial Sequence: Synthetic peptide
  Seed: IYNYFVWTHYY (TYRP1_HUMAN)
IDNYFVWTHYY

SEQ ID NO: 175921 - protein, 10 aa, Artificial Sequence
  Description of Artificial Sequence: Synthetic peptide
  Seed: LGPDGNTPQF (TYRP1_HUMAN)
LSPDGNTPQL

SEQ ID NO: 175922 - protein, 9 aa, Artificial Sequence
  Description of Artificial Sequence: Synthetic peptide
  Seed: IGHNRQYNM (TYRP1_HUMAN)
IRHNRQYNY

SEQ ID NO: 175923 - protein, 9 aa, Artificial Sequence
  Description of Artificial Sequence: Synthetic peptide
  Seed: RQCATVEAL (TYRP1_HUMAN)
RICATVEAW

SEQ ID NO: 175924 - protein, 11 aa, Artificial Sequence
  Description of Artificial Sequence: Synthetic peptide
  Seed: VTAPDNLGYTY (TYRP1_HUMAN)
VMAPDNLGYTW

SEQ ID NO: 175925 - protein, 8 aa, Artificial Sequence
  Description of Artificial Sequence: Synthetic peptide
  Seed: LIFGTASY (TYRP1_HUMAN)
LMFGTASM

SEQ ID NO: 175926 - protein, 9 aa, Artificial Sequence
  Description of Artificial Sequence: Synthetic peptide
  Seed: MAKRTTHPL (TYRP1_HUMAN)
MRKRTTHPY

SEQ ID NO: 175927 - protein, 10 aa, Artificial Sequence
  Description of Artificial Sequence: Synthetic peptide
  Seed: SIYNYFVWTH (TYRP1_HUMAN)
SIYNYFVWTK

SEQ ID NO: 175928 - protein, 9 aa, Artificial Sequence
  Description of Artificial Sequence: Synthetic peptide
  Seed: TADSRPHSP (TYRP1_HUMAN)
TQDSRPHSM

SEQ ID NO: 175929 - protein, 9 aa, Artificial Sequence
  Description of Artificial Sequence: Synthetic peptide
  Seed: SPNSVFSQW (TYRP1_HUMAN)
SPNSVFSQI

SEQ ID NO: 175930 - protein, 11 aa, Artificial Sequence
  Description of Artificial Sequence: Synthetic peptide
  Seed: RSMDEANQPLL (TYRP1_HUMAN)
RLMDEANQPLM

SEQ ID NO: 175931 - protein, 10 aa, Artificial Sequence
  Description of Artificial Sequence: Synthetic peptide
  Seed: FTDAVFDEWL (TYRP1_HUMAN)
FIDAVFDEWI

SEQ ID NO: 175932 - protein, 11 aa, Artificial Sequence
  Description of Artificial Sequence: Synthetic peptide
  Seed: IYNYFVWTHYY (TYRP1_HUMAN)
IVNYFVWTHYF

SEQ ID NO: 175933 - protein, 9 aa, Artificial Sequence
  Description of Artificial Sequence: Synthetic peptide
  Seed: YLIRARRSM (TYRP1_HUMAN)
YPIRARRST

SEQ ID NO: 175934 - protein, 9 aa, Artificial Sequence
  Description of Artificial Sequence: Synthetic peptide
  Seed: DQRVLIVRR (TYRP1_HUMAN)
DTRVLIVRK

SEQ ID NO: 175935 - protein, 9 aa, Artificial Sequence
  Description of Artificial Sequence: Synthetic peptide
  Seed: RQCATVEAL (TYRP1_HUMAN)
RLCATVEAV

SEQ ID NO: 175936 - protein, 10 aa, Artificial Sequence
  Description of Artificial Sequence: Synthetic peptide
  Seed: ATVEALRSGM (TYRP1_HUMAN)
ASVEALRSGY

SEQ ID NO: 175937 - protein, 9 aa, Artificial Sequence
  Description of Artificial Sequence: Synthetic peptide
  Seed: LTDQYQCYA (TYRP1_HUMAN)
LVDQYQCYM

SEQ ID NO: 175938 - protein, 9 aa, Artificial Sequence
  Description of Artificial Sequence: Synthetic peptide
  Seed: REFSVPEII (TYRP1_HUMAN)
RNFSVPEIF

SEQ ID NO: 175939 - protein, 9 aa, Artificial Sequence
  Description of Artificial Sequence: Synthetic peptide
  Seed: SPNDPIFVL (TYRP1_HUMAN)
SNNDPIFVL

SEQ ID NO: 175940 - protein, 8 aa, Artificial Sequence
  Description of Artificial Sequence: Synthetic peptide
  Seed: YSDPTGKY (TYRP1_HUMAN)
YSDPTGKM

SEQ ID NO: 175941 - protein, 9 aa, Artificial Sequence
  Description of Artificial Sequence: Synthetic peptide
  Seed: LQNPNQSVV (TYRP1_HUMAN)
LQNPNQSVM

SEQ ID NO: 175942 - protein, 10 aa, Artificial Sequence
  Description of Artificial Sequence: Synthetic peptide
  Seed: YSNSTNSFRN (TYRP1_HUMAN)
YINSTNSFRR

SEQ ID NO: 175943 - protein, 10 aa, Artificial Sequence
  Description of Artificial Sequence: Synthetic peptide
  Seed: YNYFVWTHYY (TYRP1_HUMAN)
YQYFVWTHYK

SEQ ID NO: 175944 - protein, 9 aa, Artificial Sequence
  Description of Artificial Sequence: Synthetic peptide
  Seed: DNLGYTYEI (TYRP1_HUMAN)
DLLGYTYEV

SEQ ID NO: 175945 - protein, 9 aa, Artificial Sequence
  Description of Artificial Sequence: Synthetic peptide
  Seed: SVPEIIAIA (TYRP1_HUMAN)
SVPEIIAIM

SEQ ID NO: 175946 - protein, 10 aa, Artificial Sequence
  Description of Artificial Sequence: Synthetic peptide
  Seed: YNYFVWTHYY (TYRP1_HUMAN)
YMYFVWTHYQ

SEQ ID NO: 175947 - protein, 10 aa, Artificial Sequence
  Description of Artificial Sequence: Synthetic peptide
  Seed: RTTHPLFVIA (TYRP1_HUMAN)
RLTHPLFVIK

SEQ ID NO: 175948 - protein, 9 aa, Artificial Sequence
  Description of Artificial Sequence: Synthetic peptide
  Seed: FSHEGPAFL (TYRP1_HUMAN)
FGHEGPAFF

SEQ ID NO: 175949 - protein, 9 aa, Artificial Sequence
  Description of Artificial Sequence: Synthetic peptide
  Seed: LLSLGCIFF (TYRP1_HUMAN)
LSSLGCIFF

SEQ ID NO: 175950 - protein, 9 aa, Artificial Sequence
  Description of Artificial Sequence: Synthetic peptide
  Seed: RSNFDSTLI (TYRP1_HUMAN)
RMNFDSTLL

SEQ ID NO: 175951 - protein, 8 aa, Artificial Sequence
  Description of Artificial Sequence: Synthetic peptide
  Seed: RQYNMVPF (TYRP1_HUMAN)
RSYNMVPY

SEQ ID NO: 175952 - protein, 9 aa, Artificial Sequence
  Description of Artificial Sequence: Synthetic peptide
  Seed: AACDQRVLI (TYRP1_HUMAN)
AMCDQRVLL

SEQ ID NO: 175953 - protein, 11 aa, Artificial Sequence
  Description of Artificial Sequence: Synthetic peptide
  Seed: AGNVARPMVQR (TYRP1_HUMAN)
ALNVARPMVQK

SEQ ID NO: 175954 - protein, 10 aa, Artificial Sequence
  Description of Artificial Sequence: Synthetic peptide
  Seed: GEVDFSHEGP (TYRP1_HUMAN)
GEVDFSHEGC

SEQ ID NO: 175955 - protein, 9 aa, Artificial Sequence
  Description of Artificial Sequence: Synthetic peptide
  Seed: RRNPAGNVA (TYRP1_HUMAN)
RYNPAGNVM

SEQ ID NO: 175956 - protein, 9 aa, Artificial Sequence
  Description of Artificial Sequence: Synthetic peptide
  Seed: FVWTHYYSV (TYRP1_HUMAN)
FMWTHYYSC

SEQ ID NO: 175957 - protein, 9 aa, Artificial Sequence
  Description of Artificial Sequence: Synthetic peptide
  Seed: STNSFRNTV (TYRP1_HUMAN)
SSNSFRNTW

SEQ ID NO: 175958 - protein, 9 aa, Artificial Sequence
  Description of Artificial Sequence: Synthetic peptide
  Seed: VGLFDTPPF (TYRP1_HUMAN)
VQLFDTPPW

SEQ ID NO: 175959 - protein, 9 aa, Artificial Sequence
  Description of Artificial Sequence: Synthetic peptide
  Seed: WPPVTNTEM (TYRP1_HUMAN)
WPPVTNTEW

SEQ ID NO: 175960 - protein, 9 aa, Artificial Sequence
  Description of Artificial Sequence: Synthetic peptide
  Seed: LPYWNFATG (TYRP1_HUMAN)
LVYWNFATY

SEQ ID NO: 175961 - protein, 9 aa, Artificial Sequence
  Description of Artificial Sequence: Synthetic peptide
  Seed: FLTWHRYHL (TYRP1_HUMAN)
FMTWHRYHY

SEQ ID NO: 175962 - protein, 10 aa, Artificial Sequence
  Description of Artificial Sequence: Synthetic peptide
  Seed: ENISIYNYFV (TYRP1_HUMAN)
EYISIYNYFV

SEQ ID NO: 175963 - protein, 11 aa, Artificial Sequence
  Description of Artificial Sequence: Synthetic peptide
  Seed: IYNYFVWTHYY (TYRP1_HUMAN)
IWNYFVWTHYW

SEQ ID NO: 175964 - protein, 9 aa, Artificial Sequence
  Description of Artificial Sequence: Synthetic peptide
  Seed: MLQEPSFSL (TYRP1_HUMAN)
MTQEPSFSF

SEQ ID NO: 175965 - protein, 9 aa, Artificial Sequence
  Description of Artificial Sequence: Synthetic peptide
  Seed: LQNPNQSVV (TYRP1_HUMAN)
LGNPNQSVY

SEQ ID NO: 175966 - protein, 10 aa, Artificial Sequence
  Description of Artificial Sequence: Synthetic peptide
  Seed: FSVPEIIAIA (TYRP1_HUMAN)
FVVPEIIAIM

SEQ ID NO: 175967 - protein, 9 aa, Artificial Sequence
  Description of Artificial Sequence: Synthetic peptide
  Seed: SPNDPIFVL (TYRP1_HUMAN)
SVNDPIFVV

SEQ ID NO: 175968 - protein, 10 aa, Artificial Sequence
  Description of Artificial Sequence: Synthetic peptide
  Seed: FLTWHRYHLL (TYRP1_HUMAN)
FKTWHRYHLV

SEQ ID NO: 175969 - protein, 9 aa, Artificial Sequence
  Description of Artificial Sequence: Synthetic peptide
  Seed: SRSNFDSTL (TYRP1_HUMAN)
SKSNFDSTF

SEQ ID NO: 175970 - protein, 10 aa, Artificial Sequence
  Description of Artificial Sequence: Synthetic peptide
  Seed: YNMVPFWPPV (TYRP1_HUMAN)
YEMVPFWPPL

SEQ ID NO: 175971 - protein, 8 aa, Artificial Sequence
  Description of Artificial Sequence: Synthetic peptide
  Seed: ACDQRVLI (TYRP1_HUMAN)
AVDQRVLL

SEQ ID NO: 175972 - protein, 9 aa, Artificial Sequence
  Description of Artificial Sequence: Synthetic peptide
  Seed: STEDGPIRR (TYRP1_HUMAN)
SAEDGPIRL

SEQ ID NO: 175973 - protein, 9 aa, Artificial Sequence
  Description of Artificial Sequence: Synthetic peptide
  Seed: RPMVQRLPE (TYRP1_HUMAN)
RPMVQRLPP

SEQ ID NO: 175974 - protein, 9 aa, Artificial Sequence
  Description of Artificial Sequence: Synthetic peptide
  Seed: SPNDPIFVL (TYRP1_HUMAN)
SHNDPIFVI

SEQ ID NO: 175975 - protein, 9 aa, Artificial Sequence
  Description of Artificial Sequence: Synthetic peptide
  Seed: ENAPIGHNR (TYRP1_HUMAN)
EAAPIGHNK

SEQ ID NO: 175976 - protein, 10 aa, Artificial Sequence
  Description of Artificial Sequence: Synthetic peptide
  Seed: YNMVPFWPPV (TYRP1_HUMAN)
YSMVPFWPPL

SEQ ID NO: 175977 - protein, 11 aa, Artificial Sequence
  Description of Artificial Sequence: Synthetic peptide
  Seed: DRCGSSSGRGR (TYRP1_HUMAN)
DMCGSSSGRGR

SEQ ID NO: 175978 - protein, 9 aa, Artificial Sequence
  Description of Artificial Sequence: Synthetic peptide
  Seed: AVRSLHNLA (TYRP1_HUMAN)
ASRSLHNLY

SEQ ID NO: 175979 - protein, 9 aa, Artificial Sequence
  Description of Artificial Sequence: Synthetic peptide
  Seed: YYSVKKTFL (TYRP1_HUMAN)
YPSVKKTFL

SEQ ID NO: 175980 - protein, 9 aa, Artificial Sequence
  Description of Artificial Sequence: Synthetic peptide
  Seed: IAIAVVGAL (TYRP1_HUMAN)
IFIAVVGAL

SEQ ID NO: 175981 - protein, 9 aa, Artificial Sequence
  Description of Artificial Sequence: Synthetic peptide
  Seed: LTWHRYHLL (TYRP1_HUMAN)
LLWHRYHLR

SEQ ID NO: 175982 - protein, 11 aa, Artificial Sequence
  Description of Artificial Sequence: Synthetic peptide
  Seed: YQCYAEEYEKL (TYRP1_HUMAN)
YFCYAEEYEKF

SEQ ID NO: 175983 - protein, 9 aa, Artificial Sequence
  Description of Artificial Sequence: Synthetic peptide
  Seed: HLSPNDPIF (TYRP1_HUMAN)
HQSPNDPII

SEQ ID NO: 175984 - protein, 11 aa, Artificial Sequence
  Description of Artificial Sequence: Synthetic peptide
  Seed: FSVPEIIAIAV (TYRP1_HUMAN)
FIVPEIIAIAV

SEQ ID NO: 175985 - protein, 9 aa, Artificial Sequence
  Description of Artificial Sequence: Synthetic peptide
  Seed: FENISIYNY (TYRP1_HUMAN)
FGNISIYNY

SEQ ID NO: 175986 - protein, 10 aa, Artificial Sequence
  Description of Artificial Sequence: Synthetic peptide
  Seed: FPRQCATVEA (TYRP1_HUMAN)
FPRQCATVEV

SEQ ID NO: 175987 - protein, 11 aa, Artificial Sequence
  Description of Artificial Sequence: Synthetic peptide
  Seed: YNMVPFWPPVT (TYRP1_HUMAN)
YLMVPFWPPVQ

SEQ ID NO: 175988 - protein, 9 aa, Artificial Sequence
  Description of Artificial Sequence: Synthetic peptide
  Seed: GTASYLIRA (TYRP1_HUMAN)
GAASYLIRV

SEQ ID NO: 175989 - protein, 9 aa, Artificial Sequence
  Description of Artificial Sequence: Synthetic peptide
  Seed: YTYEIQWPS (TYRP1_HUMAN)
YYYEIQWPV

SEQ ID NO: 175990 - protein, 9 aa, Artificial Sequence
  Description of Artificial Sequence: Synthetic peptide
  Seed: VWPLRFFNR (TYRP1_HUMAN)
VMPLRFFNR

SEQ ID NO: 175991 - protein, 10 aa, Artificial Sequence
  Description of Artificial Sequence: Synthetic peptide
  Seed: YTYEIQWPSR (TYRP1_HUMAN)
YTYEIQWPSK

SEQ ID NO: 175992 - protein, 9 aa, Artificial Sequence
  Description of Artificial Sequence: Synthetic peptide
  Seed: FTDAVFDEW (TYRP1_HUMAN)
FCDAVFDEM

SEQ ID NO: 175993 - protein, 9 aa, Artificial Sequence
  Description of Artificial Sequence: Synthetic peptide
  Seed: RQYNMVPFW (TYRP1_HUMAN)
RSYNMVPFI

SEQ ID NO: 175994 - protein, 10 aa, Artificial Sequence
  Description of Artificial Sequence: Synthetic peptide
  Seed: IAVVGALLLV (TYRP1_HUMAN)
IRVVGALLLV

SEQ ID NO: 175995 - protein, 10 aa, Artificial Sequence
  Description of Artificial Sequence: Synthetic peptide
  Seed: FTDAVFDEWL (TYRP1_HUMAN)
FMDAVFDEWL

SEQ ID NO: 175996 - protein, 9 aa, Artificial Sequence
  Description of Artificial Sequence: Synthetic peptide
  Seed: ALIFGTASY (TYRP1_HUMAN)
ARIFGTASM

SEQ ID NO: 175997 - protein, 9 aa, Artificial Sequence
  Description of Artificial Sequence: Synthetic peptide
  Seed: LHTFTDAVF (TYRP1_HUMAN)
LLTFTDAVF

SEQ ID NO: 175998 - protein, 10 aa, Artificial Sequence
  Description of Artificial Sequence: Synthetic peptide
  Seed: GLFDTPPFYS (TYRP1_HUMAN)
GMFDTPPFYI

SEQ ID NO: 175999 - protein, 9 aa, Artificial Sequence
  Description of Artificial Sequence: Synthetic peptide
  Seed: WPPVTNTEM (TYRP1_HUMAN)
WVPVTNTEL

SEQ ID NO: 176000 - protein, 9 aa, Artificial Sequence
  Description of Artificial Sequence: Synthetic peptide
  Seed: FSHEGPAFL (TYRP1_HUMAN)
FRHEGPAFI

SEQ ID NO: 176001 - protein, 8 aa, Artificial Sequence
  Description of Artificial Sequence: Synthetic peptide
  Seed: FSHEGPAF (TYRP1_HUMAN)
FYHEGPAV

SEQ ID NO: 176002 - protein, 10 aa, Artificial Sequence
  Description of Artificial Sequence: Synthetic peptide
  Seed: SQWRVVCDSL (TYRP1_HUMAN)
SMWRVVCDSV

SEQ ID NO: 176003 - protein, 9 aa, Artificial Sequence
  Description of Artificial Sequence: Synthetic peptide
  Seed: TNTEMFVTA (TYRP1_HUMAN)
THTEMFVTP

SEQ ID NO: 176004 - protein, 10 aa, Artificial Sequence
  Description of Artificial Sequence: Synthetic peptide
  Seed: NISIYNYFVW (TYRP1_HUMAN)
NHSIYNYFVW

SEQ ID NO: 176005 - protein, 10 aa, Artificial Sequence
  Description of Artificial Sequence: Synthetic peptide
  Seed: AQFPRQCATV (TYRP1_HUMAN)
ALFPRQCATF

SEQ ID NO: 176006 - protein, 9 aa, Artificial Sequence
  Description of Artificial Sequence: Synthetic peptide
  Seed: SRSNFDSTL (TYRP1_HUMAN)
SLSNFDSTY

SEQ ID NO: 176007 - protein, 10 aa, Artificial Sequence
  Description of Artificial Sequence: Synthetic peptide
  Seed: ENISIYNYFV (TYRP1_HUMAN)
ESISIYNYFA

SEQ ID NO: 176008 - protein, 9 aa, Artificial Sequence
  Description of Artificial Sequence: Synthetic peptide
  Seed: YYSVKKTFL (TYRP1_HUMAN)
YYSVKKTFI

SEQ ID NO: 176009 - protein, 8 aa, Artificial Sequence
  Description of Artificial Sequence: Synthetic peptide
  Seed: ACDQRVLI (TYRP1_HUMAN)
AYDQRVLM

SEQ ID NO: 176010 - protein, 11 aa, Artificial Sequence
  Description of Artificial Sequence: Synthetic peptide
  Seed: YNMVPFWPPVT (TYRP1_HUMAN)
YMMVPFWPPVK

SEQ ID NO: 176011 - protein, 9 aa, Artificial Sequence
  Description of Artificial Sequence: Synthetic peptide
  Seed: AVRSLHNLA (TYRP1_HUMAN)
ATRSLHNLY

SEQ ID NO: 176012 - protein, 10 aa, Artificial Sequence
  Description of Artificial Sequence: Synthetic peptide
  Seed: STLISPNSVF (TYRP1_HUMAN)
SVLISPNSVF

SEQ ID NO: 176013 - protein, 10 aa, Artificial Sequence
  Description of Artificial Sequence: Synthetic peptide
  Seed: VDFSHEGPAF (TYRP1_HUMAN)
VQFSHEGPAY

SEQ ID NO: 176014 - protein, 9 aa, Artificial Sequence
  Description of Artificial Sequence: Synthetic peptide
  Seed: CIFFPLLLF (TYRP1_HUMAN)
CTFFPLLLY

SEQ ID NO: 176015 - protein, 9 aa, Artificial Sequence
  Description of Artificial Sequence: Synthetic peptide
  Seed: LIFGTASYL (TYRP1_HUMAN)
LHFGTASYM

SEQ ID NO: 176016 - protein, 10 aa, Artificial Sequence
  Description of Artificial Sequence: Synthetic peptide
  Seed: FYSNSTNSFR (TYRP1_HUMAN)
FQSNSTNSFR

SEQ ID NO: 176017 - protein, 9 aa, Artificial Sequence
  Description of Artificial Sequence: Synthetic peptide
  Seed: RGRCEAVTA (TYRP1_HUMAN)
RTRCEAVTH

SEQ ID NO: 176018 - protein, 10 aa, Artificial Sequence
  Description of Artificial Sequence: Synthetic peptide
  Seed: LPYWNFATGK (TYRP1_HUMAN)
LMYWNFATGR

SEQ ID NO: 176019 - protein, 9 aa, Artificial Sequence
  Description of Artificial Sequence: Synthetic peptide
  Seed: MSAPKLLSL (TYRP1_HUMAN)
MFAPKLLSM

SEQ ID NO: 176020 - protein, 11 aa, Artificial Sequence
  Description of Artificial Sequence: Synthetic peptide
  Seed: MFVTAPDNLGY (TYRP1_HUMAN)
MSVTAPDNLGY

SEQ ID NO: 176021 - protein, 10 aa, Artificial Sequence
  Description of Artificial Sequence: Synthetic peptide
  Seed: TPQFENISIY (TYRP1_HUMAN)
TFQFENISIY

SEQ ID NO: 176022 - protein, 11 aa, Artificial Sequence
  Description of Artificial Sequence: Synthetic peptide
  Seed: RSMDEANQPLL (TYRP1_HUMAN)
REMDEANQPLF

SEQ ID NO: 176023 - protein, 9 aa, Artificial Sequence
  Description of Artificial Sequence: Synthetic peptide
  Seed: RQCATVEAL (TYRP1_HUMAN)
RLCATVEAY

SEQ ID NO: 176024 - protein, 9 aa, Artificial Sequence
  Description of Artificial Sequence: Synthetic peptide
  Seed: TADSRPHSP (TYRP1_HUMAN)
TFDSRPHSF

SEQ ID NO: 176025 - protein, 10 aa, Artificial Sequence
  Description of Artificial Sequence: Synthetic peptide
  Seed: AFLTWHRYHL (TYRP1_HUMAN)
AYLTWHRYHM

SEQ ID NO: 176026 - protein, 11 aa, Artificial Sequence
  Description of Artificial Sequence: Synthetic peptide
  Seed: HLSPNDPIFVL (TYRP1_HUMAN)
HQSPNDPIFVY

SEQ ID NO: 176027 - protein, 9 aa, Artificial Sequence
  Description of Artificial Sequence: Synthetic peptide
  Seed: LQNPNQSVV (TYRP1_HUMAN)
LINPNQSVY

SEQ ID NO: 176028 - protein, 10 aa, Artificial Sequence
  Description of Artificial Sequence: Synthetic peptide
  Seed: SMDEANQPLL (TYRP1_HUMAN)
SMDEANQPLF

SEQ ID NO: 176029 - protein, 10 aa, Artificial Sequence
  Description of Artificial Sequence: Synthetic peptide
  Seed: MVPFWPPVTN (TYRP1_HUMAN)
MQPFWPPVTF

SEQ ID NO: 176030 - protein, 10 aa, Artificial Sequence
  Description of Artificial Sequence: Synthetic peptide
  Seed: VALIFGTASY (TYRP1_HUMAN)
VALIFGTASF

SEQ ID NO: 176031 - protein, 9 aa, Artificial Sequence
  Description of Artificial Sequence: Synthetic peptide
  Seed: RSNFDSTLI (TYRP1_HUMAN)
RQNFDSTLL

SEQ ID NO: 176032 - protein, 9 aa, Artificial Sequence
  Description of Artificial Sequence: Synthetic peptide
  Seed: AVRSLHNLA (TYRP1_HUMAN)
ATRSLHNLG

SEQ ID NO: 176033 - protein, 9 aa, Artificial Sequence
  Description of Artificial Sequence: Synthetic peptide
  Seed: MSAPKLLSL (TYRP1_HUMAN)
MVAPKLLSM

SEQ ID NO: 176034 - protein, 10 aa, Artificial Sequence
  Description of Artificial Sequence: Synthetic peptide
  Seed: LTWHRYHLLR (TYRP1_HUMAN)
LSWHRYHLLR

SEQ ID NO: 176035 - protein, 10 aa, Artificial Sequence
  Description of Artificial Sequence: Synthetic peptide
  Seed: MVPFWPPVTN (TYRP1_HUMAN)
MYPFWPPVTF

SEQ ID NO: 176036 - protein, 10 aa, Artificial Sequence
  Description of Artificial Sequence: Synthetic peptide
  Seed: IYNYFVWTHY (TYRP1_HUMAN)
IWNYFVWTHY

SEQ ID NO: 176037 - protein, 9 aa, Artificial Sequence
  Description of Artificial Sequence: Synthetic peptide
  Seed: RFFNRTCHC (TYRP1_HUMAN)
RWFNRTCHK

SEQ ID NO: 176038 - protein, 9 aa, Artificial Sequence
  Description of Artificial Sequence: Synthetic peptide
  Seed: VARPMVQRL (TYRP1_HUMAN)
VSRPMVQRM

SEQ ID NO: 176039 - protein, 9 aa, Artificial Sequence
  Description of Artificial Sequence: Synthetic peptide
  Seed: HEGPAFLTW (TYRP1_HUMAN)
HLGPAFLTM

SEQ ID NO: 176040 - protein, 9 aa, Artificial Sequence
  Description of Artificial Sequence: Synthetic peptide
  Seed: NMVPFWPPV (TYRP1_HUMAN)
NYVPFWPPF

SEQ ID NO: 176041 - protein, 9 aa, Artificial Sequence
  Description of Artificial Sequence: Synthetic peptide
  Seed: RQYNMVPFW (TYRP1_HUMAN)
RTYNMVPFL

SEQ ID NO: 176042 - protein, 9 aa, Artificial Sequence
  Description of Artificial Sequence: Synthetic peptide
  Seed: LIFGTASYL (TYRP1_HUMAN)
LMFGTASYA

SEQ ID NO: 176043 - protein, 9 aa, Artificial Sequence
  Description of Artificial Sequence: Synthetic peptide
  Seed: RSLHNLAHL (TYRP1_HUMAN)
RMLHNLAHI

SEQ ID NO: 176044 - protein, 10 aa, Artificial Sequence
  Description of Artificial Sequence: Synthetic peptide
  Seed: LGPDGNTPQF (TYRP1_HUMAN)
LVPDGNTPQM

SEQ ID NO: 176045 - protein, 9 aa, Artificial Sequence
  Description of Artificial Sequence: Synthetic peptide
  Seed: TLISPNSVF (TYRP1_HUMAN)
TVISPNSVL

SEQ ID NO: 176046 - protein, 9 aa, Artificial Sequence
  Description of Artificial Sequence: Synthetic peptide
  Seed: MCCPDLSPV (TYRP1_HUMAN)
MQCPDLSPL

SEQ ID NO: 176047 - protein, 9 aa, Artificial Sequence
  Description of Artificial Sequence: Synthetic peptide
  Seed: YNYFVWTHY (TYRP1_HUMAN)
YSYFVWTHI

SEQ ID NO: 176048 - protein, 9 aa, Artificial Sequence
  Description of Artificial Sequence: Synthetic peptide
  Seed: FSVPEIIAI (TYRP1_HUMAN)
FVVPEIIAM

SEQ ID NO: 176049 - protein, 9 aa, Artificial Sequence
  Description of Artificial Sequence: Synthetic peptide
  Seed: ENISIYNYF (TYRP1_HUMAN)
EIISIYNYW

SEQ ID NO: 176050 - protein, 9 aa, Artificial Sequence
  Description of Artificial Sequence: Synthetic peptide
  Seed: SVFSQWRVV (TYRP1_HUMAN)
SVFSQWRVM

SEQ ID NO: 176051 - protein, 10 aa, Artificial Sequence
  Description of Artificial Sequence: Synthetic peptide
  Seed: FSLPYWNFAT (TYRP1_HUMAN)
FYLPYWNFAL

SEQ ID NO: 176052 - protein, 9 aa, Artificial Sequence
  Description of Artificial Sequence: Synthetic peptide
  Seed: GPAFLTWHR (TYRP1_HUMAN)
GIAFLTWHR

SEQ ID NO: 176053 - protein, 9 aa, Artificial Sequence
  Description of Artificial Sequence: Synthetic peptide
  Seed: GLFDTPPFY (TYRP1_HUMAN)
GSFDTPPFR

SEQ ID NO: 176054 - protein, 9 aa, Artificial Sequence
  Description of Artificial Sequence: Synthetic peptide
  Seed: LIFGTASYL (TYRP1_HUMAN)
LAFGTASYW

SEQ ID NO: 176055 - protein, 10 aa, Artificial Sequence
  Description of Artificial Sequence: Synthetic peptide
  Seed: SREFSVPEII (TYRP1_HUMAN)
SAEFSVPEIL

SEQ ID NO: 176056 - protein, 9 aa, Artificial Sequence
  Description of Artificial Sequence: Synthetic peptide
  Seed: ACDQRVLIV (TYRP1_HUMAN)
AMDQRVLIL

SEQ ID NO: 176057 - protein, 9 aa, Artificial Sequence
  Description of Artificial Sequence: Synthetic peptide
  Seed: MCCPDLSPV (TYRP1_HUMAN)
MVCPDLSPI

SEQ ID NO: 176058 - protein, 10 aa, Artificial Sequence
  Description of Artificial Sequence: Synthetic peptide
  Seed: MVPFWPPVTN (TYRP1_HUMAN)
MGPFWPPVTL

SEQ ID NO: 176059 - protein, 9 aa, Artificial Sequence
  Description of Artificial Sequence: Synthetic peptide
  Seed: DLMGSRSNF (TYRP1_HUMAN)
DSMGSRSNR

SEQ ID NO: 176060 - protein, 9 aa, Artificial Sequence
  Description of Artificial Sequence: Synthetic peptide
  Seed: SLHNLAHLF (TYRP1_HUMAN)
SHHNLAHLY

SEQ ID NO: 176061 - protein, 11 aa, Artificial Sequence
  Description of Artificial Sequence: Synthetic peptide
  Seed: FLNGTGGQTHL (TYRP1_HUMAN)
FFNGTGGQTHF

SEQ ID NO: 176062 - protein, 9 aa, Artificial Sequence
  Description of Artificial Sequence: Synthetic peptide
  Seed: SHEGPAFLT (TYRP1_HUMAN)
SHEGPAFLI

SEQ ID NO: 176063 - protein, 9 aa, Artificial Sequence
  Description of Artificial Sequence: Synthetic peptide
  Seed: SFRNTVEGY (TYRP1_HUMAN)
SQRNTVEGM

SEQ ID NO: 176064 - protein, 9 aa, Artificial Sequence
  Description of Artificial Sequence: Synthetic peptide
  Seed: AIAVVGALL (TYRP1_HUMAN)
ATAVVGALV

SEQ ID NO: 176065 - protein, 9 aa, Artificial Sequence
  Description of Artificial Sequence: Synthetic peptide
  Seed: FVWTHYYSV (TYRP1_HUMAN)
FVWTHYYST

SEQ ID NO: 176066 - protein, 9 aa, Artificial Sequence
  Description of Artificial Sequence: Synthetic peptide
  Seed: DAVFDEWLR (TYRP1_HUMAN)
DIVFDEWLR

SEQ ID NO: 176067 - protein, 9 aa, Artificial Sequence
  Description of Artificial Sequence: Synthetic peptide
  Seed: NFDSTLISP (TYRP1_HUMAN)
NADSTLISM

SEQ ID NO: 176068 - protein, 11 aa, Artificial Sequence
  Description of Artificial Sequence: Synthetic peptide
  Seed: VTAPDNLGYTY (TYRP1_HUMAN)
VQAPDNLGYTW

SEQ ID NO: 176069 - protein, 10 aa, Artificial Sequence
  Description of Artificial Sequence: Synthetic peptide
  Seed: FYSNSTNSFR (TYRP1_HUMAN)
FGSNSTNSFK

SEQ ID NO: 176070 - protein, 9 aa, Artificial Sequence
  Description of Artificial Sequence: Synthetic peptide
  Seed: RSNFDSTLI (TYRP1_HUMAN)
RSNFDSTLM

SEQ ID NO: 176071 - protein, 10 aa, Artificial Sequence
  Description of Artificial Sequence: Synthetic peptide
  Seed: KRTTHPLFVI (TYRP1_HUMAN)
KQTTHPLFVF

SEQ ID NO: 176072 - protein, 9 aa, Artificial Sequence
  Description of Artificial Sequence: Synthetic peptide
  Seed: FSVPEIIAI (TYRP1_HUMAN)
FGVPEIIAL

SEQ ID NO: 176073 - protein, 9 aa, Artificial Sequence
  Description of Artificial Sequence: Synthetic peptide
  Seed: SVKKTFLGV (TYRP1_HUMAN)
SLKKTFLGI

SEQ ID NO: 176074 - protein, 11 aa, Artificial Sequence
  Description of Artificial Sequence: Synthetic peptide
  Seed: SLPYWNFATGK (TYRP1_HUMAN)
SSPYWNFATGK

SEQ ID NO: 176075 - protein, 9 aa, Artificial Sequence
  Description of Artificial Sequence: Synthetic peptide
  Seed: MLQEPSFSL (TYRP1_HUMAN)
MQQEPSFSI

SEQ ID NO: 176076 - protein, 11 aa, Artificial Sequence
  Description of Artificial Sequence: Synthetic peptide
  Seed: FVLLHTFTDAV (TYRP1_HUMAN)
FMLLHTFTDAL

SEQ ID NO: 176077 - protein, 9 aa, Artificial Sequence
  Description of Artificial Sequence: Synthetic peptide
  Seed: GSRSNFDST (TYRP1_HUMAN)
GARSNFDSK

SEQ ID NO: 176078 - protein, 9 aa, Artificial Sequence
  Description of Artificial Sequence: Synthetic peptide
  Seed: MLQEPSFSL (TYRP1_HUMAN)
MIQEPSFSF

SEQ ID NO: 176079 - protein, 10 aa, Artificial Sequence
  Description of Artificial Sequence: Synthetic peptide
  Seed: QFENISIYNY (TYRP1_HUMAN)
QLENISIYNW

SEQ ID NO: 176080 - protein, 9 aa, Artificial Sequence
  Description of Artificial Sequence: Synthetic peptide
  Seed: LHNLAHLFL (TYRP1_HUMAN)
LKNLAHLFF

SEQ ID NO: 176081 - protein, 9 aa, Artificial Sequence
  Description of Artificial Sequence: Synthetic peptide
  Seed: YYSVKKTFL (TYRP1_HUMAN)
YRSVKKTFF

SEQ ID NO: 176082 - protein, 9 aa, Artificial Sequence
  Description of Artificial Sequence: Synthetic peptide
  Seed: FVWTHYYSV (TYRP1_HUMAN)
FRWTHYYSI

SEQ ID NO: 176083 - protein, 9 aa, Artificial Sequence
  Description of Artificial Sequence: Synthetic peptide
  Seed: LLVALIFGT (TYRP1_HUMAN)
LIVALIFGI

SEQ ID NO: 176084 - protein, 10 aa, Artificial Sequence
  Description of Artificial Sequence: Synthetic peptide
  Seed: YNYFVWTHYY (TYRP1_HUMAN)
YRYFVWTHYY

SEQ ID NO: 176085 - protein, 9 aa, Artificial Sequence
  Description of Artificial Sequence: Synthetic peptide
  Seed: MAKRTTHPL (TYRP1_HUMAN)
MQKRTTHPK

SEQ ID NO: 176086 - protein, 9 aa, Artificial Sequence
  Description of Artificial Sequence: Synthetic peptide
  Seed: RYNADISTF (TYRP1_HUMAN)
RMNADISTH

SEQ ID NO: 176087 - protein, 9 aa, Artificial Sequence
  Description of Artificial Sequence: Synthetic peptide
  Seed: RTTHPLFVI (TYRP1_HUMAN)
RMTHPLFVA

SEQ ID NO: 176088 - protein, 10 aa, Artificial Sequence
  Description of Artificial Sequence: Synthetic peptide
  Seed: YNMVPFWPPV (TYRP1_HUMAN)
YHMVPFWPPA

SEQ ID NO: 176089 - protein, 9 aa, Artificial Sequence
  Description of Artificial Sequence: Synthetic peptide
  Seed: FYSNSTNSF (TYRP1_HUMAN)
FYSNSTNSV

SEQ ID NO: 176090 - protein, 9 aa, Artificial Sequence
  Description of Artificial Sequence: Synthetic peptide
  Seed: FLGVGQESF (TYRP1_HUMAN)
FQGVGQESF

SEQ ID NO: 176091 - protein, 9 aa, Artificial Sequence
  Description of Artificial Sequence: Synthetic peptide
  Seed: ACDQRVLIV (TYRP1_HUMAN)
AQDQRVLIV

SEQ ID NO: 176092 - protein, 9 aa, Artificial Sequence
  Description of Artificial Sequence: Synthetic peptide
  Seed: LIFGTASYL (TYRP1_HUMAN)
LFFGTASYM

SEQ ID NO: 176093 - protein, 11 aa, Artificial Sequence
  Description of Artificial Sequence: Synthetic peptide
  Seed: LISPNSVFSQW (TYRP1_HUMAN)
LASPNSVFSQF

SEQ ID NO: 176094 - protein, 9 aa, Artificial Sequence
  Description of Artificial Sequence: Synthetic peptide
  Seed: FPRQCATVE (TYRP1_HUMAN)
FSRQCATVY

SEQ ID NO: 176095 - protein, 10 aa, Artificial Sequence
  Description of Artificial Sequence: Synthetic peptide
  Seed: YNYFVWTHYY (TYRP1_HUMAN)
YKYFVWTHYL

SEQ ID NO: 176096 - protein, 9 aa, Artificial Sequence
  Description of Artificial Sequence: Synthetic peptide
  Seed: FSVPEIIAI (TYRP1_HUMAN)
FPVPEIIAC

SEQ ID NO: 176097 - protein, 9 aa, Artificial Sequence
  Description of Artificial Sequence: Synthetic peptide
  Seed: ARAQFPRQC (TYRP1_HUMAN)
AQAQFPRQL

SEQ ID NO: 176098 - protein, 9 aa, Artificial Sequence
  Description of Artificial Sequence: Synthetic peptide
  Seed: RPGWRGAAC (TYRP1_HUMAN)
RPGWRGAAG

SEQ ID NO: 176099 - protein, 10 aa, Artificial Sequence
  Description of Artificial Sequence: Synthetic peptide
  Seed: RSLHNLAHLF (TYRP1_HUMAN)
RSLHNLAHLI

SEQ ID NO: 176100 - protein, 9 aa, Artificial Sequence
  Description of Artificial Sequence: Synthetic peptide
  Seed: LSPNDPIFV (TYRP1_HUMAN)
LGPNDPIFL

SEQ ID NO: 176101 - protein, 10 aa, Artificial Sequence
  Description of Artificial Sequence: Synthetic peptide
  Seed: SMDEANQPLL (TYRP1_HUMAN)
SYDEANQPLI

SEQ ID NO: 176102 - protein, 9 aa, Artificial Sequence
  Description of Artificial Sequence: Synthetic peptide
  Seed: NFDSTLISP (TYRP1_HUMAN)
NWDSTLISF

SEQ ID NO: 176103 - protein, 9 aa, Artificial Sequence
  Description of Artificial Sequence: Synthetic peptide
  Seed: SMDEANQPL (TYRP1_HUMAN)
SVDEANQPI

SEQ ID NO: 176104 - protein, 9 aa, Artificial Sequence
  Description of Artificial Sequence: Synthetic peptide
  Seed: ISIYNYFVW (TYRP1_HUMAN)
IVIYNYFVW

SEQ ID NO: 176105 - protein, 10 aa, Artificial Sequence
  Description of Artificial Sequence: Synthetic peptide
  Seed: YNMVPFWPPV (TYRP1_HUMAN)
YYMVPFWPPA

SEQ ID NO: 176106 - protein, 9 aa, Artificial Sequence
  Description of Artificial Sequence: Synthetic peptide
  Seed: EPQDVAQCL (TYRP1_HUMAN)
EAQDVAQCW

SEQ ID NO: 176107 - protein, 11 aa, Artificial Sequence
  Description of Artificial Sequence: Synthetic peptide
  Seed: FLTWHRYHLLR (TYRP1_HUMAN)
FKTWHRYHLLR

SEQ ID NO: 176108 - protein, 8 aa, Artificial Sequence
  Description of Artificial Sequence: Synthetic peptide
  Seed: YYSVKKTF (TYRP1_HUMAN)
YFSVKKTL

SEQ ID NO: 176109 - protein, 9 aa, Artificial Sequence
  Description of Artificial Sequence: Synthetic peptide
  Seed: ACDQRVLIV (TYRP1_HUMAN)
ASDQRVLIV

SEQ ID NO: 176110 - protein, 9 aa, Artificial Sequence
  Description of Artificial Sequence: Synthetic peptide
  Seed: FSVPEIIAI (TYRP1_HUMAN)
FYVPEIIAV

SEQ ID NO: 176111 - protein, 9 aa, Artificial Sequence
  Description of Artificial Sequence: Synthetic peptide
  Seed: IAIAVVGAL (TYRP1_HUMAN)
IHIAVVGAY

SEQ ID NO: 176112 - protein, 10 aa, Artificial Sequence
  Description of Artificial Sequence: Synthetic peptide
  Seed: FSLPYWNFAT (TYRP1_HUMAN)
FVLPYWNFAA

SEQ ID NO: 176113 - protein, 9 aa, Artificial Sequence
  Description of Artificial Sequence: Synthetic peptide
  Seed: LSKEEKNHF (TYRP1_HUMAN)
LTKEEKNHY

SEQ ID NO: 176114 - protein, 9 aa, Artificial Sequence
  Description of Artificial Sequence: Synthetic peptide
  Seed: SLHNLAHLF (TYRP1_HUMAN)
SNHNLAHLY

SEQ ID NO: 176115 - protein, 9 aa, Artificial Sequence
  Description of Artificial Sequence: Synthetic peptide
  Seed: TADSRPHSP (TYRP1_HUMAN)
TFDSRPHSL

SEQ ID NO: 176116 - protein, 9 aa, Artificial Sequence
  Description of Artificial Sequence: Synthetic peptide
  Seed: GPDGNTPQF (TYRP1_HUMAN)
GYDGNTPQV

SEQ ID NO: 176117 - protein, 9 aa, Artificial Sequence
  Description of Artificial Sequence: Synthetic peptide
  Seed: QQARAQFPR (TYRP1_HUMAN)
QYARAQFPR

SEQ ID NO: 176118 - protein, 8 aa, Artificial Sequence
  Description of Artificial Sequence: Synthetic peptide
  Seed: RQYNMVPF (TYRP1_HUMAN)
RKYNMVPM

SEQ ID NO: 176119 - protein, 9 aa, Artificial Sequence
  Description of Artificial Sequence: Synthetic peptide
  Seed: RAQFPRQCA (TYRP1_HUMAN)
RFQFPRQCK

SEQ ID NO: 176120 - protein, 9 aa, Artificial Sequence
  Description of Artificial Sequence: Synthetic peptide
  Seed: FVWTHYYSV (TYRP1_HUMAN)
FSWTHYYSK

SEQ ID NO: 176121 - protein, 10 aa, Artificial Sequence
  Description of Artificial Sequence: Synthetic peptide
  Seed: SPNDPIFVLL (TYRP1_HUMAN)
SPNDPIFVLA

SEQ ID NO: 176122 - protein, 9 aa, Artificial Sequence
  Description of Artificial Sequence: Synthetic peptide
  Seed: SVPEIIAIA (TYRP1_HUMAN)
STPEIIAIM

SEQ ID NO: 176123 - protein, 9 aa, Artificial Sequence
  Description of Artificial Sequence: Synthetic peptide
  Seed: RYNADISTF (TYRP1_HUMAN)
RMNADISTF

SEQ ID NO: 176124 - protein, 9 aa, Artificial Sequence
  Description of Artificial Sequence: Synthetic peptide
  Seed: YLIRARRSM (TYRP1_HUMAN)
YHIRARRSY

SEQ ID NO: 176125 - protein, 8 aa, Artificial Sequence
  Description of Artificial Sequence: Synthetic peptide
  Seed: YSDPTGKY (TYRP1_HUMAN)
YMDPTGKF

SEQ ID NO: 176126 - protein, 10 aa, Artificial Sequence
  Description of Artificial Sequence: Synthetic peptide
  Seed: FVWTHYYSVK (TYRP1_HUMAN)
FIWTHYYSVC

SEQ ID NO: 176127 - protein, 9 aa, Artificial Sequence
  Description of Artificial Sequence: Synthetic peptide
  Seed: SLPYWNFAT (TYRP1_HUMAN)
SMPYWNFAA

SEQ ID NO: 176128 - protein, 11 aa, Artificial Sequence
  Description of Artificial Sequence: Synthetic peptide
  Seed: YNYFVWTHYYS (TYRP1_HUMAN)
YMYFVWTHYYV

SEQ ID NO: 176129 - protein, 10 aa, Artificial Sequence
  Description of Artificial Sequence: Synthetic peptide
  Seed: FVWTHYYSVK (TYRP1_HUMAN)
FVWTHYYSVV

SEQ ID NO: 176130 - protein, 10 aa, Artificial Sequence
  Description of Artificial Sequence: Synthetic peptide
  Seed: ALIFGTASYL (TYRP1_HUMAN)
AIIFGTASYV

SEQ ID NO: 176131 - protein, 10 aa, Artificial Sequence
  Description of Artificial Sequence: Synthetic peptide
  Seed: AVRSLHNLAH (TYRP1_HUMAN)
ATRSLHNLAV

SEQ ID NO: 176132 - protein, 10 aa, Artificial Sequence
  Description of Artificial Sequence: Synthetic peptide
  Seed: LSLGCIFFPL (TYRP1_HUMAN)
LYLGCIFFPI

SEQ ID NO: 176133 - protein, 10 aa, Artificial Sequence
  Description of Artificial Sequence: Synthetic peptide
  Seed: YFVWTHYYSV (TYRP1_HUMAN)
YWVWTHYYSV

SEQ ID NO: 176134 - protein, 10 aa, Artificial Sequence
  Description of Artificial Sequence: Synthetic peptide
  Seed: GKYDPAVRSL (TYRP1_HUMAN)
GLYDPAVRSY

SEQ ID NO: 176135 - protein, 9 aa, Artificial Sequence
  Description of Artificial Sequence: Synthetic peptide
  Seed: RYNADISTF (TYRP1_HUMAN)
RGNADISTY

SEQ ID NO: 176136 - protein, 9 aa, Artificial Sequence
  Description of Artificial Sequence: Synthetic peptide
  Seed: REFSVPEII (TYRP1_HUMAN)
RKFSVPEIF

SEQ ID NO: 176137 - protein, 9 aa, Artificial Sequence
  Description of Artificial Sequence: Synthetic peptide
  Seed: GLFDTPPFY (TYRP1_HUMAN)
GRFDTPPFF

SEQ ID NO: 176138 - protein, 9 aa, Artificial Sequence
  Description of Artificial Sequence: Synthetic peptide
  Seed: FTDAVFDEW (TYRP1_HUMAN)
FADAVFDEC

SEQ ID NO: 176139 - protein, 10 aa, Artificial Sequence
  Description of Artificial Sequence: Synthetic peptide
  Seed: LSLGCIFFPL (TYRP1_HUMAN)
LVLGCIFFPV

SEQ ID NO: 176140 - protein, 9 aa, Artificial Sequence
  Description of Artificial Sequence: Synthetic peptide
  Seed: YTYEIQWPS (TYRP1_HUMAN)
YEYEIQWPA

SEQ ID NO: 176141 - protein, 9 aa, Artificial Sequence
  Description of Artificial Sequence: Synthetic peptide
  Seed: QYQCYAEEY (TYRP1_HUMAN)
QYQCYAEEL

SEQ ID NO: 176142 - protein, 9 aa, Artificial Sequence
  Description of Artificial Sequence: Synthetic peptide
  Seed: GPDGNTPQF (TYRP1_HUMAN)
GADGNTPQM

SEQ ID NO: 176143 - protein, 9 aa, Artificial Sequence
  Description of Artificial Sequence: Synthetic peptide
  Seed: QEMLQEPSF (TYRP1_HUMAN)
QDMLQEPSM

SEQ ID NO: 176144 - protein, 9 aa, Artificial Sequence
  Description of Artificial Sequence: Synthetic peptide
  Seed: GTASYLIRA (TYRP1_HUMAN)
GLASYLIRT

SEQ ID NO: 176145 - protein, 9 aa, Artificial Sequence
  Description of Artificial Sequence: Synthetic peptide
  Seed: RQCATVEAL (TYRP1_HUMAN)
RHCATVEAL

SEQ ID NO: 176146 - protein, 10 aa, Artificial Sequence
  Description of Artificial Sequence: Synthetic peptide
  Seed: RSMDEANQPL (TYRP1_HUMAN)
RRMDEANQPM

SEQ ID NO: 176147 - protein, 10 aa, Artificial Sequence
  Description of Artificial Sequence: Synthetic peptide
  Seed: THYYSVKKTF (TYRP1_HUMAN)
TAYYSVKKTF

SEQ ID NO: 176148 - protein, 9 aa, Artificial Sequence
  Description of Artificial Sequence: Synthetic peptide
  Seed: LLHTFTDAV (TYRP1_HUMAN)
LMHTFTDAA

SEQ ID NO: 176149 - protein, 10 aa, Artificial Sequence
  Description of Artificial Sequence: Synthetic peptide
  Seed: FSLPYWNFAT (TYRP1_HUMAN)
FVLPYWNFAL

SEQ ID NO: 176150 - protein, 9 aa, Artificial Sequence
  Description of Artificial Sequence: Synthetic peptide
  Seed: YTYEIQWPS (TYRP1_HUMAN)
YIYEIQWPT

SEQ ID NO: 176151 - protein, 11 aa, Artificial Sequence
  Description of Artificial Sequence: Synthetic peptide
  Seed: QRLPEPQDVAQ (TYRP1_HUMAN)
QRLPEPQDVAF

SEQ ID NO: 176152 - protein, 9 aa, Artificial Sequence
  Description of Artificial Sequence: Synthetic peptide
  Seed: SPNSVFSQW (TYRP1_HUMAN)
SINSVFSQF

SEQ ID NO: 176153 - protein, 10 aa, Artificial Sequence
  Description of Artificial Sequence: Synthetic peptide
  Seed: IYNYFVWTHY (TYRP1_HUMAN)
IWNYFVWTHF

SEQ ID NO: 176154 - protein, 10 aa, Artificial Sequence
  Description of Artificial Sequence: Synthetic peptide
  Seed: FWPPVTNTEM (TYRP1_HUMAN)
FTPPVTNTEF

SEQ ID NO: 176155 - protein, 9 aa, Artificial Sequence
  Description of Artificial Sequence: Synthetic peptide
  Seed: NADISTFPL (TYRP1_HUMAN)
NTDISTFPI

SEQ ID NO: 176156 - protein, 9 aa, Artificial Sequence
  Description of Artificial Sequence: Synthetic peptide
  Seed: RYNADISTF (TYRP1_HUMAN)
RHNADISTM

SEQ ID NO: 176157 - protein, 9 aa, Artificial Sequence
  Description of Artificial Sequence: Synthetic peptide
  Seed: SPNDPIFVL (TYRP1_HUMAN)
SLNDPIFVF

SEQ ID NO: 176158 - protein, 10 aa, Artificial Sequence
  Description of Artificial Sequence: Synthetic peptide
  Seed: THYYSVKKTF (TYRP1_HUMAN)
TEYYSVKKTF

SEQ ID NO: 176159 - protein, 9 aa, Artificial Sequence
  Description of Artificial Sequence: Synthetic peptide
  Seed: LGYTYEIQW (TYRP1_HUMAN)
LVYTYEIQW

SEQ ID NO: 176160 - protein, 8 aa, Artificial Sequence
  Description of Artificial Sequence: Synthetic peptide
  Seed: YFVWTHYY (TYRP1_HUMAN)
YYVWTHYM

SEQ ID NO: 176161 - protein, 10 aa, Artificial Sequence
  Description of Artificial Sequence: Synthetic peptide
  Seed: RSMDEANQPL (TYRP1_HUMAN)
RCMDEANQPF

SEQ ID NO: 176162 - protein, 9 aa, Artificial Sequence
  Description of Artificial Sequence: Synthetic peptide
  Seed: DNLGYTYEI (TYRP1_HUMAN)
DALGYTYEI

SEQ ID NO: 176163 - protein, 10 aa, Artificial Sequence
  Description of Artificial Sequence: Synthetic peptide
  Seed: YNMVPFWPPV (TYRP1_HUMAN)
YLMVPFWPPS

SEQ ID NO: 176164 - protein, 10 aa, Artificial Sequence
  Description of Artificial Sequence: Synthetic peptide
  Seed: ENISIYNYFV (TYRP1_HUMAN)
EAISIYNYFI

SEQ ID NO: 176165 - protein, 10 aa, Artificial Sequence
  Description of Artificial Sequence: Synthetic peptide
  Seed: LSLGCIFFPL (TYRP1_HUMAN)
LRLGCIFFPV

SEQ ID NO: 176166 - protein, 9 aa, Artificial Sequence
  Description of Artificial Sequence: Synthetic peptide
  Seed: REFSVPEII (TYRP1_HUMAN)
RSFSVPEII

SEQ ID NO: 176167 - protein, 10 aa, Artificial Sequence
  Description of Artificial Sequence: Synthetic peptide
  Seed: ALIFGTASYL (TYRP1_HUMAN)
ASIFGTASYV

SEQ ID NO: 176168 - protein, 9 aa, Artificial Sequence
  Description of Artificial Sequence: Synthetic peptide
  Seed: SLGCIFFPL (TYRP1_HUMAN)
SIGCIFFPA

SEQ ID NO: 176169 - protein, 9 aa, Artificial Sequence
  Description of Artificial Sequence: Synthetic peptide
  Seed: AVFDEWLRR (TYRP1_HUMAN)
ATFDEWLRR

SEQ ID NO: 176170 - protein, 11 aa, Artificial Sequence
  Description of Artificial Sequence: Synthetic peptide
  Seed: YNMVPFWPPVT (TYRP1_HUMAN)
YTMVPFWPPVV

SEQ ID NO: 176171 - protein, 9 aa, Artificial Sequence
  Description of Artificial Sequence: Synthetic peptide
  Seed: FLGVGQESF (TYRP1_HUMAN)
FIGVGQESY

SEQ ID NO: 176172 - protein, 10 aa, Artificial Sequence
  Description of Artificial Sequence: Synthetic peptide
  Seed: LGPDGNTPQF (TYRP1_HUMAN)
LEPDGNTPQW

SEQ ID NO: 176173 - protein, 10 aa, Artificial Sequence
  Description of Artificial Sequence: Synthetic peptide
  Seed: SREFSVPEII (TYRP1_HUMAN)
SHEFSVPEIL

SEQ ID NO: 176174 - protein, 9 aa, Artificial Sequence
  Description of Artificial Sequence: Synthetic peptide
  Seed: ALIFGTASY (TYRP1_HUMAN)
AAIFGTASM

SEQ ID NO: 176175 - protein, 11 aa, Artificial Sequence
  Description of Artificial Sequence: Synthetic peptide
  Seed: FSHEGPAFLTW (TYRP1_HUMAN)
FAHEGPAFLTL

SEQ ID NO: 176176 - protein, 9 aa, Artificial Sequence
  Description of Artificial Sequence: Synthetic peptide
  Seed: VPFWPPVTN (TYRP1_HUMAN)
VGFWPPVTY

SEQ ID NO: 176177 - protein, 9 aa, Artificial Sequence
  Description of Artificial Sequence: Synthetic peptide
  Seed: MLQEPSFSL (TYRP1_HUMAN)
MIQEPSFSW

SEQ ID NO: 176178 - protein, 9 aa, Artificial Sequence
  Description of Artificial Sequence: Synthetic peptide
  Seed: AVVGALLLV (TYRP1_HUMAN)
AQVGALLLW

SEQ ID NO: 176179 - protein, 10 aa, Artificial Sequence
  Description of Artificial Sequence: Synthetic peptide
  Seed: FSLPYWNFAT (TYRP1_HUMAN)
FPLPYWNFAI

SEQ ID NO: 176180 - protein, 9 aa, Artificial Sequence
  Description of Artificial Sequence: Synthetic peptide
  Seed: NMVPFWPPV (TYRP1_HUMAN)
NTVPFWPPV

SEQ ID NO: 176181 - protein, 10 aa, Artificial Sequence
  Description of Artificial Sequence: Synthetic peptide
  Seed: YNYFVWTHYY (TYRP1_HUMAN)
YTYFVWTHYK

SEQ ID NO: 176182 - protein, 10 aa, Artificial Sequence
  Description of Artificial Sequence: Synthetic peptide
  Seed: LGPDGNTPQF (TYRP1_HUMAN)
LQPDGNTPQW

SEQ ID NO: 176183 - protein, 9 aa, Artificial Sequence
  Description of Artificial Sequence: Synthetic peptide
  Seed: TLISPNSVF (TYRP1_HUMAN)
TVISPNSVF

SEQ ID NO: 176184 - protein, 9 aa, Artificial Sequence
  Description of Artificial Sequence: Synthetic peptide
  Seed: VCDICTDDL (TYRP1_HUMAN)
VFDICTDDM

SEQ ID NO: 176185 - protein, 9 aa, Artificial Sequence
  Description of Artificial Sequence: Synthetic peptide
  Seed: YTYEIQWPS (TYRP1_HUMAN)
YCYEIQWPM

SEQ ID NO: 176186 - protein, 9 aa, Artificial Sequence
  Description of Artificial Sequence: Synthetic peptide
  Seed: GTASYLIRA (TYRP1_HUMAN)
GLASYLIRC

SEQ ID NO: 176187 - protein, 11 aa, Artificial Sequence
  Description of Artificial Sequence: Synthetic peptide
  Seed: THLSPNDPIFV (TYRP1_HUMAN)
THLSPNDPIFI

SEQ ID NO: 176188 - protein, 11 aa, Artificial Sequence
  Description of Artificial Sequence: Synthetic peptide
  Seed: RRYNADISTFP (TYRP1_HUMAN)
RYYNADISTFF

SEQ ID NO: 176189 - protein, 9 aa, Artificial Sequence
  Description of Artificial Sequence: Synthetic peptide
  Seed: NGTGGQTHL (TYRP1_HUMAN)
NATGGQTHM

SEQ ID NO: 176190 - protein, 9 aa, Artificial Sequence
  Description of Artificial Sequence: Synthetic peptide
  Seed: FLGVGQESF (TYRP1_HUMAN)
FSGVGQESY

SEQ ID NO: 176191 - protein, 9 aa, Artificial Sequence
  Description of Artificial Sequence: Synthetic peptide
  Seed: AVVGALLLV (TYRP1_HUMAN)
ATVGALLLY

SEQ ID NO: 176192 - protein, 11 aa, Artificial Sequence
  Description of Artificial Sequence: Synthetic peptide
  Seed: HLSPNDPIFVL (TYRP1_HUMAN)
HQSPNDPIFVW

SEQ ID NO: 176193 - protein, 11 aa, Artificial Sequence
  Description of Artificial Sequence: Synthetic peptide
  Seed: VLLHTFTDAVF (TYRP1_HUMAN)
VKLHTFTDAVY

SEQ ID NO: 176194 - protein, 9 aa, Artificial Sequence
  Description of Artificial Sequence: Synthetic peptide
  Seed: YLIRARRSM (TYRP1_HUMAN)
YGIRARRSF

SEQ ID NO: 176195 - protein, 10 aa, Artificial Sequence
  Description of Artificial Sequence: Synthetic peptide
  Seed: YFVWTHYYSV (TYRP1_HUMAN)
YLVWTHYYSV

SEQ ID NO: 176196 - protein, 9 aa, Artificial Sequence
  Description of Artificial Sequence: Synthetic peptide
  Seed: AQFPRQCAT (TYRP1_HUMAN)
ASFPRQCAM

SEQ ID NO: 176197 - protein, 9 aa, Artificial Sequence
  Description of Artificial Sequence: Synthetic peptide
  Seed: EEYEKLQNP (TYRP1_HUMAN)
EEYEKLQNY

SEQ ID NO: 176198 - protein, 9 aa, Artificial Sequence
  Description of Artificial Sequence: Synthetic peptide
  Seed: LTWHRYHLL (TYRP1_HUMAN)
LIWHRYHLI

SEQ ID NO: 176199 - protein, 10 aa, Artificial Sequence
  Description of Artificial Sequence: Synthetic peptide
  Seed: YNMVPFWPPV (TYRP1_HUMAN)
YEMVPFWPPA

SEQ ID NO: 176200 - protein, 9 aa, Artificial Sequence
  Description of Artificial Sequence: Synthetic peptide
  Seed: YTYEIQWPS (TYRP1_HUMAN)
YLYEIQWPH

SEQ ID NO: 176201 - protein, 9 aa, Artificial Sequence
  Description of Artificial Sequence: Synthetic peptide
  Seed: TADSRPHSP (TYRP1_HUMAN)
TSDSRPHSI

SEQ ID NO: 176202 - protein, 10 aa, Artificial Sequence
  Description of Artificial Sequence: Synthetic peptide
  Seed: FYSNSTNSFR (TYRP1_HUMAN)
FFSNSTNSFR

SEQ ID NO: 176203 - protein, 9 aa, Artificial Sequence
  Description of Artificial Sequence: Synthetic peptide
  Seed: SFRNTVEGY (TYRP1_HUMAN)
STRNTVEGY

SEQ ID NO: 176204 - protein, 9 aa, Artificial Sequence
  Description of Artificial Sequence: Synthetic peptide
  Seed: YTYEIQWPS (TYRP1_HUMAN)
YGYEIQWPM

SEQ ID NO: 176205 - protein, 10 aa, Artificial Sequence
  Description of Artificial Sequence: Synthetic peptide
  Seed: RSLHNLAHLF (TYRP1_HUMAN)
RILHNLAHLF

SEQ ID NO: 176206 - protein, 9 aa, Artificial Sequence
  Description of Artificial Sequence: Synthetic peptide
  Seed: STLISPNSV (TYRP1_HUMAN)
SQLISPNSV

SEQ ID NO: 176207 - protein, 9 aa, Artificial Sequence
  Description of Artificial Sequence: Synthetic peptide
  Seed: LIFGTASYL (TYRP1_HUMAN)
LMFGTASYM

SEQ ID NO: 176208 - protein, 11 aa, Artificial Sequence
  Description of Artificial Sequence: Synthetic peptide
  Seed: LVALIFGTASY (TYRP1_HUMAN)
LMALIFGTASM

SEQ ID NO: 176209 - protein, 10 aa, Artificial Sequence
  Description of Artificial Sequence: Synthetic peptide
  Seed: LGPDGNTPQF (TYRP1_HUMAN)
LYPDGNTPQF

SEQ ID NO: 176210 - protein, 10 aa, Artificial Sequence
  Description of Artificial Sequence: Synthetic peptide
  Seed: MAKRTTHPLF (TYRP1_HUMAN)
MPKRTTHPLT

SEQ ID NO: 176211 - protein, 11 aa, Artificial Sequence
  Description of Artificial Sequence: Synthetic peptide
  Seed: EILGPDGNTPQ (TYRP1_HUMAN)
ELLGPDGNTPR

SEQ ID NO: 176212 - protein, 10 aa, Artificial Sequence
  Description of Artificial Sequence: Synthetic peptide
  Seed: LQEPSFSLPY (TYRP1_HUMAN)
LHEPSFSLPF

SEQ ID NO: 176213 - protein, 9 aa, Artificial Sequence
  Description of Artificial Sequence: Synthetic peptide
  Seed: AVRSLHNLA (TYRP1_HUMAN)
ATRSLHNLM

SEQ ID NO: 176214 - protein, 9 aa, Artificial Sequence
  Description of Artificial Sequence: Synthetic peptide
  Seed: TADSRPHSP (TYRP1_HUMAN)
TNDSRPHSM

SEQ ID NO: 176215 - protein, 11 aa, Artificial Sequence
  Description of Artificial Sequence: Synthetic peptide
  Seed: FPLLLFQQARA (TYRP1_HUMAN)
FCLLLFQQARV

SEQ ID NO: 176216 - protein, 10 aa, Artificial Sequence
  Description of Artificial Sequence: Synthetic peptide
  Seed: AVRSLHNLAH (TYRP1_HUMAN)
AYRSLHNLAK

SEQ ID NO: 176217 - protein, 9 aa, Artificial Sequence
  Description of Artificial Sequence: Synthetic peptide
  Seed: RYNADISTF (TYRP1_HUMAN)
RRNADISTF

SEQ ID NO: 176218 - protein, 9 aa, Artificial Sequence
  Description of Artificial Sequence: Synthetic peptide
  Seed: SLPYWNFAT (TYRP1_HUMAN)
STPYWNFAV

SEQ ID NO: 176219 - protein, 9 aa, Artificial Sequence
  Description of Artificial Sequence: Synthetic peptide
  Seed: FTDAVFDEW (TYRP1_HUMAN)
FIDAVFDEV

SEQ ID NO: 176220 - protein, 8 aa, Artificial Sequence
  Description of Artificial Sequence: Synthetic peptide
  Seed: GLFDTPPF (TYRP1_HUMAN)
GMFDTPPY

SEQ ID NO: 176221 - protein, 10 aa, Artificial Sequence
  Description of Artificial Sequence: Synthetic peptide
  Seed: YNMVPFWPPV (TYRP1_HUMAN)
YWMVPFWPPI

SEQ ID NO: 176222 - protein, 9 aa, Artificial Sequence
  Description of Artificial Sequence: Synthetic peptide
  Seed: RTTHPLFVI (TYRP1_HUMAN)
RTTHPLFVF

SEQ ID NO: 176223 - protein, 9 aa, Artificial Sequence
  Description of Artificial Sequence: Synthetic peptide
  Seed: NADISTFPL (TYRP1_HUMAN)
NPDISTFPY

SEQ ID NO: 176224 - protein, 10 aa, Artificial Sequence
  Description of Artificial Sequence: Synthetic peptide
  Seed: YNMVPFWPPV (TYRP1_HUMAN)
YSMVPFWPPI

SEQ ID NO: 176225 - protein, 10 aa, Artificial Sequence
  Description of Artificial Sequence: Synthetic peptide
  Seed: LIFGTASYLI (TYRP1_HUMAN)
LYFGTASYLW

SEQ ID NO: 176226 - protein, 10 aa, Artificial Sequence
  Description of Artificial Sequence: Synthetic peptide
  Seed: FLNGTGGQTH (TYRP1_HUMAN)
FSNGTGGQTF

SEQ ID NO: 176227 - protein, 9 aa, Artificial Sequence
  Description of Artificial Sequence: Synthetic peptide
  Seed: TTHPLFVIA (TYRP1_HUMAN)
TSHPLFVIF

SEQ ID NO: 176228 - protein, 9 aa, Artificial Sequence
  Description of Artificial Sequence: Synthetic peptide
  Seed: LLVALIFGT (TYRP1_HUMAN)
LVVALIFGL

SEQ ID NO: 176229 - protein, 11 aa, Artificial Sequence
  Description of Artificial Sequence: Synthetic peptide
  Seed: VCDSLEDYDTL (TYRP1_HUMAN)
VVDSLEDYDTL

SEQ ID NO: 176230 - protein, 10 aa, Artificial Sequence
  Description of Artificial Sequence: Synthetic peptide
  Seed: RRYNADISTF (TYRP1_HUMAN)
RQYNADISTY

SEQ ID NO: 176231 - protein, 9 aa, Artificial Sequence
  Description of Artificial Sequence: Synthetic peptide
  Seed: ISIYNYFVW (TYRP1_HUMAN)
IHIYNYFVY

SEQ ID NO: 176232 - protein, 11 aa, Artificial Sequence
  Description of Artificial Sequence: Synthetic peptide
  Seed: YQCYAEEYEKL (TYRP1_HUMAN)
YVCYAEEYEKF

SEQ ID NO: 176233 - protein, 9 aa, Artificial Sequence
  Description of Artificial Sequence: Synthetic peptide
  Seed: FYSNSTNSF (TYRP1_HUMAN)
FQSNSTNSL

SEQ ID NO: 176234 - protein, 9 aa, Artificial Sequence
  Description of Artificial Sequence: Synthetic peptide
  Seed: DYDTLGTLC (TYRP1_HUMAN)
DYDTLGTLI

SEQ ID NO: 176235 - protein, 10 aa, Artificial Sequence
  Description of Artificial Sequence: Synthetic peptide
  Seed: AQFPRQCATV (TYRP1_HUMAN)
AEFPRQCATI

SEQ ID NO: 176236 - protein, 9 aa, Artificial Sequence
  Description of Artificial Sequence: Synthetic peptide
  Seed: DDREVWPLR (TYRP1_HUMAN)
DTREVWPLR

SEQ ID NO: 176237 - protein, 10 aa, Artificial Sequence
  Description of Artificial Sequence: Synthetic peptide
  Seed: MLQEPSFSLP (TYRP1_HUMAN)
MMQEPSFSLF

SEQ ID NO: 176238 - protein, 10 aa, Artificial Sequence
  Description of Artificial Sequence: Synthetic peptide
  Seed: EMLQEPSFSL (TYRP1_HUMAN)
EFLQEPSFSA

SEQ ID NO: 176239 - protein, 9 aa, Artificial Sequence
  Description of Artificial Sequence: Synthetic peptide
  Seed: TLISPNSVF (TYRP1_HUMAN)
TFISPNSVV

SEQ ID NO: 176240 - protein, 9 aa, Artificial Sequence
  Description of Artificial Sequence: Synthetic peptide
  Seed: MSAPKLLSL (TYRP1_HUMAN)
MVAPKLLSI

SEQ ID NO: 176241 - protein, 9 aa, Artificial Sequence
  Description of Artificial Sequence: Synthetic peptide
  Seed: SPNDPIFVL (TYRP1_HUMAN)
SLNDPIFVI

SEQ ID NO: 176242 - protein, 10 aa, Artificial Sequence
  Description of Artificial Sequence: Synthetic peptide
  Seed: VPFWPPVTNT (TYRP1_HUMAN)
VPFWPPVTNA

SEQ ID NO: 176243 - protein, 9 aa, Artificial Sequence
  Description of Artificial Sequence: Synthetic peptide
  Seed: RSNFDSTLI (TYRP1_HUMAN)
RLNFDSTLF

SEQ ID NO: 176244 - protein, 10 aa, Artificial Sequence
  Description of Artificial Sequence: Synthetic peptide
  Seed: VALIFGTASY (TYRP1_HUMAN)
VFLIFGTASF

SEQ ID NO: 176245 - protein, 9 aa, Artificial Sequence
  Description of Artificial Sequence: Synthetic peptide
  Seed: MSAPKLLSL (TYRP1_HUMAN)
MNAPKLLSW

SEQ ID NO: 176246 - protein, 10 aa, Artificial Sequence
  Description of Artificial Sequence: Synthetic peptide
  Seed: VAQCLEVGLF (TYRP1_HUMAN)
VTQCLEVGLW

SEQ ID NO: 176247 - protein, 8 aa, Artificial Sequence
  Description of Artificial Sequence: Synthetic peptide
  Seed: YYSVKKTF (TYRP1_HUMAN)
YASVKKTL

SEQ ID NO: 176248 - protein, 9 aa, Artificial Sequence
  Description of Artificial Sequence: Synthetic peptide
  Seed: ENAPIGHNR (TYRP1_HUMAN)
EAAPIGHNH

SEQ ID NO: 176249 - protein, 11 aa, Artificial Sequence
  Description of Artificial Sequence: Synthetic peptide
  Seed: LVALIFGTASY (TYRP1_HUMAN)
LQALIFGTASM

SEQ ID NO: 176250 - protein, 9 aa, Artificial Sequence
  Description of Artificial Sequence: Synthetic peptide
  Seed: RPHSPQYPH (TYRP1_HUMAN)
RPHSPQYPY

SEQ ID NO: 176251 - protein, 9 aa, Artificial Sequence
  Description of Artificial Sequence: Synthetic peptide
  Seed: YLIRARRSM (TYRP1_HUMAN)
YPIRARRSM

SEQ ID NO: 176252 - protein, 9 aa, Artificial Sequence
  Description of Artificial Sequence: Synthetic peptide
  Seed: FENISIYNY (TYRP1_HUMAN)
FYNISIYNY

SEQ ID NO: 176253 - protein, 11 aa, Artificial Sequence
  Description of Artificial Sequence: Synthetic peptide
  Seed: FVLLHTFTDAV (TYRP1_HUMAN)
FLLLHTFTDAI

SEQ ID NO: 176254 - protein, 9 aa, Artificial Sequence
  Description of Artificial Sequence: Synthetic peptide
  Seed: AQFPRQCAT (TYRP1_HUMAN)
AVFPRQCAY

SEQ ID NO: 176255 - protein, 9 aa, Artificial Sequence
  Description of Artificial Sequence: Synthetic peptide
  Seed: KYDPAVRSL (TYRP1_HUMAN)
KRDPAVRSI

SEQ ID NO: 176256 - protein, 9 aa, Artificial Sequence
  Description of Artificial Sequence: Synthetic peptide
  Seed: MLQEPSFSL (TYRP1_HUMAN)
MQQEPSFSW

SEQ ID NO: 176257 - protein, 9 aa, Artificial Sequence
  Description of Artificial Sequence: Synthetic peptide
  Seed: IAIAVVGAL (TYRP1_HUMAN)
IGIAVVGAF

SEQ ID NO: 176258 - protein, 9 aa, Artificial Sequence
  Description of Artificial Sequence: Synthetic peptide
  Seed: MLQEPSFSL (TYRP1_HUMAN)
MFQEPSFSF

SEQ ID NO: 176259 - protein, 11 aa, Artificial Sequence
  Description of Artificial Sequence: Synthetic peptide
  Seed: YNMVPFWPPVT (TYRP1_HUMAN)
YLMVPFWPPVM

SEQ ID NO: 176260 - protein, 9 aa, Artificial Sequence
  Description of Artificial Sequence: Synthetic peptide
  Seed: AVTADSRPH (TYRP1_HUMAN)
AATADSRPY

SEQ ID NO: 176261 - protein, 11 aa, Artificial Sequence
  Description of Artificial Sequence: Synthetic peptide
  Seed: IYNYFVWTHYY (TYRP1_HUMAN)
IANYFVWTHYL

SEQ ID NO: 176262 - protein, 10 aa, Artificial Sequence
  Description of Artificial Sequence: Synthetic peptide
  Seed: SHEGPAFLTW (TYRP1_HUMAN)
SIEGPAFLTW

SEQ ID NO: 176263 - protein, 10 aa, Artificial Sequence
  Description of Artificial Sequence: Synthetic peptide
  Seed: YNADISTFPL (TYRP1_HUMAN)
YQADISTFPA

SEQ ID NO: 176264 - protein, 9 aa, Artificial Sequence
  Description of Artificial Sequence: Synthetic peptide
  Seed: DSRPHSPQY (TYRP1_HUMAN)
DMRPHSPQF

SEQ ID NO: 176265 - protein, 10 aa, Artificial Sequence
  Description of Artificial Sequence: Synthetic peptide
  Seed: QFENISIYNY (TYRP1_HUMAN)
QEENISIYNF

SEQ ID NO: 176266 - protein, 9 aa, Artificial Sequence
  Description of Artificial Sequence: Synthetic peptide
  Seed: SLPYWNFAT (TYRP1_HUMAN)
SQPYWNFAI

SEQ ID NO: 176267 - protein, 9 aa, Artificial Sequence
  Description of Artificial Sequence: Synthetic peptide
  Seed: HLSPNDPIF (TYRP1_HUMAN)
HTSPNDPIW

SEQ ID NO: 176268 - protein, 9 aa, Artificial Sequence
  Description of Artificial Sequence: Synthetic peptide
  Seed: TTHPLFVIA (TYRP1_HUMAN)
TTHPLFVIF

SEQ ID NO: 176269 - protein, 10 aa, Artificial Sequence
  Description of Artificial Sequence: Synthetic peptide
  Seed: MAKRTTHPLF (TYRP1_HUMAN)
MPKRTTHPLA

SEQ ID NO: 176270 - protein, 9 aa, Artificial Sequence
  Description of Artificial Sequence: Synthetic peptide
  Seed: AIAVVGALL (TYRP1_HUMAN)
ASAVVGALL

SEQ ID NO: 176271 - protein, 9 aa, Artificial Sequence
  Description of Artificial Sequence: Synthetic peptide
  Seed: HLSPNDPIF (TYRP1_HUMAN)
HSSPNDPIY

SEQ ID NO: 176272 - protein, 10 aa, Artificial Sequence
  Description of Artificial Sequence: Synthetic peptide
  Seed: MVPFWPPVTN (TYRP1_HUMAN)
MCPFWPPVTM

SEQ ID NO: 176273 - protein, 9 aa, Artificial Sequence
  Description of Artificial Sequence: Synthetic peptide
  Seed: EGYSDPTGK (TYRP1_HUMAN)
ESYSDPTGR

SEQ ID NO: 176274 - protein, 9 aa, Artificial Sequence
  Description of Artificial Sequence: Synthetic peptide
  Seed: KYDPAVRSL (TYRP1_HUMAN)
KGDPAVRSW

SEQ ID NO: 176275 - protein, 10 aa, Artificial Sequence
  Description of Artificial Sequence: Synthetic peptide
  Seed: GLFDTPPFYS (TYRP1_HUMAN)
GVFDTPPFYA

SEQ ID NO: 176276 - protein, 10 aa, Artificial Sequence
  Description of Artificial Sequence: Synthetic peptide
  Seed: IYNYFVWTHY (TYRP1_HUMAN)
IYNYFVWTHF

SEQ ID NO: 176277 - protein, 9 aa, Artificial Sequence
  Description of Artificial Sequence: Synthetic peptide
  Seed: VTAPDNLGY (TYRP1_HUMAN)
VKAPDNLGY

SEQ ID NO: 176278 - protein, 9 aa, Artificial Sequence
  Description of Artificial Sequence: Synthetic peptide
  Seed: YNYFVWTHY (TYRP1_HUMAN)
YQYFVWTHM

SEQ ID NO: 176279 - protein, 9 aa, Artificial Sequence
  Description of Artificial Sequence: Synthetic peptide
  Seed: FSVPEIIAI (TYRP1_HUMAN)
FYVPEIIAF

SEQ ID NO: 176280 - protein, 9 aa, Artificial Sequence
  Description of Artificial Sequence: Synthetic peptide
  Seed: SMDEANQPL (TYRP1_HUMAN)
SVDEANQPF

SEQ ID NO: 176281 - protein, 9 aa, Artificial Sequence
  Description of Artificial Sequence: Synthetic peptide
  Seed: IAIAVVGAL (TYRP1_HUMAN)
IVIAVVGAR

SEQ ID NO: 176282 - protein, 9 aa, Artificial Sequence
  Description of Artificial Sequence: Synthetic peptide
  Seed: NMVPFWPPV (TYRP1_HUMAN)
NMVPFWPPY

SEQ ID NO: 176283 - protein, 11 aa, Artificial Sequence
  Description of Artificial Sequence: Synthetic peptide
  Seed: FWPPVTNTEMF (TYRP1_HUMAN)
FWPPVTNTEMY

SEQ ID NO: 176284 - protein, 9 aa, Artificial Sequence
  Description of Artificial Sequence: Synthetic peptide
  Seed: HLSPNDPIF (TYRP1_HUMAN)
HLSPNDPIL

SEQ ID NO: 176285 - protein, 9 aa, Artificial Sequence
  Description of Artificial Sequence: Synthetic peptide
  Seed: RRSEEILGP (TYRP1_HUMAN)
RRSEEILGI

SEQ ID NO: 176286 - protein, 9 aa, Artificial Sequence
  Description of Artificial Sequence: Synthetic peptide
  Seed: AIAVVGALL (TYRP1_HUMAN)
ALAVVGALI

SEQ ID NO: 176287 - protein, 9 aa, Artificial Sequence
  Description of Artificial Sequence: Synthetic peptide
  Seed: GLFDTPPFY (TYRP1_HUMAN)
GMFDTPPFR

SEQ ID NO: 176288 - protein, 9 aa, Artificial Sequence
  Description of Artificial Sequence: Synthetic peptide
  Seed: APIGHNRQY (TYRP1_HUMAN)
AGIGHNRQY

SEQ ID NO: 176289 - protein, 9 aa, Artificial Sequence
  Description of Artificial Sequence: Synthetic peptide
  Seed: MSAPKLLSL (TYRP1_HUMAN)
MMAPKLLSL

SEQ ID NO: 176290 - protein, 9 aa, Artificial Sequence
  Description of Artificial Sequence: Synthetic peptide
  Seed: AACDQRVLI (TYRP1_HUMAN)
AMCDQRVLV

SEQ ID NO: 176291 - protein, 9 aa, Artificial Sequence
  Description of Artificial Sequence: Synthetic peptide
  Seed: TEMFVTAPD (TYRP1_HUMAN)
TEMFVTAPP

SEQ ID NO: 176292 - protein, 10 aa, Artificial Sequence
  Description of Artificial Sequence: Synthetic peptide
  Seed: YNYFVWTHYY (TYRP1_HUMAN)
YCYFVWTHYI

SEQ ID NO: 176293 - protein, 9 aa, Artificial Sequence
  Description of Artificial Sequence: Synthetic peptide
  Seed: KLLSLGCIF (TYRP1_HUMAN)
KSLSLGCIM

SEQ ID NO: 176294 - protein, 10 aa, Artificial Sequence
  Description of Artificial Sequence: Synthetic peptide
  Seed: HRYHLLRLEK (TYRP1_HUMAN)
HRYHLLRLEV

SEQ ID NO: 176295 - protein, 9 aa, Artificial Sequence
  Description of Artificial Sequence: Synthetic peptide
  Seed: YNYFVWTHY (TYRP1_HUMAN)
YMYFVWTHH

SEQ ID NO: 176296 - protein, 10 aa, Artificial Sequence
  Description of Artificial Sequence: Synthetic peptide
  Seed: FPLLLFQQAR (TYRP1_HUMAN)
FPLLLFQQAA

SEQ ID NO: 176297 - protein, 11 aa, Artificial Sequence
  Description of Artificial Sequence: Synthetic peptide
  Seed: RRSMDEANQPL (TYRP1_HUMAN)
RFSMDEANQPV

SEQ ID NO: 176298 - protein, 9 aa, Artificial Sequence
  Description of Artificial Sequence: Synthetic peptide
  Seed: ISIYNYFVW (TYRP1_HUMAN)
IYIYNYFVW

SEQ ID NO: 176299 - protein, 9 aa, Artificial Sequence
  Description of Artificial Sequence: Synthetic peptide
  Seed: LIFGTASYL (TYRP1_HUMAN)
LEFGTASYM

SEQ ID NO: 176300 - protein, 10 aa, Artificial Sequence
  Description of Artificial Sequence: Synthetic peptide
  Seed: YNMVPFWPPV (TYRP1_HUMAN)
YMMVPFWPPS

SEQ ID NO: 176301 - protein, 10 aa, Artificial Sequence
  Description of Artificial Sequence: Synthetic peptide
  Seed: SIYNYFVWTH (TYRP1_HUMAN)
SFYNYFVWTK

SEQ ID NO: 176302 - protein, 9 aa, Artificial Sequence
  Description of Artificial Sequence: Synthetic peptide
  Seed: MSAPKLLSL (TYRP1_HUMAN)
MYAPKLLSV

SEQ ID NO: 176303 - protein, 9 aa, Artificial Sequence
  Description of Artificial Sequence: Synthetic peptide
  Seed: GLFDTPPFY (TYRP1_HUMAN)
GQFDTPPFM

SEQ ID NO: 176304 - protein, 11 aa, Artificial Sequence
  Description of Artificial Sequence: Synthetic peptide
  Seed: YNMVPFWPPVT (TYRP1_HUMAN)
YMMVPFWPPVV

SEQ ID NO: 176305 - protein, 10 aa, Artificial Sequence
  Description of Artificial Sequence: Synthetic peptide
  Seed: HLSPNDPIFV (TYRP1_HUMAN)
HISPNDPIFL

SEQ ID NO: 176306 - protein, 10 aa, Artificial Sequence
  Description of Artificial Sequence: Synthetic peptide
  Seed: FSLPYWNFAT (TYRP1_HUMAN)
FVLPYWNFAV

SEQ ID NO: 176307 - protein, 9 aa, Artificial Sequence
  Description of Artificial Sequence: Synthetic peptide
  Seed: RQCATVEAL (TYRP1_HUMAN)
RTCATVEAV

SEQ ID NO: 176308 - protein, 9 aa, Artificial Sequence
  Description of Artificial Sequence: Synthetic peptide
  Seed: THYYSVKKT (TYRP1_HUMAN)
THYYSVKKA

SEQ ID NO: 176309 - protein, 9 aa, Artificial Sequence
  Description of Artificial Sequence: Synthetic peptide
  Seed: FSLPYWNFA (TYRP1_HUMAN)
FVLPYWNFL

SEQ ID NO: 176310 - protein, 9 aa, Artificial Sequence
  Description of Artificial Sequence: Synthetic peptide
  Seed: FYSNSTNSF (TYRP1_HUMAN)
FASNSTNSF

SEQ ID NO: 176311 - protein, 9 aa, Artificial Sequence
  Description of Artificial Sequence: Synthetic peptide
  Seed: SRSNFDSTL (TYRP1_HUMAN)
STSNFDSTF

SEQ ID NO: 176312 - protein, 9 aa, Artificial Sequence
  Description of Artificial Sequence: Synthetic peptide
  Seed: FSLPYWNFA (TYRP1_HUMAN)
FMLPYWNFY

SEQ ID NO: 176313 - protein, 9 aa, Artificial Sequence
  Description of Artificial Sequence: Synthetic peptide
  Seed: VWTHYYSVK (TYRP1_HUMAN)
VMTHYYSVR

SEQ ID NO: 176314 - protein, 10 aa, Artificial Sequence
  Description of Artificial Sequence: Synthetic peptide
  Seed: ADSRPHSPQY (TYRP1_HUMAN)
ADSRPHSPQK

SEQ ID NO: 176315 - protein, 10 aa, Artificial Sequence
  Description of Artificial Sequence: Synthetic peptide
  Seed: TFLGVGQESF (TYRP1_HUMAN)
TALGVGQESY

SEQ ID NO: 176316 - protein, 8 aa, Artificial Sequence
  Description of Artificial Sequence: Synthetic peptide
  Seed: VSGPGTDR (TYRP1_HUMAN)
VAGPGTDM

SEQ ID NO: 176317 - protein, 9 aa, Artificial Sequence
  Description of Artificial Sequence: Synthetic peptide
  Seed: HYYSVKKTF (TYRP1_HUMAN)
HYYSVKKTV

SEQ ID NO: 176318 - protein, 9 aa, Artificial Sequence
  Description of Artificial Sequence: Synthetic peptide
  Seed: RARRSMDEA (TYRP1_HUMAN)
RTRRSMDEA

SEQ ID NO: 176319 - protein, 11 aa, Artificial Sequence
  Description of Artificial Sequence: Synthetic peptide
  Seed: VTAPDNLGYTY (TYRP1_HUMAN)
VLAPDNLGYTY

SEQ ID NO: 176320 - protein, 9 aa, Artificial Sequence
  Description of Artificial Sequence: Synthetic peptide
  Seed: LVALIFGTA (TYRP1_HUMAN)
LPALIFGTT

SEQ ID NO: 176321 - protein, 10 aa, Artificial Sequence
  Description of Artificial Sequence: Synthetic peptide
  Seed: ALIFGTASYL (TYRP1_HUMAN)
AEIFGTASYV

SEQ ID NO: 176322 - protein, 9 aa, Artificial Sequence
  Description of Artificial Sequence: Synthetic peptide
  Seed: FPRQCATVE (TYRP1_HUMAN)
FARQCATVM

SEQ ID NO: 176323 - protein, 9 aa, Artificial Sequence
  Description of Artificial Sequence: Synthetic peptide
  Seed: HEGPAFLTW (TYRP1_HUMAN)
HRGPAFLTI

SEQ ID NO: 176324 - protein, 9 aa, Artificial Sequence
  Description of Artificial Sequence: Synthetic peptide
  Seed: SLHNLAHLF (TYRP1_HUMAN)
SLHNLAHLI

SEQ ID NO: 176325 - protein, 9 aa, Artificial Sequence
  Description of Artificial Sequence: Synthetic peptide
  Seed: MAKRTTHPL (TYRP1_HUMAN)
MVKRTTHPV

SEQ ID NO: 176326 - protein, 9 aa, Artificial Sequence
  Description of Artificial Sequence: Synthetic peptide
  Seed: VARPMVQRL (TYRP1_HUMAN)
VPRPMVQRF

SEQ ID NO: 176327 - protein, 10 aa, Artificial Sequence
  Description of Artificial Sequence: Synthetic peptide
  Seed: FYSNSTNSFR (TYRP1_HUMAN)
FESNSTNSFK

SEQ ID NO: 176328 - protein, 11 aa, Artificial Sequence
  Description of Artificial Sequence: Synthetic peptide
  Seed: YNYFVWTHYYS (TYRP1_HUMAN)
YVYFVWTHYYY

SEQ ID NO: 176329 - protein, 10 aa, Artificial Sequence
  Description of Artificial Sequence: Synthetic peptide
  Seed: RRNLLDLSKE (TYRP1_HUMAN)
RRNLLDLSKI

SEQ ID NO: 176330 - protein, 10 aa, Artificial Sequence
  Description of Artificial Sequence: Synthetic peptide
  Seed: ENISIYNYFV (TYRP1_HUMAN)
EDISIYNYFV

SEQ ID NO: 176331 - protein, 9 aa, Artificial Sequence
  Description of Artificial Sequence: Synthetic peptide
  Seed: QRLPEPQDV (TYRP1_HUMAN)
QRLPEPQDL

SEQ ID NO: 176332 - protein, 10 aa, Artificial Sequence
  Description of Artificial Sequence: Synthetic peptide
  Seed: KRTTHPLFVI (TYRP1_HUMAN)
KRTTHPLFVY

SEQ ID NO: 176333 - protein, 9 aa, Artificial Sequence
  Description of Artificial Sequence: Synthetic peptide
  Seed: SMDEANQPL (TYRP1_HUMAN)
SMDEANQPW

SEQ ID NO: 176334 - protein, 10 aa, Artificial Sequence
  Description of Artificial Sequence: Synthetic peptide
  Seed: LSPNDPIFVL (TYRP1_HUMAN)
LAPNDPIFVF

SEQ ID NO: 176335 - protein, 9 aa, Artificial Sequence
  Description of Artificial Sequence: Synthetic peptide
  Seed: FSLPYWNFA (TYRP1_HUMAN)
FILPYWNFL

SEQ ID NO: 176336 - protein, 9 aa, Artificial Sequence
  Description of Artificial Sequence: Synthetic peptide
  Seed: HEGPAFLTW (TYRP1_HUMAN)
HEGPAFLTC

SEQ ID NO: 176337 - protein, 9 aa, Artificial Sequence
  Description of Artificial Sequence: Synthetic peptide
  Seed: LLVALIFGT (TYRP1_HUMAN)
LMVALIFGL

SEQ ID NO: 176338 - protein, 10 aa, Artificial Sequence
  Description of Artificial Sequence: Synthetic peptide
  Seed: LPYWNFATGK (TYRP1_HUMAN)
LWYWNFATGK

SEQ ID NO: 176339 - protein, 9 aa, Artificial Sequence
  Description of Artificial Sequence: Synthetic peptide
  Seed: RYNADISTF (TYRP1_HUMAN)
RSNADISTM

SEQ ID NO: 176340 - protein, 11 aa, Artificial Sequence
  Description of Artificial Sequence: Synthetic peptide
  Seed: HLSPNDPIFVL (TYRP1_HUMAN)
HASPNDPIFVY

SEQ ID NO: 176341 - protein, 11 aa, Artificial Sequence
  Description of Artificial Sequence: Synthetic peptide
  Seed: VCDSLEDYDTL (TYRP1_HUMAN)
VSDSLEDYDTL

SEQ ID NO: 176342 - protein, 10 aa, Artificial Sequence
  Description of Artificial Sequence: Synthetic peptide
  Seed: KRTTHPLFVI (TYRP1_HUMAN)
KRTTHPLFVK

SEQ ID NO: 176343 - protein, 10 aa, Artificial Sequence
  Description of Artificial Sequence: Synthetic peptide
  Seed: YNADISTFPL (TYRP1_HUMAN)
YGADISTFPF

SEQ ID NO: 176344 - protein, 9 aa, Artificial Sequence
  Description of Artificial Sequence: Synthetic peptide
  Seed: ISIYNYFVW (TYRP1_HUMAN)
IAIYNYFVV

SEQ ID NO: 176345 - protein, 10 aa, Artificial Sequence
  Description of Artificial Sequence: Synthetic peptide
  Seed: YNYFVWTHYY (TYRP1_HUMAN)
YSYFVWTHYY

SEQ ID NO: 176346 - protein, 10 aa, Artificial Sequence
  Description of Artificial Sequence: Synthetic peptide
  Seed: FVLLHTFTDA (TYRP1_HUMAN)
FQLLHTFTDA

SEQ ID NO: 176347 - protein, 9 aa, Artificial Sequence
  Description of Artificial Sequence: Synthetic peptide
  Seed: FPLENAPIG (TYRP1_HUMAN)
FVLENAPIY

SEQ ID NO: 176348 - protein, 10 aa, Artificial Sequence
  Description of Artificial Sequence: Synthetic peptide
  Seed: RSMDEANQPL (TYRP1_HUMAN)
RFMDEANQPV

SEQ ID NO: 176349 - protein, 10 aa, Artificial Sequence
  Description of Artificial Sequence: Synthetic peptide
  Seed: FSVPEIIAIA (TYRP1_HUMAN)
FNVPEIIAIV

SEQ ID NO: 176350 - protein, 10 aa, Artificial Sequence
  Description of Artificial Sequence: Synthetic peptide
  Seed: FVLLHTFTDA (TYRP1_HUMAN)
FHLLHTFTDV

SEQ ID NO: 176351 - protein, 9 aa, Artificial Sequence
  Description of Artificial Sequence: Synthetic peptide
  Seed: YLIRARRSM (TYRP1_HUMAN)
YFIRARRSM

SEQ ID NO: 176352 - protein, 10 aa, Artificial Sequence
  Description of Artificial Sequence: Synthetic peptide
  Seed: RSMDEANQPL (TYRP1_HUMAN)
RMMDEANQPY

SEQ ID NO: 176353 - protein, 11 aa, Artificial Sequence
  Description of Artificial Sequence: Synthetic peptide
  Seed: VLLHTFTDAVF (TYRP1_HUMAN)
VMLHTFTDAVY

SEQ ID NO: 176354 - protein, 10 aa, Artificial Sequence
  Description of Artificial Sequence: Synthetic peptide
  Seed: SYLIRARRSM (TYRP1_HUMAN)
SYLIRARRSF

SEQ ID NO: 176355 - protein, 9 aa, Artificial Sequence
  Description of Artificial Sequence: Synthetic peptide
  Seed: RQYNMVPFW (TYRP1_HUMAN)
RQYNMVPFL

SEQ ID NO: 176356 - protein, 11 aa, Artificial Sequence
  Description of Artificial Sequence: Synthetic peptide
  Seed: LVALIFGTASY (TYRP1_HUMAN)
LYALIFGTASY

SEQ ID NO: 176357 - protein, 9 aa, Artificial Sequence
  Description of Artificial Sequence: Synthetic peptide
  Seed: HEGPAFLTW (TYRP1_HUMAN)
HHGPAFLTM

SEQ ID NO: 176358 - protein, 11 aa, Artificial Sequence
  Description of Artificial Sequence: Synthetic peptide
  Seed: YSDPTGKYDPA (TYRP1_HUMAN)
YADPTGKYDPV

SEQ ID NO: 176359 - protein, 9 aa, Artificial Sequence
  Description of Artificial Sequence: Synthetic peptide
  Seed: RGRCEAVTA (TYRP1_HUMAN)
RVRCEAVTM

SEQ ID NO: 176360 - protein, 9 aa, Artificial Sequence
  Description of Artificial Sequence: Synthetic peptide
  Seed: SLGCIFFPL (TYRP1_HUMAN)
SVGCIFFPK

SEQ ID NO: 176361 - protein, 10 aa, Artificial Sequence
  Description of Artificial Sequence: Synthetic peptide
  Seed: YFVWTHYYSV (TYRP1_HUMAN)
YEVWTHYYSV

SEQ ID NO: 176362 - protein, 10 aa, Artificial Sequence
  Description of Artificial Sequence: Synthetic peptide
  Seed: SMDEANQPLL (TYRP1_HUMAN)
SQDEANQPLL

SEQ ID NO: 176363 - protein, 9 aa, Artificial Sequence
  Description of Artificial Sequence: Synthetic peptide
  Seed: RPMVQRLPE (TYRP1_HUMAN)
RPMVQRLPF

SEQ ID NO: 176364 - protein, 9 aa, Artificial Sequence
  Description of Artificial Sequence: Synthetic peptide
  Seed: VWPLRFFNR (TYRP1_HUMAN)
VAPLRFFNR

SEQ ID NO: 176365 - protein, 9 aa, Artificial Sequence
  Description of Artificial Sequence: Synthetic peptide
  Seed: MAKRTTHPL (TYRP1_HUMAN)
MVKRTTHPK

SEQ ID NO: 176366 - protein, 9 aa, Artificial Sequence
  Description of Artificial Sequence: Synthetic peptide
  Seed: AQFPRQCAT (TYRP1_HUMAN)
AKFPRQCAL

SEQ ID NO: 176367 - protein, 10 aa, Artificial Sequence
  Description of Artificial Sequence: Synthetic peptide
  Seed: FWPPVTNTEM (TYRP1_HUMAN)
FSPPVTNTEV

SEQ ID NO: 176368 - protein, 9 aa, Artificial Sequence
  Description of Artificial Sequence: Synthetic peptide
  Seed: IAIAVVGAL (TYRP1_HUMAN)
IYIAVVGAI

SEQ ID NO: 176369 - protein, 9 aa, Artificial Sequence
  Description of Artificial Sequence: Synthetic peptide
  Seed: FLTWHRYHL (TYRP1_HUMAN)
FSTWHRYHY

SEQ ID NO: 176370 - protein, 10 aa, Artificial Sequence
  Description of Artificial Sequence: Synthetic peptide
  Seed: RRNLLDLSKE (TYRP1_HUMAN)
RRNLLDLSKR

SEQ ID NO: 176371 - protein, 10 aa, Artificial Sequence
  Description of Artificial Sequence: Synthetic peptide
  Seed: YNYFVWTHYY (TYRP1_HUMAN)
YYYFVWTHYM

SEQ ID NO: 176372 - protein, 11 aa, Artificial Sequence
  Description of Artificial Sequence: Synthetic peptide
  Seed: VTAPDNLGYTY (TYRP1_HUMAN)
VVAPDNLGYTY

SEQ ID NO: 176373 - protein, 8 aa, Artificial Sequence
  Description of Artificial Sequence: Synthetic peptide
  Seed: FSHEGPAF (TYRP1_HUMAN)
FSHEGPAM

SEQ ID NO: 176374 - protein, 9 aa, Artificial Sequence
  Description of Artificial Sequence: Synthetic peptide
  Seed: FTDAVFDEW (TYRP1_HUMAN)
FADAVFDEI

SEQ ID NO: 176375 - protein, 9 aa, Artificial Sequence
  Description of Artificial Sequence: Synthetic peptide
  Seed: KYDPAVRSL (TYRP1_HUMAN)
KVDPAVRSI

SEQ ID NO: 176376 - protein, 9 aa, Artificial Sequence
  Description of Artificial Sequence: Synthetic peptide
  Seed: ALIFGTASY (TYRP1_HUMAN)
APIFGTASY

SEQ ID NO: 176377 - protein, 10 aa, Artificial Sequence
  Description of Artificial Sequence: Synthetic peptide
  Seed: LLFQQARAQF (TYRP1_HUMAN)
LKFQQARAQF

SEQ ID NO: 176378 - protein, 11 aa, Artificial Sequence
  Description of Artificial Sequence: Synthetic peptide
  Seed: RSMDEANQPLL (TYRP1_HUMAN)
RTMDEANQPLF

SEQ ID NO: 176379 - protein, 10 aa, Artificial Sequence
  Description of Artificial Sequence: Synthetic peptide
  Seed: FSLPYWNFAT (TYRP1_HUMAN)
FALPYWNFAV

SEQ ID NO: 176380 - protein, 11 aa, Artificial Sequence
  Description of Artificial Sequence: Synthetic peptide
  Seed: VALIFGTASYL (TYRP1_HUMAN)
VMLIFGTASYI

SEQ ID NO: 176381 - protein, 11 aa, Artificial Sequence
  Description of Artificial Sequence: Synthetic peptide
  Seed: YNMVPFWPPVT (TYRP1_HUMAN)
YQMVPFWPPVR

SEQ ID NO: 176382 - protein, 8 aa, Artificial Sequence
  Description of Artificial Sequence: Synthetic peptide
  Seed: FSHEGPAF (TYRP1_HUMAN)
FCHEGPAL

SEQ ID NO: 176383 - protein, 9 aa, Artificial Sequence
  Description of Artificial Sequence: Synthetic peptide
  Seed: FVRALDMAK (TYRP1_HUMAN)
FVRALDMAR

SEQ ID NO: 176384 - protein, 9 aa, Artificial Sequence
  Description of Artificial Sequence: Synthetic peptide
  Seed: VRSLHNLAH (TYRP1_HUMAN)
VYSLHNLAM

SEQ ID NO: 176385 - protein, 9 aa, Artificial Sequence
  Description of Artificial Sequence: Synthetic peptide
  Seed: ALIFGTASY (TYRP1_HUMAN)
AWIFGTASL

SEQ ID NO: 176386 - protein, 10 aa, Artificial Sequence
  Description of Artificial Sequence: Synthetic peptide
  Seed: VALIFGTASY (TYRP1_HUMAN)
VDLIFGTASY

SEQ ID NO: 176387 - protein, 10 aa, Artificial Sequence
  Description of Artificial Sequence: Synthetic peptide
  Seed: WPPVTNTEMF (TYRP1_HUMAN)
WCPVTNTEMW

SEQ ID NO: 176388 - protein, 10 aa, Artificial Sequence
  Description of Artificial Sequence: Synthetic peptide
  Seed: RSMDEANQPL (TYRP1_HUMAN)
RKMDEANQPM

SEQ ID NO: 176389 - protein, 9 aa, Artificial Sequence
  Description of Artificial Sequence: Synthetic peptide
  Seed: LVALIFGTA (TYRP1_HUMAN)
LLALIFGTA

SEQ ID NO: 176390 - protein, 10 aa, Artificial Sequence
  Description of Artificial Sequence: Synthetic peptide
  Seed: YNYFVWTHYY (TYRP1_HUMAN)
YQYFVWTHYI

SEQ ID NO: 176391 - protein, 9 aa, Artificial Sequence
  Description of Artificial Sequence: Synthetic peptide
  Seed: LTWHRYHLL (TYRP1_HUMAN)
LIWHRYHLR

SEQ ID NO: 176392 - protein, 11 aa, Artificial Sequence
  Description of Artificial Sequence: Synthetic peptide
  Seed: SLPYWNFATGK (TYRP1_HUMAN)
SIPYWNFATGR

SEQ ID NO: 176393 - protein, 10 aa, Artificial Sequence
  Description of Artificial Sequence: Synthetic peptide
  Seed: GSRSNFDSTL (TYRP1_HUMAN)
GSRSNFDSTK

SEQ ID NO: 176394 - protein, 10 aa, Artificial Sequence
  Description of Artificial Sequence: Synthetic peptide
  Seed: YNYFVWTHYY (TYRP1_HUMAN)
YLYFVWTHYW

SEQ ID NO: 176395 - protein, 10 aa, Artificial Sequence
  Description of Artificial Sequence: Synthetic peptide
  Seed: KRTTHPLFVI (TYRP1_HUMAN)
KGTTHPLFVY

SEQ ID NO: 176396 - protein, 9 aa, Artificial Sequence
  Description of Artificial Sequence: Synthetic peptide
  Seed: NADISTFPL (TYRP1_HUMAN)
NADISTFPY

SEQ ID NO: 176397 - protein, 10 aa, Artificial Sequence
  Description of Artificial Sequence: Synthetic peptide
  Seed: FVWTHYYSVK (TYRP1_HUMAN)
FAWTHYYSVV

SEQ ID NO: 176398 - protein, 9 aa, Artificial Sequence
  Description of Artificial Sequence: Synthetic peptide
  Seed: VTAPDNLGY (TYRP1_HUMAN)
VTAPDNLGM

SEQ ID NO: 176399 - protein, 10 aa, Artificial Sequence
  Description of Artificial Sequence: Synthetic peptide
  Seed: MSAPKLLSLG (TYRP1_HUMAN)
MEAPKLLSLW

SEQ ID NO: 176400 - protein, 9 aa, Artificial Sequence
  Description of Artificial Sequence: Synthetic peptide
  Seed: NMVPFWPPV (TYRP1_HUMAN)
NVVPFWPPA

SEQ ID NO: 176401 - protein, 10 aa, Artificial Sequence
  Description of Artificial Sequence: Synthetic peptide
  Seed: ALIFGTASYL (TYRP1_HUMAN)
AMIFGTASYG

SEQ ID NO: 176402 - protein, 10 aa, Artificial Sequence
  Description of Artificial Sequence: Synthetic peptide
  Seed: RTTHPLFVIA (TYRP1_HUMAN)
RITHPLFVIA

SEQ ID NO: 176403 - protein, 9 aa, Artificial Sequence
  Description of Artificial Sequence: Synthetic peptide
  Seed: RARRSMDEA (TYRP1_HUMAN)
RSRRSMDEV

SEQ ID NO: 176404 - protein, 10 aa, Artificial Sequence
  Description of Artificial Sequence: Synthetic peptide
  Seed: FVLLHTFTDA (TYRP1_HUMAN)
FDLLHTFTDV

SEQ ID NO: 176405 - protein, 10 aa, Artificial Sequence
  Description of Artificial Sequence: Synthetic peptide
  Seed: ATVEALRSGM (TYRP1_HUMAN)
ASVEALRSGF

SEQ ID NO: 176406 - protein, 10 aa, Artificial Sequence
  Description of Artificial Sequence: Synthetic peptide
  Seed: RSLHNLAHLF (TYRP1_HUMAN)
RTLHNLAHLM

SEQ ID NO: 176407 - protein, 11 aa, Artificial Sequence
  Description of Artificial Sequence: Synthetic peptide
  Seed: FPLLLFQQARA (TYRP1_HUMAN)
FQLLLFQQARV

SEQ ID NO: 176408 - protein, 11 aa, Artificial Sequence
  Description of Artificial Sequence: Synthetic peptide
  Seed: SLPYWNFATGK (TYRP1_HUMAN)
SVPYWNFATGK

SEQ ID NO: 176409 - protein, 8 aa, Artificial Sequence
  Description of Artificial Sequence: Synthetic peptide
  Seed: YSNSTNSF (TYRP1_HUMAN)
YFNSTNSF

SEQ ID NO: 176410 - protein, 9 aa, Artificial Sequence
  Description of Artificial Sequence: Synthetic peptide
  Seed: YLIRARRSM (TYRP1_HUMAN)
YTIRARRSI

SEQ ID NO: 176411 - protein, 9 aa, Artificial Sequence
  Description of Artificial Sequence: Synthetic peptide
  Seed: LLLFQQARA (TYRP1_HUMAN)
LLLFQQARV

SEQ ID NO: 176412 - protein, 10 aa, Artificial Sequence
  Description of Artificial Sequence: Synthetic peptide
  Seed: EIIAIAVVGA (TYRP1_HUMAN)
ESIAIAVVGA

SEQ ID NO: 176413 - protein, 9 aa, Artificial Sequence
  Description of Artificial Sequence: Synthetic peptide
  Seed: MAKRTTHPL (TYRP1_HUMAN)
MKKRTTHPF

SEQ ID NO: 176414 - protein, 9 aa, Artificial Sequence
  Description of Artificial Sequence: Synthetic peptide
  Seed: LGYTYEIQW (TYRP1_HUMAN)
LAYTYEIQY

SEQ ID NO: 176415 - protein, 9 aa, Artificial Sequence
  Description of Artificial Sequence: Synthetic peptide
  Seed: SVKKTFLGV (TYRP1_HUMAN)
SAKKTFLGK

SEQ ID NO: 176416 - protein, 11 aa, Artificial Sequence
  Description of Artificial Sequence: Synthetic peptide
  Seed: VRSLHNLAHLF (TYRP1_HUMAN)
VTSLHNLAHLY

SEQ ID NO: 176417 - protein, 9 aa, Artificial Sequence
  Description of Artificial Sequence: Synthetic peptide
  Seed: FYSNSTNSF (TYRP1_HUMAN)
FISNSTNSY

SEQ ID NO: 176418 - protein, 9 aa, Artificial Sequence
  Description of Artificial Sequence: Synthetic peptide
  Seed: FYSNSTNSF (TYRP1_HUMAN)
FQSNSTNSH

SEQ ID NO: 176419 - protein, 9 aa, Artificial Sequence
  Description of Artificial Sequence: Synthetic peptide
  Seed: ACDQRVLIV (TYRP1_HUMAN)
ASDQRVLIL

SEQ ID NO: 176420 - protein, 9 aa, Artificial Sequence
  Description of Artificial Sequence: Synthetic peptide
  Seed: FPLENAPIG (TYRP1_HUMAN)
FQLENAPIY

SEQ ID NO: 176421 - protein, 10 aa, Artificial Sequence
  Description of Artificial Sequence: Synthetic peptide
  Seed: EIIAIAVVGA (TYRP1_HUMAN)
ETIAIAVVGT

SEQ ID NO: 176422 - protein, 9 aa, Artificial Sequence
  Description of Artificial Sequence: Synthetic peptide
  Seed: RYHLLRLEK (TYRP1_HUMAN)
RVHLLRLEV

SEQ ID NO: 176423 - protein, 9 aa, Artificial Sequence
  Description of Artificial Sequence: Synthetic peptide
  Seed: VFDEWLRRY (TYRP1_HUMAN)
VGDEWLRRV

SEQ ID NO: 176424 - protein, 10 aa, Artificial Sequence
  Description of Artificial Sequence: Synthetic peptide
  Seed: KLLSLGCIFF (TYRP1_HUMAN)
KWLSLGCIFF

SEQ ID NO: 176425 - protein, 9 aa, Artificial Sequence
  Description of Artificial Sequence: Synthetic peptide
  Seed: AQCLEVGLF (TYRP1_HUMAN)
AECLEVGLW

SEQ ID NO: 176426 - protein, 10 aa, Artificial Sequence
  Description of Artificial Sequence: Synthetic peptide
  Seed: ISPNSVFSQW (TYRP1_HUMAN)
IMPNSVFSQW

SEQ ID NO: 176427 - protein, 9 aa, Artificial Sequence
  Description of Artificial Sequence: Synthetic peptide
  Seed: FYSNSTNSF (TYRP1_HUMAN)
FASNSTNSI

SEQ ID NO: 176428 - protein, 9 aa, Artificial Sequence
  Description of Artificial Sequence: Synthetic peptide
  Seed: TWHRYHLLR (TYRP1_HUMAN)
TYHRYHLLR

SEQ ID NO: 176429 - protein, 9 aa, Artificial Sequence
  Description of Artificial Sequence: Synthetic peptide
  Seed: YNYFVWTHY (TYRP1_HUMAN)
YGYFVWTHY

SEQ ID NO: 176430 - protein, 9 aa, Artificial Sequence
  Description of Artificial Sequence: Synthetic peptide
  Seed: NFDSTLISP (TYRP1_HUMAN)
NLDSTLISF

SEQ ID NO: 176431 - protein, 9 aa, Artificial Sequence
  Description of Artificial Sequence: Synthetic peptide
  Seed: QEMLQEPSF (TYRP1_HUMAN)
QDMLQEPSL

SEQ ID NO: 176432 - protein, 10 aa, Artificial Sequence
  Description of Artificial Sequence: Synthetic peptide
  Seed: LLHTFTDAVF (TYRP1_HUMAN)
LKHTFTDAVF

SEQ ID NO: 176433 - protein, 9 aa, Artificial Sequence
  Description of Artificial Sequence: Synthetic peptide
  Seed: IAIAVVGAL (TYRP1_HUMAN)
IAIAVVGAF

SEQ ID NO: 176434 - protein, 11 aa, Artificial Sequence
  Description of Artificial Sequence: Synthetic peptide
  Seed: RRYNADISTFP (TYRP1_HUMAN)
RWYNADISTFK

SEQ ID NO: 176435 - protein, 10 aa, Artificial Sequence
  Description of Artificial Sequence: Synthetic peptide
  Seed: LLLVALIFGT (TYRP1_HUMAN)
LGLVALIFGI

SEQ ID NO: 176436 - protein, 9 aa, Artificial Sequence
  Description of Artificial Sequence: Synthetic peptide
  Seed: RPHSPQYPH (TYRP1_HUMAN)
RAHSPQYPM

SEQ ID NO: 176437 - protein, 9 aa, Artificial Sequence
  Description of Artificial Sequence: Synthetic peptide
  Seed: FPRQCATVE (TYRP1_HUMAN)
FARQCATVF

SEQ ID NO: 176438 - protein, 9 aa, Artificial Sequence
  Description of Artificial Sequence: Synthetic peptide
  Seed: MLQEPSFSL (TYRP1_HUMAN)
MRQEPSFSL

SEQ ID NO: 176439 - protein, 10 aa, Artificial Sequence
  Description of Artificial Sequence: Synthetic peptide
  Seed: EMLQEPSFSL (TYRP1_HUMAN)
ELLQEPSFSV

SEQ ID NO: 176440 - protein, 10 aa, Artificial Sequence
  Description of Artificial Sequence: Synthetic peptide
  Seed: STLISPNSVF (TYRP1_HUMAN)
SMLISPNSVF

SEQ ID NO: 176441 - protein, 9 aa, Artificial Sequence
  Description of Artificial Sequence: Synthetic peptide
  Seed: YTYEIQWPS (TYRP1_HUMAN)
YWYEIQWPA

SEQ ID NO: 176442 - protein, 9 aa, Artificial Sequence
  Description of Artificial Sequence: Synthetic peptide
  Seed: FSHEGPAFL (TYRP1_HUMAN)
FMHEGPAFR

SEQ ID NO: 176443 - protein, 11 aa, Artificial Sequence
  Description of Artificial Sequence: Synthetic peptide
  Seed: ILGPDGNTPQF (TYRP1_HUMAN)
IAGPDGNTPQL

SEQ ID NO: 176444 - protein, 9 aa, Artificial Sequence
  Description of Artificial Sequence: Synthetic peptide
  Seed: SKEEKNHFV (TYRP1_HUMAN)
SYEEKNHFM

SEQ ID NO: 176445 - protein, 9 aa, Artificial Sequence
  Description of Artificial Sequence: Synthetic peptide
  Seed: FPLLLFQQA (TYRP1_HUMAN)
FPLLLFQQV

SEQ ID NO: 176446 - protein, 10 aa, Artificial Sequence
  Description of Artificial Sequence: Synthetic peptide
  Seed: RRYNADISTF (TYRP1_HUMAN)
RMYNADISTL

SEQ ID NO: 176447 - protein, 11 aa, Artificial Sequence
  Description of Artificial Sequence: Synthetic peptide
  Seed: FSHEGPAFLTW (TYRP1_HUMAN)
FQHEGPAFLTF

SEQ ID NO: 176448 - protein, 8 aa, Artificial Sequence
  Description of Artificial Sequence: Synthetic peptide
  Seed: ACDQRVLI (TYRP1_HUMAN)
ASDQRVLM

SEQ ID NO: 176449 - protein, 9 aa, Artificial Sequence
  Description of Artificial Sequence: Synthetic peptide
  Seed: SPNSVFSQW (TYRP1_HUMAN)
SMNSVFSQW

SEQ ID NO: 176450 - protein, 9 aa, Artificial Sequence
  Description of Artificial Sequence: Synthetic peptide
  Seed: STNSFRNTV (TYRP1_HUMAN)
SANSFRNTF

SEQ ID NO: 176451 - protein, 9 aa, Artificial Sequence
  Description of Artificial Sequence: Synthetic peptide
  Seed: VGLFDTPPF (TYRP1_HUMAN)
VILFDTPPY

SEQ ID NO: 176452 - protein, 9 aa, Artificial Sequence
  Description of Artificial Sequence: Synthetic peptide
  Seed: RQYNMVPFW (TYRP1_HUMAN)
RTYNMVPFV

SEQ ID NO: 176453 - protein, 9 aa, Artificial Sequence
  Description of Artificial Sequence: Synthetic peptide
  Seed: SPNDPIFVL (TYRP1_HUMAN)
STNDPIFVM

SEQ ID NO: 176454 - protein, 10 aa, Artificial Sequence
  Description of Artificial Sequence: Synthetic peptide
  Seed: ISPNSVFSQW (TYRP1_HUMAN)
IDPNSVFSQW

SEQ ID NO: 176455 - protein, 9 aa, Artificial Sequence
  Description of Artificial Sequence: Synthetic peptide
  Seed: GTASYLIRA (TYRP1_HUMAN)
GQASYLIRL

SEQ ID NO: 176456 - protein, 9 aa, Artificial Sequence
  Description of Artificial Sequence: Synthetic peptide
  Seed: HLSPNDPIF (TYRP1_HUMAN)
HMSPNDPIM

SEQ ID NO: 176457 - protein, 10 aa, Artificial Sequence
  Description of Artificial Sequence: Synthetic peptide
  Seed: KRTTHPLFVI (TYRP1_HUMAN)
KMTTHPLFVY

SEQ ID NO: 176458 - protein, 10 aa, Artificial Sequence
  Description of Artificial Sequence: Synthetic peptide
  Seed: STLISPNSVF (TYRP1_HUMAN)
STLISPNSVW

SEQ ID NO: 176459 - protein, 10 aa, Artificial Sequence
  Description of Artificial Sequence: Synthetic peptide
  Seed: YNYFVWTHYY (TYRP1_HUMAN)
YMYFVWTHYT

SEQ ID NO: 176460 - protein, 10 aa, Artificial Sequence
  Description of Artificial Sequence: Synthetic peptide
  Seed: RRYNADISTF (TYRP1_HUMAN)
RAYNADISTI

SEQ ID NO: 176461 - protein, 9 aa, Artificial Sequence
  Description of Artificial Sequence: Synthetic peptide
  Seed: APDNLGYTY (TYRP1_HUMAN)
AFDNLGYTM

SEQ ID NO: 176462 - protein, 10 aa, Artificial Sequence
  Description of Artificial Sequence: Synthetic peptide
  Seed: MVPFWPPVTN (TYRP1_HUMAN)
MIPFWPPVTF

SEQ ID NO: 176463 - protein, 9 aa, Artificial Sequence
  Description of Artificial Sequence: Synthetic peptide
  Seed: TASYLIRAR (TYRP1_HUMAN)
TVSYLIRAR

SEQ ID NO: 176464 - protein, 10 aa, Artificial Sequence
  Description of Artificial Sequence: Synthetic peptide
  Seed: LSLGCIFFPL (TYRP1_HUMAN)
LDLGCIFFPV

SEQ ID NO: 176465 - protein, 10 aa, Artificial Sequence
  Description of Artificial Sequence: Synthetic peptide
  Seed: YNYFVWTHYY (TYRP1_HUMAN)
YYYFVWTHYY

SEQ ID NO: 176466 - protein, 10 aa, Artificial Sequence
  Description of Artificial Sequence: Synthetic peptide
  Seed: LPYWNFATGK (TYRP1_HUMAN)
LYYWNFATGK

SEQ ID NO: 176467 - protein, 11 aa, Artificial Sequence
  Description of Artificial Sequence: Synthetic peptide
  Seed: NTPQFENISIY (TYRP1_HUMAN)
NRPQFENISIY

SEQ ID NO: 176468 - protein, 10 aa, Artificial Sequence
  Description of Artificial Sequence: Synthetic peptide
  Seed: RVVCDSLEDY (TYRP1_HUMAN)
RLVCDSLEDF

SEQ ID NO: 176469 - protein, 9 aa, Artificial Sequence
  Description of Artificial Sequence: Synthetic peptide
  Seed: GLFDTPPFY (TYRP1_HUMAN)
GIFDTPPFR

SEQ ID NO: 176470 - protein, 10 aa, Artificial Sequence
  Description of Artificial Sequence: Synthetic peptide
  Seed: RVLIVRRNLL (TYRP1_HUMAN)
RYLIVRRNLK

SEQ ID NO: 176471 - protein, 9 aa, Artificial Sequence
  Description of Artificial Sequence: Synthetic peptide
  Seed: FTDAVFDEW (TYRP1_HUMAN)
FADAVFDEL

SEQ ID NO: 176472 - protein, 9 aa, Artificial Sequence
  Description of Artificial Sequence: Synthetic peptide
  Seed: WHRYHLLRL (TYRP1_HUMAN)
WKRYHLLRF

SEQ ID NO: 176473 - protein, 9 aa, Artificial Sequence
  Description of Artificial Sequence: Synthetic peptide
  Seed: LFQQARAQF (TYRP1_HUMAN)
LLQQARAQY

SEQ ID NO: 176474 - protein, 10 aa, Artificial Sequence
  Description of Artificial Sequence: Synthetic peptide
  Seed: LSPNDPIFVL (TYRP1_HUMAN)
LMPNDPIFVW

SEQ ID NO: 176475 - protein, 9 aa, Artificial Sequence
  Description of Artificial Sequence: Synthetic peptide
  Seed: RTTHPLFVI (TYRP1_HUMAN)
RITHPLFVV

SEQ ID NO: 176476 - protein, 9 aa, Artificial Sequence
  Description of Artificial Sequence: Synthetic peptide
  Seed: GLFDTPPFY (TYRP1_HUMAN)
GIFDTPPFV

SEQ ID NO: 176477 - protein, 10 aa, Artificial Sequence
  Description of Artificial Sequence: Synthetic peptide
  Seed: SPVSGPGTDR (TYRP1_HUMAN)
SIVSGPGTDK

SEQ ID NO: 176478 - protein, 10 aa, Artificial Sequence
  Description of Artificial Sequence: Synthetic peptide
  Seed: YNMVPFWPPV (TYRP1_HUMAN)
YWMVPFWPPA

SEQ ID NO: 176479 - protein, 9 aa, Artificial Sequence
  Description of Artificial Sequence: Synthetic peptide
  Seed: RFFNRTCHC (TYRP1_HUMAN)
RYFNRTCHV

SEQ ID NO: 176480 - protein, 10 aa, Artificial Sequence
  Description of Artificial Sequence: Synthetic peptide
  Seed: HPLFVIATRR (TYRP1_HUMAN)
HTLFVIATRL

SEQ ID NO: 176481 - protein, 10 aa, Artificial Sequence
  Description of Artificial Sequence: Synthetic peptide
  Seed: TPQFENISIY (TYRP1_HUMAN)
TLQFENISIF

SEQ ID NO: 176482 - protein, 10 aa, Artificial Sequence
  Description of Artificial Sequence: Synthetic peptide
  Seed: FVLLHTFTDA (TYRP1_HUMAN)
FNLLHTFTDI

SEQ ID NO: 176483 - protein, 9 aa, Artificial Sequence
  Description of Artificial Sequence: Synthetic peptide
  Seed: FSHEGPAFL (TYRP1_HUMAN)
FCHEGPAFL

SEQ ID NO: 176484 - protein, 10 aa, Artificial Sequence
  Description of Artificial Sequence: Synthetic peptide
  Seed: FVLLHTFTDA (TYRP1_HUMAN)
FGLLHTFTDV

SEQ ID NO: 176485 - protein, 9 aa, Artificial Sequence
  Description of Artificial Sequence: Synthetic peptide
  Seed: FSHEGPAFL (TYRP1_HUMAN)
FQHEGPAFY

SEQ ID NO: 176486 - protein, 8 aa, Artificial Sequence
  Description of Artificial Sequence: Synthetic peptide
  Seed: MVPFWPPV (TYRP1_HUMAN)
MLPFWPPV

SEQ ID NO: 176487 - protein, 9 aa, Artificial Sequence
  Description of Artificial Sequence: Synthetic peptide
  Seed: RGRCEAVTA (TYRP1_HUMAN)
RSRCEAVTT

SEQ ID NO: 176488 - protein, 9 aa, Artificial Sequence
  Description of Artificial Sequence: Synthetic peptide
  Seed: RPGWRGAAC (TYRP1_HUMAN)
RVGWRGAAL

SEQ ID NO: 176489 - protein, 9 aa, Artificial Sequence
  Description of Artificial Sequence: Synthetic peptide
  Seed: SVPEIIAIA (TYRP1_HUMAN)
SAPEIIAIV

SEQ ID NO: 176490 - protein, 8 aa, Artificial Sequence
  Description of Artificial Sequence: Synthetic peptide
  Seed: YSDPTGKY (TYRP1_HUMAN)
YCDPTGKL

SEQ ID NO: 176491 - protein, 10 aa, Artificial Sequence
  Description of Artificial Sequence: Synthetic peptide
  Seed: MAKRTTHPLF (TYRP1_HUMAN)
MMKRTTHPLF

SEQ ID NO: 176492 - protein, 9 aa, Artificial Sequence
  Description of Artificial Sequence: Synthetic peptide
  Seed: QQARAQFPR (TYRP1_HUMAN)
QVARAQFPK

SEQ ID NO: 176493 - protein, 9 aa, Artificial Sequence
  Description of Artificial Sequence: Synthetic peptide
  Seed: SFRNTVEGY (TYRP1_HUMAN)
SKRNTVEGF

SEQ ID NO: 176494 - protein, 9 aa, Artificial Sequence
  Description of Artificial Sequence: Synthetic peptide
  Seed: FSVPEIIAI (TYRP1_HUMAN)
FMVPEIIAF

SEQ ID NO: 176495 - protein, 9 aa, Artificial Sequence
  Description of Artificial Sequence: Synthetic peptide
  Seed: YNYFVWTHY (TYRP1_HUMAN)
YQYFVWTHL

SEQ ID NO: 176496 - protein, 9 aa, Artificial Sequence
  Description of Artificial Sequence: Synthetic peptide
  Seed: FYSNSTNSF (TYRP1_HUMAN)
FPSNSTNSV

SEQ ID NO: 176497 - protein, 9 aa, Artificial Sequence
  Description of Artificial Sequence: Synthetic peptide
  Seed: SIYNYFVWT (TYRP1_HUMAN)
SIYNYFVWI

SEQ ID NO: 176498 - protein, 10 aa, Artificial Sequence
  Description of Artificial Sequence: Synthetic peptide
  Seed: LSLGCIFFPL (TYRP1_HUMAN)
LHLGCIFFPL

SEQ ID NO: 176499 - protein, 9 aa, Artificial Sequence
  Description of Artificial Sequence: Synthetic peptide
  Seed: ENISIYNYF (TYRP1_HUMAN)
EVISIYNYL

SEQ ID NO: 176500 - protein, 10 aa, Artificial Sequence
  Description of Artificial Sequence: Synthetic peptide
  Seed: NYFVWTHYYS (TYRP1_HUMAN)
NMFVWTHYYY

SEQ ID NO: 176501 - protein, 8 aa, Artificial Sequence
  Description of Artificial Sequence: Synthetic peptide
  Seed: FSHEGPAF (TYRP1_HUMAN)
FWHEGPAY

SEQ ID NO: 176502 - protein, 11 aa, Artificial Sequence
  Description of Artificial Sequence: Synthetic peptide
  Seed: YFVWTHYYSVK (TYRP1_HUMAN)
YFVWTHYYSVR

SEQ ID NO: 176503 - protein, 10 aa, Artificial Sequence
  Description of Artificial Sequence: Synthetic peptide
  Seed: FLTWHRYHLL (TYRP1_HUMAN)
FWTWHRYHLV

SEQ ID NO: 176504 - protein, 9 aa, Artificial Sequence
  Description of Artificial Sequence: Synthetic peptide
  Seed: QCATVEALR (TYRP1_HUMAN)
QSATVEALR

SEQ ID NO: 176505 - protein, 9 aa, Artificial Sequence
  Description of Artificial Sequence: Synthetic peptide
  Seed: RRSEEILGP (TYRP1_HUMAN)
RRSEEILGM

SEQ ID NO: 176506 - protein, 10 aa, Artificial Sequence
  Description of Artificial Sequence: Synthetic peptide
  Seed: LSPNDPIFVL (TYRP1_HUMAN)
LFPNDPIFVM

SEQ ID NO: 176507 - protein, 10 aa, Artificial Sequence
  Description of Artificial Sequence: Synthetic peptide
  Seed: LSPNDPIFVL (TYRP1_HUMAN)
LWPNDPIFVW

SEQ ID NO: 176508 - protein, 9 aa, Artificial Sequence
  Description of Artificial Sequence: Synthetic peptide
  Seed: AVRSLHNLA (TYRP1_HUMAN)
AVRSLHNLV

SEQ ID NO: 176509 - protein, 10 aa, Artificial Sequence
  Description of Artificial Sequence: Synthetic peptide
  Seed: RPMVQRLPEP (TYRP1_HUMAN)
RPMVQRLPEA

SEQ ID NO: 176510 - protein, 9 aa, Artificial Sequence
  Description of Artificial Sequence: Synthetic peptide
  Seed: SREFSVPEI (TYRP1_HUMAN)
SYEFSVPEY

SEQ ID NO: 176511 - protein, 10 aa, Artificial Sequence
  Description of Artificial Sequence: Synthetic peptide
  Seed: STFPLENAPI (TYRP1_HUMAN)
STFPLENAPV

SEQ ID NO: 176512 - protein, 9 aa, Artificial Sequence
  Description of Artificial Sequence: Synthetic peptide
  Seed: GPDGNTPQF (TYRP1_HUMAN)
GSDGNTPQI

SEQ ID NO: 176513 - protein, 9 aa, Artificial Sequence
  Description of Artificial Sequence: Synthetic peptide
  Seed: RYHLLRLEK (TYRP1_HUMAN)
RTHLLRLES

SEQ ID NO: 176514 - protein, 11 aa, Artificial Sequence
  Description of Artificial Sequence: Synthetic peptide
  Seed: REVWPLRFFNR (TYRP1_HUMAN)
RYVWPLRFFNK

SEQ ID NO: 176515 - protein, 9 aa, Artificial Sequence
  Description of Artificial Sequence: Synthetic peptide
  Seed: FSVPEIIAI (TYRP1_HUMAN)
FSVPEIIAV

SEQ ID NO: 176516 - protein, 9 aa, Artificial Sequence
  Description of Artificial Sequence: Synthetic peptide
  Seed: HYYSVKKTF (TYRP1_HUMAN)
HKYSVKKTM

SEQ ID NO: 176517 - protein, 11 aa, Artificial Sequence
  Description of Artificial Sequence: Synthetic peptide
  Seed: YNYFVWTHYYS (TYRP1_HUMAN)
YWYFVWTHYYF

SEQ ID NO: 176518 - protein, 9 aa, Artificial Sequence
  Description of Artificial Sequence: Synthetic peptide
  Seed: YTYEIQWPS (TYRP1_HUMAN)
YSYEIQWPK

SEQ ID NO: 176519 - protein, 8 aa, Artificial Sequence
  Description of Artificial Sequence: Synthetic peptide
  Seed: IQWPSREF (TYRP1_HUMAN)
IAWPSREM

SEQ ID NO: 176520 - protein, 9 aa, Artificial Sequence
  Description of Artificial Sequence: Synthetic peptide
  Seed: GPDGNTPQF (TYRP1_HUMAN)
GTDGNTPQL

SEQ ID NO: 176521 - protein, 10 aa, Artificial Sequence
  Description of Artificial Sequence: Synthetic peptide
  Seed: LLLVALIFGT (TYRP1_HUMAN)
LALVALIFGI

SEQ ID NO: 176522 - protein, 9 aa, Artificial Sequence
  Description of Artificial Sequence: Synthetic peptide
  Seed: TLISPNSVF (TYRP1_HUMAN)
TSISPNSVY

SEQ ID NO: 176523 - protein, 9 aa, Artificial Sequence
  Description of Artificial Sequence: Synthetic peptide
  Seed: DLMGSRSNF (TYRP1_HUMAN)
DAMGSRSNF

SEQ ID NO: 176524 - protein, 10 aa, Artificial Sequence
  Description of Artificial Sequence: Synthetic peptide
  Seed: FYSNSTNSFR (TYRP1_HUMAN)
FISNSTNSFR

SEQ ID NO: 176525 - protein, 11 aa, Artificial Sequence
  Description of Artificial Sequence: Synthetic peptide
  Seed: MLQEPSFSLPY (TYRP1_HUMAN)
MQQEPSFSLPY

SEQ ID NO: 176526 - protein, 8 aa, Artificial Sequence
  Description of Artificial Sequence: Synthetic peptide
  Seed: YSDPTGKY (TYRP1_HUMAN)
YSDPTGKF

SEQ ID NO: 176527 - protein, 10 aa, Artificial Sequence
  Description of Artificial Sequence: Synthetic peptide
  Seed: FWPPVTNTEM (TYRP1_HUMAN)
FYPPVTNTEL

SEQ ID NO: 176528 - protein, 9 aa, Artificial Sequence
  Description of Artificial Sequence: Synthetic peptide
  Seed: SPNSVFSQW (TYRP1_HUMAN)
SINSVFSQY

SEQ ID NO: 176529 - protein, 11 aa, Artificial Sequence
  Description of Artificial Sequence: Synthetic peptide
  Seed: SMDEANQPLLT (TYRP1_HUMAN)
SLDEANQPLLI

SEQ ID NO: 176530 - protein, 10 aa, Artificial Sequence
  Description of Artificial Sequence: Synthetic peptide
  Seed: LIFGTASYLI (TYRP1_HUMAN)
LLFGTASYLF

SEQ ID NO: 176531 - protein, 10 aa, Artificial Sequence
  Description of Artificial Sequence: Synthetic peptide
  Seed: YNMVPFWPPV (TYRP1_HUMAN)
YTMVPFWPPM

SEQ ID NO: 176532 - protein, 10 aa, Artificial Sequence
  Description of Artificial Sequence: Synthetic peptide
  Seed: FSVPEIIAIA (TYRP1_HUMAN)
FWVPEIIAIV

SEQ ID NO: 176533 - protein, 10 aa, Artificial Sequence
  Description of Artificial Sequence: Synthetic peptide
  Seed: EGYSDPTGKY (TYRP1_HUMAN)
EMYSDPTGKK

SEQ ID NO: 176534 - protein, 11 aa, Artificial Sequence
  Description of Artificial Sequence: Synthetic peptide
  Seed: RSMDEANQPLL (TYRP1_HUMAN)
RIMDEANQPLF

SEQ ID NO: 176535 - protein, 9 aa, Artificial Sequence
  Description of Artificial Sequence: Synthetic peptide
  Seed: LLVALIFGT (TYRP1_HUMAN)
LSVALIFGI

SEQ ID NO: 176536 - protein, 11 aa, Artificial Sequence
  Description of Artificial Sequence: Synthetic peptide
  Seed: SLPYWNFATGK (TYRP1_HUMAN)
SWPYWNFATGR

SEQ ID NO: 176537 - protein, 10 aa, Artificial Sequence
  Description of Artificial Sequence: Synthetic peptide
  Seed: DVAQCLEVGL (TYRP1_HUMAN)
DSAQCLEVGV

SEQ ID NO: 176538 - protein, 10 aa, Artificial Sequence
  Description of Artificial Sequence: Synthetic peptide
  Seed: LLHTFTDAVF (TYRP1_HUMAN)
LQHTFTDAVY

SEQ ID NO: 176539 - protein, 10 aa, Artificial Sequence
  Description of Artificial Sequence: Synthetic peptide
  Seed: EGYSDPTGKY (TYRP1_HUMAN)
ELYSDPTGKR

SEQ ID NO: 176540 - protein, 9 aa, Artificial Sequence
  Description of Artificial Sequence: Synthetic peptide
  Seed: FENISIYNY (TYRP1_HUMAN)
FQNISIYNM

SEQ ID NO: 176541 - protein, 10 aa, Artificial Sequence
  Description of Artificial Sequence: Synthetic peptide
  Seed: DAVFDEWLRR (TYRP1_HUMAN)
DCVFDEWLRR

SEQ ID NO: 176542 - protein, 10 aa, Artificial Sequence
  Description of Artificial Sequence: Synthetic peptide
  Seed: YNYFVWTHYY (TYRP1_HUMAN)
YRYFVWTHYR

SEQ ID NO: 176543 - protein, 10 aa, Artificial Sequence
  Description of Artificial Sequence: Synthetic peptide
  Seed: IAIAVVGALL (TYRP1_HUMAN)
ITIAVVGALI

SEQ ID NO: 176544 - protein, 11 aa, Artificial Sequence
  Description of Artificial Sequence: Synthetic peptide
  Seed: LQEPSFSLPYW (TYRP1_HUMAN)
LTEPSFSLPYW

SEQ ID NO: 176545 - protein, 11 aa, Artificial Sequence
  Description of Artificial Sequence: Synthetic peptide
  Seed: YNMVPFWPPVT (TYRP1_HUMAN)
YIMVPFWPPVS

SEQ ID NO: 176546 - protein, 9 aa, Artificial Sequence
  Description of Artificial Sequence: Synthetic peptide
  Seed: SVKKTFLGV (TYRP1_HUMAN)
SVKKTFLGK

SEQ ID NO: 176547 - protein, 9 aa, Artificial Sequence
  Description of Artificial Sequence: Synthetic peptide
  Seed: LVALIFGTA (TYRP1_HUMAN)
LQALIFGTV

SEQ ID NO: 176548 - protein, 9 aa, Artificial Sequence
  Description of Artificial Sequence: Synthetic peptide
  Seed: RQYNMVPFW (TYRP1_HUMAN)
RGYNMVPFF

SEQ ID NO: 176549 - protein, 10 aa, Artificial Sequence
  Description of Artificial Sequence: Synthetic peptide
  Seed: RRYNADISTF (TYRP1_HUMAN)
RIYNADISTL

SEQ ID NO: 176550 - protein, 9 aa, Artificial Sequence
  Description of Artificial Sequence: Synthetic peptide
  Seed: WTHYYSVKK (TYRP1_HUMAN)
WSHYYSVKR

SEQ ID NO: 176551 - protein, 9 aa, Artificial Sequence
  Description of Artificial Sequence: Synthetic peptide
  Seed: HEGPAFLTW (TYRP1_HUMAN)
HMGPAFLTM

SEQ ID NO: 176552 - protein, 9 aa, Artificial Sequence
  Description of Artificial Sequence: Synthetic peptide
  Seed: SFSLPYWNF (TYRP1_HUMAN)
SSSLPYWNY

SEQ ID NO: 176553 - protein, 11 aa, Artificial Sequence
  Description of Artificial Sequence: Synthetic peptide
  Seed: YNMVPFWPPVT (TYRP1_HUMAN)
YIMVPFWPPVH

SEQ ID NO: 176554 - protein, 9 aa, Artificial Sequence
  Description of Artificial Sequence: Synthetic peptide
  Seed: WHRYHLLRL (TYRP1_HUMAN)
WERYHLLRY

SEQ ID NO: 176555 - protein, 10 aa, Artificial Sequence
  Description of Artificial Sequence: Synthetic peptide
  Seed: RSMDEANQPL (TYRP1_HUMAN)
RYMDEANQPI

SEQ ID NO: 176556 - protein, 10 aa, Artificial Sequence
  Description of Artificial Sequence: Synthetic peptide
  Seed: RSMDEANQPL (TYRP1_HUMAN)
REMDEANQPL

SEQ ID NO: 176557 - protein, 9 aa, Artificial Sequence
  Description of Artificial Sequence: Synthetic peptide
  Seed: DQRVLIVRR (TYRP1_HUMAN)
DSRVLIVRR

SEQ ID NO: 176558 - protein, 10 aa, Artificial Sequence
  Description of Artificial Sequence: Synthetic peptide
  Seed: LLLVALIFGT (TYRP1_HUMAN)
LYLVALIFGI

SEQ ID NO: 176559 - protein, 9 aa, Artificial Sequence
  Description of Artificial Sequence: Synthetic peptide
  Seed: MAKRTTHPL (TYRP1_HUMAN)
MYKRTTHPL

SEQ ID NO: 176560 - protein, 8 aa, Artificial Sequence
  Description of Artificial Sequence: Synthetic peptide
  Seed: RQYNMVPF (TYRP1_HUMAN)
RAYNMVPY

SEQ ID NO: 176561 - protein, 10 aa, Artificial Sequence
  Description of Artificial Sequence: Synthetic peptide
  Seed: STLISPNSVF (TYRP1_HUMAN)
SGLISPNSVY

SEQ ID NO: 176562 - protein, 9 aa, Artificial Sequence
  Description of Artificial Sequence: Synthetic peptide
  Seed: LQNPNQSVV (TYRP1_HUMAN)
LNNPNQSVF

SEQ ID NO: 176563 - protein, 10 aa, Artificial Sequence
  Description of Artificial Sequence: Synthetic peptide
  Seed: ALIFGTASYL (TYRP1_HUMAN)
AQIFGTASYP

SEQ ID NO: 176564 - protein, 10 aa, Artificial Sequence
  Description of Artificial Sequence: Synthetic peptide
  Seed: AQFPRQCATV (TYRP1_HUMAN)
AMFPRQCATF

SEQ ID NO: 176565 - protein, 11 aa, Artificial Sequence
  Description of Artificial Sequence: Synthetic peptide
  Seed: IYNYFVWTHYY (TYRP1_HUMAN)
IWNYFVWTHYL

SEQ ID NO: 176566 - protein, 9 aa, Artificial Sequence
  Description of Artificial Sequence: Synthetic peptide
  Seed: MFVTAPDNL (TYRP1_HUMAN)
MYVTAPDNW

SEQ ID NO: 176567 - protein, 10 aa, Artificial Sequence
  Description of Artificial Sequence: Synthetic peptide
  Seed: GLFDTPPFYS (TYRP1_HUMAN)
GIFDTPPFYI

SEQ ID NO: 176568 - protein, 9 aa, Artificial Sequence
  Description of Artificial Sequence: Synthetic peptide
  Seed: HYYSVKKTF (TYRP1_HUMAN)
HVYSVKKTM

SEQ ID NO: 176569 - protein, 9 aa, Artificial Sequence
  Description of Artificial Sequence: Synthetic peptide
  Seed: KRTTHPLFV (TYRP1_HUMAN)
KRTTHPLFY

SEQ ID NO: 176570 - protein, 9 aa, Artificial Sequence
  Description of Artificial Sequence: Synthetic peptide
  Seed: LIFGTASYL (TYRP1_HUMAN)
LIFGTASYK

SEQ ID NO: 176571 - protein, 10 aa, Artificial Sequence
  Description of Artificial Sequence: Synthetic peptide
  Seed: YNMVPFWPPV (TYRP1_HUMAN)
YPMVPFWPPA

SEQ ID NO: 176572 - protein, 9 aa, Artificial Sequence
  Description of Artificial Sequence: Synthetic peptide
  Seed: KYDPAVRSL (TYRP1_HUMAN)
KYDPAVRSY

SEQ ID NO: 176573 - protein, 9 aa, Artificial Sequence
  Description of Artificial Sequence: Synthetic peptide
  Seed: GLFDTPPFY (TYRP1_HUMAN)
GKFDTPPFF

SEQ ID NO: 176574 - protein, 9 aa, Artificial Sequence
  Description of Artificial Sequence: Synthetic peptide
  Seed: MSAPKLLSL (TYRP1_HUMAN)
MAAPKLLSR

SEQ ID NO: 176575 - protein, 9 aa, Artificial Sequence
  Description of Artificial Sequence: Synthetic peptide
  Seed: SLHNLAHLF (TYRP1_HUMAN)
STHNLAHLR

SEQ ID NO: 176576 - protein, 9 aa, Artificial Sequence
  Description of Artificial Sequence: Synthetic peptide
  Seed: SREFSVPEI (TYRP1_HUMAN)
SYEFSVPEL

SEQ ID NO: 176577 - protein, 9 aa, Artificial Sequence
  Description of Artificial Sequence: Synthetic peptide
  Seed: GPAFLTWHR (TYRP1_HUMAN)
GAAFLTWHK

SEQ ID NO: 176578 - protein, 11 aa, Artificial Sequence
  Description of Artificial Sequence: Synthetic peptide
  Seed: SIYNYFVWTHY (TYRP1_HUMAN)
SQYNYFVWTHF

SEQ ID NO: 176579 - protein, 9 aa, Artificial Sequence
  Description of Artificial Sequence: Synthetic peptide
  Seed: AQFPRQCAT (TYRP1_HUMAN)
AMFPRQCAF

SEQ ID NO: 176580 - protein, 9 aa, Artificial Sequence
  Description of Artificial Sequence: Synthetic peptide
  Seed: MSAPKLLSL (TYRP1_HUMAN)
MMAPKLLSF

SEQ ID NO: 176581 - protein, 10 aa, Artificial Sequence
  Description of Artificial Sequence: Synthetic peptide
  Seed: STFPLENAPI (TYRP1_HUMAN)
SSFPLENAPF

SEQ ID NO: 176582 - protein, 9 aa, Artificial Sequence
  Description of Artificial Sequence: Synthetic peptide
  Seed: SRSNFDSTL (TYRP1_HUMAN)
SRSNFDSTF

SEQ ID NO: 176583 - protein, 9 aa, Artificial Sequence
  Description of Artificial Sequence: Synthetic peptide
  Seed: SVKKTFLGV (TYRP1_HUMAN)
SYKKTFLGK

SEQ ID NO: 176584 - protein, 10 aa, Artificial Sequence
  Description of Artificial Sequence: Synthetic peptide
  Seed: DVAQCLEVGL (TYRP1_HUMAN)
DTAQCLEVGK

SEQ ID NO: 176585 - protein, 9 aa, Artificial Sequence
  Description of Artificial Sequence: Synthetic peptide
  Seed: KLQNPNQSV (TYRP1_HUMAN)
KIQNPNQSK

SEQ ID NO: 176586 - protein, 10 aa, Artificial Sequence
  Description of Artificial Sequence: Synthetic peptide
  Seed: RYNADISTFP (TYRP1_HUMAN)
RYNADISTFF

SEQ ID NO: 176587 - protein, 9 aa, Artificial Sequence
  Description of Artificial Sequence: Synthetic peptide
  Seed: FVWTHYYSV (TYRP1_HUMAN)
FAWTHYYSY

SEQ ID NO: 176588 - protein, 9 aa, Artificial Sequence
  Description of Artificial Sequence: Synthetic peptide
  Seed: SRSNFDSTL (TYRP1_HUMAN)
SESNFDSTY

SEQ ID NO: 176589 - protein, 10 aa, Artificial Sequence
  Description of Artificial Sequence: Synthetic peptide
  Seed: YNYFVWTHYY (TYRP1_HUMAN)
YVYFVWTHYV

SEQ ID NO: 176590 - protein, 9 aa, Artificial Sequence
  Description of Artificial Sequence: Synthetic peptide
  Seed: REFSVPEII (TYRP1_HUMAN)
RLFSVPEIW

SEQ ID NO: 176591 - protein, 11 aa, Artificial Sequence
  Description of Artificial Sequence: Synthetic peptide
  Seed: RSMDEANQPLL (TYRP1_HUMAN)
RVMDEANQPLL

SEQ ID NO: 176592 - protein, 11 aa, Artificial Sequence
  Description of Artificial Sequence: Synthetic peptide
  Seed: LRRYNADISTF (TYRP1_HUMAN)
LIRYNADISTF

SEQ ID NO: 176593 - protein, 9 aa, Artificial Sequence
  Description of Artificial Sequence: Synthetic peptide
  Seed: LLHTFTDAV (TYRP1_HUMAN)
LIHTFTDAI

SEQ ID NO: 176594 - protein, 9 aa, Artificial Sequence
  Description of Artificial Sequence: Synthetic peptide
  Seed: QRLPEPQDV (TYRP1_HUMAN)
QHLPEPQDI

SEQ ID NO: 176595 - protein, 11 aa, Artificial Sequence
  Description of Artificial Sequence: Synthetic peptide
  Seed: KTFLGVGQESF (TYRP1_HUMAN)
KVFLGVGQESY

SEQ ID NO: 176596 - protein, 10 aa, Artificial Sequence
  Description of Artificial Sequence: Synthetic peptide
  Seed: THYYSVKKTF (TYRP1_HUMAN)
TYYYSVKKTF

SEQ ID NO: 176597 - protein, 10 aa, Artificial Sequence
  Description of Artificial Sequence: Synthetic peptide
  Seed: MAKRTTHPLF (TYRP1_HUMAN)
MSKRTTHPLM

SEQ ID NO: 176598 - protein, 10 aa, Artificial Sequence
  Description of Artificial Sequence: Synthetic peptide
  Seed: MLQEPSFSLP (TYRP1_HUMAN)
MLQEPSFSLE

SEQ ID NO: 176599 - protein, 9 aa, Artificial Sequence
  Description of Artificial Sequence: Synthetic peptide
  Seed: REFSVPEII (TYRP1_HUMAN)
REFSVPEIS

SEQ ID NO: 176600 - protein, 9 aa, Artificial Sequence
  Description of Artificial Sequence: Synthetic peptide
  Seed: QCYAEEYEK (TYRP1_HUMAN)
QVYAEEYEK

SEQ ID NO: 176601 - protein, 9 aa, Artificial Sequence
  Description of Artificial Sequence: Synthetic peptide
  Seed: RARRSMDEA (TYRP1_HUMAN)
RVRRSMDEM

SEQ ID NO: 176602 - protein, 9 aa, Artificial Sequence
  Description of Artificial Sequence: Synthetic peptide
  Seed: MLQEPSFSL (TYRP1_HUMAN)
MAQEPSFSR

SEQ ID NO: 176603 - protein, 9 aa, Artificial Sequence
  Description of Artificial Sequence: Synthetic peptide
  Seed: FYSNSTNSF (TYRP1_HUMAN)
FFSNSTNSM

SEQ ID NO: 176604 - protein, 11 aa, Artificial Sequence
  Description of Artificial Sequence: Synthetic peptide
  Seed: YNMVPFWPPVT (TYRP1_HUMAN)
YLMVPFWPPVP

SEQ ID NO: 176605 - protein, 10 aa, Artificial Sequence
  Description of Artificial Sequence: Synthetic peptide
  Seed: LGPDGNTPQF (TYRP1_HUMAN)
LWPDGNTPQF

SEQ ID NO: 176606 - protein, 9 aa, Artificial Sequence
  Description of Artificial Sequence: Synthetic peptide
  Seed: RSLHNLAHL (TYRP1_HUMAN)
RALHNLAHW

SEQ ID NO: 176607 - protein, 9 aa, Artificial Sequence
  Description of Artificial Sequence: Synthetic peptide
  Seed: YTYEIQWPS (TYRP1_HUMAN)
YVYEIQWPL

SEQ ID NO: 176608 - protein, 9 aa, Artificial Sequence
  Description of Artificial Sequence: Synthetic peptide
  Seed: VGLFDTPPF (TYRP1_HUMAN)
VMLFDTPPY

SEQ ID NO: 176609 - protein, 9 aa, Artificial Sequence
  Description of Artificial Sequence: Synthetic peptide
  Seed: RSNFDSTLI (TYRP1_HUMAN)
RTNFDSTLL

SEQ ID NO: 176610 - protein, 9 aa, Artificial Sequence
  Description of Artificial Sequence: Synthetic peptide
  Seed: LVALIFGTA (TYRP1_HUMAN)
LLALIFGTV

SEQ ID NO: 176611 - protein, 9 aa, Artificial Sequence
  Description of Artificial Sequence: Synthetic peptide
  Seed: RQYNMVPFW (TYRP1_HUMAN)
RVYNMVPFF

SEQ ID NO: 176612 - protein, 9 aa, Artificial Sequence
  Description of Artificial Sequence: Synthetic peptide
  Seed: NADISTFPL (TYRP1_HUMAN)
NHDISTFPI

SEQ ID NO: 176613 - protein, 10 aa, Artificial Sequence
  Description of Artificial Sequence: Synthetic peptide
  Seed: TDAVFDEWLR (TYRP1_HUMAN)
TEAVFDEWLR

SEQ ID NO: 176614 - protein, 10 aa, Artificial Sequence
  Description of Artificial Sequence: Synthetic peptide
  Seed: HPLFVIATRR (TYRP1_HUMAN)
HTLFVIATRQ

SEQ ID NO: 176615 - protein, 9 aa, Artificial Sequence
  Description of Artificial Sequence: Synthetic peptide
  Seed: YLIRARRSM (TYRP1_HUMAN)
YTIRARRSV

SEQ ID NO: 176616 - protein, 11 aa, Artificial Sequence
  Description of Artificial Sequence: Synthetic peptide
  Seed: LRRYNADISTF (TYRP1_HUMAN)
LVRYNADISTF

SEQ ID NO: 176617 - protein, 10 aa, Artificial Sequence
  Description of Artificial Sequence: Synthetic peptide
  Seed: SLGCIFFPLL (TYRP1_HUMAN)
SLGCIFFPLI

SEQ ID NO: 176618 - protein, 10 aa, Artificial Sequence
  Description of Artificial Sequence: Synthetic peptide
  Seed: KYDPAVRSLH (TYRP1_HUMAN)
KADPAVRSLY

SEQ ID NO: 176619 - protein, 10 aa, Artificial Sequence
  Description of Artificial Sequence: Synthetic peptide
  Seed: FSVPEIIAIA (TYRP1_HUMAN)
FVVPEIIAII

SEQ ID NO: 176620 - protein, 10 aa, Artificial Sequence
  Description of Artificial Sequence: Synthetic peptide
  Seed: ADSRPHSPQY (TYRP1_HUMAN)
AISRPHSPQA

SEQ ID NO: 176621 - protein, 9 aa, Artificial Sequence
  Description of Artificial Sequence: Synthetic peptide
  Seed: FSLPYWNFA (TYRP1_HUMAN)
FQLPYWNFT

SEQ ID NO: 176622 - protein, 8 aa, Artificial Sequence
  Description of Artificial Sequence: Synthetic peptide
  Seed: YSDPTGKY (TYRP1_HUMAN)
YYDPTGKM

SEQ ID NO: 176623 - protein, 11 aa, Artificial Sequence
  Description of Artificial Sequence: Synthetic peptide
  Seed: VTAPDNLGYTY (TYRP1_HUMAN)
VMAPDNLGYTY

SEQ ID NO: 176624 - protein, 9 aa, Artificial Sequence
  Description of Artificial Sequence: Synthetic peptide
  Seed: SMDEANQPL (TYRP1_HUMAN)
STDEANQPF

SEQ ID NO: 176625 - protein, 9 aa, Artificial Sequence
  Description of Artificial Sequence: Synthetic peptide
  Seed: YTYEIQWPS (TYRP1_HUMAN)
YFYEIQWPK

SEQ ID NO: 176626 - protein, 9 aa, Artificial Sequence
  Description of Artificial Sequence: Synthetic peptide
  Seed: RSNFDSTLI (TYRP1_HUMAN)
RANFDSTLF

SEQ ID NO: 176627 - protein, 9 aa, Artificial Sequence
  Description of Artificial Sequence: Synthetic peptide
  Seed: KLLSLGCIF (TYRP1_HUMAN)
KKLSLGCIF

SEQ ID NO: 176628 - protein, 10 aa, Artificial Sequence
  Description of Artificial Sequence: Synthetic peptide
  Seed: TDAVFDEWLR (TYRP1_HUMAN)
TVAVFDEWLK

SEQ ID NO: 176629 - protein, 10 aa, Artificial Sequence
  Description of Artificial Sequence: Synthetic peptide
  Seed: YNMVPFWPPV (TYRP1_HUMAN)
YRMVPFWPPM

SEQ ID NO: 176630 - protein, 9 aa, Artificial Sequence
  Description of Artificial Sequence: Synthetic peptide
  Seed: SPNSVFSQW (TYRP1_HUMAN)
SINSVFSQW

SEQ ID NO: 176631 - protein, 9 aa, Artificial Sequence
  Description of Artificial Sequence: Synthetic peptide
  Seed: AFLTWHRYH (TYRP1_HUMAN)
ASLTWHRYK

SEQ ID NO: 176632 - protein, 10 aa, Artificial Sequence
  Description of Artificial Sequence: Synthetic peptide
  Seed: TFTDAVFDEW (TYRP1_HUMAN)
TMTDAVFDEW

SEQ ID NO: 176633 - protein, 10 aa, Artificial Sequence
  Description of Artificial Sequence: Synthetic peptide
  Seed: FWPPVTNTEM (TYRP1_HUMAN)
FIPPVTNTEY

SEQ ID NO: 176634 - protein, 10 aa, Artificial Sequence
  Description of Artificial Sequence: Synthetic peptide
  Seed: LSLGCIFFPL (TYRP1_HUMAN)
LMLGCIFFPA

SEQ ID NO: 176635 - protein, 9 aa, Artificial Sequence
  Description of Artificial Sequence: Synthetic peptide
  Seed: HPLFVIATR (TYRP1_HUMAN)
HPLFVIATA

SEQ ID NO: 176636 - protein, 9 aa, Artificial Sequence
  Description of Artificial Sequence: Synthetic peptide
  Seed: IAIAVVGAL (TYRP1_HUMAN)
IYIAVVGAL

SEQ ID NO: 176637 - protein, 10 aa, Artificial Sequence
  Description of Artificial Sequence: Synthetic peptide
  Seed: PFYSNSTNSF (TYRP1_HUMAN)
PYYSNSTNSW

SEQ ID NO: 176638 - protein, 10 aa, Artificial Sequence
  Description of Artificial Sequence: Synthetic peptide
  Seed: GKYDPAVRSL (TYRP1_HUMAN)
GQYDPAVRSF

SEQ ID NO: 176639 - protein, 9 aa, Artificial Sequence
  Description of Artificial Sequence: Synthetic peptide
  Seed: FLTWHRYHL (TYRP1_HUMAN)
FTTWHRYHL

SEQ ID NO: 176640 - protein, 9 aa, Artificial Sequence
  Description of Artificial Sequence: Synthetic peptide
  Seed: SPNDPIFVL (TYRP1_HUMAN)
SINDPIFVY

SEQ ID NO: 176641 - protein, 9 aa, Artificial Sequence
  Description of Artificial Sequence: Synthetic peptide
  Seed: SLHNLAHLF (TYRP1_HUMAN)
SLHNLAHLW

SEQ ID NO: 176642 - protein, 10 aa, Artificial Sequence
  Description of Artificial Sequence: Synthetic peptide
  Seed: YNADISTFPL (TYRP1_HUMAN)
YAADISTFPL

SEQ ID NO: 176643 - protein, 9 aa, Artificial Sequence
  Description of Artificial Sequence: Synthetic peptide
  Seed: SLHNLAHLF (TYRP1_HUMAN)
SLHNLAHLR

SEQ ID NO: 176644 - protein, 9 aa, Artificial Sequence
  Description of Artificial Sequence: Synthetic peptide
  Seed: CIFFPLLLF (TYRP1_HUMAN)
CIFFPLLLY

SEQ ID NO: 176645 - protein, 9 aa, Artificial Sequence
  Description of Artificial Sequence: Synthetic peptide
  Seed: FYSNSTNSF (TYRP1_HUMAN)
FGSNSTNSY

SEQ ID NO: 176646 - protein, 9 aa, Artificial Sequence
  Description of Artificial Sequence: Synthetic peptide
  Seed: HYYSVKKTF (TYRP1_HUMAN)
HFYSVKKTY

SEQ ID NO: 176647 - protein, 9 aa, Artificial Sequence
  Description of Artificial Sequence: Synthetic peptide
  Seed: RFFNRTCHC (TYRP1_HUMAN)
RWFNRTCHI

SEQ ID NO: 176648 - protein, 9 aa, Artificial Sequence
  Description of Artificial Sequence: Synthetic peptide
  Seed: KYDPAVRSL (TYRP1_HUMAN)
KVDPAVRSV

SEQ ID NO: 176649 - protein, 9 aa, Artificial Sequence
  Description of Artificial Sequence: Synthetic peptide
  Seed: IAIAVVGAL (TYRP1_HUMAN)
IRIAVVGAM

SEQ ID NO: 176650 - protein, 9 aa, Artificial Sequence
  Description of Artificial Sequence: Synthetic peptide
  Seed: YTYEIQWPS (TYRP1_HUMAN)
YLYEIQWPD

SEQ ID NO: 176651 - protein, 10 aa, Artificial Sequence
  Description of Artificial Sequence: Synthetic peptide
  Seed: NYFVWTHYYS (TYRP1_HUMAN)
NFFVWTHYYE

SEQ ID NO: 176652 - protein, 9 aa, Artificial Sequence
  Description of Artificial Sequence: Synthetic peptide
  Seed: IATRRSEEI (TYRP1_HUMAN)
IATRRSEEW

SEQ ID NO: 176653 - protein, 9 aa, Artificial Sequence
  Description of Artificial Sequence: Synthetic peptide
  Seed: VGLFDTPPF (TYRP1_HUMAN)
VLLFDTPPF

SEQ ID NO: 176654 - protein, 9 aa, Artificial Sequence
  Description of Artificial Sequence: Synthetic peptide
  Seed: IAIAVVGAL (TYRP1_HUMAN)
IMIAVVGAL

SEQ ID NO: 176655 - protein, 11 aa, Artificial Sequence
  Description of Artificial Sequence: Synthetic peptide
  Seed: FWPPVTNTEMF (TYRP1_HUMAN)
FRPPVTNTEMW

SEQ ID NO: 176656 - protein, 10 aa, Artificial Sequence
  Description of Artificial Sequence: Synthetic peptide
  Seed: ISIYNYFVWT (TYRP1_HUMAN)
ISIYNYFVWF

SEQ ID NO: 176657 - protein, 9 aa, Artificial Sequence
  Description of Artificial Sequence: Synthetic peptide
  Seed: VTAPDNLGY (TYRP1_HUMAN)
VQAPDNLGF

SEQ ID NO: 176658 - protein, 10 aa, Artificial Sequence
  Description of Artificial Sequence: Synthetic peptide
  Seed: GMCCPDLSPV (TYRP1_HUMAN)
GLCCPDLSPL

SEQ ID NO: 176659 - protein, 9 aa, Artificial Sequence
  Description of Artificial Sequence: Synthetic peptide
  Seed: LQNPNQSVV (TYRP1_HUMAN)
LENPNQSVI

SEQ ID NO: 176660 - protein, 10 aa, Artificial Sequence
  Description of Artificial Sequence: Synthetic peptide
  Seed: YNADISTFPL (TYRP1_HUMAN)
YFADISTFPM

SEQ ID NO: 176661 - protein, 9 aa, Artificial Sequence
  Description of Artificial Sequence: Synthetic peptide
  Seed: NMVPFWPPV (TYRP1_HUMAN)
NYVPFWPPV

SEQ ID NO: 176662 - protein, 10 aa, Artificial Sequence
  Description of Artificial Sequence: Synthetic peptide
  Seed: FPRQCATVEA (TYRP1_HUMAN)
FARQCATVEF

SEQ ID NO: 176663 - protein, 11 aa, Artificial Sequence
  Description of Artificial Sequence: Synthetic peptide
  Seed: QEMLQEPSFSL (TYRP1_HUMAN)
QVMLQEPSFSV

SEQ ID NO: 176664 - protein, 9 aa, Artificial Sequence
  Description of Artificial Sequence: Synthetic peptide
  Seed: YTYEIQWPS (TYRP1_HUMAN)
YFYEIQWPR

SEQ ID NO: 176665 - protein, 9 aa, Artificial Sequence
  Description of Artificial Sequence: Synthetic peptide
  Seed: LTWHRYHLL (TYRP1_HUMAN)
LSWHRYHLL

SEQ ID NO: 176666 - protein, 10 aa, Artificial Sequence
  Description of Artificial Sequence: Synthetic peptide
  Seed: YNADISTFPL (TYRP1_HUMAN)
YIADISTFPV

SEQ ID NO: 176667 - protein, 10 aa, Artificial Sequence
  Description of Artificial Sequence: Synthetic peptide
  Seed: VLLHTFTDAV (TYRP1_HUMAN)
VYLHTFTDAL

SEQ ID NO: 176668 - protein, 11 aa, Artificial Sequence
  Description of Artificial Sequence: Synthetic peptide
  Seed: YYSVKKTFLGV (TYRP1_HUMAN)
YYSVKKTFLGL

SEQ ID NO: 176669 - protein, 9 aa, Artificial Sequence
  Description of Artificial Sequence: Synthetic peptide
  Seed: FSHEGPAFL (TYRP1_HUMAN)
FVHEGPAFI

SEQ ID NO: 176670 - protein, 9 aa, Artificial Sequence
  Description of Artificial Sequence: Synthetic peptide
  Seed: APKLLSLGC (TYRP1_HUMAN)
APKLLSLGM

SEQ ID NO: 176671 - protein, 10 aa, Artificial Sequence
  Description of Artificial Sequence: Synthetic peptide
  Seed: KRTTHPLFVI (TYRP1_HUMAN)
KTTTHPLFVW

SEQ ID NO: 176672 - protein, 9 aa, Artificial Sequence
  Description of Artificial Sequence: Synthetic peptide
  Seed: KYDPAVRSL (TYRP1_HUMAN)
KEDPAVRSF

SEQ ID NO: 176673 - protein, 9 aa, Artificial Sequence
  Description of Artificial Sequence: Synthetic peptide
  Seed: MAKRTTHPL (TYRP1_HUMAN)
MYKRTTHPI

SEQ ID NO: 176674 - protein, 9 aa, Artificial Sequence
  Description of Artificial Sequence: Synthetic peptide
  Seed: RARRSMDEA (TYRP1_HUMAN)
RFRRSMDEV

SEQ ID NO: 176675 - protein, 9 aa, Artificial Sequence
  Description of Artificial Sequence: Synthetic peptide
  Seed: HEGPAFLTW (TYRP1_HUMAN)
HNGPAFLTW

SEQ ID NO: 176676 - protein, 10 aa, Artificial Sequence
  Description of Artificial Sequence: Synthetic peptide
  Seed: SHEGPAFLTW (TYRP1_HUMAN)
SEEGPAFLTY

SEQ ID NO: 176677 - protein, 10 aa, Artificial Sequence
  Description of Artificial Sequence: Synthetic peptide
  Seed: SLHNLAHLFL (TYRP1_HUMAN)
SMHNLAHLFA

SEQ ID NO: 176678 - protein, 9 aa, Artificial Sequence
  Description of Artificial Sequence: Synthetic peptide
  Seed: SFSLPYWNF (TYRP1_HUMAN)
SWSLPYWNI

SEQ ID NO: 176679 - protein, 9 aa, Artificial Sequence
  Description of Artificial Sequence: Synthetic peptide
  Seed: KYDPAVRSL (TYRP1_HUMAN)
KHDPAVRSF

SEQ ID NO: 176680 - protein, 9 aa, Artificial Sequence
  Description of Artificial Sequence: Synthetic peptide
  Seed: APIGHNRQY (TYRP1_HUMAN)
APIGHNRQW

SEQ ID NO: 176681 - protein, 9 aa, Artificial Sequence
  Description of Artificial Sequence: Synthetic peptide
  Seed: SRSNFDSTL (TYRP1_HUMAN)
SISNFDSTY

SEQ ID NO: 176682 - protein, 9 aa, Artificial Sequence
  Description of Artificial Sequence: Synthetic peptide
  Seed: VGALLLVAL (TYRP1_HUMAN)
VQALLLVAI

SEQ ID NO: 176683 - protein, 10 aa, Artificial Sequence
  Description of Artificial Sequence: Synthetic peptide
  Seed: VGLFDTPPFY (TYRP1_HUMAN)
VELFDTPPFY

SEQ ID NO: 176684 - protein, 10 aa, Artificial Sequence
  Description of Artificial Sequence: Synthetic peptide
  Seed: VALIFGTASY (TYRP1_HUMAN)
VYLIFGTASF

SEQ ID NO: 176685 - protein, 11 aa, Artificial Sequence
  Description of Artificial Sequence: Synthetic peptide
  Seed: VALIFGTASYL (TYRP1_HUMAN)
VLLIFGTASYV

SEQ ID NO: 176686 - protein, 9 aa, Artificial Sequence
  Description of Artificial Sequence: Synthetic peptide
  Seed: NMVPFWPPV (TYRP1_HUMAN)
NKVPFWPPY

SEQ ID NO: 176687 - protein, 9 aa, Artificial Sequence
  Description of Artificial Sequence: Synthetic peptide
  Seed: RQCATVEAL (TYRP1_HUMAN)
RKCATVEAM

SEQ ID NO: 176688 - protein, 10 aa, Artificial Sequence
  Description of Artificial Sequence: Synthetic peptide
  Seed: HPLFVIATRR (TYRP1_HUMAN)
HTLFVIATRT

SEQ ID NO: 176689 - protein, 10 aa, Artificial Sequence
  Description of Artificial Sequence: Synthetic peptide
  Seed: SQWRVVCDSL (TYRP1_HUMAN)
SLWRVVCDSV

SEQ ID NO: 176690 - protein, 9 aa, Artificial Sequence
  Description of Artificial Sequence: Synthetic peptide
  Seed: FPLENAPIG (TYRP1_HUMAN)
FPLENAPIT

SEQ ID NO: 176691 - protein, 9 aa, Artificial Sequence
  Description of Artificial Sequence: Synthetic peptide
  Seed: KLLSLGCIF (TYRP1_HUMAN)
KVLSLGCIF

SEQ ID NO: 176692 - protein, 9 aa, Artificial Sequence
  Description of Artificial Sequence: Synthetic peptide
  Seed: ALIFGTASY (TYRP1_HUMAN)
ALIFGTASL

SEQ ID NO: 176693 - protein, 10 aa, Artificial Sequence
  Description of Artificial Sequence: Synthetic peptide
  Seed: FSLPYWNFAT (TYRP1_HUMAN)
FTLPYWNFAA

SEQ ID NO: 176694 - protein, 9 aa, Artificial Sequence
  Description of Artificial Sequence: Synthetic peptide
  Seed: MLQEPSFSL (TYRP1_HUMAN)
MHQEPSFSA

SEQ ID NO: 176695 - protein, 10 aa, Artificial Sequence
  Description of Artificial Sequence: Synthetic peptide
  Seed: ATVEALRSGM (TYRP1_HUMAN)
AAVEALRSGY

SEQ ID NO: 176696 - protein, 10 aa, Artificial Sequence
  Description of Artificial Sequence: Synthetic peptide
  Seed: YNYFVWTHYY (TYRP1_HUMAN)
YWYFVWTHYF

SEQ ID NO: 176697 - protein, 10 aa, Artificial Sequence
  Description of Artificial Sequence: Synthetic peptide
  Seed: LLHTFTDAVF (TYRP1_HUMAN)
LKHTFTDAVM

SEQ ID NO: 176698 - protein, 8 aa, Artificial Sequence
  Description of Artificial Sequence: Synthetic peptide
  Seed: FSHEGPAF (TYRP1_HUMAN)
FLHEGPAY

SEQ ID NO: 176699 - protein, 10 aa, Artificial Sequence
  Description of Artificial Sequence: Synthetic peptide
  Seed: YTYEIQWPSR (TYRP1_HUMAN)
YYYEIQWPSK

SEQ ID NO: 176700 - protein, 9 aa, Artificial Sequence
  Description of Artificial Sequence: Synthetic peptide
  Seed: ENAPIGHNR (TYRP1_HUMAN)
EIAPIGHNY

SEQ ID NO: 176701 - protein, 9 aa, Artificial Sequence
  Description of Artificial Sequence: Synthetic peptide
  Seed: IYNYFVWTH (TYRP1_HUMAN)
IANYFVWTK

SEQ ID NO: 176702 - protein, 9 aa, Artificial Sequence
  Description of Artificial Sequence: Synthetic peptide
  Seed: QRLPEPQDV (TYRP1_HUMAN)
QRLPEPQDF

SEQ ID NO: 176703 - protein, 10 aa, Artificial Sequence
  Description of Artificial Sequence: Synthetic peptide
  Seed: YNADISTFPL (TYRP1_HUMAN)
YLADISTFPA

SEQ ID NO: 176704 - protein, 11 aa, Artificial Sequence
  Description of Artificial Sequence: Synthetic peptide
  Seed: GYTYEIQWPSR (TYRP1_HUMAN)
GFTYEIQWPSR

SEQ ID NO: 176705 - protein, 9 aa, Artificial Sequence
  Description of Artificial Sequence: Synthetic peptide
  Seed: RQCATVEAL (TYRP1_HUMAN)
RVCATVEAF

SEQ ID NO: 176706 - protein, 10 aa, Artificial Sequence
  Description of Artificial Sequence: Synthetic peptide
  Seed: GKYDPAVRSL (TYRP1_HUMAN)
GRYDPAVRSI

SEQ ID NO: 176707 - protein, 11 aa, Artificial Sequence
  Description of Artificial Sequence: Synthetic peptide
  Seed: RSMDEANQPLL (TYRP1_HUMAN)
RMMDEANQPLF

SEQ ID NO: 176708 - protein, 9 aa, Artificial Sequence
  Description of Artificial Sequence: Synthetic peptide
  Seed: AVVGALLLV (TYRP1_HUMAN)
ASVGALLLY

SEQ ID NO: 176709 - protein, 9 aa, Artificial Sequence
  Description of Artificial Sequence: Synthetic peptide
  Seed: ACDQRVLIV (TYRP1_HUMAN)
ATDQRVLIM

SEQ ID NO: 176710 - protein, 9 aa, Artificial Sequence
  Description of Artificial Sequence: Synthetic peptide
  Seed: SMDEANQPL (TYRP1_HUMAN)
SLDEANQPV

SEQ ID NO: 176711 - protein, 9 aa, Artificial Sequence
  Description of Artificial Sequence: Synthetic peptide
  Seed: AVVGALLLV (TYRP1_HUMAN)
AIVGALLLV

SEQ ID NO: 176712 - protein, 10 aa, Artificial Sequence
  Description of Artificial Sequence: Synthetic peptide
  Seed: ENISIYNYFV (TYRP1_HUMAN)
ETISIYNYFV

SEQ ID NO: 176713 - protein, 9 aa, Artificial Sequence
  Description of Artificial Sequence: Synthetic peptide
  Seed: FLTWHRYHL (TYRP1_HUMAN)
FLTWHRYHI

SEQ ID NO: 176714 - protein, 10 aa, Artificial Sequence
  Description of Artificial Sequence: Synthetic peptide
  Seed: YNADISTFPL (TYRP1_HUMAN)
YPADISTFPV

SEQ ID NO: 176715 - protein, 10 aa, Artificial Sequence
  Description of Artificial Sequence: Synthetic peptide
  Seed: YNADISTFPL (TYRP1_HUMAN)
YLADISTFPG

SEQ ID NO: 176716 - protein, 9 aa, Artificial Sequence
  Description of Artificial Sequence: Synthetic peptide
  Seed: NISIYNYFV (TYRP1_HUMAN)
NQSIYNYFV

SEQ ID NO: 176717 - protein, 9 aa, Artificial Sequence
  Description of Artificial Sequence: Synthetic peptide
  Seed: YSNSTNSFR (TYRP1_HUMAN)
YWNSTNSFR

SEQ ID NO: 176718 - protein, 11 aa, Artificial Sequence
  Description of Artificial Sequence: Synthetic peptide
  Seed: HTFTDAVFDEW (TYRP1_HUMAN)
HPFTDAVFDEW

SEQ ID NO: 176719 - protein, 9 aa, Artificial Sequence
  Description of Artificial Sequence: Synthetic peptide
  Seed: FSHEGPAFL (TYRP1_HUMAN)
FQHEGPAFI

SEQ ID NO: 176720 - protein, 9 aa, Artificial Sequence
  Description of Artificial Sequence: Synthetic peptide
  Seed: HPLFVIATR (TYRP1_HUMAN)
HQLFVIATR

SEQ ID NO: 176721 - protein, 11 aa, Artificial Sequence
  Description of Artificial Sequence: Synthetic peptide
  Seed: RSMDEANQPLL (TYRP1_HUMAN)
RLMDEANQPLV

SEQ ID NO: 176722 - protein, 9 aa, Artificial Sequence
  Description of Artificial Sequence: Synthetic peptide
  Seed: SLHNLAHLF (TYRP1_HUMAN)
SRHNLAHLM

SEQ ID NO: 176723 - protein, 10 aa, Artificial Sequence
  Description of Artificial Sequence: Synthetic peptide
  Seed: RRYNADISTF (TYRP1_HUMAN)
RNYNADISTL

SEQ ID NO: 176724 - protein, 9 aa, Artificial Sequence
  Description of Artificial Sequence: Synthetic peptide
  Seed: LIFGTASYL (TYRP1_HUMAN)
LMFGTASYI

SEQ ID NO: 176725 - protein, 10 aa, Artificial Sequence
  Description of Artificial Sequence: Synthetic peptide
  Seed: LGPDGNTPQF (TYRP1_HUMAN)
LDPDGNTPQW

SEQ ID NO: 176726 - protein, 10 aa, Artificial Sequence
  Description of Artificial Sequence: Synthetic peptide
  Seed: RSMDEANQPL (TYRP1_HUMAN)
RLMDEANQPI

SEQ ID NO: 176727 - protein, 9 aa, Artificial Sequence
  Description of Artificial Sequence: Synthetic peptide
  Seed: YLIRARRSM (TYRP1_HUMAN)
YKIRARRSF

SEQ ID NO: 176728 - protein, 11 aa, Artificial Sequence
  Description of Artificial Sequence: Synthetic peptide
  Seed: YQCYAEEYEKL (TYRP1_HUMAN)
YGCYAEEYEKF

SEQ ID NO: 176729 - protein, 9 aa, Artificial Sequence
  Description of Artificial Sequence: Synthetic peptide
  Seed: NADISTFPL (TYRP1_HUMAN)
NTDISTFPM

SEQ ID NO: 176730 - protein, 9 aa, Artificial Sequence
  Description of Artificial Sequence: Synthetic peptide
  Seed: IYNYFVWTH (TYRP1_HUMAN)
IVNYFVWTK

SEQ ID NO: 176731 - protein, 10 aa, Artificial Sequence
  Description of Artificial Sequence: Synthetic peptide
  Seed: LGPDGNTPQF (TYRP1_HUMAN)
LVPDGNTPQI

SEQ ID NO: 176732 - protein, 9 aa, Artificial Sequence
  Description of Artificial Sequence: Synthetic peptide
  Seed: RSLHNLAHL (TYRP1_HUMAN)
RLLHNLAHA

SEQ ID NO: 176733 - protein, 9 aa, Artificial Sequence
  Description of Artificial Sequence: Synthetic peptide
  Seed: LHNLAHLFL (TYRP1_HUMAN)
LRNLAHLFF

SEQ ID NO: 176734 - protein, 10 aa, Artificial Sequence
  Description of Artificial Sequence: Synthetic peptide
  Seed: RVLIVRRNLL (TYRP1_HUMAN)
RMLIVRRNLK

SEQ ID NO: 176735 - protein, 9 aa, Artificial Sequence
  Description of Artificial Sequence: Synthetic peptide
  Seed: AVFDEWLRR (TYRP1_HUMAN)
ASFDEWLRK

SEQ ID NO: 176736 - protein, 9 aa, Artificial Sequence
  Description of Artificial Sequence: Synthetic peptide
  Seed: IFGTASYLI (TYRP1_HUMAN)
IVGTASYLF

SEQ ID NO: 176737 - protein, 9 aa, Artificial Sequence
  Description of Artificial Sequence: Synthetic peptide
  Seed: RYHLLRLEK (TYRP1_HUMAN)
RYHLLRLEA

SEQ ID NO: 176738 - protein, 11 aa, Artificial Sequence
  Description of Artificial Sequence: Synthetic peptide
  Seed: SLGCIFFPLLL (TYRP1_HUMAN)
SLGCIFFPLLI

SEQ ID NO: 176739 - protein, 9 aa, Artificial Sequence
  Description of Artificial Sequence: Synthetic peptide
  Seed: LTWHRYHLL (TYRP1_HUMAN)
LIWHRYHLW

SEQ ID NO: 176740 - protein, 9 aa, Artificial Sequence
  Description of Artificial Sequence: Synthetic peptide
  Seed: ENISIYNYF (TYRP1_HUMAN)
ETISIYNYM

SEQ ID NO: 176741 - protein, 10 aa, Artificial Sequence
  Description of Artificial Sequence: Synthetic peptide
  Seed: RRYNADISTF (TYRP1_HUMAN)
RDYNADISTW

SEQ ID NO: 176742 - protein, 9 aa, Artificial Sequence
  Description of Artificial Sequence: Synthetic peptide
  Seed: IAVVGALLL (TYRP1_HUMAN)
ISVVGALLM

SEQ ID NO: 176743 - protein, 9 aa, Artificial Sequence
  Description of Artificial Sequence: Synthetic peptide
  Seed: SIYNYFVWT (TYRP1_HUMAN)
SAYNYFVWA

SEQ ID NO: 176744 - protein, 10 aa, Artificial Sequence
  Description of Artificial Sequence: Synthetic peptide
  Seed: FVLLHTFTDA (TYRP1_HUMAN)
FLLLHTFTDI

SEQ ID NO: 176745 - protein, 10 aa, Artificial Sequence
  Description of Artificial Sequence: Synthetic peptide
  Seed: LTWHRYHLLR (TYRP1_HUMAN)
LAWHRYHLLK

SEQ ID NO: 176746 - protein, 10 aa, Artificial Sequence
  Description of Artificial Sequence: Synthetic peptide
  Seed: YNYFVWTHYY (TYRP1_HUMAN)
YMYFVWTHYA

SEQ ID NO: 176747 - protein, 10 aa, Artificial Sequence
  Description of Artificial Sequence: Synthetic peptide
  Seed: MLQEPSFSLP (TYRP1_HUMAN)
MMQEPSFSLK

SEQ ID NO: 176748 - protein, 9 aa, Artificial Sequence
  Description of Artificial Sequence: Synthetic peptide
  Seed: RTTHPLFVI (TYRP1_HUMAN)
RVTHPLFVK

SEQ ID NO: 176749 - protein, 10 aa, Artificial Sequence
  Description of Artificial Sequence: Synthetic peptide
  Seed: FYSNSTNSFR (TYRP1_HUMAN)
FFSNSTNSFF

SEQ ID NO: 176750 - protein, 9 aa, Artificial Sequence
  Description of Artificial Sequence: Synthetic peptide
  Seed: IAIAVVGAL (TYRP1_HUMAN)
IMIAVVGAV

SEQ ID NO: 176751 - protein, 9 aa, Artificial Sequence
  Description of Artificial Sequence: Synthetic peptide
  Seed: FTDAVFDEW (TYRP1_HUMAN)
FLDAVFDEV

SEQ ID NO: 176752 - protein, 10 aa, Artificial Sequence
  Description of Artificial Sequence: Synthetic peptide
  Seed: RSMDEANQPL (TYRP1_HUMAN)
RQMDEANQPM

SEQ ID NO: 176753 - protein, 9 aa, Artificial Sequence
  Description of Artificial Sequence: Synthetic peptide
  Seed: AVVGALLLV (TYRP1_HUMAN)
AAVGALLLF

SEQ ID NO: 176754 - protein, 10 aa, Artificial Sequence
  Description of Artificial Sequence: Synthetic peptide
  Seed: RSMDEANQPL (TYRP1_HUMAN)
RHMDEANQPL

SEQ ID NO: 176755 - protein, 9 aa, Artificial Sequence
  Description of Artificial Sequence: Synthetic peptide
  Seed: YNYFVWTHY (TYRP1_HUMAN)
YTYFVWTHY

SEQ ID NO: 176756 - protein, 9 aa, Artificial Sequence
  Description of Artificial Sequence: Synthetic peptide
  Seed: FLNGTGGQT (TYRP1_HUMAN)
FMNGTGGQV

SEQ ID NO: 176757 - protein, 9 aa, Artificial Sequence
  Description of Artificial Sequence: Synthetic peptide
  Seed: FVWTHYYSV (TYRP1_HUMAN)
FPWTHYYSC

SEQ ID NO: 176758 - protein, 9 aa, Artificial Sequence
  Description of Artificial Sequence: Synthetic peptide
  Seed: SVKKTFLGV (TYRP1_HUMAN)
STKKTFLGM

SEQ ID NO: 176759 - protein, 9 aa, Artificial Sequence
  Description of Artificial Sequence: Synthetic peptide
  Seed: AIAVVGALL (TYRP1_HUMAN)
AVAVVGALL

SEQ ID NO: 176760 - protein, 9 aa, Artificial Sequence
  Description of Artificial Sequence: Synthetic peptide
  Seed: SIYNYFVWT (TYRP1_HUMAN)
SLYNYFVWV

SEQ ID NO: 176761 - protein, 10 aa, Artificial Sequence
  Description of Artificial Sequence: Synthetic peptide
  Seed: FVLLHTFTDA (TYRP1_HUMAN)
FMLLHTFTDI

SEQ ID NO: 176762 - protein, 11 aa, Artificial Sequence
  Description of Artificial Sequence: Synthetic peptide
  Seed: VTAPDNLGYTY (TYRP1_HUMAN)
VPAPDNLGYTY

SEQ ID NO: 176763 - protein, 9 aa, Artificial Sequence
  Description of Artificial Sequence: Synthetic peptide
  Seed: SLHNLAHLF (TYRP1_HUMAN)
SGHNLAHLY

SEQ ID NO: 176764 - protein, 10 aa, Artificial Sequence
  Description of Artificial Sequence: Synthetic peptide
  Seed: FSLPYWNFAT (TYRP1_HUMAN)
FCLPYWNFAM

SEQ ID NO: 176765 - protein, 9 aa, Artificial Sequence
  Description of Artificial Sequence: Synthetic peptide
  Seed: GPIRRNPAG (TYRP1_HUMAN)
GPIRRNPAV

SEQ ID NO: 176766 - protein, 10 aa, Artificial Sequence
  Description of Artificial Sequence: Synthetic peptide
  Seed: KRTTHPLFVI (TYRP1_HUMAN)
KETTHPLFVF

SEQ ID NO: 176767 - protein, 10 aa, Artificial Sequence
  Description of Artificial Sequence: Synthetic peptide
  Seed: YNYFVWTHYY (TYRP1_HUMAN)
YLYFVWTHYI

SEQ ID NO: 176768 - protein, 11 aa, Artificial Sequence
  Description of Artificial Sequence: Synthetic peptide
  Seed: RRSMDEANQPL (TYRP1_HUMAN)
RHSMDEANQPV

SEQ ID NO: 176769 - protein, 10 aa, Artificial Sequence
  Description of Artificial Sequence: Synthetic peptide
  Seed: ALIFGTASYL (TYRP1_HUMAN)
AMIFGTASYV

SEQ ID NO: 176770 - protein, 8 aa, Artificial Sequence
  Description of Artificial Sequence: Synthetic peptide
  Seed: IQWPSREF (TYRP1_HUMAN)
ISWPSREL

SEQ ID NO: 176771 - protein, 9 aa, Artificial Sequence
  Description of Artificial Sequence: Synthetic peptide
  Seed: STLISPNSV (TYRP1_HUMAN)
STLISPNSF

SEQ ID NO: 176772 - protein, 10 aa, Artificial Sequence
  Description of Artificial Sequence: Synthetic peptide
  Seed: EIIAIAVVGA (TYRP1_HUMAN)
EVIAIAVVGL

SEQ ID NO: 176773 - protein, 9 aa, Artificial Sequence
  Description of Artificial Sequence: Synthetic peptide
  Seed: REFSVPEII (TYRP1_HUMAN)
RLFSVPEIL

SEQ ID NO: 176774 - protein, 9 aa, Artificial Sequence
  Description of Artificial Sequence: Synthetic peptide
  Seed: DSLEDYDTL (TYRP1_HUMAN)
DVLEDYDTW

SEQ ID NO: 176775 - protein, 9 aa, Artificial Sequence
  Description of Artificial Sequence: Synthetic peptide
  Seed: IAIAVVGAL (TYRP1_HUMAN)
IHIAVVGAM

SEQ ID NO: 176776 - protein, 10 aa, Artificial Sequence
  Description of Artificial Sequence: Synthetic peptide
  Seed: LLTDQYQCYA (TYRP1_HUMAN)
LMTDQYQCYV

SEQ ID NO: 176777 - protein, 9 aa, Artificial Sequence
  Description of Artificial Sequence: Synthetic peptide
  Seed: IGHNRQYNM (TYRP1_HUMAN)
IAHNRQYNL

SEQ ID NO: 176778 - protein, 11 aa, Artificial Sequence
  Description of Artificial Sequence: Synthetic peptide
  Seed: IYNYFVWTHYY (TYRP1_HUMAN)
IWNYFVWTHYF

SEQ ID NO: 176779 - protein, 9 aa, Artificial Sequence
  Description of Artificial Sequence: Synthetic peptide
  Seed: RYNADISTF (TYRP1_HUMAN)
RNNADISTF

SEQ ID NO: 176780 - protein, 9 aa, Artificial Sequence
  Description of Artificial Sequence: Synthetic peptide
  Seed: YYSVKKTFL (TYRP1_HUMAN)
YYSVKKTFW

SEQ ID NO: 176781 - protein, 8 aa, Artificial Sequence
  Description of Artificial Sequence: Synthetic peptide
  Seed: ACDQRVLI (TYRP1_HUMAN)
ATDQRVLI

SEQ ID NO: 176782 - protein, 9 aa, Artificial Sequence
  Description of Artificial Sequence: Synthetic peptide
  Seed: APDNLGYTY (TYRP1_HUMAN)
AYDNLGYTF

SEQ ID NO: 176783 - protein, 9 aa, Artificial Sequence
  Description of Artificial Sequence: Synthetic peptide
  Seed: FLGVGQESF (TYRP1_HUMAN)
FPGVGQESF

SEQ ID NO: 176784 - protein, 8 aa, Artificial Sequence
  Description of Artificial Sequence: Synthetic peptide
  Seed: REFSVPEI (TYRP1_HUMAN)
REFSVPEC

SEQ ID NO: 176785 - protein, 9 aa, Artificial Sequence
  Description of Artificial Sequence: Synthetic peptide
  Seed: SPNSVFSQW (TYRP1_HUMAN)
SLNSVFSQY

SEQ ID NO: 176786 - protein, 10 aa, Artificial Sequence
  Description of Artificial Sequence: Synthetic peptide
  Seed: ADSRPHSPQY (TYRP1_HUMAN)
ALSRPHSPQK

SEQ ID NO: 176787 - protein, 9 aa, Artificial Sequence
  Description of Artificial Sequence: Synthetic peptide
  Seed: HLSPNDPIF (TYRP1_HUMAN)
HQSPNDPIF

SEQ ID NO: 176788 - protein, 9 aa, Artificial Sequence
  Description of Artificial Sequence: Synthetic peptide
  Seed: DDREVWPLR (TYRP1_HUMAN)
DSREVWPLR

SEQ ID NO: 176789 - protein, 9 aa, Artificial Sequence
  Description of Artificial Sequence: Synthetic peptide
  Seed: FSHEGPAFL (TYRP1_HUMAN)
FSHEGPAFK

SEQ ID NO: 176790 - protein, 11 aa, Artificial Sequence
  Description of Artificial Sequence: Synthetic peptide
  Seed: DICTDDLMGSR (TYRP1_HUMAN)
DTCTDDLMGSK

SEQ ID NO: 176791 - protein, 9 aa, Artificial Sequence
  Description of Artificial Sequence: Synthetic peptide
  Seed: SREFSVPEI (TYRP1_HUMAN)
SHEFSVPEF

SEQ ID NO: 176792 - protein, 11 aa, Artificial Sequence
  Description of Artificial Sequence: Synthetic peptide
  Seed: MLQEPSFSLPY (TYRP1_HUMAN)
MMQEPSFSLPL

SEQ ID NO: 176793 - protein, 9 aa, Artificial Sequence
  Description of Artificial Sequence: Synthetic peptide
  Seed: TADSRPHSP (TYRP1_HUMAN)
TVDSRPHSV

SEQ ID NO: 176794 - protein, 10 aa, Artificial Sequence
  Description of Artificial Sequence: Synthetic peptide
  Seed: RSMDEANQPL (TYRP1_HUMAN)
REMDEANQPV

SEQ ID NO: 176795 - protein, 9 aa, Artificial Sequence
  Description of Artificial Sequence: Synthetic peptide
  Seed: FLTWHRYHL (TYRP1_HUMAN)
FFTWHRYHF

SEQ ID NO: 176796 - protein, 10 aa, Artificial Sequence
  Description of Artificial Sequence: Synthetic peptide
  Seed: FSLPYWNFAT (TYRP1_HUMAN)
FDLPYWNFAI

SEQ ID NO: 176797 - protein, 9 aa, Artificial Sequence
  Description of Artificial Sequence: Synthetic peptide
  Seed: FTDAVFDEW (TYRP1_HUMAN)
FIDAVFDEY

SEQ ID NO: 176798 - protein, 8 aa, Artificial Sequence
  Description of Artificial Sequence: Synthetic peptide
  Seed: YDPAVRSL (TYRP1_HUMAN)
YGPAVRSL

SEQ ID NO: 176799 - protein, 9 aa, Artificial Sequence
  Description of Artificial Sequence: Synthetic peptide
  Seed: FENISIYNY (TYRP1_HUMAN)
FMNISIYNM

SEQ ID NO: 176800 - protein, 9 aa, Artificial Sequence
  Description of Artificial Sequence: Synthetic peptide
  Seed: SLHNLAHLF (TYRP1_HUMAN)
SAHNLAHLW

SEQ ID NO: 176801 - protein, 9 aa, Artificial Sequence
  Description of Artificial Sequence: Synthetic peptide
  Seed: LIFGTASYL (TYRP1_HUMAN)
LYFGTASYV

SEQ ID NO: 176802 - protein, 9 aa, Artificial Sequence
  Description of Artificial Sequence: Synthetic peptide
  Seed: HEGPAFLTW (TYRP1_HUMAN)
HPGPAFLTI

SEQ ID NO: 176803 - protein, 8 aa, Artificial Sequence
  Description of Artificial Sequence: Synthetic peptide
  Seed: IQWPSREF (TYRP1_HUMAN)
IQWPSREL

SEQ ID NO: 176804 - protein, 9 aa, Artificial Sequence
  Description of Artificial Sequence: Synthetic peptide
  Seed: KYDPAVRSL (TYRP1_HUMAN)
KMDPAVRSL

SEQ ID NO: 176805 - protein, 10 aa, Artificial Sequence
  Description of Artificial Sequence: Synthetic peptide
  Seed: QFENISIYNY (TYRP1_HUMAN)
QEENISIYNW

SEQ ID NO: 176806 - protein, 9 aa, Artificial Sequence
  Description of Artificial Sequence: Synthetic peptide
  Seed: FSLPYWNFA (TYRP1_HUMAN)
FSLPYWNFI

SEQ ID NO: 176807 - protein, 9 aa, Artificial Sequence
  Description of Artificial Sequence: Synthetic peptide
  Seed: DDREVWPLR (TYRP1_HUMAN)
DAREVWPLK

SEQ ID NO: 176808 - protein, 9 aa, Artificial Sequence
  Description of Artificial Sequence: Synthetic peptide
  Seed: SVFSQWRVV (TYRP1_HUMAN)
SIFSQWRVK

SEQ ID NO: 176809 - protein, 9 aa, Artificial Sequence
  Description of Artificial Sequence: Synthetic peptide
  Seed: SMDEANQPL (TYRP1_HUMAN)
STDEANQPY

SEQ ID NO: 176810 - protein, 10 aa, Artificial Sequence
  Description of Artificial Sequence: Synthetic peptide
  Seed: FWPPVTNTEM (TYRP1_HUMAN)
FAPPVTNTEM

SEQ ID NO: 176811 - protein, 10 aa, Artificial Sequence
  Description of Artificial Sequence: Synthetic peptide
  Seed: LIFGTASYLI (TYRP1_HUMAN)
LYFGTASYLM

SEQ ID NO: 176812 - protein, 9 aa, Artificial Sequence
  Description of Artificial Sequence: Synthetic peptide
  Seed: NHFVRALDM (TYRP1_HUMAN)
NRFVRALDF

SEQ ID NO: 176813 - protein, 9 aa, Artificial Sequence
  Description of Artificial Sequence: Synthetic peptide
  Seed: RYNADISTF (TYRP1_HUMAN)
RQNADISTY

SEQ ID NO: 176814 - protein, 9 aa, Artificial Sequence
  Description of Artificial Sequence: Synthetic peptide
  Seed: RAQFPRQCA (TYRP1_HUMAN)
RSQFPRQCA

SEQ ID NO: 176815 - protein, 9 aa, Artificial Sequence
  Description of Artificial Sequence: Synthetic peptide
  Seed: RQYNMVPFW (TYRP1_HUMAN)
RIYNMVPFI

SEQ ID NO: 176816 - protein, 9 aa, Artificial Sequence
  Description of Artificial Sequence: Synthetic peptide
  Seed: LFDTPPFYS (TYRP1_HUMAN)
LFDTPPFYF

SEQ ID NO: 176817 - protein, 9 aa, Artificial Sequence
  Description of Artificial Sequence: Synthetic peptide
  Seed: MCCPDLSPV (TYRP1_HUMAN)
MACPDLSPI

SEQ ID NO: 176818 - protein, 10 aa, Artificial Sequence
  Description of Artificial Sequence: Synthetic peptide
  Seed: AFLTWHRYHL (TYRP1_HUMAN)
AYLTWHRYHL

SEQ ID NO: 176819 - protein, 10 aa, Artificial Sequence
  Description of Artificial Sequence: Synthetic peptide
  Seed: LLLVALIFGT (TYRP1_HUMAN)
LWLVALIFGV

SEQ ID NO: 176820 - protein, 9 aa, Artificial Sequence
  Description of Artificial Sequence: Synthetic peptide
  Seed: CYAEEYEKL (TYRP1_HUMAN)
CYAEEYEKF

SEQ ID NO: 176821 - protein, 10 aa, Artificial Sequence
  Description of Artificial Sequence: Synthetic peptide
  Seed: YNMVPFWPPV (TYRP1_HUMAN)
YVMVPFWPPV

SEQ ID NO: 176822 - protein, 9 aa, Artificial Sequence
  Description of Artificial Sequence: Synthetic peptide
  Seed: QFPRQCATV (TYRP1_HUMAN)
QYPRQCATF

SEQ ID NO: 176823 - protein, 9 aa, Artificial Sequence
  Description of Artificial Sequence: Synthetic peptide
  Seed: RFFNRTCHC (TYRP1_HUMAN)
RMFNRTCHF

SEQ ID NO: 176824 - protein, 10 aa, Artificial Sequence
  Description of Artificial Sequence: Synthetic peptide
  Seed: AVRSLHNLAH (TYRP1_HUMAN)
AVRSLHNLAA

SEQ ID NO: 176825 - protein, 9 aa, Artificial Sequence
  Description of Artificial Sequence: Synthetic peptide
  Seed: YTYEIQWPS (TYRP1_HUMAN)
YMYEIQWPG

SEQ ID NO: 176826 - protein, 10 aa, Artificial Sequence
  Description of Artificial Sequence: Synthetic peptide
  Seed: DVAQCLEVGL (TYRP1_HUMAN)
DVAQCLEVGV

SEQ ID NO: 176827 - protein, 10 aa, Artificial Sequence
  Description of Artificial Sequence: Synthetic peptide
  Seed: SVPEIIAIAV (TYRP1_HUMAN)
SLPEIIAIAV

SEQ ID NO: 176828 - protein, 11 aa, Artificial Sequence
  Description of Artificial Sequence: Synthetic peptide
  Seed: FSHEGPAFLTW (TYRP1_HUMAN)
FTHEGPAFLTF

SEQ ID NO: 176829 - protein, 9 aa, Artificial Sequence
  Description of Artificial Sequence: Synthetic peptide
  Seed: YYSVKKTFL (TYRP1_HUMAN)
YYSVKKTFY

SEQ ID NO: 176830 - protein, 8 aa, Artificial Sequence
  Description of Artificial Sequence: Synthetic peptide
  Seed: ACDQRVLI (TYRP1_HUMAN)
AYDQRVLI

SEQ ID NO: 176831 - protein, 8 aa, Artificial Sequence
  Description of Artificial Sequence: Synthetic peptide
  Seed: FSHEGPAF (TYRP1_HUMAN)
FIHEGPAI

SEQ ID NO: 176832 - protein, 10 aa, Artificial Sequence
  Description of Artificial Sequence: Synthetic peptide
  Seed: KRTTHPLFVI (TYRP1_HUMAN)
KWTTHPLFVY

SEQ ID NO: 176833 - protein, 9 aa, Artificial Sequence
  Description of Artificial Sequence: Synthetic peptide
  Seed: SMDEANQPL (TYRP1_HUMAN)
SMDEANQPV

SEQ ID NO: 176834 - protein, 9 aa, Artificial Sequence
  Description of Artificial Sequence: Synthetic peptide
  Seed: YSNSTNSFR (TYRP1_HUMAN)
YFNSTNSFK

SEQ ID NO: 176835 - protein, 9 aa, Artificial Sequence
  Description of Artificial Sequence: Synthetic peptide
  Seed: SMDEANQPL (TYRP1_HUMAN)
SLDEANQPY

SEQ ID NO: 176836 - protein, 9 aa, Artificial Sequence
  Description of Artificial Sequence: Synthetic peptide
  Seed: CYAEEYEKL (TYRP1_HUMAN)
CFAEEYEKF

SEQ ID NO: 176837 - protein, 10 aa, Artificial Sequence
  Description of Artificial Sequence: Synthetic peptide
  Seed: RSMDEANQPL (TYRP1_HUMAN)
RHMDEANQPF

SEQ ID NO: 176838 - protein, 9 aa, Artificial Sequence
  Description of Artificial Sequence: Synthetic peptide
  Seed: PAFLTWHRY (TYRP1_HUMAN)
PMFLTWHRY

SEQ ID NO: 176839 - protein, 10 aa, Artificial Sequence
  Description of Artificial Sequence: Synthetic peptide
  Seed: FPRQCATVEA (TYRP1_HUMAN)
FPRQCATVEY

SEQ ID NO: 176840 - protein, 10 aa, Artificial Sequence
  Description of Artificial Sequence: Synthetic peptide
  Seed: IAVVGALLLV (TYRP1_HUMAN)
IYVVGALLLV

SEQ ID NO: 176841 - protein, 10 aa, Artificial Sequence
  Description of Artificial Sequence: Synthetic peptide
  Seed: KRTTHPLFVI (TYRP1_HUMAN)
KDTTHPLFVW

SEQ ID NO: 176842 - protein, 10 aa, Artificial Sequence
  Description of Artificial Sequence: Synthetic peptide
  Seed: FWPPVTNTEM (TYRP1_HUMAN)
FVPPVTNTEF

SEQ ID NO: 176843 - protein, 10 aa, Artificial Sequence
  Description of Artificial Sequence: Synthetic peptide
  Seed: AQFPRQCATV (TYRP1_HUMAN)
AMFPRQCATI

SEQ ID NO: 176844 - protein, 9 aa, Artificial Sequence
  Description of Artificial Sequence: Synthetic peptide
  Seed: FLGVGQESF (TYRP1_HUMAN)
FIGVGQESL

SEQ ID NO: 176845 - protein, 10 aa, Artificial Sequence
  Description of Artificial Sequence: Synthetic peptide
  Seed: ADSRPHSPQY (TYRP1_HUMAN)
ASSRPHSPQA

SEQ ID NO: 176846 - protein, 9 aa, Artificial Sequence
  Description of Artificial Sequence: Synthetic peptide
  Seed: YTYEIQWPS (TYRP1_HUMAN)
YAYEIQWPV

SEQ ID NO: 176847 - protein, 9 aa, Artificial Sequence
  Description of Artificial Sequence: Synthetic peptide
  Seed: IYNYFVWTH (TYRP1_HUMAN)
IQNYFVWTK

SEQ ID NO: 176848 - protein, 11 aa, Artificial Sequence
  Description of Artificial Sequence: Synthetic peptide
  Seed: HLSPNDPIFVL (TYRP1_HUMAN)
HMSPNDPIFVW

SEQ ID NO: 176849 - protein, 10 aa, Artificial Sequence
  Description of Artificial Sequence: Synthetic peptide
  Seed: FQQARAQFPR (TYRP1_HUMAN)
FTQARAQFPK

SEQ ID NO: 176850 - protein, 9 aa, Artificial Sequence
  Description of Artificial Sequence: Synthetic peptide
  Seed: RPHSPQYPH (TYRP1_HUMAN)
RPHSPQYPV

SEQ ID NO: 176851 - protein, 11 aa, Artificial Sequence
  Description of Artificial Sequence: Synthetic peptide
  Seed: REFSVPEIIAI (TYRP1_HUMAN)
RTFSVPEIIAL

SEQ ID NO: 176852 - protein, 11 aa, Artificial Sequence
  Description of Artificial Sequence: Synthetic peptide
  Seed: IYNYFVWTHYY (TYRP1_HUMAN)
IRNYFVWTHYL

SEQ ID NO: 176853 - protein, 9 aa, Artificial Sequence
  Description of Artificial Sequence: Synthetic peptide
  Seed: NRQYNMVPF (TYRP1_HUMAN)
NQQYNMVPM

SEQ ID NO: 176854 - protein, 9 aa, Artificial Sequence
  Description of Artificial Sequence: Synthetic peptide
  Seed: SLHNLAHLF (TYRP1_HUMAN)
SRHNLAHLV

SEQ ID NO: 176855 - protein, 11 aa, Artificial Sequence
  Description of Artificial Sequence: Synthetic peptide
  Seed: RSLHNLAHLFL (TYRP1_HUMAN)
RALHNLAHLFW

SEQ ID NO: 176856 - protein, 10 aa, Artificial Sequence
  Description of Artificial Sequence: Synthetic peptide
  Seed: LSPNDPIFVL (TYRP1_HUMAN)
LDPNDPIFVY

SEQ ID NO: 176857 - protein, 10 aa, Artificial Sequence
  Description of Artificial Sequence: Synthetic peptide
  Seed: YNYFVWTHYY (TYRP1_HUMAN)
YYYFVWTHYR

SEQ ID NO: 176858 - protein, 10 aa, Artificial Sequence
  Description of Artificial Sequence: Synthetic peptide
  Seed: YNYFVWTHYY (TYRP1_HUMAN)
YAYFVWTHYI

SEQ ID NO: 176859 - protein, 9 aa, Artificial Sequence
  Description of Artificial Sequence: Synthetic peptide
  Seed: ACDQRVLIV (TYRP1_HUMAN)
AGDQRVLIF

SEQ ID NO: 176860 - protein, 11 aa, Artificial Sequence
  Description of Artificial Sequence: Synthetic peptide
  Seed: MLQEPSFSLPY (TYRP1_HUMAN)
MLQEPSFSLPI

SEQ ID NO: 176861 - protein, 11 aa, Artificial Sequence
  Description of Artificial Sequence: Synthetic peptide
  Seed: YNMVPFWPPVT (TYRP1_HUMAN)
YMMVPFWPPVN

SEQ ID NO: 176862 - protein, 9 aa, Artificial Sequence
  Description of Artificial Sequence: Synthetic peptide
  Seed: FSHEGPAFL (TYRP1_HUMAN)
FLHEGPAFI

SEQ ID NO: 176863 - protein, 9 aa, Artificial Sequence
  Description of Artificial Sequence: Synthetic peptide
  Seed: LIFGTASYL (TYRP1_HUMAN)
LPFGTASYF

SEQ ID NO: 176864 - protein, 9 aa, Artificial Sequence
  Description of Artificial Sequence: Synthetic peptide
  Seed: YLIRARRSM (TYRP1_HUMAN)
YFIRARRSL

SEQ ID NO: 176865 - protein, 10 aa, Artificial Sequence
  Description of Artificial Sequence: Synthetic peptide
  Seed: YNYFVWTHYY (TYRP1_HUMAN)
YAYFVWTHYR

SEQ ID NO: 176866 - protein, 9 aa, Artificial Sequence
  Description of Artificial Sequence: Synthetic peptide
  Seed: FTDAVFDEW (TYRP1_HUMAN)
FIDAVFDEI

SEQ ID NO: 176867 - protein, 10 aa, Artificial Sequence
  Description of Artificial Sequence: Synthetic peptide
  Seed: FVWTHYYSVK (TYRP1_HUMAN)
FIWTHYYSVF

SEQ ID NO: 176868 - protein, 8 aa, Artificial Sequence
  Description of Artificial Sequence: Synthetic peptide
  Seed: HTFTDAVF (TYRP1_HUMAN)
HKFTDAVF

SEQ ID NO: 176869 - protein, 10 aa, Artificial Sequence
  Description of Artificial Sequence: Synthetic peptide
  Seed: YNMVPFWPPV (TYRP1_HUMAN)
YQMVPFWPPT

SEQ ID NO: 176870 - protein, 9 aa, Artificial Sequence
  Description of Artificial Sequence: Synthetic peptide
  Seed: TNTEMFVTA (TYRP1_HUMAN)
TRTEMFVTA

SEQ ID NO: 176871 - protein, 9 aa, Artificial Sequence
  Description of Artificial Sequence: Synthetic peptide
  Seed: LIFGTASYL (TYRP1_HUMAN)
LRFGTASYM

SEQ ID NO: 176872 - protein, 9 aa, Artificial Sequence
  Description of Artificial Sequence: Synthetic peptide
  Seed: GYSDPTGKY (TYRP1_HUMAN)
GASDPTGKF

SEQ ID NO: 176873 - protein, 11 aa, Artificial Sequence
  Description of Artificial Sequence: Synthetic peptide
  Seed: HTFTDAVFDEW (TYRP1_HUMAN)
HSFTDAVFDEW

SEQ ID NO: 176874 - protein, 9 aa, Artificial Sequence
  Description of Artificial Sequence: Synthetic peptide
  Seed: LTWHRYHLL (TYRP1_HUMAN)
LQWHRYHLW

SEQ ID NO: 176875 - protein, 9 aa, Artificial Sequence
  Description of Artificial Sequence: Synthetic peptide
  Seed: TLISPNSVF (TYRP1_HUMAN)
TKISPNSVM

SEQ ID NO: 176876 - protein, 10 aa, Artificial Sequence
  Description of Artificial Sequence: Synthetic peptide
  Seed: LSPNDPIFVL (TYRP1_HUMAN)
LDPNDPIFVM

SEQ ID NO: 176877 - protein, 8 aa, Artificial Sequence
  Description of Artificial Sequence: Synthetic peptide
  Seed: FSHEGPAF (TYRP1_HUMAN)
FAHEGPAL

SEQ ID NO: 176878 - protein, 9 aa, Artificial Sequence
  Description of Artificial Sequence: Synthetic peptide
  Seed: DNLGYTYEI (TYRP1_HUMAN)
DALGYTYEV

SEQ ID NO: 176879 - protein, 10 aa, Artificial Sequence
  Description of Artificial Sequence: Synthetic peptide
  Seed: DAVFDEWLRR (TYRP1_HUMAN)
DTVFDEWLRK

SEQ ID NO: 176880 - protein, 9 aa, Artificial Sequence
  Description of Artificial Sequence: Synthetic peptide
  Seed: PNDPIFVLL (TYRP1_HUMAN)
PADPIFVLL

SEQ ID NO: 176881 - protein, 10 aa, Artificial Sequence
  Description of Artificial Sequence: Synthetic peptide
  Seed: LGPDGNTPQF (TYRP1_HUMAN)
LVPDGNTPQY

SEQ ID NO: 176882 - protein, 11 aa, Artificial Sequence
  Description of Artificial Sequence: Synthetic peptide
  Seed: FPLLLFQQARA (TYRP1_HUMAN)
FPLLLFQQARV

SEQ ID NO: 176883 - protein, 10 aa, Artificial Sequence
  Description of Artificial Sequence: Synthetic peptide
  Seed: WPPVTNTEMF (TYRP1_HUMAN)
WPPVTNTEMW

SEQ ID NO: 176884 - protein, 8 aa, Artificial Sequence
  Description of Artificial Sequence: Synthetic peptide
  Seed: RPGWRGAA (TYRP1_HUMAN)
RPGWRGAI

SEQ ID NO: 176885 - protein, 9 aa, Artificial Sequence
  Description of Artificial Sequence: Synthetic peptide
  Seed: LIFGTASYL (TYRP1_HUMAN)
LTFGTASYY

SEQ ID NO: 176886 - protein, 10 aa, Artificial Sequence
  Description of Artificial Sequence: Synthetic peptide
  Seed: WPPVTNTEMF (TYRP1_HUMAN)
WRPVTNTEMY

SEQ ID NO: 176887 - protein, 9 aa, Artificial Sequence
  Description of Artificial Sequence: Synthetic peptide
  Seed: AQFPRQCAT (TYRP1_HUMAN)
ATFPRQCAF

SEQ ID NO: 176888 - protein, 9 aa, Artificial Sequence
  Description of Artificial Sequence: Synthetic peptide
  Seed: MCCPDLSPV (TYRP1_HUMAN)
MVCPDLSPV

SEQ ID NO: 176889 - protein, 9 aa, Artificial Sequence
  Description of Artificial Sequence: Synthetic peptide
  Seed: VGLFDTPPF (TYRP1_HUMAN)
VQLFDTPPF

SEQ ID NO: 176890 - protein, 9 aa, Artificial Sequence
  Description of Artificial Sequence: Synthetic peptide
  Seed: FVWTHYYSV (TYRP1_HUMAN)
FSWTHYYSI

SEQ ID NO: 176891 - protein, 9 aa, Artificial Sequence
  Description of Artificial Sequence: Synthetic peptide
  Seed: MLQEPSFSL (TYRP1_HUMAN)
MPQEPSFST

SEQ ID NO: 176892 - protein, 9 aa, Artificial Sequence
  Description of Artificial Sequence: Synthetic peptide
  Seed: MSAPKLLSL (TYRP1_HUMAN)
MQAPKLLSL

SEQ ID NO: 176893 - protein, 11 aa, Artificial Sequence
  Description of Artificial Sequence: Synthetic peptide
  Seed: YQCYAEEYEKL (TYRP1_HUMAN)
YRCYAEEYEKF

SEQ ID NO: 176894 - protein, 9 aa, Artificial Sequence
  Description of Artificial Sequence: Synthetic peptide
  Seed: YNYFVWTHY (TYRP1_HUMAN)
YVYFVWTHM

SEQ ID NO: 176895 - protein, 9 aa, Artificial Sequence
  Description of Artificial Sequence: Synthetic peptide
  Seed: RRYNADIST (TYRP1_HUMAN)
RQYNADISI

SEQ ID NO: 176896 - protein, 9 aa, Artificial Sequence
  Description of Artificial Sequence: Synthetic peptide
  Seed: MAKRTTHPL (TYRP1_HUMAN)
MYKRTTHPM

SEQ ID NO: 176897 - protein, 9 aa, Artificial Sequence
  Description of Artificial Sequence: Synthetic peptide
  Seed: LIFGTASYL (TYRP1_HUMAN)
LAFGTASYI

SEQ ID NO: 176898 - protein, 9 aa, Artificial Sequence
  Description of Artificial Sequence: Synthetic peptide
  Seed: RGRCEAVTA (TYRP1_HUMAN)
RVRCEAVTT

SEQ ID NO: 176899 - protein, 9 aa, Artificial Sequence
  Description of Artificial Sequence: Synthetic peptide
  Seed: YTYEIQWPS (TYRP1_HUMAN)
YSYEIQWPC

SEQ ID NO: 176900 - protein, 9 aa, Artificial Sequence
  Description of Artificial Sequence: Synthetic peptide
  Seed: IVRRNLLDL (TYRP1_HUMAN)
IMRRNLLDY

SEQ ID NO: 176901 - protein, 9 aa, Artificial Sequence
  Description of Artificial Sequence: Synthetic peptide
  Seed: GPDGNTPQF (TYRP1_HUMAN)
GSDGNTPQL

SEQ ID NO: 176902 - protein, 11 aa, Artificial Sequence
  Description of Artificial Sequence: Synthetic peptide
  Seed: MSAPKLLSLGC (TYRP1_HUMAN)
MSAPKLLSLGF

SEQ ID NO: 176903 - protein, 10 aa, Artificial Sequence
  Description of Artificial Sequence: Synthetic peptide
  Seed: FVTAPDNLGY (TYRP1_HUMAN)
FWTAPDNLGF

SEQ ID NO: 176904 - protein, 9 aa, Artificial Sequence
  Description of Artificial Sequence: Synthetic peptide
  Seed: LIFGTASYL (TYRP1_HUMAN)
LQFGTASYA

SEQ ID NO: 176905 - protein, 9 aa, Artificial Sequence
  Description of Artificial Sequence: Synthetic peptide
  Seed: NMVPFWPPV (TYRP1_HUMAN)
NMVPFWPPL

SEQ ID NO: 176906 - protein, 10 aa, Artificial Sequence
  Description of Artificial Sequence: Synthetic peptide
  Seed: VLLHTFTDAV (TYRP1_HUMAN)
VELHTFTDAV

SEQ ID NO: 176907 - protein, 10 aa, Artificial Sequence
  Description of Artificial Sequence: Synthetic peptide
  Seed: VGLFDTPPFY (TYRP1_HUMAN)
VPLFDTPPFK

SEQ ID NO: 176908 - protein, 10 aa, Artificial Sequence
  Description of Artificial Sequence: Synthetic peptide
  Seed: ALIFGTASYL (TYRP1_HUMAN)
ALIFGTASYM

SEQ ID NO: 176909 - protein, 11 aa, Artificial Sequence
  Description of Artificial Sequence: Synthetic peptide
  Seed: MLQEPSFSLPY (TYRP1_HUMAN)
MMQEPSFSLPI

SEQ ID NO: 176910 - protein, 9 aa, Artificial Sequence
  Description of Artificial Sequence: Synthetic peptide
  Seed: IIAIAVVGA (TYRP1_HUMAN)
IIAIAVVGI

SEQ ID NO: 176911 - protein, 9 aa, Artificial Sequence
  Description of Artificial Sequence: Synthetic peptide
  Seed: GTASYLIRA (TYRP1_HUMAN)
GMASYLIRV

SEQ ID NO: 176912 - protein, 10 aa, Artificial Sequence
  Description of Artificial Sequence: Synthetic peptide
  Seed: RRNLLDLSKE (TYRP1_HUMAN)
RRNLLDLSKF

SEQ ID NO: 176913 - protein, 9 aa, Artificial Sequence
  Description of Artificial Sequence: Synthetic peptide
  Seed: SRSNFDSTL (TYRP1_HUMAN)
SHSNFDSTA

SEQ ID NO: 176914 - protein, 8 aa, Artificial Sequence
  Description of Artificial Sequence: Synthetic peptide
  Seed: YYSVKKTF (TYRP1_HUMAN)
YYSVKKTM

SEQ ID NO: 176915 - protein, 10 aa, Artificial Sequence
  Description of Artificial Sequence: Synthetic peptide
  Seed: TAPDNLGYTY (TYRP1_HUMAN)
TAPDNLGYTL

SEQ ID NO: 176916 - protein, 9 aa, Artificial Sequence
  Description of Artificial Sequence: Synthetic peptide
  Seed: GALLLVALI (TYRP1_HUMAN)
GLLLLVALL

SEQ ID NO: 176917 - protein, 9 aa, Artificial Sequence
  Description of Artificial Sequence: Synthetic peptide
  Seed: FPLENAPIG (TYRP1_HUMAN)
FILENAPIF

SEQ ID NO: 176918 - protein, 9 aa, Artificial Sequence
  Description of Artificial Sequence: Synthetic peptide
  Seed: NISIYNYFV (TYRP1_HUMAN)
NLSIYNYFI

SEQ ID NO: 176919 - protein, 8 aa, Artificial Sequence
  Description of Artificial Sequence: Synthetic peptide
  Seed: YNADISTF (TYRP1_HUMAN)
YRADISTF

SEQ ID NO: 176920 - protein, 10 aa, Artificial Sequence
  Description of Artificial Sequence: Synthetic peptide
  Seed: MQEMLQEPSF (TYRP1_HUMAN)
MNEMLQEPSW

SEQ ID NO: 176921 - protein, 9 aa, Artificial Sequence
  Description of Artificial Sequence: Synthetic peptide
  Seed: RYHLLRLEK (TYRP1_HUMAN)
RGHLLRLER

SEQ ID NO: 176922 - protein, 9 aa, Artificial Sequence
  Description of Artificial Sequence: Synthetic peptide
  Seed: RFFNRTCHC (TYRP1_HUMAN)
RTFNRTCHS

SEQ ID NO: 176923 - protein, 9 aa, Artificial Sequence
  Description of Artificial Sequence: Synthetic peptide
  Seed: ALIFGTASY (TYRP1_HUMAN)
ANIFGTASF

SEQ ID NO: 176924 - protein, 9 aa, Artificial Sequence
  Description of Artificial Sequence: Synthetic peptide
  Seed: LTWHRYHLL (TYRP1_HUMAN)
LSWHRYHLR

SEQ ID NO: 176925 - protein, 9 aa, Artificial Sequence
  Description of Artificial Sequence: Synthetic peptide
  Seed: FPRQCATVE (TYRP1_HUMAN)
FVRQCATVY

SEQ ID NO: 176926 - protein, 9 aa, Artificial Sequence
  Description of Artificial Sequence: Synthetic peptide
  Seed: RPMVQRLPE (TYRP1_HUMAN)
RIMVQRLPM

SEQ ID NO: 176927 - protein, 10 aa, Artificial Sequence
  Description of Artificial Sequence: Synthetic peptide
  Seed: HFVRALDMAK (TYRP1_HUMAN)
HMVRALDMAK

SEQ ID NO: 176928 - protein, 9 aa, Artificial Sequence
  Description of Artificial Sequence: Synthetic peptide
  Seed: IAIAVVGAL (TYRP1_HUMAN)
IAIAVVGAR

SEQ ID NO: 176929 - protein, 10 aa, Artificial Sequence
  Description of Artificial Sequence: Synthetic peptide
  Seed: TPQFENISIY (TYRP1_HUMAN)
TYQFENISIM

SEQ ID NO: 176930 - protein, 10 aa, Artificial Sequence
  Description of Artificial Sequence: Synthetic peptide
  Seed: YNMVPFWPPV (TYRP1_HUMAN)
YFMVPFWPPV

SEQ ID NO: 176931 - protein, 9 aa, Artificial Sequence
  Description of Artificial Sequence: Synthetic peptide
  Seed: FSVPEIIAI (TYRP1_HUMAN)
FIVPEIIAV

SEQ ID NO: 176932 - protein, 9 aa, Artificial Sequence
  Description of Artificial Sequence: Synthetic peptide
  Seed: FYSNSTNSF (TYRP1_HUMAN)
FCSNSTNSM

SEQ ID NO: 176933 - protein, 9 aa, Artificial Sequence
  Description of Artificial Sequence: Synthetic peptide
  Seed: SGRGRCEAV (TYRP1_HUMAN)
SIRGRCEAM

SEQ ID NO: 176934 - protein, 9 aa, Artificial Sequence
  Description of Artificial Sequence: Synthetic peptide
  Seed: MSAPKLLSL (TYRP1_HUMAN)
MDAPKLLSL

SEQ ID NO: 176935 - protein, 10 aa, Artificial Sequence
  Description of Artificial Sequence: Synthetic peptide
  Seed: KLLSLGCIFF (TYRP1_HUMAN)
KQLSLGCIFW

SEQ ID NO: 176936 - protein, 10 aa, Artificial Sequence
  Description of Artificial Sequence: Synthetic peptide
  Seed: SQWRVVCDSL (TYRP1_HUMAN)
SRWRVVCDSM

SEQ ID NO: 176937 - protein, 9 aa, Artificial Sequence
  Description of Artificial Sequence: Synthetic peptide
  Seed: SIYNYFVWT (TYRP1_HUMAN)
SVYNYFVWL

SEQ ID NO: 176938 - protein, 10 aa, Artificial Sequence
  Description of Artificial Sequence: Synthetic peptide
  Seed: SMDEANQPLL (TYRP1_HUMAN)
SSDEANQPLF

SEQ ID NO: 176939 - protein, 10 aa, Artificial Sequence
  Description of Artificial Sequence: Synthetic peptide
  Seed: AVRSLHNLAH (TYRP1_HUMAN)
AIRSLHNLAK

SEQ ID NO: 176940 - protein, 9 aa, Artificial Sequence
  Description of Artificial Sequence: Synthetic peptide
  Seed: FVWTHYYSV (TYRP1_HUMAN)
FLWTHYYSV

SEQ ID NO: 176941 - protein, 10 aa, Artificial Sequence
  Description of Artificial Sequence: Synthetic peptide
  Seed: VALIFGTASY (TYRP1_HUMAN)
VNLIFGTASY

SEQ ID NO: 176942 - protein, 10 aa, Artificial Sequence
  Description of Artificial Sequence: Synthetic peptide
  Seed: MLQEPSFSLP (TYRP1_HUMAN)
MLQEPSFSLV

SEQ ID NO: 176943 - protein, 9 aa, Artificial Sequence
  Description of Artificial Sequence: Synthetic peptide
  Seed: GPDGNTPQF (TYRP1_HUMAN)
GLDGNTPQM

SEQ ID NO: 176944 - protein, 9 aa, Artificial Sequence
  Description of Artificial Sequence: Synthetic peptide
  Seed: KYDPAVRSL (TYRP1_HUMAN)
KMDPAVRSM

SEQ ID NO: 176945 - protein, 9 aa, Artificial Sequence
  Description of Artificial Sequence: Synthetic peptide
  Seed: MAKRTTHPL (TYRP1_HUMAN)
MYKRTTHPF

SEQ ID NO: 176946 - protein, 9 aa, Artificial Sequence
  Description of Artificial Sequence: Synthetic peptide
  Seed: AVRSLHNLA (TYRP1_HUMAN)
AMRSLHNLY

SEQ ID NO: 176947 - protein, 9 aa, Artificial Sequence
  Description of Artificial Sequence: Synthetic peptide
  Seed: SREFSVPEI (TYRP1_HUMAN)
SHEFSVPEM

SEQ ID NO: 176948 - protein, 9 aa, Artificial Sequence
  Description of Artificial Sequence: Synthetic peptide
  Seed: RSLHNLAHL (TYRP1_HUMAN)
RGLHNLAHK

SEQ ID NO: 176949 - protein, 11 aa, Artificial Sequence
  Description of Artificial Sequence: Synthetic peptide
  Seed: FPRQCATVEAL (TYRP1_HUMAN)
FPRQCATVEAF

SEQ ID NO: 176950 - protein, 9 aa, Artificial Sequence
  Description of Artificial Sequence: Synthetic peptide
  Seed: LVALIFGTA (TYRP1_HUMAN)
LIALIFGTV

SEQ ID NO: 176951 - protein, 9 aa, Artificial Sequence
  Description of Artificial Sequence: Synthetic peptide
  Seed: LQNPNQSVV (TYRP1_HUMAN)
LLNPNQSVF

SEQ ID NO: 176952 - protein, 10 aa, Artificial Sequence
  Description of Artificial Sequence: Synthetic peptide
  Seed: YNYFVWTHYY (TYRP1_HUMAN)
YSYFVWTHYW

SEQ ID NO: 176953 - protein, 10 aa, Artificial Sequence
  Description of Artificial Sequence: Synthetic peptide
  Seed: FSLPYWNFAT (TYRP1_HUMAN)
FPLPYWNFAV

SEQ ID NO: 176954 - protein, 9 aa, Artificial Sequence
  Description of Artificial Sequence: Synthetic peptide
  Seed: LTDQYQCYA (TYRP1_HUMAN)
LIDQYQCYF

SEQ ID NO: 176955 - protein, 9 aa, Artificial Sequence
  Description of Artificial Sequence: Synthetic peptide
  Seed: LGYTYEIQW (TYRP1_HUMAN)
LAYTYEIQW

SEQ ID NO: 176956 - protein, 9 aa, Artificial Sequence
  Description of Artificial Sequence: Synthetic peptide
  Seed: QQARAQFPR (TYRP1_HUMAN)
QTARAQFPK

SEQ ID NO: 176957 - protein, 9 aa, Artificial Sequence
  Description of Artificial Sequence: Synthetic peptide
  Seed: GSRSNFDST (TYRP1_HUMAN)
GTRSNFDSK

SEQ ID NO: 176958 - protein, 9 aa, Artificial Sequence
  Description of Artificial Sequence: Synthetic peptide
  Seed: LPYWNFATG (TYRP1_HUMAN)
LPYWNFATW

SEQ ID NO: 176959 - protein, 9 aa, Artificial Sequence
  Description of Artificial Sequence: Synthetic peptide
  Seed: GYSDPTGKY (TYRP1_HUMAN)
GASDPTGKM

SEQ ID NO: 176960 - protein, 10 aa, Artificial Sequence
  Description of Artificial Sequence: Synthetic peptide
  Seed: DAVFDEWLRR (TYRP1_HUMAN)
DIVFDEWLRK

SEQ ID NO: 176961 - protein, 10 aa, Artificial Sequence
  Description of Artificial Sequence: Synthetic peptide
  Seed: RSMDEANQPL (TYRP1_HUMAN)
RQMDEANQPF

SEQ ID NO: 176962 - protein, 10 aa, Artificial Sequence
  Description of Artificial Sequence: Synthetic peptide
  Seed: LGPDGNTPQF (TYRP1_HUMAN)
LKPDGNTPQW

SEQ ID NO: 176963 - protein, 9 aa, Artificial Sequence
  Description of Artificial Sequence: Synthetic peptide
  Seed: RRNPAGNVA (TYRP1_HUMAN)
RANPAGNVF

SEQ ID NO: 176964 - protein, 9 aa, Artificial Sequence
  Description of Artificial Sequence: Synthetic peptide
  Seed: STLISPNSV (TYRP1_HUMAN)
SSLISPNSW

SEQ ID NO: 176965 - protein, 10 aa, Artificial Sequence
  Description of Artificial Sequence: Synthetic peptide
  Seed: ALIFGTASYL (TYRP1_HUMAN)
ATIFGTASYF

SEQ ID NO: 176966 - protein, 10 aa, Artificial Sequence
  Description of Artificial Sequence: Synthetic peptide
  Seed: NMVPFWPPVT (TYRP1_HUMAN)
NVVPFWPPVV

SEQ ID NO: 176967 - protein, 9 aa, Artificial Sequence
  Description of Artificial Sequence: Synthetic peptide
  Seed: MLQEPSFSL (TYRP1_HUMAN)
MFQEPSFSY

SEQ ID NO: 176968 - protein, 9 aa, Artificial Sequence
  Description of Artificial Sequence: Synthetic peptide
  Seed: SFSLPYWNF (TYRP1_HUMAN)
SYSLPYWNM

SEQ ID NO: 176969 - protein, 9 aa, Artificial Sequence
  Description of Artificial Sequence: Synthetic peptide
  Seed: FLTWHRYHL (TYRP1_HUMAN)
FTTWHRYHF

SEQ ID NO: 176970 - protein, 11 aa, Artificial Sequence
  Description of Artificial Sequence: Synthetic peptide
  Seed: SLPYWNFATGK (TYRP1_HUMAN)
SHPYWNFATGR

SEQ ID NO: 176971 - protein, 9 aa, Artificial Sequence
  Description of Artificial Sequence: Synthetic peptide
  Seed: AIAVVGALL (TYRP1_HUMAN)
APAVVGALY

SEQ ID NO: 176972 - protein, 10 aa, Artificial Sequence
  Description of Artificial Sequence: Synthetic peptide
  Seed: LLHTFTDAVF (TYRP1_HUMAN)
LQHTFTDAVL

SEQ ID NO: 176973 - protein, 9 aa, Artificial Sequence
  Description of Artificial Sequence: Synthetic peptide
  Seed: MSAPKLLSL (TYRP1_HUMAN)
MRAPKLLSF

SEQ ID NO: 176974 - protein, 9 aa, Artificial Sequence
  Description of Artificial Sequence: Synthetic peptide
  Seed: RSLHNLAHL (TYRP1_HUMAN)
RILHNLAHF

SEQ ID NO: 176975 - protein, 9 aa, Artificial Sequence
  Description of Artificial Sequence: Synthetic peptide
  Seed: GTASYLIRA (TYRP1_HUMAN)
GAASYLIRI

SEQ ID NO: 176976 - protein, 10 aa, Artificial Sequence
  Description of Artificial Sequence: Synthetic peptide
  Seed: LSPNDPIFVL (TYRP1_HUMAN)
LCPNDPIFVW

SEQ ID NO: 176977 - protein, 9 aa, Artificial Sequence
  Description of Artificial Sequence: Synthetic peptide
  Seed: NSVFSQWRV (TYRP1_HUMAN)
NAVFSQWRV

SEQ ID NO: 176978 - protein, 9 aa, Artificial Sequence
  Description of Artificial Sequence: Synthetic peptide
  Seed: LIFGTASYL (TYRP1_HUMAN)
LMFGTASYR

SEQ ID NO: 176979 - protein, 9 aa, Artificial Sequence
  Description of Artificial Sequence: Synthetic peptide
  Seed: NRQYNMVPF (TYRP1_HUMAN)
NMQYNMVPF

SEQ ID NO: 176980 - protein, 9 aa, Artificial Sequence
  Description of Artificial Sequence: Synthetic peptide
  Seed: RQYNMVPFW (TYRP1_HUMAN)
RTYNMVPFW

SEQ ID NO: 176981 - protein, 10 aa, Artificial Sequence
  Description of Artificial Sequence: Synthetic peptide
  Seed: LSPNDPIFVL (TYRP1_HUMAN)
LIPNDPIFVY

SEQ ID NO: 176982 - protein, 10 aa, Artificial Sequence
  Description of Artificial Sequence: Synthetic peptide
  Seed: RRYNADISTF (TYRP1_HUMAN)
RCYNADISTF

SEQ ID NO: 176983 - protein, 9 aa, Artificial Sequence
  Description of Artificial Sequence: Synthetic peptide
  Seed: RQCATVEAL (TYRP1_HUMAN)
RSCATVEAV

SEQ ID NO: 176984 - protein, 10 aa, Artificial Sequence
  Description of Artificial Sequence: Synthetic peptide
  Seed: TAPDNLGYTY (TYRP1_HUMAN)
TPPDNLGYTW

SEQ ID NO: 176985 - protein, 8 aa, Artificial Sequence
  Description of Artificial Sequence: Synthetic peptide
  Seed: YDPAVRSL (TYRP1_HUMAN)
YAPAVRSV

SEQ ID NO: 176986 - protein, 11 aa, Artificial Sequence
  Description of Artificial Sequence: Synthetic peptide
  Seed: IYNYFVWTHYY (TYRP1_HUMAN)
IENYFVWTHYY

SEQ ID NO: 176987 - protein, 9 aa, Artificial Sequence
  Description of Artificial Sequence: Synthetic peptide
  Seed: HEGPAFLTW (TYRP1_HUMAN)
HMGPAFLTV

SEQ ID NO: 176988 - protein, 9 aa, Artificial Sequence
  Description of Artificial Sequence: Synthetic peptide
  Seed: MLQEPSFSL (TYRP1_HUMAN)
MIQEPSFSK

SEQ ID NO: 176989 - protein, 9 aa, Artificial Sequence
  Description of Artificial Sequence: Synthetic peptide
  Seed: SMDEANQPL (TYRP1_HUMAN)
SEDEANQPL

SEQ ID NO: 176990 - protein, 10 aa, Artificial Sequence
  Description of Artificial Sequence: Synthetic peptide
  Seed: YFVWTHYYSV (TYRP1_HUMAN)
YKVWTHYYSL

SEQ ID NO: 176991 - protein, 8 aa, Artificial Sequence
  Description of Artificial Sequence: Synthetic peptide
  Seed: RQYNMVPF (TYRP1_HUMAN)
RLYNMVPF

SEQ ID NO: 176992 - protein, 10 aa, Artificial Sequence
  Description of Artificial Sequence: Synthetic peptide
  Seed: ADSRPHSPQY (TYRP1_HUMAN)
ATSRPHSPQY

SEQ ID NO: 176993 - protein, 9 aa, Artificial Sequence
  Description of Artificial Sequence: Synthetic peptide
  Seed: RARRSMDEA (TYRP1_HUMAN)
RTRRSMDEM

SEQ ID NO: 176994 - protein, 11 aa, Artificial Sequence
  Description of Artificial Sequence: Synthetic peptide
  Seed: MLQEPSFSLPY (TYRP1_HUMAN)
MHQEPSFSLPY

SEQ ID NO: 176995 - protein, 10 aa, Artificial Sequence
  Description of Artificial Sequence: Synthetic peptide
  Seed: YNMVPFWPPV (TYRP1_HUMAN)
YTMVPFWPPI

SEQ ID NO: 176996 - protein, 9 aa, Artificial Sequence
  Description of Artificial Sequence: Synthetic peptide
  Seed: SVKKTFLGV (TYRP1_HUMAN)
SPKKTFLGF

SEQ ID NO: 176997 - protein, 10 aa, Artificial Sequence
  Description of Artificial Sequence: Synthetic peptide
  Seed: FSVPEIIAIA (TYRP1_HUMAN)
FLVPEIIAIM

SEQ ID NO: 176998 - protein, 9 aa, Artificial Sequence
  Description of Artificial Sequence: Synthetic peptide
  Seed: RFFNRTCHC (TYRP1_HUMAN)
RWFNRTCHF

SEQ ID NO: 176999 - protein, 9 aa, Artificial Sequence
  Description of Artificial Sequence: Synthetic peptide
  Seed: FSVPEIIAI (TYRP1_HUMAN)
FEVPEIIAY

SEQ ID NO: 177000 - protein, 9 aa, Artificial Sequence
  Description of Artificial Sequence: Synthetic peptide
  Seed: FYSNSTNSF (TYRP1_HUMAN)
FMSNSTNSI

SEQ ID NO: 177001 - protein, 9 aa, Artificial Sequence
  Description of Artificial Sequence: Synthetic peptide
  Seed: LTWHRYHLL (TYRP1_HUMAN)
LVWHRYHLL

SEQ ID NO: 177002 - protein, 10 aa, Artificial Sequence
  Description of Artificial Sequence: Synthetic peptide
  Seed: MVPFWPPVTN (TYRP1_HUMAN)
MPPFWPPVTL

SEQ ID NO: 177003 - protein, 11 aa, Artificial Sequence
  Description of Artificial Sequence: Synthetic peptide
  Seed: LVALIFGTASY (TYRP1_HUMAN)
LLALIFGTASF

SEQ ID NO: 177004 - protein, 9 aa, Artificial Sequence
  Description of Artificial Sequence: Synthetic peptide
  Seed: TWHRYHLLR (TYRP1_HUMAN)
TIHRYHLLK

SEQ ID NO: 177005 - protein, 10 aa, Artificial Sequence
  Description of Artificial Sequence: Synthetic peptide
  Seed: ALIFGTASYL (TYRP1_HUMAN)
AWIFGTASYV

SEQ ID NO: 177006 - protein, 9 aa, Artificial Sequence
  Description of Artificial Sequence: Synthetic peptide
  Seed: LIFGTASYL (TYRP1_HUMAN)
LEFGTASYY

SEQ ID NO: 177007 - protein, 10 aa, Artificial Sequence
  Description of Artificial Sequence: Synthetic peptide
  Seed: TFLGVGQESF (TYRP1_HUMAN)
TYLGVGQESF

SEQ ID NO: 177008 - protein, 11 aa, Artificial Sequence
  Description of Artificial Sequence: Synthetic peptide
  Seed: RSMDEANQPLL (TYRP1_HUMAN)
RYMDEANQPLY

SEQ ID NO: 177009 - protein, 10 aa, Artificial Sequence
  Description of Artificial Sequence: Synthetic peptide
  Seed: FGTASYLIRA (TYRP1_HUMAN)
FLTASYLIRM

SEQ ID NO: 177010 - protein, 9 aa, Artificial Sequence
  Description of Artificial Sequence: Synthetic peptide
  Seed: LIFGTASYL (TYRP1_HUMAN)
LMFGTASYC

SEQ ID NO: 177011 - protein, 9 aa, Artificial Sequence
  Description of Artificial Sequence: Synthetic peptide
  Seed: LIFGTASYL (TYRP1_HUMAN)
LKFGTASYF

SEQ ID NO: 177012 - protein, 9 aa, Artificial Sequence
  Description of Artificial Sequence: Synthetic peptide
  Seed: RTCHCNGNF (TYRP1_HUMAN)
RACHCNGNW

SEQ ID NO: 177013 - protein, 10 aa, Artificial Sequence
  Description of Artificial Sequence: Synthetic peptide
  Seed: NSFRNTVEGY (TYRP1_HUMAN)
NTFRNTVEGK

SEQ ID NO: 177014 - protein, 9 aa, Artificial Sequence
  Description of Artificial Sequence: Synthetic peptide
  Seed: NYFVWTHYY (TYRP1_HUMAN)
NWFVWTHYL

SEQ ID NO: 177015 - protein, 10 aa, Artificial Sequence
  Description of Artificial Sequence: Synthetic peptide
  Seed: LSLGCIFFPL (TYRP1_HUMAN)
LDLGCIFFPL

SEQ ID NO: 177016 - protein, 10 aa, Artificial Sequence
  Description of Artificial Sequence: Synthetic peptide
  Seed: LPYWNFATGK (TYRP1_HUMAN)
LLYWNFATGR

SEQ ID NO: 177017 - protein, 9 aa, Artificial Sequence
  Description of Artificial Sequence: Synthetic peptide
  Seed: AKRTTHPLF (TYRP1_HUMAN)
AARTTHPLY

SEQ ID NO: 177018 - protein, 10 aa, Artificial Sequence
  Description of Artificial Sequence: Synthetic peptide
  Seed: FSVPEIIAIA (TYRP1_HUMAN)
FTVPEIIAII

SEQ ID NO: 177019 - protein, 9 aa, Artificial Sequence
  Description of Artificial Sequence: Synthetic peptide
  Seed: VRSLHNLAH (TYRP1_HUMAN)
VYSLHNLAL

SEQ ID NO: 177020 - protein, 10 aa, Artificial Sequence
  Description of Artificial Sequence: Synthetic peptide
  Seed: YNYFVWTHYY (TYRP1_HUMAN)
YIYFVWTHYM

SEQ ID NO: 177021 - protein, 10 aa, Artificial Sequence
  Description of Artificial Sequence: Synthetic peptide
  Seed: RSMDEANQPL (TYRP1_HUMAN)
RLMDEANQPY

SEQ ID NO: 177022 - protein, 10 aa, Artificial Sequence
  Description of Artificial Sequence: Synthetic peptide
  Seed: RSLHNLAHLF (TYRP1_HUMAN)
RQLHNLAHLF

SEQ ID NO: 177023 - protein, 10 aa, Artificial Sequence
  Description of Artificial Sequence: Synthetic peptide
  Seed: RRYNADISTF (TYRP1_HUMAN)
RSYNADISTL

SEQ ID NO: 177024 - protein, 10 aa, Artificial Sequence
  Description of Artificial Sequence: Synthetic peptide
  Seed: IAIAVVGALL (TYRP1_HUMAN)
IMIAVVGALI

SEQ ID NO: 177025 - protein, 9 aa, Artificial Sequence
  Description of Artificial Sequence: Synthetic peptide
  Seed: NYFVWTHYY (TYRP1_HUMAN)
NYFVWTHYI

SEQ ID NO: 177026 - protein, 11 aa, Artificial Sequence
  Description of Artificial Sequence: Synthetic peptide
  Seed: YNYFVWTHYYS (TYRP1_HUMAN)
YVYFVWTHYYF

SEQ ID NO: 177027 - protein, 9 aa, Artificial Sequence
  Description of Artificial Sequence: Synthetic peptide
  Seed: FLNGTGGQT (TYRP1_HUMAN)
FTNGTGGQV

SEQ ID NO: 177028 - protein, 9 aa, Artificial Sequence
  Description of Artificial Sequence: Synthetic peptide
  Seed: ASYLIRARR (TYRP1_HUMAN)
AAYLIRARK

SEQ ID NO: 177029 - protein, 9 aa, Artificial Sequence
  Description of Artificial Sequence: Synthetic peptide
  Seed: RARRSMDEA (TYRP1_HUMAN)
RVRRSMDEV

SEQ ID NO: 177030 - protein, 11 aa, Artificial Sequence
  Description of Artificial Sequence: Synthetic peptide
  Seed: RRYNADISTFP (TYRP1_HUMAN)
RRYNADISTFY

SEQ ID NO: 177031 - protein, 10 aa, Artificial Sequence
  Description of Artificial Sequence: Synthetic peptide
  Seed: ALIFGTASYL (TYRP1_HUMAN)
ANIFGTASYV

SEQ ID NO: 177032 - protein, 10 aa, Artificial Sequence
  Description of Artificial Sequence: Synthetic peptide
  Seed: FYSNSTNSFR (TYRP1_HUMAN)
FCSNSTNSFK

SEQ ID NO: 177033 - protein, 9 aa, Artificial Sequence
  Description of Artificial Sequence: Synthetic peptide
  Seed: FSLPYWNFA (TYRP1_HUMAN)
FALPYWNFM

SEQ ID NO: 177034 - protein, 9 aa, Artificial Sequence
  Description of Artificial Sequence: Synthetic peptide
  Seed: NISIYNYFV (TYRP1_HUMAN)
NVSIYNYFI

SEQ ID NO: 177035 - protein, 10 aa, Artificial Sequence
  Description of Artificial Sequence: Synthetic peptide
  Seed: LIFGTASYLI (TYRP1_HUMAN)
LAFGTASYLV

SEQ ID NO: 177036 - protein, 9 aa, Artificial Sequence
  Description of Artificial Sequence: Synthetic peptide
  Seed: QEMLQEPSF (TYRP1_HUMAN)
QQMLQEPSM

SEQ ID NO: 177037 - protein, 9 aa, Artificial Sequence
  Description of Artificial Sequence: Synthetic peptide
  Seed: LQNPNQSVV (TYRP1_HUMAN)
LTNPNQSVV

SEQ ID NO: 177038 - protein, 9 aa, Artificial Sequence
  Description of Artificial Sequence: Synthetic peptide
  Seed: NYFVWTHYY (TYRP1_HUMAN)
NQFVWTHYF

SEQ ID NO: 177039 - protein, 9 aa, Artificial Sequence
  Description of Artificial Sequence: Synthetic peptide
  Seed: VGLFDTPPF (TYRP1_HUMAN)
VMLFDTPPW

SEQ ID NO: 177040 - protein, 10 aa, Artificial Sequence
  Description of Artificial Sequence: Synthetic peptide
  Seed: NISIYNYFVW (TYRP1_HUMAN)
NKSIYNYFVW

SEQ ID NO: 177041 - protein, 10 aa, Artificial Sequence
  Description of Artificial Sequence: Synthetic peptide
  Seed: NYFVWTHYYS (TYRP1_HUMAN)
NGFVWTHYYY

SEQ ID NO: 177042 - protein, 10 aa, Artificial Sequence
  Description of Artificial Sequence: Synthetic peptide
  Seed: HSPQYPHDGR (TYRP1_HUMAN)
HTPQYPHDGK

SEQ ID NO: 177043 - protein, 10 aa, Artificial Sequence
  Description of Artificial Sequence: Synthetic peptide
  Seed: MQEMLQEPSF (TYRP1_HUMAN)
MIEMLQEPSW

SEQ ID NO: 177044 - protein, 9 aa, Artificial Sequence
  Description of Artificial Sequence: Synthetic peptide
  Seed: RQYNMVPFW (TYRP1_HUMAN)
RNYNMVPFY

SEQ ID NO: 177045 - protein, 9 aa, Artificial Sequence
  Description of Artificial Sequence: Synthetic peptide
  Seed: RSNFDSTLI (TYRP1_HUMAN)
RTNFDSTLF

SEQ ID NO: 177046 - protein, 10 aa, Artificial Sequence
  Description of Artificial Sequence: Synthetic peptide
  Seed: LSPNDPIFVL (TYRP1_HUMAN)
LPPNDPIFVM

SEQ ID NO: 177047 - protein, 10 aa, Artificial Sequence
  Description of Artificial Sequence: Synthetic peptide
  Seed: VALIFGTASY (TYRP1_HUMAN)
VSLIFGTASL

SEQ ID NO: 177048 - protein, 11 aa, Artificial Sequence
  Description of Artificial Sequence: Synthetic peptide
  Seed: YNMVPFWPPVT (TYRP1_HUMAN)
YIMVPFWPPVL

SEQ ID NO: 177049 - protein, 9 aa, Artificial Sequence
  Description of Artificial Sequence: Synthetic peptide
  Seed: RYNADISTF (TYRP1_HUMAN)
RYNADISTV

SEQ ID NO: 177050 - protein, 9 aa, Artificial Sequence
  Description of Artificial Sequence: Synthetic peptide
  Seed: EDYDTLGTL (TYRP1_HUMAN)
EEYDTLGTM

SEQ ID NO: 177051 - protein, 9 aa, Artificial Sequence
  Description of Artificial Sequence: Synthetic peptide
  Seed: KYDPAVRSL (TYRP1_HUMAN)
KPDPAVRSM

SEQ ID NO: 177052 - protein, 8 aa, Artificial Sequence
  Description of Artificial Sequence: Synthetic peptide
  Seed: YSDPTGKY (TYRP1_HUMAN)
YTDPTGKI

SEQ ID NO: 177053 - protein, 9 aa, Artificial Sequence
  Description of Artificial Sequence: Synthetic peptide
  Seed: AQFPRQCAT (TYRP1_HUMAN)
AKFPRQCAY

SEQ ID NO: 177054 - protein, 9 aa, Artificial Sequence
  Description of Artificial Sequence: Synthetic peptide
  Seed: RVLIVRRNL (TYRP1_HUMAN)
RVLIVRRNI

SEQ ID NO: 177055 - protein, 10 aa, Artificial Sequence
  Description of Artificial Sequence: Synthetic peptide
  Seed: NYFVWTHYYS (TYRP1_HUMAN)
NLFVWTHYYF

SEQ ID NO: 177056 - protein, 9 aa, Artificial Sequence
  Description of Artificial Sequence: Synthetic peptide
  Seed: ACDQRVLIV (TYRP1_HUMAN)
AGDQRVLII

SEQ ID NO: 177057 - protein, 10 aa, Artificial Sequence
  Description of Artificial Sequence: Synthetic peptide
  Seed: RSLHNLAHLF (TYRP1_HUMAN)
RMLHNLAHLW

SEQ ID NO: 177058 - protein, 10 aa, Artificial Sequence
  Description of Artificial Sequence: Synthetic peptide
  Seed: DVAQCLEVGL (TYRP1_HUMAN)
DTAQCLEVGV

SEQ ID NO: 177059 - protein, 9 aa, Artificial Sequence
  Description of Artificial Sequence: Synthetic peptide
  Seed: SGHNCGTCR (TYRP1_HUMAN)
SAHNCGTCR

SEQ ID NO: 177060 - protein, 9 aa, Artificial Sequence
  Description of Artificial Sequence: Synthetic peptide
  Seed: VFDEWLRRY (TYRP1_HUMAN)
VTDEWLRRI

SEQ ID NO: 177061 - protein, 9 aa, Artificial Sequence
  Description of Artificial Sequence: Synthetic peptide
  Seed: FLTWHRYHL (TYRP1_HUMAN)
FRTWHRYHM

SEQ ID NO: 177062 - protein, 10 aa, Artificial Sequence
  Description of Artificial Sequence: Synthetic peptide
  Seed: SMDEANQPLL (TYRP1_HUMAN)
STDEANQPLF

SEQ ID NO: 177063 - protein, 9 aa, Artificial Sequence
  Description of Artificial Sequence: Synthetic peptide
  Seed: QCATVEALR (TYRP1_HUMAN)
QLATVEALK

SEQ ID NO: 177064 - protein, 9 aa, Artificial Sequence
  Description of Artificial Sequence: Synthetic peptide
  Seed: FSHEGPAFL (TYRP1_HUMAN)
FKHEGPAFY

SEQ ID NO: 177065 - protein, 9 aa, Artificial Sequence
  Description of Artificial Sequence: Synthetic peptide
  Seed: LPYWNFATG (TYRP1_HUMAN)
LIYWNFATY

SEQ ID NO: 177066 - protein, 11 aa, Artificial Sequence
  Description of Artificial Sequence: Synthetic peptide
  Seed: HLSPNDPIFVL (TYRP1_HUMAN)
HMSPNDPIFVV

SEQ ID NO: 177067 - protein, 9 aa, Artificial Sequence
  Description of Artificial Sequence: Synthetic peptide
  Seed: IIAIAVVGA (TYRP1_HUMAN)
IMAIAVVGI

SEQ ID NO: 177068 - protein, 9 aa, Artificial Sequence
  Description of Artificial Sequence: Synthetic peptide
  Seed: IFGTASYLI (TYRP1_HUMAN)
IFGTASYLF

SEQ ID NO: 177069 - protein, 10 aa, Artificial Sequence
  Description of Artificial Sequence: Synthetic peptide
  Seed: LLLVALIFGT (TYRP1_HUMAN)
LCLVALIFGI

SEQ ID NO: 177070 - protein, 11 aa, Artificial Sequence
  Description of Artificial Sequence: Synthetic peptide
  Seed: LTWHRYHLLRL (TYRP1_HUMAN)
LMWHRYHLLRR

SEQ ID NO: 177071 - protein, 11 aa, Artificial Sequence
  Description of Artificial Sequence: Synthetic peptide
  Seed: RSLHNLAHLFL (TYRP1_HUMAN)
RSLHNLAHLFM

SEQ ID NO: 177072 - protein, 9 aa, Artificial Sequence
  Description of Artificial Sequence: Synthetic peptide
  Seed: AACDQRVLI (TYRP1_HUMAN)
ATCDQRVLF

SEQ ID NO: 177073 - protein, 10 aa, Artificial Sequence
  Description of Artificial Sequence: Synthetic peptide
  Seed: RSMDEANQPL (TYRP1_HUMAN)
RGMDEANQPF

SEQ ID NO: 177074 - protein, 9 aa, Artificial Sequence
  Description of Artificial Sequence: Synthetic peptide
  Seed: TFPLENAPI (TYRP1_HUMAN)
TAPLENAPV

SEQ ID NO: 177075 - protein, 8 aa, Artificial Sequence
  Description of Artificial Sequence: Synthetic peptide
  Seed: YSDPTGKY (TYRP1_HUMAN)
YMDPTGKV

SEQ ID NO: 177076 - protein, 10 aa, Artificial Sequence
  Description of Artificial Sequence: Synthetic peptide
  Seed: GTASYLIRAR (TYRP1_HUMAN)
GTASYLIRAK

SEQ ID NO: 177077 - protein, 9 aa, Artificial Sequence
  Description of Artificial Sequence: Synthetic peptide
  Seed: APIGHNRQY (TYRP1_HUMAN)
ARIGHNRQM

SEQ ID NO: 177078 - protein, 9 aa, Artificial Sequence
  Description of Artificial Sequence: Synthetic peptide
  Seed: SIYNYFVWT (TYRP1_HUMAN)
SMYNYFVWS

SEQ ID NO: 177079 - protein, 9 aa, Artificial Sequence
  Description of Artificial Sequence: Synthetic peptide
  Seed: FSVPEIIAI (TYRP1_HUMAN)
FAVPEIIAY

SEQ ID NO: 177080 - protein, 10 aa, Artificial Sequence
  Description of Artificial Sequence: Synthetic peptide
  Seed: FLTWHRYHLL (TYRP1_HUMAN)
FITWHRYHLV

SEQ ID NO: 177081 - protein, 9 aa, Artificial Sequence
  Description of Artificial Sequence: Synthetic peptide
  Seed: SMDEANQPL (TYRP1_HUMAN)
SCDEANQPL

SEQ ID NO: 177082 - protein, 10 aa, Artificial Sequence
  Description of Artificial Sequence: Synthetic peptide
  Seed: HRYHLLRLEK (TYRP1_HUMAN)
HMYHLLRLEK

SEQ ID NO: 177083 - protein, 10 aa, Artificial Sequence
  Description of Artificial Sequence: Synthetic peptide
  Seed: TAPDNLGYTY (TYRP1_HUMAN)
TIPDNLGYTY

SEQ ID NO: 177084 - protein, 9 aa, Artificial Sequence
  Description of Artificial Sequence: Synthetic peptide
  Seed: QEPSFSLPY (TYRP1_HUMAN)
QQPSFSLPL

SEQ ID NO: 177085 - protein, 10 aa, Artificial Sequence
  Description of Artificial Sequence: Synthetic peptide
  Seed: EMLQEPSFSL (TYRP1_HUMAN)
EGLQEPSFSV

SEQ ID NO: 177086 - protein, 9 aa, Artificial Sequence
  Description of Artificial Sequence: Synthetic peptide
  Seed: SVPEIIAIA (TYRP1_HUMAN)
SIPEIIAIL

SEQ ID NO: 177087 - protein, 10 aa, Artificial Sequence
  Description of Artificial Sequence: Synthetic peptide
  Seed: ALIFGTASYL (TYRP1_HUMAN)
AQIFGTASYW

SEQ ID NO: 177088 - protein, 9 aa, Artificial Sequence
  Description of Artificial Sequence: Synthetic peptide
  Seed: FLTWHRYHL (TYRP1_HUMAN)
FMTWHRYHI

SEQ ID NO: 177089 - protein, 10 aa, Artificial Sequence
  Description of Artificial Sequence: Synthetic peptide
  Seed: YNYFVWTHYY (TYRP1_HUMAN)
YCYFVWTHYF

SEQ ID NO: 177090 - protein, 9 aa, Artificial Sequence
  Description of Artificial Sequence: Synthetic peptide
  Seed: SIYNYFVWT (TYRP1_HUMAN)
SIYNYFVWM

SEQ ID NO: 177091 - protein, 10 aa, Artificial Sequence
  Description of Artificial Sequence: Synthetic peptide
  Seed: ALIFGTASYL (TYRP1_HUMAN)
ACIFGTASYV

SEQ ID NO: 177092 - protein, 9 aa, Artificial Sequence
  Description of Artificial Sequence: Synthetic peptide
  Seed: ALIFGTASY (TYRP1_HUMAN)
AIIFGTASF

SEQ ID NO: 177093 - protein, 10 aa, Artificial Sequence
  Description of Artificial Sequence: Synthetic peptide
  Seed: LGPDGNTPQF (TYRP1_HUMAN)
LCPDGNTPQW

SEQ ID NO: 177094 - protein, 10 aa, Artificial Sequence
  Description of Artificial Sequence: Synthetic peptide
  Seed: RSLHNLAHLF (TYRP1_HUMAN)
RALHNLAHLF

SEQ ID NO: 177095 - protein, 11 aa, Artificial Sequence
  Description of Artificial Sequence: Synthetic peptide
  Seed: MFVTAPDNLGY (TYRP1_HUMAN)
MIVTAPDNLGW

SEQ ID NO: 177096 - protein, 10 aa, Artificial Sequence
  Description of Artificial Sequence: Synthetic peptide
  Seed: YNYFVWTHYY (TYRP1_HUMAN)
YLYFVWTHYY

SEQ ID NO: 177097 - protein, 11 aa, Artificial Sequence
  Description of Artificial Sequence: Synthetic peptide
  Seed: IYNYFVWTHYY (TYRP1_HUMAN)
IHNYFVWTHYL

SEQ ID NO: 177098 - protein, 11 aa, Artificial Sequence
  Description of Artificial Sequence: Synthetic peptide
  Seed: FVLLHTFTDAV (TYRP1_HUMAN)
FPLLHTFTDAV

SEQ ID NO: 177099 - protein, 9 aa, Artificial Sequence
  Description of Artificial Sequence: Synthetic peptide
  Seed: QCYAEEYEK (TYRP1_HUMAN)
QSYAEEYEK

SEQ ID NO: 177100 - protein, 9 aa, Artificial Sequence
  Description of Artificial Sequence: Synthetic peptide
  Seed: SLHNLAHLF (TYRP1_HUMAN)
SRHNLAHLY

SEQ ID NO: 177101 - protein, 10 aa, Artificial Sequence
  Description of Artificial Sequence: Synthetic peptide
  Seed: IAIAVVGALL (TYRP1_HUMAN)
ITIAVVGALY

SEQ ID NO: 177102 - protein, 8 aa, Artificial Sequence
  Description of Artificial Sequence: Synthetic peptide
  Seed: RQYNMVPF (TYRP1_HUMAN)
RHYNMVPF

SEQ ID NO: 177103 - protein, 9 aa, Artificial Sequence
  Description of Artificial Sequence: Synthetic peptide
  Seed: AQFPRQCAT (TYRP1_HUMAN)
ANFPRQCAF

SEQ ID NO: 177104 - protein, 10 aa, Artificial Sequence
  Description of Artificial Sequence: Synthetic peptide
  Seed: KLLSLGCIFF (TYRP1_HUMAN)
KKLSLGCIFY

SEQ ID NO: 177105 - protein, 10 aa, Artificial Sequence
  Description of Artificial Sequence: Synthetic peptide
  Seed: LGPDGNTPQF (TYRP1_HUMAN)
LPPDGNTPQY

SEQ ID NO: 177106 - protein, 10 aa, Artificial Sequence
  Description of Artificial Sequence: Synthetic peptide
  Seed: SLGCIFFPLL (TYRP1_HUMAN)
SMGCIFFPLI

SEQ ID NO: 177107 - protein, 10 aa, Artificial Sequence
  Description of Artificial Sequence: Synthetic peptide
  Seed: YNYFVWTHYY (TYRP1_HUMAN)
YGYFVWTHYR

SEQ ID NO: 177108 - protein, 9 aa, Artificial Sequence
  Description of Artificial Sequence: Synthetic peptide
  Seed: RRNPAGNVA (TYRP1_HUMAN)
RFNPAGNVF

SEQ ID NO: 177109 - protein, 9 aa, Artificial Sequence
  Description of Artificial Sequence: Synthetic peptide
  Seed: LQNPNQSVV (TYRP1_HUMAN)
LKNPNQSVM

SEQ ID NO: 177110 - protein, 9 aa, Artificial Sequence
  Description of Artificial Sequence: Synthetic peptide
  Seed: RQCATVEAL (TYRP1_HUMAN)
RACATVEAM

SEQ ID NO: 177111 - protein, 11 aa, Artificial Sequence
  Description of Artificial Sequence: Synthetic peptide
  Seed: FWPPVTNTEMF (TYRP1_HUMAN)
FMPPVTNTEMY

SEQ ID NO: 177112 - protein, 9 aa, Artificial Sequence
  Description of Artificial Sequence: Synthetic peptide
  Seed: KYDPAVRSL (TYRP1_HUMAN)
KMDPAVRSY

SEQ ID NO: 177113 - protein, 9 aa, Artificial Sequence
  Description of Artificial Sequence: Synthetic peptide
  Seed: HLSPNDPIF (TYRP1_HUMAN)
HISPNDPIF

SEQ ID NO: 177114 - protein, 10 aa, Artificial Sequence
  Description of Artificial Sequence: Synthetic peptide
  Seed: YFVWTHYYSV (TYRP1_HUMAN)
YLVWTHYYSA

SEQ ID NO: 177115 - protein, 9 aa, Artificial Sequence
  Description of Artificial Sequence: Synthetic peptide
  Seed: KYDPAVRSL (TYRP1_HUMAN)
KKDPAVRSF

SEQ ID NO: 177116 - protein, 9 aa, Artificial Sequence
  Description of Artificial Sequence: Synthetic peptide
  Seed: TADSRPHSP (TYRP1_HUMAN)
TCDSRPHSL

SEQ ID NO: 177117 - protein, 9 aa, Artificial Sequence
  Description of Artificial Sequence: Synthetic peptide
  Seed: HRYHLLRLE (TYRP1_HUMAN)
HRYHLLRLF

SEQ ID NO: 177118 - protein, 9 aa, Artificial Sequence
  Description of Artificial Sequence: Synthetic peptide
  Seed: HEGPAFLTW (TYRP1_HUMAN)
HEGPAFLTL

SEQ ID NO: 177119 - protein, 10 aa, Artificial Sequence
  Description of Artificial Sequence: Synthetic peptide
  Seed: FSLPYWNFAT (TYRP1_HUMAN)
FNLPYWNFAM

SEQ ID NO: 177120 - protein, 8 aa, Artificial Sequence
  Description of Artificial Sequence: Synthetic peptide
  Seed: LIFGTASY (TYRP1_HUMAN)
LQFGTASM

SEQ ID NO: 177121 - protein, 9 aa, Artificial Sequence
  Description of Artificial Sequence: Synthetic peptide
  Seed: APIGHNRQY (TYRP1_HUMAN)
AEIGHNRQF

SEQ ID NO: 177122 - protein, 9 aa, Artificial Sequence
  Description of Artificial Sequence: Synthetic peptide
  Seed: NISIYNYFV (TYRP1_HUMAN)
NSSIYNYFV

SEQ ID NO: 177123 - protein, 9 aa, Artificial Sequence
  Description of Artificial Sequence: Synthetic peptide
  Seed: YLIRARRSM (TYRP1_HUMAN)
YYIRARRSL

SEQ ID NO: 177124 - protein, 9 aa, Artificial Sequence
  Description of Artificial Sequence: Synthetic peptide
  Seed: AQFPRQCAT (TYRP1_HUMAN)
ALFPRQCAY

SEQ ID NO: 177125 - protein, 9 aa, Artificial Sequence
  Description of Artificial Sequence: Synthetic peptide
  Seed: MSAPKLLSL (TYRP1_HUMAN)
MGAPKLLSF

SEQ ID NO: 177126 - protein, 9 aa, Artificial Sequence
  Description of Artificial Sequence: Synthetic peptide
  Seed: AVVGALLLV (TYRP1_HUMAN)
AIVGALLLL

SEQ ID NO: 177127 - protein, 10 aa, Artificial Sequence
  Description of Artificial Sequence: Synthetic peptide
  Seed: KRTTHPLFVI (TYRP1_HUMAN)
KATTHPLFVY

SEQ ID NO: 177128 - protein, 10 aa, Artificial Sequence
  Description of Artificial Sequence: Synthetic peptide
  Seed: LSLGCIFFPL (TYRP1_HUMAN)
LPLGCIFFPV

SEQ ID NO: 177129 - protein, 10 aa, Artificial Sequence
  Description of Artificial Sequence: Synthetic peptide
  Seed: TPQFENISIY (TYRP1_HUMAN)
TWQFENISIF

SEQ ID NO: 177130 - protein, 9 aa, Artificial Sequence
  Description of Artificial Sequence: Synthetic peptide
  Seed: NMVPFWPPV (TYRP1_HUMAN)
NLVPFWPPV

SEQ ID NO: 177131 - protein, 9 aa, Artificial Sequence
  Description of Artificial Sequence: Synthetic peptide
  Seed: TADSRPHSP (TYRP1_HUMAN)
TSDSRPHSL

SEQ ID NO: 177132 - protein, 9 aa, Artificial Sequence
  Description of Artificial Sequence: Synthetic peptide
  Seed: DSRPHSPQY (TYRP1_HUMAN)
DPRPHSPQY

SEQ ID NO: 177133 - protein, 9 aa, Artificial Sequence
  Description of Artificial Sequence: Synthetic peptide
  Seed: LLVALIFGT (TYRP1_HUMAN)
LTVALIFGV

SEQ ID NO: 177134 - protein, 10 aa, Artificial Sequence
  Description of Artificial Sequence: Synthetic peptide
  Seed: MVPFWPPVTN (TYRP1_HUMAN)
MAPFWPPVTM

SEQ ID NO: 177135 - protein, 10 aa, Artificial Sequence
  Description of Artificial Sequence: Synthetic peptide
  Seed: RTTHPLFVIA (TYRP1_HUMAN)
RSTHPLFVIA

SEQ ID NO: 177136 - protein, 9 aa, Artificial Sequence
  Description of Artificial Sequence: Synthetic peptide
  Seed: VGLFDTPPF (TYRP1_HUMAN)
VRLFDTPPY

SEQ ID NO: 177137 - protein, 9 aa, Artificial Sequence
  Description of Artificial Sequence: Synthetic peptide
  Seed: MSAPKLLSL (TYRP1_HUMAN)
MMAPKLLSI

SEQ ID NO: 177138 - protein, 9 aa, Artificial Sequence
  Description of Artificial Sequence: Synthetic peptide
  Seed: FSHEGPAFL (TYRP1_HUMAN)
FIHEGPAFF

SEQ ID NO: 177139 - protein, 9 aa, Artificial Sequence
  Description of Artificial Sequence: Synthetic peptide
  Seed: PIFVLLHTF (TYRP1_HUMAN)
PYFVLLHTL

SEQ ID NO: 177140 - protein, 10 aa, Artificial Sequence
  Description of Artificial Sequence: Synthetic peptide
  Seed: RTTHPLFVIA (TYRP1_HUMAN)
RQTHPLFVIA

SEQ ID NO: 177141 - protein, 8 aa, Artificial Sequence
  Description of Artificial Sequence: Synthetic peptide
  Seed: SVPEIIAI (TYRP1_HUMAN)
SQPEIIAI

SEQ ID NO: 177142 - protein, 9 aa, Artificial Sequence
  Description of Artificial Sequence: Synthetic peptide
  Seed: MSAPKLLSL (TYRP1_HUMAN)
MVAPKLLSK

SEQ ID NO: 177143 - protein, 10 aa, Artificial Sequence
  Description of Artificial Sequence: Synthetic peptide
  Seed: AQFPRQCATV (TYRP1_HUMAN)
ALFPRQCATI

SEQ ID NO: 177144 - protein, 10 aa, Artificial Sequence
  Description of Artificial Sequence: Synthetic peptide
  Seed: ALIFGTASYL (TYRP1_HUMAN)
AQIFGTASYA

SEQ ID NO: 177145 - protein, 10 aa, Artificial Sequence
  Description of Artificial Sequence: Synthetic peptide
  Seed: FSVPEIIAIA (TYRP1_HUMAN)
FTVPEIIAIA

SEQ ID NO: 177146 - protein, 11 aa, Artificial Sequence
  Description of Artificial Sequence: Synthetic peptide
  Seed: IYNYFVWTHYY (TYRP1_HUMAN)
IGNYFVWTHYY

SEQ ID NO: 177147 - protein, 10 aa, Artificial Sequence
  Description of Artificial Sequence: Synthetic peptide
  Seed: YNYFVWTHYY (TYRP1_HUMAN)
YKYFVWTHYY

SEQ ID NO: 177148 - protein, 9 aa, Artificial Sequence
  Description of Artificial Sequence: Synthetic peptide
  Seed: DSLEDYDTL (TYRP1_HUMAN)
DTLEDYDTF

SEQ ID NO: 177149 - protein, 11 aa, Artificial Sequence
  Description of Artificial Sequence: Synthetic peptide
  Seed: ILGPDGNTPQF (TYRP1_HUMAN)
ITGPDGNTPQW

SEQ ID NO: 177150 - protein, 8 aa, Artificial Sequence
  Description of Artificial Sequence: Synthetic peptide
  Seed: FSHEGPAF (TYRP1_HUMAN)
FMHEGPAL

SEQ ID NO: 177151 - protein, 9 aa, Artificial Sequence
  Description of Artificial Sequence: Synthetic peptide
  Seed: DEWLRRYNA (TYRP1_HUMAN)
DEWLRRYNM

SEQ ID NO: 177152 - protein, 9 aa, Artificial Sequence
  Description of Artificial Sequence: Synthetic peptide
  Seed: HEGPAFLTW (TYRP1_HUMAN)
HEGPAFLTA

SEQ ID NO: 177153 - protein, 9 aa, Artificial Sequence
  Description of Artificial Sequence: Synthetic peptide
  Seed: MSAPKLLSL (TYRP1_HUMAN)
MSAPKLLSF

SEQ ID NO: 177154 - protein, 11 aa, Artificial Sequence
  Description of Artificial Sequence: Synthetic peptide
  Seed: YNYFVWTHYYS (TYRP1_HUMAN)
YMYFVWTHYYY

SEQ ID NO: 177155 - protein, 10 aa, Artificial Sequence
  Description of Artificial Sequence: Synthetic peptide
  Seed: IAIAVVGALL (TYRP1_HUMAN)
ITIAVVGALL

SEQ ID NO: 177156 - protein, 10 aa, Artificial Sequence
  Description of Artificial Sequence: Synthetic peptide
  Seed: FQQARAQFPR (TYRP1_HUMAN)
FVQARAQFPR

SEQ ID NO: 177157 - protein, 10 aa, Artificial Sequence
  Description of Artificial Sequence: Synthetic peptide
  Seed: RVVCDSLEDY (TYRP1_HUMAN)
RSVCDSLEDW

SEQ ID NO: 177158 - protein, 11 aa, Artificial Sequence
  Description of Artificial Sequence: Synthetic peptide
  Seed: MLQEPSFSLPY (TYRP1_HUMAN)
MKQEPSFSLPY

SEQ ID NO: 177159 - protein, 9 aa, Artificial Sequence
  Description of Artificial Sequence: Synthetic peptide
  Seed: RARRSMDEA (TYRP1_HUMAN)
RVRRSMDET

SEQ ID NO: 177160 - protein, 9 aa, Artificial Sequence
  Description of Artificial Sequence: Synthetic peptide
  Seed: NYFVWTHYY (TYRP1_HUMAN)
NQFVWTHYR

SEQ ID NO: 177161 - protein, 9 aa, Artificial Sequence
  Description of Artificial Sequence: Synthetic peptide
  Seed: VGLFDTPPF (TYRP1_HUMAN)
VELFDTPPY

SEQ ID NO: 177162 - protein, 9 aa, Artificial Sequence
  Description of Artificial Sequence: Synthetic peptide
  Seed: YNYFVWTHY (TYRP1_HUMAN)
YKYFVWTHY

SEQ ID NO: 177163 - protein, 10 aa, Artificial Sequence
  Description of Artificial Sequence: Synthetic peptide
  Seed: FFPLLLFQQA (TYRP1_HUMAN)
FTPLLLFQQA

SEQ ID NO: 177164 - protein, 9 aa, Artificial Sequence
  Description of Artificial Sequence: Synthetic peptide
  Seed: RLEKDMQEM (TYRP1_HUMAN)
RMEKDMQEL

SEQ ID NO: 177165 - protein, 9 aa, Artificial Sequence
  Description of Artificial Sequence: Synthetic peptide
  Seed: KLLSLGCIF (TYRP1_HUMAN)
KQLSLGCIW

SEQ ID NO: 177166 - protein, 10 aa, Artificial Sequence
  Description of Artificial Sequence: Synthetic peptide
  Seed: EIIAIAVVGA (TYRP1_HUMAN)
EAIAIAVVGL

SEQ ID NO: 177167 - protein, 10 aa, Artificial Sequence
  Description of Artificial Sequence: Synthetic peptide
  Seed: THYYSVKKTF (TYRP1_HUMAN)
TYYYSVKKTY

SEQ ID NO: 177168 - protein, 9 aa, Artificial Sequence
  Description of Artificial Sequence: Synthetic peptide
  Seed: REFSVPEII (TYRP1_HUMAN)
RDFSVPEIW

SEQ ID NO: 177169 - protein, 9 aa, Artificial Sequence
  Description of Artificial Sequence: Synthetic peptide
  Seed: RQCATVEAL (TYRP1_HUMAN)
RMCATVEAV

SEQ ID NO: 177170 - protein, 9 aa, Artificial Sequence
  Description of Artificial Sequence: Synthetic peptide
  Seed: MLQEPSFSL (TYRP1_HUMAN)
MFQEPSFSM

SEQ ID NO: 177171 - protein, 11 aa, Artificial Sequence
  Description of Artificial Sequence: Synthetic peptide
  Seed: MLQEPSFSLPY (TYRP1_HUMAN)
MIQEPSFSLPF

SEQ ID NO: 177172 - protein, 9 aa, Artificial Sequence
  Description of Artificial Sequence: Synthetic peptide
  Seed: DNLGYTYEI (TYRP1_HUMAN)
DSLGYTYEI

SEQ ID NO: 177173 - protein, 9 aa, Artificial Sequence
  Description of Artificial Sequence: Synthetic peptide
  Seed: LQNPNQSVV (TYRP1_HUMAN)
LTNPNQSVY

SEQ ID NO: 177174 - protein, 10 aa, Artificial Sequence
  Description of Artificial Sequence: Synthetic peptide
  Seed: RPMVQRLPEP (TYRP1_HUMAN)
RPMVQRLPEI

SEQ ID NO: 177175 - protein, 10 aa, Artificial Sequence
  Description of Artificial Sequence: Synthetic peptide
  Seed: MVPFWPPVTN (TYRP1_HUMAN)
MPPFWPPVTY

SEQ ID NO: 177176 - protein, 9 aa, Artificial Sequence
  Description of Artificial Sequence: Synthetic peptide
  Seed: RSNFDSTLI (TYRP1_HUMAN)
RVNFDSTLY

SEQ ID NO: 177177 - protein, 9 aa, Artificial Sequence
  Description of Artificial Sequence: Synthetic peptide
  Seed: TLISPNSVF (TYRP1_HUMAN)
TAISPNSVI

SEQ ID NO: 177178 - protein, 9 aa, Artificial Sequence
  Description of Artificial Sequence: Synthetic peptide
  Seed: DSRPHSPQY (TYRP1_HUMAN)
DSRPHSPQR

SEQ ID NO: 177179 - protein, 10 aa, Artificial Sequence
  Description of Artificial Sequence: Synthetic peptide
  Seed: MAKRTTHPLF (TYRP1_HUMAN)
MLKRTTHPLL

SEQ ID NO: 177180 - protein, 10 aa, Artificial Sequence
  Description of Artificial Sequence: Synthetic peptide
  Seed: FVWTHYYSVK (TYRP1_HUMAN)
FIWTHYYSVQ

SEQ ID NO: 177181 - protein, 9 aa, Artificial Sequence
  Description of Artificial Sequence: Synthetic peptide
  Seed: LIFGTASYL (TYRP1_HUMAN)
LAFGTASYY

SEQ ID NO: 177182 - protein, 9 aa, Artificial Sequence
  Description of Artificial Sequence: Synthetic peptide
  Seed: NYFVWTHYY (TYRP1_HUMAN)
NVFVWTHYK

SEQ ID NO: 177183 - protein, 9 aa, Artificial Sequence
  Description of Artificial Sequence: Synthetic peptide
  Seed: RYNADISTF (TYRP1_HUMAN)
RMNADISTL

SEQ ID NO: 177184 - protein, 10 aa, Artificial Sequence
  Description of Artificial Sequence: Synthetic peptide
  Seed: ISPNSVFSQW (TYRP1_HUMAN)
IKPNSVFSQW

SEQ ID NO: 177185 - protein, 9 aa, Artificial Sequence
  Description of Artificial Sequence: Synthetic peptide
  Seed: RYHLLRLEK (TYRP1_HUMAN)
RIHLLRLEK

SEQ ID NO: 177186 - protein, 9 aa, Artificial Sequence
  Description of Artificial Sequence: Synthetic peptide
  Seed: MSAPKLLSL (TYRP1_HUMAN)
MMAPKLLSW

SEQ ID NO: 177187 - protein, 10 aa, Artificial Sequence
  Description of Artificial Sequence: Synthetic peptide
  Seed: EMLQEPSFSL (TYRP1_HUMAN)
EWLQEPSFSL

SEQ ID NO: 177188 - protein, 10 aa, Artificial Sequence
  Description of Artificial Sequence: Synthetic peptide
  Seed: NISIYNYFVW (TYRP1_HUMAN)
NDSIYNYFVW

SEQ ID NO: 177189 - protein, 10 aa, Artificial Sequence
  Description of Artificial Sequence: Synthetic peptide
  Seed: LIFGTASYLI (TYRP1_HUMAN)
LMFGTASYLM

SEQ ID NO: 177190 - protein, 9 aa, Artificial Sequence
  Description of Artificial Sequence: Synthetic peptide
  Seed: LGYTYEIQW (TYRP1_HUMAN)
LVYTYEIQY

SEQ ID NO: 177191 - protein, 9 aa, Artificial Sequence
  Description of Artificial Sequence: Synthetic peptide
  Seed: RTCHCNGNF (TYRP1_HUMAN)
RACHCNGNY

SEQ ID NO: 177192 - protein, 9 aa, Artificial Sequence
  Description of Artificial Sequence: Synthetic peptide
  Seed: REVWPLRFF (TYRP1_HUMAN)
REVWPLRFM

SEQ ID NO: 177193 - protein, 9 aa, Artificial Sequence
  Description of Artificial Sequence: Synthetic peptide
  Seed: TFPLENAPI (TYRP1_HUMAN)
TFPLENAPL

SEQ ID NO: 177194 - protein, 9 aa, Artificial Sequence
  Description of Artificial Sequence: Synthetic peptide
  Seed: FSVPEIIAI (TYRP1_HUMAN)
FPVPEIIAF

SEQ ID NO: 177195 - protein, 11 aa, Artificial Sequence
  Description of Artificial Sequence: Synthetic peptide
  Seed: FSHEGPAFLTW (TYRP1_HUMAN)
FSHEGPAFLTY

SEQ ID NO: 177196 - protein, 9 aa, Artificial Sequence
  Description of Artificial Sequence: Synthetic peptide
  Seed: FYSNSTNSF (TYRP1_HUMAN)
FWSNSTNSF

SEQ ID NO: 177197 - protein, 10 aa, Artificial Sequence
  Description of Artificial Sequence: Synthetic peptide
  Seed: SHEGPAFLTW (TYRP1_HUMAN)
SNEGPAFLTW

SEQ ID NO: 177198 - protein, 10 aa, Artificial Sequence
  Description of Artificial Sequence: Synthetic peptide
  Seed: MVPFWPPVTN (TYRP1_HUMAN)
MYPFWPPVTM

SEQ ID NO: 177199 - protein, 9 aa, Artificial Sequence
  Description of Artificial Sequence: Synthetic peptide
  Seed: YTYEIQWPS (TYRP1_HUMAN)
YSYEIQWPS

SEQ ID NO: 177200 - protein, 9 aa, Artificial Sequence
  Description of Artificial Sequence: Synthetic peptide
  Seed: TFPLENAPI (TYRP1_HUMAN)
TYPLENAPF

SEQ ID NO: 177201 - protein, 10 aa, Artificial Sequence
  Description of Artificial Sequence: Synthetic peptide
  Seed: FWPPVTNTEM (TYRP1_HUMAN)
FGPPVTNTEF

SEQ ID NO: 177202 - protein, 10 aa, Artificial Sequence
  Description of Artificial Sequence: Synthetic peptide
  Seed: EIIAIAVVGA (TYRP1_HUMAN)
EKIAIAVVGV

SEQ ID NO: 177203 - protein, 8 aa, Artificial Sequence
  Description of Artificial Sequence: Synthetic peptide
  Seed: FSHEGPAF (TYRP1_HUMAN)
FPHEGPAY

SEQ ID NO: 177204 - protein, 10 aa, Artificial Sequence
  Description of Artificial Sequence: Synthetic peptide
  Seed: SMDEANQPLL (TYRP1_HUMAN)
SFDEANQPLM

SEQ ID NO: 177205 - protein, 10 aa, Artificial Sequence
  Description of Artificial Sequence: Synthetic peptide
  Seed: EIIAIAVVGA (TYRP1_HUMAN)
ECIAIAVVGV

SEQ ID NO: 177206 - protein, 10 aa, Artificial Sequence
  Description of Artificial Sequence: Synthetic peptide
  Seed: SHEGPAFLTW (TYRP1_HUMAN)
SHEGPAFLTF

SEQ ID NO: 177207 - protein, 10 aa, Artificial Sequence
  Description of Artificial Sequence: Synthetic peptide
  Seed: SMDEANQPLL (TYRP1_HUMAN)
STDEANQPLL

SEQ ID NO: 177208 - protein, 10 aa, Artificial Sequence
  Description of Artificial Sequence: Synthetic peptide
  Seed: SIYNYFVWTH (TYRP1_HUMAN)
SVYNYFVWTK

SEQ ID NO: 177209 - protein, 10 aa, Artificial Sequence
  Description of Artificial Sequence: Synthetic peptide
  Seed: SHEGPAFLTW (TYRP1_HUMAN)
SWEGPAFLTW

SEQ ID NO: 177210 - protein, 10 aa, Artificial Sequence
  Description of Artificial Sequence: Synthetic peptide
  Seed: FENISIYNYF (TYRP1_HUMAN)
FQNISIYNYY

SEQ ID NO: 177211 - protein, 8 aa, Artificial Sequence
  Description of Artificial Sequence: Synthetic peptide
  Seed: ACDQRVLI (TYRP1_HUMAN)
AADQRVLF

SEQ ID NO: 177212 - protein, 10 aa, Artificial Sequence
  Description of Artificial Sequence: Synthetic peptide
  Seed: LGPDGNTPQF (TYRP1_HUMAN)
LIPDGNTPQF

SEQ ID NO: 177213 - protein, 9 aa, Artificial Sequence
  Description of Artificial Sequence: Synthetic peptide
  Seed: FSVPEIIAI (TYRP1_HUMAN)
FLVPEIIAY

SEQ ID NO: 177214 - protein, 10 aa, Artificial Sequence
  Description of Artificial Sequence: Synthetic peptide
  Seed: YNADISTFPL (TYRP1_HUMAN)
YCADISTFPF

SEQ ID NO: 177215 - protein, 9 aa, Artificial Sequence
  Description of Artificial Sequence: Synthetic peptide
  Seed: FVWTHYYSV (TYRP1_HUMAN)
FAWTHYYSM

SEQ ID NO: 177216 - protein, 9 aa, Artificial Sequence
  Description of Artificial Sequence: Synthetic peptide
  Seed: GPDGNTPQF (TYRP1_HUMAN)
GMDGNTPQL

SEQ ID NO: 177217 - protein, 10 aa, Artificial Sequence
  Description of Artificial Sequence: Synthetic peptide
  Seed: YNMVPFWPPV (TYRP1_HUMAN)
YFMVPFWPPI

SEQ ID NO: 177218 - protein, 10 aa, Artificial Sequence
  Description of Artificial Sequence: Synthetic peptide
  Seed: IYNYFVWTHY (TYRP1_HUMAN)
IWNYFVWTHI

SEQ ID NO: 177219 - protein, 9 aa, Artificial Sequence
  Description of Artificial Sequence: Synthetic peptide
  Seed: YTYEIQWPS (TYRP1_HUMAN)
YVYEIQWPK

SEQ ID NO: 177220 - protein, 9 aa, Artificial Sequence
  Description of Artificial Sequence: Synthetic peptide
  Seed: YYSVKKTFL (TYRP1_HUMAN)
YASVKKTFF

SEQ ID NO: 177221 - protein, 9 aa, Artificial Sequence
  Description of Artificial Sequence: Synthetic peptide
  Seed: MSAPKLLSL (TYRP1_HUMAN)
MAAPKLLSI

SEQ ID NO: 177222 - protein, 11 aa, Artificial Sequence
  Description of Artificial Sequence: Synthetic peptide
  Seed: YNMVPFWPPVT (TYRP1_HUMAN)
YQMVPFWPPVA

SEQ ID NO: 177223 - protein, 9 aa, Artificial Sequence
  Description of Artificial Sequence: Synthetic peptide
  Seed: FSHEGPAFL (TYRP1_HUMAN)
FPHEGPAFR

SEQ ID NO: 177224 - protein, 9 aa, Artificial Sequence
  Description of Artificial Sequence: Synthetic peptide
  Seed: SPVSGPGTD (TYRP1_HUMAN)
SPVSGPGTT

SEQ ID NO: 177225 - protein, 10 aa, Artificial Sequence
  Description of Artificial Sequence: Synthetic peptide
  Seed: LLLVALIFGT (TYRP1_HUMAN)
LWLVALIFGL

SEQ ID NO: 177226 - protein, 10 aa, Artificial Sequence
  Description of Artificial Sequence: Synthetic peptide
  Seed: EIIAIAVVGA (TYRP1_HUMAN)
EDIAIAVVGV

SEQ ID NO: 177227 - protein, 9 aa, Artificial Sequence
  Description of Artificial Sequence: Synthetic peptide
  Seed: NADISTFPL (TYRP1_HUMAN)
NHDISTFPV

SEQ ID NO: 177228 - protein, 9 aa, Artificial Sequence
  Description of Artificial Sequence: Synthetic peptide
  Seed: HLSPNDPIF (TYRP1_HUMAN)
HLSPNDPIW

SEQ ID NO: 177229 - protein, 9 aa, Artificial Sequence
  Description of Artificial Sequence: Synthetic peptide
  Seed: FPLENAPIG (TYRP1_HUMAN)
FTLENAPIY

SEQ ID NO: 177230 - protein, 9 aa, Artificial Sequence
  Description of Artificial Sequence: Synthetic peptide
  Seed: RGRCEAVTA (TYRP1_HUMAN)
RTRCEAVTM

SEQ ID NO: 177231 - protein, 9 aa, Artificial Sequence
  Description of Artificial Sequence: Synthetic peptide
  Seed: HEGPAFLTW (TYRP1_HUMAN)
HTGPAFLTM

SEQ ID NO: 177232 - protein, 9 aa, Artificial Sequence
  Description of Artificial Sequence: Synthetic peptide
  Seed: VPFWPPVTN (TYRP1_HUMAN)
VPFWPPVTL

SEQ ID NO: 177233 - protein, 11 aa, Artificial Sequence
  Description of Artificial Sequence: Synthetic peptide
  Seed: YSDPTGKYDPA (TYRP1_HUMAN)
YLDPTGKYDPL

SEQ ID NO: 177234 - protein, 11 aa, Artificial Sequence
  Description of Artificial Sequence: Synthetic peptide
  Seed: VTAPDNLGYTY (TYRP1_HUMAN)
VSAPDNLGYTL

SEQ ID NO: 177235 - protein, 10 aa, Artificial Sequence
  Description of Artificial Sequence: Synthetic peptide
  Seed: LENAPIGHNR (TYRP1_HUMAN)
LTNAPIGHNK

SEQ ID NO: 177236 - protein, 9 aa, Artificial Sequence
  Description of Artificial Sequence: Synthetic peptide
  Seed: RRSEEILGP (TYRP1_HUMAN)
RRSEEILGL

SEQ ID NO: 177237 - protein, 9 aa, Artificial Sequence
  Description of Artificial Sequence: Synthetic peptide
  Seed: EEKNHFVRA (TYRP1_HUMAN)
EEKNHFVRY

SEQ ID NO: 177238 - protein, 9 aa, Artificial Sequence
  Description of Artificial Sequence: Synthetic peptide
  Seed: AVVGALLLV (TYRP1_HUMAN)
AIVGALLLW

SEQ ID NO: 177239 - protein, 9 aa, Artificial Sequence
  Description of Artificial Sequence: Synthetic peptide
  Seed: EGYSDPTGK (TYRP1_HUMAN)
EVYSDPTGY

SEQ ID NO: 177240 - protein, 10 aa, Artificial Sequence
  Description of Artificial Sequence: Synthetic peptide
  Seed: KRTTHPLFVI (TYRP1_HUMAN)
KRTTHPLFVM

SEQ ID NO: 177241 - protein, 10 aa, Artificial Sequence
  Description of Artificial Sequence: Synthetic peptide
  Seed: TFTDAVFDEW (TYRP1_HUMAN)
TYTDAVFDEL

SEQ ID NO: 177242 - protein, 9 aa, Artificial Sequence
  Description of Artificial Sequence: Synthetic peptide
  Seed: SPNDPIFVL (TYRP1_HUMAN)
SSNDPIFVF

SEQ ID NO: 177243 - protein, 9 aa, Artificial Sequence
  Description of Artificial Sequence: Synthetic peptide
  Seed: MAKRTTHPL (TYRP1_HUMAN)
MAKRTTHPY

SEQ ID NO: 177244 - protein, 9 aa, Artificial Sequence
  Description of Artificial Sequence: Synthetic peptide
  Seed: IYNYFVWTH (TYRP1_HUMAN)
IGNYFVWTK

SEQ ID NO: 177245 - protein, 10 aa, Artificial Sequence
  Description of Artificial Sequence: Synthetic peptide
  Seed: YNADISTFPL (TYRP1_HUMAN)
YWADISTFPL

SEQ ID NO: 177246 - protein, 11 aa, Artificial Sequence
  Description of Artificial Sequence: Synthetic peptide
  Seed: YNMVPFWPPVT (TYRP1_HUMAN)
YIMVPFWPPVT

SEQ ID NO: 177247 - protein, 10 aa, Artificial Sequence
  Description of Artificial Sequence: Synthetic peptide
  Seed: FVWTHYYSVK (TYRP1_HUMAN)
FLWTHYYSVL

SEQ ID NO: 177248 - protein, 9 aa, Artificial Sequence
  Description of Artificial Sequence: Synthetic peptide
  Seed: AFLTWHRYH (TYRP1_HUMAN)
AFLTWHRYR

SEQ ID NO: 177249 - protein, 9 aa, Artificial Sequence
  Description of Artificial Sequence: Synthetic peptide
  Seed: IAVVGALLL (TYRP1_HUMAN)
IAVVGALLY

SEQ ID NO: 177250 - protein, 8 aa, Artificial Sequence
  Description of Artificial Sequence: Synthetic peptide
  Seed: FSHEGPAF (TYRP1_HUMAN)
FYHEGPAI

SEQ ID NO: 177251 - protein, 9 aa, Artificial Sequence
  Description of Artificial Sequence: Synthetic peptide
  Seed: VVGALLLVA (TYRP1_HUMAN)
VMGALLLVV

SEQ ID NO: 177252 - protein, 11 aa, Artificial Sequence
  Description of Artificial Sequence: Synthetic peptide
  Seed: KTFLGVGQESF (TYRP1_HUMAN)
KMFLGVGQESW

SEQ ID NO: 177253 - protein, 9 aa, Artificial Sequence
  Description of Artificial Sequence: Synthetic peptide
  Seed: MLQEPSFSL (TYRP1_HUMAN)
MAQEPSFSW

SEQ ID NO: 177254 - protein, 10 aa, Artificial Sequence
  Description of Artificial Sequence: Synthetic peptide
  Seed: KYDPAVRSLH (TYRP1_HUMAN)
KLDPAVRSLY

SEQ ID NO: 177255 - protein, 9 aa, Artificial Sequence
  Description of Artificial Sequence: Synthetic peptide
  Seed: EPQDVAQCL (TYRP1_HUMAN)
EAQDVAQCF

SEQ ID NO: 177256 - protein, 11 aa, Artificial Sequence
  Description of Artificial Sequence: Synthetic peptide
  Seed: YNYFVWTHYYS (TYRP1_HUMAN)
YFYFVWTHYYR

SEQ ID NO: 177257 - protein, 10 aa, Artificial Sequence
  Description of Artificial Sequence: Synthetic peptide
  Seed: VDFSHEGPAF (TYRP1_HUMAN)
VIFSHEGPAY

SEQ ID NO: 177258 - protein, 9 aa, Artificial Sequence
  Description of Artificial Sequence: Synthetic peptide
  Seed: NMVPFWPPV (TYRP1_HUMAN)
NTVPFWPPA

SEQ ID NO: 177259 - protein, 10 aa, Artificial Sequence
  Description of Artificial Sequence: Synthetic peptide
  Seed: KLQNPNQSVV (TYRP1_HUMAN)
KQQNPNQSVW

SEQ ID NO: 177260 - protein, 9 aa, Artificial Sequence
  Description of Artificial Sequence: Synthetic peptide
  Seed: SREFSVPEI (TYRP1_HUMAN)
SHEFSVPEI

SEQ ID NO: 177261 - protein, 10 aa, Artificial Sequence
  Description of Artificial Sequence: Synthetic peptide
  Seed: SREFSVPEII (TYRP1_HUMAN)
SEEFSVPEIL

SEQ ID NO: 177262 - protein, 9 aa, Artificial Sequence
  Description of Artificial Sequence: Synthetic peptide
  Seed: FSHEGPAFL (TYRP1_HUMAN)
FSHEGPAFI

SEQ ID NO: 177263 - protein, 9 aa, Artificial Sequence
  Description of Artificial Sequence: Synthetic peptide
  Seed: DYDTLGTLC (TYRP1_HUMAN)
DFDTLGTLV

SEQ ID NO: 177264 - protein, 9 aa, Artificial Sequence
  Description of Artificial Sequence: Synthetic peptide
  Seed: QEMLQEPSF (TYRP1_HUMAN)
QAMLQEPSY

SEQ ID NO: 177265 - protein, 9 aa, Artificial Sequence
  Description of Artificial Sequence: Synthetic peptide
  Seed: FSVPEIIAI (TYRP1_HUMAN)
FMVPEIIAT

SEQ ID NO: 177266 - protein, 9 aa, Artificial Sequence
  Description of Artificial Sequence: Synthetic peptide
  Seed: LFQQARAQF (TYRP1_HUMAN)
LAQQARAQY

SEQ ID NO: 177267 - protein, 10 aa, Artificial Sequence
  Description of Artificial Sequence: Synthetic peptide
  Seed: YSNSTNSFRN (TYRP1_HUMAN)
YTNSTNSFRY

SEQ ID NO: 177268 - protein, 9 aa, Artificial Sequence
  Description of Artificial Sequence: Synthetic peptide
  Seed: MAKRTTHPL (TYRP1_HUMAN)
MTKRTTHPR

SEQ ID NO: 177269 - protein, 10 aa, Artificial Sequence
  Description of Artificial Sequence: Synthetic peptide
  Seed: FVTAPDNLGY (TYRP1_HUMAN)
FETAPDNLGW

SEQ ID NO: 177270 - protein, 10 aa, Artificial Sequence
  Description of Artificial Sequence: Synthetic peptide
  Seed: FVWTHYYSVK (TYRP1_HUMAN)
FMWTHYYSVM

SEQ ID NO: 177271 - protein, 9 aa, Artificial Sequence
  Description of Artificial Sequence: Synthetic peptide
  Seed: MSAPKLLSL (TYRP1_HUMAN)
MIAPKLLSI

SEQ ID NO: 177272 - protein, 10 aa, Artificial Sequence
  Description of Artificial Sequence: Synthetic peptide
  Seed: HPLFVIATRR (TYRP1_HUMAN)
HALFVIATRK

SEQ ID NO: 177273 - protein, 10 aa, Artificial Sequence
  Description of Artificial Sequence: Synthetic peptide
  Seed: SHEGPAFLTW (TYRP1_HUMAN)
SMEGPAFLTW

SEQ ID NO: 177274 - protein, 9 aa, Artificial Sequence
  Description of Artificial Sequence: Synthetic peptide
  Seed: IGHNRQYNM (TYRP1_HUMAN)
IRHNRQYNF

SEQ ID NO: 177275 - protein, 9 aa, Artificial Sequence
  Description of Artificial Sequence: Synthetic peptide
  Seed: STLISPNSV (TYRP1_HUMAN)
SVLISPNSW

SEQ ID NO: 177276 - protein, 9 aa, Artificial Sequence
  Description of Artificial Sequence: Synthetic peptide
  Seed: NVARPMVQR (TYRP1_HUMAN)
NFARPMVQR

SEQ ID NO: 177277 - protein, 9 aa, Artificial Sequence
  Description of Artificial Sequence: Synthetic peptide
  Seed: NADISTFPL (TYRP1_HUMAN)
NIDISTFPV

SEQ ID NO: 177278 - protein, 9 aa, Artificial Sequence
  Description of Artificial Sequence: Synthetic peptide
  Seed: REFSVPEII (TYRP1_HUMAN)
REFSVPEIV

SEQ ID NO: 177279 - protein, 9 aa, Artificial Sequence
  Description of Artificial Sequence: Synthetic peptide
  Seed: ISIYNYFVW (TYRP1_HUMAN)
IGIYNYFVY

SEQ ID NO: 177280 - protein, 10 aa, Artificial Sequence
  Description of Artificial Sequence: Synthetic peptide
  Seed: LLLVALIFGT (TYRP1_HUMAN)
LMLVALIFGV

SEQ ID NO: 177281 - protein, 11 aa, Artificial Sequence
  Description of Artificial Sequence: Synthetic peptide
  Seed: HLSPNDPIFVL (TYRP1_HUMAN)
HQSPNDPIFVL

SEQ ID NO: 177282 - protein, 9 aa, Artificial Sequence
  Description of Artificial Sequence: Synthetic peptide
  Seed: FENISIYNY (TYRP1_HUMAN)
FLNISIYNY

SEQ ID NO: 177283 - protein, 10 aa, Artificial Sequence
  Description of Artificial Sequence: Synthetic peptide
  Seed: SHEGPAFLTW (TYRP1_HUMAN)
SHEGPAFLTV

SEQ ID NO: 177284 - protein, 10 aa, Artificial Sequence
  Description of Artificial Sequence: Synthetic peptide
  Seed: STFPLENAPI (TYRP1_HUMAN)
SVFPLENAPV

SEQ ID NO: 177285 - protein, 9 aa, Artificial Sequence
  Description of Artificial Sequence: Synthetic peptide
  Seed: FTDAVFDEW (TYRP1_HUMAN)
FMDAVFDEY

SEQ ID NO: 177286 - protein, 10 aa, Artificial Sequence
  Description of Artificial Sequence: Synthetic peptide
  Seed: TPQFENISIY (TYRP1_HUMAN)
THQFENISIF

SEQ ID NO: 177287 - protein, 9 aa, Artificial Sequence
  Description of Artificial Sequence: Synthetic peptide
  Seed: FENISIYNY (TYRP1_HUMAN)
FSNISIYNY

SEQ ID NO: 177288 - protein, 11 aa, Artificial Sequence
  Description of Artificial Sequence: Synthetic peptide
  Seed: YNYFVWTHYYS (TYRP1_HUMAN)
YGYFVWTHYYY

SEQ ID NO: 177289 - protein, 9 aa, Artificial Sequence
  Description of Artificial Sequence: Synthetic peptide
  Seed: SHEGPAFLT (TYRP1_HUMAN)
SHEGPAFLM

SEQ ID NO: 177290 - protein, 10 aa, Artificial Sequence
  Description of Artificial Sequence: Synthetic peptide
  Seed: ALIFGTASYL (TYRP1_HUMAN)
AQIFGTASYE

SEQ ID NO: 177291 - protein, 9 aa, Artificial Sequence
  Description of Artificial Sequence: Synthetic peptide
  Seed: MCCPDLSPV (TYRP1_HUMAN)
MMCPDLSPL

SEQ ID NO: 177292 - protein, 9 aa, Artificial Sequence
  Description of Artificial Sequence: Synthetic peptide
  Seed: RQCATVEAL (TYRP1_HUMAN)
RTCATVEAY

SEQ ID NO: 177293 - protein, 9 aa, Artificial Sequence
  Description of Artificial Sequence: Synthetic peptide
  Seed: RQCATVEAL (TYRP1_HUMAN)
RNCATVEAY

SEQ ID NO: 177294 - protein, 11 aa, Artificial Sequence
  Description of Artificial Sequence: Synthetic peptide
  Seed: SLPYWNFATGK (TYRP1_HUMAN)
SMPYWNFATGR

SEQ ID NO: 177295 - protein, 9 aa, Artificial Sequence
  Description of Artificial Sequence: Synthetic peptide
  Seed: LGYTYEIQW (TYRP1_HUMAN)
LSYTYEIQL

SEQ ID NO: 177296 - protein, 9 aa, Artificial Sequence
  Description of Artificial Sequence: Synthetic peptide
  Seed: FSVPEIIAI (TYRP1_HUMAN)
FPVPEIIAV

SEQ ID NO: 177297 - protein, 10 aa, Artificial Sequence
  Description of Artificial Sequence: Synthetic peptide
  Seed: FVWTHYYSVK (TYRP1_HUMAN)
FMWTHYYSVH

SEQ ID NO: 177298 - protein, 9 aa, Artificial Sequence
  Description of Artificial Sequence: Synthetic peptide
  Seed: IVRRNLLDL (TYRP1_HUMAN)
ITRRNLLDA

SEQ ID NO: 177299 - protein, 9 aa, Artificial Sequence
  Description of Artificial Sequence: Synthetic peptide
  Seed: FTDAVFDEW (TYRP1_HUMAN)
FWDAVFDEM

SEQ ID NO: 177300 - protein, 9 aa, Artificial Sequence
  Description of Artificial Sequence: Synthetic peptide
  Seed: SFSLPYWNF (TYRP1_HUMAN)
SWSLPYWNM

SEQ ID NO: 177301 - protein, 9 aa, Artificial Sequence
  Description of Artificial Sequence: Synthetic peptide
  Seed: DYDTLGTLC (TYRP1_HUMAN)
DFDTLGTLF

SEQ ID NO: 177302 - protein, 11 aa, Artificial Sequence
  Description of Artificial Sequence: Synthetic peptide
  Seed: FVLLHTFTDAV (TYRP1_HUMAN)
FILLHTFTDAV

SEQ ID NO: 177303 - protein, 9 aa, Artificial Sequence
  Description of Artificial Sequence: Synthetic peptide
  Seed: MLQEPSFSL (TYRP1_HUMAN)
MPQEPSFSC

SEQ ID NO: 177304 - protein, 9 aa, Artificial Sequence
  Description of Artificial Sequence: Synthetic peptide
  Seed: MAKRTTHPL (TYRP1_HUMAN)
MVKRTTHPF

SEQ ID NO: 177305 - protein, 9 aa, Artificial Sequence
  Description of Artificial Sequence: Synthetic peptide
  Seed: RSNFDSTLI (TYRP1_HUMAN)
RGNFDSTLW

SEQ ID NO: 177306 - protein, 9 aa, Artificial Sequence
  Description of Artificial Sequence: Synthetic peptide
  Seed: SLHNLAHLF (TYRP1_HUMAN)
SFHNLAHLM

SEQ ID NO: 177307 - protein, 10 aa, Artificial Sequence
  Description of Artificial Sequence: Synthetic peptide
  Seed: FGTASYLIRA (TYRP1_HUMAN)
FQTASYLIRI

SEQ ID NO: 177308 - protein, 9 aa, Artificial Sequence
  Description of Artificial Sequence: Synthetic peptide
  Seed: SVPEIIAIA (TYRP1_HUMAN)
SAPEIIAIM

SEQ ID NO: 177309 - protein, 9 aa, Artificial Sequence
  Description of Artificial Sequence: Synthetic peptide
  Seed: RQCATVEAL (TYRP1_HUMAN)
RECATVEAT

SEQ ID NO: 177310 - protein, 9 aa, Artificial Sequence
  Description of Artificial Sequence: Synthetic peptide
  Seed: RQCATVEAL (TYRP1_HUMAN)
RQCATVEAY

SEQ ID NO: 177311 - protein, 9 aa, Artificial Sequence
  Description of Artificial Sequence: Synthetic peptide
  Seed: IYNYFVWTH (TYRP1_HUMAN)
IYNYFVWTL

SEQ ID NO: 177312 - protein, 9 aa, Artificial Sequence
  Description of Artificial Sequence: Synthetic peptide
  Seed: AVVGALLLV (TYRP1_HUMAN)
AMVGALLLM

SEQ ID NO: 177313 - protein, 9 aa, Artificial Sequence
  Description of Artificial Sequence: Synthetic peptide
  Seed: KYDPAVRSL (TYRP1_HUMAN)
KYDPAVRSV

SEQ ID NO: 177314 - protein, 9 aa, Artificial Sequence
  Description of Artificial Sequence: Synthetic peptide
  Seed: GPAFLTWHR (TYRP1_HUMAN)
GYAFLTWHR

SEQ ID NO: 177315 - protein, 9 aa, Artificial Sequence
  Description of Artificial Sequence: Synthetic peptide
  Seed: FVWTHYYSV (TYRP1_HUMAN)
FSWTHYYSM

SEQ ID NO: 177316 - protein, 9 aa, Artificial Sequence
  Description of Artificial Sequence: Synthetic peptide
  Seed: IAIAVVGAL (TYRP1_HUMAN)
IAIAVVGAH

SEQ ID NO: 177317 - protein, 9 aa, Artificial Sequence
  Description of Artificial Sequence: Synthetic peptide
  Seed: NGTGGQTHL (TYRP1_HUMAN)
NATGGQTHF

SEQ ID NO: 177318 - protein, 10 aa, Artificial Sequence
  Description of Artificial Sequence: Synthetic peptide
  Seed: MAKRTTHPLF (TYRP1_HUMAN)
MQKRTTHPLM

SEQ ID NO: 177319 - protein, 10 aa, Artificial Sequence
  Description of Artificial Sequence: Synthetic peptide
  Seed: RLEKDMQEML (TYRP1_HUMAN)
RLEKDMQEMF

SEQ ID NO: 177320 - protein, 9 aa, Artificial Sequence
  Description of Artificial Sequence: Synthetic peptide
  Seed: SVPEIIAIA (TYRP1_HUMAN)
SAPEIIAIY

SEQ ID NO: 177321 - protein, 10 aa, Artificial Sequence
  Description of Artificial Sequence: Synthetic peptide
  Seed: EMLQEPSFSL (TYRP1_HUMAN)
EWLQEPSFSI

SEQ ID NO: 177322 - protein, 9 aa, Artificial Sequence
  Description of Artificial Sequence: Synthetic peptide
  Seed: KLLSLGCIF (TYRP1_HUMAN)
KELSLGCIF

SEQ ID NO: 177323 - protein, 9 aa, Artificial Sequence
  Description of Artificial Sequence: Synthetic peptide
  Seed: KLLSLGCIF (TYRP1_HUMAN)
KMLSLGCIW

SEQ ID NO: 177324 - protein, 10 aa, Artificial Sequence
  Description of Artificial Sequence: Synthetic peptide
  Seed: VDFSHEGPAF (TYRP1_HUMAN)
VVFSHEGPAF

SEQ ID NO: 177325 - protein, 10 aa, Artificial Sequence
  Description of Artificial Sequence: Synthetic peptide
  Seed: FWPPVTNTEM (TYRP1_HUMAN)
FWPPVTNTEY

SEQ ID NO: 177326 - protein, 10 aa, Artificial Sequence
  Description of Artificial Sequence: Synthetic peptide
  Seed: KRTTHPLFVI (TYRP1_HUMAN)
KMTTHPLFVW

SEQ ID NO: 177327 - protein, 9 aa, Artificial Sequence
  Description of Artificial Sequence: Synthetic peptide
  Seed: FVRALDMAK (TYRP1_HUMAN)
FFRALDMAR

SEQ ID NO: 177328 - protein, 11 aa, Artificial Sequence
  Description of Artificial Sequence: Synthetic peptide
  Seed: ALIFGTASYLI (TYRP1_HUMAN)
AYIFGTASYLV

SEQ ID NO: 177329 - protein, 9 aa, Artificial Sequence
  Description of Artificial Sequence: Synthetic peptide
  Seed: ISIYNYFVW (TYRP1_HUMAN)
INIYNYFVY

SEQ ID NO: 177330 - protein, 9 aa, Artificial Sequence
  Description of Artificial Sequence: Synthetic peptide
  Seed: GLFDTPPFY (TYRP1_HUMAN)
GAFDTPPFY

SEQ ID NO: 177331 - protein, 10 aa, Artificial Sequence
  Description of Artificial Sequence: Synthetic peptide
  Seed: LIFGTASYLI (TYRP1_HUMAN)
LYFGTASYLL

SEQ ID NO: 177332 - protein, 10 aa, Artificial Sequence
  Description of Artificial Sequence: Synthetic peptide
  Seed: ALIFGTASYL (TYRP1_HUMAN)
AMIFGTASYW

SEQ ID NO: 177333 - protein, 9 aa, Artificial Sequence
  Description of Artificial Sequence: Synthetic peptide
  Seed: RPMVQRLPE (TYRP1_HUMAN)
RLMVQRLPL

SEQ ID NO: 177334 - protein, 10 aa, Artificial Sequence
  Description of Artificial Sequence: Synthetic peptide
  Seed: FYSNSTNSFR (TYRP1_HUMAN)
FYSNSTNSFV

SEQ ID NO: 177335 - protein, 9 aa, Artificial Sequence
  Description of Artificial Sequence: Synthetic peptide
  Seed: YTYEIQWPS (TYRP1_HUMAN)
YWYEIQWPL

SEQ ID NO: 177336 - protein, 9 aa, Artificial Sequence
  Description of Artificial Sequence: Synthetic peptide
  Seed: FVWTHYYSV (TYRP1_HUMAN)
FGWTHYYSY

SEQ ID NO: 177337 - protein, 9 aa, Artificial Sequence
  Description of Artificial Sequence: Synthetic peptide
  Seed: RTTHPLFVI (TYRP1_HUMAN)
RTTHPLFVV

SEQ ID NO: 177338 - protein, 9 aa, Artificial Sequence
  Description of Artificial Sequence: Synthetic peptide
  Seed: APIGHNRQY (TYRP1_HUMAN)
APIGHNRQF

SEQ ID NO: 177339 - protein, 9 aa, Artificial Sequence
  Description of Artificial Sequence: Synthetic peptide
  Seed: FVWTHYYSV (TYRP1_HUMAN)
FIWTHYYSR

SEQ ID NO: 177340 - protein, 10 aa, Artificial Sequence
  Description of Artificial Sequence: Synthetic peptide
  Seed: LSPNDPIFVL (TYRP1_HUMAN)
LGPNDPIFVW

SEQ ID NO: 177341 - protein, 10 aa, Artificial Sequence
  Description of Artificial Sequence: Synthetic peptide
  Seed: FVWTHYYSVK (TYRP1_HUMAN)
FIWTHYYSVE

SEQ ID NO: 177342 - protein, 9 aa, Artificial Sequence
  Description of Artificial Sequence: Synthetic peptide
  Seed: SPNDPIFVL (TYRP1_HUMAN)
SANDPIFVM

SEQ ID NO: 177343 - protein, 10 aa, Artificial Sequence
  Description of Artificial Sequence: Synthetic peptide
  Seed: FSLPYWNFAT (TYRP1_HUMAN)
FLLPYWNFAT

SEQ ID NO: 177344 - protein, 10 aa, Artificial Sequence
  Description of Artificial Sequence: Synthetic peptide
  Seed: YNYFVWTHYY (TYRP1_HUMAN)
YPYFVWTHYV

SEQ ID NO: 177345 - protein, 9 aa, Artificial Sequence
  Description of Artificial Sequence: Synthetic peptide
  Seed: ISIYNYFVW (TYRP1_HUMAN)
IQIYNYFVL

SEQ ID NO: 177346 - protein, 9 aa, Artificial Sequence
  Description of Artificial Sequence: Synthetic peptide
  Seed: SIYNYFVWT (TYRP1_HUMAN)
SVYNYFVWA

SEQ ID NO: 177347 - protein, 9 aa, Artificial Sequence
  Description of Artificial Sequence: Synthetic peptide
  Seed: SLHNLAHLF (TYRP1_HUMAN)
SQHNLAHLY

SEQ ID NO: 177348 - protein, 11 aa, Artificial Sequence
  Description of Artificial Sequence: Synthetic peptide
  Seed: TVEGYSDPTGK (TYRP1_HUMAN)
TAEGYSDPTGY

SEQ ID NO: 177349 - protein, 11 aa, Artificial Sequence
  Description of Artificial Sequence: Synthetic peptide
  Seed: YTYEIQWPSRE (TYRP1_HUMAN)
YMYEIQWPSRR

SEQ ID NO: 177350 - protein, 9 aa, Artificial Sequence
  Description of Artificial Sequence: Synthetic peptide
  Seed: QEPSFSLPY (TYRP1_HUMAN)
QRPSFSLPY

SEQ ID NO: 177351 - protein, 10 aa, Artificial Sequence
  Description of Artificial Sequence: Synthetic peptide
  Seed: LSPNDPIFVL (TYRP1_HUMAN)
LPPNDPIFVY

SEQ ID NO: 177352 - protein, 11 aa, Artificial Sequence
  Description of Artificial Sequence: Synthetic peptide
  Seed: VTAPDNLGYTY (TYRP1_HUMAN)
VSAPDNLGYTF

SEQ ID NO: 177353 - protein, 10 aa, Artificial Sequence
  Description of Artificial Sequence: Synthetic peptide
  Seed: MAKRTTHPLF (TYRP1_HUMAN)
MPKRTTHPLD

SEQ ID NO: 177354 - protein, 10 aa, Artificial Sequence
  Description of Artificial Sequence: Synthetic peptide
  Seed: EMLQEPSFSL (TYRP1_HUMAN)
EVLQEPSFSV

SEQ ID NO: 177355 - protein, 9 aa, Artificial Sequence
  Description of Artificial Sequence: Synthetic peptide
  Seed: HEGPAFLTW (TYRP1_HUMAN)
HIGPAFLTM

SEQ ID NO: 177356 - protein, 9 aa, Artificial Sequence
  Description of Artificial Sequence: Synthetic peptide
  Seed: AQFPRQCAT (TYRP1_HUMAN)
AAFPRQCAL

SEQ ID NO: 177357 - protein, 10 aa, Artificial Sequence
  Description of Artificial Sequence: Synthetic peptide
  Seed: RSLHNLAHLF (TYRP1_HUMAN)
RWLHNLAHLW

SEQ ID NO: 177358 - protein, 9 aa, Artificial Sequence
  Description of Artificial Sequence: Synthetic peptide
  Seed: ENAPIGHNR (TYRP1_HUMAN)
EYAPIGHNK

SEQ ID NO: 177359 - protein, 10 aa, Artificial Sequence
  Description of Artificial Sequence: Synthetic peptide
  Seed: LGPDGNTPQF (TYRP1_HUMAN)
LAPDGNTPQI

SEQ ID NO: 177360 - protein, 9 aa, Artificial Sequence
  Description of Artificial Sequence: Synthetic peptide
  Seed: AACDQRVLI (TYRP1_HUMAN)
AMCDQRVLF

SEQ ID NO: 177361 - protein, 10 aa, Artificial Sequence
  Description of Artificial Sequence: Synthetic peptide
  Seed: FVLLHTFTDA (TYRP1_HUMAN)
FALLHTFTDV

SEQ ID NO: 177362 - protein, 9 aa, Artificial Sequence
  Description of Artificial Sequence: Synthetic peptide
  Seed: RAQFPRQCA (TYRP1_HUMAN)
RTQFPRQCI

SEQ ID NO: 177363 - protein, 9 aa, Artificial Sequence
  Description of Artificial Sequence: Synthetic peptide
  Seed: GPDGNTPQF (TYRP1_HUMAN)
GCDGNTPQL

SEQ ID NO: 177364 - protein, 9 aa, Artificial Sequence
  Description of Artificial Sequence: Synthetic peptide
  Seed: RLPEPQDVA (TYRP1_HUMAN)
RQPEPQDVI

SEQ ID NO: 177365 - protein, 9 aa, Artificial Sequence
  Description of Artificial Sequence: Synthetic peptide
  Seed: IIAIAVVGA (TYRP1_HUMAN)
IVAIAVVGI

SEQ ID NO: 177366 - protein, 10 aa, Artificial Sequence
  Description of Artificial Sequence: Synthetic peptide
  Seed: GKYDPAVRSL (TYRP1_HUMAN)
GYYDPAVRSY

SEQ ID NO: 177367 - protein, 9 aa, Artificial Sequence
  Description of Artificial Sequence: Synthetic peptide
  Seed: HLSPNDPIF (TYRP1_HUMAN)
HVSPNDPIL

SEQ ID NO: 177368 - protein, 11 aa, Artificial Sequence
  Description of Artificial Sequence: Synthetic peptide
  Seed: QEMLQEPSFSL (TYRP1_HUMAN)
QRMLQEPSFSL

SEQ ID NO: 177369 - protein, 11 aa, Artificial Sequence
  Description of Artificial Sequence: Synthetic peptide
  Seed: SLPYWNFATGK (TYRP1_HUMAN)
SPPYWNFATGR

SEQ ID NO: 177370 - protein, 10 aa, Artificial Sequence
  Description of Artificial Sequence: Synthetic peptide
  Seed: TDAVFDEWLR (TYRP1_HUMAN)
TKAVFDEWLR

SEQ ID NO: 177371 - protein, 9 aa, Artificial Sequence
  Description of Artificial Sequence: Synthetic peptide
  Seed: HEGPAFLTW (TYRP1_HUMAN)
HSGPAFLTH

SEQ ID NO: 177372 - protein, 10 aa, Artificial Sequence
  Description of Artificial Sequence: Synthetic peptide
  Seed: GKYDPAVRSL (TYRP1_HUMAN)
GQYDPAVRSY

SEQ ID NO: 177373 - protein, 10 aa, Artificial Sequence
  Description of Artificial Sequence: Synthetic peptide
  Seed: YNADISTFPL (TYRP1_HUMAN)
YSADISTFPF

SEQ ID NO: 177374 - protein, 9 aa, Artificial Sequence
  Description of Artificial Sequence: Synthetic peptide
  Seed: LTWHRYHLL (TYRP1_HUMAN)
LQWHRYHLV

SEQ ID NO: 177375 - protein, 9 aa, Artificial Sequence
  Description of Artificial Sequence: Synthetic peptide
  Seed: NVARPMVQR (TYRP1_HUMAN)
NWARPMVQR

SEQ ID NO: 177376 - protein, 9 aa, Artificial Sequence
  Description of Artificial Sequence: Synthetic peptide
  Seed: RPMVQRLPE (TYRP1_HUMAN)
RMMVQRLPM

SEQ ID NO: 177377 - protein, 9 aa, Artificial Sequence
  Description of Artificial Sequence: Synthetic peptide
  Seed: FSHEGPAFL (TYRP1_HUMAN)
FPHEGPAFF

SEQ ID NO: 177378 - protein, 10 aa, Artificial Sequence
  Description of Artificial Sequence: Synthetic peptide
  Seed: RSMDEANQPL (TYRP1_HUMAN)
RRMDEANQPF

SEQ ID NO: 177379 - protein, 9 aa, Artificial Sequence
  Description of Artificial Sequence: Synthetic peptide
  Seed: SLHNLAHLF (TYRP1_HUMAN)
SAHNLAHLM

SEQ ID NO: 177380 - protein, 10 aa, Artificial Sequence
  Description of Artificial Sequence: Synthetic peptide
  Seed: LLLVALIFGT (TYRP1_HUMAN)
LRLVALIFGL

SEQ ID NO: 177381 - protein, 9 aa, Artificial Sequence
  Description of Artificial Sequence: Synthetic peptide
  Seed: YTYEIQWPS (TYRP1_HUMAN)
YPYEIQWPR

SEQ ID NO: 177382 - protein, 10 aa, Artificial Sequence
  Description of Artificial Sequence: Synthetic peptide
  Seed: LSLGCIFFPL (TYRP1_HUMAN)
LSLGCIFFPI

SEQ ID NO: 177383 - protein, 10 aa, Artificial Sequence
  Description of Artificial Sequence: Synthetic peptide
  Seed: MAKRTTHPLF (TYRP1_HUMAN)
MSKRTTHPLF

SEQ ID NO: 177384 - protein, 10 aa, Artificial Sequence
  Description of Artificial Sequence: Synthetic peptide
  Seed: SIYNYFVWTH (TYRP1_HUMAN)
SAYNYFVWTR

SEQ ID NO: 177385 - protein, 9 aa, Artificial Sequence
  Description of Artificial Sequence: Synthetic peptide
  Seed: RFFNRTCHC (TYRP1_HUMAN)
RQFNRTCHK

SEQ ID NO: 177386 - protein, 9 aa, Artificial Sequence
  Description of Artificial Sequence: Synthetic peptide
  Seed: LTWHRYHLL (TYRP1_HUMAN)
LAWHRYHLL

SEQ ID NO: 177387 - protein, 9 aa, Artificial Sequence
  Description of Artificial Sequence: Synthetic peptide
  Seed: MDEANQPLL (TYRP1_HUMAN)
MEEANQPLV

SEQ ID NO: 177388 - protein, 9 aa, Artificial Sequence
  Description of Artificial Sequence: Synthetic peptide
  Seed: NFDSTLISP (TYRP1_HUMAN)
NYDSTLISF

SEQ ID NO: 177389 - protein, 9 aa, Artificial Sequence
  Description of Artificial Sequence: Synthetic peptide
  Seed: TTHPLFVIA (TYRP1_HUMAN)
TLHPLFVII

SEQ ID NO: 177390 - protein, 10 aa, Artificial Sequence
  Description of Artificial Sequence: Synthetic peptide
  Seed: FLTWHRYHLL (TYRP1_HUMAN)
FITWHRYHLL

SEQ ID NO: 177391 - protein, 9 aa, Artificial Sequence
  Description of Artificial Sequence: Synthetic peptide
  Seed: SGHNCGTCR (TYRP1_HUMAN)
SSHNCGTCR

SEQ ID NO: 177392 - protein, 10 aa, Artificial Sequence
  Description of Artificial Sequence: Synthetic peptide
  Seed: ADSRPHSPQY (TYRP1_HUMAN)
ASSRPHSPQF

SEQ ID NO: 177393 - protein, 9 aa, Artificial Sequence
  Description of Artificial Sequence: Synthetic peptide
  Seed: IFGTASYLI (TYRP1_HUMAN)
IQGTASYLF

SEQ ID NO: 177394 - protein, 9 aa, Artificial Sequence
  Description of Artificial Sequence: Synthetic peptide
  Seed: VARPMVQRL (TYRP1_HUMAN)
VWRPMVQRY

SEQ ID NO: 177395 - protein, 11 aa, Artificial Sequence
  Description of Artificial Sequence: Synthetic peptide
  Seed: FSHEGPAFLTW (TYRP1_HUMAN)
FTHEGPAFLTY

SEQ ID NO: 177396 - protein, 9 aa, Artificial Sequence
  Description of Artificial Sequence: Synthetic peptide
  Seed: NFDSTLISP (TYRP1_HUMAN)
NWDSTLISI

SEQ ID NO: 177397 - protein, 10 aa, Artificial Sequence
  Description of Artificial Sequence: Synthetic peptide
  Seed: FPLENAPIGH (TYRP1_HUMAN)
FPLENAPIGY

SEQ ID NO: 177398 - protein, 9 aa, Artificial Sequence
  Description of Artificial Sequence: Synthetic peptide
  Seed: MSAPKLLSL (TYRP1_HUMAN)
MFAPKLLSF

SEQ ID NO: 177399 - protein, 10 aa, Artificial Sequence
  Description of Artificial Sequence: Synthetic peptide
  Seed: QCYAEEYEKL (TYRP1_HUMAN)
QQYAEEYEKF

SEQ ID NO: 177400 - protein, 9 aa, Artificial Sequence
  Description of Artificial Sequence: Synthetic peptide
  Seed: LTDQYQCYA (TYRP1_HUMAN)
LGDQYQCYM

SEQ ID NO: 177401 - protein, 9 aa, Artificial Sequence
  Description of Artificial Sequence: Synthetic peptide
  Seed: MLQEPSFSL (TYRP1_HUMAN)
MLQEPSFSY

SEQ ID NO: 177402 - protein, 10 aa, Artificial Sequence
  Description of Artificial Sequence: Synthetic peptide
  Seed: AQFPRQCATV (TYRP1_HUMAN)
AIFPRQCATV

SEQ ID NO: 177403 - protein, 9 aa, Artificial Sequence
  Description of Artificial Sequence: Synthetic peptide
  Seed: SLPYWNFAT (TYRP1_HUMAN)
SLPYWNFAA

SEQ ID NO: 177404 - protein, 8 aa, Artificial Sequence
  Description of Artificial Sequence: Synthetic peptide
  Seed: LIFGTASY (TYRP1_HUMAN)
LQFGTASF

SEQ ID NO: 177405 - protein, 9 aa, Artificial Sequence
  Description of Artificial Sequence: Synthetic peptide
  Seed: KYDPAVRSL (TYRP1_HUMAN)
KLDPAVRSC

SEQ ID NO: 177406 - protein, 11 aa, Artificial Sequence
  Description of Artificial Sequence: Synthetic peptide
  Seed: VCDSLEDYDTL (TYRP1_HUMAN)
VVDSLEDYDTM

SEQ ID NO: 177407 - protein, 10 aa, Artificial Sequence
  Description of Artificial Sequence: Synthetic peptide
  Seed: TEDGPIRRNP (TYRP1_HUMAN)
TEDGPIRRNV

SEQ ID NO: 177408 - protein, 11 aa, Artificial Sequence
  Description of Artificial Sequence: Synthetic peptide
  Seed: FPLLLFQQARA (TYRP1_HUMAN)
FRLLLFQQARV

SEQ ID NO: 177409 - protein, 9 aa, Artificial Sequence
  Description of Artificial Sequence: Synthetic peptide
  Seed: MDEANQPLL (TYRP1_HUMAN)
MAEANQPLV

SEQ ID NO: 177410 - protein, 11 aa, Artificial Sequence
  Description of Artificial Sequence: Synthetic peptide
  Seed: MLQEPSFSLPY (TYRP1_HUMAN)
MRQEPSFSLPF

SEQ ID NO: 177411 - protein, 9 aa, Artificial Sequence
  Description of Artificial Sequence: Synthetic peptide
  Seed: KLQNPNQSV (TYRP1_HUMAN)
KQQNPNQSI

SEQ ID NO: 177412 - protein, 9 aa, Artificial Sequence
  Description of Artificial Sequence: Synthetic peptide
  Seed: NMVPFWPPV (TYRP1_HUMAN)
NMVPFWPPA

SEQ ID NO: 177413 - protein, 9 aa, Artificial Sequence
  Description of Artificial Sequence: Synthetic peptide
  Seed: THPLFVIAT (TYRP1_HUMAN)
TRPLFVIAL

SEQ ID NO: 177414 - protein, 10 aa, Artificial Sequence
  Description of Artificial Sequence: Synthetic peptide
  Seed: LIFGTASYLI (TYRP1_HUMAN)
LMFGTASYLV

SEQ ID NO: 177415 - protein, 9 aa, Artificial Sequence
  Description of Artificial Sequence: Synthetic peptide
  Seed: ATRRSEEIL (TYRP1_HUMAN)
ATRRSEEIW

SEQ ID NO: 177416 - protein, 9 aa, Artificial Sequence
  Description of Artificial Sequence: Synthetic peptide
  Seed: FVWTHYYSV (TYRP1_HUMAN)
FVWTHYYSK

SEQ ID NO: 177417 - protein, 9 aa, Artificial Sequence
  Description of Artificial Sequence: Synthetic peptide
  Seed: VGQESFGEV (TYRP1_HUMAN)
VVQESFGEL

SEQ ID NO: 177418 - protein, 9 aa, Artificial Sequence
  Description of Artificial Sequence: Synthetic peptide
  Seed: VGLFDTPPF (TYRP1_HUMAN)
VTLFDTPPL

SEQ ID NO: 177419 - protein, 9 aa, Artificial Sequence
  Description of Artificial Sequence: Synthetic peptide
  Seed: LTDQYQCYA (TYRP1_HUMAN)
LSDQYQCYL

SEQ ID NO: 177420 - protein, 9 aa, Artificial Sequence
  Description of Artificial Sequence: Synthetic peptide
  Seed: ALIFGTASY (TYRP1_HUMAN)
ANIFGTASY

SEQ ID NO: 177421 - protein, 9 aa, Artificial Sequence
  Description of Artificial Sequence: Synthetic peptide
  Seed: DAVFDEWLR (TYRP1_HUMAN)
DAVFDEWLK

SEQ ID NO: 177422 - protein, 9 aa, Artificial Sequence
  Description of Artificial Sequence: Synthetic peptide
  Seed: LHNLAHLFL (TYRP1_HUMAN)
LMNLAHLFY

SEQ ID NO: 177423 - protein, 10 aa, Artificial Sequence
  Description of Artificial Sequence: Synthetic peptide
  Seed: VALIFGTASY (TYRP1_HUMAN)
VSLIFGTASW

SEQ ID NO: 177424 - protein, 11 aa, Artificial Sequence
  Description of Artificial Sequence: Synthetic peptide
  Seed: THLSPNDPIFV (TYRP1_HUMAN)
THLSPNDPIFL

SEQ ID NO: 177425 - protein, 10 aa, Artificial Sequence
  Description of Artificial Sequence: Synthetic peptide
  Seed: AVFDEWLRRY (TYRP1_HUMAN)
AYFDEWLRRY

SEQ ID NO: 177426 - protein, 10 aa, Artificial Sequence
  Description of Artificial Sequence: Synthetic peptide
  Seed: AQFPRQCATV (TYRP1_HUMAN)
AQFPRQCATF

SEQ ID NO: 177427 - protein, 9 aa, Artificial Sequence
  Description of Artificial Sequence: Synthetic peptide
  Seed: FPLENAPIG (TYRP1_HUMAN)
FVLENAPIM

SEQ ID NO: 177428 - protein, 10 aa, Artificial Sequence
  Description of Artificial Sequence: Synthetic peptide
  Seed: NYFVWTHYYS (TYRP1_HUMAN)
NFFVWTHYYR

SEQ ID NO: 177429 - protein, 10 aa, Artificial Sequence
  Description of Artificial Sequence: Synthetic peptide
  Seed: FENISIYNYF (TYRP1_HUMAN)
FMNISIYNYY

SEQ ID NO: 177430 - protein, 10 aa, Artificial Sequence
  Description of Artificial Sequence: Synthetic peptide
  Seed: FSLPYWNFAT (TYRP1_HUMAN)
FNLPYWNFAV

SEQ ID NO: 177431 - protein, 9 aa, Artificial Sequence
  Description of Artificial Sequence: Synthetic peptide
  Seed: AIAVVGALL (TYRP1_HUMAN)
AQAVVGALY

SEQ ID NO: 177432 - protein, 9 aa, Artificial Sequence
  Description of Artificial Sequence: Synthetic peptide
  Seed: FSVPEIIAI (TYRP1_HUMAN)
FAVPEIIAL

SEQ ID NO: 177433 - protein, 9 aa, Artificial Sequence
  Description of Artificial Sequence: Synthetic peptide
  Seed: YTYEIQWPS (TYRP1_HUMAN)
YVYEIQWPS

SEQ ID NO: 177434 - protein, 9 aa, Artificial Sequence
  Description of Artificial Sequence: Synthetic peptide
  Seed: VPEIIAIAV (TYRP1_HUMAN)
VPEIIAIAF

SEQ ID NO: 177435 - protein, 9 aa, Artificial Sequence
  Description of Artificial Sequence: Synthetic peptide
  Seed: FYSNSTNSF (TYRP1_HUMAN)
FMSNSTNSM

SEQ ID NO: 177436 - protein, 9 aa, Artificial Sequence
  Description of Artificial Sequence: Synthetic peptide
  Seed: FTDAVFDEW (TYRP1_HUMAN)
FQDAVFDEI

SEQ ID NO: 177437 - protein, 9 aa, Artificial Sequence
  Description of Artificial Sequence: Synthetic peptide
  Seed: FSLPYWNFA (TYRP1_HUMAN)
FTLPYWNFA

SEQ ID NO: 177438 - protein, 10 aa, Artificial Sequence
  Description of Artificial Sequence: Synthetic peptide
  Seed: TDAVFDEWLR (TYRP1_HUMAN)
TSAVFDEWLK

SEQ ID NO: 177439 - protein, 11 aa, Artificial Sequence
  Description of Artificial Sequence: Synthetic peptide
  Seed: IYNYFVWTHYY (TYRP1_HUMAN)
INNYFVWTHYL

SEQ ID NO: 177440 - protein, 10 aa, Artificial Sequence
  Description of Artificial Sequence: Synthetic peptide
  Seed: RRYNADISTF (TYRP1_HUMAN)
RPYNADISTW

SEQ ID NO: 177441 - protein, 9 aa, Artificial Sequence
  Description of Artificial Sequence: Synthetic peptide
  Seed: CYAEEYEKL (TYRP1_HUMAN)
CYAEEYEKW

SEQ ID NO: 177442 - protein, 9 aa, Artificial Sequence
  Description of Artificial Sequence: Synthetic peptide
  Seed: SPNDPIFVL (TYRP1_HUMAN)
SANDPIFVI

SEQ ID NO: 177443 - protein, 9 aa, Artificial Sequence
  Description of Artificial Sequence: Synthetic peptide
  Seed: ACDQRVLIV (TYRP1_HUMAN)
ALDQRVLIL

SEQ ID NO: 177444 - protein, 10 aa, Artificial Sequence
  Description of Artificial Sequence: Synthetic peptide
  Seed: FLNGTGGQTH (TYRP1_HUMAN)
FNNGTGGQTY

SEQ ID NO: 177445 - protein, 8 aa, Artificial Sequence
  Description of Artificial Sequence: Synthetic peptide
  Seed: ACDQRVLI (TYRP1_HUMAN)
ASDQRVLL

SEQ ID NO: 177446 - protein, 9 aa, Artificial Sequence
  Description of Artificial Sequence: Synthetic peptide
  Seed: VWPLRFFNR (TYRP1_HUMAN)
VMPLRFFNK

SEQ ID NO: 177447 - protein, 10 aa, Artificial Sequence
  Description of Artificial Sequence: Synthetic peptide
  Seed: KLLSLGCIFF (TYRP1_HUMAN)
KFLSLGCIFY

SEQ ID NO: 177448 - protein, 9 aa, Artificial Sequence
  Description of Artificial Sequence: Synthetic peptide
  Seed: VGLFDTPPF (TYRP1_HUMAN)
VPLFDTPPW

SEQ ID NO: 177449 - protein, 10 aa, Artificial Sequence
  Description of Artificial Sequence: Synthetic peptide
  Seed: YFVWTHYYSV (TYRP1_HUMAN)
YQVWTHYYSL

SEQ ID NO: 177450 - protein, 9 aa, Artificial Sequence
  Description of Artificial Sequence: Synthetic peptide
  Seed: ISIYNYFVW (TYRP1_HUMAN)
IYIYNYFVY

SEQ ID NO: 177451 - protein, 9 aa, Artificial Sequence
  Description of Artificial Sequence: Synthetic peptide
  Seed: SLGCIFFPL (TYRP1_HUMAN)
SAGCIFFPL

SEQ ID NO: 177452 - protein, 9 aa, Artificial Sequence
  Description of Artificial Sequence: Synthetic peptide
  Seed: SPNDPIFVL (TYRP1_HUMAN)
SINDPIFVF

SEQ ID NO: 177453 - protein, 10 aa, Artificial Sequence
  Description of Artificial Sequence: Synthetic peptide
  Seed: RSMDEANQPL (TYRP1_HUMAN)
RTMDEANQPF

SEQ ID NO: 177454 - protein, 9 aa, Artificial Sequence
  Description of Artificial Sequence: Synthetic peptide
  Seed: VPEIIAIAV (TYRP1_HUMAN)
VPEIIAIAA

SEQ ID NO: 177455 - protein, 8 aa, Artificial Sequence
  Description of Artificial Sequence: Synthetic peptide
  Seed: YNADISTF (TYRP1_HUMAN)
YYADISTW

SEQ ID NO: 177456 - protein, 8 aa, Artificial Sequence
  Description of Artificial Sequence: Synthetic peptide
  Seed: VSGPGTDR (TYRP1_HUMAN)
VAGPGTDL

SEQ ID NO: 177457 - protein, 9 aa, Artificial Sequence
  Description of Artificial Sequence: Synthetic peptide
  Seed: RTTHPLFVI (TYRP1_HUMAN)
RATHPLFVW

SEQ ID NO: 177458 - protein, 10 aa, Artificial Sequence
  Description of Artificial Sequence: Synthetic peptide
  Seed: EVWPLRFFNR (TYRP1_HUMAN)
EIWPLRFFNK

SEQ ID NO: 177459 - protein, 9 aa, Artificial Sequence
  Description of Artificial Sequence: Synthetic peptide
  Seed: YSNSTNSFR (TYRP1_HUMAN)
YANSTNSFR

SEQ ID NO: 177460 - protein, 9 aa, Artificial Sequence
  Description of Artificial Sequence: Synthetic peptide
  Seed: FSHEGPAFL (TYRP1_HUMAN)
FHHEGPAFF

SEQ ID NO: 177461 - protein, 10 aa, Artificial Sequence
  Description of Artificial Sequence: Synthetic peptide
  Seed: FYSNSTNSFR (TYRP1_HUMAN)
FSSNSTNSFR

SEQ ID NO: 177462 - protein, 10 aa, Artificial Sequence
  Description of Artificial Sequence: Synthetic peptide
  Seed: LSPNDPIFVL (TYRP1_HUMAN)
LCPNDPIFVF

SEQ ID NO: 177463 - protein, 11 aa, Artificial Sequence
  Description of Artificial Sequence: Synthetic peptide
  Seed: RSLHNLAHLFL (TYRP1_HUMAN)
RSLHNLAHLFF

SEQ ID NO: 177464 - protein, 9 aa, Artificial Sequence
  Description of Artificial Sequence: Synthetic peptide
  Seed: ALIFGTASY (TYRP1_HUMAN)
AHIFGTASF

SEQ ID NO: 177465 - protein, 8 aa, Artificial Sequence
  Description of Artificial Sequence: Synthetic peptide
  Seed: RQYNMVPF (TYRP1_HUMAN)
RMYNMVPY

SEQ ID NO: 177466 - protein, 11 aa, Artificial Sequence
  Description of Artificial Sequence: Synthetic peptide
  Seed: RSMDEANQPLL (TYRP1_HUMAN)
RAMDEANQPLW

SEQ ID NO: 177467 - protein, 9 aa, Artificial Sequence
  Description of Artificial Sequence: Synthetic peptide
  Seed: LLHTFTDAV (TYRP1_HUMAN)
LLHTFTDAA

SEQ ID NO: 177468 - protein, 9 aa, Artificial Sequence
  Description of Artificial Sequence: Synthetic peptide
  Seed: IAIAVVGAL (TYRP1_HUMAN)
IPIAVVGAV

SEQ ID NO: 177469 - protein, 10 aa, Artificial Sequence
  Description of Artificial Sequence: Synthetic peptide
  Seed: NVARPMVQRL (TYRP1_HUMAN)
NSARPMVQRR

SEQ ID NO: 177470 - protein, 9 aa, Artificial Sequence
  Description of Artificial Sequence: Synthetic peptide
  Seed: DSLEDYDTL (TYRP1_HUMAN)
DALEDYDTV

SEQ ID NO: 177471 - protein, 9 aa, Artificial Sequence
  Description of Artificial Sequence: Synthetic peptide
  Seed: VTAPDNLGY (TYRP1_HUMAN)
VIAPDNLGK

SEQ ID NO: 177472 - protein, 9 aa, Artificial Sequence
  Description of Artificial Sequence: Synthetic peptide
  Seed: VFDEWLRRY (TYRP1_HUMAN)
VTDEWLRRF

SEQ ID NO: 177473 - protein, 9 aa, Artificial Sequence
  Description of Artificial Sequence: Synthetic peptide
  Seed: GPDGNTPQF (TYRP1_HUMAN)
GADGNTPQV

SEQ ID NO: 177474 - protein, 9 aa, Artificial Sequence
  Description of Artificial Sequence: Synthetic peptide
  Seed: AVRSLHNLA (TYRP1_HUMAN)
ASRSLHNLI

SEQ ID NO: 177475 - protein, 9 aa, Artificial Sequence
  Description of Artificial Sequence: Synthetic peptide
  Seed: QQARAQFPR (TYRP1_HUMAN)
QFARAQFPR

SEQ ID NO: 177476 - protein, 9 aa, Artificial Sequence
  Description of Artificial Sequence: Synthetic peptide
  Seed: SIYNYFVWT (TYRP1_HUMAN)
SAYNYFVWI

SEQ ID NO: 177477 - protein, 9 aa, Artificial Sequence
  Description of Artificial Sequence: Synthetic peptide
  Seed: EGYSDPTGK (TYRP1_HUMAN)
EYYSDPTGR

SEQ ID NO: 177478 - protein, 10 aa, Artificial Sequence
  Description of Artificial Sequence: Synthetic peptide
  Seed: FVWTHYYSVK (TYRP1_HUMAN)
FIWTHYYSVN

SEQ ID NO: 177479 - protein, 11 aa, Artificial Sequence
  Description of Artificial Sequence: Synthetic peptide
  Seed: YQCYAEEYEKL (TYRP1_HUMAN)
YDCYAEEYEKF

SEQ ID NO: 177480 - protein, 9 aa, Artificial Sequence
  Description of Artificial Sequence: Synthetic peptide
  Seed: RGRCEAVTA (TYRP1_HUMAN)
RTRCEAVTF

SEQ ID NO: 177481 - protein, 9 aa, Artificial Sequence
  Description of Artificial Sequence: Synthetic peptide
  Seed: CIFFPLLLF (TYRP1_HUMAN)
CTFFPLLLF

SEQ ID NO: 177482 - protein, 10 aa, Artificial Sequence
  Description of Artificial Sequence: Synthetic peptide
  Seed: FSLPYWNFAT (TYRP1_HUMAN)
FELPYWNFAM

SEQ ID NO: 177483 - protein, 9 aa, Artificial Sequence
  Description of Artificial Sequence: Synthetic peptide
  Seed: RQYNMVPFW (TYRP1_HUMAN)
RYYNMVPFY

SEQ ID NO: 177484 - protein, 9 aa, Artificial Sequence
  Description of Artificial Sequence: Synthetic peptide
  Seed: MAKRTTHPL (TYRP1_HUMAN)
MTKRTTHPV

SEQ ID NO: 177485 - protein, 11 aa, Artificial Sequence
  Description of Artificial Sequence: Synthetic peptide
  Seed: REVWPLRFFNR (TYRP1_HUMAN)
RFVWPLRFFNK

SEQ ID NO: 177486 - protein, 9 aa, Artificial Sequence
  Description of Artificial Sequence: Synthetic peptide
  Seed: GLFDTPPFY (TYRP1_HUMAN)
GQFDTPPFA

SEQ ID NO: 177487 - protein, 10 aa, Artificial Sequence
  Description of Artificial Sequence: Synthetic peptide
  Seed: AQFPRQCATV (TYRP1_HUMAN)
ARFPRQCATY

SEQ ID NO: 177488 - protein, 9 aa, Artificial Sequence
  Description of Artificial Sequence: Synthetic peptide
  Seed: ENISIYNYF (TYRP1_HUMAN)
EMISIYNYY

SEQ ID NO: 177489 - protein, 9 aa, Artificial Sequence
  Description of Artificial Sequence: Synthetic peptide
  Seed: MSAPKLLSL (TYRP1_HUMAN)
MNAPKLLSY

SEQ ID NO: 177490 - protein, 10 aa, Artificial Sequence
  Description of Artificial Sequence: Synthetic peptide
  Seed: ATVEALRSGM (TYRP1_HUMAN)
AVVEALRSGR

SEQ ID NO: 177491 - protein, 9 aa, Artificial Sequence
  Description of Artificial Sequence: Synthetic peptide
  Seed: NYFVWTHYY (TYRP1_HUMAN)
NSFVWTHYY

SEQ ID NO: 177492 - protein, 10 aa, Artificial Sequence
  Description of Artificial Sequence: Synthetic peptide
  Seed: LPYWNFATGK (TYRP1_HUMAN)
LDYWNFATGR

SEQ ID NO: 177493 - protein, 9 aa, Artificial Sequence
  Description of Artificial Sequence: Synthetic peptide
  Seed: EDYDTLGTL (TYRP1_HUMAN)
EEYDTLGTV

SEQ ID NO: 177494 - protein, 9 aa, Artificial Sequence
  Description of Artificial Sequence: Synthetic peptide
  Seed: NYFVWTHYY (TYRP1_HUMAN)
NPFVWTHYF

SEQ ID NO: 177495 - protein, 10 aa, Artificial Sequence
  Description of Artificial Sequence: Synthetic peptide
  Seed: FSLPYWNFAT (TYRP1_HUMAN)
FMLPYWNFAF

SEQ ID NO: 177496 - protein, 11 aa, Artificial Sequence
  Description of Artificial Sequence: Synthetic peptide
  Seed: QEMLQEPSFSL (TYRP1_HUMAN)
QMMLQEPSFSL

SEQ ID NO: 177497 - protein, 10 aa, Artificial Sequence
  Description of Artificial Sequence: Synthetic peptide
  Seed: YNYFVWTHYY (TYRP1_HUMAN)
YCYFVWTHYW

SEQ ID NO: 177498 - protein, 9 aa, Artificial Sequence
  Description of Artificial Sequence: Synthetic peptide
  Seed: MSAPKLLSL (TYRP1_HUMAN)
MKAPKLLSF

SEQ ID NO: 177499 - protein, 9 aa, Artificial Sequence
  Description of Artificial Sequence: Synthetic peptide
  Seed: MSAPKLLSL (TYRP1_HUMAN)
MQAPKLLSR

SEQ ID NO: 177500 - protein, 9 aa, Artificial Sequence
  Description of Artificial Sequence: Synthetic peptide
  Seed: VGQESFGEV (TYRP1_HUMAN)
VAQESFGEF

SEQ ID NO: 177501 - protein, 11 aa, Artificial Sequence
  Description of Artificial Sequence: Synthetic peptide
  Seed: LVALIFGTASY (TYRP1_HUMAN)
LTALIFGTASW

SEQ ID NO: 177502 - protein, 9 aa, Artificial Sequence
  Description of Artificial Sequence: Synthetic peptide
  Seed: FVWTHYYSV (TYRP1_HUMAN)
FQWTHYYSA

SEQ ID NO: 177503 - protein, 10 aa, Artificial Sequence
  Description of Artificial Sequence: Synthetic peptide
  Seed: ISPNSVFSQW (TYRP1_HUMAN)
IEPNSVFSQW

SEQ ID NO: 177504 - protein, 10 aa, Artificial Sequence
  Description of Artificial Sequence: Synthetic peptide
  Seed: RVVCDSLEDY (TYRP1_HUMAN)
RMVCDSLEDM

SEQ ID NO: 177505 - protein, 9 aa, Artificial Sequence
  Description of Artificial Sequence: Synthetic peptide
  Seed: FSHEGPAFL (TYRP1_HUMAN)
FLHEGPAFR

SEQ ID NO: 177506 - protein, 9 aa, Artificial Sequence
  Description of Artificial Sequence: Synthetic peptide
  Seed: LFDTPPFYS (TYRP1_HUMAN)
LFDTPPFYM

SEQ ID NO: 177507 - protein, 10 aa, Artificial Sequence
  Description of Artificial Sequence: Synthetic peptide
  Seed: FSVPEIIAIA (TYRP1_HUMAN)
FTVPEIIAIL

SEQ ID NO: 177508 - protein, 11 aa, Artificial Sequence
  Description of Artificial Sequence: Synthetic peptide
  Seed: YSDPTGKYDPA (TYRP1_HUMAN)
YTDPTGKYDPF

SEQ ID NO: 177509 - protein, 9 aa, Artificial Sequence
  Description of Artificial Sequence: Synthetic peptide
  Seed: QEPSFSLPY (TYRP1_HUMAN)
QMPSFSLPY

SEQ ID NO: 177510 - protein, 10 aa, Artificial Sequence
  Description of Artificial Sequence: Synthetic peptide
  Seed: YNYFVWTHYY (TYRP1_HUMAN)
YMYFVWTHYI

SEQ ID NO: 177511 - protein, 9 aa, Artificial Sequence
  Description of Artificial Sequence: Synthetic peptide
  Seed: YTYEIQWPS (TYRP1_HUMAN)
YMYEIQWPQ

SEQ ID NO: 177512 - protein, 9 aa, Artificial Sequence
  Description of Artificial Sequence: Synthetic peptide
  Seed: RSNFDSTLI (TYRP1_HUMAN)
RSNFDSTLY

SEQ ID NO: 177513 - protein, 9 aa, Artificial Sequence
  Description of Artificial Sequence: Synthetic peptide
  Seed: ARAQFPRQC (TYRP1_HUMAN)
AYAQFPRQM

SEQ ID NO: 177514 - protein, 9 aa, Artificial Sequence
  Description of Artificial Sequence: Synthetic peptide
  Seed: DSRPHSPQY (TYRP1_HUMAN)
DLRPHSPQK

SEQ ID NO: 177515 - protein, 9 aa, Artificial Sequence
  Description of Artificial Sequence: Synthetic peptide
  Seed: SVKKTFLGV (TYRP1_HUMAN)
SQKKTFLGV

SEQ ID NO: 177516 - protein, 9 aa, Artificial Sequence
  Description of Artificial Sequence: Synthetic peptide
  Seed: ENISIYNYF (TYRP1_HUMAN)
ETISIYNYL

SEQ ID NO: 177517 - protein, 10 aa, Artificial Sequence
  Description of Artificial Sequence: Synthetic peptide
  Seed: YNYFVWTHYY (TYRP1_HUMAN)
YMYFVWTHYM

SEQ ID NO: 177518 - protein, 10 aa, Artificial Sequence
  Description of Artificial Sequence: Synthetic peptide
  Seed: LGPDGNTPQF (TYRP1_HUMAN)
LFPDGNTPQM

SEQ ID NO: 177519 - protein, 10 aa, Artificial Sequence
  Description of Artificial Sequence: Synthetic peptide
  Seed: SPVSGPGTDR (TYRP1_HUMAN)
SAVSGPGTDR

SEQ ID NO: 177520 - protein, 10 aa, Artificial Sequence
  Description of Artificial Sequence: Synthetic peptide
  Seed: RRYNADISTF (TYRP1_HUMAN)
RYYNADISTW

SEQ ID NO: 177521 - protein, 9 aa, Artificial Sequence
  Description of Artificial Sequence: Synthetic peptide
  Seed: FTDAVFDEW (TYRP1_HUMAN)
FFDAVFDEF

SEQ ID NO: 177522 - protein, 9 aa, Artificial Sequence
  Description of Artificial Sequence: Synthetic peptide
  Seed: FLTWHRYHL (TYRP1_HUMAN)
FVTWHRYHL

SEQ ID NO: 177523 - protein, 10 aa, Artificial Sequence
  Description of Artificial Sequence: Synthetic peptide
  Seed: KRTTHPLFVI (TYRP1_HUMAN)
KGTTHPLFVW

SEQ ID NO: 177524 - protein, 10 aa, Artificial Sequence
  Description of Artificial Sequence: Synthetic peptide
  Seed: FGTASYLIRA (TYRP1_HUMAN)
FQTASYLIRL

SEQ ID NO: 177525 - protein, 10 aa, Artificial Sequence
  Description of Artificial Sequence: Synthetic peptide
  Seed: GLFDTPPFYS (TYRP1_HUMAN)
GMFDTPPFYM

SEQ ID NO: 177526 - protein, 10 aa, Artificial Sequence
  Description of Artificial Sequence: Synthetic peptide
  Seed: VDFSHEGPAF (TYRP1_HUMAN)
VTFSHEGPAF

SEQ ID NO: 177527 - protein, 10 aa, Artificial Sequence
  Description of Artificial Sequence: Synthetic peptide
  Seed: EIIAIAVVGA (TYRP1_HUMAN)
EIIAIAVVGL

SEQ ID NO: 177528 - protein, 10 aa, Artificial Sequence
  Description of Artificial Sequence: Synthetic peptide
  Seed: DISTFPLENA (TYRP1_HUMAN)
DVSTFPLENV

SEQ ID NO: 177529 - protein, 10 aa, Artificial Sequence
  Description of Artificial Sequence: Synthetic peptide
  Seed: STLISPNSVF (TYRP1_HUMAN)
SDLISPNSVF

SEQ ID NO: 177530 - protein, 9 aa, Artificial Sequence
  Description of Artificial Sequence: Synthetic peptide
  Seed: EGYSDPTGK (TYRP1_HUMAN)
EVYSDPTGK

SEQ ID NO: 177531 - protein, 10 aa, Artificial Sequence
  Description of Artificial Sequence: Synthetic peptide
  Seed: LIFGTASYLI (TYRP1_HUMAN)
LMFGTASYLA

SEQ ID NO: 177532 - protein, 9 aa, Artificial Sequence
  Description of Artificial Sequence: Synthetic peptide
  Seed: LQNPNQSVV (TYRP1_HUMAN)
LRNPNQSVY

SEQ ID NO: 177533 - protein, 10 aa, Artificial Sequence
  Description of Artificial Sequence: Synthetic peptide
  Seed: GLFDTPPFYS (TYRP1_HUMAN)
GLFDTPPFYT

SEQ ID NO: 177534 - protein, 9 aa, Artificial Sequence
  Description of Artificial Sequence: Synthetic peptide
  Seed: HYYSVKKTF (TYRP1_HUMAN)
HIYSVKKTF

SEQ ID NO: 177535 - protein, 10 aa, Artificial Sequence
  Description of Artificial Sequence: Synthetic peptide
  Seed: ISPNSVFSQW (TYRP1_HUMAN)
ILPNSVFSQW

SEQ ID NO: 177536 - protein, 10 aa, Artificial Sequence
  Description of Artificial Sequence: Synthetic peptide
  Seed: FVLLHTFTDA (TYRP1_HUMAN)
FQLLHTFTDI

SEQ ID NO: 177537 - protein, 10 aa, Artificial Sequence
  Description of Artificial Sequence: Synthetic peptide
  Seed: MAKRTTHPLF (TYRP1_HUMAN)
MPKRTTHPLP

SEQ ID NO: 177538 - protein, 11 aa, Artificial Sequence
  Description of Artificial Sequence: Synthetic peptide
  Seed: FWPPVTNTEMF (TYRP1_HUMAN)
FQPPVTNTEMY

SEQ ID NO: 177539 - protein, 9 aa, Artificial Sequence
  Description of Artificial Sequence: Synthetic peptide
  Seed: RYHLLRLEK (TYRP1_HUMAN)
RFHLLRLER

SEQ ID NO: 177540 - protein, 11 aa, Artificial Sequence
  Description of Artificial Sequence: Synthetic peptide
  Seed: RRYNADISTFP (TYRP1_HUMAN)
RRYNADISTFL

SEQ ID NO: 177541 - protein, 10 aa, Artificial Sequence
  Description of Artificial Sequence: Synthetic peptide
  Seed: KRTTHPLFVI (TYRP1_HUMAN)
KHTTHPLFVY

SEQ ID NO: 177542 - protein, 8 aa, Artificial Sequence
  Description of Artificial Sequence: Synthetic peptide
  Seed: FSHEGPAF (TYRP1_HUMAN)
FYHEGPAY

SEQ ID NO: 177543 - protein, 10 aa, Artificial Sequence
  Description of Artificial Sequence: Synthetic peptide
  Seed: HFVRALDMAK (TYRP1_HUMAN)
HLVRALDMAK

SEQ ID NO: 177544 - protein, 9 aa, Artificial Sequence
  Description of Artificial Sequence: Synthetic peptide
  Seed: KYDPAVRSL (TYRP1_HUMAN)
KMDPAVRSI

SEQ ID NO: 177545 - protein, 10 aa, Artificial Sequence
  Description of Artificial Sequence: Synthetic peptide
  Seed: DAVFDEWLRR (TYRP1_HUMAN)
DLVFDEWLRR

SEQ ID NO: 177546 - protein, 8 aa, Artificial Sequence
  Description of Artificial Sequence: Synthetic peptide
  Seed: YDPAVRSL (TYRP1_HUMAN)
YQPAVRSI

SEQ ID NO: 177547 - protein, 10 aa, Artificial Sequence
  Description of Artificial Sequence: Synthetic peptide
  Seed: YNYFVWTHYY (TYRP1_HUMAN)
YIYFVWTHYL

SEQ ID NO: 177548 - protein, 9 aa, Artificial Sequence
  Description of Artificial Sequence: Synthetic peptide
  Seed: FPLENAPIG (TYRP1_HUMAN)
FVLENAPIF

SEQ ID NO: 177549 - protein, 11 aa, Artificial Sequence
  Description of Artificial Sequence: Synthetic peptide
  Seed: LRRYNADISTF (TYRP1_HUMAN)
LARYNADISTF

SEQ ID NO: 177550 - protein, 9 aa, Artificial Sequence
  Description of Artificial Sequence: Synthetic peptide
  Seed: SVFSQWRVV (TYRP1_HUMAN)
SQFSQWRVK

SEQ ID NO: 177551 - protein, 10 aa, Artificial Sequence
  Description of Artificial Sequence: Synthetic peptide
  Seed: YNADISTFPL (TYRP1_HUMAN)
YHADISTFPL

SEQ ID NO: 177552 - protein, 8 aa, Artificial Sequence
  Description of Artificial Sequence: Synthetic peptide
  Seed: SAPKLLSL (TYRP1_HUMAN)
SYPKLLSF

SEQ ID NO: 177553 - protein, 9 aa, Artificial Sequence
  Description of Artificial Sequence: Synthetic peptide
  Seed: LGCIFFPLL (TYRP1_HUMAN)
LMCIFFPLI

SEQ ID NO: 177554 - protein, 8 aa, Artificial Sequence
  Description of Artificial Sequence: Synthetic peptide
  Seed: ALLLVALI (TYRP1_HUMAN)
AQLLVALL

SEQ ID NO: 177555 - protein, 10 aa, Artificial Sequence
  Description of Artificial Sequence: Synthetic peptide
  Seed: VGLFDTPPFY (TYRP1_HUMAN)
VPLFDTPPFY

SEQ ID NO: 177556 - protein, 9 aa, Artificial Sequence
  Description of Artificial Sequence: Synthetic peptide
  Seed: FLNGTGGQT (TYRP1_HUMAN)
FVNGTGGQI

SEQ ID NO: 177557 - protein, 9 aa, Artificial Sequence
  Description of Artificial Sequence: Synthetic peptide
  Seed: ACDQRVLIV (TYRP1_HUMAN)
AADQRVLIY

SEQ ID NO: 177558 - protein, 10 aa, Artificial Sequence
  Description of Artificial Sequence: Synthetic peptide
  Seed: SLGCIFFPLL (TYRP1_HUMAN)
SQGCIFFPLV

SEQ ID NO: 177559 - protein, 9 aa, Artificial Sequence
  Description of Artificial Sequence: Synthetic peptide
  Seed: SPNSVFSQW (TYRP1_HUMAN)
SENSVFSQY

SEQ ID NO: 177560 - protein, 10 aa, Artificial Sequence
  Description of Artificial Sequence: Synthetic peptide
  Seed: YNYFVWTHYY (TYRP1_HUMAN)
YFYFVWTHYF

SEQ ID NO: 177561 - protein, 9 aa, Artificial Sequence
  Description of Artificial Sequence: Synthetic peptide
  Seed: KYDPAVRSL (TYRP1_HUMAN)
KNDPAVRSL

SEQ ID NO: 177562 - protein, 10 aa, Artificial Sequence
  Description of Artificial Sequence: Synthetic peptide
  Seed: RQCATVEALR (TYRP1_HUMAN)
RFCATVEALR

SEQ ID NO: 177563 - protein, 10 aa, Artificial Sequence
  Description of Artificial Sequence: Synthetic peptide
  Seed: FVWTHYYSVK (TYRP1_HUMAN)
FIWTHYYSVL

SEQ ID NO: 177564 - protein, 9 aa, Artificial Sequence
  Description of Artificial Sequence: Synthetic peptide
  Seed: NYFVWTHYY (TYRP1_HUMAN)
NLFVWTHYY

SEQ ID NO: 177565 - protein, 9 aa, Artificial Sequence
  Description of Artificial Sequence: Synthetic peptide
  Seed: MSAPKLLSL (TYRP1_HUMAN)
MSAPKLLSA

SEQ ID NO: 177566 - protein, 11 aa, Artificial Sequence
  Description of Artificial Sequence: Synthetic peptide
  Seed: RRYNADISTFP (TYRP1_HUMAN)
RWYNADISTFE

SEQ ID NO: 177567 - protein, 9 aa, Artificial Sequence
  Description of Artificial Sequence: Synthetic peptide
  Seed: VFDEWLRRY (TYRP1_HUMAN)
VLDEWLRRV

SEQ ID NO: 177568 - protein, 10 aa, Artificial Sequence
  Description of Artificial Sequence: Synthetic peptide
  Seed: MAKRTTHPLF (TYRP1_HUMAN)
MPKRTTHPLN

SEQ ID NO: 177569 - protein, 9 aa, Artificial Sequence
  Description of Artificial Sequence: Synthetic peptide
  Seed: YTYEIQWPS (TYRP1_HUMAN)
YNYEIQWPV

SEQ ID NO: 177570 - protein, 10 aa, Artificial Sequence
  Description of Artificial Sequence: Synthetic peptide
  Seed: KRTTHPLFVI (TYRP1_HUMAN)
KITTHPLFVY

SEQ ID NO: 177571 - protein, 9 aa, Artificial Sequence
  Description of Artificial Sequence: Synthetic peptide
  Seed: FVWTHYYSV (TYRP1_HUMAN)
FTWTHYYSR

SEQ ID NO: 177572 - protein, 9 aa, Artificial Sequence
  Description of Artificial Sequence: Synthetic peptide
  Seed: YSNSTNSFR (TYRP1_HUMAN)
YNNSTNSFR

SEQ ID NO: 177573 - protein, 10 aa, Artificial Sequence
  Description of Artificial Sequence: Synthetic peptide
  Seed: FVLLHTFTDA (TYRP1_HUMAN)
FNLLHTFTDL

SEQ ID NO: 177574 - protein, 10 aa, Artificial Sequence
  Description of Artificial Sequence: Synthetic peptide
  Seed: SMDEANQPLL (TYRP1_HUMAN)
SLDEANQPLF

SEQ ID NO: 177575 - protein, 9 aa, Artificial Sequence
  Description of Artificial Sequence: Synthetic peptide
  Seed: SLHNLAHLF (TYRP1_HUMAN)
SFHNLAHLL

SEQ ID NO: 177576 - protein, 9 aa, Artificial Sequence
  Description of Artificial Sequence: Synthetic peptide
  Seed: RRNLLDLSK (TYRP1_HUMAN)
RRNLLDLSM

SEQ ID NO: 177577 - protein, 10 aa, Artificial Sequence
  Description of Artificial Sequence: Synthetic peptide
  Seed: YEIQWPSREF (TYRP1_HUMAN)
YIIQWPSREY

SEQ ID NO: 177578 - protein, 10 aa, Artificial Sequence
  Description of Artificial Sequence: Synthetic peptide
  Seed: TDAVFDEWLR (TYRP1_HUMAN)
TCAVFDEWLR

SEQ ID NO: 177579 - protein, 10 aa, Artificial Sequence
  Description of Artificial Sequence: Synthetic peptide
  Seed: NTVEGYSDPT (TYRP1_HUMAN)
NAVEGYSDPV

SEQ ID NO: 177580 - protein, 9 aa, Artificial Sequence
  Description of Artificial Sequence: Synthetic peptide
  Seed: SMDEANQPL (TYRP1_HUMAN)
SHDEANQPV

SEQ ID NO: 177581 - protein, 9 aa, Artificial Sequence
  Description of Artificial Sequence: Synthetic peptide
  Seed: FYSNSTNSF (TYRP1_HUMAN)
FGSNSTNSM

SEQ ID NO: 177582 - protein, 9 aa, Artificial Sequence
  Description of Artificial Sequence: Synthetic peptide
  Seed: RGRCEAVTA (TYRP1_HUMAN)
RSRCEAVTM

SEQ ID NO: 177583 - protein, 9 aa, Artificial Sequence
  Description of Artificial Sequence: Synthetic peptide
  Seed: NFDSTLISP (TYRP1_HUMAN)
NLDSTLISL

SEQ ID NO: 177584 - protein, 9 aa, Artificial Sequence
  Description of Artificial Sequence: Synthetic peptide
  Seed: RPMVQRLPE (TYRP1_HUMAN)
RAMVQRLPM

SEQ ID NO: 177585 - protein, 9 aa, Artificial Sequence
  Description of Artificial Sequence: Synthetic peptide
  Seed: FSLPYWNFA (TYRP1_HUMAN)
FQLPYWNFL

SEQ ID NO: 177586 - protein, 10 aa, Artificial Sequence
  Description of Artificial Sequence: Synthetic peptide
  Seed: GKYDPAVRSL (TYRP1_HUMAN)
GAYDPAVRSY

SEQ ID NO: 177587 - protein, 9 aa, Artificial Sequence
  Description of Artificial Sequence: Synthetic peptide
  Seed: LFQQARAQF (TYRP1_HUMAN)
LWQQARAQM

SEQ ID NO: 177588 - protein, 11 aa, Artificial Sequence
  Description of Artificial Sequence: Synthetic peptide
  Seed: QEMLQEPSFSL (TYRP1_HUMAN)
QAMLQEPSFSV

SEQ ID NO: 177589 - protein, 9 aa, Artificial Sequence
  Description of Artificial Sequence: Synthetic peptide
  Seed: AVRSLHNLA (TYRP1_HUMAN)
AARSLHNLK

SEQ ID NO: 177590 - protein, 11 aa, Artificial Sequence
  Description of Artificial Sequence: Synthetic peptide
  Seed: YPHDGRDDREV (TYRP1_HUMAN)
YPHDGRDDREY

SEQ ID NO: 177591 - protein, 9 aa, Artificial Sequence
  Description of Artificial Sequence: Synthetic peptide
  Seed: LTWHRYHLL (TYRP1_HUMAN)
LTWHRYHLI

SEQ ID NO: 177592 - protein, 10 aa, Artificial Sequence
  Description of Artificial Sequence: Synthetic peptide
  Seed: KLQNPNQSVV (TYRP1_HUMAN)
KQQNPNQSVF

SEQ ID NO: 177593 - protein, 11 aa, Artificial Sequence
  Description of Artificial Sequence: Synthetic peptide
  Seed: YSDPTGKYDPA (TYRP1_HUMAN)
YGDPTGKYDPL

SEQ ID NO: 177594 - protein, 9 aa, Artificial Sequence
  Description of Artificial Sequence: Synthetic peptide
  Seed: KYDPAVRSL (TYRP1_HUMAN)
KGDPAVRSF

SEQ ID NO: 177595 - protein, 10 aa, Artificial Sequence
  Description of Artificial Sequence: Synthetic peptide
  Seed: LTWHRYHLLR (TYRP1_HUMAN)
LGWHRYHLLR

SEQ ID NO: 177596 - protein, 9 aa, Artificial Sequence
  Description of Artificial Sequence: Synthetic peptide
  Seed: NADISTFPL (TYRP1_HUMAN)
NQDISTFPM

SEQ ID NO: 177597 - protein, 10 aa, Artificial Sequence
  Description of Artificial Sequence: Synthetic peptide
  Seed: YTYEIQWPSR (TYRP1_HUMAN)
YMYEIQWPSR

SEQ ID NO: 177598 - protein, 10 aa, Artificial Sequence
  Description of Artificial Sequence: Synthetic peptide
  Seed: YFVWTHYYSV (TYRP1_HUMAN)
YSVWTHYYSL

SEQ ID NO: 177599 - protein, 10 aa, Artificial Sequence
  Description of Artificial Sequence: Synthetic peptide
  Seed: EGYSDPTGKY (TYRP1_HUMAN)
ETYSDPTGKF

SEQ ID NO: 177600 - protein, 9 aa, Artificial Sequence
  Description of Artificial Sequence: Synthetic peptide
  Seed: RRYNADIST (TYRP1_HUMAN)
RYYNADISF

SEQ ID NO: 177601 - protein, 11 aa, Artificial Sequence
  Description of Artificial Sequence: Synthetic peptide
  Seed: LVALIFGTASY (TYRP1_HUMAN)
LFALIFGTASY

SEQ ID NO: 177602 - protein, 9 aa, Artificial Sequence
  Description of Artificial Sequence: Synthetic peptide
  Seed: STNSFRNTV (TYRP1_HUMAN)
SQNSFRNTY

SEQ ID NO: 177603 - protein, 10 aa, Artificial Sequence
  Description of Artificial Sequence: Synthetic peptide
  Seed: SPNDPIFVLL (TYRP1_HUMAN)
SSNDPIFVLL

SEQ ID NO: 177604 - protein, 9 aa, Artificial Sequence
  Description of Artificial Sequence: Synthetic peptide
  Seed: FSLPYWNFA (TYRP1_HUMAN)
FPLPYWNFI

SEQ ID NO: 177605 - protein, 9 aa, Artificial Sequence
  Description of Artificial Sequence: Synthetic peptide
  Seed: KLLSLGCIF (TYRP1_HUMAN)
KHLSLGCIF

SEQ ID NO: 177606 - protein, 10 aa, Artificial Sequence
  Description of Artificial Sequence: Synthetic peptide
  Seed: TASYLIRARR (TYRP1_HUMAN)
TKSYLIRARR

SEQ ID NO: 177607 - protein, 10 aa, Artificial Sequence
  Description of Artificial Sequence: Synthetic peptide
  Seed: LLHTFTDAVF (TYRP1_HUMAN)
LTHTFTDAVY

SEQ ID NO: 177608 - protein, 9 aa, Artificial Sequence
  Description of Artificial Sequence: Synthetic peptide
  Seed: SVFSQWRVV (TYRP1_HUMAN)
SVFSQWRVW

SEQ ID NO: 177609 - protein, 10 aa, Artificial Sequence
  Description of Artificial Sequence: Synthetic peptide
  Seed: AFLTWHRYHL (TYRP1_HUMAN)
AILTWHRYHV

SEQ ID NO: 177610 - protein, 10 aa, Artificial Sequence
  Description of Artificial Sequence: Synthetic peptide
  Seed: FVWTHYYSVK (TYRP1_HUMAN)
FLWTHYYSVG

SEQ ID NO: 177611 - protein, 9 aa, Artificial Sequence
  Description of Artificial Sequence: Synthetic peptide
  Seed: FLTWHRYHL (TYRP1_HUMAN)
FATWHRYHL

SEQ ID NO: 177612 - protein, 10 aa, Artificial Sequence
  Description of Artificial Sequence: Synthetic peptide
  Seed: HFVRALDMAK (TYRP1_HUMAN)
HAVRALDMAR

SEQ ID NO: 177613 - protein, 10 aa, Artificial Sequence
  Description of Artificial Sequence: Synthetic peptide
  Seed: RRYNADISTF (TYRP1_HUMAN)
RIYNADISTF

SEQ ID NO: 177614 - protein, 10 aa, Artificial Sequence
  Description of Artificial Sequence: Synthetic peptide
  Seed: ASYLIRARRS (TYRP1_HUMAN)
ATYLIRARRR

SEQ ID NO: 177615 - protein, 11 aa, Artificial Sequence
  Description of Artificial Sequence: Synthetic peptide
  Seed: MLQEPSFSLPY (TYRP1_HUMAN)
MSQEPSFSLPF

SEQ ID NO: 177616 - protein, 10 aa, Artificial Sequence
  Description of Artificial Sequence: Synthetic peptide
  Seed: FWPPVTNTEM (TYRP1_HUMAN)
FWPPVTNTEW

SEQ ID NO: 177617 - protein, 9 aa, Artificial Sequence
  Description of Artificial Sequence: Synthetic peptide
  Seed: ISIYNYFVW (TYRP1_HUMAN)
IMIYNYFVL

SEQ ID NO: 177618 - protein, 9 aa, Artificial Sequence
  Description of Artificial Sequence: Synthetic peptide
  Seed: LTWHRYHLL (TYRP1_HUMAN)
LAWHRYHLV

SEQ ID NO: 177619 - protein, 9 aa, Artificial Sequence
  Description of Artificial Sequence: Synthetic peptide
  Seed: LIFGTASYL (TYRP1_HUMAN)
LAFGTASYM

SEQ ID NO: 177620 - protein, 10 aa, Artificial Sequence
  Description of Artificial Sequence: Synthetic peptide
  Seed: FVLLHTFTDA (TYRP1_HUMAN)
FQLLHTFTDV

SEQ ID NO: 177621 - protein, 9 aa, Artificial Sequence
  Description of Artificial Sequence: Synthetic peptide
  Seed: NYFVWTHYY (TYRP1_HUMAN)
NAFVWTHYM

SEQ ID NO: 177622 - protein, 10 aa, Artificial Sequence
  Description of Artificial Sequence: Synthetic peptide
  Seed: RSMDEANQPL (TYRP1_HUMAN)
RPMDEANQPV

SEQ ID NO: 177623 - protein, 10 aa, Artificial Sequence
  Description of Artificial Sequence: Synthetic peptide
  Seed: NMVPFWPPVT (TYRP1_HUMAN)
NMVPFWPPVL

SEQ ID NO: 177624 - protein, 10 aa, Artificial Sequence
  Description of Artificial Sequence: Synthetic peptide
  Seed: LLLVALIFGT (TYRP1_HUMAN)
LTLVALIFGI

SEQ ID NO: 177625 - protein, 10 aa, Artificial Sequence
  Description of Artificial Sequence: Synthetic peptide
  Seed: VWTHYYSVKK (TYRP1_HUMAN)
VYTHYYSVKR

SEQ ID NO: 177626 - protein, 9 aa, Artificial Sequence
  Description of Artificial Sequence: Synthetic peptide
  Seed: TADSRPHSP (TYRP1_HUMAN)
TADSRPHSF

SEQ ID NO: 177627 - protein, 10 aa, Artificial Sequence
  Description of Artificial Sequence: Synthetic peptide
  Seed: FWPPVTNTEM (TYRP1_HUMAN)
FSPPVTNTEM

SEQ ID NO: 177628 - protein, 10 aa, Artificial Sequence
  Description of Artificial Sequence: Synthetic peptide
  Seed: FVWTHYYSVK (TYRP1_HUMAN)
FTWTHYYSVI

SEQ ID NO: 177629 - protein, 9 aa, Artificial Sequence
  Description of Artificial Sequence: Synthetic peptide
  Seed: RVLIVRRNL (TYRP1_HUMAN)
RVLIVRRNW

SEQ ID NO: 177630 - protein, 10 aa, Artificial Sequence
  Description of Artificial Sequence: Synthetic peptide
  Seed: RSLHNLAHLF (TYRP1_HUMAN)
RNLHNLAHLY

SEQ ID NO: 177631 - protein, 11 aa, Artificial Sequence
  Description of Artificial Sequence: Synthetic peptide
  Seed: YQCYAEEYEKL (TYRP1_HUMAN)
YNCYAEEYEKF

SEQ ID NO: 177632 - protein, 9 aa, Artificial Sequence
  Description of Artificial Sequence: Synthetic peptide
  Seed: SFSLPYWNF (TYRP1_HUMAN)
SYSLPYWNY

SEQ ID NO: 177633 - protein, 10 aa, Artificial Sequence
  Description of Artificial Sequence: Synthetic peptide
  Seed: THPLFVIATR (TYRP1_HUMAN)
TIPLFVIATR

SEQ ID NO: 177634 - protein, 9 aa, Artificial Sequence
  Description of Artificial Sequence: Synthetic peptide
  Seed: FSHEGPAFL (TYRP1_HUMAN)
FVHEGPAFK

SEQ ID NO: 177635 - protein, 9 aa, Artificial Sequence
  Description of Artificial Sequence: Synthetic peptide
  Seed: AVRSLHNLA (TYRP1_HUMAN)
AIRSLHNLK

SEQ ID NO: 177636 - protein, 9 aa, Artificial Sequence
  Description of Artificial Sequence: Synthetic peptide
  Seed: NYFVWTHYY (TYRP1_HUMAN)
NWFVWTHYF

SEQ ID NO: 177637 - protein, 11 aa, Artificial Sequence
  Description of Artificial Sequence: Synthetic peptide
  Seed: IYNYFVWTHYY (TYRP1_HUMAN)
ITNYFVWTHYL

SEQ ID NO: 177638 - protein, 11 aa, Artificial Sequence
  Description of Artificial Sequence: Synthetic peptide
  Seed: LQEPSFSLPYW (TYRP1_HUMAN)
LSEPSFSLPYW

SEQ ID NO: 177639 - protein, 9 aa, Artificial Sequence
  Description of Artificial Sequence: Synthetic peptide
  Seed: FPRQCATVE (TYRP1_HUMAN)
FVRQCATVL

SEQ ID NO: 177640 - protein, 9 aa, Artificial Sequence
  Description of Artificial Sequence: Synthetic peptide
  Seed: NADISTFPL (TYRP1_HUMAN)
NRDISTFPI

SEQ ID NO: 177641 - protein, 10 aa, Artificial Sequence
  Description of Artificial Sequence: Synthetic peptide
  Seed: RRYNADISTF (TYRP1_HUMAN)
RQYNADISTW

SEQ ID NO: 177642 - protein, 10 aa, Artificial Sequence
  Description of Artificial Sequence: Synthetic peptide
  Seed: FFPLLLFQQA (TYRP1_HUMAN)
FRPLLLFQQA

SEQ ID NO: 177643 - protein, 9 aa, Artificial Sequence
  Description of Artificial Sequence: Synthetic peptide
  Seed: QEMLQEPSF (TYRP1_HUMAN)
QIMLQEPSY

SEQ ID NO: 177644 - protein, 10 aa, Artificial Sequence
  Description of Artificial Sequence: Synthetic peptide
  Seed: NYFVWTHYYS (TYRP1_HUMAN)
NYFVWTHYYF

SEQ ID NO: 177645 - protein, 9 aa, Artificial Sequence
  Description of Artificial Sequence: Synthetic peptide
  Seed: MLQEPSFSL (TYRP1_HUMAN)
MVQEPSFSV

SEQ ID NO: 177646 - protein, 10 aa, Artificial Sequence
  Description of Artificial Sequence: Synthetic peptide
  Seed: LGPDGNTPQF (TYRP1_HUMAN)
LFPDGNTPQW

SEQ ID NO: 177647 - protein, 10 aa, Artificial Sequence
  Description of Artificial Sequence: Synthetic peptide
  Seed: TASYLIRARR (TYRP1_HUMAN)
TTSYLIRARK

SEQ ID NO: 177648 - protein, 9 aa, Artificial Sequence
  Description of Artificial Sequence: Synthetic peptide
  Seed: AKRTTHPLF (TYRP1_HUMAN)
AMRTTHPLF

SEQ ID NO: 177649 - protein, 9 aa, Artificial Sequence
  Description of Artificial Sequence: Synthetic peptide
  Seed: AVVGALLLV (TYRP1_HUMAN)
ATVGALLLL

SEQ ID NO: 177650 - protein, 9 aa, Artificial Sequence
  Description of Artificial Sequence: Synthetic peptide
  Seed: LIFGTASYL (TYRP1_HUMAN)
LIFGTASYW

SEQ ID NO: 177651 - protein, 10 aa, Artificial Sequence
  Description of Artificial Sequence: Synthetic peptide
  Seed: MVPFWPPVTN (TYRP1_HUMAN)
MMPFWPPVTL

SEQ ID NO: 177652 - protein, 9 aa, Artificial Sequence
  Description of Artificial Sequence: Synthetic peptide
  Seed: VLIVRRNLL (TYRP1_HUMAN)
VFIVRRNLL

SEQ ID NO: 177653 - protein, 9 aa, Artificial Sequence
  Description of Artificial Sequence: Synthetic peptide
  Seed: AQFPRQCAT (TYRP1_HUMAN)
AEFPRQCAA

SEQ ID NO: 177654 - protein, 10 aa, Artificial Sequence
  Description of Artificial Sequence: Synthetic peptide
  Seed: RQCATVEALR (TYRP1_HUMAN)
RYCATVEALR

SEQ ID NO: 177655 - protein, 10 aa, Artificial Sequence
  Description of Artificial Sequence: Synthetic peptide
  Seed: FLNGTGGQTH (TYRP1_HUMAN)
FMNGTGGQTM

SEQ ID NO: 177656 - protein, 9 aa, Artificial Sequence
  Description of Artificial Sequence: Synthetic peptide
  Seed: VVGALLLVA (TYRP1_HUMAN)
VMGALLLVL

SEQ ID NO: 177657 - protein, 9 aa, Artificial Sequence
  Description of Artificial Sequence: Synthetic peptide
  Seed: YLIRARRSM (TYRP1_HUMAN)
YQIRARRSL

SEQ ID NO: 177658 - protein, 9 aa, Artificial Sequence
  Description of Artificial Sequence: Synthetic peptide
  Seed: TAPDNLGYT (TYRP1_HUMAN)
TSPDNLGYL

SEQ ID NO: 177659 - protein, 9 aa, Artificial Sequence
  Description of Artificial Sequence: Synthetic peptide
  Seed: FSHEGPAFL (TYRP1_HUMAN)
FPHEGPAFV

SEQ ID NO: 177660 - protein, 10 aa, Artificial Sequence
  Description of Artificial Sequence: Synthetic peptide
  Seed: RSMDEANQPL (TYRP1_HUMAN)
RSMDEANQPF

SEQ ID NO: 177661 - protein, 9 aa, Artificial Sequence
  Description of Artificial Sequence: Synthetic peptide
  Seed: GTASYLIRA (TYRP1_HUMAN)
GLASYLIRI

SEQ ID NO: 177662 - protein, 10 aa, Artificial Sequence
  Description of Artificial Sequence: Synthetic peptide
  Seed: EMLQEPSFSL (TYRP1_HUMAN)
ESLQEPSFSL

SEQ ID NO: 177663 - protein, 11 aa, Artificial Sequence
  Description of Artificial Sequence: Synthetic peptide
  Seed: YFVWTHYYSVK (TYRP1_HUMAN)
YYVWTHYYSVR

SEQ ID NO: 177664 - protein, 9 aa, Artificial Sequence
  Description of Artificial Sequence: Synthetic peptide
  Seed: FLTWHRYHL (TYRP1_HUMAN)
FFTWHRYHM

SEQ ID NO: 177665 - protein, 9 aa, Artificial Sequence
  Description of Artificial Sequence: Synthetic peptide
  Seed: MLQEPSFSL (TYRP1_HUMAN)
MKQEPSFSF

SEQ ID NO: 177666 - protein, 9 aa, Artificial Sequence
  Description of Artificial Sequence: Synthetic peptide
  Seed: RSLHNLAHL (TYRP1_HUMAN)
RWLHNLAHY

SEQ ID NO: 177667 - protein, 10 aa, Artificial Sequence
  Description of Artificial Sequence: Synthetic peptide
  Seed: YEIQWPSREF (TYRP1_HUMAN)
YEIQWPSREA

SEQ ID NO: 177668 - protein, 9 aa, Artificial Sequence
  Description of Artificial Sequence: Synthetic peptide
  Seed: LQNPNQSVV (TYRP1_HUMAN)
LHNPNQSVA

SEQ ID NO: 177669 - protein, 10 aa, Artificial Sequence
  Description of Artificial Sequence: Synthetic peptide
  Seed: LPYWNFATGK (TYRP1_HUMAN)
LQYWNFATGK

SEQ ID NO: 177670 - protein, 8 aa, Artificial Sequence
  Description of Artificial Sequence: Synthetic peptide
  Seed: FPRQCATV (TYRP1_HUMAN)
FPRQCATI

SEQ ID NO: 177671 - protein, 9 aa, Artificial Sequence
  Description of Artificial Sequence: Synthetic peptide
  Seed: TLISPNSVF (TYRP1_HUMAN)
TWISPNSVM

SEQ ID NO: 177672 - protein, 10 aa, Artificial Sequence
  Description of Artificial Sequence: Synthetic peptide
  Seed: HLSPNDPIFV (TYRP1_HUMAN)
HTSPNDPIFL

SEQ ID NO: 177673 - protein, 9 aa, Artificial Sequence
  Description of Artificial Sequence: Synthetic peptide
  Seed: RYHLLRLEK (TYRP1_HUMAN)
RTHLLRLEK

SEQ ID NO: 177674 - protein, 9 aa, Artificial Sequence
  Description of Artificial Sequence: Synthetic peptide
  Seed: RPMVQRLPE (TYRP1_HUMAN)
RTMVQRLPL

SEQ ID NO: 177675 - protein, 9 aa, Artificial Sequence
  Description of Artificial Sequence: Synthetic peptide
  Seed: QQARAQFPR (TYRP1_HUMAN)
QSARAQFPK

SEQ ID NO: 177676 - protein, 10 aa, Artificial Sequence
  Description of Artificial Sequence: Synthetic peptide
  Seed: MAKRTTHPLF (TYRP1_HUMAN)
MPKRTTHPLW

SEQ ID NO: 177677 - protein, 9 aa, Artificial Sequence
  Description of Artificial Sequence: Synthetic peptide
  Seed: FPRQCATVE (TYRP1_HUMAN)
FPRQCATVM

SEQ ID NO: 177678 - protein, 10 aa, Artificial Sequence
  Description of Artificial Sequence: Synthetic peptide
  Seed: SPVSGPGTDR (TYRP1_HUMAN)
SSVSGPGTDR

SEQ ID NO: 177679 - protein, 9 aa, Artificial Sequence
  Description of Artificial Sequence: Synthetic peptide
  Seed: ALIFGTASY (TYRP1_HUMAN)
AVIFGTASK

SEQ ID NO: 177680 - protein, 9 aa, Artificial Sequence
  Description of Artificial Sequence: Synthetic peptide
  Seed: SPNDPIFVL (TYRP1_HUMAN)
SGNDPIFVM

SEQ ID NO: 177681 - protein, 9 aa, Artificial Sequence
  Description of Artificial Sequence: Synthetic peptide
  Seed: RTTHPLFVI (TYRP1_HUMAN)
RTTHPLFVM

SEQ ID NO: 177682 - protein, 10 aa, Artificial Sequence
  Description of Artificial Sequence: Synthetic peptide
  Seed: DISTFPLENA (TYRP1_HUMAN)
DTSTFPLENV

SEQ ID NO: 177683 - protein, 10 aa, Artificial Sequence
  Description of Artificial Sequence: Synthetic peptide
  Seed: FQQARAQFPR (TYRP1_HUMAN)
FAQARAQFPK

SEQ ID NO: 177684 - protein, 9 aa, Artificial Sequence
  Description of Artificial Sequence: Synthetic peptide
  Seed: MAKRTTHPL (TYRP1_HUMAN)
MEKRTTHPM

SEQ ID NO: 177685 - protein, 9 aa, Artificial Sequence
  Description of Artificial Sequence: Synthetic peptide
  Seed: GYSDPTGKY (TYRP1_HUMAN)
GASDPTGKL

SEQ ID NO: 177686 - protein, 9 aa, Artificial Sequence
  Description of Artificial Sequence: Synthetic peptide
  Seed: RFFNRTCHC (TYRP1_HUMAN)
RAFNRTCHA

SEQ ID NO: 177687 - protein, 10 aa, Artificial Sequence
  Description of Artificial Sequence: Synthetic peptide
  Seed: GKYDPAVRSL (TYRP1_HUMAN)
GRYDPAVRSM

SEQ ID NO: 177688 - protein, 9 aa, Artificial Sequence
  Description of Artificial Sequence: Synthetic peptide
  Seed: GPDGNTPQF (TYRP1_HUMAN)
GTDGNTPQI

SEQ ID NO: 177689 - protein, 9 aa, Artificial Sequence
  Description of Artificial Sequence: Synthetic peptide
  Seed: IAVVGALLL (TYRP1_HUMAN)
IYVVGALLF

SEQ ID NO: 177690 - protein, 10 aa, Artificial Sequence
  Description of Artificial Sequence: Synthetic peptide
  Seed: LGPDGNTPQF (TYRP1_HUMAN)
LLPDGNTPQW

SEQ ID NO: 177691 - protein, 9 aa, Artificial Sequence
  Description of Artificial Sequence: Synthetic peptide
  Seed: SGHNCGTCR (TYRP1_HUMAN)
SVHNCGTCY

SEQ ID NO: 177692 - protein, 11 aa, Artificial Sequence
  Description of Artificial Sequence: Synthetic peptide
  Seed: LISPNSVFSQW (TYRP1_HUMAN)
LTSPNSVFSQY

SEQ ID NO: 177693 - protein, 9 aa, Artificial Sequence
  Description of Artificial Sequence: Synthetic peptide
  Seed: RTTHPLFVI (TYRP1_HUMAN)
RLTHPLFVW

SEQ ID NO: 177694 - protein, 10 aa, Artificial Sequence
  Description of Artificial Sequence: Synthetic peptide
  Seed: MLQEPSFSLP (TYRP1_HUMAN)
MLQEPSFSLF

SEQ ID NO: 177695 - protein, 8 aa, Artificial Sequence
  Description of Artificial Sequence: Synthetic peptide
  Seed: YDPAVRSL (TYRP1_HUMAN)
YQPAVRSL

SEQ ID NO: 177696 - protein, 9 aa, Artificial Sequence
  Description of Artificial Sequence: Synthetic peptide
  Seed: MSAPKLLSL (TYRP1_HUMAN)
MEAPKLLSV

SEQ ID NO: 177697 - protein, 9 aa, Artificial Sequence
  Description of Artificial Sequence: Synthetic peptide
  Seed: FYSNSTNSF (TYRP1_HUMAN)
FASNSTNSY

SEQ ID NO: 177698 - protein, 10 aa, Artificial Sequence
  Description of Artificial Sequence: Synthetic peptide
  Seed: MVPFWPPVTN (TYRP1_HUMAN)
MQPFWPPVTY

SEQ ID NO: 177699 - protein, 9 aa, Artificial Sequence
  Description of Artificial Sequence: Synthetic peptide
  Seed: YLIRARRSM (TYRP1_HUMAN)
YFIRARRSY

SEQ ID NO: 177700 - protein, 9 aa, Artificial Sequence
  Description of Artificial Sequence: Synthetic peptide
  Seed: YNYFVWTHY (TYRP1_HUMAN)
YQYFVWTHV

SEQ ID NO: 177701 - protein, 8 aa, Artificial Sequence
  Description of Artificial Sequence: Synthetic peptide
  Seed: RQYNMVPF (TYRP1_HUMAN)
RTYNMVPY

SEQ ID NO: 177702 - protein, 10 aa, Artificial Sequence
  Description of Artificial Sequence: Synthetic peptide
  Seed: YNADISTFPL (TYRP1_HUMAN)
YPADISTFPA

SEQ ID NO: 177703 - protein, 11 aa, Artificial Sequence
  Description of Artificial Sequence: Synthetic peptide
  Seed: MFVTAPDNLGY (TYRP1_HUMAN)
MVVTAPDNLGW

SEQ ID NO: 177704 - protein, 9 aa, Artificial Sequence
  Description of Artificial Sequence: Synthetic peptide
  Seed: SVPEIIAIA (TYRP1_HUMAN)
SIPEIIAIV

SEQ ID NO: 177705 - protein, 9 aa, Artificial Sequence
  Description of Artificial Sequence: Synthetic peptide
  Seed: QCYAEEYEK (TYRP1_HUMAN)
QVYAEEYER

SEQ ID NO: 177706 - protein, 10 aa, Artificial Sequence
  Description of Artificial Sequence: Synthetic peptide
  Seed: MLQEPSFSLP (TYRP1_HUMAN)
MQQEPSFSLV

SEQ ID NO: 177707 - protein, 9 aa, Artificial Sequence
  Description of Artificial Sequence: Synthetic peptide
  Seed: FSLPYWNFA (TYRP1_HUMAN)
FSLPYWNFL

SEQ ID NO: 177708 - protein, 9 aa, Artificial Sequence
  Description of Artificial Sequence: Synthetic peptide
  Seed: EGYSDPTGK (TYRP1_HUMAN)
EIYSDPTGK

SEQ ID NO: 177709 - protein, 9 aa, Artificial Sequence
  Description of Artificial Sequence: Synthetic peptide
  Seed: GTASYLIRA (TYRP1_HUMAN)
GIASYLIRM

SEQ ID NO: 177710 - protein, 10 aa, Artificial Sequence
  Description of Artificial Sequence: Synthetic peptide
  Seed: FSLPYWNFAT (TYRP1_HUMAN)
FYLPYWNFAI

SEQ ID NO: 177711 - protein, 9 aa, Artificial Sequence
  Description of Artificial Sequence: Synthetic peptide
  Seed: AVVGALLLV (TYRP1_HUMAN)
AVVGALLLW

SEQ ID NO: 177712 - protein, 9 aa, Artificial Sequence
  Description of Artificial Sequence: Synthetic peptide
  Seed: FLTWHRYHL (TYRP1_HUMAN)
FQTWHRYHL

SEQ ID NO: 177713 - protein, 9 aa, Artificial Sequence
  Description of Artificial Sequence: Synthetic peptide
  Seed: QEPSFSLPY (TYRP1_HUMAN)
QSPSFSLPF

SEQ ID NO: 177714 - protein, 9 aa, Artificial Sequence
  Description of Artificial Sequence: Synthetic peptide
  Seed: FLTWHRYHL (TYRP1_HUMAN)
FVTWHRYHY

SEQ ID NO: 177715 - protein, 11 aa, Artificial Sequence
  Description of Artificial Sequence: Synthetic peptide
  Seed: YNMVPFWPPVT (TYRP1_HUMAN)
YLMVPFWPPVA

SEQ ID NO: 177716 - protein, 9 aa, Artificial Sequence
  Description of Artificial Sequence: Synthetic peptide
  Seed: WHRYHLLRL (TYRP1_HUMAN)
WMRYHLLRM

SEQ ID NO: 177717 - protein, 10 aa, Artificial Sequence
  Description of Artificial Sequence: Synthetic peptide
  Seed: RRYNADISTF (TYRP1_HUMAN)
RWYNADISTM

SEQ ID NO: 177718 - protein, 10 aa, Artificial Sequence
  Description of Artificial Sequence: Synthetic peptide
  Seed: MLQEPSFSLP (TYRP1_HUMAN)
MMQEPSFSLY

SEQ ID NO: 177719 - protein, 10 aa, Artificial Sequence
  Description of Artificial Sequence: Synthetic peptide
  Seed: ADSRPHSPQY (TYRP1_HUMAN)
AGSRPHSPQK

SEQ ID NO: 177720 - protein, 9 aa, Artificial Sequence
  Description of Artificial Sequence: Synthetic peptide
  Seed: RTTHPLFVI (TYRP1_HUMAN)
RCTHPLFVW

SEQ ID NO: 177721 - protein, 11 aa, Artificial Sequence
  Description of Artificial Sequence: Synthetic peptide
  Seed: VALIFGTASYL (TYRP1_HUMAN)
VSLIFGTASYV

SEQ ID NO: 177722 - protein, 9 aa, Artificial Sequence
  Description of Artificial Sequence: Synthetic peptide
  Seed: RPGWRGAAC (TYRP1_HUMAN)
RVGWRGAAM

SEQ ID NO: 177723 - protein, 10 aa, Artificial Sequence
  Description of Artificial Sequence: Synthetic peptide
  Seed: ADSRPHSPQY (TYRP1_HUMAN)
AYSRPHSPQW

SEQ ID NO: 177724 - protein, 9 aa, Artificial Sequence
  Description of Artificial Sequence: Synthetic peptide
  Seed: FYSNSTNSF (TYRP1_HUMAN)
FCSNSTNSF

SEQ ID NO: 177725 - protein, 10 aa, Artificial Sequence
  Description of Artificial Sequence: Synthetic peptide
  Seed: VALIFGTASY (TYRP1_HUMAN)
VFLIFGTASY

SEQ ID NO: 177726 - protein, 9 aa, Artificial Sequence
  Description of Artificial Sequence: Synthetic peptide
  Seed: RYHLLRLEK (TYRP1_HUMAN)
RGHLLRLEK

SEQ ID NO: 177727 - protein, 9 aa, Artificial Sequence
  Description of Artificial Sequence: Synthetic peptide
  Seed: RSLHNLAHL (TYRP1_HUMAN)
RSLHNLAHW

SEQ ID NO: 177728 - protein, 10 aa, Artificial Sequence
  Description of Artificial Sequence: Synthetic peptide
  Seed: MQEMLQEPSF (TYRP1_HUMAN)
MYEMLQEPSW

SEQ ID NO: 177729 - protein, 9 aa, Artificial Sequence
  Description of Artificial Sequence: Synthetic peptide
  Seed: SPNSVFSQW (TYRP1_HUMAN)
STNSVFSQF

SEQ ID NO: 177730 - protein, 10 aa, Artificial Sequence
  Description of Artificial Sequence: Synthetic peptide
  Seed: YNMVPFWPPV (TYRP1_HUMAN)
YWMVPFWPPM

SEQ ID NO: 177731 - protein, 8 aa, Artificial Sequence
  Description of Artificial Sequence: Synthetic peptide
  Seed: YFVWTHYY (TYRP1_HUMAN)
YYVWTHYF

SEQ ID NO: 177732 - protein, 10 aa, Artificial Sequence
  Description of Artificial Sequence: Synthetic peptide
  Seed: VVGALLLVAL (TYRP1_HUMAN)
VMGALLLVAV

SEQ ID NO: 177733 - protein, 9 aa, Artificial Sequence
  Description of Artificial Sequence: Synthetic peptide
  Seed: MCCPDLSPV (TYRP1_HUMAN)
MICPDLSPA

SEQ ID NO: 177734 - protein, 10 aa, Artificial Sequence
  Description of Artificial Sequence: Synthetic peptide
  Seed: LPYWNFATGK (TYRP1_HUMAN)
LSYWNFATGK

SEQ ID NO: 177735 - protein, 10 aa, Artificial Sequence
  Description of Artificial Sequence: Synthetic peptide
  Seed: AVVGALLLVA (TYRP1_HUMAN)
ALVGALLLVV

SEQ ID NO: 177736 - protein, 10 aa, Artificial Sequence
  Description of Artificial Sequence: Synthetic peptide
  Seed: VGLFDTPPFY (TYRP1_HUMAN)
VCLFDTPPFY

SEQ ID NO: 177737 - protein, 9 aa, Artificial Sequence
  Description of Artificial Sequence: Synthetic peptide
  Seed: STNSFRNTV (TYRP1_HUMAN)
STNSFRNTM

SEQ ID NO: 177738 - protein, 9 aa, Artificial Sequence
  Description of Artificial Sequence: Synthetic peptide
  Seed: ALLLVALIF (TYRP1_HUMAN)
AKLLVALIF

SEQ ID NO: 177739 - protein, 9 aa, Artificial Sequence
  Description of Artificial Sequence: Synthetic peptide
  Seed: LIFGTASYL (TYRP1_HUMAN)
LMFGTASYW

SEQ ID NO: 177740 - protein, 11 aa, Artificial Sequence
  Description of Artificial Sequence: Synthetic peptide
  Seed: REFSVPEIIAI (TYRP1_HUMAN)
RYFSVPEIIAF

SEQ ID NO: 177741 - protein, 9 aa, Artificial Sequence
  Description of Artificial Sequence: Synthetic peptide
  Seed: MSAPKLLSL (TYRP1_HUMAN)
MQAPKLLSY

SEQ ID NO: 177742 - protein, 9 aa, Artificial Sequence
  Description of Artificial Sequence: Synthetic peptide
  Seed: KYDPAVRSL (TYRP1_HUMAN)
KGDPAVRSV

SEQ ID NO: 177743 - protein, 9 aa, Artificial Sequence
  Description of Artificial Sequence: Synthetic peptide
  Seed: MSAPKLLSL (TYRP1_HUMAN)
MLAPKLLSM

SEQ ID NO: 177744 - protein, 11 aa, Artificial Sequence
  Description of Artificial Sequence: Synthetic peptide
  Seed: YNYFVWTHYYS (TYRP1_HUMAN)
YFYFVWTHYYT

SEQ ID NO: 177745 - protein, 9 aa, Artificial Sequence
  Description of Artificial Sequence: Synthetic peptide
  Seed: VLIVRRNLL (TYRP1_HUMAN)
VAIVRRNLM

SEQ ID NO: 177746 - protein, 10 aa, Artificial Sequence
  Description of Artificial Sequence: Synthetic peptide
  Seed: NISIYNYFVW (TYRP1_HUMAN)
NPSIYNYFVW

SEQ ID NO: 177747 - protein, 9 aa, Artificial Sequence
  Description of Artificial Sequence: Synthetic peptide
  Seed: RSNFDSTLI (TYRP1_HUMAN)
RTNFDSTLI

SEQ ID NO: 177748 - protein, 9 aa, Artificial Sequence
  Description of Artificial Sequence: Synthetic peptide
  Seed: MCCPDLSPV (TYRP1_HUMAN)
MQCPDLSPA

SEQ ID NO: 177749 - protein, 9 aa, Artificial Sequence
  Description of Artificial Sequence: Synthetic peptide
  Seed: LLLFQQARA (TYRP1_HUMAN)
LMLFQQARL

SEQ ID NO: 177750 - protein, 11 aa, Artificial Sequence
  Description of Artificial Sequence: Synthetic peptide
  Seed: YNYFVWTHYYS (TYRP1_HUMAN)
YWYFVWTHYYY

SEQ ID NO: 177751 - protein, 10 aa, Artificial Sequence
  Description of Artificial Sequence: Synthetic peptide
  Seed: SIYNYFVWTH (TYRP1_HUMAN)
SWYNYFVWTK

SEQ ID NO: 177752 - protein, 10 aa, Artificial Sequence
  Description of Artificial Sequence: Synthetic peptide
  Seed: YNADISTFPL (TYRP1_HUMAN)
YMADISTFPF

SEQ ID NO: 177753 - protein, 9 aa, Artificial Sequence
  Description of Artificial Sequence: Synthetic peptide
  Seed: YTYEIQWPS (TYRP1_HUMAN)
YGYEIQWPI

SEQ ID NO: 177754 - protein, 10 aa, Artificial Sequence
  Description of Artificial Sequence: Synthetic peptide
  Seed: ADSRPHSPQY (TYRP1_HUMAN)
AVSRPHSPQK

SEQ ID NO: 177755 - protein, 9 aa, Artificial Sequence
  Description of Artificial Sequence: Synthetic peptide
  Seed: LTWHRYHLL (TYRP1_HUMAN)
LYWHRYHLI

SEQ ID NO: 177756 - protein, 10 aa, Artificial Sequence
  Description of Artificial Sequence: Synthetic peptide
  Seed: FGTASYLIRA (TYRP1_HUMAN)
FGTASYLIRI

SEQ ID NO: 177757 - protein, 10 aa, Artificial Sequence
  Description of Artificial Sequence: Synthetic peptide
  Seed: HLSPNDPIFV (TYRP1_HUMAN)
HQSPNDPIFM

SEQ ID NO: 177758 - protein, 9 aa, Artificial Sequence
  Description of Artificial Sequence: Synthetic peptide
  Seed: STLISPNSV (TYRP1_HUMAN)
SSLISPNSL

SEQ ID NO: 177759 - protein, 9 aa, Artificial Sequence
  Description of Artificial Sequence: Synthetic peptide
  Seed: SEEILGPDG (TYRP1_HUMAN)
SEEILGPDL

SEQ ID NO: 177760 - protein, 9 aa, Artificial Sequence
  Description of Artificial Sequence: Synthetic peptide
  Seed: VGALLLVAL (TYRP1_HUMAN)
VAALLLVAL

SEQ ID NO: 177761 - protein, 9 aa, Artificial Sequence
  Description of Artificial Sequence: Synthetic peptide
  Seed: REFSVPEII (TYRP1_HUMAN)
RHFSVPEIA

SEQ ID NO: 177762 - protein, 10 aa, Artificial Sequence
  Description of Artificial Sequence: Synthetic peptide
  Seed: RTTHPLFVIA (TYRP1_HUMAN)
RNTHPLFVIK

SEQ ID NO: 177763 - protein, 9 aa, Artificial Sequence
  Description of Artificial Sequence: Synthetic peptide
  Seed: ALLLVALIF (TYRP1_HUMAN)
ALLLVALIY

SEQ ID NO: 177764 - protein, 10 aa, Artificial Sequence
  Description of Artificial Sequence: Synthetic peptide
  Seed: VDFSHEGPAF (TYRP1_HUMAN)
VAFSHEGPAL

SEQ ID NO: 177765 - protein, 9 aa, Artificial Sequence
  Description of Artificial Sequence: Synthetic peptide
  Seed: VARPMVQRL (TYRP1_HUMAN)
VQRPMVQRF

SEQ ID NO: 177766 - protein, 9 aa, Artificial Sequence
  Description of Artificial Sequence: Synthetic peptide
  Seed: SGRGRCEAV (TYRP1_HUMAN)
SPRGRCEAA

SEQ ID NO: 177767 - protein, 10 aa, Artificial Sequence
  Description of Artificial Sequence: Synthetic peptide
  Seed: SHEGPAFLTW (TYRP1_HUMAN)
SPEGPAFLTW

SEQ ID NO: 177768 - protein, 9 aa, Artificial Sequence
  Description of Artificial Sequence: Synthetic peptide
  Seed: NADISTFPL (TYRP1_HUMAN)
NADISTFPV

SEQ ID NO: 177769 - protein, 10 aa, Artificial Sequence
  Description of Artificial Sequence: Synthetic peptide
  Seed: RSMDEANQPL (TYRP1_HUMAN)
RMMDEANQPF

SEQ ID NO: 177770 - protein, 9 aa, Artificial Sequence
  Description of Artificial Sequence: Synthetic peptide
  Seed: TFPLENAPI (TYRP1_HUMAN)
TAPLENAPL

SEQ ID NO: 177771 - protein, 9 aa, Artificial Sequence
  Description of Artificial Sequence: Synthetic peptide
  Seed: RSNFDSTLI (TYRP1_HUMAN)
RTNFDSTLM

SEQ ID NO: 177772 - protein, 10 aa, Artificial Sequence
  Description of Artificial Sequence: Synthetic peptide
  Seed: YNYFVWTHYY (TYRP1_HUMAN)
YSYFVWTHYM

SEQ ID NO: 177773 - protein, 10 aa, Artificial Sequence
  Description of Artificial Sequence: Synthetic peptide
  Seed: LIFGTASYLI (TYRP1_HUMAN)
LIFGTASYLV

SEQ ID NO: 177774 - protein, 9 aa, Artificial Sequence
  Description of Artificial Sequence: Synthetic peptide
  Seed: APDNLGYTY (TYRP1_HUMAN)
ARDNLGYTY

SEQ ID NO: 177775 - protein, 9 aa, Artificial Sequence
  Description of Artificial Sequence: Synthetic peptide
  Seed: CTDDLMGSR (TYRP1_HUMAN)
CMDDLMGSY

SEQ ID NO: 177776 - protein, 10 aa, Artificial Sequence
  Description of Artificial Sequence: Synthetic peptide
  Seed: FYSNSTNSFR (TYRP1_HUMAN)
FDSNSTNSFR

SEQ ID NO: 177777 - protein, 9 aa, Artificial Sequence
  Description of Artificial Sequence: Synthetic peptide
  Seed: VCDICTDDL (TYRP1_HUMAN)
VYDICTDDL

SEQ ID NO: 177778 - protein, 10 aa, Artificial Sequence
  Description of Artificial Sequence: Synthetic peptide
  Seed: ADSRPHSPQY (TYRP1_HUMAN)
ATSRPHSPQA

SEQ ID NO: 177779 - protein, 10 aa, Artificial Sequence
  Description of Artificial Sequence: Synthetic peptide
  Seed: LTWHRYHLLR (TYRP1_HUMAN)
LWWHRYHLLK

SEQ ID NO: 177780 - protein, 10 aa, Artificial Sequence
  Description of Artificial Sequence: Synthetic peptide
  Seed: FVLLHTFTDA (TYRP1_HUMAN)
FMLLHTFTDV

SEQ ID NO: 177781 - protein, 10 aa, Artificial Sequence
  Description of Artificial Sequence: Synthetic peptide
  Seed: MSAPKLLSLG (TYRP1_HUMAN)
MFAPKLLSLW

SEQ ID NO: 177782 - protein, 10 aa, Artificial Sequence
  Description of Artificial Sequence: Synthetic peptide
  Seed: LQEPSFSLPY (TYRP1_HUMAN)
LKEPSFSLPY

SEQ ID NO: 177783 - protein, 11 aa, Artificial Sequence
  Description of Artificial Sequence: Synthetic peptide
  Seed: TADSRPHSPQY (TYRP1_HUMAN)
TTDSRPHSPQY

SEQ ID NO: 177784 - protein, 9 aa, Artificial Sequence
  Description of Artificial Sequence: Synthetic peptide
  Seed: MLQEPSFSL (TYRP1_HUMAN)
MWQEPSFSF

SEQ ID NO: 177785 - protein, 9 aa, Artificial Sequence
  Description of Artificial Sequence: Synthetic peptide
  Seed: AVRSLHNLA (TYRP1_HUMAN)
ATRSLHNLK

SEQ ID NO: 177786 - protein, 9 aa, Artificial Sequence
  Description of Artificial Sequence: Synthetic peptide
  Seed: MSAPKLLSL (TYRP1_HUMAN)
MSAPKLLSW

SEQ ID NO: 177787 - protein, 11 aa, Artificial Sequence
  Description of Artificial Sequence: Synthetic peptide
  Seed: RSMDEANQPLL (TYRP1_HUMAN)
RIMDEANQPLW

SEQ ID NO: 177788 - protein, 11 aa, Artificial Sequence
  Description of Artificial Sequence: Synthetic peptide
  Seed: VALIFGTASYL (TYRP1_HUMAN)
VWLIFGTASYV

SEQ ID NO: 177789 - protein, 10 aa, Artificial Sequence
  Description of Artificial Sequence: Synthetic peptide
  Seed: WPPVTNTEMF (TYRP1_HUMAN)
WSPVTNTEMY

SEQ ID NO: 177790 - protein, 10 aa, Artificial Sequence
  Description of Artificial Sequence: Synthetic peptide
  Seed: FWPPVTNTEM (TYRP1_HUMAN)
FVPPVTNTEM

SEQ ID NO: 177791 - protein, 9 aa, Artificial Sequence
  Description of Artificial Sequence: Synthetic peptide
  Seed: VTAPDNLGY (TYRP1_HUMAN)
VTAPDNLGW

SEQ ID NO: 177792 - protein, 11 aa, Artificial Sequence
  Description of Artificial Sequence: Synthetic peptide
  Seed: YNYFVWTHYYS (TYRP1_HUMAN)
YMYFVWTHYYM

SEQ ID NO: 177793 - protein, 9 aa, Artificial Sequence
  Description of Artificial Sequence: Synthetic peptide
  Seed: GPDGNTPQF (TYRP1_HUMAN)
GIDGNTPQI

SEQ ID NO: 177794 - protein, 10 aa, Artificial Sequence
  Description of Artificial Sequence: Synthetic peptide
  Seed: RRYNADISTF (TYRP1_HUMAN)
RHYNADISTW

SEQ ID NO: 177795 - protein, 9 aa, Artificial Sequence
  Description of Artificial Sequence: Synthetic peptide
  Seed: LHTFTDAVF (TYRP1_HUMAN)
LKTFTDAVF

SEQ ID NO: 177796 - protein, 10 aa, Artificial Sequence
  Description of Artificial Sequence: Synthetic peptide
  Seed: YEIQWPSREF (TYRP1_HUMAN)
YQIQWPSREF

SEQ ID NO: 177797 - protein, 9 aa, Artificial Sequence
  Description of Artificial Sequence: Synthetic peptide
  Seed: SFRNTVEGY (TYRP1_HUMAN)
SLRNTVEGF

SEQ ID NO: 177798 - protein, 9 aa, Artificial Sequence
  Description of Artificial Sequence: Synthetic peptide
  Seed: VGQESFGEV (TYRP1_HUMAN)
VTQESFGEL

SEQ ID NO: 177799 - protein, 8 aa, Artificial Sequence
  Description of Artificial Sequence: Synthetic peptide
  Seed: YYSVKKTF (TYRP1_HUMAN)
YSSVKKTL

SEQ ID NO: 177800 - protein, 10 aa, Artificial Sequence
  Description of Artificial Sequence: Synthetic peptide
  Seed: RTTHPLFVIA (TYRP1_HUMAN)
RGTHPLFVIK

SEQ ID NO: 177801 - protein, 9 aa, Artificial Sequence
  Description of Artificial Sequence: Synthetic peptide
  Seed: SVFSQWRVV (TYRP1_HUMAN)
STFSQWRVK

SEQ ID NO: 177802 - protein, 9 aa, Artificial Sequence
  Description of Artificial Sequence: Synthetic peptide
  Seed: GLFDTPPFY (TYRP1_HUMAN)
GVFDTPPFY

SEQ ID NO: 177803 - protein, 9 aa, Artificial Sequence
  Description of Artificial Sequence: Synthetic peptide
  Seed: YLIRARRSM (TYRP1_HUMAN)
YEIRARRSY

SEQ ID NO: 177804 - protein, 10 aa, Artificial Sequence
  Description of Artificial Sequence: Synthetic peptide
  Seed: RSMDEANQPL (TYRP1_HUMAN)
RKMDEANQPV

SEQ ID NO: 177805 - protein, 10 aa, Artificial Sequence
  Description of Artificial Sequence: Synthetic peptide
  Seed: YNADISTFPL (TYRP1_HUMAN)
YAADISTFPI

SEQ ID NO: 177806 - protein, 11 aa, Artificial Sequence
  Description of Artificial Sequence: Synthetic peptide
  Seed: FWPPVTNTEMF (TYRP1_HUMAN)
FKPPVTNTEMW

SEQ ID NO: 177807 - protein, 11 aa, Artificial Sequence
  Description of Artificial Sequence: Synthetic peptide
  Seed: LISPNSVFSQW (TYRP1_HUMAN)
LTSPNSVFSQW

SEQ ID NO: 177808 - protein, 8 aa, Artificial Sequence
  Description of Artificial Sequence: Synthetic peptide
  Seed: RQYNMVPF (TYRP1_HUMAN)
REYNMVPY

SEQ ID NO: 177809 - protein, 9 aa, Artificial Sequence
  Description of Artificial Sequence: Synthetic peptide
  Seed: KLLSLGCIF (TYRP1_HUMAN)
KRLSLGCIY

SEQ ID NO: 177810 - protein, 9 aa, Artificial Sequence
  Description of Artificial Sequence: Synthetic peptide
  Seed: RSNFDSTLI (TYRP1_HUMAN)
RLNFDSTLL

SEQ ID NO: 177811 - protein, 10 aa, Artificial Sequence
  Description of Artificial Sequence: Synthetic peptide
  Seed: YNADISTFPL (TYRP1_HUMAN)
YTADISTFPS

SEQ ID NO: 177812 - protein, 9 aa, Artificial Sequence
  Description of Artificial Sequence: Synthetic peptide
  Seed: TTHPLFVIA (TYRP1_HUMAN)
TTHPLFVIV

SEQ ID NO: 177813 - protein, 9 aa, Artificial Sequence
  Description of Artificial Sequence: Synthetic peptide
  Seed: ALIFGTASY (TYRP1_HUMAN)
AAIFGTASH

SEQ ID NO: 177814 - protein, 9 aa, Artificial Sequence
  Description of Artificial Sequence: Synthetic peptide
  Seed: APDNLGYTY (TYRP1_HUMAN)
AADNLGYTY

SEQ ID NO: 177815 - protein, 9 aa, Artificial Sequence
  Description of Artificial Sequence: Synthetic peptide
  Seed: ARAQFPRQC (TYRP1_HUMAN)
AYAQFPRQL

SEQ ID NO: 177816 - protein, 9 aa, Artificial Sequence
  Description of Artificial Sequence: Synthetic peptide
  Seed: ISIYNYFVW (TYRP1_HUMAN)
IHIYNYFVF

SEQ ID NO: 177817 - protein, 10 aa, Artificial Sequence
  Description of Artificial Sequence: Synthetic peptide
  Seed: HPLFVIATRR (TYRP1_HUMAN)
HFLFVIATRR

SEQ ID NO: 177818 - protein, 9 aa, Artificial Sequence
  Description of Artificial Sequence: Synthetic peptide
  Seed: YYSVKKTFL (TYRP1_HUMAN)
YTSVKKTFY

SEQ ID NO: 177819 - protein, 9 aa, Artificial Sequence
  Description of Artificial Sequence: Synthetic peptide
  Seed: STLISPNSV (TYRP1_HUMAN)
SILISPNSL

SEQ ID NO: 177820 - protein, 9 aa, Artificial Sequence
  Description of Artificial Sequence: Synthetic peptide
  Seed: FPLENAPIG (TYRP1_HUMAN)
FLLENAPIY

SEQ ID NO: 177821 - protein, 9 aa, Artificial Sequence
  Description of Artificial Sequence: Synthetic peptide
  Seed: AFLTWHRYH (TYRP1_HUMAN)
AVLTWHRYK

SEQ ID NO: 177822 - protein, 10 aa, Artificial Sequence
  Description of Artificial Sequence: Synthetic peptide
  Seed: RSMDEANQPL (TYRP1_HUMAN)
RGMDEANQPW

SEQ ID NO: 177823 - protein, 10 aa, Artificial Sequence
  Description of Artificial Sequence: Synthetic peptide
  Seed: LGPDGNTPQF (TYRP1_HUMAN)
LAPDGNTPQY

SEQ ID NO: 177824 - protein, 9 aa, Artificial Sequence
  Description of Artificial Sequence: Synthetic peptide
  Seed: TTHPLFVIA (TYRP1_HUMAN)
TSHPLFVIM

SEQ ID NO: 177825 - protein, 9 aa, Artificial Sequence
  Description of Artificial Sequence: Synthetic peptide
  Seed: AVFDEWLRR (TYRP1_HUMAN)
AQFDEWLRR

SEQ ID NO: 177826 - protein, 9 aa, Artificial Sequence
  Description of Artificial Sequence: Synthetic peptide
  Seed: VLLHTFTDA (TYRP1_HUMAN)
VMLHTFTDA

SEQ ID NO: 177827 - protein, 9 aa, Artificial Sequence
  Description of Artificial Sequence: Synthetic peptide
  Seed: ALIFGTASY (TYRP1_HUMAN)
AYIFGTASI

SEQ ID NO: 177828 - protein, 11 aa, Artificial Sequence
  Description of Artificial Sequence: Synthetic peptide
  Seed: MLQEPSFSLPY (TYRP1_HUMAN)
MIQEPSFSLPV

SEQ ID NO: 177829 - protein, 9 aa, Artificial Sequence
  Description of Artificial Sequence: Synthetic peptide
  Seed: RARRSMDEA (TYRP1_HUMAN)
RTRRSMDEC

SEQ ID NO: 177830 - protein, 9 aa, Artificial Sequence
  Description of Artificial Sequence: Synthetic peptide
  Seed: MAKRTTHPL (TYRP1_HUMAN)
MTKRTTHPG

SEQ ID NO: 177831 - protein, 9 aa, Artificial Sequence
  Description of Artificial Sequence: Synthetic peptide
  Seed: AVVGALLLV (TYRP1_HUMAN)
ASVGALLLI

SEQ ID NO: 177832 - protein, 9 aa, Artificial Sequence
  Description of Artificial Sequence: Synthetic peptide
  Seed: FYSNSTNSF (TYRP1_HUMAN)
FTSNSTNSV

SEQ ID NO: 177833 - protein, 9 aa, Artificial Sequence
  Description of Artificial Sequence: Synthetic peptide
  Seed: FSVPEIIAI (TYRP1_HUMAN)
FSVPEIIAW

SEQ ID NO: 177834 - protein, 10 aa, Artificial Sequence
  Description of Artificial Sequence: Synthetic peptide
  Seed: QFENISIYNY (TYRP1_HUMAN)
QVENISIYNW

SEQ ID NO: 177835 - protein, 9 aa, Artificial Sequence
  Description of Artificial Sequence: Synthetic peptide
  Seed: RGRCEAVTA (TYRP1_HUMAN)
RMRCEAVTM

SEQ ID NO: 177836 - protein, 10 aa, Artificial Sequence
  Description of Artificial Sequence: Synthetic peptide
  Seed: RTTHPLFVIA (TYRP1_HUMAN)
RNTHPLFVIA

SEQ ID NO: 177837 - protein, 9 aa, Artificial Sequence
  Description of Artificial Sequence: Synthetic peptide
  Seed: SFRNTVEGY (TYRP1_HUMAN)
SFRNTVEGF

SEQ ID NO: 177838 - protein, 10 aa, Artificial Sequence
  Description of Artificial Sequence: Synthetic peptide
  Seed: FVTAPDNLGY (TYRP1_HUMAN)
FFTAPDNLGY

SEQ ID NO: 177839 - protein, 10 aa, Artificial Sequence
  Description of Artificial Sequence: Synthetic peptide
  Seed: VALIFGTASY (TYRP1_HUMAN)
VKLIFGTASF

SEQ ID NO: 177840 - protein, 8 aa, Artificial Sequence
  Description of Artificial Sequence: Synthetic peptide
  Seed: SVPEIIAI (TYRP1_HUMAN)
SPPEIIAI

SEQ ID NO: 177841 - protein, 9 aa, Artificial Sequence
  Description of Artificial Sequence: Synthetic peptide
  Seed: ENAPIGHNR (TYRP1_HUMAN)
ETAPIGHNM

SEQ ID NO: 177842 - protein, 9 aa, Artificial Sequence
  Description of Artificial Sequence: Synthetic peptide
  Seed: IAIAVVGAL (TYRP1_HUMAN)
INIAVVGAY

SEQ ID NO: 177843 - protein, 10 aa, Artificial Sequence
  Description of Artificial Sequence: Synthetic peptide
  Seed: RQCATVEALR (TYRP1_HUMAN)
RVCATVEALK

SEQ ID NO: 177844 - protein, 9 aa, Artificial Sequence
  Description of Artificial Sequence: Synthetic peptide
  Seed: RSLHNLAHL (TYRP1_HUMAN)
RSLHNLAHM

SEQ ID NO: 177845 - protein, 10 aa, Artificial Sequence
  Description of Artificial Sequence: Synthetic peptide
  Seed: LLHTFTDAVF (TYRP1_HUMAN)
LHHTFTDAVF

SEQ ID NO: 177846 - protein, 9 aa, Artificial Sequence
  Description of Artificial Sequence: Synthetic peptide
  Seed: SPNSVFSQW (TYRP1_HUMAN)
SCNSVFSQW

SEQ ID NO: 177847 - protein, 9 aa, Artificial Sequence
  Description of Artificial Sequence: Synthetic peptide
  Seed: LIFGTASYL (TYRP1_HUMAN)
LQFGTASYR

SEQ ID NO: 177848 - protein, 9 aa, Artificial Sequence
  Description of Artificial Sequence: Synthetic peptide
  Seed: RQYNMVPFW (TYRP1_HUMAN)
RLYNMVPFY

SEQ ID NO: 177849 - protein, 9 aa, Artificial Sequence
  Description of Artificial Sequence: Synthetic peptide
  Seed: VTAPDNLGY (TYRP1_HUMAN)
VQAPDNLGY

SEQ ID NO: 177850 - protein, 10 aa, Artificial Sequence
  Description of Artificial Sequence: Synthetic peptide
  Seed: STLISPNSVF (TYRP1_HUMAN)
SLLISPNSVF

SEQ ID NO: 177851 - protein, 9 aa, Artificial Sequence
  Description of Artificial Sequence: Synthetic peptide
  Seed: GPDGNTPQF (TYRP1_HUMAN)
GTDGNTPQM

SEQ ID NO: 177852 - protein, 9 aa, Artificial Sequence
  Description of Artificial Sequence: Synthetic peptide
  Seed: VFDEWLRRY (TYRP1_HUMAN)
VADEWLRRY

SEQ ID NO: 177853 - protein, 9 aa, Artificial Sequence
  Description of Artificial Sequence: Synthetic peptide
  Seed: KLLSLGCIF (TYRP1_HUMAN)
KYLSLGCIF

SEQ ID NO: 177854 - protein, 10 aa, Artificial Sequence
  Description of Artificial Sequence: Synthetic peptide
  Seed: VGLFDTPPFY (TYRP1_HUMAN)
VYLFDTPPFY

SEQ ID NO: 177855 - protein, 10 aa, Artificial Sequence
  Description of Artificial Sequence: Synthetic peptide
  Seed: YTYEIQWPSR (TYRP1_HUMAN)
YMYEIQWPSK

SEQ ID NO: 177856 - protein, 9 aa, Artificial Sequence
  Description of Artificial Sequence: Synthetic peptide
  Seed: ALLLVALIF (TYRP1_HUMAN)
AKLLVALIM

SEQ ID NO: 177857 - protein, 9 aa, Artificial Sequence
  Description of Artificial Sequence: Synthetic peptide
  Seed: YLIRARRSM (TYRP1_HUMAN)
YNIRARRSY

SEQ ID NO: 177858 - protein, 9 aa, Artificial Sequence
  Description of Artificial Sequence: Synthetic peptide
  Seed: WHRYHLLRL (TYRP1_HUMAN)
WKRYHLLRY

SEQ ID NO: 177859 - protein, 10 aa, Artificial Sequence
  Description of Artificial Sequence: Synthetic peptide
  Seed: YNADISTFPL (TYRP1_HUMAN)
YIADISTFPA

SEQ ID NO: 177860 - protein, 9 aa, Artificial Sequence
  Description of Artificial Sequence: Synthetic peptide
  Seed: AQFPRQCAT (TYRP1_HUMAN)
AMFPRQCAW

SEQ ID NO: 177861 - protein, 9 aa, Artificial Sequence
  Description of Artificial Sequence: Synthetic peptide
  Seed: LTWHRYHLL (TYRP1_HUMAN)
LLWHRYHLL

SEQ ID NO: 177862 - protein, 10 aa, Artificial Sequence
  Description of Artificial Sequence: Synthetic peptide
  Seed: RSLHNLAHLF (TYRP1_HUMAN)
RVLHNLAHLY

SEQ ID NO: 177863 - protein, 9 aa, Artificial Sequence
  Description of Artificial Sequence: Synthetic peptide
  Seed: FSVPEIIAI (TYRP1_HUMAN)
FPVPEIIAL

SEQ ID NO: 177864 - protein, 11 aa, Artificial Sequence
  Description of Artificial Sequence: Synthetic peptide
  Seed: KEEKNHFVRAL (TYRP1_HUMAN)
KEEKNHFVRAY

SEQ ID NO: 177865 - protein, 10 aa, Artificial Sequence
  Description of Artificial Sequence: Synthetic peptide
  Seed: GKYDPAVRSL (TYRP1_HUMAN)
GRYDPAVRSW

SEQ ID NO: 177866 - protein, 10 aa, Artificial Sequence
  Description of Artificial Sequence: Synthetic peptide
  Seed: FVLLHTFTDA (TYRP1_HUMAN)
FELLHTFTDI

SEQ ID NO: 177867 - protein, 9 aa, Artificial Sequence
  Description of Artificial Sequence: Synthetic peptide
  Seed: TLISPNSVF (TYRP1_HUMAN)
TAISPNSVY

SEQ ID NO: 177868 - protein, 8 aa, Artificial Sequence
  Description of Artificial Sequence: Synthetic peptide
  Seed: YSDPTGKY (TYRP1_HUMAN)
YNDPTGKL

SEQ ID NO: 177869 - protein, 9 aa, Artificial Sequence
  Description of Artificial Sequence: Synthetic peptide
  Seed: WPLRFFNRT (TYRP1_HUMAN)
WPLRFFNRA

SEQ ID NO: 177870 - protein, 10 aa, Artificial Sequence
  Description of Artificial Sequence: Synthetic peptide
  Seed: ADSRPHSPQY (TYRP1_HUMAN)
AGSRPHSPQA

SEQ ID NO: 177871 - protein, 11 aa, Artificial Sequence
  Description of Artificial Sequence: Synthetic peptide
  Seed: MLQEPSFSLPY (TYRP1_HUMAN)
MTQEPSFSLPY

SEQ ID NO: 177872 - protein, 9 aa, Artificial Sequence
  Description of Artificial Sequence: Synthetic peptide
  Seed: SVPEIIAIA (TYRP1_HUMAN)
SQPEIIAII

SEQ ID NO: 177873 - protein, 9 aa, Artificial Sequence
  Description of Artificial Sequence: Synthetic peptide
  Seed: SMDEANQPL (TYRP1_HUMAN)
SEDEANQPV

SEQ ID NO: 177874 - protein, 10 aa, Artificial Sequence
  Description of Artificial Sequence: Synthetic peptide
  Seed: RTTHPLFVIA (TYRP1_HUMAN)
RWTHPLFVIA

SEQ ID NO: 177875 - protein, 10 aa, Artificial Sequence
  Description of Artificial Sequence: Synthetic peptide
  Seed: LLVALIFGTA (TYRP1_HUMAN)
LQVALIFGTV

SEQ ID NO: 177876 - protein, 11 aa, Artificial Sequence
  Description of Artificial Sequence: Synthetic peptide
  Seed: NYFVWTHYYSV (TYRP1_HUMAN)
NYFVWTHYYSL

SEQ ID NO: 177877 - protein, 9 aa, Artificial Sequence
  Description of Artificial Sequence: Synthetic peptide
  Seed: DSLEDYDTL (TYRP1_HUMAN)
DVLEDYDTY

SEQ ID NO: 177878 - protein, 9 aa, Artificial Sequence
  Description of Artificial Sequence: Synthetic peptide
  Seed: QEPSFSLPY (TYRP1_HUMAN)
QSPSFSLPY

SEQ ID NO: 177879 - protein, 9 aa, Artificial Sequence
  Description of Artificial Sequence: Synthetic peptide
  Seed: RSLHNLAHL (TYRP1_HUMAN)
RHLHNLAHF

SEQ ID NO: 177880 - protein, 9 aa, Artificial Sequence
  Description of Artificial Sequence: Synthetic peptide
  Seed: MLQEPSFSL (TYRP1_HUMAN)
MNQEPSFSY

SEQ ID NO: 177881 - protein, 9 aa, Artificial Sequence
  Description of Artificial Sequence: Synthetic peptide
  Seed: LIFGTASYL (TYRP1_HUMAN)
LLFGTASYT

SEQ ID NO: 177882 - protein, 9 aa, Artificial Sequence
  Description of Artificial Sequence: Synthetic peptide
  Seed: KLLSLGCIF (TYRP1_HUMAN)
KFLSLGCIY

SEQ ID NO: 177883 - protein, 9 aa, Artificial Sequence
  Description of Artificial Sequence: Synthetic peptide
  Seed: QEPSFSLPY (TYRP1_HUMAN)
QYPSFSLPY

SEQ ID NO: 177884 - protein, 9 aa, Artificial Sequence
  Description of Artificial Sequence: Synthetic peptide
  Seed: NMVPFWPPV (TYRP1_HUMAN)
NIVPFWPPV

SEQ ID NO: 177885 - protein, 10 aa, Artificial Sequence
  Description of Artificial Sequence: Synthetic peptide
  Seed: FWPPVTNTEM (TYRP1_HUMAN)
FMPPVTNTEI

SEQ ID NO: 177886 - protein, 9 aa, Artificial Sequence
  Description of Artificial Sequence: Synthetic peptide
  Seed: GTASYLIRA (TYRP1_HUMAN)
GTASYLIRL

SEQ ID NO: 177887 - protein, 10 aa, Artificial Sequence
  Description of Artificial Sequence: Synthetic peptide
  Seed: YNYFVWTHYY (TYRP1_HUMAN)
YNYFVWTHYF

SEQ ID NO: 177888 - protein, 9 aa, Artificial Sequence
  Description of Artificial Sequence: Synthetic peptide
  Seed: MSAPKLLSL (TYRP1_HUMAN)
MEAPKLLSL

SEQ ID NO: 177889 - protein, 8 aa, Artificial Sequence
  Description of Artificial Sequence: Synthetic peptide
  Seed: YSDPTGKY (TYRP1_HUMAN)
YNDPTGKI

SEQ ID NO: 177890 - protein, 9 aa, Artificial Sequence
  Description of Artificial Sequence: Synthetic peptide
  Seed: FTDAVFDEW (TYRP1_HUMAN)
FVDAVFDEF

SEQ ID NO: 177891 - protein, 9 aa, Artificial Sequence
  Description of Artificial Sequence: Synthetic peptide
  Seed: RYNADISTF (TYRP1_HUMAN)
RWNADISTW

SEQ ID NO: 177892 - protein, 9 aa, Artificial Sequence
  Description of Artificial Sequence: Synthetic peptide
  Seed: FLTWHRYHL (TYRP1_HUMAN)
FMTWHRYHL

SEQ ID NO: 177893 - protein, 9 aa, Artificial Sequence
  Description of Artificial Sequence: Synthetic peptide
  Seed: RYNADISTF (TYRP1_HUMAN)
RENADISTY

SEQ ID NO: 177894 - protein, 10 aa, Artificial Sequence
  Description of Artificial Sequence: Synthetic peptide
  Seed: RSMDEANQPL (TYRP1_HUMAN)
RMMDEANQPI

SEQ ID NO: 177895 - protein, 9 aa, Artificial Sequence
  Description of Artificial Sequence: Synthetic peptide
  Seed: VGALLLVAL (TYRP1_HUMAN)
VMALLLVAL

SEQ ID NO: 177896 - protein, 11 aa, Artificial Sequence
  Description of Artificial Sequence: Synthetic peptide
  Seed: HLSPNDPIFVL (TYRP1_HUMAN)
HASPNDPIFVF

SEQ ID NO: 177897 - protein, 9 aa, Artificial Sequence
  Description of Artificial Sequence: Synthetic peptide
  Seed: LQNPNQSVV (TYRP1_HUMAN)
LENPNQSVV

SEQ ID NO: 177898 - protein, 10 aa, Artificial Sequence
  Description of Artificial Sequence: Synthetic peptide
  Seed: LLLVALIFGT (TYRP1_HUMAN)
LHLVALIFGV

SEQ ID NO: 177899 - protein, 9 aa, Artificial Sequence
  Description of Artificial Sequence: Synthetic peptide
  Seed: VTAPDNLGY (TYRP1_HUMAN)
VAAPDNLGY

SEQ ID NO: 177900 - protein, 11 aa, Artificial Sequence
  Description of Artificial Sequence: Synthetic peptide
  Seed: LLSLGCIFFPL (TYRP1_HUMAN)
LMSLGCIFFPV

SEQ ID NO: 177901 - protein, 10 aa, Artificial Sequence
  Description of Artificial Sequence: Synthetic peptide
  Seed: ATVEALRSGM (TYRP1_HUMAN)
ALVEALRSGV

SEQ ID NO: 177902 - protein, 11 aa, Artificial Sequence
  Description of Artificial Sequence: Synthetic peptide
  Seed: RRYNADISTFP (TYRP1_HUMAN)
RMYNADISTFF

SEQ ID NO: 177903 - protein, 9 aa, Artificial Sequence
  Description of Artificial Sequence: Synthetic peptide
  Seed: FSHEGPAFL (TYRP1_HUMAN)
FIHEGPAFT

SEQ ID NO: 177904 - protein, 9 aa, Artificial Sequence
  Description of Artificial Sequence: Synthetic peptide
  Seed: EEYEKLQNP (TYRP1_HUMAN)
EEYEKLQNF

SEQ ID NO: 177905 - protein, 11 aa, Artificial Sequence
  Description of Artificial Sequence: Synthetic peptide
  Seed: MFVTAPDNLGY (TYRP1_HUMAN)
MMVTAPDNLGW

SEQ ID NO: 177906 - protein, 10 aa, Artificial Sequence
  Description of Artificial Sequence: Synthetic peptide
  Seed: VGLFDTPPFY (TYRP1_HUMAN)
VKLFDTPPFF

SEQ ID NO: 177907 - protein, 11 aa, Artificial Sequence
  Description of Artificial Sequence: Synthetic peptide
  Seed: EVWPLRFFNRT (TYRP1_HUMAN)
EWWPLRFFNRR

SEQ ID NO: 177908 - protein, 9 aa, Artificial Sequence
  Description of Artificial Sequence: Synthetic peptide
  Seed: SMDEANQPL (TYRP1_HUMAN)
SMDEANQPI

SEQ ID NO: 177909 - protein, 9 aa, Artificial Sequence
  Description of Artificial Sequence: Synthetic peptide
  Seed: RSLHNLAHL (TYRP1_HUMAN)
RQLHNLAHI

SEQ ID NO: 177910 - protein, 10 aa, Artificial Sequence
  Description of Artificial Sequence: Synthetic peptide
  Seed: TPQFENISIY (TYRP1_HUMAN)
TNQFENISIM

SEQ ID NO: 177911 - protein, 10 aa, Artificial Sequence
  Description of Artificial Sequence: Synthetic peptide
  Seed: HLSPNDPIFV (TYRP1_HUMAN)
HQSPNDPIFL

SEQ ID NO: 177912 - protein, 11 aa, Artificial Sequence
  Description of Artificial Sequence: Synthetic peptide
  Seed: FLNGTGGQTHL (TYRP1_HUMAN)
FGNGTGGQTHY

SEQ ID NO: 177913 - protein, 9 aa, Artificial Sequence
  Description of Artificial Sequence: Synthetic peptide
  Seed: MAKRTTHPL (TYRP1_HUMAN)
MIKRTTHPL

SEQ ID NO: 177914 - protein, 11 aa, Artificial Sequence
  Description of Artificial Sequence: Synthetic peptide
  Seed: VALIFGTASYL (TYRP1_HUMAN)
VFLIFGTASYL

SEQ ID NO: 177915 - protein, 10 aa, Artificial Sequence
  Description of Artificial Sequence: Synthetic peptide
  Seed: ALIFGTASYL (TYRP1_HUMAN)
ALIFGTASYV

SEQ ID NO: 177916 - protein, 10 aa, Artificial Sequence
  Description of Artificial Sequence: Synthetic peptide
  Seed: YNYFVWTHYY (TYRP1_HUMAN)
YGYFVWTHYY

SEQ ID NO: 177917 - protein, 11 aa, Artificial Sequence
  Description of Artificial Sequence: Synthetic peptide
  Seed: QEMLQEPSFSL (TYRP1_HUMAN)
QNMLQEPSFSV

SEQ ID NO: 177918 - protein, 9 aa, Artificial Sequence
  Description of Artificial Sequence: Synthetic peptide
  Seed: FSLPYWNFA (TYRP1_HUMAN)
FALPYWNFI

SEQ ID NO: 177919 - protein, 9 aa, Artificial Sequence
  Description of Artificial Sequence: Synthetic peptide
  Seed: LHNLAHLFL (TYRP1_HUMAN)
LMNLAHLFF

SEQ ID NO: 177920 - protein, 9 aa, Artificial Sequence
  Description of Artificial Sequence: Synthetic peptide
  Seed: REFSVPEII (TYRP1_HUMAN)
RQFSVPEIW

SEQ ID NO: 177921 - protein, 10 aa, Artificial Sequence
  Description of Artificial Sequence: Synthetic peptide
  Seed: YNYFVWTHYY (TYRP1_HUMAN)
YFYFVWTHYP

SEQ ID NO: 177922 - protein, 10 aa, Artificial Sequence
  Description of Artificial Sequence: Synthetic peptide
  Seed: YFVWTHYYSV (TYRP1_HUMAN)
YAVWTHYYSL

SEQ ID NO: 177923 - protein, 9 aa, Artificial Sequence
  Description of Artificial Sequence: Synthetic peptide
  Seed: LLSLGCIFF (TYRP1_HUMAN)
LTSLGCIFW

SEQ ID NO: 177924 - protein, 9 aa, Artificial Sequence
  Description of Artificial Sequence: Synthetic peptide
  Seed: SGRGRCEAV (TYRP1_HUMAN)
SMRGRCEAM

SEQ ID NO: 177925 - protein, 9 aa, Artificial Sequence
  Description of Artificial Sequence: Synthetic peptide
  Seed: LLVALIFGT (TYRP1_HUMAN)
LTVALIFGM

SEQ ID NO: 177926 - protein, 9 aa, Artificial Sequence
  Description of Artificial Sequence: Synthetic peptide
  Seed: SPNSVFSQW (TYRP1_HUMAN)
SPNSVFSQT

SEQ ID NO: 177927 - protein, 10 aa, Artificial Sequence
  Description of Artificial Sequence: Synthetic peptide
  Seed: VGLFDTPPFY (TYRP1_HUMAN)
VDLFDTPPFY

SEQ ID NO: 177928 - protein, 10 aa, Artificial Sequence
  Description of Artificial Sequence: Synthetic peptide
  Seed: SVKKTFLGVG (TYRP1_HUMAN)
SSKKTFLGVA

SEQ ID NO: 177929 - protein, 9 aa, Artificial Sequence
  Description of Artificial Sequence: Synthetic peptide
  Seed: ALIFGTASY (TYRP1_HUMAN)
AQIFGTASM

SEQ ID NO: 177930 - protein, 9 aa, Artificial Sequence
  Description of Artificial Sequence: Synthetic peptide
  Seed: SVPEIIAIA (TYRP1_HUMAN)
SAPEIIAIH

SEQ ID NO: 177931 - protein, 9 aa, Artificial Sequence
  Description of Artificial Sequence: Synthetic peptide
  Seed: QEMLQEPSF (TYRP1_HUMAN)
QAMLQEPSF

SEQ ID NO: 177932 - protein, 10 aa, Artificial Sequence
  Description of Artificial Sequence: Synthetic peptide
  Seed: MVPFWPPVTN (TYRP1_HUMAN)
MWPFWPPVTY

SEQ ID NO: 177933 - protein, 9 aa, Artificial Sequence
  Description of Artificial Sequence: Synthetic peptide
  Seed: ALIFGTASY (TYRP1_HUMAN)
AKIFGTASI

SEQ ID NO: 177934 - protein, 11 aa, Artificial Sequence
  Description of Artificial Sequence: Synthetic peptide
  Seed: MAKRTTHPLFV (TYRP1_HUMAN)
MSKRTTHPLFK

SEQ ID NO: 177935 - protein, 9 aa, Artificial Sequence
  Description of Artificial Sequence: Synthetic peptide
  Seed: IAVVGALLL (TYRP1_HUMAN)
ITVVGALLF

SEQ ID NO: 177936 - protein, 10 aa, Artificial Sequence
  Description of Artificial Sequence: Synthetic peptide
  Seed: FVTAPDNLGY (TYRP1_HUMAN)
FATAPDNLGF

SEQ ID NO: 177937 - protein, 10 aa, Artificial Sequence
  Description of Artificial Sequence: Synthetic peptide
  Seed: GKYDPAVRSL (TYRP1_HUMAN)
GYYDPAVRSF

SEQ ID NO: 177938 - protein, 9 aa, Artificial Sequence
  Description of Artificial Sequence: Synthetic peptide
  Seed: VCDICTDDL (TYRP1_HUMAN)
VYDICTDDM

SEQ ID NO: 177939 - protein, 10 aa, Artificial Sequence
  Description of Artificial Sequence: Synthetic peptide
  Seed: STFPLENAPI (TYRP1_HUMAN)
SLFPLENAPV

SEQ ID NO: 177940 - protein, 9 aa, Artificial Sequence
  Description of Artificial Sequence: Synthetic peptide
  Seed: MCCPDLSPV (TYRP1_HUMAN)
MSCPDLSPV

SEQ ID NO: 177941 - protein, 9 aa, Artificial Sequence
  Description of Artificial Sequence: Synthetic peptide
  Seed: IAIAVVGAL (TYRP1_HUMAN)
ILIAVVGAA

SEQ ID NO: 177942 - protein, 10 aa, Artificial Sequence
  Description of Artificial Sequence: Synthetic peptide
  Seed: YNYFVWTHYY (TYRP1_HUMAN)
YFYFVWTHYI

SEQ ID NO: 177943 - protein, 9 aa, Artificial Sequence
  Description of Artificial Sequence: Synthetic peptide
  Seed: GLFDTPPFY (TYRP1_HUMAN)
GGFDTPPFK

SEQ ID NO: 177944 - protein, 9 aa, Artificial Sequence
  Description of Artificial Sequence: Synthetic peptide
  Seed: AIAVVGALL (TYRP1_HUMAN)
AAAVVGALF

SEQ ID NO: 177945 - protein, 10 aa, Artificial Sequence
  Description of Artificial Sequence: Synthetic peptide
  Seed: RRYNADISTF (TYRP1_HUMAN)
RPYNADISTI

SEQ ID NO: 177946 - protein, 10 aa, Artificial Sequence
  Description of Artificial Sequence: Synthetic peptide
  Seed: SLGCIFFPLL (TYRP1_HUMAN)
SLGCIFFPLV

SEQ ID NO: 177947 - protein, 10 aa, Artificial Sequence
  Description of Artificial Sequence: Synthetic peptide
  Seed: RSMDEANQPL (TYRP1_HUMAN)
RRMDEANQPV

SEQ ID NO: 177948 - protein, 9 aa, Artificial Sequence
  Description of Artificial Sequence: Synthetic peptide
  Seed: APKLLSLGC (TYRP1_HUMAN)
APKLLSLGV

SEQ ID NO: 177949 - protein, 11 aa, Artificial Sequence
  Description of Artificial Sequence: Synthetic peptide
  Seed: VTAPDNLGYTY (TYRP1_HUMAN)
VSAPDNLGYTI

SEQ ID NO: 177950 - protein, 10 aa, Artificial Sequence
  Description of Artificial Sequence: Synthetic peptide
  Seed: VLLHTFTDAV (TYRP1_HUMAN)
VTLHTFTDAV

SEQ ID NO: 177951 - protein, 9 aa, Artificial Sequence
  Description of Artificial Sequence: Synthetic peptide
  Seed: VRSLHNLAH (TYRP1_HUMAN)
VRSLHNLAL

SEQ ID NO: 177952 - protein, 10 aa, Artificial Sequence
  Description of Artificial Sequence: Synthetic peptide
  Seed: YFVWTHYYSV (TYRP1_HUMAN)
YFVWTHYYSY

SEQ ID NO: 177953 - protein, 10 aa, Artificial Sequence
  Description of Artificial Sequence: Synthetic peptide
  Seed: ADSRPHSPQY (TYRP1_HUMAN)
APSRPHSPQK

SEQ ID NO: 177954 - protein, 9 aa, Artificial Sequence
  Description of Artificial Sequence: Synthetic peptide
  Seed: FLNGTGGQT (TYRP1_HUMAN)
FLNGTGGQI

SEQ ID NO: 177955 - protein, 9 aa, Artificial Sequence
  Description of Artificial Sequence: Synthetic peptide
  Seed: SVPEIIAIA (TYRP1_HUMAN)
SVPEIIAIV

SEQ ID NO: 177956 - protein, 11 aa, Artificial Sequence
  Description of Artificial Sequence: Synthetic peptide
  Seed: REFSVPEIIAI (TYRP1_HUMAN)
RLFSVPEIIAW

SEQ ID NO: 177957 - protein, 9 aa, Artificial Sequence
  Description of Artificial Sequence: Synthetic peptide
  Seed: TADSRPHSP (TYRP1_HUMAN)
TFDSRPHSV

SEQ ID NO: 177958 - protein, 9 aa, Artificial Sequence
  Description of Artificial Sequence: Synthetic peptide
  Seed: RQYNMVPFW (TYRP1_HUMAN)
RIYNMVPFV

SEQ ID NO: 177959 - protein, 9 aa, Artificial Sequence
  Description of Artificial Sequence: Synthetic peptide
  Seed: LTWHRYHLL (TYRP1_HUMAN)
LVWHRYHLK

SEQ ID NO: 177960 - protein, 9 aa, Artificial Sequence
  Description of Artificial Sequence: Synthetic peptide
  Seed: REFSVPEII (TYRP1_HUMAN)
RMFSVPEIW

SEQ ID NO: 177961 - protein, 9 aa, Artificial Sequence
  Description of Artificial Sequence: Synthetic peptide
  Seed: YLIRARRSM (TYRP1_HUMAN)
YMIRARRSW

SEQ ID NO: 177962 - protein, 10 aa, Artificial Sequence
  Description of Artificial Sequence: Synthetic peptide
  Seed: SREFSVPEII (TYRP1_HUMAN)
SNEFSVPEIL

SEQ ID NO: 177963 - protein, 9 aa, Artificial Sequence
  Description of Artificial Sequence: Synthetic peptide
  Seed: GLFDTPPFY (TYRP1_HUMAN)
GAFDTPPFK

SEQ ID NO: 177964 - protein, 9 aa, Artificial Sequence
  Description of Artificial Sequence: Synthetic peptide
  Seed: VWPLRFFNR (TYRP1_HUMAN)
VYPLRFFNR

SEQ ID NO: 177965 - protein, 9 aa, Artificial Sequence
  Description of Artificial Sequence: Synthetic peptide
  Seed: SVPEIIAIA (TYRP1_HUMAN)
SIPEIIAII

SEQ ID NO: 177966 - protein, 9 aa, Artificial Sequence
  Description of Artificial Sequence: Synthetic peptide
  Seed: KLLSLGCIF (TYRP1_HUMAN)
KQLSLGCII

SEQ ID NO: 177967 - protein, 9 aa, Artificial Sequence
  Description of Artificial Sequence: Synthetic peptide
  Seed: RGAACDQRV (TYRP1_HUMAN)
RMAACDQRV

SEQ ID NO: 177968 - protein, 9 aa, Artificial Sequence
  Description of Artificial Sequence: Synthetic peptide
  Seed: GTASYLIRA (TYRP1_HUMAN)
GMASYLIRT

SEQ ID NO: 177969 - protein, 10 aa, Artificial Sequence
  Description of Artificial Sequence: Synthetic peptide
  Seed: YTYEIQWPSR (TYRP1_HUMAN)
YVYEIQWPSR

SEQ ID NO: 177970 - protein, 10 aa, Artificial Sequence
  Description of Artificial Sequence: Synthetic peptide
  Seed: FVTAPDNLGY (TYRP1_HUMAN)
FITAPDNLGF

SEQ ID NO: 177971 - protein, 10 aa, Artificial Sequence
  Description of Artificial Sequence: Synthetic peptide
  Seed: RRNLLDLSKE (TYRP1_HUMAN)
RRNLLDLSKM

SEQ ID NO: 177972 - protein, 10 aa, Artificial Sequence
  Description of Artificial Sequence: Synthetic peptide
  Seed: RVVCDSLEDY (TYRP1_HUMAN)
RMVCDSLEDY

SEQ ID NO: 177973 - protein, 10 aa, Artificial Sequence
  Description of Artificial Sequence: Synthetic peptide
  Seed: LTWHRYHLLR (TYRP1_HUMAN)
LIWHRYHLLR

SEQ ID NO: 177974 - protein, 9 aa, Artificial Sequence
  Description of Artificial Sequence: Synthetic peptide
  Seed: RQCATVEAL (TYRP1_HUMAN)
RICATVEAL

SEQ ID NO: 177975 - protein, 10 aa, Artificial Sequence
  Description of Artificial Sequence: Synthetic peptide
  Seed: SVKKTFLGVG (TYRP1_HUMAN)
SAKKTFLGVK

SEQ ID NO: 177976 - protein, 9 aa, Artificial Sequence
  Description of Artificial Sequence: Synthetic peptide
  Seed: DSRPHSPQY (TYRP1_HUMAN)
DVRPHSPQF

SEQ ID NO: 177977 - protein, 10 aa, Artificial Sequence
  Description of Artificial Sequence: Synthetic peptide
  Seed: FVWTHYYSVK (TYRP1_HUMAN)
FVWTHYYSVI

SEQ ID NO: 177978 - protein, 8 aa, Artificial Sequence
  Description of Artificial Sequence: Synthetic peptide
  Seed: FSHEGPAF (TYRP1_HUMAN)
FMHEGPAF

SEQ ID NO: 177979 - protein, 10 aa, Artificial Sequence
  Description of Artificial Sequence: Synthetic peptide
  Seed: RRYNADISTF (TYRP1_HUMAN)
RLYNADISTI

SEQ ID NO: 177980 - protein, 8 aa, Artificial Sequence
  Description of Artificial Sequence: Synthetic peptide
  Seed: LIRARRSM (TYRP1_HUMAN)
LMRARRSM

SEQ ID NO: 177981 - protein, 10 aa, Artificial Sequence
  Description of Artificial Sequence: Synthetic peptide
  Seed: YFVWTHYYSV (TYRP1_HUMAN)
YGVWTHYYSL

SEQ ID NO: 177982 - protein, 9 aa, Artificial Sequence
  Description of Artificial Sequence: Synthetic peptide
  Seed: MSAPKLLSL (TYRP1_HUMAN)
MPAPKLLSM

SEQ ID NO: 177983 - protein, 10 aa, Artificial Sequence
  Description of Artificial Sequence: Synthetic peptide
  Seed: MAKRTTHPLF (TYRP1_HUMAN)
MTKRTTHPLY

SEQ ID NO: 177984 - protein, 9 aa, Artificial Sequence
  Description of Artificial Sequence: Synthetic peptide
  Seed: QWRVVCDSL (TYRP1_HUMAN)
QYRVVCDSF

SEQ ID NO: 177985 - protein, 9 aa, Artificial Sequence
  Description of Artificial Sequence: Synthetic peptide
  Seed: SLGCIFFPL (TYRP1_HUMAN)
SVGCIFFPI

SEQ ID NO: 177986 - protein, 9 aa, Artificial Sequence
  Description of Artificial Sequence: Synthetic peptide
  Seed: VCDICTDDL (TYRP1_HUMAN)
VMDICTDDL

SEQ ID NO: 177987 - protein, 9 aa, Artificial Sequence
  Description of Artificial Sequence: Synthetic peptide
  Seed: VFDEWLRRY (TYRP1_HUMAN)
VVDEWLRRY

SEQ ID NO: 177988 - protein, 9 aa, Artificial Sequence
  Description of Artificial Sequence: Synthetic peptide
  Seed: SMDEANQPL (TYRP1_HUMAN)
SFDEANQPL

SEQ ID NO: 177989 - protein, 9 aa, Artificial Sequence
  Description of Artificial Sequence: Synthetic peptide
  Seed: LPYWNFATG (TYRP1_HUMAN)
LMYWNFATY

SEQ ID NO: 177990 - protein, 10 aa, Artificial Sequence
  Description of Artificial Sequence: Synthetic peptide
  Seed: FLTWHRYHLL (TYRP1_HUMAN)
FPTWHRYHLV

SEQ ID NO: 177991 - protein, 9 aa, Artificial Sequence
  Description of Artificial Sequence: Synthetic peptide
  Seed: SPNDPIFVL (TYRP1_HUMAN)
SMNDPIFVL

SEQ ID NO: 177992 - protein, 9 aa, Artificial Sequence
  Description of Artificial Sequence: Synthetic peptide
  Seed: NFDSTLISP (TYRP1_HUMAN)
NADSTLISL

SEQ ID NO: 177993 - protein, 9 aa, Artificial Sequence
  Description of Artificial Sequence: Synthetic peptide
  Seed: SLHNLAHLF (TYRP1_HUMAN)
SVHNLAHLW

SEQ ID NO: 177994 - protein, 11 aa, Artificial Sequence
  Description of Artificial Sequence: Synthetic peptide
  Seed: RSMDEANQPLL (TYRP1_HUMAN)
RCMDEANQPLW

SEQ ID NO: 177995 - protein, 9 aa, Artificial Sequence
  Description of Artificial Sequence: Synthetic peptide
  Seed: HEGPAFLTW (TYRP1_HUMAN)
HEGPAFLTF

SEQ ID NO: 177996 - protein, 10 aa, Artificial Sequence
  Description of Artificial Sequence: Synthetic peptide
  Seed: YNYFVWTHYY (TYRP1_HUMAN)
YMYFVWTHYL

SEQ ID NO: 177997 - protein, 11 aa, Artificial Sequence
  Description of Artificial Sequence: Synthetic peptide
  Seed: VALIFGTASYL (TYRP1_HUMAN)
VYLIFGTASYI

SEQ ID NO: 177998 - protein, 9 aa, Artificial Sequence
  Description of Artificial Sequence: Synthetic peptide
  Seed: SLPYWNFAT (TYRP1_HUMAN)
SMPYWNFAM

SEQ ID NO: 177999 - protein, 9 aa, Artificial Sequence
  Description of Artificial Sequence: Synthetic peptide
  Seed: IAIAVVGAL (TYRP1_HUMAN)
IVIAVVGAY

SEQ ID NO: 178000 - protein, 9 aa, Artificial Sequence
  Description of Artificial Sequence: Synthetic peptide
  Seed: AVVGALLLV (TYRP1_HUMAN)
AVVGALLLY

SEQ ID NO: 178001 - protein, 10 aa, Artificial Sequence
  Description of Artificial Sequence: Synthetic peptide
  Seed: HRYHLLRLEK (TYRP1_HUMAN)
HRYHLLRLEL

SEQ ID NO: 178002 - protein, 9 aa, Artificial Sequence
  Description of Artificial Sequence: Synthetic peptide
  Seed: YLIRARRSM (TYRP1_HUMAN)
YWIRARRSM

SEQ ID NO: 178003 - protein, 10 aa, Artificial Sequence
  Description of Artificial Sequence: Synthetic peptide
  Seed: HLSPNDPIFV (TYRP1_HUMAN)
HLSPNDPIFI

SEQ ID NO: 178004 - protein, 9 aa, Artificial Sequence
  Description of Artificial Sequence: Synthetic peptide
  Seed: MDEANQPLL (TYRP1_HUMAN)
MSEANQPLL

SEQ ID NO: 178005 - protein, 9 aa, Artificial Sequence
  Description of Artificial Sequence: Synthetic peptide
  Seed: RYNADISTF (TYRP1_HUMAN)
RWNADISTY

SEQ ID NO: 178006 - protein, 10 aa, Artificial Sequence
  Description of Artificial Sequence: Synthetic peptide
  Seed: ADSRPHSPQY (TYRP1_HUMAN)
AISRPHSPQV

SEQ ID NO: 178007 - protein, 10 aa, Artificial Sequence
  Description of Artificial Sequence: Synthetic peptide
  Seed: FVWTHYYSVK (TYRP1_HUMAN)
FLWTHYYSVY

SEQ ID NO: 178008 - protein, 10 aa, Artificial Sequence
  Description of Artificial Sequence: Synthetic peptide
  Seed: SIYNYFVWTH (TYRP1_HUMAN)
SKYNYFVWTR

SEQ ID NO: 178009 - protein, 9 aa, Artificial Sequence
  Description of Artificial Sequence: Synthetic peptide
  Seed: YTYEIQWPS (TYRP1_HUMAN)
YIYEIQWPL

SEQ ID NO: 178010 - protein, 9 aa, Artificial Sequence
  Description of Artificial Sequence: Synthetic peptide
  Seed: NRQYNMVPF (TYRP1_HUMAN)
NWQYNMVPF

SEQ ID NO: 178011 - protein, 8 aa, Artificial Sequence
  Description of Artificial Sequence: Synthetic peptide
  Seed: SNFDSTLI (TYRP1_HUMAN)
SQFDSTLI

SEQ ID NO: 178012 - protein, 9 aa, Artificial Sequence
  Description of Artificial Sequence: Synthetic peptide
  Seed: MCCPDLSPV (TYRP1_HUMAN)
MICPDLSPI

SEQ ID NO: 178013 - protein, 10 aa, Artificial Sequence
  Description of Artificial Sequence: Synthetic peptide
  Seed: SHEGPAFLTW (TYRP1_HUMAN)
SHEGPAFLTM

SEQ ID NO: 178014 - protein, 9 aa, Artificial Sequence
  Description of Artificial Sequence: Synthetic peptide
  Seed: LHTFTDAVF (TYRP1_HUMAN)
LATFTDAVF

SEQ ID NO: 178015 - protein, 10 aa, Artificial Sequence
  Description of Artificial Sequence: Synthetic peptide
  Seed: GLFDTPPFYS (TYRP1_HUMAN)
GLFDTPPFYA

SEQ ID NO: 178016 - protein, 9 aa, Artificial Sequence
  Description of Artificial Sequence: Synthetic peptide
  Seed: MSAPKLLSL (TYRP1_HUMAN)
MQAPKLLSF

SEQ ID NO: 178017 - protein, 9 aa, Artificial Sequence
  Description of Artificial Sequence: Synthetic peptide
  Seed: IAVVGALLL (TYRP1_HUMAN)
ITVVGALLW

SEQ ID NO: 178018 - protein, 11 aa, Artificial Sequence
  Description of Artificial Sequence: Synthetic peptide
  Seed: QEMLQEPSFSL (TYRP1_HUMAN)
QFMLQEPSFSL

SEQ ID NO: 178019 - protein, 9 aa, Artificial Sequence
  Description of Artificial Sequence: Synthetic peptide
  Seed: SGRGRCEAV (TYRP1_HUMAN)
SMRGRCEAI

SEQ ID NO: 178020 - protein, 9 aa, Artificial Sequence
  Description of Artificial Sequence: Synthetic peptide
  Seed: AQFPRQCAT (TYRP1_HUMAN)
ASFPRQCAF

SEQ ID NO: 178021 - protein, 9 aa, Artificial Sequence
  Description of Artificial Sequence: Synthetic peptide
  Seed: YNYFVWTHY (TYRP1_HUMAN)
YMYFVWTHF

SEQ ID NO: 178022 - protein, 10 aa, Artificial Sequence
  Description of Artificial Sequence: Synthetic peptide
  Seed: AVFDEWLRRY (TYRP1_HUMAN)
AQFDEWLRRW

SEQ ID NO: 178023 - protein, 10 aa, Artificial Sequence
  Description of Artificial Sequence: Synthetic peptide
  Seed: FSLPYWNFAT (TYRP1_HUMAN)
FRLPYWNFAL

SEQ ID NO: 178024 - protein, 9 aa, Artificial Sequence
  Description of Artificial Sequence: Synthetic peptide
  Seed: SVPEIIAIA (TYRP1_HUMAN)
STPEIIAIR

SEQ ID NO: 178025 - protein, 9 aa, Artificial Sequence
  Description of Artificial Sequence: Synthetic peptide
  Seed: RFFNRTCHC (TYRP1_HUMAN)
RMFNRTCHI

SEQ ID NO: 178026 - protein, 9 aa, Artificial Sequence
  Description of Artificial Sequence: Synthetic peptide
  Seed: IGHNRQYNM (TYRP1_HUMAN)
ISHNRQYNM

SEQ ID NO: 178027 - protein, 11 aa, Artificial Sequence
  Description of Artificial Sequence: Synthetic peptide
  Seed: YNMVPFWPPVT (TYRP1_HUMAN)
YLMVPFWPPVE

SEQ ID NO: 178028 - protein, 11 aa, Artificial Sequence
  Description of Artificial Sequence: Synthetic peptide
  Seed: YSDPTGKYDPA (TYRP1_HUMAN)
YTDPTGKYDPL

SEQ ID NO: 178029 - protein, 9 aa, Artificial Sequence
  Description of Artificial Sequence: Synthetic peptide
  Seed: VFDEWLRRY (TYRP1_HUMAN)
VYDEWLRRI

SEQ ID NO: 178030 - protein, 10 aa, Artificial Sequence
  Description of Artificial Sequence: Synthetic peptide
  Seed: WPLRFFNRTC (TYRP1_HUMAN)
WPLRFFNRTA

SEQ ID NO: 178031 - protein, 9 aa, Artificial Sequence
  Description of Artificial Sequence: Synthetic peptide
  Seed: FSVPEIIAI (TYRP1_HUMAN)
FTVPEIIAH

SEQ ID NO: 178032 - protein, 9 aa, Artificial Sequence
  Description of Artificial Sequence: Synthetic peptide
  Seed: FSLPYWNFA (TYRP1_HUMAN)
FMLPYWNFA

SEQ ID NO: 178033 - protein, 9 aa, Artificial Sequence
  Description of Artificial Sequence: Synthetic peptide
  Seed: IAIAVVGAL (TYRP1_HUMAN)
INIAVVGAF

SEQ ID NO: 178034 - protein, 9 aa, Artificial Sequence
  Description of Artificial Sequence: Synthetic peptide
  Seed: LIFGTASYL (TYRP1_HUMAN)
LQFGTASYM

SEQ ID NO: 178035 - protein, 10 aa, Artificial Sequence
  Description of Artificial Sequence: Synthetic peptide
  Seed: FSLPYWNFAT (TYRP1_HUMAN)
FSLPYWNFAI

SEQ ID NO: 178036 - protein, 11 aa, Artificial Sequence
  Description of Artificial Sequence: Synthetic peptide
  Seed: RYNADISTFPL (TYRP1_HUMAN)
RWNADISTFPF

SEQ ID NO: 178037 - protein, 8 aa, Artificial Sequence
  Description of Artificial Sequence: Synthetic peptide
  Seed: YYSVKKTF (TYRP1_HUMAN)
YYSVKKTL

SEQ ID NO: 178038 - protein, 11 aa, Artificial Sequence
  Description of Artificial Sequence: Synthetic peptide
  Seed: QEMLQEPSFSL (TYRP1_HUMAN)
QEMLQEPSFSM

SEQ ID NO: 178039 - protein, 9 aa, Artificial Sequence
  Description of Artificial Sequence: Synthetic peptide
  Seed: RQYNMVPFW (TYRP1_HUMAN)
RWYNMVPFI

SEQ ID NO: 178040 - protein, 8 aa, Artificial Sequence
  Description of Artificial Sequence: Synthetic peptide
  Seed: VSGPGTDR (TYRP1_HUMAN)
VAGPGTDY

SEQ ID NO: 178041 - protein, 10 aa, Artificial Sequence
  Description of Artificial Sequence: Synthetic peptide
  Seed: TASYLIRARR (TYRP1_HUMAN)
TISYLIRARK

SEQ ID NO: 178042 - protein, 10 aa, Artificial Sequence
  Description of Artificial Sequence: Synthetic peptide
  Seed: GKYDPAVRSL (TYRP1_HUMAN)
GNYDPAVRSY

SEQ ID NO: 178043 - protein, 10 aa, Artificial Sequence
  Description of Artificial Sequence: Synthetic peptide
  Seed: LSPNDPIFVL (TYRP1_HUMAN)
LNPNDPIFVY

SEQ ID NO: 178044 - protein, 9 aa, Artificial Sequence
  Description of Artificial Sequence: Synthetic peptide
  Seed: RVLIVRRNL (TYRP1_HUMAN)
RMLIVRRNW

SEQ ID NO: 178045 - protein, 9 aa, Artificial Sequence
  Description of Artificial Sequence: Synthetic peptide
  Seed: GEVDFSHEG (TYRP1_HUMAN)
GEVDFSHEC

SEQ ID NO: 178046 - protein, 9 aa, Artificial Sequence
  Description of Artificial Sequence: Synthetic peptide
  Seed: LQNPNQSVV (TYRP1_HUMAN)
LANPNQSVF

SEQ ID NO: 178047 - protein, 10 aa, Artificial Sequence
  Description of Artificial Sequence: Synthetic peptide
  Seed: GEVDFSHEGP (TYRP1_HUMAN)
GEVDFSHEGV

SEQ ID NO: 178048 - protein, 10 aa, Artificial Sequence
  Description of Artificial Sequence: Synthetic peptide
  Seed: REFSVPEIIA (TYRP1_HUMAN)
REFSVPEIIT

SEQ ID NO: 178049 - protein, 10 aa, Artificial Sequence
  Description of Artificial Sequence: Synthetic peptide
  Seed: YFVWTHYYSV (TYRP1_HUMAN)
YHVWTHYYSI

SEQ ID NO: 178050 - protein, 10 aa, Artificial Sequence
  Description of Artificial Sequence: Synthetic peptide
  Seed: QCYAEEYEKL (TYRP1_HUMAN)
QTYAEEYEKF

SEQ ID NO: 178051 - protein, 10 aa, Artificial Sequence
  Description of Artificial Sequence: Synthetic peptide
  Seed: KRTTHPLFVI (TYRP1_HUMAN)
KFTTHPLFVW

SEQ ID NO: 178052 - protein, 10 aa, Artificial Sequence
  Description of Artificial Sequence: Synthetic peptide
  Seed: FPLENAPIGH (TYRP1_HUMAN)
FPLENAPIGM

SEQ ID NO: 178053 - protein, 9 aa, Artificial Sequence
  Description of Artificial Sequence: Synthetic peptide
  Seed: RFFNRTCHC (TYRP1_HUMAN)
RFFNRTCHL

SEQ ID NO: 178054 - protein, 10 aa, Artificial Sequence
  Description of Artificial Sequence: Synthetic peptide
  Seed: REFSVPEIIA (TYRP1_HUMAN)
REFSVPEIIV

SEQ ID NO: 178055 - protein, 10 aa, Artificial Sequence
  Description of Artificial Sequence: Synthetic peptide
  Seed: TPQFENISIY (TYRP1_HUMAN)
TIQFENISIM

SEQ ID NO: 178056 - protein, 9 aa, Artificial Sequence
  Description of Artificial Sequence: Synthetic peptide
  Seed: YLIRARRSM (TYRP1_HUMAN)
YAIRARRSF

SEQ ID NO: 178057 - protein, 10 aa, Artificial Sequence
  Description of Artificial Sequence: Synthetic peptide
  Seed: GNVARPMVQR (TYRP1_HUMAN)
GTVARPMVQK

SEQ ID NO: 178058 - protein, 9 aa, Artificial Sequence
  Description of Artificial Sequence: Synthetic peptide
  Seed: SPNDPIFVL (TYRP1_HUMAN)
SRNDPIFVV

SEQ ID NO: 178059 - protein, 9 aa, Artificial Sequence
  Description of Artificial Sequence: Synthetic peptide
  Seed: LTWHRYHLL (TYRP1_HUMAN)
LMWHRYHLA

SEQ ID NO: 178060 - protein, 9 aa, Artificial Sequence
  Description of Artificial Sequence: Synthetic peptide
  Seed: VFDEWLRRY (TYRP1_HUMAN)
VTDEWLRRM

SEQ ID NO: 178061 - protein, 9 aa, Artificial Sequence
  Description of Artificial Sequence: Synthetic peptide
  Seed: KYDPAVRSL (TYRP1_HUMAN)
KNDPAVRSI

SEQ ID NO: 178062 - protein, 10 aa, Artificial Sequence
  Description of Artificial Sequence: Synthetic peptide
  Seed: HPLFVIATRR (TYRP1_HUMAN)
HTLFVIATRG

SEQ ID NO: 178063 - protein, 9 aa, Artificial Sequence
  Description of Artificial Sequence: Synthetic peptide
  Seed: KLLSLGCIF (TYRP1_HUMAN)
KMLSLGCIL

SEQ ID NO: 178064 - protein, 9 aa, Artificial Sequence
  Description of Artificial Sequence: Synthetic peptide
  Seed: REFSVPEII (TYRP1_HUMAN)
RVFSVPEIW

SEQ ID NO: 178065 - protein, 9 aa, Artificial Sequence
  Description of Artificial Sequence: Synthetic peptide
  Seed: HLSPNDPIF (TYRP1_HUMAN)
HYSPNDPIF

SEQ ID NO: 178066 - protein, 9 aa, Artificial Sequence
  Description of Artificial Sequence: Synthetic peptide
  Seed: IAVVGALLL (TYRP1_HUMAN)
IVVVGALLW

SEQ ID NO: 178067 - protein, 9 aa, Artificial Sequence
  Description of Artificial Sequence: Synthetic peptide
  Seed: ISIYNYFVW (TYRP1_HUMAN)
IYIYNYFVL

SEQ ID NO: 178068 - protein, 9 aa, Artificial Sequence
  Description of Artificial Sequence: Synthetic peptide
  Seed: NVARPMVQR (TYRP1_HUMAN)
NAARPMVQK

SEQ ID NO: 178069 - protein, 11 aa, Artificial Sequence
  Description of Artificial Sequence: Synthetic peptide
  Seed: WHRYHLLRLEK (TYRP1_HUMAN)
WRRYHLLRLEK

SEQ ID NO: 178070 - protein, 10 aa, Artificial Sequence
  Description of Artificial Sequence: Synthetic peptide
  Seed: FLNGTGGQTH (TYRP1_HUMAN)
FFNGTGGQTY

SEQ ID NO: 178071 - protein, 9 aa, Artificial Sequence
  Description of Artificial Sequence: Synthetic peptide
  Seed: LHTFTDAVF (TYRP1_HUMAN)
LHTFTDAVI

SEQ ID NO: 178072 - protein, 10 aa, Artificial Sequence
  Description of Artificial Sequence: Synthetic peptide
  Seed: NYFVWTHYYS (TYRP1_HUMAN)
NFFVWTHYYV

SEQ ID NO: 178073 - protein, 9 aa, Artificial Sequence
  Description of Artificial Sequence: Synthetic peptide
  Seed: LIFGTASYL (TYRP1_HUMAN)
LLFGTASYW

SEQ ID NO: 178074 - protein, 9 aa, Artificial Sequence
  Description of Artificial Sequence: Synthetic peptide
  Seed: SVFSQWRVV (TYRP1_HUMAN)
STFSQWRVM

SEQ ID NO: 178075 - protein, 10 aa, Artificial Sequence
  Description of Artificial Sequence: Synthetic peptide
  Seed: YTYEIQWPSR (TYRP1_HUMAN)
YIYEIQWPSR

SEQ ID NO: 178076 - protein, 11 aa, Artificial Sequence
  Description of Artificial Sequence: Synthetic peptide
  Seed: HTFTDAVFDEW (TYRP1_HUMAN)
HQFTDAVFDEL

SEQ ID NO: 178077 - protein, 9 aa, Artificial Sequence
  Description of Artificial Sequence: Synthetic peptide
  Seed: DSRPHSPQY (TYRP1_HUMAN)
DIRPHSPQF

SEQ ID NO: 178078 - protein, 10 aa, Artificial Sequence
  Description of Artificial Sequence: Synthetic peptide
  Seed: STFPLENAPI (TYRP1_HUMAN)
SMFPLENAPM

SEQ ID NO: 178079 - protein, 10 aa, Artificial Sequence
  Description of Artificial Sequence: Synthetic peptide
  Seed: YNYFVWTHYY (TYRP1_HUMAN)
YAYFVWTHYF

SEQ ID NO: 178080 - protein, 9 aa, Artificial Sequence
  Description of Artificial Sequence: Synthetic peptide
  Seed: IFGTASYLI (TYRP1_HUMAN)
ILGTASYLF

SEQ ID NO: 178081 - protein, 10 aa, Artificial Sequence
  Description of Artificial Sequence: Synthetic peptide
  Seed: ATVEALRSGM (TYRP1_HUMAN)
AMVEALRSGL

SEQ ID NO: 178082 - protein, 9 aa, Artificial Sequence
  Description of Artificial Sequence: Synthetic peptide
  Seed: LTWHRYHLL (TYRP1_HUMAN)
LSWHRYHLY

SEQ ID NO: 178083 - protein, 9 aa, Artificial Sequence
  Description of Artificial Sequence: Synthetic peptide
  Seed: FVWTHYYSV (TYRP1_HUMAN)
FAWTHYYSW

SEQ ID NO: 178084 - protein, 9 aa, Artificial Sequence
  Description of Artificial Sequence: Synthetic peptide
  Seed: NMVPFWPPV (TYRP1_HUMAN)
NSVPFWPPF

SEQ ID NO: 178085 - protein, 10 aa, Artificial Sequence
  Description of Artificial Sequence: Synthetic peptide
  Seed: MSAPKLLSLG (TYRP1_HUMAN)
MVAPKLLSLW

SEQ ID NO: 178086 - protein, 10 aa, Artificial Sequence
  Description of Artificial Sequence: Synthetic peptide
  Seed: SPNDPIFVLL (TYRP1_HUMAN)
SPNDPIFVLW

SEQ ID NO: 178087 - protein, 10 aa, Artificial Sequence
  Description of Artificial Sequence: Synthetic peptide
  Seed: YNYFVWTHYY (TYRP1_HUMAN)
YGYFVWTHYI

SEQ ID NO: 178088 - protein, 9 aa, Artificial Sequence
  Description of Artificial Sequence: Synthetic peptide
  Seed: RQCATVEAL (TYRP1_HUMAN)
RICATVEAV

SEQ ID NO: 178089 - protein, 11 aa, Artificial Sequence
  Description of Artificial Sequence: Synthetic peptide
  Seed: RYNADISTFPL (TYRP1_HUMAN)
RYNADISTFPI

SEQ ID NO: 178090 - protein, 11 aa, Artificial Sequence
  Description of Artificial Sequence: Synthetic peptide
  Seed: FLTWHRYHLLR (TYRP1_HUMAN)
FSTWHRYHLLR

SEQ ID NO: 178091 - protein, 10 aa, Artificial Sequence
  Description of Artificial Sequence: Synthetic peptide
  Seed: MVPFWPPVTN (TYRP1_HUMAN)
MKPFWPPVTY

SEQ ID NO: 178092 - protein, 10 aa, Artificial Sequence
  Description of Artificial Sequence: Synthetic peptide
  Seed: STLISPNSVF (TYRP1_HUMAN)
SPLISPNSVF

SEQ ID NO: 178093 - protein, 9 aa, Artificial Sequence
  Description of Artificial Sequence: Synthetic peptide
  Seed: SPNSVFSQW (TYRP1_HUMAN)
SENSVFSQW

SEQ ID NO: 178094 - protein, 10 aa, Artificial Sequence
  Description of Artificial Sequence: Synthetic peptide
  Seed: FYSNSTNSFR (TYRP1_HUMAN)
FESNSTNSFR

SEQ ID NO: 178095 - protein, 11 aa, Artificial Sequence
  Description of Artificial Sequence: Synthetic peptide
  Seed: RSMDEANQPLL (TYRP1_HUMAN)
RIMDEANQPLL

SEQ ID NO: 178096 - protein, 10 aa, Artificial Sequence
  Description of Artificial Sequence: Synthetic peptide
  Seed: MAKRTTHPLF (TYRP1_HUMAN)
MPKRTTHPLG

SEQ ID NO: 178097 - protein, 11 aa, Artificial Sequence
  Description of Artificial Sequence: Synthetic peptide
  Seed: SLGCIFFPLLL (TYRP1_HUMAN)
SMGCIFFPLLV

SEQ ID NO: 178098 - protein, 9 aa, Artificial Sequence
  Description of Artificial Sequence: Synthetic peptide
  Seed: VARPMVQRL (TYRP1_HUMAN)
VQRPMVQRM

SEQ ID NO: 178099 - protein, 9 aa, Artificial Sequence
  Description of Artificial Sequence: Synthetic peptide
  Seed: STNSFRNTV (TYRP1_HUMAN)
SLNSFRNTK

SEQ ID NO: 178100 - protein, 10 aa, Artificial Sequence
  Description of Artificial Sequence: Synthetic peptide
  Seed: FSVPEIIAIA (TYRP1_HUMAN)
FMVPEIIAIA

SEQ ID NO: 178101 - protein, 9 aa, Artificial Sequence
  Description of Artificial Sequence: Synthetic peptide
  Seed: NADISTFPL (TYRP1_HUMAN)
NIDISTFPY

SEQ ID NO: 178102 - protein, 9 aa, Artificial Sequence
  Description of Artificial Sequence: Synthetic peptide
  Seed: SLPYWNFAT (TYRP1_HUMAN)
SQPYWNFAV

SEQ ID NO: 178103 - protein, 11 aa, Artificial Sequence
  Description of Artificial Sequence: Synthetic peptide
  Seed: DRCGSSSGRGR (TYRP1_HUMAN)
DYCGSSSGRGR

SEQ ID NO: 178104 - protein, 9 aa, Artificial Sequence
  Description of Artificial Sequence: Synthetic peptide
  Seed: ALLLVALIF (TYRP1_HUMAN)
AQLLVALIF

SEQ ID NO: 178105 - protein, 10 aa, Artificial Sequence
  Description of Artificial Sequence: Synthetic peptide
  Seed: YFVWTHYYSV (TYRP1_HUMAN)
YSVWTHYYSV

SEQ ID NO: 178106 - protein, 10 aa, Artificial Sequence
  Description of Artificial Sequence: Synthetic peptide
  Seed: TPQFENISIY (TYRP1_HUMAN)
TAQFENISIY

SEQ ID NO: 178107 - protein, 9 aa, Artificial Sequence
  Description of Artificial Sequence: Synthetic peptide
  Seed: LFDTPPFYS (TYRP1_HUMAN)
LLDTPPFYM

SEQ ID NO: 178108 - protein, 9 aa, Artificial Sequence
  Description of Artificial Sequence: Synthetic peptide
  Seed: GSRSNFDST (TYRP1_HUMAN)
GTRSNFDSV

SEQ ID NO: 178109 - protein, 9 aa, Artificial Sequence
  Description of Artificial Sequence: Synthetic peptide
  Seed: FPLLLFQQA (TYRP1_HUMAN)
FPLLLFQQT

SEQ ID NO: 178110 - protein, 9 aa, Artificial Sequence
  Description of Artificial Sequence: Synthetic peptide
  Seed: RYNADISTF (TYRP1_HUMAN)
RFNADISTL

SEQ ID NO: 178111 - protein, 9 aa, Artificial Sequence
  Description of Artificial Sequence: Synthetic peptide
  Seed: DNLGYTYEI (TYRP1_HUMAN)
DTLGYTYEA

SEQ ID NO: 178112 - protein, 10 aa, Artificial Sequence
  Description of Artificial Sequence: Synthetic peptide
  Seed: RRYNADISTF (TYRP1_HUMAN)
RIYNADISTW

SEQ ID NO: 178113 - protein, 10 aa, Artificial Sequence
  Description of Artificial Sequence: Synthetic peptide
  Seed: FVWTHYYSVK (TYRP1_HUMAN)
FMWTHYYSVT

SEQ ID NO: 178114 - protein, 9 aa, Artificial Sequence
  Description of Artificial Sequence: Synthetic peptide
  Seed: VGLFDTPPF (TYRP1_HUMAN)
VVLFDTPPY

SEQ ID NO: 178115 - protein, 10 aa, Artificial Sequence
  Description of Artificial Sequence: Synthetic peptide
  Seed: FVWTHYYSVK (TYRP1_HUMAN)
FTWTHYYSVK

SEQ ID NO: 178116 - protein, 10 aa, Artificial Sequence
  Description of Artificial Sequence: Synthetic peptide
  Seed: ENISIYNYFV (TYRP1_HUMAN)
EVISIYNYFM

SEQ ID NO: 178117 - protein, 9 aa, Artificial Sequence
  Description of Artificial Sequence: Synthetic peptide
  Seed: ENISIYNYF (TYRP1_HUMAN)
ETISIYNYI

SEQ ID NO: 178118 - protein, 9 aa, Artificial Sequence
  Description of Artificial Sequence: Synthetic peptide
  Seed: SLGCIFFPL (TYRP1_HUMAN)
SLGCIFFPC

SEQ ID NO: 178119 - protein, 10 aa, Artificial Sequence
  Description of Artificial Sequence: Synthetic peptide
  Seed: YSVKKTFLGV (TYRP1_HUMAN)
YMVKKTFLGV

SEQ ID NO: 178120 - protein, 9 aa, Artificial Sequence
  Description of Artificial Sequence: Synthetic peptide
  Seed: AIAVVGALL (TYRP1_HUMAN)
AIAVVGALI

SEQ ID NO: 178121 - protein, 11 aa, Artificial Sequence
  Description of Artificial Sequence: Synthetic peptide
  Seed: IYNYFVWTHYY (TYRP1_HUMAN)
ISNYFVWTHYY

SEQ ID NO: 178122 - protein, 10 aa, Artificial Sequence
  Description of Artificial Sequence: Synthetic peptide
  Seed: FSLPYWNFAT (TYRP1_HUMAN)
FFLPYWNFAI

SEQ ID NO: 178123 - protein, 10 aa, Artificial Sequence
  Description of Artificial Sequence: Synthetic peptide
  Seed: YNYFVWTHYY (TYRP1_HUMAN)
YFYFVWTHYQ

SEQ ID NO: 178124 - protein, 9 aa, Artificial Sequence
  Description of Artificial Sequence: Synthetic peptide
  Seed: REFSVPEII (TYRP1_HUMAN)
RVFSVPEIL

SEQ ID NO: 178125 - protein, 10 aa, Artificial Sequence
  Description of Artificial Sequence: Synthetic peptide
  Seed: GLFDTPPFYS (TYRP1_HUMAN)
GLFDTPPFYV

SEQ ID NO: 178126 - protein, 10 aa, Artificial Sequence
  Description of Artificial Sequence: Synthetic peptide
  Seed: PAVRSLHNLA (TYRP1_HUMAN)
PRVRSLHNLA

SEQ ID NO: 178127 - protein, 9 aa, Artificial Sequence
  Description of Artificial Sequence: Synthetic peptide
  Seed: GLFDTPPFY (TYRP1_HUMAN)
GVFDTPPFA

SEQ ID NO: 178128 - protein, 10 aa, Artificial Sequence
  Description of Artificial Sequence: Synthetic peptide
  Seed: ENISIYNYFV (TYRP1_HUMAN)
ELISIYNYFV

SEQ ID NO: 178129 - protein, 10 aa, Artificial Sequence
  Description of Artificial Sequence: Synthetic peptide
  Seed: AVFDEWLRRY (TYRP1_HUMAN)
AIFDEWLRRK

SEQ ID NO: 178130 - protein, 9 aa, Artificial Sequence
  Description of Artificial Sequence: Synthetic peptide
  Seed: LIFGTASYL (TYRP1_HUMAN)
LKFGTASYW

SEQ ID NO: 178131 - protein, 10 aa, Artificial Sequence
  Description of Artificial Sequence: Synthetic peptide
  Seed: VDFSHEGPAF (TYRP1_HUMAN)
VMFSHEGPAM

SEQ ID NO: 178132 - protein, 10 aa, Artificial Sequence
  Description of Artificial Sequence: Synthetic peptide
  Seed: ADSRPHSPQY (TYRP1_HUMAN)
AKSRPHSPQW

SEQ ID NO: 178133 - protein, 9 aa, Artificial Sequence
  Description of Artificial Sequence: Synthetic peptide
  Seed: VFDEWLRRY (TYRP1_HUMAN)
VYDEWLRRF

SEQ ID NO: 178134 - protein, 9 aa, Artificial Sequence
  Description of Artificial Sequence: Synthetic peptide
  Seed: ALIFGTASY (TYRP1_HUMAN)
ACIFGTASY

SEQ ID NO: 178135 - protein, 11 aa, Artificial Sequence
  Description of Artificial Sequence: Synthetic peptide
  Seed: RRYNADISTFP (TYRP1_HUMAN)
RRYNADISTFF

SEQ ID NO: 178136 - protein, 9 aa, Artificial Sequence
  Description of Artificial Sequence: Synthetic peptide
  Seed: FYSNSTNSF (TYRP1_HUMAN)
FNSNSTNSF

SEQ ID NO: 178137 - protein, 8 aa, Artificial Sequence
  Description of Artificial Sequence: Synthetic peptide
  Seed: YSDPTGKY (TYRP1_HUMAN)
YVDPTGKM

SEQ ID NO: 178138 - protein, 9 aa, Artificial Sequence
  Description of Artificial Sequence: Synthetic peptide
  Seed: SVKKTFLGV (TYRP1_HUMAN)
SMKKTFLGA

SEQ ID NO: 178139 - protein, 9 aa, Artificial Sequence
  Description of Artificial Sequence: Synthetic peptide
  Seed: FPRQCATVE (TYRP1_HUMAN)
FPRQCATVY

SEQ ID NO: 178140 - protein, 10 aa, Artificial Sequence
  Description of Artificial Sequence: Synthetic peptide
  Seed: LLFQQARAQF (TYRP1_HUMAN)
LYFQQARAQL

SEQ ID NO: 178141 - protein, 11 aa, Artificial Sequence
  Description of Artificial Sequence: Synthetic peptide
  Seed: IYNYFVWTHYY (TYRP1_HUMAN)
IHNYFVWTHYY

SEQ ID NO: 178142 - protein, 9 aa, Artificial Sequence
  Description of Artificial Sequence: Synthetic peptide
  Seed: YTYEIQWPS (TYRP1_HUMAN)
YQYEIQWPL

SEQ ID NO: 178143 - protein, 11 aa, Artificial Sequence
  Description of Artificial Sequence: Synthetic peptide
  Seed: AVVGALLLVAL (TYRP1_HUMAN)
AQVGALLLVAV

SEQ ID NO: 178144 - protein, 10 aa, Artificial Sequence
  Description of Artificial Sequence: Synthetic peptide
  Seed: MAKRTTHPLF (TYRP1_HUMAN)
MPKRTTHPLK

SEQ ID NO: 178145 - protein, 9 aa, Artificial Sequence
  Description of Artificial Sequence: Synthetic peptide
  Seed: TADSRPHSP (TYRP1_HUMAN)
TTDSRPHSV

SEQ ID NO: 178146 - protein, 9 aa, Artificial Sequence
  Description of Artificial Sequence: Synthetic peptide
  Seed: NVARPMVQR (TYRP1_HUMAN)
NIARPMVQR

SEQ ID NO: 178147 - protein, 9 aa, Artificial Sequence
  Description of Artificial Sequence: Synthetic peptide
  Seed: FVWTHYYSV (TYRP1_HUMAN)
FMWTHYYSK

SEQ ID NO: 178148 - protein, 10 aa, Artificial Sequence
  Description of Artificial Sequence: Synthetic peptide
  Seed: TPQFENISIY (TYRP1_HUMAN)
TEQFENISIY

SEQ ID NO: 178149 - protein, 9 aa, Artificial Sequence
  Description of Artificial Sequence: Synthetic peptide
  Seed: RTTHPLFVI (TYRP1_HUMAN)
RVTHPLFVV

SEQ ID NO: 178150 - protein, 9 aa, Artificial Sequence
  Description of Artificial Sequence: Synthetic peptide
  Seed: GLFDTPPFY (TYRP1_HUMAN)
GQFDTPPFK

SEQ ID NO: 178151 - protein, 10 aa, Artificial Sequence
  Description of Artificial Sequence: Synthetic peptide
  Seed: FSVPEIIAIA (TYRP1_HUMAN)
FPVPEIIAIV

SEQ ID NO: 178152 - protein, 10 aa, Artificial Sequence
  Description of Artificial Sequence: Synthetic peptide
  Seed: LSLGCIFFPL (TYRP1_HUMAN)
LLLGCIFFPI

SEQ ID NO: 178153 - protein, 9 aa, Artificial Sequence
  Description of Artificial Sequence: Synthetic peptide
  Seed: SPNDPIFVL (TYRP1_HUMAN)
SRNDPIFVM

SEQ ID NO: 178154 - protein, 9 aa, Artificial Sequence
  Description of Artificial Sequence: Synthetic peptide
  Seed: YTYEIQWPS (TYRP1_HUMAN)
YMYEIQWPM

SEQ ID NO: 178155 - protein, 11 aa, Artificial Sequence
  Description of Artificial Sequence: Synthetic peptide
  Seed: FVLLHTFTDAV (TYRP1_HUMAN)
FKLLHTFTDAV

SEQ ID NO: 178156 - protein, 10 aa, Artificial Sequence
  Description of Artificial Sequence: Synthetic peptide
  Seed: ADSRPHSPQY (TYRP1_HUMAN)
AWSRPHSPQV

SEQ ID NO: 178157 - protein, 9 aa, Artificial Sequence
  Description of Artificial Sequence: Synthetic peptide
  Seed: MLQEPSFSL (TYRP1_HUMAN)
MYQEPSFSY

SEQ ID NO: 178158 - protein, 10 aa, Artificial Sequence
  Description of Artificial Sequence: Synthetic peptide
  Seed: EIIAIAVVGA (TYRP1_HUMAN)
EVIAIAVVGA

SEQ ID NO: 178159 - protein, 10 aa, Artificial Sequence
  Description of Artificial Sequence: Synthetic peptide
  Seed: RSMDEANQPL (TYRP1_HUMAN)
RRMDEANQPL

SEQ ID NO: 178160 - protein, 9 aa, Artificial Sequence
  Description of Artificial Sequence: Synthetic peptide
  Seed: DSLEDYDTL (TYRP1_HUMAN)
DVLEDYDTF

SEQ ID NO: 178161 - protein, 9 aa, Artificial Sequence
  Description of Artificial Sequence: Synthetic peptide
  Seed: ENAPIGHNR (TYRP1_HUMAN)
ETAPIGHNH

SEQ ID NO: 178162 - protein, 11 aa, Artificial Sequence
  Description of Artificial Sequence: Synthetic peptide
  Seed: QEMLQEPSFSL (TYRP1_HUMAN)
QIMLQEPSFSV

SEQ ID NO: 178163 - protein, 10 aa, Artificial Sequence
  Description of Artificial Sequence: Synthetic peptide
  Seed: FVWTHYYSVK (TYRP1_HUMAN)
FIWTHYYSVG

SEQ ID NO: 178164 - protein, 10 aa, Artificial Sequence
  Description of Artificial Sequence: Synthetic peptide
  Seed: MVPFWPPVTN (TYRP1_HUMAN)
MGPFWPPVTF

SEQ ID NO: 178165 - protein, 9 aa, Artificial Sequence
  Description of Artificial Sequence: Synthetic peptide
  Seed: GLFDTPPFY (TYRP1_HUMAN)
GIFDTPPFY

SEQ ID NO: 178166 - protein, 9 aa, Artificial Sequence
  Description of Artificial Sequence: Synthetic peptide
  Seed: MLQEPSFSL (TYRP1_HUMAN)
MQQEPSFSV

SEQ ID NO: 178167 - protein, 9 aa, Artificial Sequence
  Description of Artificial Sequence: Synthetic peptide
  Seed: CIFFPLLLF (TYRP1_HUMAN)
CMFFPLLLW

SEQ ID NO: 178168 - protein, 9 aa, Artificial Sequence
  Description of Artificial Sequence: Synthetic peptide
  Seed: KLQNPNQSV (TYRP1_HUMAN)
KVQNPNQSW

SEQ ID NO: 178169 - protein, 9 aa, Artificial Sequence
  Description of Artificial Sequence: Synthetic peptide
  Seed: MAKRTTHPL (TYRP1_HUMAN)
MIKRTTHPY

SEQ ID NO: 178170 - protein, 10 aa, Artificial Sequence
  Description of Artificial Sequence: Synthetic peptide
  Seed: LIFGTASYLI (TYRP1_HUMAN)
LYFGTASYLF

SEQ ID NO: 178171 - protein, 10 aa, Artificial Sequence
  Description of Artificial Sequence: Synthetic peptide
  Seed: RSMDEANQPL (TYRP1_HUMAN)
RQMDEANQPL

SEQ ID NO: 178172 - protein, 9 aa, Artificial Sequence
  Description of Artificial Sequence: Synthetic peptide
  Seed: TADSRPHSP (TYRP1_HUMAN)
TGDSRPHSI

SEQ ID NO: 178173 - protein, 10 aa, Artificial Sequence
  Description of Artificial Sequence: Synthetic peptide
  Seed: ADSRPHSPQY (TYRP1_HUMAN)
AASRPHSPQF

SEQ ID NO: 178174 - protein, 9 aa, Artificial Sequence
  Description of Artificial Sequence: Synthetic peptide
  Seed: FSVPEIIAI (TYRP1_HUMAN)
FAVPEIIAI

SEQ ID NO: 178175 - protein, 9 aa, Artificial Sequence
  Description of Artificial Sequence: Synthetic peptide
  Seed: LIFGTASYL (TYRP1_HUMAN)
LLFGTASYI

SEQ ID NO: 178176 - protein, 9 aa, Artificial Sequence
  Description of Artificial Sequence: Synthetic peptide
  Seed: MAKRTTHPL (TYRP1_HUMAN)
MWKRTTHPL

SEQ ID NO: 178177 - protein, 9 aa, Artificial Sequence
  Description of Artificial Sequence: Synthetic peptide
  Seed: HEGPAFLTW (TYRP1_HUMAN)
HDGPAFLTF

SEQ ID NO: 178178 - protein, 9 aa, Artificial Sequence
  Description of Artificial Sequence: Synthetic peptide
  Seed: SPNDPIFVL (TYRP1_HUMAN)
SVNDPIFVM

SEQ ID NO: 178179 - protein, 9 aa, Artificial Sequence
  Description of Artificial Sequence: Synthetic peptide
  Seed: LTWHRYHLL (TYRP1_HUMAN)
LMWHRYHLI

SEQ ID NO: 178180 - protein, 9 aa, Artificial Sequence
  Description of Artificial Sequence: Synthetic peptide
  Seed: IAIAVVGAL (TYRP1_HUMAN)
ISIAVVGAY

SEQ ID NO: 178181 - protein, 10 aa, Artificial Sequence
  Description of Artificial Sequence: Synthetic peptide
  Seed: YNMVPFWPPV (TYRP1_HUMAN)
YTMVPFWPPV

SEQ ID NO: 178182 - protein, 10 aa, Artificial Sequence
  Description of Artificial Sequence: Synthetic peptide
  Seed: HRYHLLRLEK (TYRP1_HUMAN)
HMYHLLRLER

SEQ ID NO: 178183 - protein, 10 aa, Artificial Sequence
  Description of Artificial Sequence: Synthetic peptide
  Seed: NISIYNYFVW (TYRP1_HUMAN)
NSSIYNYFVW

SEQ ID NO: 178184 - protein, 9 aa, Artificial Sequence
  Description of Artificial Sequence: Synthetic peptide
  Seed: RARRSMDEA (TYRP1_HUMAN)
RLRRSMDEA

SEQ ID NO: 178185 - protein, 10 aa, Artificial Sequence
  Description of Artificial Sequence: Synthetic peptide
  Seed: VWTHYYSVKK (TYRP1_HUMAN)
VMTHYYSVKR

SEQ ID NO: 178186 - protein, 10 aa, Artificial Sequence
  Description of Artificial Sequence: Synthetic peptide
  Seed: YSVKKTFLGV (TYRP1_HUMAN)
YQVKKTFLGV

SEQ ID NO: 178187 - protein, 9 aa, Artificial Sequence
  Description of Artificial Sequence: Synthetic peptide
  Seed: IAVVGALLL (TYRP1_HUMAN)
IPVVGALLY

SEQ ID NO: 178188 - protein, 10 aa, Artificial Sequence
  Description of Artificial Sequence: Synthetic peptide
  Seed: YNADISTFPL (TYRP1_HUMAN)
YMADISTFPV

SEQ ID NO: 178189 - protein, 9 aa, Artificial Sequence
  Description of Artificial Sequence: Synthetic peptide
  Seed: VFDEWLRRY (TYRP1_HUMAN)
VVDEWLRRM

SEQ ID NO: 178190 - protein, 10 aa, Artificial Sequence
  Description of Artificial Sequence: Synthetic peptide
  Seed: YNADISTFPL (TYRP1_HUMAN)
YRADISTFPM

SEQ ID NO: 178191 - protein, 10 aa, Artificial Sequence
  Description of Artificial Sequence: Synthetic peptide
  Seed: FVWTHYYSVK (TYRP1_HUMAN)
FIWTHYYSVT

SEQ ID NO: 178192 - protein, 9 aa, Artificial Sequence
  Description of Artificial Sequence: Synthetic peptide
  Seed: APIGHNRQY (TYRP1_HUMAN)
AIIGHNRQY

SEQ ID NO: 178193 - protein, 9 aa, Artificial Sequence
  Description of Artificial Sequence: Synthetic peptide
  Seed: APDNLGYTY (TYRP1_HUMAN)
ATDNLGYTF

SEQ ID NO: 178194 - protein, 9 aa, Artificial Sequence
  Description of Artificial Sequence: Synthetic peptide
  Seed: RPMVQRLPE (TYRP1_HUMAN)
RPMVQRLPI

SEQ ID NO: 178195 - protein, 9 aa, Artificial Sequence
  Description of Artificial Sequence: Synthetic peptide
  Seed: FSLPYWNFA (TYRP1_HUMAN)
FILPYWNFT

SEQ ID NO: 178196 - protein, 9 aa, Artificial Sequence
  Description of Artificial Sequence: Synthetic peptide
  Seed: RGRCEAVTA (TYRP1_HUMAN)
RTRCEAVTL

SEQ ID NO: 178197 - protein, 10 aa, Artificial Sequence
  Description of Artificial Sequence: Synthetic peptide
  Seed: RRYNADISTF (TYRP1_HUMAN)
RRYNADISTI

SEQ ID NO: 178198 - protein, 8 aa, Artificial Sequence
  Description of Artificial Sequence: Synthetic peptide
  Seed: YSDPTGKY (TYRP1_HUMAN)
YQDPTGKL

SEQ ID NO: 178199 - protein, 9 aa, Artificial Sequence
  Description of Artificial Sequence: Synthetic peptide
  Seed: IAIAVVGAL (TYRP1_HUMAN)
IVIAVVGAW

SEQ ID NO: 178200 - protein, 9 aa, Artificial Sequence
  Description of Artificial Sequence: Synthetic peptide
  Seed: FLGVGQESF (TYRP1_HUMAN)
FMGVGQESF

SEQ ID NO: 178201 - protein, 9 aa, Artificial Sequence
  Description of Artificial Sequence: Synthetic peptide
  Seed: TWHRYHLLR (TYRP1_HUMAN)
TLHRYHLLK

SEQ ID NO: 178202 - protein, 10 aa, Artificial Sequence
  Description of Artificial Sequence: Synthetic peptide
  Seed: VLLHTFTDAV (TYRP1_HUMAN)
VILHTFTDAV

SEQ ID NO: 178203 - protein, 9 aa, Artificial Sequence
  Description of Artificial Sequence: Synthetic peptide
  Seed: APIGHNRQY (TYRP1_HUMAN)
AKIGHNRQF

SEQ ID NO: 178204 - protein, 9 aa, Artificial Sequence
  Description of Artificial Sequence: Synthetic peptide
  Seed: MLQEPSFSL (TYRP1_HUMAN)
MPQEPSFSM

SEQ ID NO: 178205 - protein, 8 aa, Artificial Sequence
  Description of Artificial Sequence: Synthetic peptide
  Seed: FSHEGPAF (TYRP1_HUMAN)
FAHEGPAM

SEQ ID NO: 178206 - protein, 11 aa, Artificial Sequence
  Description of Artificial Sequence: Synthetic peptide
  Seed: YTYEIQWPSRE (TYRP1_HUMAN)
YSYEIQWPSRR

SEQ ID NO: 178207 - protein, 9 aa, Artificial Sequence
  Description of Artificial Sequence: Synthetic peptide
  Seed: STEDGPIRR (TYRP1_HUMAN)
SAEDGPIRM

SEQ ID NO: 178208 - protein, 9 aa, Artificial Sequence
  Description of Artificial Sequence: Synthetic peptide
  Seed: RQYNMVPFW (TYRP1_HUMAN)
RCYNMVPFW

SEQ ID NO: 178209 - protein, 10 aa, Artificial Sequence
  Description of Artificial Sequence: Synthetic peptide
  Seed: TASYLIRARR (TYRP1_HUMAN)
TSSYLIRARR

SEQ ID NO: 178210 - protein, 9 aa, Artificial Sequence
  Description of Artificial Sequence: Synthetic peptide
  Seed: SVPEIIAIA (TYRP1_HUMAN)
SLPEIIAIY

SEQ ID NO: 178211 - protein, 9 aa, Artificial Sequence
  Description of Artificial Sequence: Synthetic peptide
  Seed: RSLHNLAHL (TYRP1_HUMAN)
RYLHNLAHY

SEQ ID NO: 178212 - protein, 9 aa, Artificial Sequence
  Description of Artificial Sequence: Synthetic peptide
  Seed: SMDEANQPL (TYRP1_HUMAN)
SIDEANQPM

SEQ ID NO: 178213 - protein, 10 aa, Artificial Sequence
  Description of Artificial Sequence: Synthetic peptide
  Seed: FVWTHYYSVK (TYRP1_HUMAN)
FIWTHYYSVY

SEQ ID NO: 178214 - protein, 9 aa, Artificial Sequence
  Description of Artificial Sequence: Synthetic peptide
  Seed: RVLIVRRNL (TYRP1_HUMAN)
RSLIVRRNA

SEQ ID NO: 178215 - protein, 10 aa, Artificial Sequence
  Description of Artificial Sequence: Synthetic peptide
  Seed: RRYNADISTF (TYRP1_HUMAN)
RVYNADISTF

SEQ ID NO: 178216 - protein, 9 aa, Artificial Sequence
  Description of Artificial Sequence: Synthetic peptide
  Seed: VCDICTDDL (TYRP1_HUMAN)
VLDICTDDL

SEQ ID NO: 178217 - protein, 10 aa, Artificial Sequence
  Description of Artificial Sequence: Synthetic peptide
  Seed: TASYLIRARR (TYRP1_HUMAN)
TWSYLIRARR

SEQ ID NO: 178218 - protein, 9 aa, Artificial Sequence
  Description of Artificial Sequence: Synthetic peptide
  Seed: ALIFGTASY (TYRP1_HUMAN)
AAIFGTASV

SEQ ID NO: 178219 - protein, 10 aa, Artificial Sequence
  Description of Artificial Sequence: Synthetic peptide
  Seed: FLNGTGGQTH (TYRP1_HUMAN)
FANGTGGQTM

SEQ ID NO: 178220 - protein, 9 aa, Artificial Sequence
  Description of Artificial Sequence: Synthetic peptide
  Seed: ISIYNYFVW (TYRP1_HUMAN)
ISIYNYFVI

SEQ ID NO: 178221 - protein, 9 aa, Artificial Sequence
  Description of Artificial Sequence: Synthetic peptide
  Seed: LIFGTASYL (TYRP1_HUMAN)
LLFGTASYR

SEQ ID NO: 178222 - protein, 9 aa, Artificial Sequence
  Description of Artificial Sequence: Synthetic peptide
  Seed: MSAPKLLSL (TYRP1_HUMAN)
MMAPKLLSR

SEQ ID NO: 178223 - protein, 8 aa, Artificial Sequence
  Description of Artificial Sequence: Synthetic peptide
  Seed: MVPFWPPV (TYRP1_HUMAN)
MMPFWPPV

SEQ ID NO: 178224 - protein, 9 aa, Artificial Sequence
  Description of Artificial Sequence: Synthetic peptide
  Seed: HYYSVKKTF (TYRP1_HUMAN)
HRYSVKKTM

SEQ ID NO: 178225 - protein, 9 aa, Artificial Sequence
  Description of Artificial Sequence: Synthetic peptide
  Seed: SVPEIIAIA (TYRP1_HUMAN)
SNPEIIAIL

SEQ ID NO: 178226 - protein, 9 aa, Artificial Sequence
  Description of Artificial Sequence: Synthetic peptide
  Seed: FSVPEIIAI (TYRP1_HUMAN)
FCVPEIIAM

SEQ ID NO: 178227 - protein, 9 aa, Artificial Sequence
  Description of Artificial Sequence: Synthetic peptide
  Seed: LGCIFFPLL (TYRP1_HUMAN)
LTCIFFPLW

SEQ ID NO: 178228 - protein, 9 aa, Artificial Sequence
  Description of Artificial Sequence: Synthetic peptide
  Seed: EDYDTLGTL (TYRP1_HUMAN)
EQYDTLGTV

SEQ ID NO: 178229 - protein, 9 aa, Artificial Sequence
  Description of Artificial Sequence: Synthetic peptide
  Seed: SVKKTFLGV (TYRP1_HUMAN)
SAKKTFLGV

SEQ ID NO: 178230 - protein, 11 aa, Artificial Sequence
  Description of Artificial Sequence: Synthetic peptide
  Seed: AGNVARPMVQR (TYRP1_HUMAN)
AENVARPMVQK

SEQ ID NO: 178231 - protein, 9 aa, Artificial Sequence
  Description of Artificial Sequence: Synthetic peptide
  Seed: MSAPKLLSL (TYRP1_HUMAN)
MYAPKLLSW

SEQ ID NO: 178232 - protein, 10 aa, Artificial Sequence
  Description of Artificial Sequence: Synthetic peptide
  Seed: FVTAPDNLGY (TYRP1_HUMAN)
FCTAPDNLGF

SEQ ID NO: 178233 - protein, 9 aa, Artificial Sequence
  Description of Artificial Sequence: Synthetic peptide
  Seed: APDNLGYTY (TYRP1_HUMAN)
AFDNLGYTF

SEQ ID NO: 178234 - protein, 9 aa, Artificial Sequence
  Description of Artificial Sequence: Synthetic peptide
  Seed: YTYEIQWPS (TYRP1_HUMAN)
YPYEIQWPV

SEQ ID NO: 178235 - protein, 10 aa, Artificial Sequence
  Description of Artificial Sequence: Synthetic peptide
  Seed: EIIAIAVVGA (TYRP1_HUMAN)
ESIAIAVVGV

SEQ ID NO: 178236 - protein, 10 aa, Artificial Sequence
  Description of Artificial Sequence: Synthetic peptide
  Seed: KRTTHPLFVI (TYRP1_HUMAN)
KTTTHPLFVF

SEQ ID NO: 178237 - protein, 9 aa, Artificial Sequence
  Description of Artificial Sequence: Synthetic peptide
  Seed: RRSEEILGP (TYRP1_HUMAN)
RRSEEILGV

SEQ ID NO: 178238 - protein, 9 aa, Artificial Sequence
  Description of Artificial Sequence: Synthetic peptide
  Seed: NRQYNMVPF (TYRP1_HUMAN)
NHQYNMVPL

SEQ ID NO: 178239 - protein, 9 aa, Artificial Sequence
  Description of Artificial Sequence: Synthetic peptide
  Seed: ENISIYNYF (TYRP1_HUMAN)
ETISIYNYV

SEQ ID NO: 178240 - protein, 9 aa, Artificial Sequence
  Description of Artificial Sequence: Synthetic peptide
  Seed: VARPMVQRL (TYRP1_HUMAN)
VMRPMVQRF

SEQ ID NO: 178241 - protein, 9 aa, Artificial Sequence
  Description of Artificial Sequence: Synthetic peptide
  Seed: GPDGNTPQF (TYRP1_HUMAN)
GFDGNTPQL

SEQ ID NO: 178242 - protein, 8 aa, Artificial Sequence
  Description of Artificial Sequence: Synthetic peptide
  Seed: YSDPTGKY (TYRP1_HUMAN)
YVDPTGKI

SEQ ID NO: 178243 - protein, 10 aa, Artificial Sequence
  Description of Artificial Sequence: Synthetic peptide
  Seed: LGPDGNTPQF (TYRP1_HUMAN)
LAPDGNTPQF

SEQ ID NO: 178244 - protein, 9 aa, Artificial Sequence
  Description of Artificial Sequence: Synthetic peptide
  Seed: LPYWNFATG (TYRP1_HUMAN)
LPYWNFATI

SEQ ID NO: 178245 - protein, 10 aa, Artificial Sequence
  Description of Artificial Sequence: Synthetic peptide
  Seed: SQWRVVCDSL (TYRP1_HUMAN)
SRWRVVCDSV

SEQ ID NO: 178246 - protein, 10 aa, Artificial Sequence
  Description of Artificial Sequence: Synthetic peptide
  Seed: LTWHRYHLLR (TYRP1_HUMAN)
LQWHRYHLLR

SEQ ID NO: 178247 - protein, 9 aa, Artificial Sequence
  Description of Artificial Sequence: Synthetic peptide
  Seed: SLHNLAHLF (TYRP1_HUMAN)
SAHNLAHLF

SEQ ID NO: 178248 - protein, 9 aa, Artificial Sequence
  Description of Artificial Sequence: Synthetic peptide
  Seed: FSHEGPAFL (TYRP1_HUMAN)
FTHEGPAFA

SEQ ID NO: 178249 - protein, 10 aa, Artificial Sequence
  Description of Artificial Sequence: Synthetic peptide
  Seed: FVWTHYYSVK (TYRP1_HUMAN)
FLWTHYYSVV

SEQ ID NO: 178250 - protein, 9 aa, Artificial Sequence
  Description of Artificial Sequence: Synthetic peptide
  Seed: YTYEIQWPS (TYRP1_HUMAN)
YLYEIQWPA

SEQ ID NO: 178251 - protein, 9 aa, Artificial Sequence
  Description of Artificial Sequence: Synthetic peptide
  Seed: RSNFDSTLI (TYRP1_HUMAN)
RANFDSTLM

SEQ ID NO: 178252 - protein, 10 aa, Artificial Sequence
  Description of Artificial Sequence: Synthetic peptide
  Seed: FVWTHYYSVK (TYRP1_HUMAN)
FIWTHYYSVV

SEQ ID NO: 178253 - protein, 11 aa, Artificial Sequence
  Description of Artificial Sequence: Synthetic peptide
  Seed: RRSMDEANQPL (TYRP1_HUMAN)
RWSMDEANQPV

SEQ ID NO: 178254 - protein, 10 aa, Artificial Sequence
  Description of Artificial Sequence: Synthetic peptide
  Seed: NYFVWTHYYS (TYRP1_HUMAN)
NCFVWTHYYY

SEQ ID NO: 178255 - protein, 9 aa, Artificial Sequence
  Description of Artificial Sequence: Synthetic peptide
  Seed: REFSVPEII (TYRP1_HUMAN)
RVFSVPEII

SEQ ID NO: 178256 - protein, 10 aa, Artificial Sequence
  Description of Artificial Sequence: Synthetic peptide
  Seed: NVARPMVQRL (TYRP1_HUMAN)
NTARPMVQRR

SEQ ID NO: 178257 - protein, 9 aa, Artificial Sequence
  Description of Artificial Sequence: Synthetic peptide
  Seed: FVWTHYYSV (TYRP1_HUMAN)
FPWTHYYSI

SEQ ID NO: 178258 - protein, 10 aa, Artificial Sequence
  Description of Artificial Sequence: Synthetic peptide
  Seed: YFVWTHYYSV (TYRP1_HUMAN)
YRVWTHYYSI

SEQ ID NO: 178259 - protein, 9 aa, Artificial Sequence
  Description of Artificial Sequence: Synthetic peptide
  Seed: ISIYNYFVW (TYRP1_HUMAN)
IVIYNYFVF

SEQ ID NO: 178260 - protein, 11 aa, Artificial Sequence
  Description of Artificial Sequence: Synthetic peptide
  Seed: FSHEGPAFLTW (TYRP1_HUMAN)
FSHEGPAFLTF

SEQ ID NO: 178261 - protein, 9 aa, Artificial Sequence
  Description of Artificial Sequence: Synthetic peptide
  Seed: HPLFVIATR (TYRP1_HUMAN)
HSLFVIATR

SEQ ID NO: 178262 - protein, 9 aa, Artificial Sequence
  Description of Artificial Sequence: Synthetic peptide
  Seed: NMVPFWPPV (TYRP1_HUMAN)
NQVPFWPPY

SEQ ID NO: 178263 - protein, 9 aa, Artificial Sequence
  Description of Artificial Sequence: Synthetic peptide
  Seed: GLFDTPPFY (TYRP1_HUMAN)
GIFDTPPFF

SEQ ID NO: 178264 - protein, 9 aa, Artificial Sequence
  Description of Artificial Sequence: Synthetic peptide
  Seed: GLFDTPPFY (TYRP1_HUMAN)
GRFDTPPFL

SEQ ID NO: 178265 - protein, 9 aa, Artificial Sequence
  Description of Artificial Sequence: Synthetic peptide
  Seed: GLFDTPPFY (TYRP1_HUMAN)
GKFDTPPFY

SEQ ID NO: 178266 - protein, 9 aa, Artificial Sequence
  Description of Artificial Sequence: Synthetic peptide
  Seed: AVRSLHNLA (TYRP1_HUMAN)
ASRSLHNLG

SEQ ID NO: 178267 - protein, 11 aa, Artificial Sequence
  Description of Artificial Sequence: Synthetic peptide
  Seed: YNMVPFWPPVT (TYRP1_HUMAN)
YMMVPFWPPVS

SEQ ID NO: 178268 - protein, 10 aa, Artificial Sequence
  Description of Artificial Sequence: Synthetic peptide
  Seed: DAVFDEWLRR (TYRP1_HUMAN)
DWVFDEWLRR

SEQ ID NO: 178269 - protein, 10 aa, Artificial Sequence
  Description of Artificial Sequence: Synthetic peptide
  Seed: AVFDEWLRRY (TYRP1_HUMAN)
AVFDEWLRRK

SEQ ID NO: 178270 - protein, 11 aa, Artificial Sequence
  Description of Artificial Sequence: Synthetic peptide
  Seed: LRRYNADISTF (TYRP1_HUMAN)
LNRYNADISTF

SEQ ID NO: 178271 - protein, 10 aa, Artificial Sequence
  Description of Artificial Sequence: Synthetic peptide
  Seed: YNADISTFPL (TYRP1_HUMAN)
YMADISTFPP

SEQ ID NO: 178272 - protein, 8 aa, Artificial Sequence
  Description of Artificial Sequence: Synthetic peptide
  Seed: LPYWNFAT (TYRP1_HUMAN)
LPYWNFAV

SEQ ID NO: 178273 - protein, 9 aa, Artificial Sequence
  Description of Artificial Sequence: Synthetic peptide
  Seed: DFSHEGPAF (TYRP1_HUMAN)
DMSHEGPAY

SEQ ID NO: 178274 - protein, 9 aa, Artificial Sequence
  Description of Artificial Sequence: Synthetic peptide
  Seed: VWPLRFFNR (TYRP1_HUMAN)
VFPLRFFNR

SEQ ID NO: 178275 - protein, 10 aa, Artificial Sequence
  Description of Artificial Sequence: Synthetic peptide
  Seed: SPVSGPGTDR (TYRP1_HUMAN)
SVVSGPGTDR

SEQ ID NO: 178276 - protein, 11 aa, Artificial Sequence
  Description of Artificial Sequence: Synthetic peptide
  Seed: ILGPDGNTPQF (TYRP1_HUMAN)
IQGPDGNTPQF

SEQ ID NO: 178277 - protein, 11 aa, Artificial Sequence
  Description of Artificial Sequence: Synthetic peptide
  Seed: KTFLGVGQESF (TYRP1_HUMAN)
KQFLGVGQESV

SEQ ID NO: 178278 - protein, 11 aa, Artificial Sequence
  Description of Artificial Sequence: Synthetic peptide
  Seed: RSMDEANQPLL (TYRP1_HUMAN)
RQMDEANQPLF

SEQ ID NO: 178279 - protein, 9 aa, Artificial Sequence
  Description of Artificial Sequence: Synthetic peptide
  Seed: AVFDEWLRR (TYRP1_HUMAN)
AFFDEWLRY

SEQ ID NO: 178280 - protein, 9 aa, Artificial Sequence
  Description of Artificial Sequence: Synthetic peptide
  Seed: GPIRRNPAG (TYRP1_HUMAN)
GPIRRNPAM

SEQ ID NO: 178281 - protein, 11 aa, Artificial Sequence
  Description of Artificial Sequence: Synthetic peptide
  Seed: AGNVARPMVQR (TYRP1_HUMAN)
ATNVARPMVQK

SEQ ID NO: 178282 - protein, 9 aa, Artificial Sequence
  Description of Artificial Sequence: Synthetic peptide
  Seed: AVVGALLLV (TYRP1_HUMAN)
ALVGALLLL

SEQ ID NO: 178283 - protein, 9 aa, Artificial Sequence
  Description of Artificial Sequence: Synthetic peptide
  Seed: LIFGTASYL (TYRP1_HUMAN)
LHFGTASYF

SEQ ID NO: 178284 - protein, 9 aa, Artificial Sequence
  Description of Artificial Sequence: Synthetic peptide
  Seed: ISIYNYFVW (TYRP1_HUMAN)
IMIYNYFVY

SEQ ID NO: 178285 - protein, 9 aa, Artificial Sequence
  Description of Artificial Sequence: Synthetic peptide
  Seed: THLSPNDPI (TYRP1_HUMAN)
THLSPNDPL

SEQ ID NO: 178286 - protein, 10 aa, Artificial Sequence
  Description of Artificial Sequence: Synthetic peptide
  Seed: SPNSVFSQWR (TYRP1_HUMAN)
SWNSVFSQWR

SEQ ID NO: 178287 - protein, 10 aa, Artificial Sequence
  Description of Artificial Sequence: Synthetic peptide
  Seed: LSPNDPIFVL (TYRP1_HUMAN)
LSPNDPIFVF

SEQ ID NO: 178288 - protein, 9 aa, Artificial Sequence
  Description of Artificial Sequence: Synthetic peptide
  Seed: SLGCIFFPL (TYRP1_HUMAN)
SIGCIFFPV

SEQ ID NO: 178289 - protein, 10 aa, Artificial Sequence
  Description of Artificial Sequence: Synthetic peptide
  Seed: SREFSVPEII (TYRP1_HUMAN)
SPEFSVPEIL

SEQ ID NO: 178290 - protein, 10 aa, Artificial Sequence
  Description of Artificial Sequence: Synthetic peptide
  Seed: TFLGVGQESF (TYRP1_HUMAN)
TQLGVGQESF

SEQ ID NO: 178291 - protein, 9 aa, Artificial Sequence
  Description of Artificial Sequence: Synthetic peptide
  Seed: NISIYNYFV (TYRP1_HUMAN)
NASIYNYFI

SEQ ID NO: 178292 - protein, 9 aa, Artificial Sequence
  Description of Artificial Sequence: Synthetic peptide
  Seed: REFSVPEII (TYRP1_HUMAN)
RAFSVPEII

SEQ ID NO: 178293 - protein, 10 aa, Artificial Sequence
  Description of Artificial Sequence: Synthetic peptide
  Seed: FLTWHRYHLL (TYRP1_HUMAN)
FHTWHRYHLV

SEQ ID NO: 178294 - protein, 11 aa, Artificial Sequence
  Description of Artificial Sequence: Synthetic peptide
  Seed: REVWPLRFFNR (TYRP1_HUMAN)
RHVWPLRFFNR

SEQ ID NO: 178295 - protein, 9 aa, Artificial Sequence
  Description of Artificial Sequence: Synthetic peptide
  Seed: SPNDPIFVL (TYRP1_HUMAN)
SANDPIFVH

SEQ ID NO: 178296 - protein, 11 aa, Artificial Sequence
  Description of Artificial Sequence: Synthetic peptide
  Seed: IYNYFVWTHYY (TYRP1_HUMAN)
IVNYFVWTHYL

SEQ ID NO: 178297 - protein, 11 aa, Artificial Sequence
  Description of Artificial Sequence: Synthetic peptide
  Seed: QEMLQEPSFSL (TYRP1_HUMAN)
QMMLQEPSFSM

SEQ ID NO: 178298 - protein, 10 aa, Artificial Sequence
  Description of Artificial Sequence: Synthetic peptide
  Seed: FPLLLFQQAR (TYRP1_HUMAN)
FPLLLFQQAT

SEQ ID NO: 178299 - protein, 10 aa, Artificial Sequence
  Description of Artificial Sequence: Synthetic peptide
  Seed: LSPNDPIFVL (TYRP1_HUMAN)
LCPNDPIFVY

SEQ ID NO: 178300 - protein, 9 aa, Artificial Sequence
  Description of Artificial Sequence: Synthetic peptide
  Seed: APIGHNRQY (TYRP1_HUMAN)
ASIGHNRQI

SEQ ID NO: 178301 - protein, 10 aa, Artificial Sequence
  Description of Artificial Sequence: Synthetic peptide
  Seed: LGPDGNTPQF (TYRP1_HUMAN)
LMPDGNTPQW

SEQ ID NO: 178302 - protein, 9 aa, Artificial Sequence
  Description of Artificial Sequence: Synthetic peptide
  Seed: ALIFGTASY (TYRP1_HUMAN)
APIFGTASF

SEQ ID NO: 178303 - protein, 9 aa, Artificial Sequence
  Description of Artificial Sequence: Synthetic peptide
  Seed: GALLLVALI (TYRP1_HUMAN)
GLLLLVALV

SEQ ID NO: 178304 - protein, 9 aa, Artificial Sequence
  Description of Artificial Sequence: Synthetic peptide
  Seed: RQCATVEAL (TYRP1_HUMAN)
RQCATVEAF

SEQ ID NO: 178305 - protein, 10 aa, Artificial Sequence
  Description of Artificial Sequence: Synthetic peptide
  Seed: KRTTHPLFVI (TYRP1_HUMAN)
KETTHPLFVW

SEQ ID NO: 178306 - protein, 9 aa, Artificial Sequence
  Description of Artificial Sequence: Synthetic peptide
  Seed: RGRCEAVTA (TYRP1_HUMAN)
RARCEAVTA

SEQ ID NO: 178307 - protein, 9 aa, Artificial Sequence
  Description of Artificial Sequence: Synthetic peptide
  Seed: SGRGRCEAV (TYRP1_HUMAN)
SLRGRCEAV

SEQ ID NO: 178308 - protein, 9 aa, Artificial Sequence
  Description of Artificial Sequence: Synthetic peptide
  Seed: MSAPKLLSL (TYRP1_HUMAN)
MYAPKLLSY

SEQ ID NO: 178309 - protein, 10 aa, Artificial Sequence
  Description of Artificial Sequence: Synthetic peptide
  Seed: RRYNADISTF (TYRP1_HUMAN)
RAYNADISTW

SEQ ID NO: 178310 - protein, 9 aa, Artificial Sequence
  Description of Artificial Sequence: Synthetic peptide
  Seed: ENAPIGHNR (TYRP1_HUMAN)
ETAPIGHNL

SEQ ID NO: 178311 - protein, 10 aa, Artificial Sequence
  Description of Artificial Sequence: Synthetic peptide
  Seed: VLLHTFTDAV (TYRP1_HUMAN)
VMLHTFTDAL

SEQ ID NO: 178312 - protein, 9 aa, Artificial Sequence
  Description of Artificial Sequence: Synthetic peptide
  Seed: GYSDPTGKY (TYRP1_HUMAN)
GQSDPTGKY

SEQ ID NO: 178313 - protein, 9 aa, Artificial Sequence
  Description of Artificial Sequence: Synthetic peptide
  Seed: GLFDTPPFY (TYRP1_HUMAN)
GSFDTPPFY

SEQ ID NO: 178314 - protein, 9 aa, Artificial Sequence
  Description of Artificial Sequence: Synthetic peptide
  Seed: YLIRARRSM (TYRP1_HUMAN)
YWIRARRSV

SEQ ID NO: 178315 - protein, 10 aa, Artificial Sequence
  Description of Artificial Sequence: Synthetic peptide
  Seed: FVTAPDNLGY (TYRP1_HUMAN)
FQTAPDNLGF

SEQ ID NO: 178316 - protein, 9 aa, Artificial Sequence
  Description of Artificial Sequence: Synthetic peptide
  Seed: AVRSLHNLA (TYRP1_HUMAN)
AMRSLHNLA

SEQ ID NO: 178317 - protein, 10 aa, Artificial Sequence
  Description of Artificial Sequence: Synthetic peptide
  Seed: VWTHYYSVKK (TYRP1_HUMAN)
VTTHYYSVKR

SEQ ID NO: 178318 - protein, 11 aa, Artificial Sequence
  Description of Artificial Sequence: Synthetic peptide
  Seed: MLQEPSFSLPY (TYRP1_HUMAN)
MMQEPSFSLPM

SEQ ID NO: 178319 - protein, 10 aa, Artificial Sequence
  Description of Artificial Sequence: Synthetic peptide
  Seed: RVVCDSLEDY (TYRP1_HUMAN)
RTVCDSLEDY

SEQ ID NO: 178320 - protein, 9 aa, Artificial Sequence
  Description of Artificial Sequence: Synthetic peptide
  Seed: VGLFDTPPF (TYRP1_HUMAN)
VPLFDTPPY

SEQ ID NO: 178321 - protein, 9 aa, Artificial Sequence
  Description of Artificial Sequence: Synthetic peptide
  Seed: VWPLRFFNR (TYRP1_HUMAN)
VQPLRFFNR

SEQ ID NO: 178322 - protein, 10 aa, Artificial Sequence
  Description of Artificial Sequence: Synthetic peptide
  Seed: WPPVTNTEMF (TYRP1_HUMAN)
WMPVTNTEMW

SEQ ID NO: 178323 - protein, 9 aa, Artificial Sequence
  Description of Artificial Sequence: Synthetic peptide
  Seed: SIYNYFVWT (TYRP1_HUMAN)
SQYNYFVWA

SEQ ID NO: 178324 - protein, 9 aa, Artificial Sequence
  Description of Artificial Sequence: Synthetic peptide
  Seed: SMDEANQPL (TYRP1_HUMAN)
SYDEANQPY

SEQ ID NO: 178325 - protein, 9 aa, Artificial Sequence
  Description of Artificial Sequence: Synthetic peptide
  Seed: DYDTLGTLC (TYRP1_HUMAN)
DWDTLGTLL

SEQ ID NO: 178326 - protein, 9 aa, Artificial Sequence
  Description of Artificial Sequence: Synthetic peptide
  Seed: SREFSVPEI (TYRP1_HUMAN)
SYEFSVPEF

SEQ ID NO: 178327 - protein, 9 aa, Artificial Sequence
  Description of Artificial Sequence: Synthetic peptide
  Seed: CIFFPLLLF (TYRP1_HUMAN)
CTFFPLLLW

SEQ ID NO: 178328 - protein, 9 aa, Artificial Sequence
  Description of Artificial Sequence: Synthetic peptide
  Seed: VGALLLVAL (TYRP1_HUMAN)
VLALLLVAV

SEQ ID NO: 178329 - protein, 11 aa, Artificial Sequence
  Description of Artificial Sequence: Synthetic peptide
  Seed: FVLLHTFTDAV (TYRP1_HUMAN)
FCLLHTFTDAV

SEQ ID NO: 178330 - protein, 9 aa, Artificial Sequence
  Description of Artificial Sequence: Synthetic peptide
  Seed: NFDSTLISP (TYRP1_HUMAN)
NIDSTLISF

SEQ ID NO: 178331 - protein, 10 aa, Artificial Sequence
  Description of Artificial Sequence: Synthetic peptide
  Seed: KRTTHPLFVI (TYRP1_HUMAN)
KATTHPLFVW

SEQ ID NO: 178332 - protein, 11 aa, Artificial Sequence
  Description of Artificial Sequence: Synthetic peptide
  Seed: RRSMDEANQPL (TYRP1_HUMAN)
RESMDEANQPV

SEQ ID NO: 178333 - protein, 10 aa, Artificial Sequence
  Description of Artificial Sequence: Synthetic peptide
  Seed: MSAPKLLSLG (TYRP1_HUMAN)
MSAPKLLSLI

SEQ ID NO: 178334 - protein, 9 aa, Artificial Sequence
  Description of Artificial Sequence: Synthetic peptide
  Seed: TFPLENAPI (TYRP1_HUMAN)
TVPLENAPM

SEQ ID NO: 178335 - protein, 9 aa, Artificial Sequence
  Description of Artificial Sequence: Synthetic peptide
  Seed: FSHEGPAFL (TYRP1_HUMAN)
FMHEGPAFS

SEQ ID NO: 178336 - protein, 9 aa, Artificial Sequence
  Description of Artificial Sequence: Synthetic peptide
  Seed: NSTEDGPIR (TYRP1_HUMAN)
NTTEDGPIR

SEQ ID NO: 178337 - protein, 10 aa, Artificial Sequence
  Description of Artificial Sequence: Synthetic peptide
  Seed: NYFVWTHYYS (TYRP1_HUMAN)
NKFVWTHYYY

SEQ ID NO: 178338 - protein, 8 aa, Artificial Sequence
  Description of Artificial Sequence: Synthetic peptide
  Seed: RQYNMVPF (TYRP1_HUMAN)
RLYNMVPY

SEQ ID NO: 178339 - protein, 9 aa, Artificial Sequence
  Description of Artificial Sequence: Synthetic peptide
  Seed: ASYLIRARR (TYRP1_HUMAN)
AAYLIRARR

SEQ ID NO: 178340 - protein, 10 aa, Artificial Sequence
  Description of Artificial Sequence: Synthetic peptide
  Seed: AVVGALLLVA (TYRP1_HUMAN)
ALVGALLLVL

SEQ ID NO: 178341 - protein, 11 aa, Artificial Sequence
  Description of Artificial Sequence: Synthetic peptide
  Seed: REFSVPEIIAI (TYRP1_HUMAN)
RIFSVPEIIAF

SEQ ID NO: 178342 - protein, 11 aa, Artificial Sequence
  Description of Artificial Sequence: Synthetic peptide
  Seed: QEMLQEPSFSL (TYRP1_HUMAN)
QLMLQEPSFSM

SEQ ID NO: 178343 - protein, 10 aa, Artificial Sequence
  Description of Artificial Sequence: Synthetic peptide
  Seed: SMDEANQPLL (TYRP1_HUMAN)
SADEANQPLY

SEQ ID NO: 178344 - protein, 9 aa, Artificial Sequence
  Description of Artificial Sequence: Synthetic peptide
  Seed: SVPEIIAIA (TYRP1_HUMAN)
SCPEIIAIL

SEQ ID NO: 178345 - protein, 9 aa, Artificial Sequence
  Description of Artificial Sequence: Synthetic peptide
  Seed: RGRCEAVTA (TYRP1_HUMAN)
RLRCEAVTK

SEQ ID NO: 178346 - protein, 9 aa, Artificial Sequence
  Description of Artificial Sequence: Synthetic peptide
  Seed: LIFGTASYL (TYRP1_HUMAN)
LVFGTASYL

SEQ ID NO: 178347 - protein, 10 aa, Artificial Sequence
  Description of Artificial Sequence: Synthetic peptide
  Seed: SQWRVVCDSL (TYRP1_HUMAN)
SKWRVVCDSF

SEQ ID NO: 178348 - protein, 9 aa, Artificial Sequence
  Description of Artificial Sequence: Synthetic peptide
  Seed: VFDEWLRRY (TYRP1_HUMAN)
VWDEWLRRV

SEQ ID NO: 178349 - protein, 10 aa, Artificial Sequence
  Description of Artificial Sequence: Synthetic peptide
  Seed: NVARPMVQRL (TYRP1_HUMAN)
NTARPMVQRI

SEQ ID NO: 178350 - protein, 10 aa, Artificial Sequence
  Description of Artificial Sequence: Synthetic peptide
  Seed: SLGCIFFPLL (TYRP1_HUMAN)
SMGCIFFPLM

SEQ ID NO: 178351 - protein, 10 aa, Artificial Sequence
  Description of Artificial Sequence: Synthetic peptide
  Seed: FVTAPDNLGY (TYRP1_HUMAN)
FMTAPDNLGY

SEQ ID NO: 178352 - protein, 9 aa, Artificial Sequence
  Description of Artificial Sequence: Synthetic peptide
  Seed: SGRGRCEAV (TYRP1_HUMAN)
SMRGRCEAL

SEQ ID NO: 178353 - protein, 10 aa, Artificial Sequence
  Description of Artificial Sequence: Synthetic peptide
  Seed: LPYWNFATGK (TYRP1_HUMAN)
LPYWNFATGR

SEQ ID NO: 178354 - protein, 10 aa, Artificial Sequence
  Description of Artificial Sequence: Synthetic peptide
  Seed: WPPVTNTEMF (TYRP1_HUMAN)
WYPVTNTEMY

SEQ ID NO: 178355 - protein, 9 aa, Artificial Sequence
  Description of Artificial Sequence: Synthetic peptide
  Seed: AVVGALLLV (TYRP1_HUMAN)
AQVGALLLT

SEQ ID NO: 178356 - protein, 10 aa, Artificial Sequence
  Description of Artificial Sequence: Synthetic peptide
  Seed: KRTTHPLFVI (TYRP1_HUMAN)
KCTTHPLFVY

SEQ ID NO: 178357 - protein, 10 aa, Artificial Sequence
  Description of Artificial Sequence: Synthetic peptide
  Seed: YNYFVWTHYY (TYRP1_HUMAN)
YHYFVWTHYL

SEQ ID NO: 178358 - protein, 9 aa, Artificial Sequence
  Description of Artificial Sequence: Synthetic peptide
  Seed: DDREVWPLR (TYRP1_HUMAN)
DIREVWPLK

SEQ ID NO: 178359 - protein, 9 aa, Artificial Sequence
  Description of Artificial Sequence: Synthetic peptide
  Seed: ALIFGTASY (TYRP1_HUMAN)
AEIFGTASY

SEQ ID NO: 178360 - protein, 11 aa, Artificial Sequence
  Description of Artificial Sequence: Synthetic peptide
  Seed: VRSLHNLAHLF (TYRP1_HUMAN)
VLSLHNLAHLW

SEQ ID NO: 178361 - protein, 10 aa, Artificial Sequence
  Description of Artificial Sequence: Synthetic peptide
  Seed: KRTTHPLFVI (TYRP1_HUMAN)
KTTTHPLFVM

SEQ ID NO: 178362 - protein, 11 aa, Artificial Sequence
  Description of Artificial Sequence: Synthetic peptide
  Seed: KTFLGVGQESF (TYRP1_HUMAN)
KTFLGVGQESM

SEQ ID NO: 178363 - protein, 10 aa, Artificial Sequence
  Description of Artificial Sequence: Synthetic peptide
  Seed: THYYSVKKTF (TYRP1_HUMAN)
TFYYSVKKTF

SEQ ID NO: 178364 - protein, 10 aa, Artificial Sequence
  Description of Artificial Sequence: Synthetic peptide
  Seed: FVWTHYYSVK (TYRP1_HUMAN)
FIWTHYYSVR

SEQ ID NO: 178365 - protein, 9 aa, Artificial Sequence
  Description of Artificial Sequence: Synthetic peptide
  Seed: SIYNYFVWT (TYRP1_HUMAN)
SMYNYFVWC

SEQ ID NO: 178366 - protein, 9 aa, Artificial Sequence
  Description of Artificial Sequence: Synthetic peptide
  Seed: FSHEGPAFL (TYRP1_HUMAN)
FAHEGPAFF

SEQ ID NO: 178367 - protein, 10 aa, Artificial Sequence
  Description of Artificial Sequence: Synthetic peptide
  Seed: PAVRSLHNLA (TYRP1_HUMAN)
PKVRSLHNLA

SEQ ID NO: 178368 - protein, 9 aa, Artificial Sequence
  Description of Artificial Sequence: Synthetic peptide
  Seed: FVWTHYYSV (TYRP1_HUMAN)
FQWTHYYSK

SEQ ID NO: 178369 - protein, 9 aa, Artificial Sequence
  Description of Artificial Sequence: Synthetic peptide
  Seed: NRQYNMVPF (TYRP1_HUMAN)
NFQYNMVPM

SEQ ID NO: 178370 - protein, 9 aa, Artificial Sequence
  Description of Artificial Sequence: Synthetic peptide
  Seed: RVLIVRRNL (TYRP1_HUMAN)
RTLIVRRNL

SEQ ID NO: 178371 - protein, 9 aa, Artificial Sequence
  Description of Artificial Sequence: Synthetic peptide
  Seed: HEGPAFLTW (TYRP1_HUMAN)
HQGPAFLTM

SEQ ID NO: 178372 - protein, 11 aa, Artificial Sequence
  Description of Artificial Sequence: Synthetic peptide
  Seed: RLPEPQDVAQC (TYRP1_HUMAN)
RLPEPQDVAQM

SEQ ID NO: 178373 - protein, 9 aa, Artificial Sequence
  Description of Artificial Sequence: Synthetic peptide
  Seed: FTDAVFDEW (TYRP1_HUMAN)
FNDAVFDEI

SEQ ID NO: 178374 - protein, 9 aa, Artificial Sequence
  Description of Artificial Sequence: Synthetic peptide
  Seed: MLQEPSFSL (TYRP1_HUMAN)
MQQEPSFSM

SEQ ID NO: 178375 - protein, 10 aa, Artificial Sequence
  Description of Artificial Sequence: Synthetic peptide
  Seed: YNYFVWTHYY (TYRP1_HUMAN)
YGYFVWTHYW

SEQ ID NO: 178376 - protein, 10 aa, Artificial Sequence
  Description of Artificial Sequence: Synthetic peptide
  Seed: HPLFVIATRR (TYRP1_HUMAN)
HSLFVIATRK

SEQ ID NO: 178377 - protein, 10 aa, Artificial Sequence
  Description of Artificial Sequence: Synthetic peptide
  Seed: ISPNSVFSQW (TYRP1_HUMAN)
IRPNSVFSQW

SEQ ID NO: 178378 - protein, 9 aa, Artificial Sequence
  Description of Artificial Sequence: Synthetic peptide
  Seed: THLSPNDPI (TYRP1_HUMAN)
THLSPNDPA

SEQ ID NO: 178379 - protein, 9 aa, Artificial Sequence
  Description of Artificial Sequence: Synthetic peptide
  Seed: HEGPAFLTW (TYRP1_HUMAN)
HEGPAFLTT

SEQ ID NO: 178380 - protein, 9 aa, Artificial Sequence
  Description of Artificial Sequence: Synthetic peptide
  Seed: RNPAGNVAR (TYRP1_HUMAN)
RVPAGNVAR

SEQ ID NO: 178381 - protein, 9 aa, Artificial Sequence
  Description of Artificial Sequence: Synthetic peptide
  Seed: RSLHNLAHL (TYRP1_HUMAN)
RILHNLAHW

SEQ ID NO: 178382 - protein, 9 aa, Artificial Sequence
  Description of Artificial Sequence: Synthetic peptide
  Seed: TAPDNLGYT (TYRP1_HUMAN)
TVPDNLGYI

SEQ ID NO: 178383 - protein, 9 aa, Artificial Sequence
  Description of Artificial Sequence: Synthetic peptide
  Seed: STNSFRNTV (TYRP1_HUMAN)
SMNSFRNTM

SEQ ID NO: 178384 - protein, 10 aa, Artificial Sequence
  Description of Artificial Sequence: Synthetic peptide
  Seed: VDFSHEGPAF (TYRP1_HUMAN)
VSFSHEGPAY

SEQ ID NO: 178385 - protein, 9 aa, Artificial Sequence
  Description of Artificial Sequence: Synthetic peptide
  Seed: RQYNMVPFW (TYRP1_HUMAN)
RVYNMVPFW

SEQ ID NO: 178386 - protein, 9 aa, Artificial Sequence
  Description of Artificial Sequence: Synthetic peptide
  Seed: IYNYFVWTH (TYRP1_HUMAN)
IYNYFVWTF

SEQ ID NO: 178387 - protein, 9 aa, Artificial Sequence
  Description of Artificial Sequence: Synthetic peptide
  Seed: KLLSLGCIF (TYRP1_HUMAN)
KTLSLGCIL

SEQ ID NO: 178388 - protein, 9 aa, Artificial Sequence
  Description of Artificial Sequence: Synthetic peptide
  Seed: SMDEANQPL (TYRP1_HUMAN)
SADEANQPY

SEQ ID NO: 178389 - protein, 8 aa, Artificial Sequence
  Description of Artificial Sequence: Synthetic peptide
  Seed: HEGPAFLT (TYRP1_HUMAN)
HEGPAFLL

SEQ ID NO: 178390 - protein, 10 aa, Artificial Sequence
  Description of Artificial Sequence: Synthetic peptide
  Seed: HLSPNDPIFV (TYRP1_HUMAN)
HLSPNDPIFL

SEQ ID NO: 178391 - protein, 9 aa, Artificial Sequence
  Description of Artificial Sequence: Synthetic peptide
  Seed: LTWHRYHLL (TYRP1_HUMAN)
LLWHRYHLT

SEQ ID NO: 178392 - protein, 9 aa, Artificial Sequence
  Description of Artificial Sequence: Synthetic peptide
  Seed: HEGPAFLTW (TYRP1_HUMAN)
HSGPAFLTW

SEQ ID NO: 178393 - protein, 9 aa, Artificial Sequence
  Description of Artificial Sequence: Synthetic peptide
  Seed: KLLSLGCIF (TYRP1_HUMAN)
KTLSLGCIF

SEQ ID NO: 178394 - protein, 9 aa, Artificial Sequence
  Description of Artificial Sequence: Synthetic peptide
  Seed: RTCHCNGNF (TYRP1_HUMAN)
RLCHCNGNY

SEQ ID NO: 178395 - protein, 9 aa, Artificial Sequence
  Description of Artificial Sequence: Synthetic peptide
  Seed: FPLENAPIG (TYRP1_HUMAN)
FSLENAPIM

SEQ ID NO: 178396 - protein, 8 aa, Artificial Sequence
  Description of Artificial Sequence: Synthetic peptide
  Seed: GLFDTPPF (TYRP1_HUMAN)
GMFDTPPF

SEQ ID NO: 178397 - protein, 10 aa, Artificial Sequence
  Description of Artificial Sequence: Synthetic peptide
  Seed: FVLLHTFTDA (TYRP1_HUMAN)
FKLLHTFTDV

SEQ ID NO: 178398 - protein, 9 aa, Artificial Sequence
  Description of Artificial Sequence: Synthetic peptide
  Seed: MLQEPSFSL (TYRP1_HUMAN)
MMQEPSFST

SEQ ID NO: 178399 - protein, 9 aa, Artificial Sequence
  Description of Artificial Sequence: Synthetic peptide
  Seed: FSLPYWNFA (TYRP1_HUMAN)
FVLPYWNFA

SEQ ID NO: 178400 - protein, 10 aa, Artificial Sequence
  Description of Artificial Sequence: Synthetic peptide
  Seed: LLLVALIFGT (TYRP1_HUMAN)
LVLVALIFGV

SEQ ID NO: 178401 - protein, 9 aa, Artificial Sequence
  Description of Artificial Sequence: Synthetic peptide
  Seed: AACDQRVLI (TYRP1_HUMAN)
ATCDQRVLI

SEQ ID NO: 178402 - protein, 9 aa, Artificial Sequence
  Description of Artificial Sequence: Synthetic peptide
  Seed: QEMLQEPSF (TYRP1_HUMAN)
QEMLQEPSV

SEQ ID NO: 178403 - protein, 9 aa, Artificial Sequence
  Description of Artificial Sequence: Synthetic peptide
  Seed: KLQNPNQSV (TYRP1_HUMAN)
KMQNPNQSI

SEQ ID NO: 178404 - protein, 9 aa, Artificial Sequence
  Description of Artificial Sequence: Synthetic peptide
  Seed: KLQNPNQSV (TYRP1_HUMAN)
KQQNPNQSL

SEQ ID NO: 178405 - protein, 8 aa, Artificial Sequence
  Description of Artificial Sequence: Synthetic peptide
  Seed: YSNSTNSF (TYRP1_HUMAN)
YFNSTNSM

SEQ ID NO: 178406 - protein, 11 aa, Artificial Sequence
  Description of Artificial Sequence: Synthetic peptide
  Seed: YNMVPFWPPVT (TYRP1_HUMAN)
YMMVPFWPPVL

SEQ ID NO: 178407 - protein, 10 aa, Artificial Sequence
  Description of Artificial Sequence: Synthetic peptide
  Seed: NYFVWTHYYS (TYRP1_HUMAN)
NMFVWTHYYH

SEQ ID NO: 178408 - protein, 10 aa, Artificial Sequence
  Description of Artificial Sequence: Synthetic peptide
  Seed: LGPDGNTPQF (TYRP1_HUMAN)
LLPDGNTPQM

SEQ ID NO: 178409 - protein, 10 aa, Artificial Sequence
  Description of Artificial Sequence: Synthetic peptide
  Seed: YNMVPFWPPV (TYRP1_HUMAN)
YLMVPFWPPL

SEQ ID NO: 178410 - protein, 9 aa, Artificial Sequence
  Description of Artificial Sequence: Synthetic peptide
  Seed: LSPNDPIFV (TYRP1_HUMAN)
LLPNDPIFL

SEQ ID NO: 178411 - protein, 10 aa, Artificial Sequence
  Description of Artificial Sequence: Synthetic peptide
  Seed: GNVARPMVQR (TYRP1_HUMAN)
GMVARPMVQR

SEQ ID NO: 178412 - protein, 11 aa, Artificial Sequence
  Description of Artificial Sequence: Synthetic peptide
  Seed: REFSVPEIIAI (TYRP1_HUMAN)
RLFSVPEIIAF

SEQ ID NO: 178413 - protein, 9 aa, Artificial Sequence
  Description of Artificial Sequence: Synthetic peptide
  Seed: RQCATVEAL (TYRP1_HUMAN)
RICATVEAI

SEQ ID NO: 178414 - protein, 10 aa, Artificial Sequence
  Description of Artificial Sequence: Synthetic peptide
  Seed: VPFWPPVTNT (TYRP1_HUMAN)
VPFWPPVTNL

SEQ ID NO: 178415 - protein, 11 aa, Artificial Sequence
  Description of Artificial Sequence: Synthetic peptide
  Seed: GTDRCGSSSGR (TYRP1_HUMAN)
GSDRCGSSSGY

SEQ ID NO: 178416 - protein, 9 aa, Artificial Sequence
  Description of Artificial Sequence: Synthetic peptide
  Seed: CIFFPLLLF (TYRP1_HUMAN)
CGFFPLLLY

SEQ ID NO: 178417 - protein, 9 aa, Artificial Sequence
  Description of Artificial Sequence: Synthetic peptide
  Seed: FTDAVFDEW (TYRP1_HUMAN)
FSDAVFDEL

SEQ ID NO: 178418 - protein, 9 aa, Artificial Sequence
  Description of Artificial Sequence: Synthetic peptide
  Seed: RGRCEAVTA (TYRP1_HUMAN)
RFRCEAVTK

SEQ ID NO: 178419 - protein, 9 aa, Artificial Sequence
  Description of Artificial Sequence: Synthetic peptide
  Seed: VGALLLVAL (TYRP1_HUMAN)
VLALLLVAL

SEQ ID NO: 178420 - protein, 9 aa, Artificial Sequence
  Description of Artificial Sequence: Synthetic peptide
  Seed: SVKKTFLGV (TYRP1_HUMAN)
SMKKTFLGK

SEQ ID NO: 178421 - protein, 9 aa, Artificial Sequence
  Description of Artificial Sequence: Synthetic peptide
  Seed: NYFVWTHYY (TYRP1_HUMAN)
NMFVWTHYK

SEQ ID NO: 178422 - protein, 9 aa, Artificial Sequence
  Description of Artificial Sequence: Synthetic peptide
  Seed: TLISPNSVF (TYRP1_HUMAN)
TFISPNSVL

SEQ ID NO: 178423 - protein, 9 aa, Artificial Sequence
  Description of Artificial Sequence: Synthetic peptide
  Seed: GTASYLIRA (TYRP1_HUMAN)
GIASYLIRL

SEQ ID NO: 178424 - protein, 11 aa, Artificial Sequence
  Description of Artificial Sequence: Synthetic peptide
  Seed: EEILGPDGNTP (TYRP1_HUMAN)
EEILGPDGNTL

SEQ ID NO: 178425 - protein, 9 aa, Artificial Sequence
  Description of Artificial Sequence: Synthetic peptide
  Seed: MLQEPSFSL (TYRP1_HUMAN)
MWQEPSFSM

SEQ ID NO: 178426 - protein, 10 aa, Artificial Sequence
  Description of Artificial Sequence: Synthetic peptide
  Seed: FVWTHYYSVK (TYRP1_HUMAN)
FVWTHYYSVA

SEQ ID NO: 178427 - protein, 9 aa, Artificial Sequence
  Description of Artificial Sequence: Synthetic peptide
  Seed: AVFDEWLRR (TYRP1_HUMAN)
ALFDEWLRY

SEQ ID NO: 178428 - protein, 10 aa, Artificial Sequence
  Description of Artificial Sequence: Synthetic peptide
  Seed: AVFDEWLRRY (TYRP1_HUMAN)
AAFDEWLRRK

SEQ ID NO: 178429 - protein, 11 aa, Artificial Sequence
  Description of Artificial Sequence: Synthetic peptide
  Seed: YQCYAEEYEKL (TYRP1_HUMAN)
YKCYAEEYEKF

SEQ ID NO: 178430 - protein, 9 aa, Artificial Sequence
  Description of Artificial Sequence: Synthetic peptide
  Seed: LTDQYQCYA (TYRP1_HUMAN)
LIDQYQCYL

SEQ ID NO: 178431 - protein, 9 aa, Artificial Sequence
  Description of Artificial Sequence: Synthetic peptide
  Seed: RVLIVRRNL (TYRP1_HUMAN)
RTLIVRRNF

SEQ ID NO: 178432 - protein, 10 aa, Artificial Sequence
  Description of Artificial Sequence: Synthetic peptide
  Seed: FGTASYLIRA (TYRP1_HUMAN)
FITASYLIRL

SEQ ID NO: 178433 - protein, 10 aa, Artificial Sequence
  Description of Artificial Sequence: Synthetic peptide
  Seed: MVPFWPPVTN (TYRP1_HUMAN)
MRPFWPPVTM

SEQ ID NO: 178434 - protein, 11 aa, Artificial Sequence
  Description of Artificial Sequence: Synthetic peptide
  Seed: EILGPDGNTPQ (TYRP1_HUMAN)
ESLGPDGNTPK

SEQ ID NO: 178435 - protein, 9 aa, Artificial Sequence
  Description of Artificial Sequence: Synthetic peptide
  Seed: SMDEANQPL (TYRP1_HUMAN)
SADEANQPI

SEQ ID NO: 178436 - protein, 10 aa, Artificial Sequence
  Description of Artificial Sequence: Synthetic peptide
  Seed: YNMVPFWPPV (TYRP1_HUMAN)
YMMVPFWPPF

SEQ ID NO: 178437 - protein, 9 aa, Artificial Sequence
  Description of Artificial Sequence: Synthetic peptide
  Seed: DNLGYTYEI (TYRP1_HUMAN)
DTLGYTYEV

SEQ ID NO: 178438 - protein, 9 aa, Artificial Sequence
  Description of Artificial Sequence: Synthetic peptide
  Seed: LSKEEKNHF (TYRP1_HUMAN)
LLKEEKNHY

SEQ ID NO: 178439 - protein, 9 aa, Artificial Sequence
  Description of Artificial Sequence: Synthetic peptide
  Seed: SMDEANQPL (TYRP1_HUMAN)
SADEANQPF

SEQ ID NO: 178440 - protein, 9 aa, Artificial Sequence
  Description of Artificial Sequence: Synthetic peptide
  Seed: REFSVPEII (TYRP1_HUMAN)
RIFSVPEIF

SEQ ID NO: 178441 - protein, 10 aa, Artificial Sequence
  Description of Artificial Sequence: Synthetic peptide
  Seed: VDFSHEGPAF (TYRP1_HUMAN)
VSFSHEGPAF

SEQ ID NO: 178442 - protein, 9 aa, Artificial Sequence
  Description of Artificial Sequence: Synthetic peptide
  Seed: EPSFSLPYW (TYRP1_HUMAN)
ETSFSLPYW

SEQ ID NO: 178443 - protein, 9 aa, Artificial Sequence
  Description of Artificial Sequence: Synthetic peptide
  Seed: RGRCEAVTA (TYRP1_HUMAN)
RFRCEAVTA

SEQ ID NO: 178444 - protein, 9 aa, Artificial Sequence
  Description of Artificial Sequence: Synthetic peptide
  Seed: SPNDPIFVL (TYRP1_HUMAN)
SMNDPIFVM

SEQ ID NO: 178445 - protein, 9 aa, Artificial Sequence
  Description of Artificial Sequence: Synthetic peptide
  Seed: LLHTFTDAV (TYRP1_HUMAN)
LTHTFTDAV

SEQ ID NO: 178446 - protein, 9 aa, Artificial Sequence
  Description of Artificial Sequence: Synthetic peptide
  Seed: ALIFGTASY (TYRP1_HUMAN)
ASIFGTASF

SEQ ID NO: 178447 - protein, 9 aa, Artificial Sequence
  Description of Artificial Sequence: Synthetic peptide
  Seed: AVRSLHNLA (TYRP1_HUMAN)
AMRSLHNLM

SEQ ID NO: 178448 - protein, 9 aa, Artificial Sequence
  Description of Artificial Sequence: Synthetic peptide
  Seed: SLHNLAHLF (TYRP1_HUMAN)
SAHNLAHLV

SEQ ID NO: 178449 - protein, 10 aa, Artificial Sequence
  Description of Artificial Sequence: Synthetic peptide
  Seed: ALIFGTASYL (TYRP1_HUMAN)
AQIFGTASYD

SEQ ID NO: 178450 - protein, 9 aa, Artificial Sequence
  Description of Artificial Sequence: Synthetic peptide
  Seed: FYSNSTNSF (TYRP1_HUMAN)
FQSNSTNSV

SEQ ID NO: 178451 - protein, 9 aa, Artificial Sequence
  Description of Artificial Sequence: Synthetic peptide
  Seed: NISIYNYFV (TYRP1_HUMAN)
NTSIYNYFI

SEQ ID NO: 178452 - protein, 11 aa, Artificial Sequence
  Description of Artificial Sequence: Synthetic peptide
  Seed: REFSVPEIIAI (TYRP1_HUMAN)
RAFSVPEIIAY

SEQ ID NO: 178453 - protein, 9 aa, Artificial Sequence
  Description of Artificial Sequence: Synthetic peptide
  Seed: RGRCEAVTA (TYRP1_HUMAN)
RTRCEAVTI

SEQ ID NO: 178454 - protein, 9 aa, Artificial Sequence
  Description of Artificial Sequence: Synthetic peptide
  Seed: LTWHRYHLL (TYRP1_HUMAN)
LYWHRYHLL

SEQ ID NO: 178455 - protein, 10 aa, Artificial Sequence
  Description of Artificial Sequence: Synthetic peptide
  Seed: NMVPFWPPVT (TYRP1_HUMAN)
NMVPFWPPVA

SEQ ID NO: 178456 - protein, 10 aa, Artificial Sequence
  Description of Artificial Sequence: Synthetic peptide
  Seed: HFVRALDMAK (TYRP1_HUMAN)
HYVRALDMAK

SEQ ID NO: 178457 - protein, 10 aa, Artificial Sequence
  Description of Artificial Sequence: Synthetic peptide
  Seed: RSMDEANQPL (TYRP1_HUMAN)
RAMDEANQPM

SEQ ID NO: 178458 - protein, 9 aa, Artificial Sequence
  Description of Artificial Sequence: Synthetic peptide
  Seed: FYSNSTNSF (TYRP1_HUMAN)
FFSNSTNSF

SEQ ID NO: 178459 - protein, 9 aa, Artificial Sequence
  Description of Artificial Sequence: Synthetic peptide
  Seed: LLVALIFGT (TYRP1_HUMAN)
LAVALIFGI

SEQ ID NO: 178460 - protein, 10 aa, Artificial Sequence
  Description of Artificial Sequence: Synthetic peptide
  Seed: MVPFWPPVTN (TYRP1_HUMAN)
MPPFWPPVTF

SEQ ID NO: 178461 - protein, 9 aa, Artificial Sequence
  Description of Artificial Sequence: Synthetic peptide
  Seed: GLFDTPPFY (TYRP1_HUMAN)
GLFDTPPFW

SEQ ID NO: 178462 - protein, 11 aa, Artificial Sequence
  Description of Artificial Sequence: Synthetic peptide
  Seed: EILGPDGNTPQ (TYRP1_HUMAN)
ELLGPDGNTPK

SEQ ID NO: 178463 - protein, 9 aa, Artificial Sequence
  Description of Artificial Sequence: Synthetic peptide
  Seed: TADSRPHSP (TYRP1_HUMAN)
TGDSRPHSV

SEQ ID NO: 178464 - protein, 9 aa, Artificial Sequence
  Description of Artificial Sequence: Synthetic peptide
  Seed: AVRSLHNLA (TYRP1_HUMAN)
AMRSLHNLV

SEQ ID NO: 178465 - protein, 10 aa, Artificial Sequence
  Description of Artificial Sequence: Synthetic peptide
  Seed: YNADISTFPL (TYRP1_HUMAN)
YIADISTFPT

SEQ ID NO: 178466 - protein, 10 aa, Artificial Sequence
  Description of Artificial Sequence: Synthetic peptide
  Seed: MQEMLQEPSF (TYRP1_HUMAN)
MHEMLQEPSW

SEQ ID NO: 178467 - protein, 10 aa, Artificial Sequence
  Description of Artificial Sequence: Synthetic peptide
  Seed: NLAHLFLNGT (TYRP1_HUMAN)
NVAHLFLNGV

SEQ ID NO: 178468 - protein, 9 aa, Artificial Sequence
  Description of Artificial Sequence: Synthetic peptide
  Seed: SVFSQWRVV (TYRP1_HUMAN)
SLFSQWRVV

SEQ ID NO: 178469 - protein, 11 aa, Artificial Sequence
  Description of Artificial Sequence: Synthetic peptide
  Seed: FVLLHTFTDAV (TYRP1_HUMAN)
FELLHTFTDAL

SEQ ID NO: 178470 - protein, 10 aa, Artificial Sequence
  Description of Artificial Sequence: Synthetic peptide
  Seed: MVPFWPPVTN (TYRP1_HUMAN)
MIPFWPPVTM

SEQ ID NO: 178471 - protein, 10 aa, Artificial Sequence
  Description of Artificial Sequence: Synthetic peptide
  Seed: SPNDPIFVLL (TYRP1_HUMAN)
SPNDPIFVLY

SEQ ID NO: 178472 - protein, 9 aa, Artificial Sequence
  Description of Artificial Sequence: Synthetic peptide
  Seed: SVPEIIAIA (TYRP1_HUMAN)
STPEIIAIV

SEQ ID NO: 178473 - protein, 9 aa, Artificial Sequence
  Description of Artificial Sequence: Synthetic peptide
  Seed: GLFDTPPFY (TYRP1_HUMAN)
GRFDTPPFM

SEQ ID NO: 178474 - protein, 9 aa, Artificial Sequence
  Description of Artificial Sequence: Synthetic peptide
  Seed: ISIYNYFVW (TYRP1_HUMAN)
IEIYNYFVY

SEQ ID NO: 178475 - protein, 10 aa, Artificial Sequence
  Description of Artificial Sequence: Synthetic peptide
  Seed: TFLGVGQESF (TYRP1_HUMAN)
TQLGVGQESY

SEQ ID NO: 178476 - protein, 9 aa, Artificial Sequence
  Description of Artificial Sequence: Synthetic peptide
  Seed: SVKKTFLGV (TYRP1_HUMAN)
STKKTFLGS

SEQ ID NO: 178477 - protein, 8 aa, Artificial Sequence
  Description of Artificial Sequence: Synthetic peptide
  Seed: RQYNMVPF (TYRP1_HUMAN)
RQYNMVPY

SEQ ID NO: 178478 - protein, 9 aa, Artificial Sequence
  Description of Artificial Sequence: Synthetic peptide
  Seed: NSVFSQWRV (TYRP1_HUMAN)
NTVFSQWRV

SEQ ID NO: 178479 - protein, 10 aa, Artificial Sequence
  Description of Artificial Sequence: Synthetic peptide
  Seed: RSLHNLAHLF (TYRP1_HUMAN)
RYLHNLAHLM

SEQ ID NO: 178480 - protein, 9 aa, Artificial Sequence
  Description of Artificial Sequence: Synthetic peptide
  Seed: SGRGRCEAV (TYRP1_HUMAN)
SLRGRCEAI

SEQ ID NO: 178481 - protein, 8 aa, Artificial Sequence
  Description of Artificial Sequence: Synthetic peptide
  Seed: YSDPTGKY (TYRP1_HUMAN)
YIDPTGKV

SEQ ID NO: 178482 - protein, 9 aa, Artificial Sequence
  Description of Artificial Sequence: Synthetic peptide
  Seed: ISIYNYFVW (TYRP1_HUMAN)
IIIYNYFVF

SEQ ID NO: 178483 - protein, 9 aa, Artificial Sequence
  Description of Artificial Sequence: Synthetic peptide
  Seed: YTYEIQWPS (TYRP1_HUMAN)
YMYEIQWPL

SEQ ID NO: 178484 - protein, 9 aa, Artificial Sequence
  Description of Artificial Sequence: Synthetic peptide
  Seed: CIFFPLLLF (TYRP1_HUMAN)
CMFFPLLLF

SEQ ID NO: 178485 - protein, 9 aa, Artificial Sequence
  Description of Artificial Sequence: Synthetic peptide
  Seed: HEGPAFLTW (TYRP1_HUMAN)
HDGPAFLTL

SEQ ID NO: 178486 - protein, 9 aa, Artificial Sequence
  Description of Artificial Sequence: Synthetic peptide
  Seed: AVVGALLLV (TYRP1_HUMAN)
AAVGALLLY

SEQ ID NO: 178487 - protein, 9 aa, Artificial Sequence
  Description of Artificial Sequence: Synthetic peptide
  Seed: LQNPNQSVV (TYRP1_HUMAN)
LINPNQSVF

SEQ ID NO: 178488 - protein, 9 aa, Artificial Sequence
  Description of Artificial Sequence: Synthetic peptide
  Seed: VCDICTDDL (TYRP1_HUMAN)
VTDICTDDL

SEQ ID NO: 178489 - protein, 10 aa, Artificial Sequence
  Description of Artificial Sequence: Synthetic peptide
  Seed: RRNPAGNVAR (TYRP1_HUMAN)
RRNPAGNVAM

SEQ ID NO: 178490 - protein, 9 aa, Artificial Sequence
  Description of Artificial Sequence: Synthetic peptide
  Seed: ISIYNYFVW (TYRP1_HUMAN)
IKIYNYFVY

SEQ ID NO: 178491 - protein, 9 aa, Artificial Sequence
  Description of Artificial Sequence: Synthetic peptide
  Seed: AVVGALLLV (TYRP1_HUMAN)
AMVGALLLT

SEQ ID NO: 178492 - protein, 10 aa, Artificial Sequence
  Description of Artificial Sequence: Synthetic peptide
  Seed: MVPFWPPVTN (TYRP1_HUMAN)
MYPFWPPVTL

SEQ ID NO: 178493 - protein, 10 aa, Artificial Sequence
  Description of Artificial Sequence: Synthetic peptide
  Seed: ADSRPHSPQY (TYRP1_HUMAN)
AESRPHSPQY

SEQ ID NO: 178494 - protein, 10 aa, Artificial Sequence
  Description of Artificial Sequence: Synthetic peptide
  Seed: HLSPNDPIFV (TYRP1_HUMAN)
HLSPNDPIFW

SEQ ID NO: 178495 - protein, 9 aa, Artificial Sequence
  Description of Artificial Sequence: Synthetic peptide
  Seed: ACDQRVLIV (TYRP1_HUMAN)
AYDQRVLIL

SEQ ID NO: 178496 - protein, 9 aa, Artificial Sequence
  Description of Artificial Sequence: Synthetic peptide
  Seed: FSHEGPAFL (TYRP1_HUMAN)
FFHEGPAFM

SEQ ID NO: 178497 - protein, 9 aa, Artificial Sequence
  Description of Artificial Sequence: Synthetic peptide
  Seed: NADISTFPL (TYRP1_HUMAN)
NWDISTFPM

SEQ ID NO: 178498 - protein, 11 aa, Artificial Sequence
  Description of Artificial Sequence: Synthetic peptide
  Seed: RRYNADISTFP (TYRP1_HUMAN)
RWYNADISTFN

SEQ ID NO: 178499 - protein, 10 aa, Artificial Sequence
  Description of Artificial Sequence: Synthetic peptide
  Seed: FVTAPDNLGY (TYRP1_HUMAN)
FTTAPDNLGK

SEQ ID NO: 178500 - protein, 10 aa, Artificial Sequence
  Description of Artificial Sequence: Synthetic peptide
  Seed: YNADISTFPL (TYRP1_HUMAN)
YEADISTFPL

SEQ ID NO: 178501 - protein, 9 aa, Artificial Sequence
  Description of Artificial Sequence: Synthetic peptide
  Seed: LIFGTASYL (TYRP1_HUMAN)
LTFGTASYW

SEQ ID NO: 178502 - protein, 9 aa, Artificial Sequence
  Description of Artificial Sequence: Synthetic peptide
  Seed: SLGCIFFPL (TYRP1_HUMAN)
SLGCIFFPA

SEQ ID NO: 178503 - protein, 11 aa, Artificial Sequence
  Description of Artificial Sequence: Synthetic peptide
  Seed: VALIFGTASYL (TYRP1_HUMAN)
VMLIFGTASYL

SEQ ID NO: 178504 - protein, 9 aa, Artificial Sequence
  Description of Artificial Sequence: Synthetic peptide
  Seed: VFDEWLRRY (TYRP1_HUMAN)
VYDEWLRRL

SEQ ID NO: 178505 - protein, 9 aa, Artificial Sequence
  Description of Artificial Sequence: Synthetic peptide
  Seed: NMVPFWPPV (TYRP1_HUMAN)
NAVPFWPPY

SEQ ID NO: 178506 - protein, 10 aa, Artificial Sequence
  Description of Artificial Sequence: Synthetic peptide
  Seed: WPPVTNTEMF (TYRP1_HUMAN)
WDPVTNTEMY

SEQ ID NO: 178507 - protein, 9 aa, Artificial Sequence
  Description of Artificial Sequence: Synthetic peptide
  Seed: QWPSREFSV (TYRP1_HUMAN)
QWPSREFSF

SEQ ID NO: 178508 - protein, 10 aa, Artificial Sequence
  Description of Artificial Sequence: Synthetic peptide
  Seed: LGPDGNTPQF (TYRP1_HUMAN)
LLPDGNTPQI

SEQ ID NO: 178509 - protein, 10 aa, Artificial Sequence
  Description of Artificial Sequence: Synthetic peptide
  Seed: EGYSDPTGKY (TYRP1_HUMAN)
EAYSDPTGKK

SEQ ID NO: 178510 - protein, 9 aa, Artificial Sequence
  Description of Artificial Sequence: Synthetic peptide
  Seed: RGRCEAVTA (TYRP1_HUMAN)
RMRCEAVTI

SEQ ID NO: 178511 - protein, 10 aa, Artificial Sequence
  Description of Artificial Sequence: Synthetic peptide
  Seed: EGYSDPTGKY (TYRP1_HUMAN)
ETYSDPTGKR

SEQ ID NO: 178512 - protein, 9 aa, Artificial Sequence
  Description of Artificial Sequence: Synthetic peptide
  Seed: MSAPKLLSL (TYRP1_HUMAN)
MKAPKLLSI

SEQ ID NO: 178513 - protein, 9 aa, Artificial Sequence
  Description of Artificial Sequence: Synthetic peptide
  Seed: NYFVWTHYY (TYRP1_HUMAN)
NMFVWTHYL

SEQ ID NO: 178514 - protein, 9 aa, Artificial Sequence
  Description of Artificial Sequence: Synthetic peptide
  Seed: PNDPIFVLL (TYRP1_HUMAN)
PLDPIFVLM

SEQ ID NO: 178515 - protein, 9 aa, Artificial Sequence
  Description of Artificial Sequence: Synthetic peptide
  Seed: MSAPKLLSL (TYRP1_HUMAN)
MLAPKLLSA

SEQ ID NO: 178516 - protein, 9 aa, Artificial Sequence
  Description of Artificial Sequence: Synthetic peptide
  Seed: ISIYNYFVW (TYRP1_HUMAN)
IQIYNYFVV

SEQ ID NO: 178517 - protein, 10 aa, Artificial Sequence
  Description of Artificial Sequence: Synthetic peptide
  Seed: STFPLENAPI (TYRP1_HUMAN)
SVFPLENAPW

SEQ ID NO: 178518 - protein, 9 aa, Artificial Sequence
  Description of Artificial Sequence: Synthetic peptide
  Seed: GPDGNTPQF (TYRP1_HUMAN)
GIDGNTPQF

SEQ ID NO: 178519 - protein, 10 aa, Artificial Sequence
  Description of Artificial Sequence: Synthetic peptide
  Seed: FSLPYWNFAT (TYRP1_HUMAN)
FWLPYWNFAL

SEQ ID NO: 178520 - protein, 9 aa, Artificial Sequence
  Description of Artificial Sequence: Synthetic peptide
  Seed: KLLSLGCIF (TYRP1_HUMAN)
KTLSLGCIW

SEQ ID NO: 178521 - protein, 10 aa, Artificial Sequence
  Description of Artificial Sequence: Synthetic peptide
  Seed: NYFVWTHYYS (TYRP1_HUMAN)
NYFVWTHYYY

SEQ ID NO: 178522 - protein, 11 aa, Artificial Sequence
  Description of Artificial Sequence: Synthetic peptide
  Seed: YTYEIQWPSRE (TYRP1_HUMAN)
YAYEIQWPSRK

SEQ ID NO: 178523 - protein, 10 aa, Artificial Sequence
  Description of Artificial Sequence: Synthetic peptide
  Seed: GLFDTPPFYS (TYRP1_HUMAN)
GLFDTPPFYI

SEQ ID NO: 178524 - protein, 10 aa, Artificial Sequence
  Description of Artificial Sequence: Synthetic peptide
  Seed: YFVWTHYYSV (TYRP1_HUMAN)
YYVWTHYYSF

SEQ ID NO: 178525 - protein, 10 aa, Artificial Sequence
  Description of Artificial Sequence: Synthetic peptide
  Seed: LSPNDPIFVL (TYRP1_HUMAN)
LHPNDPIFVF

SEQ ID NO: 178526 - protein, 9 aa, Artificial Sequence
  Description of Artificial Sequence: Synthetic peptide
  Seed: GTASYLIRA (TYRP1_HUMAN)
GMASYLIRC

SEQ ID NO: 178527 - protein, 9 aa, Artificial Sequence
  Description of Artificial Sequence: Synthetic peptide
  Seed: NMVPFWPPV (TYRP1_HUMAN)
NLVPFWPPF

SEQ ID NO: 178528 - protein, 10 aa, Artificial Sequence
  Description of Artificial Sequence: Synthetic peptide
  Seed: YNMVPFWPPV (TYRP1_HUMAN)
YCMVPFWPPI

SEQ ID NO: 178529 - protein, 9 aa, Artificial Sequence
  Description of Artificial Sequence: Synthetic peptide
  Seed: SPNDPIFVL (TYRP1_HUMAN)
SSNDPIFVL

SEQ ID NO: 178530 - protein, 9 aa, Artificial Sequence
  Description of Artificial Sequence: Synthetic peptide
  Seed: RYHLLRLEK (TYRP1_HUMAN)
RIHLLRLEI

SEQ ID NO: 178531 - protein, 9 aa, Artificial Sequence
  Description of Artificial Sequence: Synthetic peptide
  Seed: FLGVGQESF (TYRP1_HUMAN)
FLGVGQESY

SEQ ID NO: 178532 - protein, 10 aa, Artificial Sequence
  Description of Artificial Sequence: Synthetic peptide
  Seed: FWPPVTNTEM (TYRP1_HUMAN)
FFPPVTNTEW

SEQ ID NO: 178533 - protein, 11 aa, Artificial Sequence
  Description of Artificial Sequence: Synthetic peptide
  Seed: MFVTAPDNLGY (TYRP1_HUMAN)
MGVTAPDNLGW

SEQ ID NO: 178534 - protein, 11 aa, Artificial Sequence
  Description of Artificial Sequence: Synthetic peptide
  Seed: VTAPDNLGYTY (TYRP1_HUMAN)
VIAPDNLGYTY

SEQ ID NO: 178535 - protein, 9 aa, Artificial Sequence
  Description of Artificial Sequence: Synthetic peptide
  Seed: ALIFGTASY (TYRP1_HUMAN)
AHIFGTASY

SEQ ID NO: 178536 - protein, 11 aa, Artificial Sequence
  Description of Artificial Sequence: Synthetic peptide
  Seed: YSDPTGKYDPA (TYRP1_HUMAN)
YIDPTGKYDPL

SEQ ID NO: 178537 - protein, 11 aa, Artificial Sequence
  Description of Artificial Sequence: Synthetic peptide
  Seed: YNMVPFWPPVT (TYRP1_HUMAN)
YQMVPFWPPVD

SEQ ID NO: 178538 - protein, 10 aa, Artificial Sequence
  Description of Artificial Sequence: Synthetic peptide
  Seed: LGPDGNTPQF (TYRP1_HUMAN)
LTPDGNTPQY

SEQ ID NO: 178539 - protein, 11 aa, Artificial Sequence
  Description of Artificial Sequence: Synthetic peptide
  Seed: MLQEPSFSLPY (TYRP1_HUMAN)
MVQEPSFSLPY

SEQ ID NO: 178540 - protein, 9 aa, Artificial Sequence
  Description of Artificial Sequence: Synthetic peptide
  Seed: LQNPNQSVV (TYRP1_HUMAN)
LYNPNQSVM

SEQ ID NO: 178541 - protein, 10 aa, Artificial Sequence
  Description of Artificial Sequence: Synthetic peptide
  Seed: RSLHNLAHLF (TYRP1_HUMAN)
RCLHNLAHLY

SEQ ID NO: 178542 - protein, 10 aa, Artificial Sequence
  Description of Artificial Sequence: Synthetic peptide
  Seed: ADSRPHSPQY (TYRP1_HUMAN)
AMSRPHSPQY

SEQ ID NO: 178543 - protein, 8 aa, Artificial Sequence
  Description of Artificial Sequence: Synthetic peptide
  Seed: YNADISTF (TYRP1_HUMAN)
YAADISTY

SEQ ID NO: 178544 - protein, 11 aa, Artificial Sequence
  Description of Artificial Sequence: Synthetic peptide
  Seed: LISPNSVFSQW (TYRP1_HUMAN)
LMSPNSVFSQW

SEQ ID NO: 178545 - protein, 9 aa, Artificial Sequence
  Description of Artificial Sequence: Synthetic peptide
  Seed: SVKKTFLGV (TYRP1_HUMAN)
SLKKTFLGA

SEQ ID NO: 178546 - protein, 9 aa, Artificial Sequence
  Description of Artificial Sequence: Synthetic peptide
  Seed: AVVGALLLV (TYRP1_HUMAN)
ATVGALLLK

SEQ ID NO: 178547 - protein, 10 aa, Artificial Sequence
  Description of Artificial Sequence: Synthetic peptide
  Seed: EIIAIAVVGA (TYRP1_HUMAN)
EGIAIAVVGV

SEQ ID NO: 178548 - protein, 9 aa, Artificial Sequence
  Description of Artificial Sequence: Synthetic peptide
  Seed: YLIRARRSM (TYRP1_HUMAN)
YQIRARRSH

SEQ ID NO: 178549 - protein, 10 aa, Artificial Sequence
  Description of Artificial Sequence: Synthetic peptide
  Seed: ENISIYNYFV (TYRP1_HUMAN)
EMISIYNYFA

SEQ ID NO: 178550 - protein, 9 aa, Artificial Sequence
  Description of Artificial Sequence: Synthetic peptide
  Seed: APIGHNRQY (TYRP1_HUMAN)
ALIGHNRQF

SEQ ID NO: 178551 - protein, 10 aa, Artificial Sequence
  Description of Artificial Sequence: Synthetic peptide
  Seed: LLHTFTDAVF (TYRP1_HUMAN)
LQHTFTDAVW

SEQ ID NO: 178552 - protein, 9 aa, Artificial Sequence
  Description of Artificial Sequence: Synthetic peptide
  Seed: HYYSVKKTF (TYRP1_HUMAN)
HEYSVKKTY

SEQ ID NO: 178553 - protein, 9 aa, Artificial Sequence
  Description of Artificial Sequence: Synthetic peptide
  Seed: IAVVGALLL (TYRP1_HUMAN)
IKVVGALLF

SEQ ID NO: 178554 - protein, 8 aa, Artificial Sequence
  Description of Artificial Sequence: Synthetic peptide
  Seed: IQWPSREF (TYRP1_HUMAN)
ISWPSREM

SEQ ID NO: 178555 - protein, 9 aa, Artificial Sequence
  Description of Artificial Sequence: Synthetic peptide
  Seed: IAIAVVGAL (TYRP1_HUMAN)
ITIAVVGAK

SEQ ID NO: 178556 - protein, 11 aa, Artificial Sequence
  Description of Artificial Sequence: Synthetic peptide
  Seed: FLNGTGGQTHL (TYRP1_HUMAN)
FMNGTGGQTHV

SEQ ID NO: 178557 - protein, 11 aa, Artificial Sequence
  Description of Artificial Sequence: Synthetic peptide
  Seed: LRRYNADISTF (TYRP1_HUMAN)
LSRYNADISTF

SEQ ID NO: 178558 - protein, 11 aa, Artificial Sequence
  Description of Artificial Sequence: Synthetic peptide
  Seed: REFSVPEIIAI (TYRP1_HUMAN)
RAFSVPEIIAF

SEQ ID NO: 178559 - protein, 11 aa, Artificial Sequence
  Description of Artificial Sequence: Synthetic peptide
  Seed: YSDPTGKYDPA (TYRP1_HUMAN)
YIDPTGKYDPF

SEQ ID NO: 178560 - protein, 9 aa, Artificial Sequence
  Description of Artificial Sequence: Synthetic peptide
  Seed: MLQEPSFSL (TYRP1_HUMAN)
MQQEPSFSH

SEQ ID NO: 178561 - protein, 9 aa, Artificial Sequence
  Description of Artificial Sequence: Synthetic peptide
  Seed: GLFDTPPFY (TYRP1_HUMAN)
GMFDTPPFY

SEQ ID NO: 178562 - protein, 9 aa, Artificial Sequence
  Description of Artificial Sequence: Synthetic peptide
  Seed: RQCATVEAL (TYRP1_HUMAN)
RQCATVEAW

SEQ ID NO: 178563 - protein, 9 aa, Artificial Sequence
  Description of Artificial Sequence: Synthetic peptide
  Seed: REFSVPEII (TYRP1_HUMAN)
REFSVPEIM

SEQ ID NO: 178564 - protein, 9 aa, Artificial Sequence
  Description of Artificial Sequence: Synthetic peptide
  Seed: MFVTAPDNL (TYRP1_HUMAN)
MYVTAPDNF

SEQ ID NO: 178565 - protein, 9 aa, Artificial Sequence
  Description of Artificial Sequence: Synthetic peptide
  Seed: GLFDTPPFY (TYRP1_HUMAN)
GVFDTPPFI

SEQ ID NO: 178566 - protein, 9 aa, Artificial Sequence
  Description of Artificial Sequence: Synthetic peptide
  Seed: REFSVPEII (TYRP1_HUMAN)
RMFSVPEIL

SEQ ID NO: 178567 - protein, 9 aa, Artificial Sequence
  Description of Artificial Sequence: Synthetic peptide
  Seed: RTCHCNGNF (TYRP1_HUMAN)
RSCHCNGNY

SEQ ID NO: 178568 - protein, 10 aa, Artificial Sequence
  Description of Artificial Sequence: Synthetic peptide
  Seed: FSLPYWNFAT (TYRP1_HUMAN)
FLLPYWNFAV

SEQ ID NO: 178569 - protein, 9 aa, Artificial Sequence
  Description of Artificial Sequence: Synthetic peptide
  Seed: LFQQARAQF (TYRP1_HUMAN)
LYQQARAQV

SEQ ID NO: 178570 - protein, 11 aa, Artificial Sequence
  Description of Artificial Sequence: Synthetic peptide
  Seed: IYNYFVWTHYY (TYRP1_HUMAN)
IWNYFVWTHYY

SEQ ID NO: 178571 - protein, 9 aa, Artificial Sequence
  Description of Artificial Sequence: Synthetic peptide
  Seed: SMDEANQPL (TYRP1_HUMAN)
SYDEANQPM

SEQ ID NO: 178572 - protein, 9 aa, Artificial Sequence
  Description of Artificial Sequence: Synthetic peptide
  Seed: GPDGNTPQF (TYRP1_HUMAN)
GLDGNTPQF

SEQ ID NO: 178573 - protein, 9 aa, Artificial Sequence
  Description of Artificial Sequence: Synthetic peptide
  Seed: FLNGTGGQT (TYRP1_HUMAN)
FINGTGGQL

SEQ ID NO: 178574 - protein, 9 aa, Artificial Sequence
  Description of Artificial Sequence: Synthetic peptide
  Seed: VARPMVQRL (TYRP1_HUMAN)
VRRPMVQRF

SEQ ID NO: 178575 - protein, 9 aa, Artificial Sequence
  Description of Artificial Sequence: Synthetic peptide
  Seed: MSAPKLLSL (TYRP1_HUMAN)
MTAPKLLSH

SEQ ID NO: 178576 - protein, 8 aa, Artificial Sequence
  Description of Artificial Sequence: Synthetic peptide
  Seed: YSDPTGKY (TYRP1_HUMAN)
YYDPTGKL

SEQ ID NO: 178577 - protein, 11 aa, Artificial Sequence
  Description of Artificial Sequence: Synthetic peptide
  Seed: FSHEGPAFLTW (TYRP1_HUMAN)
FAHEGPAFLTW

SEQ ID NO: 178578 - protein, 9 aa, Artificial Sequence
  Description of Artificial Sequence: Synthetic peptide
  Seed: GPDGNTPQF (TYRP1_HUMAN)
GSDGNTPQF

SEQ ID NO: 178579 - protein, 11 aa, Artificial Sequence
  Description of Artificial Sequence: Synthetic peptide
  Seed: KTFLGVGQESF (TYRP1_HUMAN)
KLFLGVGQESL

SEQ ID NO: 178580 - protein, 10 aa, Artificial Sequence
  Description of Artificial Sequence: Synthetic peptide
  Seed: GNVARPMVQR (TYRP1_HUMAN)
GHVARPMVQK

SEQ ID NO: 178581 - protein, 9 aa, Artificial Sequence
  Description of Artificial Sequence: Synthetic peptide
  Seed: KLLSLGCIF (TYRP1_HUMAN)
KNLSLGCIF

SEQ ID NO: 178582 - protein, 9 aa, Artificial Sequence
  Description of Artificial Sequence: Synthetic peptide
  Seed: LEKDMQEML (TYRP1_HUMAN)
LEKDMQEMI

SEQ ID NO: 178583 - protein, 9 aa, Artificial Sequence
  Description of Artificial Sequence: Synthetic peptide
  Seed: FVRALDMAK (TYRP1_HUMAN)
FYRALDMAR

SEQ ID NO: 178584 - protein, 9 aa, Artificial Sequence
  Description of Artificial Sequence: Synthetic peptide
  Seed: SLPYWNFAT (TYRP1_HUMAN)
SLPYWNFAC

SEQ ID NO: 178585 - protein, 8 aa, Artificial Sequence
  Description of Artificial Sequence: Synthetic peptide
  Seed: RPGWRGAA (TYRP1_HUMAN)
RPGWRGAV

SEQ ID NO: 178586 - protein, 10 aa, Artificial Sequence
  Description of Artificial Sequence: Synthetic peptide
  Seed: LENAPIGHNR (TYRP1_HUMAN)
LANAPIGHNR

SEQ ID NO: 178587 - protein, 9 aa, Artificial Sequence
  Description of Artificial Sequence: Synthetic peptide
  Seed: RQYNMVPFW (TYRP1_HUMAN)
RRYNMVPFQ

SEQ ID NO: 178588 - protein, 9 aa, Artificial Sequence
  Description of Artificial Sequence: Synthetic peptide
  Seed: RRNLLDLSK (TYRP1_HUMAN)
RRNLLDLSV

SEQ ID NO: 178589 - protein, 10 aa, Artificial Sequence
  Description of Artificial Sequence: Synthetic peptide
  Seed: RTTHPLFVIA (TYRP1_HUMAN)
RMTHPLFVIA

SEQ ID NO: 178590 - protein, 9 aa, Artificial Sequence
  Description of Artificial Sequence: Synthetic peptide
  Seed: FSHEGPAFL (TYRP1_HUMAN)
FAHEGPAFW

SEQ ID NO: 178591 - protein, 9 aa, Artificial Sequence
  Description of Artificial Sequence: Synthetic peptide
  Seed: LQNPNQSVV (TYRP1_HUMAN)
LHNPNQSVL

SEQ ID NO: 178592 - protein, 9 aa, Artificial Sequence
  Description of Artificial Sequence: Synthetic peptide
  Seed: RYHLLRLEK (TYRP1_HUMAN)
RSHLLRLEM

SEQ ID NO: 178593 - protein, 9 aa, Artificial Sequence
  Description of Artificial Sequence: Synthetic peptide
  Seed: SGRGRCEAV (TYRP1_HUMAN)
SVRGRCEAL

SEQ ID NO: 178594 - protein, 9 aa, Artificial Sequence
  Description of Artificial Sequence: Synthetic peptide
  Seed: RVLIVRRNL (TYRP1_HUMAN)
RTLIVRRNW

SEQ ID NO: 178595 - protein, 9 aa, Artificial Sequence
  Description of Artificial Sequence: Synthetic peptide
  Seed: RQCATVEAL (TYRP1_HUMAN)
RMCATVEAL

SEQ ID NO: 178596 - protein, 10 aa, Artificial Sequence
  Description of Artificial Sequence: Synthetic peptide
  Seed: STFPLENAPI (TYRP1_HUMAN)
SMFPLENAPV

SEQ ID NO: 178597 - protein, 10 aa, Artificial Sequence
  Description of Artificial Sequence: Synthetic peptide
  Seed: SVKKTFLGVG (TYRP1_HUMAN)
STKKTFLGVA

SEQ ID NO: 178598 - protein, 9 aa, Artificial Sequence
  Description of Artificial Sequence: Synthetic peptide
  Seed: AQFPRQCAT (TYRP1_HUMAN)
AEFPRQCAV

SEQ ID NO: 178599 - protein, 9 aa, Artificial Sequence
  Description of Artificial Sequence: Synthetic peptide
  Seed: PNDPIFVLL (TYRP1_HUMAN)
PIDPIFVLM

SEQ ID NO: 178600 - protein, 10 aa, Artificial Sequence
  Description of Artificial Sequence: Synthetic peptide
  Seed: LPYWNFATGK (TYRP1_HUMAN)
LHYWNFATGR

SEQ ID NO: 178601 - protein, 9 aa, Artificial Sequence
  Description of Artificial Sequence: Synthetic peptide
  Seed: SMDEANQPL (TYRP1_HUMAN)
SPDEANQPL

SEQ ID NO: 178602 - protein, 9 aa, Artificial Sequence
  Description of Artificial Sequence: Synthetic peptide
  Seed: HLSPNDPIF (TYRP1_HUMAN)
HTSPNDPIY

SEQ ID NO: 178603 - protein, 10 aa, Artificial Sequence
  Description of Artificial Sequence: Synthetic peptide
  Seed: FWPPVTNTEM (TYRP1_HUMAN)
FAPPVTNTEV

SEQ ID NO: 178604 - protein, 10 aa, Artificial Sequence
  Description of Artificial Sequence: Synthetic peptide
  Seed: SPVSGPGTDR (TYRP1_HUMAN)
SIVSGPGTDR

SEQ ID NO: 178605 - protein, 10 aa, Artificial Sequence
  Description of Artificial Sequence: Synthetic peptide
  Seed: RVLIVRRNLL (TYRP1_HUMAN)
RTLIVRRNLA

SEQ ID NO: 178606 - protein, 9 aa, Artificial Sequence
  Description of Artificial Sequence: Synthetic peptide
  Seed: LLTDQYQCY (TYRP1_HUMAN)
LQTDQYQCY

SEQ ID NO: 178607 - protein, 9 aa, Artificial Sequence
  Description of Artificial Sequence: Synthetic peptide
  Seed: RYNADISTF (TYRP1_HUMAN)
RVNADISTF

SEQ ID NO: 178608 - protein, 10 aa, Artificial Sequence
  Description of Artificial Sequence: Synthetic peptide
  Seed: LSLGCIFFPL (TYRP1_HUMAN)
LRLGCIFFPI

SEQ ID NO: 178609 - protein, 11 aa, Artificial Sequence
  Description of Artificial Sequence: Synthetic peptide
  Seed: LRRYNADISTF (TYRP1_HUMAN)
LERYNADISTF

SEQ ID NO: 178610 - protein, 10 aa, Artificial Sequence
  Description of Artificial Sequence: Synthetic peptide
  Seed: SVPEIIAIAV (TYRP1_HUMAN)
SMPEIIAIAM

SEQ ID NO: 178611 - protein, 9 aa, Artificial Sequence
  Description of Artificial Sequence: Synthetic peptide
  Seed: VGLFDTPPF (TYRP1_HUMAN)
VQLFDTPPI

SEQ ID NO: 178612 - protein, 9 aa, Artificial Sequence
  Description of Artificial Sequence: Synthetic peptide
  Seed: RQYNMVPFW (TYRP1_HUMAN)
RWYNMVPFF

SEQ ID NO: 178613 - protein, 9 aa, Artificial Sequence
  Description of Artificial Sequence: Synthetic peptide
  Seed: WPPVTNTEM (TYRP1_HUMAN)
WLPVTNTEL

SEQ ID NO: 178614 - protein, 10 aa, Artificial Sequence
  Description of Artificial Sequence: Synthetic peptide
  Seed: ALIFGTASYL (TYRP1_HUMAN)
AQIFGTASYL

SEQ ID NO: 178615 - protein, 10 aa, Artificial Sequence
  Description of Artificial Sequence: Synthetic peptide
  Seed: LPYWNFATGK (TYRP1_HUMAN)
LFYWNFATGR

SEQ ID NO: 178616 - protein, 10 aa, Artificial Sequence
  Description of Artificial Sequence: Synthetic peptide
  Seed: FLNGTGGQTH (TYRP1_HUMAN)
FINGTGGQTF

SEQ ID NO: 178617 - protein, 11 aa, Artificial Sequence
  Description of Artificial Sequence: Synthetic peptide
  Seed: FVLLHTFTDAV (TYRP1_HUMAN)
FTLLHTFTDAV

SEQ ID NO: 178618 - protein, 9 aa, Artificial Sequence
  Description of Artificial Sequence: Synthetic peptide
  Seed: RQCATVEAL (TYRP1_HUMAN)
RLCATVEAW

SEQ ID NO: 178619 - protein, 10 aa, Artificial Sequence
  Description of Artificial Sequence: Synthetic peptide
  Seed: YNMVPFWPPV (TYRP1_HUMAN)
YVMVPFWPPA

SEQ ID NO: 178620 - protein, 9 aa, Artificial Sequence
  Description of Artificial Sequence: Synthetic peptide
  Seed: HEGPAFLTW (TYRP1_HUMAN)
HRGPAFLTF

SEQ ID NO: 178621 - protein, 9 aa, Artificial Sequence
  Description of Artificial Sequence: Synthetic peptide
  Seed: TAPDNLGYT (TYRP1_HUMAN)
TAPDNLGYL

SEQ ID NO: 178622 - protein, 9 aa, Artificial Sequence
  Description of Artificial Sequence: Synthetic peptide
  Seed: QEMLQEPSF (TYRP1_HUMAN)
QQMLQEPSY

SEQ ID NO: 178623 - protein, 9 aa, Artificial Sequence
  Description of Artificial Sequence: Synthetic peptide
  Seed: ACDQRVLIV (TYRP1_HUMAN)
ATDQRVLIY

SEQ ID NO: 178624 - protein, 10 aa, Artificial Sequence
  Description of Artificial Sequence: Synthetic peptide
  Seed: LSPNDPIFVL (TYRP1_HUMAN)
LNPNDPIFVW

SEQ ID NO: 178625 - protein, 10 aa, Artificial Sequence
  Description of Artificial Sequence: Synthetic peptide
  Seed: LSLGCIFFPL (TYRP1_HUMAN)
LQLGCIFFPV

SEQ ID NO: 178626 - protein, 9 aa, Artificial Sequence
  Description of Artificial Sequence: Synthetic peptide
  Seed: NHFVRALDM (TYRP1_HUMAN)
NHFVRALDV

SEQ ID NO: 178627 - protein, 10 aa, Artificial Sequence
  Description of Artificial Sequence: Synthetic peptide
  Seed: ADSRPHSPQY (TYRP1_HUMAN)
ACSRPHSPQA

SEQ ID NO: 178628 - protein, 9 aa, Artificial Sequence
  Description of Artificial Sequence: Synthetic peptide
  Seed: RQCATVEAL (TYRP1_HUMAN)
RECATVEAM

SEQ ID NO: 178629 - protein, 9 aa, Artificial Sequence
  Description of Artificial Sequence: Synthetic peptide
  Seed: LIFGTASYL (TYRP1_HUMAN)
LFFGTASYY

SEQ ID NO: 178630 - protein, 9 aa, Artificial Sequence
  Description of Artificial Sequence: Synthetic peptide
  Seed: AIAVVGALL (TYRP1_HUMAN)
ALAVVGALM

SEQ ID NO: 178631 - protein, 9 aa, Artificial Sequence
  Description of Artificial Sequence: Synthetic peptide
  Seed: YTYEIQWPS (TYRP1_HUMAN)
YTYEIQWPV

SEQ ID NO: 178632 - protein, 9 aa, Artificial Sequence
  Description of Artificial Sequence: Synthetic peptide
  Seed: FYSNSTNSF (TYRP1_HUMAN)
FPSNSTNSY

SEQ ID NO: 178633 - protein, 11 aa, Artificial Sequence
  Description of Artificial Sequence: Synthetic peptide
  Seed: FLTWHRYHLLR (TYRP1_HUMAN)
FMTWHRYHLLV

SEQ ID NO: 178634 - protein, 9 aa, Artificial Sequence
  Description of Artificial Sequence: Synthetic peptide
  Seed: ALIFGTASY (TYRP1_HUMAN)
AQIFGTASA

SEQ ID NO: 178635 - protein, 9 aa, Artificial Sequence
  Description of Artificial Sequence: Synthetic peptide
  Seed: CIFFPLLLF (TYRP1_HUMAN)
CMFFPLLLY

SEQ ID NO: 178636 - protein, 11 aa, Artificial Sequence
  Description of Artificial Sequence: Synthetic peptide
  Seed: QEMLQEPSFSL (TYRP1_HUMAN)
QYMLQEPSFSL

SEQ ID NO: 178637 - protein, 9 aa, Artificial Sequence
  Description of Artificial Sequence: Synthetic peptide
  Seed: VTAPDNLGY (TYRP1_HUMAN)
VMAPDNLGY

SEQ ID NO: 178638 - protein, 11 aa, Artificial Sequence
  Description of Artificial Sequence: Synthetic peptide
  Seed: YNYFVWTHYYS (TYRP1_HUMAN)
YCYFVWTHYYY

SEQ ID NO: 178639 - protein, 9 aa, Artificial Sequence
  Description of Artificial Sequence: Synthetic peptide
  Seed: SPNDPIFVL (TYRP1_HUMAN)
SPNDPIFVP

SEQ ID NO: 178640 - protein, 10 aa, Artificial Sequence
  Description of Artificial Sequence: Synthetic peptide
  Seed: TAPDNLGYTY (TYRP1_HUMAN)
TMPDNLGYTW

SEQ ID NO: 178641 - protein, 11 aa, Artificial Sequence
  Description of Artificial Sequence: Synthetic peptide
  Seed: FVLLHTFTDAV (TYRP1_HUMAN)
FLLLHTFTDAL

SEQ ID NO: 178642 - protein, 10 aa, Artificial Sequence
  Description of Artificial Sequence: Synthetic peptide
  Seed: YNYFVWTHYY (TYRP1_HUMAN)
YQYFVWTHYH

SEQ ID NO: 178643 - protein, 9 aa, Artificial Sequence
  Description of Artificial Sequence: Synthetic peptide
  Seed: MCCPDLSPV (TYRP1_HUMAN)
MACPDLSPV

SEQ ID NO: 178644 - protein, 10 aa, Artificial Sequence
  Description of Artificial Sequence: Synthetic peptide
  Seed: YNADISTFPL (TYRP1_HUMAN)
YHADISTFPM

SEQ ID NO: 178645 - protein, 10 aa, Artificial Sequence
  Description of Artificial Sequence: Synthetic peptide
  Seed: LLHTFTDAVF (TYRP1_HUMAN)
LTHTFTDAVF

SEQ ID NO: 178646 - protein, 10 aa, Artificial Sequence
  Description of Artificial Sequence: Synthetic peptide
  Seed: LTWHRYHLLR (TYRP1_HUMAN)
LWWHRYHLLR

SEQ ID NO: 178647 - protein, 9 aa, Artificial Sequence
  Description of Artificial Sequence: Synthetic peptide
  Seed: YNYFVWTHY (TYRP1_HUMAN)
YKYFVWTHM

SEQ ID NO: 178648 - protein, 9 aa, Artificial Sequence
  Description of Artificial Sequence: Synthetic peptide
  Seed: SIYNYFVWT (TYRP1_HUMAN)
SMYNYFVWM

SEQ ID NO: 178649 - protein, 11 aa, Artificial Sequence
  Description of Artificial Sequence: Synthetic peptide
  Seed: YNYFVWTHYYS (TYRP1_HUMAN)
YLYFVWTHYYF

SEQ ID NO: 178650 - protein, 9 aa, Artificial Sequence
  Description of Artificial Sequence: Synthetic peptide
  Seed: IAVVGALLL (TYRP1_HUMAN)
IRVVGALLY

SEQ ID NO: 178651 - protein, 10 aa, Artificial Sequence
  Description of Artificial Sequence: Synthetic peptide
  Seed: FSLPYWNFAT (TYRP1_HUMAN)
FGLPYWNFAM

SEQ ID NO: 178652 - protein, 10 aa, Artificial Sequence
  Description of Artificial Sequence: Synthetic peptide
  Seed: LLFQQARAQF (TYRP1_HUMAN)
LQFQQARAQM

SEQ ID NO: 178653 - protein, 9 aa, Artificial Sequence
  Description of Artificial Sequence: Synthetic peptide
  Seed: APIGHNRQY (TYRP1_HUMAN)
AEIGHNRQY

SEQ ID NO: 178654 - protein, 9 aa, Artificial Sequence
  Description of Artificial Sequence: Synthetic peptide
  Seed: RTTHPLFVI (TYRP1_HUMAN)
RLTHPLFVI

SEQ ID NO: 178655 - protein, 10 aa, Artificial Sequence
  Description of Artificial Sequence: Synthetic peptide
  Seed: SPNDPIFVLL (TYRP1_HUMAN)
SANDPIFVLM

SEQ ID NO: 178656 - protein, 9 aa, Artificial Sequence
  Description of Artificial Sequence: Synthetic peptide
  Seed: ALIFGTASY (TYRP1_HUMAN)
ASIFGTASI

SEQ ID NO: 178657 - protein, 9 aa, Artificial Sequence
  Description of Artificial Sequence: Synthetic peptide
  Seed: FYSNSTNSF (TYRP1_HUMAN)
FRSNSTNSM

SEQ ID NO: 178658 - protein, 9 aa, Artificial Sequence
  Description of Artificial Sequence: Synthetic peptide
  Seed: SPNSVFSQW (TYRP1_HUMAN)
SENSVFSQF

SEQ ID NO: 178659 - protein, 9 aa, Artificial Sequence
  Description of Artificial Sequence: Synthetic peptide
  Seed: STLISPNSV (TYRP1_HUMAN)
SLLISPNSI

SEQ ID NO: 178660 - protein, 9 aa, Artificial Sequence
  Description of Artificial Sequence: Synthetic peptide
  Seed: ALIFGTASY (TYRP1_HUMAN)
AGIFGTASW

SEQ ID NO: 178661 - protein, 11 aa, Artificial Sequence
  Description of Artificial Sequence: Synthetic peptide
  Seed: KTFLGVGQESF (TYRP1_HUMAN)
KVFLGVGQESW

SEQ ID NO: 178662 - protein, 9 aa, Artificial Sequence
  Description of Artificial Sequence: Synthetic peptide
  Seed: RGRCEAVTA (TYRP1_HUMAN)
RTRCEAVTA

SEQ ID NO: 178663 - protein, 9 aa, Artificial Sequence
  Description of Artificial Sequence: Synthetic peptide
  Seed: FSHEGPAFL (TYRP1_HUMAN)
FFHEGPAFV

SEQ ID NO: 178664 - protein, 9 aa, Artificial Sequence
  Description of Artificial Sequence: Synthetic peptide
  Seed: ASYLIRARR (TYRP1_HUMAN)
AVYLIRARK

SEQ ID NO: 178665 - protein, 9 aa, Artificial Sequence
  Description of Artificial Sequence: Synthetic peptide
  Seed: CTDDLMGSR (TYRP1_HUMAN)
CVDDLMGSY

SEQ ID NO: 178666 - protein, 9 aa, Artificial Sequence
  Description of Artificial Sequence: Synthetic peptide
  Seed: MDEANQPLL (TYRP1_HUMAN)
MIEANQPLL

SEQ ID NO: 178667 - protein, 9 aa, Artificial Sequence
  Description of Artificial Sequence: Synthetic peptide
  Seed: STLISPNSV (TYRP1_HUMAN)
SVLISPNSV

SEQ ID NO: 178668 - protein, 9 aa, Artificial Sequence
  Description of Artificial Sequence: Synthetic peptide
  Seed: HEGPAFLTW (TYRP1_HUMAN)
HQGPAFLTL

SEQ ID NO: 178669 - protein, 9 aa, Artificial Sequence
  Description of Artificial Sequence: Synthetic peptide
  Seed: YTYEIQWPS (TYRP1_HUMAN)
YVYEIQWPF

SEQ ID NO: 178670 - protein, 9 aa, Artificial Sequence
  Description of Artificial Sequence: Synthetic peptide
  Seed: CIFFPLLLF (TYRP1_HUMAN)
CMFFPLLLM

SEQ ID NO: 178671 - protein, 9 aa, Artificial Sequence
  Description of Artificial Sequence: Synthetic peptide
  Seed: SVFSQWRVV (TYRP1_HUMAN)
SMFSQWRVF

SEQ ID NO: 178672 - protein, 10 aa, Artificial Sequence
  Description of Artificial Sequence: Synthetic peptide
  Seed: AACDQRVLIV (TYRP1_HUMAN)
AACDQRVLIY

SEQ ID NO: 178673 - protein, 9 aa, Artificial Sequence
  Description of Artificial Sequence: Synthetic peptide
  Seed: VFDEWLRRY (TYRP1_HUMAN)
VMDEWLRRF

SEQ ID NO: 178674 - protein, 9 aa, Artificial Sequence
  Description of Artificial Sequence: Synthetic peptide
  Seed: FTDAVFDEW (TYRP1_HUMAN)
FQDAVFDEV

SEQ ID NO: 178675 - protein, 10 aa, Artificial Sequence
  Description of Artificial Sequence: Synthetic peptide
  Seed: NPAGNVARPM (TYRP1_HUMAN)
NPAGNVARPA

SEQ ID NO: 178676 - protein, 10 aa, Artificial Sequence
  Description of Artificial Sequence: Synthetic peptide
  Seed: YNYFVWTHYY (TYRP1_HUMAN)
YQYFVWTHYL

SEQ ID NO: 178677 - protein, 10 aa, Artificial Sequence
  Description of Artificial Sequence: Synthetic peptide
  Seed: IQWPSREFSV (TYRP1_HUMAN)
IMWPSREFSL

SEQ ID NO: 178678 - protein, 10 aa, Artificial Sequence
  Description of Artificial Sequence: Synthetic peptide
  Seed: ALIFGTASYL (TYRP1_HUMAN)
AEIFGTASYY

SEQ ID NO: 178679 - protein, 9 aa, Artificial Sequence
  Description of Artificial Sequence: Synthetic peptide
  Seed: LLVALIFGT (TYRP1_HUMAN)
LIVALIFGL

SEQ ID NO: 178680 - protein, 10 aa, Artificial Sequence
  Description of Artificial Sequence: Synthetic peptide
  Seed: FWPPVTNTEM (TYRP1_HUMAN)
FAPPVTNTEH

SEQ ID NO: 178681 - protein, 10 aa, Artificial Sequence
  Description of Artificial Sequence: Synthetic peptide
  Seed: RSMDEANQPL (TYRP1_HUMAN)
RCMDEANQPW

SEQ ID NO: 178682 - protein, 9 aa, Artificial Sequence
  Description of Artificial Sequence: Synthetic peptide
  Seed: FSVPEIIAI (TYRP1_HUMAN)
FQVPEIIAW

SEQ ID NO: 178683 - protein, 9 aa, Artificial Sequence
  Description of Artificial Sequence: Synthetic peptide
  Seed: MAKRTTHPL (TYRP1_HUMAN)
MHKRTTHPL

SEQ ID NO: 178684 - protein, 10 aa, Artificial Sequence
  Description of Artificial Sequence: Synthetic peptide
  Seed: YSNSTNSFRN (TYRP1_HUMAN)
YLNSTNSFRR

SEQ ID NO: 178685 - protein, 10 aa, Artificial Sequence
  Description of Artificial Sequence: Synthetic peptide
  Seed: KLLSLGCIFF (TYRP1_HUMAN)
KYLSLGCIFY

SEQ ID NO: 178686 - protein, 10 aa, Artificial Sequence
  Description of Artificial Sequence: Synthetic peptide
  Seed: MSAPKLLSLG (TYRP1_HUMAN)
MYAPKLLSLW

SEQ ID NO: 178687 - protein, 11 aa, Artificial Sequence
  Description of Artificial Sequence: Synthetic peptide
  Seed: QYNMVPFWPPV (TYRP1_HUMAN)
QYNMVPFWPPF

SEQ ID NO: 178688 - protein, 9 aa, Artificial Sequence
  Description of Artificial Sequence: Synthetic peptide
  Seed: LVALIFGTA (TYRP1_HUMAN)
LPALIFGTL

SEQ ID NO: 178689 - protein, 8 aa, Artificial Sequence
  Description of Artificial Sequence: Synthetic peptide
  Seed: YSNSTNSF (TYRP1_HUMAN)
YFNSTNSI

SEQ ID NO: 178690 - protein, 10 aa, Artificial Sequence
  Description of Artificial Sequence: Synthetic peptide
  Seed: EIIAIAVVGA (TYRP1_HUMAN)
ERIAIAVVGV

SEQ ID NO: 178691 - protein, 9 aa, Artificial Sequence
  Description of Artificial Sequence: Synthetic peptide
  Seed: SPNSVFSQW (TYRP1_HUMAN)
SANSVFSQF

SEQ ID NO: 178692 - protein, 11 aa, Artificial Sequence
  Description of Artificial Sequence: Synthetic peptide
  Seed: IYNYFVWTHYY (TYRP1_HUMAN)
IQNYFVWTHYL

SEQ ID NO: 178693 - protein, 10 aa, Artificial Sequence
  Description of Artificial Sequence: Synthetic peptide
  Seed: PFYSNSTNSF (TYRP1_HUMAN)
PYYSNSTNSM

SEQ ID NO: 178694 - protein, 9 aa, Artificial Sequence
  Description of Artificial Sequence: Synthetic peptide
  Seed: SVPEIIAIA (TYRP1_HUMAN)
SLPEIIAIT

SEQ ID NO: 178695 - protein, 9 aa, Artificial Sequence
  Description of Artificial Sequence: Synthetic peptide
  Seed: MSAPKLLSL (TYRP1_HUMAN)
MPAPKLLSI

SEQ ID NO: 178696 - protein, 9 aa, Artificial Sequence
  Description of Artificial Sequence: Synthetic peptide
  Seed: YTYEIQWPS (TYRP1_HUMAN)
YEYEIQWPL

SEQ ID NO: 178697 - protein, 10 aa, Artificial Sequence
  Description of Artificial Sequence: Synthetic peptide
  Seed: RTTHPLFVIA (TYRP1_HUMAN)
RMTHPLFVIK

SEQ ID NO: 178698 - protein, 11 aa, Artificial Sequence
  Description of Artificial Sequence: Synthetic peptide
  Seed: YNYFVWTHYYS (TYRP1_HUMAN)
YFYFVWTHYYV

SEQ ID NO: 178699 - protein, 10 aa, Artificial Sequence
  Description of Artificial Sequence: Synthetic peptide
  Seed: FVTAPDNLGY (TYRP1_HUMAN)
FETAPDNLGF

SEQ ID NO: 178700 - protein, 9 aa, Artificial Sequence
  Description of Artificial Sequence: Synthetic peptide
  Seed: REFSVPEII (TYRP1_HUMAN)
RIFSVPEIV

SEQ ID NO: 178701 - protein, 9 aa, Artificial Sequence
  Description of Artificial Sequence: Synthetic peptide
  Seed: TPQFENISI (TYRP1_HUMAN)
TPQFENISF

SEQ ID NO: 178702 - protein, 10 aa, Artificial Sequence
  Description of Artificial Sequence: Synthetic peptide
  Seed: GKYDPAVRSL (TYRP1_HUMAN)
GHYDPAVRSY

SEQ ID NO: 178703 - protein, 9 aa, Artificial Sequence
  Description of Artificial Sequence: Synthetic peptide
  Seed: RARRSMDEA (TYRP1_HUMAN)
RMRRSMDEI

SEQ ID NO: 178704 - protein, 9 aa, Artificial Sequence
  Description of Artificial Sequence: Synthetic peptide
  Seed: RSLHNLAHL (TYRP1_HUMAN)
RRLHNLAHL

SEQ ID NO: 178705 - protein, 9 aa, Artificial Sequence
  Description of Artificial Sequence: Synthetic peptide
  Seed: APIGHNRQY (TYRP1_HUMAN)
AKIGHNRQY

SEQ ID NO: 178706 - protein, 10 aa, Artificial Sequence
  Description of Artificial Sequence: Synthetic peptide
  Seed: AIAVVGALLL (TYRP1_HUMAN)
AMAVVGALLV

SEQ ID NO: 178707 - protein, 9 aa, Artificial Sequence
  Description of Artificial Sequence: Synthetic peptide
  Seed: STLISPNSV (TYRP1_HUMAN)
SMLISPNSV

SEQ ID NO: 178708 - protein, 10 aa, Artificial Sequence
  Description of Artificial Sequence: Synthetic peptide
  Seed: NYFVWTHYYS (TYRP1_HUMAN)
NMFVWTHYYW

SEQ ID NO: 178709 - protein, 10 aa, Artificial Sequence
  Description of Artificial Sequence: Synthetic peptide
  Seed: NMVPFWPPVT (TYRP1_HUMAN)
NLVPFWPPVI

SEQ ID NO: 178710 - protein, 10 aa, Artificial Sequence
  Description of Artificial Sequence: Synthetic peptide
  Seed: LIFGTASYLI (TYRP1_HUMAN)
LLFGTASYLL

SEQ ID NO: 178711 - protein, 9 aa, Artificial Sequence
  Description of Artificial Sequence: Synthetic peptide
  Seed: LIFGTASYL (TYRP1_HUMAN)
LTFGTASYA

SEQ ID NO: 178712 - protein, 10 aa, Artificial Sequence
  Description of Artificial Sequence: Synthetic peptide
  Seed: YSNSTNSFRN (TYRP1_HUMAN)
YQNSTNSFRR

SEQ ID NO: 178713 - protein, 9 aa, Artificial Sequence
  Description of Artificial Sequence: Synthetic peptide
  Seed: GLFDTPPFY (TYRP1_HUMAN)
GAFDTPPFR

SEQ ID NO: 178714 - protein, 8 aa, Artificial Sequence
  Description of Artificial Sequence: Synthetic peptide
  Seed: REFSVPEI (TYRP1_HUMAN)
RQFSVPEV

SEQ ID NO: 178715 - protein, 10 aa, Artificial Sequence
  Description of Artificial Sequence: Synthetic peptide
  Seed: MVPFWPPVTN (TYRP1_HUMAN)
MLPFWPPVTM

SEQ ID NO: 178716 - protein, 11 aa, Artificial Sequence
  Description of Artificial Sequence: Synthetic peptide
  Seed: YQCYAEEYEKL (TYRP1_HUMAN)
YQCYAEEYEKF

SEQ ID NO: 178717 - protein, 9 aa, Artificial Sequence
  Description of Artificial Sequence: Synthetic peptide
  Seed: RFFNRTCHC (TYRP1_HUMAN)
RWFNRTCHA

SEQ ID NO: 178718 - protein, 11 aa, Artificial Sequence
  Description of Artificial Sequence: Synthetic peptide
  Seed: EILGPDGNTPQ (TYRP1_HUMAN)
ETLGPDGNTPK

SEQ ID NO: 178719 - protein, 11 aa, Artificial Sequence
  Description of Artificial Sequence: Synthetic peptide
  Seed: MLQEPSFSLPY (TYRP1_HUMAN)
MLQEPSFSLPV

SEQ ID NO: 178720 - protein, 9 aa, Artificial Sequence
  Description of Artificial Sequence: Synthetic peptide
  Seed: IAIAVVGAL (TYRP1_HUMAN)
IPIAVVGAY

SEQ ID NO: 178721 - protein, 10 aa, Artificial Sequence
  Description of Artificial Sequence: Synthetic peptide
  Seed: NSFRNTVEGY (TYRP1_HUMAN)
NSFRNTVEGW

SEQ ID NO: 178722 - protein, 9 aa, Artificial Sequence
  Description of Artificial Sequence: Synthetic peptide
  Seed: WHRYHLLRL (TYRP1_HUMAN)
WYRYHLLRF

SEQ ID NO: 178723 - protein, 9 aa, Artificial Sequence
  Description of Artificial Sequence: Synthetic peptide
  Seed: LHTFTDAVF (TYRP1_HUMAN)
LQTFTDAVM

SEQ ID NO: 178724 - protein, 9 aa, Artificial Sequence
  Description of Artificial Sequence: Synthetic peptide
  Seed: CTDDLMGSR (TYRP1_HUMAN)
CIDDLMGSY

SEQ ID NO: 178725 - protein, 10 aa, Artificial Sequence
  Description of Artificial Sequence: Synthetic peptide
  Seed: NYFVWTHYYS (TYRP1_HUMAN)
NWFVWTHYYF

SEQ ID NO: 178726 - protein, 9 aa, Artificial Sequence
  Description of Artificial Sequence: Synthetic peptide
  Seed: LPYWNFATG (TYRP1_HUMAN)
LGYWNFATY

SEQ ID NO: 178727 - protein, 10 aa, Artificial Sequence
  Description of Artificial Sequence: Synthetic peptide
  Seed: VALIFGTASY (TYRP1_HUMAN)
VTLIFGTASF

SEQ ID NO: 178728 - protein, 10 aa, Artificial Sequence
  Description of Artificial Sequence: Synthetic peptide
  Seed: STLISPNSVF (TYRP1_HUMAN)
SNLISPNSVF

SEQ ID NO: 178729 - protein, 9 aa, Artificial Sequence
  Description of Artificial Sequence: Synthetic peptide
  Seed: RSLHNLAHL (TYRP1_HUMAN)
RALHNLAHF

SEQ ID NO: 178730 - protein, 9 aa, Artificial Sequence
  Description of Artificial Sequence: Synthetic peptide
  Seed: VTAPDNLGY (TYRP1_HUMAN)
VAAPDNLGW

SEQ ID NO: 178731 - protein, 9 aa, Artificial Sequence
  Description of Artificial Sequence: Synthetic peptide
  Seed: VPFWPPVTN (TYRP1_HUMAN)
VPFWPPVTP

SEQ ID NO: 178732 - protein, 10 aa, Artificial Sequence
  Description of Artificial Sequence: Synthetic peptide
  Seed: FTDAVFDEWL (TYRP1_HUMAN)
FADAVFDEWY

SEQ ID NO: 178733 - protein, 9 aa, Artificial Sequence
  Description of Artificial Sequence: Synthetic peptide
  Seed: LLLFQQARA (TYRP1_HUMAN)
LLLFQQARL

SEQ ID NO: 178734 - protein, 9 aa, Artificial Sequence
  Description of Artificial Sequence: Synthetic peptide
  Seed: FSVPEIIAI (TYRP1_HUMAN)
FGVPEIIAI

SEQ ID NO: 178735 - protein, 11 aa, Artificial Sequence
  Description of Artificial Sequence: Synthetic peptide
  Seed: QEMLQEPSFSL (TYRP1_HUMAN)
QLMLQEPSFSI

SEQ ID NO: 178736 - protein, 9 aa, Artificial Sequence
  Description of Artificial Sequence: Synthetic peptide
  Seed: AQFPRQCAT (TYRP1_HUMAN)
AQFPRQCAL

SEQ ID NO: 178737 - protein, 10 aa, Artificial Sequence
  Description of Artificial Sequence: Synthetic peptide
  Seed: FENISIYNYF (TYRP1_HUMAN)
FKNISIYNYY

SEQ ID NO: 178738 - protein, 10 aa, Artificial Sequence
  Description of Artificial Sequence: Synthetic peptide
  Seed: MLQEPSFSLP (TYRP1_HUMAN)
MMQEPSFSLQ

SEQ ID NO: 178739 - protein, 10 aa, Artificial Sequence
  Description of Artificial Sequence: Synthetic peptide
  Seed: TPQFENISIY (TYRP1_HUMAN)
THQFENISIM

SEQ ID NO: 178740 - protein, 10 aa, Artificial Sequence
  Description of Artificial Sequence: Synthetic peptide
  Seed: FSLPYWNFAT (TYRP1_HUMAN)
FFLPYWNFAV

SEQ ID NO: 178741 - protein, 9 aa, Artificial Sequence
  Description of Artificial Sequence: Synthetic peptide
  Seed: GYSDPTGKY (TYRP1_HUMAN)
GRSDPTGKF

SEQ ID NO: 178742 - protein, 9 aa, Artificial Sequence
  Description of Artificial Sequence: Synthetic peptide
  Seed: SVPEIIAIA (TYRP1_HUMAN)
STPEIIAIL

SEQ ID NO: 178743 - protein, 9 aa, Artificial Sequence
  Description of Artificial Sequence: Synthetic peptide
  Seed: FSLPYWNFA (TYRP1_HUMAN)
FALPYWNFA

SEQ ID NO: 178744 - protein, 9 aa, Artificial Sequence
  Description of Artificial Sequence: Synthetic peptide
  Seed: SFRNTVEGY (TYRP1_HUMAN)
SKRNTVEGY

SEQ ID NO: 178745 - protein, 11 aa, Artificial Sequence
  Description of Artificial Sequence: Synthetic peptide
  Seed: LRRYNADISTF (TYRP1_HUMAN)
LWRYNADISTF

SEQ ID NO: 178746 - protein, 11 aa, Artificial Sequence
  Description of Artificial Sequence: Synthetic peptide
  Seed: VALIFGTASYL (TYRP1_HUMAN)
VKLIFGTASYV

SEQ ID NO: 178747 - protein, 10 aa, Artificial Sequence
  Description of Artificial Sequence: Synthetic peptide
  Seed: IIAIAVVGAL (TYRP1_HUMAN)
ILAIAVVGAV

SEQ ID NO: 178748 - protein, 10 aa, Artificial Sequence
  Description of Artificial Sequence: Synthetic peptide
  Seed: TASYLIRARR (TYRP1_HUMAN)
TDSYLIRARR

SEQ ID NO: 178749 - protein, 9 aa, Artificial Sequence
  Description of Artificial Sequence: Synthetic peptide
  Seed: YTYEIQWPS (TYRP1_HUMAN)
YSYEIQWPM

SEQ ID NO: 178750 - protein, 9 aa, Artificial Sequence
  Description of Artificial Sequence: Synthetic peptide
  Seed: FSLPYWNFA (TYRP1_HUMAN)
FTLPYWNFI

SEQ ID NO: 178751 - protein, 10 aa, Artificial Sequence
  Description of Artificial Sequence: Synthetic peptide
  Seed: STLISPNSVF (TYRP1_HUMAN)
SKLISPNSVY

SEQ ID NO: 178752 - protein, 9 aa, Artificial Sequence
  Description of Artificial Sequence: Synthetic peptide
  Seed: FSVPEIIAI (TYRP1_HUMAN)
FFVPEIIAY

SEQ ID NO: 178753 - protein, 9 aa, Artificial Sequence
  Description of Artificial Sequence: Synthetic peptide
  Seed: FSVPEIIAI (TYRP1_HUMAN)
FRVPEIIAL

SEQ ID NO: 178754 - protein, 10 aa, Artificial Sequence
  Description of Artificial Sequence: Synthetic peptide
  Seed: THYYSVKKTF (TYRP1_HUMAN)
TWYYSVKKTF

SEQ ID NO: 178755 - protein, 11 aa, Artificial Sequence
  Description of Artificial Sequence: Synthetic peptide
  Seed: FLNGTGGQTHL (TYRP1_HUMAN)
FYNGTGGQTHM

SEQ ID NO: 178756 - protein, 11 aa, Artificial Sequence
  Description of Artificial Sequence: Synthetic peptide
  Seed: FWPPVTNTEMF (TYRP1_HUMAN)
FCPPVTNTEMW

SEQ ID NO: 178757 - protein, 9 aa, Artificial Sequence
  Description of Artificial Sequence: Synthetic peptide
  Seed: SPNDPIFVL (TYRP1_HUMAN)
SGNDPIFVL

SEQ ID NO: 178758 - protein, 9 aa, Artificial Sequence
  Description of Artificial Sequence: Synthetic peptide
  Seed: EEYEKLQNP (TYRP1_HUMAN)
EEYEKLQNM

SEQ ID NO: 178759 - protein, 11 aa, Artificial Sequence
  Description of Artificial Sequence: Synthetic peptide
  Seed: RRYNADISTFP (TYRP1_HUMAN)
RRYNADISTFI

SEQ ID NO: 178760 - protein, 9 aa, Artificial Sequence
  Description of Artificial Sequence: Synthetic peptide
  Seed: ENISIYNYF (TYRP1_HUMAN)
ETISIYNYW

SEQ ID NO: 178761 - protein, 11 aa, Artificial Sequence
  Description of Artificial Sequence: Synthetic peptide
  Seed: FVLLHTFTDAV (TYRP1_HUMAN)
FQLLHTFTDAL

SEQ ID NO: 178762 - protein, 10 aa, Artificial Sequence
  Description of Artificial Sequence: Synthetic peptide
  Seed: FGTASYLIRA (TYRP1_HUMAN)
FATASYLIRI

SEQ ID NO: 178763 - protein, 10 aa, Artificial Sequence
  Description of Artificial Sequence: Synthetic peptide
  Seed: EVWPLRFFNR (TYRP1_HUMAN)
ENWPLRFFNR

SEQ ID NO: 178764 - protein, 8 aa, Artificial Sequence
  Description of Artificial Sequence: Synthetic peptide
  Seed: FSHEGPAF (TYRP1_HUMAN)
FTHEGPAF

SEQ ID NO: 178765 - protein, 9 aa, Artificial Sequence
  Description of Artificial Sequence: Synthetic peptide
  Seed: SLGCIFFPL (TYRP1_HUMAN)
SAGCIFFPR

SEQ ID NO: 178766 - protein, 9 aa, Artificial Sequence
  Description of Artificial Sequence: Synthetic peptide
  Seed: FYSNSTNSF (TYRP1_HUMAN)
FYSNSTNSH

SEQ ID NO: 178767 - protein, 10 aa, Artificial Sequence
  Description of Artificial Sequence: Synthetic peptide
  Seed: FWPPVTNTEM (TYRP1_HUMAN)
FLPPVTNTEI

SEQ ID NO: 178768 - protein, 9 aa, Artificial Sequence
  Description of Artificial Sequence: Synthetic peptide
  Seed: AVVGALLLV (TYRP1_HUMAN)
AVVGALLLI

SEQ ID NO: 178769 - protein, 9 aa, Artificial Sequence
  Description of Artificial Sequence: Synthetic peptide
  Seed: RVLIVRRNL (TYRP1_HUMAN)
RLLIVRRNF

SEQ ID NO: 178770 - protein, 9 aa, Artificial Sequence
  Description of Artificial Sequence: Synthetic peptide
  Seed: YYSVKKTFL (TYRP1_HUMAN)
YASVKKTFY

SEQ ID NO: 178771 - protein, 11 aa, Artificial Sequence
  Description of Artificial Sequence: Synthetic peptide
  Seed: YSDPTGKYDPA (TYRP1_HUMAN)
YSDPTGKYDPF

SEQ ID NO: 178772 - protein, 10 aa, Artificial Sequence
  Description of Artificial Sequence: Synthetic peptide
  Seed: FGTASYLIRA (TYRP1_HUMAN)
FETASYLIRI

SEQ ID NO: 178773 - protein, 10 aa, Artificial Sequence
  Description of Artificial Sequence: Synthetic peptide
  Seed: EMLQEPSFSL (TYRP1_HUMAN)
ERLQEPSFSV

SEQ ID NO: 178774 - protein, 9 aa, Artificial Sequence
  Description of Artificial Sequence: Synthetic peptide
  Seed: HYYSVKKTF (TYRP1_HUMAN)
HTYSVKKTM

SEQ ID NO: 178775 - protein, 11 aa, Artificial Sequence
  Description of Artificial Sequence: Synthetic peptide
  Seed: REFSVPEIIAI (TYRP1_HUMAN)
RSFSVPEIIAF

SEQ ID NO: 178776 - protein, 9 aa, Artificial Sequence
  Description of Artificial Sequence: Synthetic peptide
  Seed: RGRCEAVTA (TYRP1_HUMAN)
RFRCEAVTV

SEQ ID NO: 178777 - protein, 11 aa, Artificial Sequence
  Description of Artificial Sequence: Synthetic peptide
  Seed: VLLHTFTDAVF (TYRP1_HUMAN)
VQLHTFTDAVY

SEQ ID NO: 178778 - protein, 9 aa, Artificial Sequence
  Description of Artificial Sequence: Synthetic peptide
  Seed: ALIFGTASY (TYRP1_HUMAN)
AEIFGTASF

SEQ ID NO: 178779 - protein, 9 aa, Artificial Sequence
  Description of Artificial Sequence: Synthetic peptide
  Seed: DSRPHSPQY (TYRP1_HUMAN)
DVRPHSPQW

SEQ ID NO: 178780 - protein, 10 aa, Artificial Sequence
  Description of Artificial Sequence: Synthetic peptide
  Seed: ALIFGTASYL (TYRP1_HUMAN)
APIFGTASYV

SEQ ID NO: 178781 - protein, 9 aa, Artificial Sequence
  Description of Artificial Sequence: Synthetic peptide
  Seed: QDVAQCLEV (TYRP1_HUMAN)
QEVAQCLEI

SEQ ID NO: 178782 - protein, 9 aa, Artificial Sequence
  Description of Artificial Sequence: Synthetic peptide
  Seed: LGYTYEIQW (TYRP1_HUMAN)
LPYTYEIQF

SEQ ID NO: 178783 - protein, 9 aa, Artificial Sequence
  Description of Artificial Sequence: Synthetic peptide
  Seed: FSHEGPAFL (TYRP1_HUMAN)
FIHEGPAFC

SEQ ID NO: 178784 - protein, 9 aa, Artificial Sequence
  Description of Artificial Sequence: Synthetic peptide
  Seed: ALIFGTASY (TYRP1_HUMAN)
AYIFGTASM

SEQ ID NO: 178785 - protein, 9 aa, Artificial Sequence
  Description of Artificial Sequence: Synthetic peptide
  Seed: LIFGTASYL (TYRP1_HUMAN)
LAFGTASYR

SEQ ID NO: 178786 - protein, 9 aa, Artificial Sequence
  Description of Artificial Sequence: Synthetic peptide
  Seed: FENISIYNY (TYRP1_HUMAN)
FQNISIYNF

SEQ ID NO: 178787 - protein, 9 aa, Artificial Sequence
  Description of Artificial Sequence: Synthetic peptide
  Seed: RSLHNLAHL (TYRP1_HUMAN)
RTLHNLAHA

SEQ ID NO: 178788 - protein, 11 aa, Artificial Sequence
  Description of Artificial Sequence: Synthetic peptide
  Seed: FVLLHTFTDAV (TYRP1_HUMAN)
FTLLHTFTDAL

SEQ ID NO: 178789 - protein, 9 aa, Artificial Sequence
  Description of Artificial Sequence: Synthetic peptide
  Seed: TPQFENISI (TYRP1_HUMAN)
TAQFENISY

SEQ ID NO: 178790 - protein, 9 aa, Artificial Sequence
  Description of Artificial Sequence: Synthetic peptide
  Seed: AVRSLHNLA (TYRP1_HUMAN)
ATRSLHNLR

SEQ ID NO: 178791 - protein, 9 aa, Artificial Sequence
  Description of Artificial Sequence: Synthetic peptide
  Seed: NMVPFWPPV (TYRP1_HUMAN)
NFVPFWPPY

SEQ ID NO: 178792 - protein, 9 aa, Artificial Sequence
  Description of Artificial Sequence: Synthetic peptide
  Seed: QCYAEEYEK (TYRP1_HUMAN)
QIYAEEYEK

SEQ ID NO: 178793 - protein, 10 aa, Artificial Sequence
  Description of Artificial Sequence: Synthetic peptide
  Seed: IAIAVVGALL (TYRP1_HUMAN)
ILIAVVGALL

SEQ ID NO: 178794 - protein, 11 aa, Artificial Sequence
  Description of Artificial Sequence: Synthetic peptide
  Seed: FWPPVTNTEMF (TYRP1_HUMAN)
FYPPVTNTEMF

SEQ ID NO: 178795 - protein, 9 aa, Artificial Sequence
  Description of Artificial Sequence: Synthetic peptide
  Seed: KYDPAVRSL (TYRP1_HUMAN)
KEDPAVRSM

SEQ ID NO: 178796 - protein, 10 aa, Artificial Sequence
  Description of Artificial Sequence: Synthetic peptide
  Seed: ALIFGTASYL (TYRP1_HUMAN)
AQIFGTASYC

SEQ ID NO: 178797 - protein, 10 aa, Artificial Sequence
  Description of Artificial Sequence: Synthetic peptide
  Seed: FVTAPDNLGY (TYRP1_HUMAN)
FTTAPDNLGF

SEQ ID NO: 178798 - protein, 11 aa, Artificial Sequence
  Description of Artificial Sequence: Synthetic peptide
  Seed: YTYEIQWPSRE (TYRP1_HUMAN)
YFYEIQWPSRR

SEQ ID NO: 178799 - protein, 9 aa, Artificial Sequence
  Description of Artificial Sequence: Synthetic peptide
  Seed: IVRRNLLDL (TYRP1_HUMAN)
IPRRNLLDL

SEQ ID NO: 178800 - protein, 10 aa, Artificial Sequence
  Description of Artificial Sequence: Synthetic peptide
  Seed: YNMVPFWPPV (TYRP1_HUMAN)
YAMVPFWPPI

SEQ ID NO: 178801 - protein, 9 aa, Artificial Sequence
  Description of Artificial Sequence: Synthetic peptide
  Seed: DDREVWPLR (TYRP1_HUMAN)
DSREVWPLK

SEQ ID NO: 178802 - protein, 9 aa, Artificial Sequence
  Description of Artificial Sequence: Synthetic peptide
  Seed: MSAPKLLSL (TYRP1_HUMAN)
MWAPKLLSL

SEQ ID NO: 178803 - protein, 9 aa, Artificial Sequence
  Description of Artificial Sequence: Synthetic peptide
  Seed: WHRYHLLRL (TYRP1_HUMAN)
WQRYHLLRL

SEQ ID NO: 178804 - protein, 9 aa, Artificial Sequence
  Description of Artificial Sequence: Synthetic peptide
  Seed: KLQNPNQSV (TYRP1_HUMAN)
KMQNPNQSF

SEQ ID NO: 178805 - protein, 9 aa, Artificial Sequence
  Description of Artificial Sequence: Synthetic peptide
  Seed: TTHPLFVIA (TYRP1_HUMAN)
TPHPLFVIT

SEQ ID NO: 178806 - protein, 10 aa, Artificial Sequence
  Description of Artificial Sequence: Synthetic peptide
  Seed: HPLFVIATRR (TYRP1_HUMAN)
HTLFVIATRD

SEQ ID NO: 178807 - protein, 9 aa, Artificial Sequence
  Description of Artificial Sequence: Synthetic peptide
  Seed: MSAPKLLSL (TYRP1_HUMAN)
MAAPKLLSM

SEQ ID NO: 178808 - protein, 10 aa, Artificial Sequence
  Description of Artificial Sequence: Synthetic peptide
  Seed: TPQFENISIY (TYRP1_HUMAN)
TCQFENISIY

SEQ ID NO: 178809 - protein, 10 aa, Artificial Sequence
  Description of Artificial Sequence: Synthetic peptide
  Seed: YFVWTHYYSV (TYRP1_HUMAN)
YYVWTHYYSL

SEQ ID NO: 178810 - protein, 10 aa, Artificial Sequence
  Description of Artificial Sequence: Synthetic peptide
  Seed: TFTDAVFDEW (TYRP1_HUMAN)
TWTDAVFDEF

SEQ ID NO: 178811 - protein, 9 aa, Artificial Sequence
  Description of Artificial Sequence: Synthetic peptide
  Seed: NADISTFPL (TYRP1_HUMAN)
NMDISTFPF

SEQ ID NO: 178812 - protein, 9 aa, Artificial Sequence
  Description of Artificial Sequence: Synthetic peptide
  Seed: ALIFGTASY (TYRP1_HUMAN)
AQIFGTASF

SEQ ID NO: 178813 - protein, 10 aa, Artificial Sequence
  Description of Artificial Sequence: Synthetic peptide
  Seed: FVTAPDNLGY (TYRP1_HUMAN)
FSTAPDNLGY

SEQ ID NO: 178814 - protein, 10 aa, Artificial Sequence
  Description of Artificial Sequence: Synthetic peptide
  Seed: LLHTFTDAVF (TYRP1_HUMAN)
LQHTFTDAVM

SEQ ID NO: 178815 - protein, 9 aa, Artificial Sequence
  Description of Artificial Sequence: Synthetic peptide
  Seed: SPNDPIFVL (TYRP1_HUMAN)
SHNDPIFVV

SEQ ID NO: 178816 - protein, 9 aa, Artificial Sequence
  Description of Artificial Sequence: Synthetic peptide
  Seed: RYNADISTF (TYRP1_HUMAN)
RYNADISTL

SEQ ID NO: 178817 - protein, 9 aa, Artificial Sequence
  Description of Artificial Sequence: Synthetic peptide
  Seed: QEMLQEPSF (TYRP1_HUMAN)
QQMLQEPSV

SEQ ID NO: 178818 - protein, 9 aa, Artificial Sequence
  Description of Artificial Sequence: Synthetic peptide
  Seed: CIFFPLLLF (TYRP1_HUMAN)
CKFFPLLLY

SEQ ID NO: 178819 - protein, 10 aa, Artificial Sequence
  Description of Artificial Sequence: Synthetic peptide
  Seed: VGLFDTPPFY (TYRP1_HUMAN)
VALFDTPPFY

SEQ ID NO: 178820 - protein, 10 aa, Artificial Sequence
  Description of Artificial Sequence: Synthetic peptide
  Seed: YNYFVWTHYY (TYRP1_HUMAN)
YQYFVWTHYW

SEQ ID NO: 178821 - protein, 9 aa, Artificial Sequence
  Description of Artificial Sequence: Synthetic peptide
  Seed: ENAPIGHNR (TYRP1_HUMAN)
EFAPIGHNR

SEQ ID NO: 178822 - protein, 9 aa, Artificial Sequence
  Description of Artificial Sequence: Synthetic peptide
  Seed: SLHNLAHLF (TYRP1_HUMAN)
STHNLAHLM

SEQ ID NO: 178823 - protein, 10 aa, Artificial Sequence
  Description of Artificial Sequence: Synthetic peptide
  Seed: FGTASYLIRA (TYRP1_HUMAN)
FITASYLIRV

SEQ ID NO: 178824 - protein, 10 aa, Artificial Sequence
  Description of Artificial Sequence: Synthetic peptide
  Seed: EIIAIAVVGA (TYRP1_HUMAN)
EVIAIAVVGI

SEQ ID NO: 178825 - protein, 9 aa, Artificial Sequence
  Description of Artificial Sequence: Synthetic peptide
  Seed: HEGPAFLTW (TYRP1_HUMAN)
HLGPAFLTI

SEQ ID NO: 178826 - protein, 11 aa, Artificial Sequence
  Description of Artificial Sequence: Synthetic peptide
  Seed: HTFTDAVFDEW (TYRP1_HUMAN)
HQFTDAVFDEF

SEQ ID NO: 178827 - protein, 11 aa, Artificial Sequence
  Description of Artificial Sequence: Synthetic peptide
  Seed: VTAPDNLGYTY (TYRP1_HUMAN)
VVAPDNLGYTW

SEQ ID NO: 178828 - protein, 10 aa, Artificial Sequence
  Description of Artificial Sequence: Synthetic peptide
  Seed: LGPDGNTPQF (TYRP1_HUMAN)
LCPDGNTPQY

SEQ ID NO: 178829 - protein, 9 aa, Artificial Sequence
  Description of Artificial Sequence: Synthetic peptide
  Seed: WTHYYSVKK (TYRP1_HUMAN)
WAHYYSVKK

SEQ ID NO: 178830 - protein, 9 aa, Artificial Sequence
  Description of Artificial Sequence: Synthetic peptide
  Seed: YTYEIQWPS (TYRP1_HUMAN)
YMYEIQWPP

SEQ ID NO: 178831 - protein, 9 aa, Artificial Sequence
  Description of Artificial Sequence: Synthetic peptide
  Seed: RYNADISTF (TYRP1_HUMAN)
RANADISTY

SEQ ID NO: 178832 - protein, 9 aa, Artificial Sequence
  Description of Artificial Sequence: Synthetic peptide
  Seed: MCCPDLSPV (TYRP1_HUMAN)
MQCPDLSPM

SEQ ID NO: 178833 - protein, 10 aa, Artificial Sequence
  Description of Artificial Sequence: Synthetic peptide
  Seed: RRYNADISTF (TYRP1_HUMAN)
RKYNADISTF

SEQ ID NO: 178834 - protein, 9 aa, Artificial Sequence
  Description of Artificial Sequence: Synthetic peptide
  Seed: LVALIFGTA (TYRP1_HUMAN)
LLALIFGTT

SEQ ID NO: 178835 - protein, 10 aa, Artificial Sequence
  Description of Artificial Sequence: Synthetic peptide
  Seed: YNYFVWTHYY (TYRP1_HUMAN)
YWYFVWTHYV

SEQ ID NO: 178836 - protein, 9 aa, Artificial Sequence
  Description of Artificial Sequence: Synthetic peptide
  Seed: APDNLGYTY (TYRP1_HUMAN)
ARDNLGYTL

SEQ ID NO: 178837 - protein, 9 aa, Artificial Sequence
  Description of Artificial Sequence: Synthetic peptide
  Seed: SVFSQWRVV (TYRP1_HUMAN)
SAFSQWRVL

SEQ ID NO: 178838 - protein, 10 aa, Artificial Sequence
  Description of Artificial Sequence: Synthetic peptide
  Seed: SHEGPAFLTW (TYRP1_HUMAN)
SHEGPAFLTL

SEQ ID NO: 178839 - protein, 9 aa, Artificial Sequence
  Description of Artificial Sequence: Synthetic peptide
  Seed: FENISIYNY (TYRP1_HUMAN)
FLNISIYNF

SEQ ID NO: 178840 - protein, 9 aa, Artificial Sequence
  Description of Artificial Sequence: Synthetic peptide
  Seed: RSLHNLAHL (TYRP1_HUMAN)
RFLHNLAHY

SEQ ID NO: 178841 - protein, 10 aa, Artificial Sequence
  Description of Artificial Sequence: Synthetic peptide
  Seed: SVPEIIAIAV (TYRP1_HUMAN)
SMPEIIAIAV

SEQ ID NO: 178842 - protein, 9 aa, Artificial Sequence
  Description of Artificial Sequence: Synthetic peptide
  Seed: LIFGTASYL (TYRP1_HUMAN)
LIFGTASYY

SEQ ID NO: 178843 - protein, 9 aa, Artificial Sequence
  Description of Artificial Sequence: Synthetic peptide
  Seed: MCCPDLSPV (TYRP1_HUMAN)
MLCPDLSPM

SEQ ID NO: 178844 - protein, 9 aa, Artificial Sequence
  Description of Artificial Sequence: Synthetic peptide
  Seed: YNYFVWTHY (TYRP1_HUMAN)
YQYFVWTHF

SEQ ID NO: 178845 - protein, 8 aa, Artificial Sequence
  Description of Artificial Sequence: Synthetic peptide
  Seed: YSDPTGKY (TYRP1_HUMAN)
YTDPTGKL

SEQ ID NO: 178846 - protein, 9 aa, Artificial Sequence
  Description of Artificial Sequence: Synthetic peptide
  Seed: TADSRPHSP (TYRP1_HUMAN)
TFDSRPHSM

SEQ ID NO: 178847 - protein, 10 aa, Artificial Sequence
  Description of Artificial Sequence: Synthetic peptide
  Seed: FVTAPDNLGY (TYRP1_HUMAN)
FNTAPDNLGW

SEQ ID NO: 178848 - protein, 10 aa, Artificial Sequence
  Description of Artificial Sequence: Synthetic peptide
  Seed: FSVPEIIAIA (TYRP1_HUMAN)
FVVPEIIAIA

SEQ ID NO: 178849 - protein, 9 aa, Artificial Sequence
  Description of Artificial Sequence: Synthetic peptide
  Seed: FVWTHYYSV (TYRP1_HUMAN)
FPWTHYYSP

SEQ ID NO: 178850 - protein, 10 aa, Artificial Sequence
  Description of Artificial Sequence: Synthetic peptide
  Seed: IIAIAVVGAL (TYRP1_HUMAN)
IMAIAVVGAL

SEQ ID NO: 178851 - protein, 9 aa, Artificial Sequence
  Description of Artificial Sequence: Synthetic peptide
  Seed: YNYFVWTHY (TYRP1_HUMAN)
YFYFVWTHM

SEQ ID NO: 178852 - protein, 10 aa, Artificial Sequence
  Description of Artificial Sequence: Synthetic peptide
  Seed: WPPVTNTEMF (TYRP1_HUMAN)
WEPVTNTEMY

SEQ ID NO: 178853 - protein, 9 aa, Artificial Sequence
  Description of Artificial Sequence: Synthetic peptide
  Seed: SPNDPIFVL (TYRP1_HUMAN)
SHNDPIFVA

SEQ ID NO: 178854 - protein, 10 aa, Artificial Sequence
  Description of Artificial Sequence: Synthetic peptide
  Seed: TASYLIRARR (TYRP1_HUMAN)
TISYLIRARR

SEQ ID NO: 178855 - protein, 9 aa, Artificial Sequence
  Description of Artificial Sequence: Synthetic peptide
  Seed: YSNSTNSFR (TYRP1_HUMAN)
YANSTNSFY

SEQ ID NO: 178856 - protein, 9 aa, Artificial Sequence
  Description of Artificial Sequence: Synthetic peptide
  Seed: NISIYNYFV (TYRP1_HUMAN)
NVSIYNYFV

SEQ ID NO: 178857 - protein, 9 aa, Artificial Sequence
  Description of Artificial Sequence: Synthetic peptide
  Seed: TLISPNSVF (TYRP1_HUMAN)
THISPNSVY

SEQ ID NO: 178858 - protein, 10 aa, Artificial Sequence
  Description of Artificial Sequence: Synthetic peptide
  Seed: KLLSLGCIFF (TYRP1_HUMAN)
KYLSLGCIFW

SEQ ID NO: 178859 - protein, 9 aa, Artificial Sequence
  Description of Artificial Sequence: Synthetic peptide
  Seed: ALIFGTASY (TYRP1_HUMAN)
AYIFGTASW

SEQ ID NO: 178860 - protein, 10 aa, Artificial Sequence
  Description of Artificial Sequence: Synthetic peptide
  Seed: LGPDGNTPQF (TYRP1_HUMAN)
LPPDGNTPQW

SEQ ID NO: 178861 - protein, 9 aa, Artificial Sequence
  Description of Artificial Sequence: Synthetic peptide
  Seed: RVLIVRRNL (TYRP1_HUMAN)
RMLIVRRNK

SEQ ID NO: 178862 - protein, 10 aa, Artificial Sequence
  Description of Artificial Sequence: Synthetic peptide
  Seed: LGPDGNTPQF (TYRP1_HUMAN)
LWPDGNTPQW

SEQ ID NO: 178863 - protein, 11 aa, Artificial Sequence
  Description of Artificial Sequence: Synthetic peptide
  Seed: YQCYAEEYEKL (TYRP1_HUMAN)
YYCYAEEYEKW

SEQ ID NO: 178864 - protein, 9 aa, Artificial Sequence
  Description of Artificial Sequence: Synthetic peptide
  Seed: TLISPNSVF (TYRP1_HUMAN)
TAISPNSVM

SEQ ID NO: 178865 - protein, 9 aa, Artificial Sequence
  Description of Artificial Sequence: Synthetic peptide
  Seed: NYFVWTHYY (TYRP1_HUMAN)
NTFVWTHYW

SEQ ID NO: 178866 - protein, 10 aa, Artificial Sequence
  Description of Artificial Sequence: Synthetic peptide
  Seed: SMDEANQPLL (TYRP1_HUMAN)
SQDEANQPLY

SEQ ID NO: 178867 - protein, 9 aa, Artificial Sequence
  Description of Artificial Sequence: Synthetic peptide
  Seed: RYHLLRLEK (TYRP1_HUMAN)
RIHLLRLEV

SEQ ID NO: 178868 - protein, 11 aa, Artificial Sequence
  Description of Artificial Sequence: Synthetic peptide
  Seed: FPLLLFQQARA (TYRP1_HUMAN)
FTLLLFQQARV

SEQ ID NO: 178869 - protein, 9 aa, Artificial Sequence
  Description of Artificial Sequence: Synthetic peptide
  Seed: TEMFVTAPD (TYRP1_HUMAN)
TEMFVTAPI

SEQ ID NO: 178870 - protein, 11 aa, Artificial Sequence
  Description of Artificial Sequence: Synthetic peptide
  Seed: VALIFGTASYL (TYRP1_HUMAN)
VRLIFGTASYV

SEQ ID NO: 178871 - protein, 10 aa, Artificial Sequence
  Description of Artificial Sequence: Synthetic peptide
  Seed: MLQEPSFSLP (TYRP1_HUMAN)
MMQEPSFSLM

SEQ ID NO: 178872 - protein, 9 aa, Artificial Sequence
  Description of Artificial Sequence: Synthetic peptide
  Seed: RSNFDSTLI (TYRP1_HUMAN)
RSNFDSTLF

SEQ ID NO: 178873 - protein, 9 aa, Artificial Sequence
  Description of Artificial Sequence: Synthetic peptide
  Seed: RYNADISTF (TYRP1_HUMAN)
RTNADISTY

SEQ ID NO: 178874 - protein, 10 aa, Artificial Sequence
  Description of Artificial Sequence: Synthetic peptide
  Seed: EGYSDPTGKY (TYRP1_HUMAN)
EQYSDPTGKY

SEQ ID NO: 178875 - protein, 10 aa, Artificial Sequence
  Description of Artificial Sequence: Synthetic peptide
  Seed: FVLLHTFTDA (TYRP1_HUMAN)
FELLHTFTDL

SEQ ID NO: 178876 - protein, 10 aa, Artificial Sequence
  Description of Artificial Sequence: Synthetic peptide
  Seed: AQFPRQCATV (TYRP1_HUMAN)
AMFPRQCATV

SEQ ID NO: 178877 - protein, 9 aa, Artificial Sequence
  Description of Artificial Sequence: Synthetic peptide
  Seed: REVWPLRFF (TYRP1_HUMAN)
RMVWPLRFY

SEQ ID NO: 178878 - protein, 9 aa, Artificial Sequence
  Description of Artificial Sequence: Synthetic peptide
  Seed: SGHNCGTCR (TYRP1_HUMAN)
STHNCGTCR

SEQ ID NO: 178879 - protein, 10 aa, Artificial Sequence
  Description of Artificial Sequence: Synthetic peptide
  Seed: NPAGNVARPM (TYRP1_HUMAN)
NPAGNVARPF

SEQ ID NO: 178880 - protein, 11 aa, Artificial Sequence
  Description of Artificial Sequence: Synthetic peptide
  Seed: YNMVPFWPPVT (TYRP1_HUMAN)
YLMVPFWPPVV

SEQ ID NO: 178881 - protein, 10 aa, Artificial Sequence
  Description of Artificial Sequence: Synthetic peptide
  Seed: FVTAPDNLGY (TYRP1_HUMAN)
FWTAPDNLGY

SEQ ID NO: 178882 - protein, 11 aa, Artificial Sequence
  Description of Artificial Sequence: Synthetic peptide
  Seed: KTFLGVGQESF (TYRP1_HUMAN)
KTFLGVGQESW

SEQ ID NO: 178883 - protein, 9 aa, Artificial Sequence
  Description of Artificial Sequence: Synthetic peptide
  Seed: NMVPFWPPV (TYRP1_HUMAN)
NLVPFWPPR

SEQ ID NO: 178884 - protein, 9 aa, Artificial Sequence
  Description of Artificial Sequence: Synthetic peptide
  Seed: RSNFDSTLI (TYRP1_HUMAN)
RANFDSTLY

SEQ ID NO: 178885 - protein, 9 aa, Artificial Sequence
  Description of Artificial Sequence: Synthetic peptide
  Seed: FYSNSTNSF (TYRP1_HUMAN)
FYSNSTNSY

SEQ ID NO: 178886 - protein, 9 aa, Artificial Sequence
  Description of Artificial Sequence: Synthetic peptide
  Seed: FSLPYWNFA (TYRP1_HUMAN)
FSLPYWNFY

SEQ ID NO: 178887 - protein, 9 aa, Artificial Sequence
  Description of Artificial Sequence: Synthetic peptide
  Seed: SPQYPHDGR (TYRP1_HUMAN)
SVQYPHDGR

SEQ ID NO: 178888 - protein, 10 aa, Artificial Sequence
  Description of Artificial Sequence: Synthetic peptide
  Seed: EGYSDPTGKY (TYRP1_HUMAN)
EAYSDPTGKY

SEQ ID NO: 178889 - protein, 10 aa, Artificial Sequence
  Description of Artificial Sequence: Synthetic peptide
  Seed: TPQFENISIY (TYRP1_HUMAN)
TRQFENISIM

SEQ ID NO: 178890 - protein, 9 aa, Artificial Sequence
  Description of Artificial Sequence: Synthetic peptide
  Seed: LLVALIFGT (TYRP1_HUMAN)
LMVALIFGI

SEQ ID NO: 178891 - protein, 9 aa, Artificial Sequence
  Description of Artificial Sequence: Synthetic peptide
  Seed: SIYNYFVWT (TYRP1_HUMAN)
SMYNYFVWV

SEQ ID NO: 178892 - protein, 9 aa, Artificial Sequence
  Description of Artificial Sequence: Synthetic peptide
  Seed: KYDPAVRSL (TYRP1_HUMAN)
KLDPAVRSL

SEQ ID NO: 178893 - protein, 11 aa, Artificial Sequence
  Description of Artificial Sequence: Synthetic peptide
  Seed: IYNYFVWTHYY (TYRP1_HUMAN)
IHNYFVWTHYF

SEQ ID NO: 178894 - protein, 10 aa, Artificial Sequence
  Description of Artificial Sequence: Synthetic peptide
  Seed: RRYNADISTF (TYRP1_HUMAN)
RSYNADISTF

SEQ ID NO: 178895 - protein, 10 aa, Artificial Sequence
  Description of Artificial Sequence: Synthetic peptide
  Seed: LPYWNFATGK (TYRP1_HUMAN)
LAYWNFATGR

SEQ ID NO: 178896 - protein, 9 aa, Artificial Sequence
  Description of Artificial Sequence: Synthetic peptide
  Seed: YLIRARRSM (TYRP1_HUMAN)
YAIRARRSV

SEQ ID NO: 178897 - protein, 9 aa, Artificial Sequence
  Description of Artificial Sequence: Synthetic peptide
  Seed: IFGTASYLI (TYRP1_HUMAN)
IYGTASYLL

SEQ ID NO: 178898 - protein, 9 aa, Artificial Sequence
  Description of Artificial Sequence: Synthetic peptide
  Seed: RLEKDMQEM (TYRP1_HUMAN)
RMEKDMQEY

SEQ ID NO: 178899 - protein, 10 aa, Artificial Sequence
  Description of Artificial Sequence: Synthetic peptide
  Seed: AVRSLHNLAH (TYRP1_HUMAN)
ASRSLHNLAA

SEQ ID NO: 178900 - protein, 10 aa, Artificial Sequence
  Description of Artificial Sequence: Synthetic peptide
  Seed: GKYDPAVRSL (TYRP1_HUMAN)
GKYDPAVRSF

SEQ ID NO: 178901 - protein, 10 aa, Artificial Sequence
  Description of Artificial Sequence: Synthetic peptide
  Seed: LSPNDPIFVL (TYRP1_HUMAN)
LGPNDPIFVM

SEQ ID NO: 178902 - protein, 10 aa, Artificial Sequence
  Description of Artificial Sequence: Synthetic peptide
  Seed: MLQEPSFSLP (TYRP1_HUMAN)
MMQEPSFSLH

SEQ ID NO: 178903 - protein, 10 aa, Artificial Sequence
  Description of Artificial Sequence: Synthetic peptide
  Seed: TPQFENISIY (TYRP1_HUMAN)
TWQFENISIY

SEQ ID NO: 178904 - protein, 9 aa, Artificial Sequence
  Description of Artificial Sequence: Synthetic peptide
  Seed: STNSFRNTV (TYRP1_HUMAN)
SINSFRNTY

SEQ ID NO: 178905 - protein, 11 aa, Artificial Sequence
  Description of Artificial Sequence: Synthetic peptide
  Seed: VTAPDNLGYTY (TYRP1_HUMAN)
VCAPDNLGYTW

SEQ ID NO: 178906 - protein, 9 aa, Artificial Sequence
  Description of Artificial Sequence: Synthetic peptide
  Seed: IAIAVVGAL (TYRP1_HUMAN)
IQIAVVGAW

SEQ ID NO: 178907 - protein, 10 aa, Artificial Sequence
  Description of Artificial Sequence: Synthetic peptide
  Seed: SIYNYFVWTH (TYRP1_HUMAN)
SGYNYFVWTR

SEQ ID NO: 178908 - protein, 10 aa, Artificial Sequence
  Description of Artificial Sequence: Synthetic peptide
  Seed: RRYNADISTF (TYRP1_HUMAN)
RHYNADISTL

SEQ ID NO: 178909 - protein, 9 aa, Artificial Sequence
  Description of Artificial Sequence: Synthetic peptide
  Seed: RVLIVRRNL (TYRP1_HUMAN)
RQLIVRRNY

SEQ ID NO: 178910 - protein, 9 aa, Artificial Sequence
  Description of Artificial Sequence: Synthetic peptide
  Seed: KLLSLGCIF (TYRP1_HUMAN)
KKLSLGCIL

SEQ ID NO: 178911 - protein, 9 aa, Artificial Sequence
  Description of Artificial Sequence: Synthetic peptide
  Seed: FLTWHRYHL (TYRP1_HUMAN)
FMTWHRYHR

SEQ ID NO: 178912 - protein, 9 aa, Artificial Sequence
  Description of Artificial Sequence: Synthetic peptide
  Seed: MSAPKLLSL (TYRP1_HUMAN)
MYAPKLLSF

SEQ ID NO: 178913 - protein, 9 aa, Artificial Sequence
  Description of Artificial Sequence: Synthetic peptide
  Seed: FSHEGPAFL (TYRP1_HUMAN)
FLHEGPAFK

SEQ ID NO: 178914 - protein, 10 aa, Artificial Sequence
  Description of Artificial Sequence: Synthetic peptide
  Seed: FFPLLLFQQA (TYRP1_HUMAN)
FPPLLLFQQA

SEQ ID NO: 178915 - protein, 10 aa, Artificial Sequence
  Description of Artificial Sequence: Synthetic peptide
  Seed: YSVKKTFLGV (TYRP1_HUMAN)
YMVKKTFLGL

SEQ ID NO: 178916 - protein, 9 aa, Artificial Sequence
  Description of Artificial Sequence: Synthetic peptide
  Seed: SPNSVFSQW (TYRP1_HUMAN)
SSNSVFSQW

SEQ ID NO: 178917 - protein, 9 aa, Artificial Sequence
  Description of Artificial Sequence: Synthetic peptide
  Seed: SMDEANQPL (TYRP1_HUMAN)
STDEANQPM

SEQ ID NO: 178918 - protein, 10 aa, Artificial Sequence
  Description of Artificial Sequence: Synthetic peptide
  Seed: PSFSLPYWNF (TYRP1_HUMAN)
PWFSLPYWNF

SEQ ID NO: 178919 - protein, 10 aa, Artificial Sequence
  Description of Artificial Sequence: Synthetic peptide
  Seed: ASYLIRARRS (TYRP1_HUMAN)
AMYLIRARRR

SEQ ID NO: 178920 - protein, 10 aa, Artificial Sequence
  Description of Artificial Sequence: Synthetic peptide
  Seed: LIFGTASYLI (TYRP1_HUMAN)
LFFGTASYLF

SEQ ID NO: 178921 - protein, 9 aa, Artificial Sequence
  Description of Artificial Sequence: Synthetic peptide
  Seed: FSVPEIIAI (TYRP1_HUMAN)
FLVPEIIAL

SEQ ID NO: 178922 - protein, 10 aa, Artificial Sequence
  Description of Artificial Sequence: Synthetic peptide
  Seed: MVPFWPPVTN (TYRP1_HUMAN)
MAPFWPPVTY

SEQ ID NO: 178923 - protein, 11 aa, Artificial Sequence
  Description of Artificial Sequence: Synthetic peptide
  Seed: FENISIYNYFV (TYRP1_HUMAN)
FMNISIYNYFA

SEQ ID NO: 178924 - protein, 10 aa, Artificial Sequence
  Description of Artificial Sequence: Synthetic peptide
  Seed: ENISIYNYFV (TYRP1_HUMAN)
EHISIYNYFV

SEQ ID NO: 178925 - protein, 10 aa, Artificial Sequence
  Description of Artificial Sequence: Synthetic peptide
  Seed: FVLLHTFTDA (TYRP1_HUMAN)
FLLLHTFTDA

SEQ ID NO: 178926 - protein, 9 aa, Artificial Sequence
  Description of Artificial Sequence: Synthetic peptide
  Seed: LLDLSKEEK (TYRP1_HUMAN)
LADLSKEEM

SEQ ID NO: 178927 - protein, 9 aa, Artificial Sequence
  Description of Artificial Sequence: Synthetic peptide
  Seed: VCDICTDDL (TYRP1_HUMAN)
VWDICTDDF

SEQ ID NO: 178928 - protein, 9 aa, Artificial Sequence
  Description of Artificial Sequence: Synthetic peptide
  Seed: DSRPHSPQY (TYRP1_HUMAN)
DTRPHSPQY

SEQ ID NO: 178929 - protein, 10 aa, Artificial Sequence
  Description of Artificial Sequence: Synthetic peptide
  Seed: LLTDQYQCYA (TYRP1_HUMAN)
LMTDQYQCYA

SEQ ID NO: 178930 - protein, 10 aa, Artificial Sequence
  Description of Artificial Sequence: Synthetic peptide
  Seed: FVTAPDNLGY (TYRP1_HUMAN)
FLTAPDNLGF

SEQ ID NO: 178931 - protein, 11 aa, Artificial Sequence
  Description of Artificial Sequence: Synthetic peptide
  Seed: YFVWTHYYSVK (TYRP1_HUMAN)
YQVWTHYYSVR

SEQ ID NO: 178932 - protein, 9 aa, Artificial Sequence
  Description of Artificial Sequence: Synthetic peptide
  Seed: SVPEIIAIA (TYRP1_HUMAN)
STPEIIAIY

SEQ ID NO: 178933 - protein, 9 aa, Artificial Sequence
  Description of Artificial Sequence: Synthetic peptide
  Seed: LIFGTASYL (TYRP1_HUMAN)
LVFGTASYW

SEQ ID NO: 178934 - protein, 9 aa, Artificial Sequence
  Description of Artificial Sequence: Synthetic peptide
  Seed: RSLHNLAHL (TYRP1_HUMAN)
RQLHNLAHL

SEQ ID NO: 178935 - protein, 11 aa, Artificial Sequence
  Description of Artificial Sequence: Synthetic peptide
  Seed: LRRYNADISTF (TYRP1_HUMAN)
LCRYNADISTF

SEQ ID NO: 178936 - protein, 9 aa, Artificial Sequence
  Description of Artificial Sequence: Synthetic peptide
  Seed: RPMVQRLPE (TYRP1_HUMAN)
RAMVQRLPL

SEQ ID NO: 178937 - protein, 9 aa, Artificial Sequence
  Description of Artificial Sequence: Synthetic peptide
  Seed: ALIFGTASY (TYRP1_HUMAN)
ASIFGTASR

SEQ ID NO: 178938 - protein, 9 aa, Artificial Sequence
  Description of Artificial Sequence: Synthetic peptide
  Seed: VARPMVQRL (TYRP1_HUMAN)
VPRPMVQRM

SEQ ID NO: 178939 - protein, 9 aa, Artificial Sequence
  Description of Artificial Sequence: Synthetic peptide
  Seed: TTHPLFVIA (TYRP1_HUMAN)
TTHPLFVIY

SEQ ID NO: 178940 - protein, 9 aa, Artificial Sequence
  Description of Artificial Sequence: Synthetic peptide
  Seed: FTDAVFDEW (TYRP1_HUMAN)
FLDAVFDEL

SEQ ID NO: 178941 - protein, 10 aa, Artificial Sequence
  Description of Artificial Sequence: Synthetic peptide
  Seed: AVFDEWLRRY (TYRP1_HUMAN)
AQFDEWLRRY

SEQ ID NO: 178942 - protein, 10 aa, Artificial Sequence
  Description of Artificial Sequence: Synthetic peptide
  Seed: FSLPYWNFAT (TYRP1_HUMAN)
FTLPYWNFAM

SEQ ID NO: 178943 - protein, 10 aa, Artificial Sequence
  Description of Artificial Sequence: Synthetic peptide
  Seed: HNRQYNMVPF (TYRP1_HUMAN)
HKRQYNMVPY

SEQ ID NO: 178944 - protein, 9 aa, Artificial Sequence
  Description of Artificial Sequence: Synthetic peptide
  Seed: HLSPNDPIF (TYRP1_HUMAN)
HVSPNDPIF

SEQ ID NO: 178945 - protein, 10 aa, Artificial Sequence
  Description of Artificial Sequence: Synthetic peptide
  Seed: IIAIAVVGAL (TYRP1_HUMAN)
ILAIAVVGAA

SEQ ID NO: 178946 - protein, 9 aa, Artificial Sequence
  Description of Artificial Sequence: Synthetic peptide
  Seed: RQYNMVPFW (TYRP1_HUMAN)
REYNMVPFY

SEQ ID NO: 178947 - protein, 11 aa, Artificial Sequence
  Description of Artificial Sequence: Synthetic peptide
  Seed: YNMVPFWPPVT (TYRP1_HUMAN)
YQMVPFWPPVS

SEQ ID NO: 178948 - protein, 9 aa, Artificial Sequence
  Description of Artificial Sequence: Synthetic peptide
  Seed: RQYNMVPFW (TYRP1_HUMAN)
RMYNMVPFH

SEQ ID NO: 178949 - protein, 11 aa, Artificial Sequence
  Description of Artificial Sequence: Synthetic peptide
  Seed: HTFTDAVFDEW (TYRP1_HUMAN)
HPFTDAVFDEF

SEQ ID NO: 178950 - protein, 9 aa, Artificial Sequence
  Description of Artificial Sequence: Synthetic peptide
  Seed: RSNFDSTLI (TYRP1_HUMAN)
RQNFDSTLM

SEQ ID NO: 178951 - protein, 9 aa, Artificial Sequence
  Description of Artificial Sequence: Synthetic peptide
  Seed: FPRQCATVE (TYRP1_HUMAN)
FPRQCATVT

SEQ ID NO: 178952 - protein, 9 aa, Artificial Sequence
  Description of Artificial Sequence: Synthetic peptide
  Seed: TFPLENAPI (TYRP1_HUMAN)
TSPLENAPL

SEQ ID NO: 178953 - protein, 10 aa, Artificial Sequence
  Description of Artificial Sequence: Synthetic peptide
  Seed: DAVFDEWLRR (TYRP1_HUMAN)
DVVFDEWLRK

SEQ ID NO: 178954 - protein, 9 aa, Artificial Sequence
  Description of Artificial Sequence: Synthetic peptide
  Seed: VPFWPPVTN (TYRP1_HUMAN)
VSFWPPVTY

SEQ ID NO: 178955 - protein, 9 aa, Artificial Sequence
  Description of Artificial Sequence: Synthetic peptide
  Seed: RGAACDQRV (TYRP1_HUMAN)
RMAACDQRI

SEQ ID NO: 178956 - protein, 10 aa, Artificial Sequence
  Description of Artificial Sequence: Synthetic peptide
  Seed: FWPPVTNTEM (TYRP1_HUMAN)
FGPPVTNTEL

SEQ ID NO: 178957 - protein, 10 aa, Artificial Sequence
  Description of Artificial Sequence: Synthetic peptide
  Seed: RRNLLDLSKE (TYRP1_HUMAN)
RRNLLDLSKY

SEQ ID NO: 178958 - protein, 10 aa, Artificial Sequence
  Description of Artificial Sequence: Synthetic peptide
  Seed: YNMVPFWPPV (TYRP1_HUMAN)
YIMVPFWPPT

SEQ ID NO: 178959 - protein, 9 aa, Artificial Sequence
  Description of Artificial Sequence: Synthetic peptide
  Seed: SMDEANQPL (TYRP1_HUMAN)
SPDEANQPV

SEQ ID NO: 178960 - protein, 9 aa, Artificial Sequence
  Description of Artificial Sequence: Synthetic peptide
  Seed: VFDEWLRRY (TYRP1_HUMAN)
VIDEWLRRW

SEQ ID NO: 178961 - protein, 8 aa, Artificial Sequence
  Description of Artificial Sequence: Synthetic peptide
  Seed: IQWPSREF (TYRP1_HUMAN)
IQWPSREM

SEQ ID NO: 178962 - protein, 9 aa, Artificial Sequence
  Description of Artificial Sequence: Synthetic peptide
  Seed: ENISIYNYF (TYRP1_HUMAN)
EIISIYNYY

SEQ ID NO: 178963 - protein, 11 aa, Artificial Sequence
  Description of Artificial Sequence: Synthetic peptide
  Seed: QEMLQEPSFSL (TYRP1_HUMAN)
QGMLQEPSFSV

SEQ ID NO: 178964 - protein, 10 aa, Artificial Sequence
  Description of Artificial Sequence: Synthetic peptide
  Seed: ALIFGTASYL (TYRP1_HUMAN)
AVIFGTASYY

SEQ ID NO: 178965 - protein, 9 aa, Artificial Sequence
  Description of Artificial Sequence: Synthetic peptide
  Seed: AQFPRQCAT (TYRP1_HUMAN)
AAFPRQCAM

SEQ ID NO: 178966 - protein, 9 aa, Artificial Sequence
  Description of Artificial Sequence: Synthetic peptide
  Seed: RQYNMVPFW (TYRP1_HUMAN)
RRYNMVPFG

SEQ ID NO: 178967 - protein, 9 aa, Artificial Sequence
  Description of Artificial Sequence: Synthetic peptide
  Seed: SVKKTFLGV (TYRP1_HUMAN)
SAKKTFLGM

SEQ ID NO: 178968 - protein, 9 aa, Artificial Sequence
  Description of Artificial Sequence: Synthetic peptide
  Seed: AIAVVGALL (TYRP1_HUMAN)
AQAVVGALF

SEQ ID NO: 178969 - protein, 10 aa, Artificial Sequence
  Description of Artificial Sequence: Synthetic peptide
  Seed: FFPLLLFQQA (TYRP1_HUMAN)
FIPLLLFQQA

SEQ ID NO: 178970 - protein, 9 aa, Artificial Sequence
  Description of Artificial Sequence: Synthetic peptide
  Seed: HLSPNDPIF (TYRP1_HUMAN)
HHSPNDPIF

SEQ ID NO: 178971 - protein, 9 aa, Artificial Sequence
  Description of Artificial Sequence: Synthetic peptide
  Seed: RAQFPRQCA (TYRP1_HUMAN)
RPQFPRQCF

SEQ ID NO: 178972 - protein, 9 aa, Artificial Sequence
  Description of Artificial Sequence: Synthetic peptide
  Seed: MSAPKLLSL (TYRP1_HUMAN)
MAAPKLLSW

SEQ ID NO: 178973 - protein, 10 aa, Artificial Sequence
  Description of Artificial Sequence: Synthetic peptide
  Seed: ADSRPHSPQY (TYRP1_HUMAN)
AMSRPHSPQF

SEQ ID NO: 178974 - protein, 9 aa, Artificial Sequence
  Description of Artificial Sequence: Synthetic peptide
  Seed: SEEILGPDG (TYRP1_HUMAN)
SEEILGPDA

SEQ ID NO: 178975 - protein, 10 aa, Artificial Sequence
  Description of Artificial Sequence: Synthetic peptide
  Seed: AVFDEWLRRY (TYRP1_HUMAN)
AMFDEWLRRF

SEQ ID NO: 178976 - protein, 9 aa, Artificial Sequence
  Description of Artificial Sequence: Synthetic peptide
  Seed: FVWTHYYSV (TYRP1_HUMAN)
FMWTHYYSP

SEQ ID NO: 178977 - protein, 10 aa, Artificial Sequence
  Description of Artificial Sequence: Synthetic peptide
  Seed: FGTASYLIRA (TYRP1_HUMAN)
FKTASYLIRV

SEQ ID NO: 178978 - protein, 10 aa, Artificial Sequence
  Description of Artificial Sequence: Synthetic peptide
  Seed: TDAVFDEWLR (TYRP1_HUMAN)
TTAVFDEWLK

SEQ ID NO: 178979 - protein, 9 aa, Artificial Sequence
  Description of Artificial Sequence: Synthetic peptide
  Seed: LIFGTASYL (TYRP1_HUMAN)
LMFGTASYH

SEQ ID NO: 178980 - protein, 10 aa, Artificial Sequence
  Description of Artificial Sequence: Synthetic peptide
  Seed: AQFPRQCATV (TYRP1_HUMAN)
AQFPRQCATM

SEQ ID NO: 178981 - protein, 9 aa, Artificial Sequence
  Description of Artificial Sequence: Synthetic peptide
  Seed: IGHNRQYNM (TYRP1_HUMAN)
IRHNRQYNL

SEQ ID NO: 178982 - protein, 9 aa, Artificial Sequence
  Description of Artificial Sequence: Synthetic peptide
  Seed: RARRSMDEA (TYRP1_HUMAN)
RTRRSMDEI

SEQ ID NO: 178983 - protein, 10 aa, Artificial Sequence
  Description of Artificial Sequence: Synthetic peptide
  Seed: TDAVFDEWLR (TYRP1_HUMAN)
THAVFDEWLR

SEQ ID NO: 178984 - protein, 9 aa, Artificial Sequence
  Description of Artificial Sequence: Synthetic peptide
  Seed: ALIFGTASY (TYRP1_HUMAN)
AMIFGTASW

SEQ ID NO: 178985 - protein, 10 aa, Artificial Sequence
  Description of Artificial Sequence: Synthetic peptide
  Seed: RRYNADISTF (TYRP1_HUMAN)
RPYNADISTF

SEQ ID NO: 178986 - protein, 10 aa, Artificial Sequence
  Description of Artificial Sequence: Synthetic peptide
  Seed: YNYFVWTHYY (TYRP1_HUMAN)
YNYFVWTHYW

SEQ ID NO: 178987 - protein, 11 aa, Artificial Sequence
  Description of Artificial Sequence: Synthetic peptide
  Seed: RRYNADISTFP (TYRP1_HUMAN)
RRYNADISTFR

SEQ ID NO: 178988 - protein, 9 aa, Artificial Sequence
  Description of Artificial Sequence: Synthetic peptide
  Seed: RNPAGNVAR (TYRP1_HUMAN)
RIPAGNVAR

SEQ ID NO: 178989 - protein, 9 aa, Artificial Sequence
  Description of Artificial Sequence: Synthetic peptide
  Seed: FYSNSTNSF (TYRP1_HUMAN)
FWSNSTNSV

SEQ ID NO: 178990 - protein, 10 aa, Artificial Sequence
  Description of Artificial Sequence: Synthetic peptide
  Seed: FWPPVTNTEM (TYRP1_HUMAN)
FYPPVTNTEM

SEQ ID NO: 178991 - protein, 10 aa, Artificial Sequence
  Description of Artificial Sequence: Synthetic peptide
  Seed: RRYNADISTF (TYRP1_HUMAN)
RTYNADISTL

SEQ ID NO: 178992 - protein, 11 aa, Artificial Sequence
  Description of Artificial Sequence: Synthetic peptide
  Seed: QEMLQEPSFSL (TYRP1_HUMAN)
QSMLQEPSFSV

SEQ ID NO: 178993 - protein, 11 aa, Artificial Sequence
  Description of Artificial Sequence: Synthetic peptide
  Seed: AGNVARPMVQR (TYRP1_HUMAN)
AWNVARPMVQK

SEQ ID NO: 178994 - protein, 9 aa, Artificial Sequence
  Description of Artificial Sequence: Synthetic peptide
  Seed: ALIFGTASY (TYRP1_HUMAN)
APIFGTASM

SEQ ID NO: 178995 - protein, 10 aa, Artificial Sequence
  Description of Artificial Sequence: Synthetic peptide
  Seed: RYNADISTFP (TYRP1_HUMAN)
RYNADISTFC

SEQ ID NO: 178996 - protein, 9 aa, Artificial Sequence
  Description of Artificial Sequence: Synthetic peptide
  Seed: HYYSVKKTF (TYRP1_HUMAN)
HVYSVKKTY

SEQ ID NO: 178997 - protein, 9 aa, Artificial Sequence
  Description of Artificial Sequence: Synthetic peptide
  Seed: NADISTFPL (TYRP1_HUMAN)
NRDISTFPM

SEQ ID NO: 178998 - protein, 8 aa, Artificial Sequence
  Description of Artificial Sequence: Synthetic peptide
  Seed: FSHEGPAF (TYRP1_HUMAN)
FVHEGPAF

SEQ ID NO: 178999 - protein, 9 aa, Artificial Sequence
  Description of Artificial Sequence: Synthetic peptide
  Seed: AVRSLHNLA (TYRP1_HUMAN)
ATRSLHNLA

SEQ ID NO: 179000 - protein, 10 aa, Artificial Sequence
  Description of Artificial Sequence: Synthetic peptide
  Seed: FTDAVFDEWL (TYRP1_HUMAN)
FMDAVFDEWY

SEQ ID NO: 179001 - protein, 9 aa, Artificial Sequence
  Description of Artificial Sequence: Synthetic peptide
  Seed: GPDGNTPQF (TYRP1_HUMAN)
GYDGNTPQI

SEQ ID NO: 179002 - protein, 9 aa, Artificial Sequence
  Description of Artificial Sequence: Synthetic peptide
  Seed: QQARAQFPR (TYRP1_HUMAN)
QAARAQFPK

SEQ ID NO: 179003 - protein, 9 aa, Artificial Sequence
  Description of Artificial Sequence: Synthetic peptide
  Seed: IFGTASYLI (TYRP1_HUMAN)
IFGTASYLL

SEQ ID NO: 179004 - protein, 10 aa, Artificial Sequence
  Description of Artificial Sequence: Synthetic peptide
  Seed: AVFDEWLRRY (TYRP1_HUMAN)
ASFDEWLRRK

SEQ ID NO: 179005 - protein, 9 aa, Artificial Sequence
  Description of Artificial Sequence: Synthetic peptide
  Seed: KYDPAVRSL (TYRP1_HUMAN)
KTDPAVRSC

SEQ ID NO: 179006 - protein, 10 aa, Artificial Sequence
  Description of Artificial Sequence: Synthetic peptide
  Seed: SHEGPAFLTW (TYRP1_HUMAN)
SDEGPAFLTW

SEQ ID NO: 179007 - protein, 10 aa, Artificial Sequence
  Description of Artificial Sequence: Synthetic peptide
  Seed: MVPFWPPVTN (TYRP1_HUMAN)
MHPFWPPVTY

SEQ ID NO: 179008 - protein, 11 aa, Artificial Sequence
  Description of Artificial Sequence: Synthetic peptide
  Seed: FWPPVTNTEMF (TYRP1_HUMAN)
FIPPVTNTEMW

SEQ ID NO: 179009 - protein, 9 aa, Artificial Sequence
  Description of Artificial Sequence: Synthetic peptide
  Seed: TLISPNSVF (TYRP1_HUMAN)
TMISPNSVL

SEQ ID NO: 179010 - protein, 11 aa, Artificial Sequence
  Description of Artificial Sequence: Synthetic peptide
  Seed: RRYNADISTFP (TYRP1_HUMAN)
RFYNADISTFW

SEQ ID NO: 179011 - protein, 11 aa, Artificial Sequence
  Description of Artificial Sequence: Synthetic peptide
  Seed: MFVTAPDNLGY (TYRP1_HUMAN)
MGVTAPDNLGF

SEQ ID NO: 179012 - protein, 11 aa, Artificial Sequence
  Description of Artificial Sequence: Synthetic peptide
  Seed: REFSVPEIIAI (TYRP1_HUMAN)
RMFSVPEIIAF

SEQ ID NO: 179013 - protein, 9 aa, Artificial Sequence
  Description of Artificial Sequence: Synthetic peptide
  Seed: SPNSVFSQW (TYRP1_HUMAN)
SLNSVFSQF

SEQ ID NO: 179014 - protein, 9 aa, Artificial Sequence
  Description of Artificial Sequence: Synthetic peptide
  Seed: KYDPAVRSL (TYRP1_HUMAN)
KCDPAVRSI

SEQ ID NO: 179015 - protein, 11 aa, Artificial Sequence
  Description of Artificial Sequence: Synthetic peptide
  Seed: ALIFGTASYLI (TYRP1_HUMAN)
AMIFGTASYLI

SEQ ID NO: 179016 - protein, 10 aa, Artificial Sequence
  Description of Artificial Sequence: Synthetic peptide
  Seed: RSMDEANQPL (TYRP1_HUMAN)
REMDEANQPY

SEQ ID NO: 179017 - protein, 9 aa, Artificial Sequence
  Description of Artificial Sequence: Synthetic peptide
  Seed: YNYFVWTHY (TYRP1_HUMAN)
YIYFVWTHF

SEQ ID NO: 179018 - protein, 10 aa, Artificial Sequence
  Description of Artificial Sequence: Synthetic peptide
  Seed: LSPNDPIFVL (TYRP1_HUMAN)
LDPNDPIFVW

SEQ ID NO: 179019 - protein, 11 aa, Artificial Sequence
  Description of Artificial Sequence: Synthetic peptide
  Seed: QEMLQEPSFSL (TYRP1_HUMAN)
QQMLQEPSFSV

SEQ ID NO: 179020 - protein, 8 aa, Artificial Sequence
  Description of Artificial Sequence: Synthetic peptide
  Seed: LPYWNFAT (TYRP1_HUMAN)
LPYWNFAA

SEQ ID NO: 179021 - protein, 10 aa, Artificial Sequence
  Description of Artificial Sequence: Synthetic peptide
  Seed: LSPNDPIFVL (TYRP1_HUMAN)
LTPNDPIFVY

SEQ ID NO: 179022 - protein, 11 aa, Artificial Sequence
  Description of Artificial Sequence: Synthetic peptide
  Seed: LRRYNADISTF (TYRP1_HUMAN)
LMRYNADISTF

SEQ ID NO: 179023 - protein, 10 aa, Artificial Sequence
  Description of Artificial Sequence: Synthetic peptide
  Seed: YNYFVWTHYY (TYRP1_HUMAN)
YVYFVWTHYM

SEQ ID NO: 179024 - protein, 9 aa, Artificial Sequence
  Description of Artificial Sequence: Synthetic peptide
  Seed: STNSFRNTV (TYRP1_HUMAN)
SSNSFRNTV

SEQ ID NO: 179025 - protein, 11 aa, Artificial Sequence
  Description of Artificial Sequence: Synthetic peptide
  Seed: RSMDEANQPLL (TYRP1_HUMAN)
REMDEANQPLL

SEQ ID NO: 179026 - protein, 9 aa, Artificial Sequence
  Description of Artificial Sequence: Synthetic peptide
  Seed: TTHPLFVIA (TYRP1_HUMAN)
TAHPLFVIL

SEQ ID NO: 179027 - protein, 9 aa, Artificial Sequence
  Description of Artificial Sequence: Synthetic peptide
  Seed: NMVPFWPPV (TYRP1_HUMAN)
NYVPFWPPL

SEQ ID NO: 179028 - protein, 10 aa, Artificial Sequence
  Description of Artificial Sequence: Synthetic peptide
  Seed: SREFSVPEII (TYRP1_HUMAN)
SKEFSVPEIL

SEQ ID NO: 179029 - protein, 9 aa, Artificial Sequence
  Description of Artificial Sequence: Synthetic peptide
  Seed: MAKRTTHPL (TYRP1_HUMAN)
MMKRTTHPA

SEQ ID NO: 179030 - protein, 10 aa, Artificial Sequence
  Description of Artificial Sequence: Synthetic peptide
  Seed: EVWPLRFFNR (TYRP1_HUMAN)
EGWPLRFFNR

SEQ ID NO: 179031 - protein, 10 aa, Artificial Sequence
  Description of Artificial Sequence: Synthetic peptide
  Seed: FLTWHRYHLL (TYRP1_HUMAN)
FYTWHRYHLV

SEQ ID NO: 179032 - protein, 11 aa, Artificial Sequence
  Description of Artificial Sequence: Synthetic peptide
  Seed: YNMVPFWPPVT (TYRP1_HUMAN)
YIMVPFWPPVD

SEQ ID NO: 179033 - protein, 9 aa, Artificial Sequence
  Description of Artificial Sequence: Synthetic peptide
  Seed: EDYDTLGTL (TYRP1_HUMAN)
EEYDTLGTT

SEQ ID NO: 179034 - protein, 9 aa, Artificial Sequence
  Description of Artificial Sequence: Synthetic peptide
  Seed: RQYNMVPFW (TYRP1_HUMAN)
RQYNMVPFK

SEQ ID NO: 179035 - protein, 9 aa, Artificial Sequence
  Description of Artificial Sequence: Synthetic peptide
  Seed: YTYEIQWPS (TYRP1_HUMAN)
YNYEIQWPR

SEQ ID NO: 179036 - protein, 9 aa, Artificial Sequence
  Description of Artificial Sequence: Synthetic peptide
  Seed: DAVFDEWLR (TYRP1_HUMAN)
DVVFDEWLK

SEQ ID NO: 179037 - protein, 10 aa, Artificial Sequence
  Description of Artificial Sequence: Synthetic peptide
  Seed: EMLQEPSFSL (TYRP1_HUMAN)
EYLQEPSFSL

SEQ ID NO: 179038 - protein, 9 aa, Artificial Sequence
  Description of Artificial Sequence: Synthetic peptide
  Seed: AACDQRVLI (TYRP1_HUMAN)
AQCDQRVLL

SEQ ID NO: 179039 - protein, 9 aa, Artificial Sequence
  Description of Artificial Sequence: Synthetic peptide
  Seed: AACDQRVLI (TYRP1_HUMAN)
ATCDQRVLY

SEQ ID NO: 179040 - protein, 9 aa, Artificial Sequence
  Description of Artificial Sequence: Synthetic peptide
  Seed: LTWHRYHLL (TYRP1_HUMAN)
LLWHRYHLA

SEQ ID NO: 179041 - protein, 9 aa, Artificial Sequence
  Description of Artificial Sequence: Synthetic peptide
  Seed: SVFSQWRVV (TYRP1_HUMAN)
SSFSQWRVA

SEQ ID NO: 179042 - protein, 9 aa, Artificial Sequence
  Description of Artificial Sequence: Synthetic peptide
  Seed: GCIFFPLLL (TYRP1_HUMAN)
GSIFFPLLL

SEQ ID NO: 179043 - protein, 10 aa, Artificial Sequence
  Description of Artificial Sequence: Synthetic peptide
  Seed: QEPSFSLPYW (TYRP1_HUMAN)
QMPSFSLPYW

SEQ ID NO: 179044 - protein, 10 aa, Artificial Sequence
  Description of Artificial Sequence: Synthetic peptide
  Seed: NYFVWTHYYS (TYRP1_HUMAN)
NVFVWTHYYF

SEQ ID NO: 179045 - protein, 10 aa, Artificial Sequence
  Description of Artificial Sequence: Synthetic peptide
  Seed: VGLFDTPPFY (TYRP1_HUMAN)
VYLFDTPPFK

SEQ ID NO: 179046 - protein, 10 aa, Artificial Sequence
  Description of Artificial Sequence: Synthetic peptide
  Seed: WPPVTNTEMF (TYRP1_HUMAN)
WDPVTNTEMW

SEQ ID NO: 179047 - protein, 10 aa, Artificial Sequence
  Description of Artificial Sequence: Synthetic peptide
  Seed: HLSPNDPIFV (TYRP1_HUMAN)
HMSPNDPIFI

SEQ ID NO: 179048 - protein, 10 aa, Artificial Sequence
  Description of Artificial Sequence: Synthetic peptide
  Seed: GLFDTPPFYS (TYRP1_HUMAN)
GSFDTPPFYI

SEQ ID NO: 179049 - protein, 9 aa, Artificial Sequence
  Description of Artificial Sequence: Synthetic peptide
  Seed: KLLSLGCIF (TYRP1_HUMAN)
KILSLGCIY

SEQ ID NO: 179050 - protein, 9 aa, Artificial Sequence
  Description of Artificial Sequence: Synthetic peptide
  Seed: QEPSFSLPY (TYRP1_HUMAN)
QKPSFSLPF

SEQ ID NO: 179051 - protein, 10 aa, Artificial Sequence
  Description of Artificial Sequence: Synthetic peptide
  Seed: LLTDQYQCYA (TYRP1_HUMAN)
LITDQYQCYV

SEQ ID NO: 179052 - protein, 10 aa, Artificial Sequence
  Description of Artificial Sequence: Synthetic peptide
  Seed: ALIFGTASYL (TYRP1_HUMAN)
AKIFGTASYV

SEQ ID NO: 179053 - protein, 10 aa, Artificial Sequence
  Description of Artificial Sequence: Synthetic peptide
  Seed: ADSRPHSPQY (TYRP1_HUMAN)
ATSRPHSPQI

SEQ ID NO: 179054 - protein, 9 aa, Artificial Sequence
  Description of Artificial Sequence: Synthetic peptide
  Seed: SVKKTFLGV (TYRP1_HUMAN)
SAKKTFLGA

SEQ ID NO: 179055 - protein, 10 aa, Artificial Sequence
  Description of Artificial Sequence: Synthetic peptide
  Seed: IIAIAVVGAL (TYRP1_HUMAN)
IMAIAVVGAV

SEQ ID NO: 179056 - protein, 10 aa, Artificial Sequence
  Description of Artificial Sequence: Synthetic peptide
  Seed: ALIFGTASYL (TYRP1_HUMAN)
AMIFGTASYY

SEQ ID NO: 179057 - protein, 9 aa, Artificial Sequence
  Description of Artificial Sequence: Synthetic peptide
  Seed: DSRPHSPQY (TYRP1_HUMAN)
DIRPHSPQK

SEQ ID NO: 179058 - protein, 10 aa, Artificial Sequence
  Description of Artificial Sequence: Synthetic peptide
  Seed: ALIFGTASYL (TYRP1_HUMAN)
AGIFGTASYV

SEQ ID NO: 179059 - protein, 9 aa, Artificial Sequence
  Description of Artificial Sequence: Synthetic peptide
  Seed: SMDEANQPL (TYRP1_HUMAN)
SLDEANQPW

SEQ ID NO: 179060 - protein, 9 aa, Artificial Sequence
  Description of Artificial Sequence: Synthetic peptide
  Seed: RYHLLRLEK (TYRP1_HUMAN)
RSHLLRLEV

SEQ ID NO: 179061 - protein, 10 aa, Artificial Sequence
  Description of Artificial Sequence: Synthetic peptide
  Seed: MAKRTTHPLF (TYRP1_HUMAN)
MPKRTTHPLE

SEQ ID NO: 179062 - protein, 9 aa, Artificial Sequence
  Description of Artificial Sequence: Synthetic peptide
  Seed: RQCATVEAL (TYRP1_HUMAN)
RACATVEAY

SEQ ID NO: 179063 - protein, 10 aa, Artificial Sequence
  Description of Artificial Sequence: Synthetic peptide
  Seed: RVVCDSLEDY (TYRP1_HUMAN)
RKVCDSLEDF

SEQ ID NO: 179064 - protein, 9 aa, Artificial Sequence
  Description of Artificial Sequence: Synthetic peptide
  Seed: FENISIYNY (TYRP1_HUMAN)
FTNISIYNY

SEQ ID NO: 179065 - protein, 11 aa, Artificial Sequence
  Description of Artificial Sequence: Synthetic peptide
  Seed: RRYNADISTFP (TYRP1_HUMAN)
RYYNADISTFE

SEQ ID NO: 179066 - protein, 8 aa, Artificial Sequence
  Description of Artificial Sequence: Synthetic peptide
  Seed: YSNSTNSF (TYRP1_HUMAN)
YMNSTNSF

SEQ ID NO: 179067 - protein, 11 aa, Artificial Sequence
  Description of Artificial Sequence: Synthetic peptide
  Seed: YNYFVWTHYYS (TYRP1_HUMAN)
YTYFVWTHYYY

SEQ ID NO: 179068 - protein, 9 aa, Artificial Sequence
  Description of Artificial Sequence: Synthetic peptide
  Seed: FYSNSTNSF (TYRP1_HUMAN)
FWSNSTNSL

SEQ ID NO: 179069 - protein, 10 aa, Artificial Sequence
  Description of Artificial Sequence: Synthetic peptide
  Seed: PSFSLPYWNF (TYRP1_HUMAN)
PYFSLPYWNL

SEQ ID NO: 179070 - protein, 9 aa, Artificial Sequence
  Description of Artificial Sequence: Synthetic peptide
  Seed: YYSVKKTFL (TYRP1_HUMAN)
YWSVKKTFM

SEQ ID NO: 179071 - protein, 10 aa, Artificial Sequence
  Description of Artificial Sequence: Synthetic peptide
  Seed: GLFDTPPFYS (TYRP1_HUMAN)
GLFDTPPFYL

SEQ ID NO: 179072 - protein, 10 aa, Artificial Sequence
  Description of Artificial Sequence: Synthetic peptide
  Seed: RSLHNLAHLF (TYRP1_HUMAN)
RGLHNLAHLY

SEQ ID NO: 179073 - protein, 10 aa, Artificial Sequence
  Description of Artificial Sequence: Synthetic peptide
  Seed: TAPDNLGYTY (TYRP1_HUMAN)
TLPDNLGYTM

SEQ ID NO: 179074 - protein, 9 aa, Artificial Sequence
  Description of Artificial Sequence: Synthetic peptide
  Seed: VFDEWLRRY (TYRP1_HUMAN)
VQDEWLRRI

SEQ ID NO: 179075 - protein, 9 aa, Artificial Sequence
  Description of Artificial Sequence: Synthetic peptide
  Seed: FSHEGPAFL (TYRP1_HUMAN)
FQHEGPAFT

SEQ ID NO: 179076 - protein, 10 aa, Artificial Sequence
  Description of Artificial Sequence: Synthetic peptide
  Seed: FGTASYLIRA (TYRP1_HUMAN)
FVTASYLIRL

SEQ ID NO: 179077 - protein, 10 aa, Artificial Sequence
  Description of Artificial Sequence: Synthetic peptide
  Seed: KYDPAVRSLH (TYRP1_HUMAN)
KQDPAVRSLY

SEQ ID NO: 179078 - protein, 10 aa, Artificial Sequence
  Description of Artificial Sequence: Synthetic peptide
  Seed: LSPNDPIFVL (TYRP1_HUMAN)
LIPNDPIFVM

SEQ ID NO: 179079 - protein, 11 aa, Artificial Sequence
  Description of Artificial Sequence: Synthetic peptide
  Seed: RSMDEANQPLL (TYRP1_HUMAN)
RLMDEANQPLW

SEQ ID NO: 179080 - protein, 9 aa, Artificial Sequence
  Description of Artificial Sequence: Synthetic peptide
  Seed: GYSDPTGKY (TYRP1_HUMAN)
GVSDPTGKF

SEQ ID NO: 179081 - protein, 9 aa, Artificial Sequence
  Description of Artificial Sequence: Synthetic peptide
  Seed: RYNADISTF (TYRP1_HUMAN)
RQNADISTM

SEQ ID NO: 179082 - protein, 9 aa, Artificial Sequence
  Description of Artificial Sequence: Synthetic peptide
  Seed: SRSNFDSTL (TYRP1_HUMAN)
SRSNFDSTY

SEQ ID NO: 179083 - protein, 9 aa, Artificial Sequence
  Description of Artificial Sequence: Synthetic peptide
  Seed: KYDPAVRSL (TYRP1_HUMAN)
KIDPAVRSI

SEQ ID NO: 179084 - protein, 10 aa, Artificial Sequence
  Description of Artificial Sequence: Synthetic peptide
  Seed: FYSNSTNSFR (TYRP1_HUMAN)
FFSNSTNSFY

SEQ ID NO: 179085 - protein, 9 aa, Artificial Sequence
  Description of Artificial Sequence: Synthetic peptide
  Seed: MLQEPSFSL (TYRP1_HUMAN)
MSQEPSFSM

SEQ ID NO: 179086 - protein, 10 aa, Artificial Sequence
  Description of Artificial Sequence: Synthetic peptide
  Seed: HPLFVIATRR (TYRP1_HUMAN)
HVLFVIATRK

SEQ ID NO: 179087 - protein, 9 aa, Artificial Sequence
  Description of Artificial Sequence: Synthetic peptide
  Seed: HEGPAFLTW (TYRP1_HUMAN)
HSGPAFLTF

SEQ ID NO: 179088 - protein, 11 aa, Artificial Sequence
  Description of Artificial Sequence: Synthetic peptide
  Seed: FLNGTGGQTHL (TYRP1_HUMAN)
FYNGTGGQTHY

SEQ ID NO: 179089 - protein, 9 aa, Artificial Sequence
  Description of Artificial Sequence: Synthetic peptide
  Seed: FSHEGPAFL (TYRP1_HUMAN)
FQHEGPAFF

SEQ ID NO: 179090 - protein, 9 aa, Artificial Sequence
  Description of Artificial Sequence: Synthetic peptide
  Seed: APDNLGYTY (TYRP1_HUMAN)
AADNLGYTF

SEQ ID NO: 179091 - protein, 9 aa, Artificial Sequence
  Description of Artificial Sequence: Synthetic peptide
  Seed: VVGALLLVA (TYRP1_HUMAN)
VLGALLLVI

SEQ ID NO: 179092 - protein, 11 aa, Artificial Sequence
  Description of Artificial Sequence: Synthetic peptide
  Seed: REVWPLRFFNR (TYRP1_HUMAN)
RSVWPLRFFNK

SEQ ID NO: 179093 - protein, 9 aa, Artificial Sequence
  Description of Artificial Sequence: Synthetic peptide
  Seed: LFQQARAQF (TYRP1_HUMAN)
LQQQARAQY

SEQ ID NO: 179094 - protein, 10 aa, Artificial Sequence
  Description of Artificial Sequence: Synthetic peptide
  Seed: IYNYFVWTHY (TYRP1_HUMAN)
ISNYFVWTHY

SEQ ID NO: 179095 - protein, 9 aa, Artificial Sequence
  Description of Artificial Sequence: Synthetic peptide
  Seed: RLEKDMQEM (TYRP1_HUMAN)
RMEKDMQEF

SEQ ID NO: 179096 - protein, 9 aa, Artificial Sequence
  Description of Artificial Sequence: Synthetic peptide
  Seed: AFLTWHRYH (TYRP1_HUMAN)
AWLTWHRYK

SEQ ID NO: 179097 - protein, 9 aa, Artificial Sequence
  Description of Artificial Sequence: Synthetic peptide
  Seed: SLPYWNFAT (TYRP1_HUMAN)
STPYWNFAI

SEQ ID NO: 179098 - protein, 9 aa, Artificial Sequence
  Description of Artificial Sequence: Synthetic peptide
  Seed: FYSNSTNSF (TYRP1_HUMAN)
FGSNSTNSL

SEQ ID NO: 179099 - protein, 9 aa, Artificial Sequence
  Description of Artificial Sequence: Synthetic peptide
  Seed: TFPLENAPI (TYRP1_HUMAN)
TYPLENAPL

SEQ ID NO: 179100 - protein, 9 aa, Artificial Sequence
  Description of Artificial Sequence: Synthetic peptide
  Seed: FLGVGQESF (TYRP1_HUMAN)
FAGVGQESM

SEQ ID NO: 179101 - protein, 9 aa, Artificial Sequence
  Description of Artificial Sequence: Synthetic peptide
  Seed: REFSVPEII (TYRP1_HUMAN)
RDFSVPEIF

SEQ ID NO: 179102 - protein, 10 aa, Artificial Sequence
  Description of Artificial Sequence: Synthetic peptide
  Seed: AVRSLHNLAH (TYRP1_HUMAN)
AGRSLHNLAK

SEQ ID NO: 179103 - protein, 9 aa, Artificial Sequence
  Description of Artificial Sequence: Synthetic peptide
  Seed: YTYEIQWPS (TYRP1_HUMAN)
YQYEIQWPR

SEQ ID NO: 179104 - protein, 9 aa, Artificial Sequence
  Description of Artificial Sequence: Synthetic peptide
  Seed: RYNADISTF (TYRP1_HUMAN)
RLNADISTM

SEQ ID NO: 179105 - protein, 10 aa, Artificial Sequence
  Description of Artificial Sequence: Synthetic peptide
  Seed: APKLLSLGCI (TYRP1_HUMAN)
APKLLSLGCL

SEQ ID NO: 179106 - protein, 10 aa, Artificial Sequence
  Description of Artificial Sequence: Synthetic peptide
  Seed: FVTAPDNLGY (TYRP1_HUMAN)
FATAPDNLGY

SEQ ID NO: 179107 - protein, 10 aa, Artificial Sequence
  Description of Artificial Sequence: Synthetic peptide
  Seed: FVWTHYYSVK (TYRP1_HUMAN)
FMWTHYYSVK

SEQ ID NO: 179108 - protein, 9 aa, Artificial Sequence
  Description of Artificial Sequence: Synthetic peptide
  Seed: SPNDPIFVL (TYRP1_HUMAN)
SRNDPIFVY

SEQ ID NO: 179109 - protein, 10 aa, Artificial Sequence
  Description of Artificial Sequence: Synthetic peptide
  Seed: FSVPEIIAIA (TYRP1_HUMAN)
FMVPEIIAIM

SEQ ID NO: 179110 - protein, 9 aa, Artificial Sequence
  Description of Artificial Sequence: Synthetic peptide
  Seed: NYFVWTHYY (TYRP1_HUMAN)
NAFVWTHYY

SEQ ID NO: 179111 - protein, 9 aa, Artificial Sequence
  Description of Artificial Sequence: Synthetic peptide
  Seed: SLGCIFFPL (TYRP1_HUMAN)
SMGCIFFPS

SEQ ID NO: 179112 - protein, 10 aa, Artificial Sequence
  Description of Artificial Sequence: Synthetic peptide
  Seed: FGTASYLIRA (TYRP1_HUMAN)
FVTASYLIRI

SEQ ID NO: 179113 - protein, 9 aa, Artificial Sequence
  Description of Artificial Sequence: Synthetic peptide
  Seed: ASYLIRARR (TYRP1_HUMAN)
AIYLIRARK

SEQ ID NO: 179114 - protein, 9 aa, Artificial Sequence
  Description of Artificial Sequence: Synthetic peptide
  Seed: SLPYWNFAT (TYRP1_HUMAN)
SIPYWNFAV

SEQ ID NO: 179115 - protein, 9 aa, Artificial Sequence
  Description of Artificial Sequence: Synthetic peptide
  Seed: LLHTFTDAV (TYRP1_HUMAN)
LQHTFTDAI

SEQ ID NO: 179116 - protein, 9 aa, Artificial Sequence
  Description of Artificial Sequence: Synthetic peptide
  Seed: LTWHRYHLL (TYRP1_HUMAN)
LAWHRYHLR

SEQ ID NO: 179117 - protein, 9 aa, Artificial Sequence
  Description of Artificial Sequence: Synthetic peptide
  Seed: HYYSVKKTF (TYRP1_HUMAN)
HSYSVKKTI

SEQ ID NO: 179118 - protein, 10 aa, Artificial Sequence
  Description of Artificial Sequence: Synthetic peptide
  Seed: VALIFGTASY (TYRP1_HUMAN)
VQLIFGTASL

SEQ ID NO: 179119 - protein, 9 aa, Artificial Sequence
  Description of Artificial Sequence: Synthetic peptide
  Seed: RSLHNLAHL (TYRP1_HUMAN)
RALHNLAHV

SEQ ID NO: 179120 - protein, 10 aa, Artificial Sequence
  Description of Artificial Sequence: Synthetic peptide
  Seed: ADSRPHSPQY (TYRP1_HUMAN)
AESRPHSPQV

SEQ ID NO: 179121 - protein, 9 aa, Artificial Sequence
  Description of Artificial Sequence: Synthetic peptide
  Seed: LSPNDPIFV (TYRP1_HUMAN)
LLPNDPIFI

SEQ ID NO: 179122 - protein, 9 aa, Artificial Sequence
  Description of Artificial Sequence: Synthetic peptide
  Seed: LTDQYQCYA (TYRP1_HUMAN)
LLDQYQCYY

SEQ ID NO: 179123 - protein, 9 aa, Artificial Sequence
  Description of Artificial Sequence: Synthetic peptide
  Seed: SRSNFDSTL (TYRP1_HUMAN)
SMSNFDSTM

SEQ ID NO: 179124 - protein, 8 aa, Artificial Sequence
  Description of Artificial Sequence: Synthetic peptide
  Seed: QYNMVPFW (TYRP1_HUMAN)
QYNMVPFF

SEQ ID NO: 179125 - protein, 9 aa, Artificial Sequence
  Description of Artificial Sequence: Synthetic peptide
  Seed: RTTHPLFVI (TYRP1_HUMAN)
RSTHPLFVW

SEQ ID NO: 179126 - protein, 9 aa, Artificial Sequence
  Description of Artificial Sequence: Synthetic peptide
  Seed: FTDAVFDEW (TYRP1_HUMAN)
FSDAVFDEW

SEQ ID NO: 179127 - protein, 9 aa, Artificial Sequence
  Description of Artificial Sequence: Synthetic peptide
  Seed: AIAVVGALL (TYRP1_HUMAN)
AAAVVGALL

SEQ ID NO: 179128 - protein, 11 aa, Artificial Sequence
  Description of Artificial Sequence: Synthetic peptide
  Seed: LPEPQDVAQCL (TYRP1_HUMAN)
LPEPQDVAQCW

SEQ ID NO: 179129 - protein, 9 aa, Artificial Sequence
  Description of Artificial Sequence: Synthetic peptide
  Seed: TADSRPHSP (TYRP1_HUMAN)
TMDSRPHSI

SEQ ID NO: 179130 - protein, 9 aa, Artificial Sequence
  Description of Artificial Sequence: Synthetic peptide
  Seed: ENAPIGHNR (TYRP1_HUMAN)
EVAPIGHNK

SEQ ID NO: 179131 - protein, 10 aa, Artificial Sequence
  Description of Artificial Sequence: Synthetic peptide
  Seed: FVLLHTFTDA (TYRP1_HUMAN)
FTLLHTFTDI

SEQ ID NO: 179132 - protein, 11 aa, Artificial Sequence
  Description of Artificial Sequence: Synthetic peptide
  Seed: YNYFVWTHYYS (TYRP1_HUMAN)
YYYFVWTHYYM

SEQ ID NO: 179133 - protein, 9 aa, Artificial Sequence
  Description of Artificial Sequence: Synthetic peptide
  Seed: FYSNSTNSF (TYRP1_HUMAN)
FASNSTNSM

SEQ ID NO: 179134 - protein, 10 aa, Artificial Sequence
  Description of Artificial Sequence: Synthetic peptide
  Seed: FSLPYWNFAT (TYRP1_HUMAN)
FVLPYWNFAM

SEQ ID NO: 179135 - protein, 9 aa, Artificial Sequence
  Description of Artificial Sequence: Synthetic peptide
  Seed: MDEANQPLL (TYRP1_HUMAN)
MEEANQPLM

SEQ ID NO: 179136 - protein, 10 aa, Artificial Sequence
  Description of Artificial Sequence: Synthetic peptide
  Seed: FSVPEIIAIA (TYRP1_HUMAN)
FIVPEIIAIA

SEQ ID NO: 179137 - protein, 9 aa, Artificial Sequence
  Description of Artificial Sequence: Synthetic peptide
  Seed: RGAACDQRV (TYRP1_HUMAN)
RQAACDQRI

SEQ ID NO: 179138 - protein, 10 aa, Artificial Sequence
  Description of Artificial Sequence: Synthetic peptide
  Seed: RPMVQRLPEP (TYRP1_HUMAN)
RPMVQRLPEL

SEQ ID NO: 179139 - protein, 9 aa, Artificial Sequence
  Description of Artificial Sequence: Synthetic peptide
  Seed: SIYNYFVWT (TYRP1_HUMAN)
SLYNYFVWI

SEQ ID NO: 179140 - protein, 10 aa, Artificial Sequence
  Description of Artificial Sequence: Synthetic peptide
  Seed: YSNSTNSFRN (TYRP1_HUMAN)
YYNSTNSFRR

SEQ ID NO: 179141 - protein, 11 aa, Artificial Sequence
  Description of Artificial Sequence: Synthetic peptide
  Seed: HLSPNDPIFVL (TYRP1_HUMAN)
HMSPNDPIFVL

SEQ ID NO: 179142 - protein, 9 aa, Artificial Sequence
  Description of Artificial Sequence: Synthetic peptide
  Seed: RYNADISTF (TYRP1_HUMAN)
RQNADISTH

SEQ ID NO: 179143 - protein, 9 aa, Artificial Sequence
  Description of Artificial Sequence: Synthetic peptide
  Seed: SFSLPYWNF (TYRP1_HUMAN)
SYSLPYWNL

SEQ ID NO: 179144 - protein, 9 aa, Artificial Sequence
  Description of Artificial Sequence: Synthetic peptide
  Seed: NFDSTLISP (TYRP1_HUMAN)
NFDSTLISV

SEQ ID NO: 179145 - protein, 10 aa, Artificial Sequence
  Description of Artificial Sequence: Synthetic peptide
  Seed: VLLHTFTDAV (TYRP1_HUMAN)
VLLHTFTDAL

SEQ ID NO: 179146 - protein, 9 aa, Artificial Sequence
  Description of Artificial Sequence: Synthetic peptide
  Seed: RSLHNLAHL (TYRP1_HUMAN)
RRLHNLAHF

SEQ ID NO: 179147 - protein, 9 aa, Artificial Sequence
  Description of Artificial Sequence: Synthetic peptide
  Seed: SLPYWNFAT (TYRP1_HUMAN)
SIPYWNFAL

SEQ ID NO: 179148 - protein, 9 aa, Artificial Sequence
  Description of Artificial Sequence: Synthetic peptide
  Seed: ISIYNYFVW (TYRP1_HUMAN)
IYIYNYFVF

SEQ ID NO: 179149 - protein, 9 aa, Artificial Sequence
  Description of Artificial Sequence: Synthetic peptide
  Seed: RPHSPQYPH (TYRP1_HUMAN)
RPHSPQYPI

SEQ ID NO: 179150 - protein, 10 aa, Artificial Sequence
  Description of Artificial Sequence: Synthetic peptide
  Seed: FVWTHYYSVK (TYRP1_HUMAN)
FLWTHYYSVM

SEQ ID NO: 179151 - protein, 9 aa, Artificial Sequence
  Description of Artificial Sequence: Synthetic peptide
  Seed: FLTWHRYHL (TYRP1_HUMAN)
FTTWHRYHV

SEQ ID NO: 179152 - protein, 11 aa, Artificial Sequence
  Description of Artificial Sequence: Synthetic peptide
  Seed: REVWPLRFFNR (TYRP1_HUMAN)
RYVWPLRFFNR

SEQ ID NO: 179153 - protein, 9 aa, Artificial Sequence
  Description of Artificial Sequence: Synthetic peptide
  Seed: MAKRTTHPL (TYRP1_HUMAN)
MPKRTTHPT

SEQ ID NO: 179154 - protein, 10 aa, Artificial Sequence
  Description of Artificial Sequence: Synthetic peptide
  Seed: FSLPYWNFAT (TYRP1_HUMAN)
FDLPYWNFAL

SEQ ID NO: 179155 - protein, 11 aa, Artificial Sequence
  Description of Artificial Sequence: Synthetic peptide
  Seed: RRSMDEANQPL (TYRP1_HUMAN)
RISMDEANQPV

SEQ ID NO: 179156 - protein, 11 aa, Artificial Sequence
  Description of Artificial Sequence: Synthetic peptide
  Seed: FWPPVTNTEMF (TYRP1_HUMAN)
FAPPVTNTEMW

SEQ ID NO: 179157 - protein, 10 aa, Artificial Sequence
  Description of Artificial Sequence: Synthetic peptide
  Seed: GNVARPMVQR (TYRP1_HUMAN)
GFVARPMVQK

SEQ ID NO: 179158 - protein, 8 aa, Artificial Sequence
  Description of Artificial Sequence: Synthetic peptide
  Seed: LFDTPPFY (TYRP1_HUMAN)
LWDTPPFL

SEQ ID NO: 179159 - protein, 9 aa, Artificial Sequence
  Description of Artificial Sequence: Synthetic peptide
  Seed: RTTHPLFVI (TYRP1_HUMAN)
RYTHPLFVY

SEQ ID NO: 179160 - protein, 10 aa, Artificial Sequence
  Description of Artificial Sequence: Synthetic peptide
  Seed: AIAVVGALLL (TYRP1_HUMAN)
AMAVVGALLL

SEQ ID NO: 179161 - protein, 9 aa, Artificial Sequence
  Description of Artificial Sequence: Synthetic peptide
  Seed: LLSLGCIFF (TYRP1_HUMAN)
LYSLGCIFY

SEQ ID NO: 179162 - protein, 10 aa, Artificial Sequence
  Description of Artificial Sequence: Synthetic peptide
  Seed: YFVWTHYYSV (TYRP1_HUMAN)
YHVWTHYYSF

SEQ ID NO: 179163 - protein, 10 aa, Artificial Sequence
  Description of Artificial Sequence: Synthetic peptide
  Seed: VLLHTFTDAV (TYRP1_HUMAN)
VFLHTFTDAL

SEQ ID NO: 179164 - protein, 9 aa, Artificial Sequence
  Description of Artificial Sequence: Synthetic peptide
  Seed: AVRSLHNLA (TYRP1_HUMAN)
APRSLHNLA

SEQ ID NO: 179165 - protein, 9 aa, Artificial Sequence
  Description of Artificial Sequence: Synthetic peptide
  Seed: VCDICTDDL (TYRP1_HUMAN)
VIDICTDDL

SEQ ID NO: 179166 - protein, 9 aa, Artificial Sequence
  Description of Artificial Sequence: Synthetic peptide
  Seed: VGQESFGEV (TYRP1_HUMAN)
VLQESFGEL

SEQ ID NO: 179167 - protein, 11 aa, Artificial Sequence
  Description of Artificial Sequence: Synthetic peptide
  Seed: FLNGTGGQTHL (TYRP1_HUMAN)
FYNGTGGQTHF

SEQ ID NO: 179168 - protein, 9 aa, Artificial Sequence
  Description of Artificial Sequence: Synthetic peptide
  Seed: AVRSLHNLA (TYRP1_HUMAN)
AWRSLHNLK

SEQ ID NO: 179169 - protein, 11 aa, Artificial Sequence
  Description of Artificial Sequence: Synthetic peptide
  Seed: IYNYFVWTHYY (TYRP1_HUMAN)
INNYFVWTHYF

SEQ ID NO: 179170 - protein, 10 aa, Artificial Sequence
  Description of Artificial Sequence: Synthetic peptide
  Seed: WPPVTNTEMF (TYRP1_HUMAN)
WVPVTNTEMY

SEQ ID NO: 179171 - protein, 9 aa, Artificial Sequence
  Description of Artificial Sequence: Synthetic peptide
  Seed: SPNDPIFVL (TYRP1_HUMAN)
SVNDPIFVL

SEQ ID NO: 179172 - protein, 9 aa, Artificial Sequence
  Description of Artificial Sequence: Synthetic peptide
  Seed: FLNGTGGQT (TYRP1_HUMAN)
FMNGTGGQM

SEQ ID NO: 179173 - protein, 10 aa, Artificial Sequence
  Description of Artificial Sequence: Synthetic peptide
  Seed: SQWRVVCDSL (TYRP1_HUMAN)
SMWRVVCDSL

SEQ ID NO: 179174 - protein, 9 aa, Artificial Sequence
  Description of Artificial Sequence: Synthetic peptide
  Seed: FLGVGQESF (TYRP1_HUMAN)
FPGVGQESM

SEQ ID NO: 179175 - protein, 9 aa, Artificial Sequence
  Description of Artificial Sequence: Synthetic peptide
  Seed: YLIRARRSM (TYRP1_HUMAN)
YKIRARRSL

SEQ ID NO: 179176 - protein, 11 aa, Artificial Sequence
  Description of Artificial Sequence: Synthetic peptide
  Seed: FVLLHTFTDAV (TYRP1_HUMAN)
FGLLHTFTDAV

SEQ ID NO: 179177 - protein, 9 aa, Artificial Sequence
  Description of Artificial Sequence: Synthetic peptide
  Seed: LQNPNQSVV (TYRP1_HUMAN)
LQNPNQSVL

SEQ ID NO: 179178 - protein, 9 aa, Artificial Sequence
  Description of Artificial Sequence: Synthetic peptide
  Seed: GEVDFSHEG (TYRP1_HUMAN)
GEVDFSHEL

SEQ ID NO: 179179 - protein, 11 aa, Artificial Sequence
  Description of Artificial Sequence: Synthetic peptide
  Seed: LLSLGCIFFPL (TYRP1_HUMAN)
LLSLGCIFFPV

SEQ ID NO: 179180 - protein, 9 aa, Artificial Sequence
  Description of Artificial Sequence: Synthetic peptide
  Seed: FLGVGQESF (TYRP1_HUMAN)
FAGVGQESI

SEQ ID NO: 179181 - protein, 9 aa, Artificial Sequence
  Description of Artificial Sequence: Synthetic peptide
  Seed: NISIYNYFV (TYRP1_HUMAN)
NTSIYNYFV

SEQ ID NO: 179182 - protein, 10 aa, Artificial Sequence
  Description of Artificial Sequence: Synthetic peptide
  Seed: YNYFVWTHYY (TYRP1_HUMAN)
YHYFVWTHYV

SEQ ID NO: 179183 - protein, 9 aa, Artificial Sequence
  Description of Artificial Sequence: Synthetic peptide
  Seed: RFFNRTCHC (TYRP1_HUMAN)
RTFNRTCHY

SEQ ID NO: 179184 - protein, 10 aa, Artificial Sequence
  Description of Artificial Sequence: Synthetic peptide
  Seed: YFVWTHYYSV (TYRP1_HUMAN)
YDVWTHYYSI

SEQ ID NO: 179185 - protein, 9 aa, Artificial Sequence
  Description of Artificial Sequence: Synthetic peptide
  Seed: IAVVGALLL (TYRP1_HUMAN)
IPVVGALLF

SEQ ID NO: 179186 - protein, 9 aa, Artificial Sequence
  Description of Artificial Sequence: Synthetic peptide
  Seed: REVWPLRFF (TYRP1_HUMAN)
REVWPLRFI

SEQ ID NO: 179187 - protein, 10 aa, Artificial Sequence
  Description of Artificial Sequence: Synthetic peptide
  Seed: GLFDTPPFYS (TYRP1_HUMAN)
GIFDTPPFYA

SEQ ID NO: 179188 - protein, 9 aa, Artificial Sequence
  Description of Artificial Sequence: Synthetic peptide
  Seed: TAPDNLGYT (TYRP1_HUMAN)
TVPDNLGYL

SEQ ID NO: 179189 - protein, 9 aa, Artificial Sequence
  Description of Artificial Sequence: Synthetic peptide
  Seed: NFDSTLISP (TYRP1_HUMAN)
NYDSTLISL

SEQ ID NO: 179190 - protein, 11 aa, Artificial Sequence
  Description of Artificial Sequence: Synthetic peptide
  Seed: AGNVARPMVQR (TYRP1_HUMAN)
ARNVARPMVQK

SEQ ID NO: 179191 - protein, 10 aa, Artificial Sequence
  Description of Artificial Sequence: Synthetic peptide
  Seed: YNMVPFWPPV (TYRP1_HUMAN)
YKMVPFWPPM

SEQ ID NO: 179192 - protein, 10 aa, Artificial Sequence
  Description of Artificial Sequence: Synthetic peptide
  Seed: YNYFVWTHYY (TYRP1_HUMAN)
YWYFVWTHYY

SEQ ID NO: 179193 - protein, 9 aa, Artificial Sequence
  Description of Artificial Sequence: Synthetic peptide
  Seed: SMDEANQPL (TYRP1_HUMAN)
SWDEANQPM

SEQ ID NO: 179194 - protein, 9 aa, Artificial Sequence
  Description of Artificial Sequence: Synthetic peptide
  Seed: RSLHNLAHL (TYRP1_HUMAN)
RTLHNLAHL

SEQ ID NO: 179195 - protein, 10 aa, Artificial Sequence
  Description of Artificial Sequence: Synthetic peptide
  Seed: YNMVPFWPPV (TYRP1_HUMAN)
YDMVPFWPPM

SEQ ID NO: 179196 - protein, 11 aa, Artificial Sequence
  Description of Artificial Sequence: Synthetic peptide
  Seed: YQCYAEEYEKL (TYRP1_HUMAN)
YCCYAEEYEKF

SEQ ID NO: 179197 - protein, 11 aa, Artificial Sequence
  Description of Artificial Sequence: Synthetic peptide
  Seed: YQCYAEEYEKL (TYRP1_HUMAN)
YICYAEEYEKF

SEQ ID NO: 179198 - protein, 10 aa, Artificial Sequence
  Description of Artificial Sequence: Synthetic peptide
  Seed: LSPNDPIFVL (TYRP1_HUMAN)
LYPNDPIFVM

SEQ ID NO: 179199 - protein, 10 aa, Artificial Sequence
  Description of Artificial Sequence: Synthetic peptide
  Seed: YFVWTHYYSV (TYRP1_HUMAN)
YDVWTHYYSL

SEQ ID NO: 179200 - protein, 9 aa, Artificial Sequence
  Description of Artificial Sequence: Synthetic peptide
  Seed: NSVFSQWRV (TYRP1_HUMAN)
NVVFSQWRV

SEQ ID NO: 179201 - protein, 11 aa, Artificial Sequence
  Description of Artificial Sequence: Synthetic peptide
  Seed: VALIFGTASYL (TYRP1_HUMAN)
VYLIFGTASYL

SEQ ID NO: 179202 - protein, 9 aa, Artificial Sequence
  Description of Artificial Sequence: Synthetic peptide
  Seed: DSLEDYDTL (TYRP1_HUMAN)
DALEDYDTL

SEQ ID NO: 179203 - protein, 9 aa, Artificial Sequence
  Description of Artificial Sequence: Synthetic peptide
  Seed: QEMLQEPSF (TYRP1_HUMAN)
QQMLQEPSI

SEQ ID NO: 179204 - protein, 9 aa, Artificial Sequence
  Description of Artificial Sequence: Synthetic peptide
  Seed: RRNPAGNVA (TYRP1_HUMAN)
RRNPAGNVY

SEQ ID NO: 179205 - protein, 10 aa, Artificial Sequence
  Description of Artificial Sequence: Synthetic peptide
  Seed: QCYAEEYEKL (TYRP1_HUMAN)
QKYAEEYEKF

SEQ ID NO: 179206 - protein, 10 aa, Artificial Sequence
  Description of Artificial Sequence: Synthetic peptide
  Seed: GKYDPAVRSL (TYRP1_HUMAN)
GHYDPAVRSF

SEQ ID NO: 179207 - protein, 10 aa, Artificial Sequence
  Description of Artificial Sequence: Synthetic peptide
  Seed: YSNSTNSFRN (TYRP1_HUMAN)
YTNSTNSFRR

SEQ ID NO: 179208 - protein, 10 aa, Artificial Sequence
  Description of Artificial Sequence: Synthetic peptide
  Seed: KLLSLGCIFF (TYRP1_HUMAN)
KVLSLGCIFV

SEQ ID NO: 179209 - protein, 9 aa, Artificial Sequence
  Description of Artificial Sequence: Synthetic peptide
  Seed: IFGTASYLI (TYRP1_HUMAN)
IMGTASYLF

SEQ ID NO: 179210 - protein, 9 aa, Artificial Sequence
  Description of Artificial Sequence: Synthetic peptide
  Seed: TAPDNLGYT (TYRP1_HUMAN)
TIPDNLGYL

SEQ ID NO: 179211 - protein, 9 aa, Artificial Sequence
  Description of Artificial Sequence: Synthetic peptide
  Seed: GLFDTPPFY (TYRP1_HUMAN)
GIFDTPPFL

SEQ ID NO: 179212 - protein, 9 aa, Artificial Sequence
  Description of Artificial Sequence: Synthetic peptide
  Seed: YLIRARRSM (TYRP1_HUMAN)
YYIRARRSY

SEQ ID NO: 179213 - protein, 10 aa, Artificial Sequence
  Description of Artificial Sequence: Synthetic peptide
  Seed: MQEMLQEPSF (TYRP1_HUMAN)
MCEMLQEPSW

SEQ ID NO: 179214 - protein, 11 aa, Artificial Sequence
  Description of Artificial Sequence: Synthetic peptide
  Seed: VALIFGTASYL (TYRP1_HUMAN)
VFLIFGTASYI

SEQ ID NO: 179215 - protein, 9 aa, Artificial Sequence
  Description of Artificial Sequence: Synthetic peptide
  Seed: DSRPHSPQY (TYRP1_HUMAN)
DTRPHSPQW

SEQ ID NO: 179216 - protein, 10 aa, Artificial Sequence
  Description of Artificial Sequence: Synthetic peptide
  Seed: VALIFGTASY (TYRP1_HUMAN)
VCLIFGTASF

SEQ ID NO: 179217 - protein, 9 aa, Artificial Sequence
  Description of Artificial Sequence: Synthetic peptide
  Seed: RARRSMDEA (TYRP1_HUMAN)
RTRRSMDEL

SEQ ID NO: 179218 - protein, 9 aa, Artificial Sequence
  Description of Artificial Sequence: Synthetic peptide
  Seed: YTYEIQWPS (TYRP1_HUMAN)
YMYEIQWPI

SEQ ID NO: 179219 - protein, 9 aa, Artificial Sequence
  Description of Artificial Sequence: Synthetic peptide
  Seed: IFGTASYLI (TYRP1_HUMAN)
IWGTASYLM

SEQ ID NO: 179220 - protein, 10 aa, Artificial Sequence
  Description of Artificial Sequence: Synthetic peptide
  Seed: TFLGVGQESF (TYRP1_HUMAN)
TVLGVGQESY

SEQ ID NO: 179221 - protein, 9 aa, Artificial Sequence
  Description of Artificial Sequence: Synthetic peptide
  Seed: RFFNRTCHC (TYRP1_HUMAN)
RTFNRTCHA

SEQ ID NO: 179222 - protein, 11 aa, Artificial Sequence
  Description of Artificial Sequence: Synthetic peptide
  Seed: YEKLQNPNQSV (TYRP1_HUMAN)
YEKLQNPNQSL

SEQ ID NO: 179223 - protein, 8 aa, Artificial Sequence
  Description of Artificial Sequence: Synthetic peptide
  Seed: FSHEGPAF (TYRP1_HUMAN)
FAHEGPAF

SEQ ID NO: 179224 - protein, 9 aa, Artificial Sequence
  Description of Artificial Sequence: Synthetic peptide
  Seed: LPYWNFATG (TYRP1_HUMAN)
LSYWNFATM

SEQ ID NO: 179225 - protein, 9 aa, Artificial Sequence
  Description of Artificial Sequence: Synthetic peptide
  Seed: RQCATVEAL (TYRP1_HUMAN)
RQCATVEAV

SEQ ID NO: 179226 - protein, 9 aa, Artificial Sequence
  Description of Artificial Sequence: Synthetic peptide
  Seed: DNLGYTYEI (TYRP1_HUMAN)
DLLGYTYEI

SEQ ID NO: 179227 - protein, 9 aa, Artificial Sequence
  Description of Artificial Sequence: Synthetic peptide
  Seed: RSLHNLAHL (TYRP1_HUMAN)
RALHNLAHI

SEQ ID NO: 179228 - protein, 10 aa, Artificial Sequence
  Description of Artificial Sequence: Synthetic peptide
  Seed: EMLQEPSFSL (TYRP1_HUMAN)
ELLQEPSFSI

SEQ ID NO: 179229 - protein, 10 aa, Artificial Sequence
  Description of Artificial Sequence: Synthetic peptide
  Seed: TPQFENISIY (TYRP1_HUMAN)
TTQFENISIF

SEQ ID NO: 179230 - protein, 10 aa, Artificial Sequence
  Description of Artificial Sequence: Synthetic peptide
  Seed: LLHTFTDAVF (TYRP1_HUMAN)
LSHTFTDAVF

SEQ ID NO: 179231 - protein, 9 aa, Artificial Sequence
  Description of Artificial Sequence: Synthetic peptide
  Seed: AQFPRQCAT (TYRP1_HUMAN)
AQFPRQCAA

SEQ ID NO: 179232 - protein, 10 aa, Artificial Sequence
  Description of Artificial Sequence: Synthetic peptide
  Seed: LSLGCIFFPL (TYRP1_HUMAN)
LTLGCIFFPA

SEQ ID NO: 179233 - protein, 9 aa, Artificial Sequence
  Description of Artificial Sequence: Synthetic peptide
  Seed: RAQFPRQCA (TYRP1_HUMAN)
RVQFPRQCA

SEQ ID NO: 179234 - protein, 11 aa, Artificial Sequence
  Description of Artificial Sequence: Synthetic peptide
  Seed: VTAPDNLGYTY (TYRP1_HUMAN)
VTAPDNLGYTW

SEQ ID NO: 179235 - protein, 8 aa, Artificial Sequence
  Description of Artificial Sequence: Synthetic peptide
  Seed: LIRARRSM (TYRP1_HUMAN)
LLRARRSM

SEQ ID NO: 179236 - protein, 9 aa, Artificial Sequence
  Description of Artificial Sequence: Synthetic peptide
  Seed: MAKRTTHPL (TYRP1_HUMAN)
MHKRTTHPF

SEQ ID NO: 179237 - protein, 10 aa, Artificial Sequence
  Description of Artificial Sequence: Synthetic peptide
  Seed: YTYEIQWPSR (TYRP1_HUMAN)
YFYEIQWPSK

SEQ ID NO: 179238 - protein, 11 aa, Artificial Sequence
  Description of Artificial Sequence: Synthetic peptide
  Seed: EVWPLRFFNRT (TYRP1_HUMAN)
ETWPLRFFNRR

SEQ ID NO: 179239 - protein, 9 aa, Artificial Sequence
  Description of Artificial Sequence: Synthetic peptide
  Seed: SLGCIFFPL (TYRP1_HUMAN)
SIGCIFFPL

SEQ ID NO: 179240 - protein, 10 aa, Artificial Sequence
  Description of Artificial Sequence: Synthetic peptide
  Seed: RRYNADISTF (TYRP1_HUMAN)
RWYNADISTF

SEQ ID NO: 179241 - protein, 9 aa, Artificial Sequence
  Description of Artificial Sequence: Synthetic peptide
  Seed: YTYEIQWPS (TYRP1_HUMAN)
YSYEIQWPI

SEQ ID NO: 179242 - protein, 10 aa, Artificial Sequence
  Description of Artificial Sequence: Synthetic peptide
  Seed: FVTAPDNLGY (TYRP1_HUMAN)
FGTAPDNLGF

SEQ ID NO: 179243 - protein, 10 aa, Artificial Sequence
  Description of Artificial Sequence: Synthetic peptide
  Seed: VALIFGTASY (TYRP1_HUMAN)
VTLIFGTASM

SEQ ID NO: 179244 - protein, 10 aa, Artificial Sequence
  Description of Artificial Sequence: Synthetic peptide
  Seed: NSTNSFRNTV (TYRP1_HUMAN)
NTTNSFRNTV

SEQ ID NO: 179245 - protein, 9 aa, Artificial Sequence
  Description of Artificial Sequence: Synthetic peptide
  Seed: SLHNLAHLF (TYRP1_HUMAN)
SIHNLAHLW

SEQ ID NO: 179246 - protein, 9 aa, Artificial Sequence
  Description of Artificial Sequence: Synthetic peptide
  Seed: KYDPAVRSL (TYRP1_HUMAN)
KHDPAVRSM

SEQ ID NO: 179247 - protein, 9 aa, Artificial Sequence
  Description of Artificial Sequence: Synthetic peptide
  Seed: LTWHRYHLL (TYRP1_HUMAN)
LVWHRYHLV

SEQ ID NO: 179248 - protein, 9 aa, Artificial Sequence
  Description of Artificial Sequence: Synthetic peptide
  Seed: NYFVWTHYY (TYRP1_HUMAN)
NRFVWTHYI

SEQ ID NO: 179249 - protein, 9 aa, Artificial Sequence
  Description of Artificial Sequence: Synthetic peptide
  Seed: TADSRPHSP (TYRP1_HUMAN)
TMDSRPHSF

SEQ ID NO: 179250 - protein, 11 aa, Artificial Sequence
  Description of Artificial Sequence: Synthetic peptide
  Seed: REFSVPEIIAI (TYRP1_HUMAN)
RSFSVPEIIAY

SEQ ID NO: 179251 - protein, 10 aa, Artificial Sequence
  Description of Artificial Sequence: Synthetic peptide
  Seed: RPMVQRLPEP (TYRP1_HUMAN)
RPMVQRLPEC

SEQ ID NO: 179252 - protein, 9 aa, Artificial Sequence
  Description of Artificial Sequence: Synthetic peptide
  Seed: ACDQRVLIV (TYRP1_HUMAN)
AADQRVLIF

SEQ ID NO: 179253 - protein, 11 aa, Artificial Sequence
  Description of Artificial Sequence: Synthetic peptide
  Seed: IYNYFVWTHYY (TYRP1_HUMAN)
IFNYFVWTHYY

SEQ ID NO: 179254 - protein, 10 aa, Artificial Sequence
  Description of Artificial Sequence: Synthetic peptide
  Seed: SPVSGPGTDR (TYRP1_HUMAN)
SAVSGPGTDM

SEQ ID NO: 179255 - protein, 10 aa, Artificial Sequence
  Description of Artificial Sequence: Synthetic peptide
  Seed: ATVEALRSGM (TYRP1_HUMAN)
AQVEALRSGI

SEQ ID NO: 179256 - protein, 9 aa, Artificial Sequence
  Description of Artificial Sequence: Synthetic peptide
  Seed: PNDPIFVLL (TYRP1_HUMAN)
PIDPIFVLL

SEQ ID NO: 179257 - protein, 9 aa, Artificial Sequence
  Description of Artificial Sequence: Synthetic peptide
  Seed: ENAPIGHNR (TYRP1_HUMAN)
ESAPIGHNK

SEQ ID NO: 179258 - protein, 10 aa, Artificial Sequence
  Description of Artificial Sequence: Synthetic peptide
  Seed: LLVALIFGTA (TYRP1_HUMAN)
LTVALIFGTV

SEQ ID NO: 179259 - protein, 9 aa, Artificial Sequence
  Description of Artificial Sequence: Synthetic peptide
  Seed: KLQNPNQSV (TYRP1_HUMAN)
KMQNPNQSY

SEQ ID NO: 179260 - protein, 10 aa, Artificial Sequence
  Description of Artificial Sequence: Synthetic peptide
  Seed: YNMVPFWPPV (TYRP1_HUMAN)
YLMVPFWPPA

SEQ ID NO: 179261 - protein, 10 aa, Artificial Sequence
  Description of Artificial Sequence: Synthetic peptide
  Seed: YNYFVWTHYY (TYRP1_HUMAN)
YHYFVWTHYM

SEQ ID NO: 179262 - protein, 11 aa, Artificial Sequence
  Description of Artificial Sequence: Synthetic peptide
  Seed: REFSVPEIIAI (TYRP1_HUMAN)
RCFSVPEIIAF

SEQ ID NO: 179263 - protein, 9 aa, Artificial Sequence
  Description of Artificial Sequence: Synthetic peptide
  Seed: GPDGNTPQF (TYRP1_HUMAN)
GMDGNTPQM

SEQ ID NO: 179264 - protein, 9 aa, Artificial Sequence
  Description of Artificial Sequence: Synthetic peptide
  Seed: MSAPKLLSL (TYRP1_HUMAN)
MLAPKLLSV

SEQ ID NO: 179265 - protein, 9 aa, Artificial Sequence
  Description of Artificial Sequence: Synthetic peptide
  Seed: PNDPIFVLL (TYRP1_HUMAN)
PWDPIFVLL

SEQ ID NO: 179266 - protein, 9 aa, Artificial Sequence
  Description of Artificial Sequence: Synthetic peptide
  Seed: VGLFDTPPF (TYRP1_HUMAN)
VKLFDTPPY

SEQ ID NO: 179267 - protein, 10 aa, Artificial Sequence
  Description of Artificial Sequence: Synthetic peptide
  Seed: THYYSVKKTF (TYRP1_HUMAN)
TMYYSVKKTF

SEQ ID NO: 179268 - protein, 10 aa, Artificial Sequence
  Description of Artificial Sequence: Synthetic peptide
  Seed: YNADISTFPL (TYRP1_HUMAN)
YLADISTFPP

SEQ ID NO: 179269 - protein, 11 aa, Artificial Sequence
  Description of Artificial Sequence: Synthetic peptide
  Seed: YNMVPFWPPVT (TYRP1_HUMAN)
YSMVPFWPPVV

SEQ ID NO: 179270 - protein, 10 aa, Artificial Sequence
  Description of Artificial Sequence: Synthetic peptide
  Seed: DVAQCLEVGL (TYRP1_HUMAN)
DIAQCLEVGR

SEQ ID NO: 179271 - protein, 10 aa, Artificial Sequence
  Description of Artificial Sequence: Synthetic peptide
  Seed: MVPFWPPVTN (TYRP1_HUMAN)
MGPFWPPVTM

SEQ ID NO: 179272 - protein, 10 aa, Artificial Sequence
  Description of Artificial Sequence: Synthetic peptide
  Seed: EMLQEPSFSL (TYRP1_HUMAN)
EILQEPSFSI

SEQ ID NO: 179273 - protein, 10 aa, Artificial Sequence
  Description of Artificial Sequence: Synthetic peptide
  Seed: YNYFVWTHYY (TYRP1_HUMAN)
YDYFVWTHYY

SEQ ID NO: 179274 - protein, 10 aa, Artificial Sequence
  Description of Artificial Sequence: Synthetic peptide
  Seed: WPPVTNTEMF (TYRP1_HUMAN)
WTPVTNTEMW

SEQ ID NO: 179275 - protein, 10 aa, Artificial Sequence
  Description of Artificial Sequence: Synthetic peptide
  Seed: MAKRTTHPLF (TYRP1_HUMAN)
MPKRTTHPLH

SEQ ID NO: 179276 - protein, 10 aa, Artificial Sequence
  Description of Artificial Sequence: Synthetic peptide
  Seed: EGPAFLTWHR (TYRP1_HUMAN)
EIPAFLTWHR

SEQ ID NO: 179277 - protein, 9 aa, Artificial Sequence
  Description of Artificial Sequence: Synthetic peptide
  Seed: FVWTHYYSV (TYRP1_HUMAN)
FFWTHYYSV

SEQ ID NO: 179278 - protein, 10 aa, Artificial Sequence
  Description of Artificial Sequence: Synthetic peptide
  Seed: VALIFGTASY (TYRP1_HUMAN)
VQLIFGTASF

SEQ ID NO: 179279 - protein, 8 aa, Artificial Sequence
  Description of Artificial Sequence: Synthetic peptide
  Seed: LIRARRSM (TYRP1_HUMAN)
LLRARRSI

SEQ ID NO: 179280 - protein, 10 aa, Artificial Sequence
  Description of Artificial Sequence: Synthetic peptide
  Seed: LIFGTASYLI (TYRP1_HUMAN)
LTFGTASYLV

SEQ ID NO: 179281 - protein, 9 aa, Artificial Sequence
  Description of Artificial Sequence: Synthetic peptide
  Seed: LGYTYEIQW (TYRP1_HUMAN)
LSYTYEIQI

SEQ ID NO: 179282 - protein, 9 aa, Artificial Sequence
  Description of Artificial Sequence: Synthetic peptide
  Seed: MCCPDLSPV (TYRP1_HUMAN)
MICPDLSPV

SEQ ID NO: 179283 - protein, 10 aa, Artificial Sequence
  Description of Artificial Sequence: Synthetic peptide
  Seed: LLLVALIFGT (TYRP1_HUMAN)
LNLVALIFGV

SEQ ID NO: 179284 - protein, 9 aa, Artificial Sequence
  Description of Artificial Sequence: Synthetic peptide
  Seed: RPHSPQYPH (TYRP1_HUMAN)
RVHSPQYPL

SEQ ID NO: 179285 - protein, 10 aa, Artificial Sequence
  Description of Artificial Sequence: Synthetic peptide
  Seed: IAIAVVGALL (TYRP1_HUMAN)
ITIAVVGALF

SEQ ID NO: 179286 - protein, 9 aa, Artificial Sequence
  Description of Artificial Sequence: Synthetic peptide
  Seed: VLIVRRNLL (TYRP1_HUMAN)
VMIVRRNLM

SEQ ID NO: 179287 - protein, 10 aa, Artificial Sequence
  Description of Artificial Sequence: Synthetic peptide
  Seed: YNADISTFPL (TYRP1_HUMAN)
YPADISTFPL

SEQ ID NO: 179288 - protein, 8 aa, Artificial Sequence
  Description of Artificial Sequence: Synthetic peptide
  Seed: LFDTPPFY (TYRP1_HUMAN)
LFDTPPFM

SEQ ID NO: 179289 - protein, 10 aa, Artificial Sequence
  Description of Artificial Sequence: Synthetic peptide
  Seed: FGTASYLIRA (TYRP1_HUMAN)
FFTASYLIRV

SEQ ID NO: 179290 - protein, 9 aa, Artificial Sequence
  Description of Artificial Sequence: Synthetic peptide
  Seed: FSHEGPAFL (TYRP1_HUMAN)
FMHEGPAFK

SEQ ID NO: 179291 - protein, 9 aa, Artificial Sequence
  Description of Artificial Sequence: Synthetic peptide
  Seed: RARRSMDEA (TYRP1_HUMAN)
RMRRSMDEL

SEQ ID NO: 179292 - protein, 9 aa, Artificial Sequence
  Description of Artificial Sequence: Synthetic peptide
  Seed: REFSVPEII (TYRP1_HUMAN)
REFSVPEIY

SEQ ID NO: 179293 - protein, 11 aa, Artificial Sequence
  Description of Artificial Sequence: Synthetic peptide
  Seed: LIFGTASYLIR (TYRP1_HUMAN)
LTFGTASYLIR

SEQ ID NO: 179294 - protein, 11 aa, Artificial Sequence
  Description of Artificial Sequence: Synthetic peptide
  Seed: SLPYWNFATGK (TYRP1_HUMAN)
SEPYWNFATGR

SEQ ID NO: 179295 - protein, 9 aa, Artificial Sequence
  Description of Artificial Sequence: Synthetic peptide
  Seed: KYDPAVRSL (TYRP1_HUMAN)
KKDPAVRSY

SEQ ID NO: 179296 - protein, 10 aa, Artificial Sequence
  Description of Artificial Sequence: Synthetic peptide
  Seed: LSPNDPIFVL (TYRP1_HUMAN)
LHPNDPIFVM

SEQ ID NO: 179297 - protein, 9 aa, Artificial Sequence
  Description of Artificial Sequence: Synthetic peptide
  Seed: RPHSPQYPH (TYRP1_HUMAN)
RPHSPQYPA

SEQ ID NO: 179298 - protein, 10 aa, Artificial Sequence
  Description of Artificial Sequence: Synthetic peptide
  Seed: REFSVPEIIA (TYRP1_HUMAN)
RQFSVPEIIV

SEQ ID NO: 179299 - protein, 10 aa, Artificial Sequence
  Description of Artificial Sequence: Synthetic peptide
  Seed: MSAPKLLSLG (TYRP1_HUMAN)
MTAPKLLSLF

SEQ ID NO: 179300 - protein, 10 aa, Artificial Sequence
  Description of Artificial Sequence: Synthetic peptide
  Seed: GNVARPMVQR (TYRP1_HUMAN)
GFVARPMVQR

SEQ ID NO: 179301 - protein, 10 aa, Artificial Sequence
  Description of Artificial Sequence: Synthetic peptide
  Seed: YFVWTHYYSV (TYRP1_HUMAN)
YRVWTHYYSL

SEQ ID NO: 179302 - protein, 8 aa, Artificial Sequence
  Description of Artificial Sequence: Synthetic peptide
  Seed: REFSVPEI (TYRP1_HUMAN)
RDFSVPEF

SEQ ID NO: 179303 - protein, 11 aa, Artificial Sequence
  Description of Artificial Sequence: Synthetic peptide
  Seed: REFSVPEIIAI (TYRP1_HUMAN)
RVFSVPEIIAY

SEQ ID NO: 179304 - protein, 8 aa, Artificial Sequence
  Description of Artificial Sequence: Synthetic peptide
  Seed: TEMFVTAP (TYRP1_HUMAN)
TEMFVTAV

SEQ ID NO: 179305 - protein, 10 aa, Artificial Sequence
  Description of Artificial Sequence: Synthetic peptide
  Seed: FVWTHYYSVK (TYRP1_HUMAN)
FLWTHYYSVA

SEQ ID NO: 179306 - protein, 10 aa, Artificial Sequence
  Description of Artificial Sequence: Synthetic peptide
  Seed: LSPNDPIFVL (TYRP1_HUMAN)
LTPNDPIFVW

SEQ ID NO: 179307 - protein, 10 aa, Artificial Sequence
  Description of Artificial Sequence: Synthetic peptide
  Seed: SPNSVFSQWR (TYRP1_HUMAN)
SVNSVFSQWR

SEQ ID NO: 179308 - protein, 9 aa, Artificial Sequence
  Description of Artificial Sequence: Synthetic peptide
  Seed: ENISIYNYF (TYRP1_HUMAN)
EAISIYNYM

SEQ ID NO: 179309 - protein, 9 aa, Artificial Sequence
  Description of Artificial Sequence: Synthetic peptide
  Seed: YSNSTNSFR (TYRP1_HUMAN)
YLNSTNSFK

SEQ ID NO: 179310 - protein, 9 aa, Artificial Sequence
  Description of Artificial Sequence: Synthetic peptide
  Seed: LHTFTDAVF (TYRP1_HUMAN)
LSTFTDAVF

SEQ ID NO: 179311 - protein, 9 aa, Artificial Sequence
  Description of Artificial Sequence: Synthetic peptide
  Seed: TLISPNSVF (TYRP1_HUMAN)
TTISPNSVF

SEQ ID NO: 179312 - protein, 9 aa, Artificial Sequence
  Description of Artificial Sequence: Synthetic peptide
  Seed: RSNFDSTLI (TYRP1_HUMAN)
RSNFDSTLW

SEQ ID NO: 179313 - protein, 9 aa, Artificial Sequence
  Description of Artificial Sequence: Synthetic peptide
  Seed: RTTHPLFVI (TYRP1_HUMAN)
RITHPLFVY

SEQ ID NO: 179314 - protein, 9 aa, Artificial Sequence
  Description of Artificial Sequence: Synthetic peptide
  Seed: YLIRARRSM (TYRP1_HUMAN)
YYIRARRSH

SEQ ID NO: 179315 - protein, 9 aa, Artificial Sequence
  Description of Artificial Sequence: Synthetic peptide
  Seed: REFSVPEII (TYRP1_HUMAN)
RRFSVPEIV

SEQ ID NO: 179316 - protein, 9 aa, Artificial Sequence
  Description of Artificial Sequence: Synthetic peptide
  Seed: ASYLIRARR (TYRP1_HUMAN)
AYYLIRARK

SEQ ID NO: 179317 - protein, 9 aa, Artificial Sequence
  Description of Artificial Sequence: Synthetic peptide
  Seed: LQNPNQSVV (TYRP1_HUMAN)
LLNPNQSVV

SEQ ID NO: 179318 - protein, 10 aa, Artificial Sequence
  Description of Artificial Sequence: Synthetic peptide
  Seed: YNYFVWTHYY (TYRP1_HUMAN)
YVYFVWTHYY

SEQ ID NO: 179319 - protein, 11 aa, Artificial Sequence
  Description of Artificial Sequence: Synthetic peptide
  Seed: YNMVPFWPPVT (TYRP1_HUMAN)
YMMVPFWPPVI

SEQ ID NO: 179320 - protein, 9 aa, Artificial Sequence
  Description of Artificial Sequence: Synthetic peptide
  Seed: QQARAQFPR (TYRP1_HUMAN)
QQARAQFPK

SEQ ID NO: 179321 - protein, 9 aa, Artificial Sequence
  Description of Artificial Sequence: Synthetic peptide
  Seed: ALLLVALIF (TYRP1_HUMAN)
AALLVALIY

SEQ ID NO: 179322 - protein, 10 aa, Artificial Sequence
  Description of Artificial Sequence: Synthetic peptide
  Seed: FLNGTGGQTH (TYRP1_HUMAN)
FQNGTGGQTF

SEQ ID NO: 179323 - protein, 9 aa, Artificial Sequence
  Description of Artificial Sequence: Synthetic peptide
  Seed: HLSPNDPIF (TYRP1_HUMAN)
HQSPNDPIW

SEQ ID NO: 179324 - protein, 9 aa, Artificial Sequence
  Description of Artificial Sequence: Synthetic peptide
  Seed: SVFSQWRVV (TYRP1_HUMAN)
SSFSQWRVM

SEQ ID NO: 179325 - protein, 11 aa, Artificial Sequence
  Description of Artificial Sequence: Synthetic peptide
  Seed: KTFLGVGQESF (TYRP1_HUMAN)
KQFLGVGQESI

SEQ ID NO: 179326 - protein, 10 aa, Artificial Sequence
  Description of Artificial Sequence: Synthetic peptide
  Seed: EGPAFLTWHR (TYRP1_HUMAN)
ELPAFLTWHR

SEQ ID NO: 179327 - protein, 8 aa, Artificial Sequence
  Description of Artificial Sequence: Synthetic peptide
  Seed: YAEEYEKL (TYRP1_HUMAN)
YFEEYEKL

SEQ ID NO: 179328 - protein, 9 aa, Artificial Sequence
  Description of Artificial Sequence: Synthetic peptide
  Seed: APDNLGYTY (TYRP1_HUMAN)
APDNLGYTM

SEQ ID NO: 179329 - protein, 8 aa, Artificial Sequence
  Description of Artificial Sequence: Synthetic peptide
  Seed: YSNSTNSF (TYRP1_HUMAN)
YWNSTNSF

SEQ ID NO: 179330 - protein, 9 aa, Artificial Sequence
  Description of Artificial Sequence: Synthetic peptide
  Seed: STNSFRNTV (TYRP1_HUMAN)
SMNSFRNTA

SEQ ID NO: 179331 - protein, 9 aa, Artificial Sequence
  Description of Artificial Sequence: Synthetic peptide
  Seed: MAKRTTHPL (TYRP1_HUMAN)
MKKRTTHPL

SEQ ID NO: 179332 - protein, 9 aa, Artificial Sequence
  Description of Artificial Sequence: Synthetic peptide
  Seed: FSVPEIIAI (TYRP1_HUMAN)
FVVPEIIAF

SEQ ID NO: 179333 - protein, 10 aa, Artificial Sequence
  Description of Artificial Sequence: Synthetic peptide
  Seed: TAPDNLGYTY (TYRP1_HUMAN)
TMPDNLGYTM

SEQ ID NO: 179334 - protein, 10 aa, Artificial Sequence
  Description of Artificial Sequence: Synthetic peptide
  Seed: YEIQWPSREF (TYRP1_HUMAN)
YMIQWPSREF

SEQ ID NO: 179335 - protein, 9 aa, Artificial Sequence
  Description of Artificial Sequence: Synthetic peptide
  Seed: GTASYLIRA (TYRP1_HUMAN)
GIASYLIRA

SEQ ID NO: 179336 - protein, 9 aa, Artificial Sequence
  Description of Artificial Sequence: Synthetic peptide
  Seed: AIAVVGALL (TYRP1_HUMAN)
AQAVVGALM

SEQ ID NO: 179337 - protein, 10 aa, Artificial Sequence
  Description of Artificial Sequence: Synthetic peptide
  Seed: LLTDQYQCYA (TYRP1_HUMAN)
LLTDQYQCYI

SEQ ID NO: 179338 - protein, 9 aa, Artificial Sequence
  Description of Artificial Sequence: Synthetic peptide
  Seed: IAIAVVGAL (TYRP1_HUMAN)
ILIAVVGAF

SEQ ID NO: 179339 - protein, 9 aa, Artificial Sequence
  Description of Artificial Sequence: Synthetic peptide
  Seed: SFRNTVEGY (TYRP1_HUMAN)
SARNTVEGY

SEQ ID NO: 179340 - protein, 10 aa, Artificial Sequence
  Description of Artificial Sequence: Synthetic peptide
  Seed: QCYAEEYEKL (TYRP1_HUMAN)
QMYAEEYEKF

SEQ ID NO: 179341 - protein, 9 aa, Artificial Sequence
  Description of Artificial Sequence: Synthetic peptide
  Seed: GTASYLIRA (TYRP1_HUMAN)
GLASYLIRL

SEQ ID NO: 179342 - protein, 8 aa, Artificial Sequence
  Description of Artificial Sequence: Synthetic peptide
  Seed: SIYNYFVW (TYRP1_HUMAN)
SSYNYFVF

SEQ ID NO: 179343 - protein, 9 aa, Artificial Sequence
  Description of Artificial Sequence: Synthetic peptide
  Seed: LSKEEKNHF (TYRP1_HUMAN)
LSKEEKNHW

SEQ ID NO: 179344 - protein, 11 aa, Artificial Sequence
  Description of Artificial Sequence: Synthetic peptide
  Seed: FVLLHTFTDAV (TYRP1_HUMAN)
FDLLHTFTDAL

SEQ ID NO: 179345 - protein, 10 aa, Artificial Sequence
  Description of Artificial Sequence: Synthetic peptide
  Seed: SMDEANQPLL (TYRP1_HUMAN)
STDEANQPLI

SEQ ID NO: 179346 - protein, 9 aa, Artificial Sequence
  Description of Artificial Sequence: Synthetic peptide
  Seed: RYHLLRLEK (TYRP1_HUMAN)
RWHLLRLER

SEQ ID NO: 179347 - protein, 11 aa, Artificial Sequence
  Description of Artificial Sequence: Synthetic peptide
  Seed: MLQEPSFSLPY (TYRP1_HUMAN)
MKQEPSFSLPM

SEQ ID NO: 179348 - protein, 9 aa, Artificial Sequence
  Description of Artificial Sequence: Synthetic peptide
  Seed: SIYNYFVWT (TYRP1_HUMAN)
SIYNYFVWL

SEQ ID NO: 179349 - protein, 9 aa, Artificial Sequence
  Description of Artificial Sequence: Synthetic peptide
  Seed: KLQNPNQSV (TYRP1_HUMAN)
KIQNPNQSW

SEQ ID NO: 179350 - protein, 9 aa, Artificial Sequence
  Description of Artificial Sequence: Synthetic peptide
  Seed: VPFWPPVTN (TYRP1_HUMAN)
VAFWPPVTF

SEQ ID NO: 179351 - protein, 9 aa, Artificial Sequence
  Description of Artificial Sequence: Synthetic peptide
  Seed: VFDEWLRRY (TYRP1_HUMAN)
VWDEWLRRI

SEQ ID NO: 179352 - protein, 9 aa, Artificial Sequence
  Description of Artificial Sequence: Synthetic peptide
  Seed: ALIFGTASY (TYRP1_HUMAN)
AIIFGTASK

SEQ ID NO: 179353 - protein, 9 aa, Artificial Sequence
  Description of Artificial Sequence: Synthetic peptide
  Seed: YYSVKKTFL (TYRP1_HUMAN)
YRSVKKTFY

SEQ ID NO: 179354 - protein, 9 aa, Artificial Sequence
  Description of Artificial Sequence: Synthetic peptide
  Seed: LQNPNQSVV (TYRP1_HUMAN)
LQNPNQSVW

SEQ ID NO: 179355 - protein, 10 aa, Artificial Sequence
  Description of Artificial Sequence: Synthetic peptide
  Seed: HRYHLLRLEK (TYRP1_HUMAN)
HFYHLLRLER

SEQ ID NO: 179356 - protein, 10 aa, Artificial Sequence
  Description of Artificial Sequence: Synthetic peptide
  Seed: IYNYFVWTHY (TYRP1_HUMAN)
IVNYFVWTHY

SEQ ID NO: 179357 - protein, 10 aa, Artificial Sequence
  Description of Artificial Sequence: Synthetic peptide
  Seed: YNYFVWTHYY (TYRP1_HUMAN)
YRYFVWTHYI

SEQ ID NO: 179358 - protein, 10 aa, Artificial Sequence
  Description of Artificial Sequence: Synthetic peptide
  Seed: QCYAEEYEKL (TYRP1_HUMAN)
QAYAEEYEKF

SEQ ID NO: 179359 - protein, 10 aa, Artificial Sequence
  Description of Artificial Sequence: Synthetic peptide
  Seed: FFPLLLFQQA (TYRP1_HUMAN)
FLPLLLFQQA

SEQ ID NO: 179360 - protein, 10 aa, Artificial Sequence
  Description of Artificial Sequence: Synthetic peptide
  Seed: WPPVTNTEMF (TYRP1_HUMAN)
WGPVTNTEMW

SEQ ID NO: 179361 - protein, 9 aa, Artificial Sequence
  Description of Artificial Sequence: Synthetic peptide
  Seed: MAKRTTHPL (TYRP1_HUMAN)
MFKRTTHPF

SEQ ID NO: 179362 - protein, 9 aa, Artificial Sequence
  Description of Artificial Sequence: Synthetic peptide
  Seed: RQCATVEAL (TYRP1_HUMAN)
RECATVEAP

SEQ ID NO: 179363 - protein, 10 aa, Artificial Sequence
  Description of Artificial Sequence: Synthetic peptide
  Seed: LLHTFTDAVF (TYRP1_HUMAN)
LMHTFTDAVL

SEQ ID NO: 179364 - protein, 9 aa, Artificial Sequence
  Description of Artificial Sequence: Synthetic peptide
  Seed: MSAPKLLSL (TYRP1_HUMAN)
MQAPKLLSW

SEQ ID NO: 179365 - protein, 9 aa, Artificial Sequence
  Description of Artificial Sequence: Synthetic peptide
  Seed: RYHLLRLEK (TYRP1_HUMAN)
RLHLLRLER

SEQ ID NO: 179366 - protein, 10 aa, Artificial Sequence
  Description of Artificial Sequence: Synthetic peptide
  Seed: ENISIYNYFV (TYRP1_HUMAN)
ETISIYNYFI

SEQ ID NO: 179367 - protein, 11 aa, Artificial Sequence
  Description of Artificial Sequence: Synthetic peptide
  Seed: IYNYFVWTHYY (TYRP1_HUMAN)
IFNYFVWTHYI

SEQ ID NO: 179368 - protein, 9 aa, Artificial Sequence
  Description of Artificial Sequence: Synthetic peptide
  Seed: NISIYNYFV (TYRP1_HUMAN)
NLSIYNYFL

SEQ ID NO: 179369 - protein, 9 aa, Artificial Sequence
  Description of Artificial Sequence: Synthetic peptide
  Seed: YTYEIQWPS (TYRP1_HUMAN)
YGYEIQWPA

SEQ ID NO: 179370 - protein, 9 aa, Artificial Sequence
  Description of Artificial Sequence: Synthetic peptide
  Seed: DLMGSRSNF (TYRP1_HUMAN)
DMMGSRSNR

SEQ ID NO: 179371 - protein, 10 aa, Artificial Sequence
  Description of Artificial Sequence: Synthetic peptide
  Seed: VDFSHEGPAF (TYRP1_HUMAN)
VPFSHEGPAY

SEQ ID NO: 179372 - protein, 9 aa, Artificial Sequence
  Description of Artificial Sequence: Synthetic peptide
  Seed: KLLSLGCIF (TYRP1_HUMAN)
KLLSLGCIW

SEQ ID NO: 179373 - protein, 10 aa, Artificial Sequence
  Description of Artificial Sequence: Synthetic peptide
  Seed: AVFDEWLRRY (TYRP1_HUMAN)
AKFDEWLRRY

SEQ ID NO: 179374 - protein, 10 aa, Artificial Sequence
  Description of Artificial Sequence: Synthetic peptide
  Seed: FGTASYLIRA (TYRP1_HUMAN)
FFTASYLIRI

SEQ ID NO: 179375 - protein, 10 aa, Artificial Sequence
  Description of Artificial Sequence: Synthetic peptide
  Seed: FQQARAQFPR (TYRP1_HUMAN)
FMQARAQFPK

SEQ ID NO: 179376 - protein, 10 aa, Artificial Sequence
  Description of Artificial Sequence: Synthetic peptide
  Seed: KLLSLGCIFF (TYRP1_HUMAN)
KMLSLGCIFW

SEQ ID NO: 179377 - protein, 9 aa, Artificial Sequence
  Description of Artificial Sequence: Synthetic peptide
  Seed: STNSFRNTV (TYRP1_HUMAN)
SVNSFRNTW

SEQ ID NO: 179378 - protein, 10 aa, Artificial Sequence
  Description of Artificial Sequence: Synthetic peptide
  Seed: ALIFGTASYL (TYRP1_HUMAN)
AAIFGTASYV

SEQ ID NO: 179379 - protein, 9 aa, Artificial Sequence
  Description of Artificial Sequence: Synthetic peptide
  Seed: IAVVGALLL (TYRP1_HUMAN)
IVVVGALLY

SEQ ID NO: 179380 - protein, 9 aa, Artificial Sequence
  Description of Artificial Sequence: Synthetic peptide
  Seed: LIFGTASYL (TYRP1_HUMAN)
LTFGTASYF

SEQ ID NO: 179381 - protein, 10 aa, Artificial Sequence
  Description of Artificial Sequence: Synthetic peptide
  Seed: MLQEPSFSLP (TYRP1_HUMAN)
MMQEPSFSLL

SEQ ID NO: 179382 - protein, 9 aa, Artificial Sequence
  Description of Artificial Sequence: Synthetic peptide
  Seed: YTYEIQWPS (TYRP1_HUMAN)
YIYEIQWPC

SEQ ID NO: 179383 - protein, 11 aa, Artificial Sequence
  Description of Artificial Sequence: Synthetic peptide
  Seed: YSDPTGKYDPA (TYRP1_HUMAN)
YTDPTGKYDPM

SEQ ID NO: 179384 - protein, 10 aa, Artificial Sequence
  Description of Artificial Sequence: Synthetic peptide
  Seed: YFVWTHYYSV (TYRP1_HUMAN)
YTVWTHYYSV

SEQ ID NO: 179385 - protein, 9 aa, Artificial Sequence
  Description of Artificial Sequence: Synthetic peptide
  Seed: MLQEPSFSL (TYRP1_HUMAN)
MKQEPSFSL

SEQ ID NO: 179386 - protein, 10 aa, Artificial Sequence
  Description of Artificial Sequence: Synthetic peptide
  Seed: ADSRPHSPQY (TYRP1_HUMAN)
AQSRPHSPQY

SEQ ID NO: 179387 - protein, 8 aa, Artificial Sequence
  Description of Artificial Sequence: Synthetic peptide
  Seed: RQYNMVPF (TYRP1_HUMAN)
RQYNMVPV

SEQ ID NO: 179388 - protein, 9 aa, Artificial Sequence
  Description of Artificial Sequence: Synthetic peptide
  Seed: LTDQYQCYA (TYRP1_HUMAN)
LVDQYQCYF

SEQ ID NO: 179389 - protein, 10 aa, Artificial Sequence
  Description of Artificial Sequence: Synthetic peptide
  Seed: LLLVALIFGT (TYRP1_HUMAN)
LFLVALIFGI

SEQ ID NO: 179390 - protein, 8 aa, Artificial Sequence
  Description of Artificial Sequence: Synthetic peptide
  Seed: LIFGTASY (TYRP1_HUMAN)
LPFGTASF

SEQ ID NO: 179391 - protein, 9 aa, Artificial Sequence
  Description of Artificial Sequence: Synthetic peptide
  Seed: HEGPAFLTW (TYRP1_HUMAN)
HEGPAFLTI

SEQ ID NO: 179392 - protein, 10 aa, Artificial Sequence
  Description of Artificial Sequence: Synthetic peptide
  Seed: MQEMLQEPSF (TYRP1_HUMAN)
MPEMLQEPSW

SEQ ID NO: 179393 - protein, 9 aa, Artificial Sequence
  Description of Artificial Sequence: Synthetic peptide
  Seed: GLFDTPPFY (TYRP1_HUMAN)
GEFDTPPFY

SEQ ID NO: 179394 - protein, 10 aa, Artificial Sequence
  Description of Artificial Sequence: Synthetic peptide
  Seed: NVARPMVQRL (TYRP1_HUMAN)
NTARPMVQRK

SEQ ID NO: 179395 - protein, 11 aa, Artificial Sequence
  Description of Artificial Sequence: Synthetic peptide
  Seed: LISPNSVFSQW (TYRP1_HUMAN)
LPSPNSVFSQW

SEQ ID NO: 179396 - protein, 9 aa, Artificial Sequence
  Description of Artificial Sequence: Synthetic peptide
  Seed: MSAPKLLSL (TYRP1_HUMAN)
MKAPKLLSL

SEQ ID NO: 179397 - protein, 9 aa, Artificial Sequence
  Description of Artificial Sequence: Synthetic peptide
  Seed: GLFDTPPFY (TYRP1_HUMAN)
GTFDTPPFL

SEQ ID NO: 179398 - protein, 9 aa, Artificial Sequence
  Description of Artificial Sequence: Synthetic peptide
  Seed: NADISTFPL (TYRP1_HUMAN)
NYDISTFPM

SEQ ID NO: 179399 - protein, 9 aa, Artificial Sequence
  Description of Artificial Sequence: Synthetic peptide
  Seed: AIAVVGALL (TYRP1_HUMAN)
AMAVVGALV

SEQ ID NO: 179400 - protein, 9 aa, Artificial Sequence
  Description of Artificial Sequence: Synthetic peptide
  Seed: YLIRARRSM (TYRP1_HUMAN)
YPIRARRSI

SEQ ID NO: 179401 - protein, 10 aa, Artificial Sequence
  Description of Artificial Sequence: Synthetic peptide
  Seed: LLVALIFGTA (TYRP1_HUMAN)
LLVALIFGTV

SEQ ID NO: 179402 - protein, 10 aa, Artificial Sequence
  Description of Artificial Sequence: Synthetic peptide
  Seed: AVFDEWLRRY (TYRP1_HUMAN)
ATFDEWLRRW

SEQ ID NO: 179403 - protein, 9 aa, Artificial Sequence
  Description of Artificial Sequence: Synthetic peptide
  Seed: MSAPKLLSL (TYRP1_HUMAN)
MLAPKLLSI

SEQ ID NO: 179404 - protein, 9 aa, Artificial Sequence
  Description of Artificial Sequence: Synthetic peptide
  Seed: RQYNMVPFW (TYRP1_HUMAN)
RSYNMVPFY

SEQ ID NO: 179405 - protein, 9 aa, Artificial Sequence
  Description of Artificial Sequence: Synthetic peptide
  Seed: AQFPRQCAT (TYRP1_HUMAN)
AHFPRQCAV

SEQ ID NO: 179406 - protein, 8 aa, Artificial Sequence
  Description of Artificial Sequence: Synthetic peptide
  Seed: LFDTPPFY (TYRP1_HUMAN)
LYDTPPFF

SEQ ID NO: 179407 - protein, 11 aa, Artificial Sequence
  Description of Artificial Sequence: Synthetic peptide
  Seed: YNMVPFWPPVT (TYRP1_HUMAN)
YQMVPFWPPVW

SEQ ID NO: 179408 - protein, 9 aa, Artificial Sequence
  Description of Artificial Sequence: Synthetic peptide
  Seed: SFSLPYWNF (TYRP1_HUMAN)
SFSLPYWNY

SEQ ID NO: 179409 - protein, 10 aa, Artificial Sequence
  Description of Artificial Sequence: Synthetic peptide
  Seed: FWPPVTNTEM (TYRP1_HUMAN)
FRPPVTNTEY

SEQ ID NO: 179410 - protein, 10 aa, Artificial Sequence
  Description of Artificial Sequence: Synthetic peptide
  Seed: LSLGCIFFPL (TYRP1_HUMAN)
LLLGCIFFPT

SEQ ID NO: 179411 - protein, 10 aa, Artificial Sequence
  Description of Artificial Sequence: Synthetic peptide
  Seed: LSLGCIFFPL (TYRP1_HUMAN)
LCLGCIFFPL

SEQ ID NO: 179412 - protein, 10 aa, Artificial Sequence
  Description of Artificial Sequence: Synthetic peptide
  Seed: RSLHNLAHLF (TYRP1_HUMAN)
RHLHNLAHLF

SEQ ID NO: 179413 - protein, 10 aa, Artificial Sequence
  Description of Artificial Sequence: Synthetic peptide
  Seed: YNADISTFPL (TYRP1_HUMAN)
YAADISTFPY

SEQ ID NO: 179414 - protein, 9 aa, Artificial Sequence
  Description of Artificial Sequence: Synthetic peptide
  Seed: SIYNYFVWT (TYRP1_HUMAN)
SMYNYFVWT

SEQ ID NO: 179415 - protein, 10 aa, Artificial Sequence
  Description of Artificial Sequence: Synthetic peptide
  Seed: THLSPNDPIF (TYRP1_HUMAN)
THLSPNDPIL

SEQ ID NO: 179416 - protein, 9 aa, Artificial Sequence
  Description of Artificial Sequence: Synthetic peptide
  Seed: ACDQRVLIV (TYRP1_HUMAN)
AWDQRVLIM

SEQ ID NO: 179417 - protein, 9 aa, Artificial Sequence
  Description of Artificial Sequence: Synthetic peptide
  Seed: MSAPKLLSL (TYRP1_HUMAN)
MPAPKLLSA

SEQ ID NO: 179418 - protein, 9 aa, Artificial Sequence
  Description of Artificial Sequence: Synthetic peptide
  Seed: RVLIVRRNL (TYRP1_HUMAN)
RLLIVRRNK

SEQ ID NO: 179419 - protein, 9 aa, Artificial Sequence
  Description of Artificial Sequence: Synthetic peptide
  Seed: RQCATVEAL (TYRP1_HUMAN)
RRCATVEAF

SEQ ID NO: 179420 - protein, 10 aa, Artificial Sequence
  Description of Artificial Sequence: Synthetic peptide
  Seed: YSNSTNSFRN (TYRP1_HUMAN)
YFNSTNSFRR

SEQ ID NO: 179421 - protein, 10 aa, Artificial Sequence
  Description of Artificial Sequence: Synthetic peptide
  Seed: MAKRTTHPLF (TYRP1_HUMAN)
MEKRTTHPLF

SEQ ID NO: 179422 - protein, 10 aa, Artificial Sequence
  Description of Artificial Sequence: Synthetic peptide
  Seed: YNADISTFPL (TYRP1_HUMAN)
YPADISTFPI

SEQ ID NO: 179423 - protein, 10 aa, Artificial Sequence
  Description of Artificial Sequence: Synthetic peptide
  Seed: FSVPEIIAIA (TYRP1_HUMAN)
FMVPEIIAII

SEQ ID NO: 179424 - protein, 10 aa, Artificial Sequence
  Description of Artificial Sequence: Synthetic peptide
  Seed: WPLRFFNRTC (TYRP1_HUMAN)
WPLRFFNRTI

SEQ ID NO: 179425 - protein, 10 aa, Artificial Sequence
  Description of Artificial Sequence: Synthetic peptide
  Seed: RSMDEANQPL (TYRP1_HUMAN)
RQMDEANQPH

SEQ ID NO: 179426 - protein, 9 aa, Artificial Sequence
  Description of Artificial Sequence: Synthetic peptide
  Seed: GLFDTPPFY (TYRP1_HUMAN)
GMFDTPPFL

SEQ ID NO: 179427 - protein, 9 aa, Artificial Sequence
  Description of Artificial Sequence: Synthetic peptide
  Seed: VARPMVQRL (TYRP1_HUMAN)
VVRPMVQRW

SEQ ID NO: 179428 - protein, 9 aa, Artificial Sequence
  Description of Artificial Sequence: Synthetic peptide
  Seed: WHRYHLLRL (TYRP1_HUMAN)
WLRYHLLRF

SEQ ID NO: 179429 - protein, 9 aa, Artificial Sequence
  Description of Artificial Sequence: Synthetic peptide
  Seed: GPAFLTWHR (TYRP1_HUMAN)
GVAFLTWHR

SEQ ID NO: 179430 - protein, 10 aa, Artificial Sequence
  Description of Artificial Sequence: Synthetic peptide
  Seed: AFLTWHRYHL (TYRP1_HUMAN)
AYLTWHRYHI

SEQ ID NO: 179431 - protein, 9 aa, Artificial Sequence
  Description of Artificial Sequence: Synthetic peptide
  Seed: FVWTHYYSV (TYRP1_HUMAN)
FQWTHYYSM

SEQ ID NO: 179432 - protein, 9 aa, Artificial Sequence
  Description of Artificial Sequence: Synthetic peptide
  Seed: VVCDSLEDY (TYRP1_HUMAN)
VMCDSLEDY

SEQ ID NO: 179433 - protein, 9 aa, Artificial Sequence
  Description of Artificial Sequence: Synthetic peptide
  Seed: KLQNPNQSV (TYRP1_HUMAN)
KLQNPNQSI

SEQ ID NO: 179434 - protein, 9 aa, Artificial Sequence
  Description of Artificial Sequence: Synthetic peptide
  Seed: ISIYNYFVW (TYRP1_HUMAN)
IPIYNYFVW

SEQ ID NO: 179435 - protein, 9 aa, Artificial Sequence
  Description of Artificial Sequence: Synthetic peptide
  Seed: RGAACDQRV (TYRP1_HUMAN)
RLAACDQRI

SEQ ID NO: 179436 - protein, 9 aa, Artificial Sequence
  Description of Artificial Sequence: Synthetic peptide
  Seed: LFQQARAQF (TYRP1_HUMAN)
LYQQARAQY

SEQ ID NO: 179437 - protein, 9 aa, Artificial Sequence
  Description of Artificial Sequence: Synthetic peptide
  Seed: ISIYNYFVW (TYRP1_HUMAN)
IAIYNYFVM

SEQ ID NO: 179438 - protein, 9 aa, Artificial Sequence
  Description of Artificial Sequence: Synthetic peptide
  Seed: VARPMVQRL (TYRP1_HUMAN)
VVRPMVQRF

SEQ ID NO: 179439 - protein, 9 aa, Artificial Sequence
  Description of Artificial Sequence: Synthetic peptide
  Seed: LIFGTASYL (TYRP1_HUMAN)
LGFGTASYY

SEQ ID NO: 179440 - protein, 10 aa, Artificial Sequence
  Description of Artificial Sequence: Synthetic peptide
  Seed: ALIFGTASYL (TYRP1_HUMAN)
AMIFGTASYI

SEQ ID NO: 179441 - protein, 9 aa, Artificial Sequence
  Description of Artificial Sequence: Synthetic peptide
  Seed: QQARAQFPR (TYRP1_HUMAN)
QLARAQFPR

SEQ ID NO: 179442 - protein, 9 aa, Artificial Sequence
  Description of Artificial Sequence: Synthetic peptide
  Seed: TADSRPHSP (TYRP1_HUMAN)
TLDSRPHSV

SEQ ID NO: 179443 - protein, 11 aa, Artificial Sequence
  Description of Artificial Sequence: Synthetic peptide
  Seed: SMDEANQPLLT (TYRP1_HUMAN)
SMDEANQPLLV

SEQ ID NO: 179444 - protein, 9 aa, Artificial Sequence
  Description of Artificial Sequence: Synthetic peptide
  Seed: RQYNMVPFW (TYRP1_HUMAN)
RVYNMVPFY

SEQ ID NO: 179445 - protein, 9 aa, Artificial Sequence
  Description of Artificial Sequence: Synthetic peptide
  Seed: RTTHPLFVI (TYRP1_HUMAN)
RITHPLFVW

SEQ ID NO: 179446 - protein, 9 aa, Artificial Sequence
  Description of Artificial Sequence: Synthetic peptide
  Seed: APIGHNRQY (TYRP1_HUMAN)
ARIGHNRQL

SEQ ID NO: 179447 - protein, 9 aa, Artificial Sequence
  Description of Artificial Sequence: Synthetic peptide
  Seed: TLISPNSVF (TYRP1_HUMAN)
TGISPNSVY

SEQ ID NO: 179448 - protein, 10 aa, Artificial Sequence
  Description of Artificial Sequence: Synthetic peptide
  Seed: RQCATVEALR (TYRP1_HUMAN)
RICATVEALK

SEQ ID NO: 179449 - protein, 9 aa, Artificial Sequence
  Description of Artificial Sequence: Synthetic peptide
  Seed: SPNDPIFVL (TYRP1_HUMAN)
SANDPIFVV

SEQ ID NO: 179450 - protein, 10 aa, Artificial Sequence
  Description of Artificial Sequence: Synthetic peptide
  Seed: MSAPKLLSLG (TYRP1_HUMAN)
MQAPKLLSLW

SEQ ID NO: 179451 - protein, 9 aa, Artificial Sequence
  Description of Artificial Sequence: Synthetic peptide
  Seed: REVWPLRFF (TYRP1_HUMAN)
RLVWPLRFY

SEQ ID NO: 179452 - protein, 10 aa, Artificial Sequence
  Description of Artificial Sequence: Synthetic peptide
  Seed: TFLGVGQESF (TYRP1_HUMAN)
TMLGVGQESY

SEQ ID NO: 179453 - protein, 9 aa, Artificial Sequence
  Description of Artificial Sequence: Synthetic peptide
  Seed: RFFNRTCHC (TYRP1_HUMAN)
RIFNRTCHY

SEQ ID NO: 179454 - protein, 10 aa, Artificial Sequence
  Description of Artificial Sequence: Synthetic peptide
  Seed: RTTHPLFVIA (TYRP1_HUMAN)
RATHPLFVIA

SEQ ID NO: 179455 - protein, 9 aa, Artificial Sequence
  Description of Artificial Sequence: Synthetic peptide
  Seed: RQYNMVPFW (TYRP1_HUMAN)
RLYNMVPFV

SEQ ID NO: 179456 - protein, 9 aa, Artificial Sequence
  Description of Artificial Sequence: Synthetic peptide
  Seed: RYNADISTF (TYRP1_HUMAN)
RYNADISTM

SEQ ID NO: 179457 - protein, 10 aa, Artificial Sequence
  Description of Artificial Sequence: Synthetic peptide
  Seed: RSLHNLAHLF (TYRP1_HUMAN)
RQLHNLAHLL

SEQ ID NO: 179458 - protein, 11 aa, Artificial Sequence
  Description of Artificial Sequence: Synthetic peptide
  Seed: YSDPTGKYDPA (TYRP1_HUMAN)
YADPTGKYDPM

SEQ ID NO: 179459 - protein, 9 aa, Artificial Sequence
  Description of Artificial Sequence: Synthetic peptide
  Seed: REFSVPEII (TYRP1_HUMAN)
RTFSVPEIL

SEQ ID NO: 179460 - protein, 11 aa, Artificial Sequence
  Description of Artificial Sequence: Synthetic peptide
  Seed: FWPPVTNTEMF (TYRP1_HUMAN)
FTPPVTNTEMW

SEQ ID NO: 179461 - protein, 10 aa, Artificial Sequence
  Description of Artificial Sequence: Synthetic peptide
  Seed: AFLTWHRYHL (TYRP1_HUMAN)
AWLTWHRYHF

SEQ ID NO: 179462 - protein, 9 aa, Artificial Sequence
  Description of Artificial Sequence: Synthetic peptide
  Seed: LPYWNFATG (TYRP1_HUMAN)
LAYWNFATY

SEQ ID NO: 179463 - protein, 11 aa, Artificial Sequence
  Description of Artificial Sequence: Synthetic peptide
  Seed: YNYFVWTHYYS (TYRP1_HUMAN)
YMYFVWTHYYE

SEQ ID NO: 179464 - protein, 11 aa, Artificial Sequence
  Description of Artificial Sequence: Synthetic peptide
  Seed: WTHYYSVKKTF (TYRP1_HUMAN)
WYHYYSVKKTF

SEQ ID NO: 179465 - protein, 10 aa, Artificial Sequence
  Description of Artificial Sequence: Synthetic peptide
  Seed: KRTTHPLFVI (TYRP1_HUMAN)
KRTTHPLFVL

SEQ ID NO: 179466 - protein, 9 aa, Artificial Sequence
  Description of Artificial Sequence: Synthetic peptide
  Seed: MCCPDLSPV (TYRP1_HUMAN)
MTCPDLSPI

SEQ ID NO: 179467 - protein, 10 aa, Artificial Sequence
  Description of Artificial Sequence: Synthetic peptide
  Seed: SMDEANQPLL (TYRP1_HUMAN)
SWDEANQPLM

SEQ ID NO: 179468 - protein, 9 aa, Artificial Sequence
  Description of Artificial Sequence: Synthetic peptide
  Seed: DQRVLIVRR (TYRP1_HUMAN)
DYRVLIVRK

SEQ ID NO: 179469 - protein, 9 aa, Artificial Sequence
  Description of Artificial Sequence: Synthetic peptide
  Seed: LLSLGCIFF (TYRP1_HUMAN)
LMSLGCIFF

SEQ ID NO: 179470 - protein, 9 aa, Artificial Sequence
  Description of Artificial Sequence: Synthetic peptide
  Seed: STNSFRNTV (TYRP1_HUMAN)
SVNSFRNTL

SEQ ID NO: 179471 - protein, 9 aa, Artificial Sequence
  Description of Artificial Sequence: Synthetic peptide
  Seed: QESFGEVDF (TYRP1_HUMAN)
QESFGEVDV

SEQ ID NO: 179472 - protein, 9 aa, Artificial Sequence
  Description of Artificial Sequence: Synthetic peptide
  Seed: VFDEWLRRY (TYRP1_HUMAN)
VTDEWLRRW

SEQ ID NO: 179473 - protein, 9 aa, Artificial Sequence
  Description of Artificial Sequence: Synthetic peptide
  Seed: SIYNYFVWT (TYRP1_HUMAN)
STYNYFVWV

SEQ ID NO: 179474 - protein, 9 aa, Artificial Sequence
  Description of Artificial Sequence: Synthetic peptide
  Seed: VCDICTDDL (TYRP1_HUMAN)
VWDICTDDL

SEQ ID NO: 179475 - protein, 11 aa, Artificial Sequence
  Description of Artificial Sequence: Synthetic peptide
  Seed: ILGPDGNTPQF (TYRP1_HUMAN)
ILGPDGNTPQW

SEQ ID NO: 179476 - protein, 11 aa, Artificial Sequence
  Description of Artificial Sequence: Synthetic peptide
  Seed: MLQEPSFSLPY (TYRP1_HUMAN)
MRQEPSFSLPY

SEQ ID NO: 179477 - protein, 11 aa, Artificial Sequence
  Description of Artificial Sequence: Synthetic peptide
  Seed: FSHEGPAFLTW (TYRP1_HUMAN)
FAHEGPAFLTY

SEQ ID NO: 179478 - protein, 11 aa, Artificial Sequence
  Description of Artificial Sequence: Synthetic peptide
  Seed: LEVGLFDTPPF (TYRP1_HUMAN)
LQVGLFDTPPY

SEQ ID NO: 179479 - protein, 10 aa, Artificial Sequence
  Description of Artificial Sequence: Synthetic peptide
  Seed: ISIYNYFVWT (TYRP1_HUMAN)
ITIYNYFVWF

SEQ ID NO: 179480 - protein, 10 aa, Artificial Sequence
  Description of Artificial Sequence: Synthetic peptide
  Seed: AVFDEWLRRY (TYRP1_HUMAN)
AAFDEWLRRW

SEQ ID NO: 179481 - protein, 9 aa, Artificial Sequence
  Description of Artificial Sequence: Synthetic peptide
  Seed: FVWTHYYSV (TYRP1_HUMAN)
FPWTHYYSM

SEQ ID NO: 179482 - protein, 10 aa, Artificial Sequence
  Description of Artificial Sequence: Synthetic peptide
  Seed: SIYNYFVWTH (TYRP1_HUMAN)
SIYNYFVWTR

SEQ ID NO: 179483 - protein, 9 aa, Artificial Sequence
  Description of Artificial Sequence: Synthetic peptide
  Seed: RQYNMVPFW (TYRP1_HUMAN)
RQYNMVPFV

SEQ ID NO: 179484 - protein, 11 aa, Artificial Sequence
  Description of Artificial Sequence: Synthetic peptide
  Seed: RRYNADISTFP (TYRP1_HUMAN)
RWYNADISTFH

SEQ ID NO: 179485 - protein, 9 aa, Artificial Sequence
  Description of Artificial Sequence: Synthetic peptide
  Seed: IAVVGALLL (TYRP1_HUMAN)
IGVVGALLW

SEQ ID NO: 179486 - protein, 9 aa, Artificial Sequence
  Description of Artificial Sequence: Synthetic peptide
  Seed: STLISPNSV (TYRP1_HUMAN)
STLISPNSM

SEQ ID NO: 179487 - protein, 10 aa, Artificial Sequence
  Description of Artificial Sequence: Synthetic peptide
  Seed: FGTASYLIRA (TYRP1_HUMAN)
FGTASYLIRV

SEQ ID NO: 179488 - protein, 10 aa, Artificial Sequence
  Description of Artificial Sequence: Synthetic peptide
  Seed: EIIAIAVVGA (TYRP1_HUMAN)
ERIAIAVVGI

SEQ ID NO: 179489 - protein, 9 aa, Artificial Sequence
  Description of Artificial Sequence: Synthetic peptide
  Seed: TLISPNSVF (TYRP1_HUMAN)
TKISPNSVL

SEQ ID NO: 179490 - protein, 10 aa, Artificial Sequence
  Description of Artificial Sequence: Synthetic peptide
  Seed: FVWTHYYSVK (TYRP1_HUMAN)
FAWTHYYSVR

SEQ ID NO: 179491 - protein, 10 aa, Artificial Sequence
  Description of Artificial Sequence: Synthetic peptide
  Seed: GLFDTPPFYS (TYRP1_HUMAN)
GSFDTPPFYV

SEQ ID NO: 179492 - protein, 10 aa, Artificial Sequence
  Description of Artificial Sequence: Synthetic peptide
  Seed: YFVWTHYYSV (TYRP1_HUMAN)
YEVWTHYYSI

SEQ ID NO: 179493 - protein, 9 aa, Artificial Sequence
  Description of Artificial Sequence: Synthetic peptide
  Seed: AVRSLHNLA (TYRP1_HUMAN)
ASRSLHNLK

SEQ ID NO: 179494 - protein, 9 aa, Artificial Sequence
  Description of Artificial Sequence: Synthetic peptide
  Seed: TAPDNLGYT (TYRP1_HUMAN)
TMPDNLGYL

SEQ ID NO: 179495 - protein, 9 aa, Artificial Sequence
  Description of Artificial Sequence: Synthetic peptide
  Seed: FTDAVFDEW (TYRP1_HUMAN)
FNDAVFDEY

SEQ ID NO: 179496 - protein, 9 aa, Artificial Sequence
  Description of Artificial Sequence: Synthetic peptide
  Seed: NMVPFWPPV (TYRP1_HUMAN)
NTVPFWPPR

SEQ ID NO: 179497 - protein, 9 aa, Artificial Sequence
  Description of Artificial Sequence: Synthetic peptide
  Seed: SPNDPIFVL (TYRP1_HUMAN)
SMNDPIFVF

SEQ ID NO: 179498 - protein, 10 aa, Artificial Sequence
  Description of Artificial Sequence: Synthetic peptide
  Seed: AVRSLHNLAH (TYRP1_HUMAN)
AARSLHNLAK

SEQ ID NO: 179499 - protein, 9 aa, Artificial Sequence
  Description of Artificial Sequence: Synthetic peptide
  Seed: VTAPDNLGY (TYRP1_HUMAN)
VVAPDNLGR

SEQ ID NO: 179500 - protein, 10 aa, Artificial Sequence
  Description of Artificial Sequence: Synthetic peptide
  Seed: LGPDGNTPQF (TYRP1_HUMAN)
LGPDGNTPQM

SEQ ID NO: 179501 - protein, 9 aa, Artificial Sequence
  Description of Artificial Sequence: Synthetic peptide
  Seed: FPLENAPIG (TYRP1_HUMAN)
FMLENAPIY

SEQ ID NO: 179502 - protein, 10 aa, Artificial Sequence
  Description of Artificial Sequence: Synthetic peptide
  Seed: MAKRTTHPLF (TYRP1_HUMAN)
MSKRTTHPLW

SEQ ID NO: 179503 - protein, 9 aa, Artificial Sequence
  Description of Artificial Sequence: Synthetic peptide
  Seed: LHNLAHLFL (TYRP1_HUMAN)
LENLAHLFF

SEQ ID NO: 179504 - protein, 10 aa, Artificial Sequence
  Description of Artificial Sequence: Synthetic peptide
  Seed: YEIQWPSREF (TYRP1_HUMAN)
YAIQWPSREY

SEQ ID NO: 179505 - protein, 9 aa, Artificial Sequence
  Description of Artificial Sequence: Synthetic peptide
  Seed: IAVVGALLL (TYRP1_HUMAN)
IQVVGALLV

SEQ ID NO: 179506 - protein, 9 aa, Artificial Sequence
  Description of Artificial Sequence: Synthetic peptide
  Seed: LIFGTASYL (TYRP1_HUMAN)
LIFGTASYR

SEQ ID NO: 179507 - protein, 9 aa, Artificial Sequence
  Description of Artificial Sequence: Synthetic peptide
  Seed: KLQNPNQSV (TYRP1_HUMAN)
KLQNPNQSK

SEQ ID NO: 179508 - protein, 9 aa, Artificial Sequence
  Description of Artificial Sequence: Synthetic peptide
  Seed: RYNADISTF (TYRP1_HUMAN)
RQNADISTV

SEQ ID NO: 179509 - protein, 9 aa, Artificial Sequence
  Description of Artificial Sequence: Synthetic peptide
  Seed: KYDPAVRSL (TYRP1_HUMAN)
KDDPAVRSI

SEQ ID NO: 179510 - protein, 9 aa, Artificial Sequence
  Description of Artificial Sequence: Synthetic peptide
  Seed: HEGPAFLTW (TYRP1_HUMAN)
HHGPAFLTL

SEQ ID NO: 179511 - protein, 9 aa, Artificial Sequence
  Description of Artificial Sequence: Synthetic peptide
  Seed: STLISPNSV (TYRP1_HUMAN)
SMLISPNSI

SEQ ID NO: 179512 - protein, 9 aa, Artificial Sequence
  Description of Artificial Sequence: Synthetic peptide
  Seed: ACDQRVLIV (TYRP1_HUMAN)
ALDQRVLII

SEQ ID NO: 179513 - protein, 11 aa, Artificial Sequence
  Description of Artificial Sequence: Synthetic peptide
  Seed: YQCYAEEYEKL (TYRP1_HUMAN)
YYCYAEEYEKF

SEQ ID NO: 179514 - protein, 9 aa, Artificial Sequence
  Description of Artificial Sequence: Synthetic peptide
  Seed: GTASYLIRA (TYRP1_HUMAN)
GSASYLIRV

SEQ ID NO: 179515 - protein, 10 aa, Artificial Sequence
  Description of Artificial Sequence: Synthetic peptide
  Seed: FSVPEIIAIA (TYRP1_HUMAN)
FFVPEIIAIV

SEQ ID NO: 179516 - protein, 9 aa, Artificial Sequence
  Description of Artificial Sequence: Synthetic peptide
  Seed: FSVPEIIAI (TYRP1_HUMAN)
FNVPEIIAF

SEQ ID NO: 179517 - protein, 9 aa, Artificial Sequence
  Description of Artificial Sequence: Synthetic peptide
  Seed: QQARAQFPR (TYRP1_HUMAN)
QLARAQFPK

SEQ ID NO: 179518 - protein, 10 aa, Artificial Sequence
  Description of Artificial Sequence: Synthetic peptide
  Seed: FWPPVTNTEM (TYRP1_HUMAN)
FIPPVTNTEL

SEQ ID NO: 179519 - protein, 9 aa, Artificial Sequence
  Description of Artificial Sequence: Synthetic peptide
  Seed: DSRPHSPQY (TYRP1_HUMAN)
DMRPHSPQK

SEQ ID NO: 179520 - protein, 10 aa, Artificial Sequence
  Description of Artificial Sequence: Synthetic peptide
  Seed: YNADISTFPL (TYRP1_HUMAN)
YKADISTFPM

SEQ ID NO: 179521 - protein, 9 aa, Artificial Sequence
  Description of Artificial Sequence: Synthetic peptide
  Seed: VARPMVQRL (TYRP1_HUMAN)
VVRPMVQRK

SEQ ID NO: 179522 - protein, 11 aa, Artificial Sequence
  Description of Artificial Sequence: Synthetic peptide
  Seed: FTDAVFDEWLR (TYRP1_HUMAN)
FTDAVFDEWLY

SEQ ID NO: 179523 - protein, 9 aa, Artificial Sequence
  Description of Artificial Sequence: Synthetic peptide
  Seed: FTDAVFDEW (TYRP1_HUMAN)
FCDAVFDEV

SEQ ID NO: 179524 - protein, 11 aa, Artificial Sequence
  Description of Artificial Sequence: Synthetic peptide
  Seed: YNYFVWTHYYS (TYRP1_HUMAN)
YMYFVWTHYYP

SEQ ID NO: 179525 - protein, 9 aa, Artificial Sequence
  Description of Artificial Sequence: Synthetic peptide
  Seed: EEYEKLQNP (TYRP1_HUMAN)
EEYEKLQNW

SEQ ID NO: 179526 - protein, 10 aa, Artificial Sequence
  Description of Artificial Sequence: Synthetic peptide
  Seed: FYSNSTNSFR (TYRP1_HUMAN)
FNSNSTNSFR

SEQ ID NO: 179527 - protein, 11 aa, Artificial Sequence
  Description of Artificial Sequence: Synthetic peptide
  Seed: VALIFGTASYL (TYRP1_HUMAN)
VALIFGTASYV

SEQ ID NO: 179528 - protein, 9 aa, Artificial Sequence
  Description of Artificial Sequence: Synthetic peptide
  Seed: FVWTHYYSV (TYRP1_HUMAN)
FQWTHYYSR

SEQ ID NO: 179529 - protein, 8 aa, Artificial Sequence
  Description of Artificial Sequence: Synthetic peptide
  Seed: FSHEGPAF (TYRP1_HUMAN)
FVHEGPAI

SEQ ID NO: 179530 - protein, 10 aa, Artificial Sequence
  Description of Artificial Sequence: Synthetic peptide
  Seed: RRYNADISTF (TYRP1_HUMAN)
RSYNADISTY

SEQ ID NO: 179531 - protein, 10 aa, Artificial Sequence
  Description of Artificial Sequence: Synthetic peptide
  Seed: FSGHNCGTCR (TYRP1_HUMAN)
FTGHNCGTCR

SEQ ID NO: 179532 - protein, 9 aa, Artificial Sequence
  Description of Artificial Sequence: Synthetic peptide
  Seed: RFFNRTCHC (TYRP1_HUMAN)
RNFNRTCHK

SEQ ID NO: 179533 - protein, 10 aa, Artificial Sequence
  Description of Artificial Sequence: Synthetic peptide
  Seed: FVLLHTFTDA (TYRP1_HUMAN)
FTLLHTFTDV

SEQ ID NO: 179534 - protein, 8 aa, Artificial Sequence
  Description of Artificial Sequence: Synthetic peptide
  Seed: SVPEIIAI (TYRP1_HUMAN)
SQPEIIAV

SEQ ID NO: 179535 - protein, 9 aa, Artificial Sequence
  Description of Artificial Sequence: Synthetic peptide
  Seed: YTYEIQWPS (TYRP1_HUMAN)
YAYEIQWPT

SEQ ID NO: 179536 - protein, 9 aa, Artificial Sequence
  Description of Artificial Sequence: Synthetic peptide
  Seed: TADSRPHSP (TYRP1_HUMAN)
TADSRPHSC

SEQ ID NO: 179537 - protein, 9 aa, Artificial Sequence
  Description of Artificial Sequence: Synthetic peptide
  Seed: TADSRPHSP (TYRP1_HUMAN)
TTDSRPHSI

SEQ ID NO: 179538 - protein, 9 aa, Artificial Sequence
  Description of Artificial Sequence: Synthetic peptide
  Seed: PQFENISIY (TYRP1_HUMAN)
PMFENISIY

SEQ ID NO: 179539 - protein, 11 aa, Artificial Sequence
  Description of Artificial Sequence: Synthetic peptide
  Seed: FVLLHTFTDAV (TYRP1_HUMAN)
FALLHTFTDAV

SEQ ID NO: 179540 - protein, 9 aa, Artificial Sequence
  Description of Artificial Sequence: Synthetic peptide
  Seed: FYSNSTNSF (TYRP1_HUMAN)
FYSNSTNSW

SEQ ID NO: 179541 - protein, 9 aa, Artificial Sequence
  Description of Artificial Sequence: Synthetic peptide
  Seed: RAQFPRQCA (TYRP1_HUMAN)
RAQFPRQCK

SEQ ID NO: 179542 - protein, 10 aa, Artificial Sequence
  Description of Artificial Sequence: Synthetic peptide
  Seed: AFLTWHRYHL (TYRP1_HUMAN)
AMLTWHRYHA

SEQ ID NO: 179543 - protein, 9 aa, Artificial Sequence
  Description of Artificial Sequence: Synthetic peptide
  Seed: LIFGTASYL (TYRP1_HUMAN)
LQFGTASYY

SEQ ID NO: 179544 - protein, 9 aa, Artificial Sequence
  Description of Artificial Sequence: Synthetic peptide
  Seed: RQYNMVPFW (TYRP1_HUMAN)
RFYNMVPFL

SEQ ID NO: 179545 - protein, 10 aa, Artificial Sequence
  Description of Artificial Sequence: Synthetic peptide
  Seed: LLVALIFGTA (TYRP1_HUMAN)
LVVALIFGTV

SEQ ID NO: 179546 - protein, 10 aa, Artificial Sequence
  Description of Artificial Sequence: Synthetic peptide
  Seed: LLLVALIFGT (TYRP1_HUMAN)
LSLVALIFGI

SEQ ID NO: 179547 - protein, 10 aa, Artificial Sequence
  Description of Artificial Sequence: Synthetic peptide
  Seed: ADSRPHSPQY (TYRP1_HUMAN)
ASSRPHSPQK

SEQ ID NO: 179548 - protein, 10 aa, Artificial Sequence
  Description of Artificial Sequence: Synthetic peptide
  Seed: FVWTHYYSVK (TYRP1_HUMAN)
FVWTHYYSVR

SEQ ID NO: 179549 - protein, 10 aa, Artificial Sequence
  Description of Artificial Sequence: Synthetic peptide
  Seed: MVPFWPPVTN (TYRP1_HUMAN)
MNPFWPPVTL

SEQ ID NO: 179550 - protein, 11 aa, Artificial Sequence
  Description of Artificial Sequence: Synthetic peptide
  Seed: FPLLLFQQARA (TYRP1_HUMAN)
FFLLLFQQARV

SEQ ID NO: 179551 - protein, 9 aa, Artificial Sequence
  Description of Artificial Sequence: Synthetic peptide
  Seed: SPNDPIFVL (TYRP1_HUMAN)
SSNDPIFVM

SEQ ID NO: 179552 - protein, 9 aa, Artificial Sequence
  Description of Artificial Sequence: Synthetic peptide
  Seed: YYSVKKTFL (TYRP1_HUMAN)
YFSVKKTFM

SEQ ID NO: 179553 - protein, 9 aa, Artificial Sequence
  Description of Artificial Sequence: Synthetic peptide
  Seed: VARPMVQRL (TYRP1_HUMAN)
VQRPMVQRV

SEQ ID NO: 179554 - protein, 9 aa, Artificial Sequence
  Description of Artificial Sequence: Synthetic peptide
  Seed: FSHEGPAFL (TYRP1_HUMAN)
FTHEGPAFR

SEQ ID NO: 179555 - protein, 9 aa, Artificial Sequence
  Description of Artificial Sequence: Synthetic peptide
  Seed: LIFGTASYL (TYRP1_HUMAN)
LNFGTASYM

SEQ ID NO: 179556 - protein, 9 aa, Artificial Sequence
  Description of Artificial Sequence: Synthetic peptide
  Seed: KLLSLGCIF (TYRP1_HUMAN)
KILSLGCIW

SEQ ID NO: 179557 - protein, 9 aa, Artificial Sequence
  Description of Artificial Sequence: Synthetic peptide
  Seed: NMVPFWPPV (TYRP1_HUMAN)
NVVPFWPPR

SEQ ID NO: 179558 - protein, 9 aa, Artificial Sequence
  Description of Artificial Sequence: Synthetic peptide
  Seed: ARAQFPRQC (TYRP1_HUMAN)
AAAQFPRQI

SEQ ID NO: 179559 - protein, 10 aa, Artificial Sequence
  Description of Artificial Sequence: Synthetic peptide
  Seed: NYFVWTHYYS (TYRP1_HUMAN)
NFFVWTHYYM

SEQ ID NO: 179560 - protein, 9 aa, Artificial Sequence
  Description of Artificial Sequence: Synthetic peptide
  Seed: MSAPKLLSL (TYRP1_HUMAN)
MHAPKLLSL

SEQ ID NO: 179561 - protein, 9 aa, Artificial Sequence
  Description of Artificial Sequence: Synthetic peptide
  Seed: ACDQRVLIV (TYRP1_HUMAN)
AADQRVLIL

SEQ ID NO: 179562 - protein, 9 aa, Artificial Sequence
  Description of Artificial Sequence: Synthetic peptide
  Seed: TADSRPHSP (TYRP1_HUMAN)
TMDSRPHSM

SEQ ID NO: 179563 - protein, 9 aa, Artificial Sequence
  Description of Artificial Sequence: Synthetic peptide
  Seed: IAIAVVGAL (TYRP1_HUMAN)
ITIAVVGAW

SEQ ID NO: 179564 - protein, 9 aa, Artificial Sequence
  Description of Artificial Sequence: Synthetic peptide
  Seed: ALIFGTASY (TYRP1_HUMAN)
AAIFGTASY

SEQ ID NO: 179565 - protein, 9 aa, Artificial Sequence
  Description of Artificial Sequence: Synthetic peptide
  Seed: FTDAVFDEW (TYRP1_HUMAN)
FWDAVFDEF

SEQ ID NO: 179566 - protein, 9 aa, Artificial Sequence
  Description of Artificial Sequence: Synthetic peptide
  Seed: FSVPEIIAI (TYRP1_HUMAN)
FDVPEIIAF

SEQ ID NO: 179567 - protein, 9 aa, Artificial Sequence
  Description of Artificial Sequence: Synthetic peptide
  Seed: VLLHTFTDA (TYRP1_HUMAN)
VILHTFTDV

SEQ ID NO: 179568 - protein, 9 aa, Artificial Sequence
  Description of Artificial Sequence: Synthetic peptide
  Seed: RQCATVEAL (TYRP1_HUMAN)
RHCATVEAY

SEQ ID NO: 179569 - protein, 9 aa, Artificial Sequence
  Description of Artificial Sequence: Synthetic peptide
  Seed: TWHRYHLLR (TYRP1_HUMAN)
TTHRYHLLR

SEQ ID NO: 179570 - protein, 10 aa, Artificial Sequence
  Description of Artificial Sequence: Synthetic peptide
  Seed: LSLGCIFFPL (TYRP1_HUMAN)
LLLGCIFFPA

SEQ ID NO: 179571 - protein, 10 aa, Artificial Sequence
  Description of Artificial Sequence: Synthetic peptide
  Seed: TDAVFDEWLR (TYRP1_HUMAN)
TGAVFDEWLR

SEQ ID NO: 179572 - protein, 10 aa, Artificial Sequence
  Description of Artificial Sequence: Synthetic peptide
  Seed: AVVGALLLVA (TYRP1_HUMAN)
AMVGALLLVI

SEQ ID NO: 179573 - protein, 9 aa, Artificial Sequence
  Description of Artificial Sequence: Synthetic peptide
  Seed: AVVGALLLV (TYRP1_HUMAN)
ASVGALLLL

SEQ ID NO: 179574 - protein, 10 aa, Artificial Sequence
  Description of Artificial Sequence: Synthetic peptide
  Seed: YSVKKTFLGV (TYRP1_HUMAN)
YMVKKTFLGM

SEQ ID NO: 179575 - protein, 10 aa, Artificial Sequence
  Description of Artificial Sequence: Synthetic peptide
  Seed: MQEMLQEPSF (TYRP1_HUMAN)
MKEMLQEPSW

SEQ ID NO: 179576 - protein, 10 aa, Artificial Sequence
  Description of Artificial Sequence: Synthetic peptide
  Seed: SVKKTFLGVG (TYRP1_HUMAN)
SMKKTFLGVK

SEQ ID NO: 179577 - protein, 9 aa, Artificial Sequence
  Description of Artificial Sequence: Synthetic peptide
  Seed: SVKKTFLGV (TYRP1_HUMAN)
SVKKTFLGI

SEQ ID NO: 179578 - protein, 10 aa, Artificial Sequence
  Description of Artificial Sequence: Synthetic peptide
  Seed: YNYFVWTHYY (TYRP1_HUMAN)
YKYFVWTHYW

SEQ ID NO: 179579 - protein, 10 aa, Artificial Sequence
  Description of Artificial Sequence: Synthetic peptide
  Seed: YNYFVWTHYY (TYRP1_HUMAN)
YMYFVWTHYW

SEQ ID NO: 179580 - protein, 9 aa, Artificial Sequence
  Description of Artificial Sequence: Synthetic peptide
  Seed: HYYSVKKTF (TYRP1_HUMAN)
HKYSVKKTY

SEQ ID NO: 179581 - protein, 8 aa, Artificial Sequence
  Description of Artificial Sequence: Synthetic peptide
  Seed: YFVWTHYY (TYRP1_HUMAN)
YYVWTHYY

SEQ ID NO: 179582 - protein, 10 aa, Artificial Sequence
  Description of Artificial Sequence: Synthetic peptide
  Seed: LLLVALIFGT (TYRP1_HUMAN)
LDLVALIFGL

SEQ ID NO: 179583 - protein, 9 aa, Artificial Sequence
  Description of Artificial Sequence: Synthetic peptide
  Seed: CIFFPLLLF (TYRP1_HUMAN)
CSFFPLLLL

SEQ ID NO: 179584 - protein, 10 aa, Artificial Sequence
  Description of Artificial Sequence: Synthetic peptide
  Seed: FVWTHYYSVK (TYRP1_HUMAN)
FLWTHYYSVR

SEQ ID NO: 179585 - protein, 9 aa, Artificial Sequence
  Description of Artificial Sequence: Synthetic peptide
  Seed: HYYSVKKTF (TYRP1_HUMAN)
HAYSVKKTI

SEQ ID NO: 179586 - protein, 10 aa, Artificial Sequence
  Description of Artificial Sequence: Synthetic peptide
  Seed: FSLPYWNFAT (TYRP1_HUMAN)
FLLPYWNFAI

SEQ ID NO: 179587 - protein, 10 aa, Artificial Sequence
  Description of Artificial Sequence: Synthetic peptide
  Seed: NYFVWTHYYS (TYRP1_HUMAN)
NEFVWTHYYY

SEQ ID NO: 179588 - protein, 9 aa, Artificial Sequence
  Description of Artificial Sequence: Synthetic peptide
  Seed: RFFNRTCHC (TYRP1_HUMAN)
RTFNRTCHM

SEQ ID NO: 179589 - protein, 11 aa, Artificial Sequence
  Description of Artificial Sequence: Synthetic peptide
  Seed: MLQEPSFSLPY (TYRP1_HUMAN)
MPQEPSFSLPL

SEQ ID NO: 179590 - protein, 9 aa, Artificial Sequence
  Description of Artificial Sequence: Synthetic peptide
  Seed: SGHNCGTCR (TYRP1_HUMAN)
SFHNCGTCR

SEQ ID NO: 179591 - protein, 8 aa, Artificial Sequence
  Description of Artificial Sequence: Synthetic peptide
  Seed: YNADISTF (TYRP1_HUMAN)
YFADISTF

SEQ ID NO: 179592 - protein, 9 aa, Artificial Sequence
  Description of Artificial Sequence: Synthetic peptide
  Seed: LGCIFFPLL (TYRP1_HUMAN)
LTCIFFPLF

SEQ ID NO: 179593 - protein, 9 aa, Artificial Sequence
  Description of Artificial Sequence: Synthetic peptide
  Seed: TLISPNSVF (TYRP1_HUMAN)
TKISPNSVY

SEQ ID NO: 179594 - protein, 11 aa, Artificial Sequence
  Description of Artificial Sequence: Synthetic peptide
  Seed: VEGYSDPTGKY (TYRP1_HUMAN)
VEGYSDPTGKW

SEQ ID NO: 179595 - protein, 9 aa, Artificial Sequence
  Description of Artificial Sequence: Synthetic peptide
  Seed: RSLHNLAHL (TYRP1_HUMAN)
RKLHNLAHL

SEQ ID NO: 179596 - protein, 9 aa, Artificial Sequence
  Description of Artificial Sequence: Synthetic peptide
  Seed: YNYFVWTHY (TYRP1_HUMAN)
YMYFVWTHK

SEQ ID NO: 179597 - protein, 9 aa, Artificial Sequence
  Description of Artificial Sequence: Synthetic peptide
  Seed: STLISPNSV (TYRP1_HUMAN)
SSLISPNSM

SEQ ID NO: 179598 - protein, 11 aa, Artificial Sequence
  Description of Artificial Sequence: Synthetic peptide
  Seed: REFSVPEIIAI (TYRP1_HUMAN)
RPFSVPEIIAF

SEQ ID NO: 179599 - protein, 9 aa, Artificial Sequence
  Description of Artificial Sequence: Synthetic peptide
  Seed: SLGCIFFPL (TYRP1_HUMAN)
SVGCIFFPA

SEQ ID NO: 179600 - protein, 8 aa, Artificial Sequence
  Description of Artificial Sequence: Synthetic peptide
  Seed: RQYNMVPF (TYRP1_HUMAN)
RQYNMVPW

SEQ ID NO: 179601 - protein, 11 aa, Artificial Sequence
  Description of Artificial Sequence: Synthetic peptide
  Seed: RRYNADISTFP (TYRP1_HUMAN)
RYYNADISTFL

SEQ ID NO: 179602 - protein, 10 aa, Artificial Sequence
  Description of Artificial Sequence: Synthetic peptide
  Seed: LSPNDPIFVL (TYRP1_HUMAN)
LYPNDPIFVW

SEQ ID NO: 179603 - protein, 11 aa, Artificial Sequence
  Description of Artificial Sequence: Synthetic peptide
  Seed: IYNYFVWTHYY (TYRP1_HUMAN)
IINYFVWTHYY

SEQ ID NO: 179604 - protein, 10 aa, Artificial Sequence
  Description of Artificial Sequence: Synthetic peptide
  Seed: HPLFVIATRR (TYRP1_HUMAN)
HQLFVIATRR

SEQ ID NO: 179605 - protein, 11 aa, Artificial Sequence
  Description of Artificial Sequence: Synthetic peptide
  Seed: MSAPKLLSLGC (TYRP1_HUMAN)
MTAPKLLSLGW

SEQ ID NO: 179606 - protein, 10 aa, Artificial Sequence
  Description of Artificial Sequence: Synthetic peptide
  Seed: WPPVTNTEMF (TYRP1_HUMAN)
WIPVTNTEMW

SEQ ID NO: 179607 - protein, 9 aa, Artificial Sequence
  Description of Artificial Sequence: Synthetic peptide
  Seed: AFLTWHRYH (TYRP1_HUMAN)
AALTWHRYR

SEQ ID NO: 179608 - protein, 10 aa, Artificial Sequence
  Description of Artificial Sequence: Synthetic peptide
  Seed: MVPFWPPVTN (TYRP1_HUMAN)
MTPFWPPVTL

SEQ ID NO: 179609 - protein, 10 aa, Artificial Sequence
  Description of Artificial Sequence: Synthetic peptide
  Seed: EVWPLRFFNR (TYRP1_HUMAN)
EMWPLRFFNK

SEQ ID NO: 179610 - protein, 9 aa, Artificial Sequence
  Description of Artificial Sequence: Synthetic peptide
  Seed: RFFNRTCHC (TYRP1_HUMAN)
RSFNRTCHM

SEQ ID NO: 179611 - protein, 9 aa, Artificial Sequence
  Description of Artificial Sequence: Synthetic peptide
  Seed: GLFDTPPFY (TYRP1_HUMAN)
GMFDTPPFA

SEQ ID NO: 179612 - protein, 9 aa, Artificial Sequence
  Description of Artificial Sequence: Synthetic peptide
  Seed: RQYNMVPFW (TYRP1_HUMAN)
RRYNMVPFF

SEQ ID NO: 179613 - protein, 9 aa, Artificial Sequence
  Description of Artificial Sequence: Synthetic peptide
  Seed: SLHNLAHLF (TYRP1_HUMAN)
SLHNLAHLL

SEQ ID NO: 179614 - protein, 11 aa, Artificial Sequence
  Description of Artificial Sequence: Synthetic peptide
  Seed: NYFVWTHYYSV (TYRP1_HUMAN)
NIFVWTHYYSV

SEQ ID NO: 179615 - protein, 10 aa, Artificial Sequence
  Description of Artificial Sequence: Synthetic peptide
  Seed: SMDEANQPLL (TYRP1_HUMAN)
STDEANQPLV

SEQ ID NO: 179616 - protein, 9 aa, Artificial Sequence
  Description of Artificial Sequence: Synthetic peptide
  Seed: TTHPLFVIA (TYRP1_HUMAN)
TAHPLFVIF

SEQ ID NO: 179617 - protein, 10 aa, Artificial Sequence
  Description of Artificial Sequence: Synthetic peptide
  Seed: STLISPNSVF (TYRP1_HUMAN)
SHLISPNSVY

SEQ ID NO: 179618 - protein, 10 aa, Artificial Sequence
  Description of Artificial Sequence: Synthetic peptide
  Seed: FGTASYLIRA (TYRP1_HUMAN)
FETASYLIRV

SEQ ID NO: 179619 - protein, 10 aa, Artificial Sequence
  Description of Artificial Sequence: Synthetic peptide
  Seed: FSLPYWNFAT (TYRP1_HUMAN)
FHLPYWNFAA

SEQ ID NO: 179620 - protein, 9 aa, Artificial Sequence
  Description of Artificial Sequence: Synthetic peptide
  Seed: MDEANQPLL (TYRP1_HUMAN)
MAEANQPLL

SEQ ID NO: 179621 - protein, 10 aa, Artificial Sequence
  Description of Artificial Sequence: Synthetic peptide
  Seed: SVPEIIAIAV (TYRP1_HUMAN)
SSPEIIAIAL

SEQ ID NO: 179622 - protein, 8 aa, Artificial Sequence
  Description of Artificial Sequence: Synthetic peptide
  Seed: LIFGTASY (TYRP1_HUMAN)
LVFGTASY

SEQ ID NO: 179623 - protein, 9 aa, Artificial Sequence
  Description of Artificial Sequence: Synthetic peptide
  Seed: RLEKDMQEM (TYRP1_HUMAN)
RMEKDMQEM

SEQ ID NO: 179624 - protein, 9 aa, Artificial Sequence
  Description of Artificial Sequence: Synthetic peptide
  Seed: WPPVTNTEM (TYRP1_HUMAN)
WMPVTNTEL

SEQ ID NO: 179625 - protein, 9 aa, Artificial Sequence
  Description of Artificial Sequence: Synthetic peptide
  Seed: NMVPFWPPV (TYRP1_HUMAN)
NKVPFWPPF

SEQ ID NO: 179626 - protein, 10 aa, Artificial Sequence
  Description of Artificial Sequence: Synthetic peptide
  Seed: VLLHTFTDAV (TYRP1_HUMAN)
VKLHTFTDAV

SEQ ID NO: 179627 - protein, 10 aa, Artificial Sequence
  Description of Artificial Sequence: Synthetic peptide
  Seed: LLHTFTDAVF (TYRP1_HUMAN)
LIHTFTDAVF

SEQ ID NO: 179628 - protein, 9 aa, Artificial Sequence
  Description of Artificial Sequence: Synthetic peptide
  Seed: APIGHNRQY (TYRP1_HUMAN)
ASIGHNRQL

SEQ ID NO: 179629 - protein, 9 aa, Artificial Sequence
  Description of Artificial Sequence: Synthetic peptide
  Seed: IYNYFVWTH (TYRP1_HUMAN)
IGNYFVWTR

SEQ ID NO: 179630 - protein, 10 aa, Artificial Sequence
  Description of Artificial Sequence: Synthetic peptide
  Seed: GKYDPAVRSL (TYRP1_HUMAN)
GQYDPAVRSM

SEQ ID NO: 179631 - protein, 10 aa, Artificial Sequence
  Description of Artificial Sequence: Synthetic peptide
  Seed: TAPDNLGYTY (TYRP1_HUMAN)
TTPDNLGYTW

SEQ ID NO: 179632 - protein, 10 aa, Artificial Sequence
  Description of Artificial Sequence: Synthetic peptide
  Seed: LPYWNFATGK (TYRP1_HUMAN)
LAYWNFATGK

SEQ ID NO: 179633 - protein, 9 aa, Artificial Sequence
  Description of Artificial Sequence: Synthetic peptide
  Seed: LTDQYQCYA (TYRP1_HUMAN)
LADQYQCYF

SEQ ID NO: 179634 - protein, 9 aa, Artificial Sequence
  Description of Artificial Sequence: Synthetic peptide
  Seed: FSVPEIIAI (TYRP1_HUMAN)
FAVPEIIAV

SEQ ID NO: 179635 - protein, 11 aa, Artificial Sequence
  Description of Artificial Sequence: Synthetic peptide
  Seed: IYNYFVWTHYY (TYRP1_HUMAN)
IYNYFVWTHYI

SEQ ID NO: 179636 - protein, 9 aa, Artificial Sequence
  Description of Artificial Sequence: Synthetic peptide
  Seed: LIFGTASYL (TYRP1_HUMAN)
LRFGTASYY

SEQ ID NO: 179637 - protein, 9 aa, Artificial Sequence
  Description of Artificial Sequence: Synthetic peptide
  Seed: MAKRTTHPL (TYRP1_HUMAN)
MLKRTTHPI

SEQ ID NO: 179638 - protein, 9 aa, Artificial Sequence
  Description of Artificial Sequence: Synthetic peptide
  Seed: ARAQFPRQC (TYRP1_HUMAN)
AHAQFPRQY

SEQ ID NO: 179639 - protein, 9 aa, Artificial Sequence
  Description of Artificial Sequence: Synthetic peptide
  Seed: SPNSVFSQW (TYRP1_HUMAN)
SVNSVFSQY

SEQ ID NO: 179640 - protein, 9 aa, Artificial Sequence
  Description of Artificial Sequence: Synthetic peptide
  Seed: SFRNTVEGY (TYRP1_HUMAN)
SMRNTVEGF

SEQ ID NO: 179641 - protein, 11 aa, Artificial Sequence
  Description of Artificial Sequence: Synthetic peptide
  Seed: EILGPDGNTPQ (TYRP1_HUMAN)
EILGPDGNTPR

SEQ ID NO: 179642 - protein, 8 aa, Artificial Sequence
  Description of Artificial Sequence: Synthetic peptide
  Seed: YSDPTGKY (TYRP1_HUMAN)
YADPTGKM

SEQ ID NO: 179643 - protein, 9 aa, Artificial Sequence
  Description of Artificial Sequence: Synthetic peptide
  Seed: FLGVGQESF (TYRP1_HUMAN)
FAGVGQESL

SEQ ID NO: 179644 - protein, 9 aa, Artificial Sequence
  Description of Artificial Sequence: Synthetic peptide
  Seed: SLHNLAHLF (TYRP1_HUMAN)
SCHNLAHLW

SEQ ID NO: 179645 - protein, 9 aa, Artificial Sequence
  Description of Artificial Sequence: Synthetic peptide
  Seed: YTYEIQWPS (TYRP1_HUMAN)
YGYEIQWPR

SEQ ID NO: 179646 - protein, 11 aa, Artificial Sequence
  Description of Artificial Sequence: Synthetic peptide
  Seed: LEVGLFDTPPF (TYRP1_HUMAN)
LQVGLFDTPPF

SEQ ID NO: 179647 - protein, 9 aa, Artificial Sequence
  Description of Artificial Sequence: Synthetic peptide
  Seed: FSHEGPAFL (TYRP1_HUMAN)
FWHEGPAFM

SEQ ID NO: 179648 - protein, 10 aa, Artificial Sequence
  Description of Artificial Sequence: Synthetic peptide
  Seed: ENISIYNYFV (TYRP1_HUMAN)
EVISIYNYFA

SEQ ID NO: 179649 - protein, 11 aa, Artificial Sequence
  Description of Artificial Sequence: Synthetic peptide
  Seed: IYNYFVWTHYY (TYRP1_HUMAN)
IGNYFVWTHYL

SEQ ID NO: 179650 - protein, 10 aa, Artificial Sequence
  Description of Artificial Sequence: Synthetic peptide
  Seed: FWPPVTNTEM (TYRP1_HUMAN)
FYPPVTNTEY

SEQ ID NO: 179651 - protein, 9 aa, Artificial Sequence
  Description of Artificial Sequence: Synthetic peptide
  Seed: FYSNSTNSF (TYRP1_HUMAN)
FFSNSTNSI

SEQ ID NO: 179652 - protein, 11 aa, Artificial Sequence
  Description of Artificial Sequence: Synthetic peptide
  Seed: LSPVSGPGTDR (TYRP1_HUMAN)
LAPVSGPGTDL

SEQ ID NO: 179653 - protein, 9 aa, Artificial Sequence
  Description of Artificial Sequence: Synthetic peptide
  Seed: AQFPRQCAT (TYRP1_HUMAN)
AAFPRQCAY

SEQ ID NO: 179654 - protein, 10 aa, Artificial Sequence
  Description of Artificial Sequence: Synthetic peptide
  Seed: GNVARPMVQR (TYRP1_HUMAN)
GGVARPMVQK

SEQ ID NO: 179655 - protein, 10 aa, Artificial Sequence
  Description of Artificial Sequence: Synthetic peptide
  Seed: LGPDGNTPQF (TYRP1_HUMAN)
LSPDGNTPQM

SEQ ID NO: 179656 - protein, 10 aa, Artificial Sequence
  Description of Artificial Sequence: Synthetic peptide
  Seed: YNMVPFWPPV (TYRP1_HUMAN)
YEMVPFWPPM

SEQ ID NO: 179657 - protein, 9 aa, Artificial Sequence
  Description of Artificial Sequence: Synthetic peptide
  Seed: FYSNSTNSF (TYRP1_HUMAN)
FTSNSTNSF

SEQ ID NO: 179658 - protein, 9 aa, Artificial Sequence
  Description of Artificial Sequence: Synthetic peptide
  Seed: RSNFDSTLI (TYRP1_HUMAN)
RTNFDSTLK

SEQ ID NO: 179659 - protein, 10 aa, Artificial Sequence
  Description of Artificial Sequence: Synthetic peptide
  Seed: HRYHLLRLEK (TYRP1_HUMAN)
HTYHLLRLEK

SEQ ID NO: 179660 - protein, 9 aa, Artificial Sequence
  Description of Artificial Sequence: Synthetic peptide
  Seed: IAVVGALLL (TYRP1_HUMAN)
ICVVGALLW

SEQ ID NO: 179661 - protein, 10 aa, Artificial Sequence
  Description of Artificial Sequence: Synthetic peptide
  Seed: STFPLENAPI (TYRP1_HUMAN)
SIFPLENAPV

SEQ ID NO: 179662 - protein, 11 aa, Artificial Sequence
  Description of Artificial Sequence: Synthetic peptide
  Seed: SLPYWNFATGK (TYRP1_HUMAN)
SYPYWNFATGR

SEQ ID NO: 179663 - protein, 9 aa, Artificial Sequence
  Description of Artificial Sequence: Synthetic peptide
  Seed: APDNLGYTY (TYRP1_HUMAN)
AQDNLGYTY

SEQ ID NO: 179664 - protein, 9 aa, Artificial Sequence
  Description of Artificial Sequence: Synthetic peptide
  Seed: TTHPLFVIA (TYRP1_HUMAN)
TVHPLFVIK

SEQ ID NO: 179665 - protein, 9 aa, Artificial Sequence
  Description of Artificial Sequence: Synthetic peptide
  Seed: RGRCEAVTA (TYRP1_HUMAN)
RYRCEAVTK

SEQ ID NO: 179666 - protein, 9 aa, Artificial Sequence
  Description of Artificial Sequence: Synthetic peptide
  Seed: MLQEPSFSL (TYRP1_HUMAN)
MFQEPSFSW

SEQ ID NO: 179667 - protein, 10 aa, Artificial Sequence
  Description of Artificial Sequence: Synthetic peptide
  Seed: ALIFGTASYL (TYRP1_HUMAN)
ALIFGTASYF

SEQ ID NO: 179668 - protein, 9 aa, Artificial Sequence
  Description of Artificial Sequence: Synthetic peptide
  Seed: GPAFLTWHR (TYRP1_HUMAN)
GMAFLTWHR

SEQ ID NO: 179669 - protein, 9 aa, Artificial Sequence
  Description of Artificial Sequence: Synthetic peptide
  Seed: FYSNSTNSF (TYRP1_HUMAN)
FSSNSTNSI

SEQ ID NO: 179670 - protein, 9 aa, Artificial Sequence
  Description of Artificial Sequence: Synthetic peptide
  Seed: IAIAVVGAL (TYRP1_HUMAN)
IKIAVVGAL

SEQ ID NO: 179671 - protein, 10 aa, Artificial Sequence
  Description of Artificial Sequence: Synthetic peptide
  Seed: ADSRPHSPQY (TYRP1_HUMAN)
AYSRPHSPQK

SEQ ID NO: 179672 - protein, 9 aa, Artificial Sequence
  Description of Artificial Sequence: Synthetic peptide
  Seed: NMVPFWPPV (TYRP1_HUMAN)
NSVPFWPPV

SEQ ID NO: 179673 - protein, 11 aa, Artificial Sequence
  Description of Artificial Sequence: Synthetic peptide
  Seed: VTAPDNLGYTY (TYRP1_HUMAN)
VIAPDNLGYTF

SEQ ID NO: 179674 - protein, 11 aa, Artificial Sequence
  Description of Artificial Sequence: Synthetic peptide
  Seed: RSMDEANQPLL (TYRP1_HUMAN)
RVMDEANQPLY

SEQ ID NO: 179675 - protein, 9 aa, Artificial Sequence
  Description of Artificial Sequence: Synthetic peptide
  Seed: SVFSQWRVV (TYRP1_HUMAN)
SAFSQWRVV

SEQ ID NO: 179676 - protein, 9 aa, Artificial Sequence
  Description of Artificial Sequence: Synthetic peptide
  Seed: FVWTHYYSV (TYRP1_HUMAN)
FPWTHYYSA

SEQ ID NO: 179677 - protein, 10 aa, Artificial Sequence
  Description of Artificial Sequence: Synthetic peptide
  Seed: FSLPYWNFAT (TYRP1_HUMAN)
FILPYWNFAL

SEQ ID NO: 179678 - protein, 11 aa, Artificial Sequence
  Description of Artificial Sequence: Synthetic peptide
  Seed: FENISIYNYFV (TYRP1_HUMAN)
FINISIYNYFV

SEQ ID NO: 179679 - protein, 10 aa, Artificial Sequence
  Description of Artificial Sequence: Synthetic peptide
  Seed: RSMDEANQPL (TYRP1_HUMAN)
RYMDEANQPV

SEQ ID NO: 179680 - protein, 9 aa, Artificial Sequence
  Description of Artificial Sequence: Synthetic peptide
  Seed: RFFNRTCHC (TYRP1_HUMAN)
RAFNRTCHK

SEQ ID NO: 179681 - protein, 9 aa, Artificial Sequence
  Description of Artificial Sequence: Synthetic peptide
  Seed: YLIRARRSM (TYRP1_HUMAN)
YGIRARRSY

SEQ ID NO: 179682 - protein, 10 aa, Artificial Sequence
  Description of Artificial Sequence: Synthetic peptide
  Seed: KRTTHPLFVI (TYRP1_HUMAN)
KVTTHPLFVF

SEQ ID NO: 179683 - protein, 9 aa, Artificial Sequence
  Description of Artificial Sequence: Synthetic peptide
  Seed: STNSFRNTV (TYRP1_HUMAN)
SANSFRNTK

SEQ ID NO: 179684 - protein, 10 aa, Artificial Sequence
  Description of Artificial Sequence: Synthetic peptide
  Seed: VALIFGTASY (TYRP1_HUMAN)
VALIFGTASW

SEQ ID NO: 179685 - protein, 9 aa, Artificial Sequence
  Description of Artificial Sequence: Synthetic peptide
  Seed: HLSPNDPIF (TYRP1_HUMAN)
HHSPNDPIL

SEQ ID NO: 179686 - protein, 9 aa, Artificial Sequence
  Description of Artificial Sequence: Synthetic peptide
  Seed: SLGCIFFPL (TYRP1_HUMAN)
SLGCIFFPS

SEQ ID NO: 179687 - protein, 9 aa, Artificial Sequence
  Description of Artificial Sequence: Synthetic peptide
  Seed: RSNFDSTLI (TYRP1_HUMAN)
RINFDSTLW

SEQ ID NO: 179688 - protein, 11 aa, Artificial Sequence
  Description of Artificial Sequence: Synthetic peptide
  Seed: VALIFGTASYL (TYRP1_HUMAN)
VILIFGTASYV

SEQ ID NO: 179689 - protein, 10 aa, Artificial Sequence
  Description of Artificial Sequence: Synthetic peptide
  Seed: GTASYLIRAR (TYRP1_HUMAN)
GSASYLIRAK

SEQ ID NO: 179690 - protein, 9 aa, Artificial Sequence
  Description of Artificial Sequence: Synthetic peptide
  Seed: HRYHLLRLE (TYRP1_HUMAN)
HRYHLLRLI

SEQ ID NO: 179691 - protein, 11 aa, Artificial Sequence
  Description of Artificial Sequence: Synthetic peptide
  Seed: YNMVPFWPPVT (TYRP1_HUMAN)
YMMVPFWPPVT

SEQ ID NO: 179692 - protein, 8 aa, Artificial Sequence
  Description of Artificial Sequence: Synthetic peptide
  Seed: HTFTDAVF (TYRP1_HUMAN)
HMFTDAVM

SEQ ID NO: 179693 - protein, 9 aa, Artificial Sequence
  Description of Artificial Sequence: Synthetic peptide
  Seed: KYDPAVRSL (TYRP1_HUMAN)
KFDPAVRSI

SEQ ID NO: 179694 - protein, 9 aa, Artificial Sequence
  Description of Artificial Sequence: Synthetic peptide
  Seed: FSVPEIIAI (TYRP1_HUMAN)
FMVPEIIAI

SEQ ID NO: 179695 - protein, 9 aa, Artificial Sequence
  Description of Artificial Sequence: Synthetic peptide
  Seed: FLTWHRYHL (TYRP1_HUMAN)
FMTWHRYHA

SEQ ID NO: 179696 - protein, 11 aa, Artificial Sequence
  Description of Artificial Sequence: Synthetic peptide
  Seed: IYNYFVWTHYY (TYRP1_HUMAN)
IENYFVWTHYF

SEQ ID NO: 179697 - protein, 10 aa, Artificial Sequence
  Description of Artificial Sequence: Synthetic peptide
  Seed: FSLPYWNFAT (TYRP1_HUMAN)
FELPYWNFAA

SEQ ID NO: 179698 - protein, 9 aa, Artificial Sequence
  Description of Artificial Sequence: Synthetic peptide
  Seed: RPMVQRLPE (TYRP1_HUMAN)
RPMVQRLPM

SEQ ID NO: 179699 - protein, 9 aa, Artificial Sequence
  Description of Artificial Sequence: Synthetic peptide
  Seed: IAIAVVGAL (TYRP1_HUMAN)
IVIAVVGAV

SEQ ID NO: 179700 - protein, 9 aa, Artificial Sequence
  Description of Artificial Sequence: Synthetic peptide
  Seed: RYNADISTF (TYRP1_HUMAN)
RRNADISTY

SEQ ID NO: 179701 - protein, 9 aa, Artificial Sequence
  Description of Artificial Sequence: Synthetic peptide
  Seed: STNSFRNTV (TYRP1_HUMAN)
SRNSFRNTL

SEQ ID NO: 179702 - protein, 9 aa, Artificial Sequence
  Description of Artificial Sequence: Synthetic peptide
  Seed: VFDEWLRRY (TYRP1_HUMAN)
VSDEWLRRV

SEQ ID NO: 179703 - protein, 9 aa, Artificial Sequence
  Description of Artificial Sequence: Synthetic peptide
  Seed: STNSFRNTV (TYRP1_HUMAN)
SMNSFRNTV

SEQ ID NO: 179704 - protein, 9 aa, Artificial Sequence
  Description of Artificial Sequence: Synthetic peptide
  Seed: FSHEGPAFL (TYRP1_HUMAN)
FSHEGPAFA

SEQ ID NO: 179705 - protein, 10 aa, Artificial Sequence
  Description of Artificial Sequence: Synthetic peptide
  Seed: EGPAFLTWHR (TYRP1_HUMAN)
ESPAFLTWHK

SEQ ID NO: 179706 - protein, 10 aa, Artificial Sequence
  Description of Artificial Sequence: Synthetic peptide
  Seed: FYSNSTNSFR (TYRP1_HUMAN)
FFSNSTNSFL

SEQ ID NO: 179707 - protein, 9 aa, Artificial Sequence
  Description of Artificial Sequence: Synthetic peptide
  Seed: SLHNLAHLF (TYRP1_HUMAN)
SSHNLAHLW

SEQ ID NO: 179708 - protein, 10 aa, Artificial Sequence
  Description of Artificial Sequence: Synthetic peptide
  Seed: TASYLIRARR (TYRP1_HUMAN)
TVSYLIRARR

SEQ ID NO: 179709 - protein, 9 aa, Artificial Sequence
  Description of Artificial Sequence: Synthetic peptide
  Seed: AVVGALLLV (TYRP1_HUMAN)
AMVGALLLV

SEQ ID NO: 179710 - protein, 10 aa, Artificial Sequence
  Description of Artificial Sequence: Synthetic peptide
  Seed: SLGCIFFPLL (TYRP1_HUMAN)
SIGCIFFPLV

SEQ ID NO: 179711 - protein, 10 aa, Artificial Sequence
  Description of Artificial Sequence: Synthetic peptide
  Seed: GKYDPAVRSL (TYRP1_HUMAN)
GQYDPAVRSW

SEQ ID NO: 179712 - protein, 9 aa, Artificial Sequence
  Description of Artificial Sequence: Synthetic peptide
  Seed: YLIRARRSM (TYRP1_HUMAN)
YTIRARRSF

SEQ ID NO: 179713 - protein, 9 aa, Artificial Sequence
  Description of Artificial Sequence: Synthetic peptide
  Seed: SVPEIIAIA (TYRP1_HUMAN)
SAPEIIAIR

SEQ ID NO: 179714 - protein, 9 aa, Artificial Sequence
  Description of Artificial Sequence: Synthetic peptide
  Seed: LIFGTASYL (TYRP1_HUMAN)
LYFGTASYI

SEQ ID NO: 179715 - protein, 8 aa, Artificial Sequence
  Description of Artificial Sequence: Synthetic peptide
  Seed: LIRARRSM (TYRP1_HUMAN)
LLRARRSF

SEQ ID NO: 179716 - protein, 10 aa, Artificial Sequence
  Description of Artificial Sequence: Synthetic peptide
  Seed: KRTTHPLFVI (TYRP1_HUMAN)
KITTHPLFVF

SEQ ID NO: 179717 - protein, 10 aa, Artificial Sequence
  Description of Artificial Sequence: Synthetic peptide
  Seed: MQEMLQEPSF (TYRP1_HUMAN)
MMEMLQEPSW

SEQ ID NO: 179718 - protein, 9 aa, Artificial Sequence
  Description of Artificial Sequence: Synthetic peptide
  Seed: RRNPAGNVA (TYRP1_HUMAN)
RRNPAGNVL

SEQ ID NO: 179719 - protein, 9 aa, Artificial Sequence
  Description of Artificial Sequence: Synthetic peptide
  Seed: APIGHNRQY (TYRP1_HUMAN)
APIGHNRQI

SEQ ID NO: 179720 - protein, 9 aa, Artificial Sequence
  Description of Artificial Sequence: Synthetic peptide
  Seed: SMDEANQPL (TYRP1_HUMAN)
SFDEANQPV

SEQ ID NO: 179721 - protein, 9 aa, Artificial Sequence
  Description of Artificial Sequence: Synthetic peptide
  Seed: VARPMVQRL (TYRP1_HUMAN)
VARPMVQRV

SEQ ID NO: 179722 - protein, 8 aa, Artificial Sequence
  Description of Artificial Sequence: Synthetic peptide
  Seed: IQWPSREF (TYRP1_HUMAN)
IQWPSREY

SEQ ID NO: 179723 - protein, 9 aa, Artificial Sequence
  Description of Artificial Sequence: Synthetic peptide
  Seed: IAVVGALLL (TYRP1_HUMAN)
IRVVGALLF

SEQ ID NO: 179724 - protein, 10 aa, Artificial Sequence
  Description of Artificial Sequence: Synthetic peptide
  Seed: YNYFVWTHYY (TYRP1_HUMAN)
YIYFVWTHYY

SEQ ID NO: 179725 - protein, 11 aa, Artificial Sequence
  Description of Artificial Sequence: Synthetic peptide
  Seed: YNMVPFWPPVT (TYRP1_HUMAN)
YLMVPFWPPVG

SEQ ID NO: 179726 - protein, 9 aa, Artificial Sequence
  Description of Artificial Sequence: Synthetic peptide
  Seed: NRQYNMVPF (TYRP1_HUMAN)
NQQYNMVPL

SEQ ID NO: 179727 - protein, 9 aa, Artificial Sequence
  Description of Artificial Sequence: Synthetic peptide
  Seed: DDREVWPLR (TYRP1_HUMAN)
DMREVWPLR

SEQ ID NO: 179728 - protein, 9 aa, Artificial Sequence
  Description of Artificial Sequence: Synthetic peptide
  Seed: RTTHPLFVI (TYRP1_HUMAN)
RGTHPLFVW

SEQ ID NO: 179729 - protein, 9 aa, Artificial Sequence
  Description of Artificial Sequence: Synthetic peptide
  Seed: HYYSVKKTF (TYRP1_HUMAN)
HQYSVKKTL

SEQ ID NO: 179730 - protein, 9 aa, Artificial Sequence
  Description of Artificial Sequence: Synthetic peptide
  Seed: AQFPRQCAT (TYRP1_HUMAN)
AEFPRQCAC

SEQ ID NO: 179731 - protein, 10 aa, Artificial Sequence
  Description of Artificial Sequence: Synthetic peptide
  Seed: FVLLHTFTDA (TYRP1_HUMAN)
FFLLHTFTDI

SEQ ID NO: 179732 - protein, 9 aa, Artificial Sequence
  Description of Artificial Sequence: Synthetic peptide
  Seed: LLVALIFGT (TYRP1_HUMAN)
LQVALIFGV

SEQ ID NO: 179733 - protein, 9 aa, Artificial Sequence
  Description of Artificial Sequence: Synthetic peptide
  Seed: FVWTHYYSV (TYRP1_HUMAN)
FIWTHYYSK

SEQ ID NO: 179734 - protein, 11 aa, Artificial Sequence
  Description of Artificial Sequence: Synthetic peptide
  Seed: REFSVPEIIAI (TYRP1_HUMAN)
RQFSVPEIIAI

SEQ ID NO: 179735 - protein, 9 aa, Artificial Sequence
  Description of Artificial Sequence: Synthetic peptide
  Seed: YLIRARRSM (TYRP1_HUMAN)
YLIRARRSY

SEQ ID NO: 179736 - protein, 9 aa, Artificial Sequence
  Description of Artificial Sequence: Synthetic peptide
  Seed: RFFNRTCHC (TYRP1_HUMAN)
RYFNRTCHY

SEQ ID NO: 179737 - protein, 10 aa, Artificial Sequence
  Description of Artificial Sequence: Synthetic peptide
  Seed: YNMVPFWPPV (TYRP1_HUMAN)
YQMVPFWPPS

SEQ ID NO: 179738 - protein, 10 aa, Artificial Sequence
  Description of Artificial Sequence: Synthetic peptide
  Seed: ISPNSVFSQW (TYRP1_HUMAN)
IYPNSVFSQW

SEQ ID NO: 179739 - protein, 11 aa, Artificial Sequence
  Description of Artificial Sequence: Synthetic peptide
  Seed: RSLHNLAHLFL (TYRP1_HUMAN)
RALHNLAHLFF

SEQ ID NO: 179740 - protein, 9 aa, Artificial Sequence
  Description of Artificial Sequence: Synthetic peptide
  Seed: SLHNLAHLF (TYRP1_HUMAN)
SYHNLAHLW

SEQ ID NO: 179741 - protein, 10 aa, Artificial Sequence
  Description of Artificial Sequence: Synthetic peptide
  Seed: HRYHLLRLEK (TYRP1_HUMAN)
HRYHLLRLEY

SEQ ID NO: 179742 - protein, 10 aa, Artificial Sequence
  Description of Artificial Sequence: Synthetic peptide
  Seed: YNMVPFWPPV (TYRP1_HUMAN)
YMMVPFWPPM

SEQ ID NO: 179743 - protein, 9 aa, Artificial Sequence
  Description of Artificial Sequence: Synthetic peptide
  Seed: AACDQRVLI (TYRP1_HUMAN)
ALCDQRVLL

SEQ ID NO: 179744 - protein, 9 aa, Artificial Sequence
  Description of Artificial Sequence: Synthetic peptide
  Seed: IAIAVVGAL (TYRP1_HUMAN)
ILIAVVGAI

SEQ ID NO: 179745 - protein, 8 aa, Artificial Sequence
  Description of Artificial Sequence: Synthetic peptide
  Seed: YSDPTGKY (TYRP1_HUMAN)
YMDPTGKM

SEQ ID NO: 179746 - protein, 9 aa, Artificial Sequence
  Description of Artificial Sequence: Synthetic peptide
  Seed: IIAIAVVGA (TYRP1_HUMAN)
IQAIAVVGV

SEQ ID NO: 179747 - protein, 9 aa, Artificial Sequence
  Description of Artificial Sequence: Synthetic peptide
  Seed: YTYEIQWPS (TYRP1_HUMAN)
YVYEIQWPR

SEQ ID NO: 179748 - protein, 10 aa, Artificial Sequence
  Description of Artificial Sequence: Synthetic peptide
  Seed: YNYFVWTHYY (TYRP1_HUMAN)
YNYFVWTHYR

SEQ ID NO: 179749 - protein, 9 aa, Artificial Sequence
  Description of Artificial Sequence: Synthetic peptide
  Seed: FTDAVFDEW (TYRP1_HUMAN)
FMDAVFDEW

SEQ ID NO: 179750 - protein, 10 aa, Artificial Sequence
  Description of Artificial Sequence: Synthetic peptide
  Seed: ALIFGTASYL (TYRP1_HUMAN)
AVIFGTASYL

SEQ ID NO: 179751 - protein, 9 aa, Artificial Sequence
  Description of Artificial Sequence: Synthetic peptide
  Seed: ALLLVALIF (TYRP1_HUMAN)
AHLLVALIY

SEQ ID NO: 179752 - protein, 9 aa, Artificial Sequence
  Description of Artificial Sequence: Synthetic peptide
  Seed: TADSRPHSP (TYRP1_HUMAN)
TADSRPHSA

SEQ ID NO: 179753 - protein, 10 aa, Artificial Sequence
  Description of Artificial Sequence: Synthetic peptide
  Seed: IQWPSREFSV (TYRP1_HUMAN)
ILWPSREFSI

SEQ ID NO: 179754 - protein, 8 aa, Artificial Sequence
  Description of Artificial Sequence: Synthetic peptide
  Seed: ACDQRVLI (TYRP1_HUMAN)
AFDQRVLI

SEQ ID NO: 179755 - protein, 10 aa, Artificial Sequence
  Description of Artificial Sequence: Synthetic peptide
  Seed: IYNYFVWTHY (TYRP1_HUMAN)
IQNYFVWTHY

SEQ ID NO: 179756 - protein, 9 aa, Artificial Sequence
  Description of Artificial Sequence: Synthetic peptide
  Seed: LLHTFTDAV (TYRP1_HUMAN)
LMHTFTDAV

SEQ ID NO: 179757 - protein, 10 aa, Artificial Sequence
  Description of Artificial Sequence: Synthetic peptide
  Seed: ALIFGTASYL (TYRP1_HUMAN)
AIIFGTASYI

SEQ ID NO: 179758 - protein, 9 aa, Artificial Sequence
  Description of Artificial Sequence: Synthetic peptide
  Seed: IVRRNLLDL (TYRP1_HUMAN)
IARRNLLDK

SEQ ID NO: 179759 - protein, 9 aa, Artificial Sequence
  Description of Artificial Sequence: Synthetic peptide
  Seed: NHFVRALDM (TYRP1_HUMAN)
NQFVRALDL

SEQ ID NO: 179760 - protein, 10 aa, Artificial Sequence
  Description of Artificial Sequence: Synthetic peptide
  Seed: FLTWHRYHLL (TYRP1_HUMAN)
FLTWHRYHLM

SEQ ID NO: 179761 - protein, 9 aa, Artificial Sequence
  Description of Artificial Sequence: Synthetic peptide
  Seed: SVPEIIAIA (TYRP1_HUMAN)
SAPEIIAII

SEQ ID NO: 179762 - protein, 9 aa, Artificial Sequence
  Description of Artificial Sequence: Synthetic peptide
  Seed: GYSDPTGKY (TYRP1_HUMAN)
GLSDPTGKF

SEQ ID NO: 179763 - protein, 10 aa, Artificial Sequence
  Description of Artificial Sequence: Synthetic peptide
  Seed: CDQRVLIVRR (TYRP1_HUMAN)
CMQRVLIVRR

SEQ ID NO: 179764 - protein, 9 aa, Artificial Sequence
  Description of Artificial Sequence: Synthetic peptide
  Seed: KLLSLGCIF (TYRP1_HUMAN)
KQLSLGCIF

SEQ ID NO: 179765 - protein, 10 aa, Artificial Sequence
  Description of Artificial Sequence: Synthetic peptide
  Seed: EIIAIAVVGA (TYRP1_HUMAN)
EEIAIAVVGI

SEQ ID NO: 179766 - protein, 8 aa, Artificial Sequence
  Description of Artificial Sequence: Synthetic peptide
  Seed: LIFGTASY (TYRP1_HUMAN)
LHFGTASY

SEQ ID NO: 179767 - protein, 9 aa, Artificial Sequence
  Description of Artificial Sequence: Synthetic peptide
  Seed: FSHEGPAFL (TYRP1_HUMAN)
FQHEGPAFA

SEQ ID NO: 179768 - protein, 9 aa, Artificial Sequence
  Description of Artificial Sequence: Synthetic peptide
  Seed: RRYNADIST (TYRP1_HUMAN)
RQYNADISV

SEQ ID NO: 179769 - protein, 9 aa, Artificial Sequence
  Description of Artificial Sequence: Synthetic peptide
  Seed: SVKKTFLGV (TYRP1_HUMAN)
SMKKTFLGI

SEQ ID NO: 179770 - protein, 9 aa, Artificial Sequence
  Description of Artificial Sequence: Synthetic peptide
  Seed: VTAPDNLGY (TYRP1_HUMAN)
VAAPDNLGV

SEQ ID NO: 179771 - protein, 9 aa, Artificial Sequence
  Description of Artificial Sequence: Synthetic peptide
  Seed: LGYTYEIQW (TYRP1_HUMAN)
LTYTYEIQF

SEQ ID NO: 179772 - protein, 11 aa, Artificial Sequence
  Description of Artificial Sequence: Synthetic peptide
  Seed: VRSLHNLAHLF (TYRP1_HUMAN)
VSSLHNLAHLW

SEQ ID NO: 179773 - protein, 11 aa, Artificial Sequence
  Description of Artificial Sequence: Synthetic peptide
  Seed: YTYEIQWPSRE (TYRP1_HUMAN)
YVYEIQWPSRR

SEQ ID NO: 179774 - protein, 11 aa, Artificial Sequence
  Description of Artificial Sequence: Synthetic peptide
  Seed: FLNGTGGQTHL (TYRP1_HUMAN)
FANGTGGQTHY

SEQ ID NO: 179775 - protein, 9 aa, Artificial Sequence
  Description of Artificial Sequence: Synthetic peptide
  Seed: SVFSQWRVV (TYRP1_HUMAN)
SLFSQWRVW

SEQ ID NO: 179776 - protein, 9 aa, Artificial Sequence
  Description of Artificial Sequence: Synthetic peptide
  Seed: RSLHNLAHL (TYRP1_HUMAN)
RSLHNLAHR

SEQ ID NO: 179777 - protein, 9 aa, Artificial Sequence
  Description of Artificial Sequence: Synthetic peptide
  Seed: TADSRPHSP (TYRP1_HUMAN)
TMDSRPHSL

SEQ ID NO: 179778 - protein, 9 aa, Artificial Sequence
  Description of Artificial Sequence: Synthetic peptide
  Seed: ATRRSEEIL (TYRP1_HUMAN)
AMRRSEEIK

SEQ ID NO: 179779 - protein, 9 aa, Artificial Sequence
  Description of Artificial Sequence: Synthetic peptide
  Seed: STNSFRNTV (TYRP1_HUMAN)
SYNSFRNTK

SEQ ID NO: 179780 - protein, 9 aa, Artificial Sequence
  Description of Artificial Sequence: Synthetic peptide
  Seed: YLIRARRSM (TYRP1_HUMAN)
YQIRARRSW

SEQ ID NO: 179781 - protein, 10 aa, Artificial Sequence
  Description of Artificial Sequence: Synthetic peptide
  Seed: YTYEIQWPSR (TYRP1_HUMAN)
YLYEIQWPSK

SEQ ID NO: 179782 - protein, 10 aa, Artificial Sequence
  Description of Artificial Sequence: Synthetic peptide
  Seed: YEIQWPSREF (TYRP1_HUMAN)
YVIQWPSREF

SEQ ID NO: 179783 - protein, 9 aa, Artificial Sequence
  Description of Artificial Sequence: Synthetic peptide
  Seed: GYSDPTGKY (TYRP1_HUMAN)
GISDPTGKY

SEQ ID NO: 179784 - protein, 9 aa, Artificial Sequence
  Description of Artificial Sequence: Synthetic peptide
  Seed: HLSPNDPIF (TYRP1_HUMAN)
HMSPNDPIW

SEQ ID NO: 179785 - protein, 9 aa, Artificial Sequence
  Description of Artificial Sequence: Synthetic peptide
  Seed: KEEKNHFVR (TYRP1_HUMAN)
KEEKNHFVY

SEQ ID NO: 179786 - protein, 10 aa, Artificial Sequence
  Description of Artificial Sequence: Synthetic peptide
  Seed: YSNSTNSFRN (TYRP1_HUMAN)
YVNSTNSFRR

SEQ ID NO: 179787 - protein, 9 aa, Artificial Sequence
  Description of Artificial Sequence: Synthetic peptide
  Seed: LEKDMQEML (TYRP1_HUMAN)
LEKDMQEMV

SEQ ID NO: 179788 - protein, 9 aa, Artificial Sequence
  Description of Artificial Sequence: Synthetic peptide
  Seed: AKRTTHPLF (TYRP1_HUMAN)
AHRTTHPLF

SEQ ID NO: 179789 - protein, 10 aa, Artificial Sequence
  Description of Artificial Sequence: Synthetic peptide
  Seed: RRYNADISTF (TYRP1_HUMAN)
RGYNADISTL

SEQ ID NO: 179790 - protein, 9 aa, Artificial Sequence
  Description of Artificial Sequence: Synthetic peptide
  Seed: YTYEIQWPS (TYRP1_HUMAN)
YMYEIQWPC

SEQ ID NO: 179791 - protein, 9 aa, Artificial Sequence
  Description of Artificial Sequence: Synthetic peptide
  Seed: AACDQRVLI (TYRP1_HUMAN)
AACDQRVLW

SEQ ID NO: 179792 - protein, 9 aa, Artificial Sequence
  Description of Artificial Sequence: Synthetic peptide
  Seed: LTWHRYHLL (TYRP1_HUMAN)
LSWHRYHLK

SEQ ID NO: 179793 - protein, 10 aa, Artificial Sequence
  Description of Artificial Sequence: Synthetic peptide
  Seed: FVTAPDNLGY (TYRP1_HUMAN)
FPTAPDNLGF

SEQ ID NO: 179794 - protein, 10 aa, Artificial Sequence
  Description of Artificial Sequence: Synthetic peptide
  Seed: LSLGCIFFPL (TYRP1_HUMAN)
LKLGCIFFPI

SEQ ID NO: 179795 - protein, 9 aa, Artificial Sequence
  Description of Artificial Sequence: Synthetic peptide
  Seed: SVPEIIAIA (TYRP1_HUMAN)
SQPEIIAIY

SEQ ID NO: 179796 - protein, 9 aa, Artificial Sequence
  Description of Artificial Sequence: Synthetic peptide
  Seed: RSLHNLAHL (TYRP1_HUMAN)
RMLHNLAHL

SEQ ID NO: 179797 - protein, 9 aa, Artificial Sequence
  Description of Artificial Sequence: Synthetic peptide
  Seed: FVWTHYYSV (TYRP1_HUMAN)
FRWTHYYSM

SEQ ID NO: 179798 - protein, 10 aa, Artificial Sequence
  Description of Artificial Sequence: Synthetic peptide
  Seed: LIFGTASYLI (TYRP1_HUMAN)
LWFGTASYLW

SEQ ID NO: 179799 - protein, 8 aa, Artificial Sequence
  Description of Artificial Sequence: Synthetic peptide
  Seed: ACDQRVLI (TYRP1_HUMAN)
ASDQRVLV

SEQ ID NO: 179800 - protein, 9 aa, Artificial Sequence
  Description of Artificial Sequence: Synthetic peptide
  Seed: GLFDTPPFY (TYRP1_HUMAN)
GQFDTPPFV

SEQ ID NO: 179801 - protein, 9 aa, Artificial Sequence
  Description of Artificial Sequence: Synthetic peptide
  Seed: AVVGALLLV (TYRP1_HUMAN)
AIVGALLLI

SEQ ID NO: 179802 - protein, 9 aa, Artificial Sequence
  Description of Artificial Sequence: Synthetic peptide
  Seed: NFDSTLISP (TYRP1_HUMAN)
NMDSTLISM

SEQ ID NO: 179803 - protein, 11 aa, Artificial Sequence
  Description of Artificial Sequence: Synthetic peptide
  Seed: RSMDEANQPLL (TYRP1_HUMAN)
RIMDEANQPLM

SEQ ID NO: 179804 - protein, 10 aa, Artificial Sequence
  Description of Artificial Sequence: Synthetic peptide
  Seed: HFVRALDMAK (TYRP1_HUMAN)
HVVRALDMAR

SEQ ID NO: 179805 - protein, 9 aa, Artificial Sequence
  Description of Artificial Sequence: Synthetic peptide
  Seed: LLTDQYQCY (TYRP1_HUMAN)
LFTDQYQCY

SEQ ID NO: 179806 - protein, 9 aa, Artificial Sequence
  Description of Artificial Sequence: Synthetic peptide
  Seed: VFDEWLRRY (TYRP1_HUMAN)
VGDEWLRRM

SEQ ID NO: 179807 - protein, 11 aa, Artificial Sequence
  Description of Artificial Sequence: Synthetic peptide
  Seed: DRCGSSSGRGR (TYRP1_HUMAN)
DVCGSSSGRGR

SEQ ID NO: 179808 - protein, 10 aa, Artificial Sequence
  Description of Artificial Sequence: Synthetic peptide
  Seed: ASYLIRARRS (TYRP1_HUMAN)
AVYLIRARRR

SEQ ID NO: 179809 - protein, 9 aa, Artificial Sequence
  Description of Artificial Sequence: Synthetic peptide
  Seed: FSHEGPAFL (TYRP1_HUMAN)
FLHEGPAFM

SEQ ID NO: 179810 - protein, 10 aa, Artificial Sequence
  Description of Artificial Sequence: Synthetic peptide
  Seed: AQFPRQCATV (TYRP1_HUMAN)
AAFPRQCATF

SEQ ID NO: 179811 - protein, 11 aa, Artificial Sequence
  Description of Artificial Sequence: Synthetic peptide
  Seed: FWPPVTNTEMF (TYRP1_HUMAN)
FGPPVTNTEMW

SEQ ID NO: 179812 - protein, 9 aa, Artificial Sequence
  Description of Artificial Sequence: Synthetic peptide
  Seed: IAVVGALLL (TYRP1_HUMAN)
ITVVGALLY

SEQ ID NO: 179813 - protein, 9 aa, Artificial Sequence
  Description of Artificial Sequence: Synthetic peptide
  Seed: NMVPFWPPV (TYRP1_HUMAN)
NLVPFWPPM

SEQ ID NO: 179814 - protein, 9 aa, Artificial Sequence
  Description of Artificial Sequence: Synthetic peptide
  Seed: YNYFVWTHY (TYRP1_HUMAN)
YMYFVWTHM

SEQ ID NO: 179815 - protein, 10 aa, Artificial Sequence
  Description of Artificial Sequence: Synthetic peptide
  Seed: SMDEANQPLL (TYRP1_HUMAN)
SVDEANQPLM

SEQ ID NO: 179816 - protein, 9 aa, Artificial Sequence
  Description of Artificial Sequence: Synthetic peptide
  Seed: MSAPKLLSL (TYRP1_HUMAN)
MHAPKLLSF

SEQ ID NO: 179817 - protein, 10 aa, Artificial Sequence
  Description of Artificial Sequence: Synthetic peptide
  Seed: RQCATVEALR (TYRP1_HUMAN)
RLCATVEALR

SEQ ID NO: 179818 - protein, 9 aa, Artificial Sequence
  Description of Artificial Sequence: Synthetic peptide
  Seed: ALIFGTASY (TYRP1_HUMAN)
AEIFGTASM

SEQ ID NO: 179819 - protein, 10 aa, Artificial Sequence
  Description of Artificial Sequence: Synthetic peptide
  Seed: YNADISTFPL (TYRP1_HUMAN)
YLADISTFPY

SEQ ID NO: 179820 - protein, 9 aa, Artificial Sequence
  Description of Artificial Sequence: Synthetic peptide
  Seed: HYYSVKKTF (TYRP1_HUMAN)
HAYSVKKTY

SEQ ID NO: 179821 - protein, 10 aa, Artificial Sequence
  Description of Artificial Sequence: Synthetic peptide
  Seed: RSMDEANQPL (TYRP1_HUMAN)
RIMDEANQPL

SEQ ID NO: 179822 - protein, 10 aa, Artificial Sequence
  Description of Artificial Sequence: Synthetic peptide
  Seed: VALIFGTASY (TYRP1_HUMAN)
VRLIFGTASF

SEQ ID NO: 179823 - protein, 10 aa, Artificial Sequence
  Description of Artificial Sequence: Synthetic peptide
  Seed: LLLVALIFGT (TYRP1_HUMAN)
LKLVALIFGI

SEQ ID NO: 179824 - protein, 11 aa, Artificial Sequence
  Description of Artificial Sequence: Synthetic peptide
  Seed: KTFLGVGQESF (TYRP1_HUMAN)
KAFLGVGQESW

SEQ ID NO: 179825 - protein, 9 aa, Artificial Sequence
  Description of Artificial Sequence: Synthetic peptide
  Seed: RSLHNLAHL (TYRP1_HUMAN)
RMLHNLAHV

SEQ ID NO: 179826 - protein, 10 aa, Artificial Sequence
  Description of Artificial Sequence: Synthetic peptide
  Seed: FVLLHTFTDA (TYRP1_HUMAN)
FKLLHTFTDI

SEQ ID NO: 179827 - protein, 10 aa, Artificial Sequence
  Description of Artificial Sequence: Synthetic peptide
  Seed: SREFSVPEII (TYRP1_HUMAN)
SSEFSVPEIL

SEQ ID NO: 179828 - protein, 10 aa, Artificial Sequence
  Description of Artificial Sequence: Synthetic peptide
  Seed: THPLFVIATR (TYRP1_HUMAN)
TTPLFVIATR

SEQ ID NO: 179829 - protein, 9 aa, Artificial Sequence
  Description of Artificial Sequence: Synthetic peptide
  Seed: MAKRTTHPL (TYRP1_HUMAN)
MTKRTTHPI

SEQ ID NO: 179830 - protein, 9 aa, Artificial Sequence
  Description of Artificial Sequence: Synthetic peptide
  Seed: SMDEANQPL (TYRP1_HUMAN)
SLDEANQPM

SEQ ID NO: 179831 - protein, 9 aa, Artificial Sequence
  Description of Artificial Sequence: Synthetic peptide
  Seed: LFDTPPFYS (TYRP1_HUMAN)
LYDTPPFYI

SEQ ID NO: 179832 - protein, 9 aa, Artificial Sequence
  Description of Artificial Sequence: Synthetic peptide
  Seed: LGYTYEIQW (TYRP1_HUMAN)
LTYTYEIQI

SEQ ID NO: 179833 - protein, 9 aa, Artificial Sequence
  Description of Artificial Sequence: Synthetic peptide
  Seed: NISIYNYFV (TYRP1_HUMAN)
NTSIYNYFA

SEQ ID NO: 179834 - protein, 9 aa, Artificial Sequence
  Description of Artificial Sequence: Synthetic peptide
  Seed: GEVDFSHEG (TYRP1_HUMAN)
GEVDFSHEF

SEQ ID NO: 179835 - protein, 10 aa, Artificial Sequence
  Description of Artificial Sequence: Synthetic peptide
  Seed: SPNSVFSQWR (TYRP1_HUMAN)
SVNSVFSQWK

SEQ ID NO: 179836 - protein, 9 aa, Artificial Sequence
  Description of Artificial Sequence: Synthetic peptide
  Seed: TFPLENAPI (TYRP1_HUMAN)
TWPLENAPF

SEQ ID NO: 179837 - protein, 11 aa, Artificial Sequence
  Description of Artificial Sequence: Synthetic peptide
  Seed: FLNGTGGQTHL (TYRP1_HUMAN)
FSNGTGGQTHY

SEQ ID NO: 179838 - protein, 9 aa, Artificial Sequence
  Description of Artificial Sequence: Synthetic peptide
  Seed: YSNSTNSFR (TYRP1_HUMAN)
YSNSTNSFL

SEQ ID NO: 179839 - protein, 9 aa, Artificial Sequence
  Description of Artificial Sequence: Synthetic peptide
  Seed: RSLHNLAHL (TYRP1_HUMAN)
RTLHNLAHK

SEQ ID NO: 179840 - protein, 9 aa, Artificial Sequence
  Description of Artificial Sequence: Synthetic peptide
  Seed: VARPMVQRL (TYRP1_HUMAN)
VYRPMVQRL

SEQ ID NO: 179841 - protein, 9 aa, Artificial Sequence
  Description of Artificial Sequence: Synthetic peptide
  Seed: FENISIYNY (TYRP1_HUMAN)
FENISIYNW

SEQ ID NO: 179842 - protein, 9 aa, Artificial Sequence
  Description of Artificial Sequence: Synthetic peptide
  Seed: SVKKTFLGV (TYRP1_HUMAN)
SVKKTFLGA

SEQ ID NO: 179843 - protein, 10 aa, Artificial Sequence
  Description of Artificial Sequence: Synthetic peptide
  Seed: NISIYNYFVW (TYRP1_HUMAN)
NQSIYNYFVW

SEQ ID NO: 179844 - protein, 9 aa, Artificial Sequence
  Description of Artificial Sequence: Synthetic peptide
  Seed: RYHLLRLEK (TYRP1_HUMAN)
RVHLLRLEG

SEQ ID NO: 179845 - protein, 11 aa, Artificial Sequence
  Description of Artificial Sequence: Synthetic peptide
  Seed: MFVTAPDNLGY (TYRP1_HUMAN)
MQVTAPDNLGF

SEQ ID NO: 179846 - protein, 9 aa, Artificial Sequence
  Description of Artificial Sequence: Synthetic peptide
  Seed: RSLHNLAHL (TYRP1_HUMAN)
RELHNLAHF

SEQ ID NO: 179847 - protein, 11 aa, Artificial Sequence
  Description of Artificial Sequence: Synthetic peptide
  Seed: NYFVWTHYYSV (TYRP1_HUMAN)
NYFVWTHYYSF

SEQ ID NO: 179848 - protein, 9 aa, Artificial Sequence
  Description of Artificial Sequence: Synthetic peptide
  Seed: STLISPNSV (TYRP1_HUMAN)
STLISPNSY
